United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 96

SEQ ID NO: 187718 - DNA, 1290 bp, Artificial Sequence
  Description of Artificial Sequence: Synthetic coding sequence
atgctgccccggctgctgctgctgatctgcgcccccctgtgcgagcccgccgagctgttcctaatcgcaagccccagccacccgaccgaaggctctcctgtaaccctcacttgtaaaatgccttttttacaaagtagcgatgcccagttccagttttgtttctttagagacactagggccctgggtcctggctggtccagcagccctaagttacagatcgccgccatgtggaaagaagacactggaagctactggtgtgaggcccagaccatggcaagcaaggtgttgcgcagtaggagaagccaaatcaatgtacaccgtgtgccagtggccgatgtctcactggagacacagcctcccgggggccaggttatggaaggtgaccgcctggtgcttatctgctccgtggccatgggcactggggatatcaccttcctgtggtataaaggggccgtcgggctgaatctgcaatctaagacacagagatccctgacagccgagtatgaaattccctctgtgagagaaagcgatgctgaacagtactactgcgtggctgagaatgggtacggtccgagccccagtggcctggtgagtatcactgtgcggataccagttagccggccgattcttatgttgagagcccctagggcccaggcagctgtggaagatgtccttgaacttcactgcgaggccttgcgcggcagccccccaatactttactggttctaccatgaggacattactctgggctcaagatcggctcccagcggaggtggcgccagttttaacctgagtctgacagaagagcattctggcaattattcctgcgaagctaataatggacttggcgcccaacgctcagaggccgtgactttgaacttcacggtgccaaccggagctcggtccaaccacctcactagtggcgtgatagagggcctactctccacccttggccccgcaacagtcgcactcctattttgctacggtctcaaaagaaagatcggaaggcggtccgcgcgggaccctctgaggtctcttcccagtcccctgccgcaggagttcacttacctgaactcaccgaccccagggcagttgcaacctatctacgagaatgtgaatgtggtgagtggcgatgaagtgtattccctcgcatattacaatcagccggagcaagagtccgttgccgctgagacacttggtacccacatggaagacaaagtgtccctggacatctatagtcgccttcggaaggctaacatcactgacgtggactatgaggatgctatgtag

SEQ ID NO: 187719 - DNA, 1287 bp, Artificial Sequence
  Description of Artificial Sequence: Synthetic coding sequence
atgctgccccggctgctgctgctgatctgcgcccccctgtgcgagcccgctgagctcttcctcattgcctctccttcccacccaaccgaaggcagccctgtgacactgacgtgcaaaatgccgttcttgcagtcatccgacgcccaatttcaattctgcttcttcagagacactagagcactcgggcctggttggtcttcatcccctaaactgcagattgctgcaatgtggaaggaagacactggaagttactggtgcgaagctcagaccatggcatccaaagtgctacgttccaggcgctcccagattaacgtgcatcgcgtgcccgtcgccgacgtctccttagagactcagcccccagggggacaagttatggaaggcgacaggcttgtcctgatctgctcggttgccatgggaactggcgacataacatttctgtggtacaaaggcgcagtgggcctaaaccttcagtcaaaaactcagaggtccttgactgccgagtatgagatcccatctgtccgagaaagtgatgccgaacaatactactgtgttgctgagaacggctacggaccctccccaagtggtttggtgtctatcacggttcggatcccggtaagtaggccaattcttatgttacgtgcacccagagcccaggcagccgtcgaagacgtgttggagctccactgtgaagctctgaggggaagtccgcccattctgtactggttctaccatgaggacatcaccttaggctctaggagcgcacccagtggtggcggggctagcttcaacctgtcgttgacagaagaacatagcggtaattattcctgtgaagctaataacggcttgggggctcagcggagtgaggcggtgactctcaacttcactgtcccaactggagccaggagtaaccacctgacctctggcgtcattgagggcctgctcagtaccctcggacctgcgacagttgctcttctcttttgctacggcctaaagcgcaagatagggagaaggagcgcgagagaccctttacgatcattgccaagtcccctcccgcaggaattcacctacctgaactctcccacaccaggccaactgcaacccatctatgagaacgtgaatgtcgtctccggtgacgaagtgtattctctggcctactacaaccagcccgagcaagaatcagtggccgaaaccttaggcactcatatggaagacaaagtatctctggatatctattcccgactgcgaaaagccaacatcacagatgttgattacgaagacgccatgtag

SEQ ID NO: 187720 - DNA, 2670 bp, Artificial Sequence
  Description of Artificial Sequence: Synthetic coding sequence
atgagctacttcggcgagcacttctggggcgagaagaaccacggctttgaagtgctctatcacagtgtcaaacaagggcccatctctacgaaggaactggcagattttattcgtgagagagccacaattgaggagacttacagcaaggcaatggctaaactctctaagctagcgagcaacgggacaccaatgggaaccttcgctccgctctgggaggtgttccgagtatcctcagataaactggcactgtgtcacctcgagttgaccagaaagcttcaggacctgataaaagacgttctgaggtatggagaggaacagcttaaaacccataagaagtgtaaagaggaagtggtgtccacactggatgccgtgcaggtgctgagcggggtgagccagctgctgcccaagtccagagagaactacttgaaccgctgtatggaccaggaaaggttacggcgtgagtccacgagccagaaggagatggacaaagccgagaccaagacaaagaaagctgcagagtctttgcggcgcagtgtcgagaaatacaactccgcgcgggcggactttgagcaaaaaatgctggacagcgcattgaggtttcaggcaatggaggagacacatttgagacacatgaaagccctcctgggcagctacgctcactcagtcgaagacactcatgtacagatcggccaggtccatgaagaattcaaacagaacattgaaaatgtctccgtcgaaatgttactgcggaagtttgcggagtccaaggggacgggcagagaaaaacccggcccccttgattttgaggcttattcagcggccgcactccaagaagccatgaaacgcctgcggggcgcaaaggcatttaggctgccaggtctcagtagacgtgagagggagcccgaacccccagctgccgtggactttctcgaacccgactctggaacttgccctgaagtggatgaagagggcttcacagttcgtcccgacgtaacccagaactctacagctgagccttccaggttctcctcaagtgacagtgacttcgacgacgaagaaccgagaaagttttacgtccatattaagcctgctcccgcaagagccccagcttgttcccctgaggccgccgccgctcagttaagggctaccgccggcagcctgatcttgccccccggtccaggtgggaccatgaagcggcactcaagcagagacgccgccggcaagccccaacgaccccgaagcgctccacgaacatcatcctgcgcagaacggctgcaaagcgaggaacaggttagcaagaacctttttggccctccactggagtctgcgttcgaccacgaagactttaccgggagtagtagtctgggattcacatcttcgccctcacccttttcaagttccagcccagagaatgtcgaggatagcggtctggacagtccgtcgcacgctgcaccaggcccaagccccgatagctgggtccctcggcctggaaccccccagtcaccgccgtcctgtagggctcccccccctgaagctagggggatacgtgctccacccttaccggactctccacagcccctggctagcagtcccgggccctggggcctggaagccctggcaggcggggatctgatgccagccccagccgaccccaccgcccgcgaaggtttagccgcccccccccggcggttacgttcgaggaaggtttcttgcccacttaccagatctaatggcgatttgtcacggtctttaagtccgtcaccccttggttcaagtgcggctagcactgcactggagaggccatcattcctgagccaaactgggcacggtgtcagtagaggaccatcccctgtagtattaggaagccaagacgctctgccgatcgctaccgcatttaccgagtacgttcacgcatactttcgcggccactccccttcctgcctcgcccgcgtcactggcgaactgacgatgacgtttccagcaggaatagttcgggtattcagcggcacacccccccctcccgtcctcagctttaggcttgtccatacaacagctatcgagcatttccagccgaacgctgatttgttattcagtgatccatctcagtcagacccagagacaaaagatttttggcttaatatggccgccctgactgaggccttgcagcggcaggccgagcagaaccccacagcgtcatattacaatgtagtgttactgcggtaccagtttagtcgcccaggcccccagtcagttcctttgcaactcagcgcacactggcagtgcggagctacacttacacaggtctccgtggaatacgggtaccgtcccggcgctacagcagtgccaacgcctctaaccaatgtacagatcctgttgcctgtcggggaacccgtcacaaacgtacgtctgcagccagccgccacttggaatctggaagagaaacggctgacttggaggctgcctgacgtctccgaggcaggcgggtctgggagattgtccgcatcttgggagccgctaagtggaccatccaccccaagtcctgttgccgcacagtttacatcggaaggcacaactctcagtggcgtcgatctggagttagttggatcaggctacaggatgtccttagtgaagagaagattcgctacaggcatgtatttggtcagctgctag

SEQ ID NO: 187721 - DNA, 2670 bp, Artificial Sequence
  Description of Artificial Sequence: Synthetic coding sequence
atgagctacttcggcgagcacttctggggcgagaagaaccacggcttcgaggttctgtaccatagtgtgaaacaagggcccatcagtactaaagaacttgccgactttataagggagagagccacaatcgaggagacatattcaaaagctatggccaagctctccaaactggccagcaacggaaccccaatgggtacatttgcgccgttgtgggaggtcttcagagttagcagcgacaagcttgccctgtgtcacttagagctcacccggaagctgcaggacctgattaaggacgtcctgaggtatggtgaggagcagttaaaaacacacaagaaatgcaaagaggaggtggtctccaccctggatgccgttcaggttcttagcggggtgagccagctgttacccaaatcacgcgagaactatctgaaccgatgtatggatcaggagaggctccgccgcgaaagcacttctcagaaggagatggataaagccgagacgaagactaaaaaggcggcagagtctctgcgacggagcgtcgaaaagtacaacagtgccagggctgacttcgagcagaaaatgctcgattctgccctgaggttccaagcgatggaagagacccacttgcggcacatgaaggctttgctgggtagctacgctcattcggtggaagatacacacgttcagatcggccaagtccacgaagaatttaagcaaaatatcgaaaacgtatccgtggaaatgttattaagaaagttcgcggagagcaaggggaccggtagagaaaaaccgggcccgctggattttgaagcctattctgcggctgccctgcaggaagccatgaaaagacttcgtggagcaaaggcatttcgactaccaggcctgagtcgtagagagagggaaccggagccccctgccgccgtggatttcctagaaccagattctgggacttgccctgaggtcgacgaggaagggttcacagtgagacccgatgtgacccagaattcgacagcggaaccctcaaggttctctagcagtgattctgacttcgatgacgaagaacccagaaagttttatgtccacattaagcccgctccagccagggctcccgcctgcagtcccgaagccgcggcagctcaacttagagccaccgcgggatccctgatcctgccaccagggcctgggggcactatgaaacggcactctagcagagacgccgccggaaagccccagagacctagatcagctcctagaacctcaagctgcgccgaacgcctgcaatccgaagagcaagttagcaagaatctgtttggacctcctctggagagtgcatttgaccacgaagatttcaccgggtcaagttctctgggttttacaagctcgcctagtccattctcctcttcctcccccgaaaatgtcgaggacagcggccttgacagccccagtcacgcggcaccagggccatcacctgactcgtgggtgccccggccaggtacgcctcagtctccccctagctgtcgcgcccctcctccagaagcacgaggcatcagagcgcctcctttgccagactccccgcagcctctcgccagttctccgggcccctggggtttggaggccctggccggcggagatctgatgccagcacccgcagaccctaccgcccgcgaaggactggctgccccccctagacgattgaggtcaagaaaagtctcttgtccgttgaccaggagcaacggtgatctatcacgttctttgagtcccagtccgctgggctccagcgctgcctccaccgccctcgaaaggccaagctttctgagccaaacagggcacggtgtaagcaggggcccctcccctgttgtcttgggatcccaggatgctctgcccattgccaccgctttcacagagtacgtgcatgcatactttaggggccacagcccctcatgtctggcgagggtcacgggggaactaaccatgacattccctgccggcatcgtgagggtgtttagtggaacaccccccccgcctgtgctgagcttcagactcgtccataccacagctatcgaacacttccaaccgaatgcagatctcctgtttagtgacccatcgcaaagcgaccctgagaccaaggatttttggctgaacatggccgccctgaccgaggctctccagcgacaggcagaacaaaatcccactgccagttactataatgtcgtcctgctccgctaccaattttctcggcccggcccccagagcgtccctttgcaactgtccgctcattggcagtgcggtgcgactctcacccaggtttcagtggagtacggctatcgacccggcgctactgcggtacctacacctctcaccaacgtgcagattctcctgccagtaggggagcctgtcacaaacgtccgtctgcagcccgcagctacgtggaatctcgaggagaaacggttgacttggaggcttcctgacgtgtcggaggccgggggctctggccgcctgagcgcatcttgggagcctctgagcggcccatcaactccatcgcccgtggccgctcagttcacttcagaggggacaacactgagtggcgtagatttagagctggtcggaagcgggtaccggatgtccctggtcaagcggcgattcgctacggggatgtaccttgtgtcttgttag

SEQ ID NO: 187722 - DNA, 2670 bp, Artificial Sequence
  Description of Artificial Sequence: Synthetic coding sequence
atgagctacttcggcgagcacttctggggcgagaagaaccacggcttcgaggtgctttaccacagcgtgaagcagggaccaatctctacaaaagagctcgctgactttatccgcgaaagggccacaatagaggaaacatacagcaaagctatggccaagctctccaagctcgcaagcaatggcacgccaatgggcacgtttgccccactatgggaagtgtttcgtgtgtcatccgacaagctagcgttatgtcacctcgagctcacaagaaagctccaggacttgatcaaagacgtccttaggtacggagaagagcagttaaaaacacacaagaagtgcaaagaggaagtggtgagcaccctagatgcagtgcaagtgctgtcaggggtcagccagcttctgcctaaatccagagagaattatctgaatcgctgtatggatcaagaaaggctgcggagggagagcacatcacagaaggagatggataaggccgagaccaaaactaaaaaggcggcagagtccttacgccgttctgtggaaaaatacaatagcgcacgggccgactttgagcagaaaatgcttgattccgccctgaggttccaggctatggaggaaacgcatttacgccacatgaaggccctgctcggatcatatgcacattcggtggaggatacacacgtccagataggccaggttcacgaggaattcaagcaaaacattgaaaatgtatcagtcgagatgttgttacgtaaatttgccgaatctaagggtaccggtagggaaaaacccggtccgctagatttcgaagcctacagtgcagccgctctccaggaagctatgaagcggttgcggggagccaaagcctttcgattgcccggactgtctcgacgcgaacgagagccagaacctcctgcagctgtcgacttcctggagccggacagcggcacctgccccgaagtcgacgaagagggctttacggtgcggccggacgtgacccaaaattccaccgctgagccaagccgtttctctagtagcgattctgacttcgacgacgaggagccaaggaaattctacgtccacattaaaccagcccctgcacgggcgcccgcctgcagtcccgaagccgccgccgcacagctcagagcgactgccggttctctgatcctgcctccgggccccggggggaccatgaagcgacactctagccgtgatgccgcaggcaaaccccagagaccgcgttctgccccacgcacgagctcatgcgctgagcgcctccagtccgaggagcaggtatctaagaatctgtttggtcccccacttgaatcagcattcgaccacgaagattttactgggtcctcctcacttgggttcacgagtagtccaagccccttctccagcagctccccagagaatgtggaggattccggtctcgatagtcccagccatgcagcgcctggcccgtccccagatagctgggtcccccgacctggcaccccccagtctcctccctcgtgtcgggctccaccaccagaggctcgcggcattcgtgcgcccccactgccggactcacctcagcccctggcgtcctctccaggaccctggggactggaagccctggccggaggggacctgatgccggcgcctgctgaccccaccgctagggaggggctggctgcccccccacggcggttgcggagtcggaaagtgtcttgccctctgaccagaagcaacggtgacctttcgcgctcactgagcccctccccactggggagttctgcagctagcacagctctggagcgaccttccttcttatcccagaccggccacggcgtcagccgcggaccctctccggttgtcctcggttcccaggatgcactgccaattgctactgccttcacagaatatgtccacgcttactttcgaggccacagcccatcttgcctagccagagtgaccggggaactcactatgacgttccccgcaggaatcgtgcgagtgtttagcggcacgccccctccccctgtgctcagctttcgcctagtgcatacgactgcaatcgaacactttcagcctaacgccgacctgctgttcagtgatcctagccagtccgacccagaaacaaaagatttctggctgaacatggctgccctgaccgaagcgctgcagcgccaggccgagcagaatcctacagcttcgtactacaacgtggttctcttgcgatatcagttcagccgtcctggacctcagtctgttccgctgcaattatctgcgcattggcagtgcggcgccacattgacccaggtgtccgtggaatatggctaccgccccggtgctaccgctgtgcccacccctctgacaaatgtccagatactgttgccagttggggaaccagtaaccaacgtgagattgcagccagccgccacttggaacctcgaggaaaaaaggctgacatggcggctgcccgatgtgtccgaggcaggtggtagcggcagactcagtgctagttgggaacctctatctggaccatctaccccctcaccggtcgcagcacagttcaccagcgaggggacaactctcagcggcgttgatctcgaactcgtgggctcgggctacaggatgtcactggtaaagcgccgattcgcaaccggaatgtacctcgtcagttgctag

SEQ ID NO: 187723 - DNA, 2676 bp, Artificial Sequence
  Description of Artificial Sequence: Synthetic coding sequence
atgagctacttcggcgagcacttctggggcgagaagaaccacggctttgaagtcctttatcacagcgtgaagcagggtcctatatcaacaaaagagctagctgattttatcagggaaagagccaccatcgaagagacttattccaaagctatggccaaactgagcaagttagccagcaacgggacccctatggggacattcgcacctctctgggaagtctttcgtgtctcatccgacaagttggccctgtgtcaccttgagctgactcgcaaactgcaggacctgatcaaggacgtcctgaggtacggggaggagcagctcaaaacacacaaaaagtgcaaggaagaagtcgtctcaactttagatgccgtgcaagtgctttcgggagtgtctcagctgttaccaaagagtcgggagaattatctcaacaggtgcatggatcaggagagactgcggcgcgagtccacaagccagaaagaaatggataaggccgaaactaaaaccaagaaggctgcagaatcactgcgtcggtcagtagaaaagtacaactccgctagggcagatttcgagcagaaaatgctggacagcgccctgagatttcaggcaatggaagagacccaccttaggcacatgaaggccctacttgggtcctatgctcattcggtcgaagatacacacgttcagattggccaagtgcacgaggaattcaaacagaacatagaaaacgtgagcgtcgagatgctactccgcaagtttgcagaatccaaaggcactgggcgcgagaaaccaggaccattagattttgaggcttactcagccgccgcccttcaggaggccatgaagcggctcaggggtgccaaggcgtttaggcttccaggactatcacggcgggaacgggagcccgaacctccagcagccgtggattttctggaacccgatagtggcacctgtcccgaggtggatgaggaagggtttactgttcgcccagatgtcacccagaactctacagcagaaccctcccgattcagcagctctgattccgacttcgacgatgaggagccaagaaaattttatgttcatataaaacccgcacctgcacgcgccccagcttgctcccctgaagccgccgccgcgcagctaagagccacggctggaagcctaatcctgcctccaggccctgggggaacaatgaaaagacactcatcgagggacgccgccgggaaacctcaacggcctcgatcagctccccgcacatcaagttgcgcggagagactccagtctgaggagcaagttagtaaaaacctgttcggtccccccctcgagagcgctttcgatcatgaagacttcactggtagtagttctctcggcttcacaagcagtccctctccttttagctcatccagccctgagaatgttgaggatagcggcttggacagccccagccacgccgctccagggccttcccccgattcgtgggtcccacgtcctggcaccccgcaaagtcctccctcttgtagagctcctccccctgaagccaggggtatccgcgcgccacctctgccagactctccccagcctctagctagcagccctggcccttggggactagaggccctagctggtggagaccttatgcccgcccccgccgaccccacagcacgcgagggcctcgctgccccgccccggaggcttagatctaggaaagtgtcatgtcccctgactagaagtaatggggacttaagccgatccctgagtccctcacctctggggtcctccgccgcgtctactgcccttgaacggccgtcattcctgagccagaccggacatggagtcagccgcggcccttcgcctgtcgttcttggaagccaggatgccctgcccattgccacagcatttaccgagtacgtacacgcctacttcaggggacacagtccctcatgcctcgctcgcgtgacaggggaactgacaatgaccttcccagccggcatcgttagggtattcagcggcacaccaccccctcccgtcctctcatttcgtctcgtgcacacaaccgcaattgagcacttccagccaaatgccgacctgcttttctccgatccatcccaatccgacccggagacaaaagatttctggctcaacatggccgcccttaccgaggctttacagaggcaggccgaacagaatccaactgcatcctactataatgtagtcctgcttcgctaccagttctcacggccgggccctcagtccgtgccgttgcagctttctgctcattggcagtgcggggcaacactcactcaggtgtctgttgagtatggatacaggcccggggccaccgccgtacctactccactgaccaacgtgcagatcctgttacccgttggggaacctgtgacgaatgtcagacttcagccagcggccacgtggaatttagaggagaagcgcctgacgtggcggctgcccgacgtcagcgaagcaggtggtagtggaaggttatcggccagctgggagcctctgagtggcccatcaacaccgagccctgtggccgcccagtttacaagcgaaggcacaactctaagtggtgtggatttggagttggttgggagcgggtacagaatgtccctggttaaaaggcgattcgccacagctgctccgccacagggatgtacatggtag

SEQ ID NO: 187724 - DNA, 2520 bp, Artificial Sequence
  Description of Artificial Sequence: Synthetic coding sequence
atggccaagctgagcaagctggccagcaacggcacccccatgggcacattcgccccactgtgggaggttttccgcgtgtctagtgacaaacttgcactttgccatttagagctgactagaaaacttcaagatctgatcaaagacgtactgcgatacggagaggagcagctcaagacccacaaaaagtgtaaggaggaggtggtatctacactcgatgccgtgcaggttctcagtggagtgagccaactgttgcccaagagcagggaaaactatctgaacaggtgtatggatcaggagcgacttaggagagaaagtacatcccaaaaagagatggataaagcagagactaagacaaaaaaggctgctgagtcactgcgtcggtccgtcgaaaagtacaatagtgcaagagccgactttgaacaaaagatgcttgattccgctttgcggttccaggcgatggaagaaacccaccttaggcacatgaaagccctgctgggctcttatgcacatagcgtggaggacactcacgtgcaaattggccaggttcacgaggaattcaaacagaacattgaaaatgtgagcgtagagatgttgctgagaaagtttgccgagagcaaagggacaggacgcgagaagccgggacctctggacttcgaggcatattcagcggctgccttgcaggaggccatgaagcggctgcgtggtgctaaggcctttaggctgcctggcttgtctcggcgggaacgcgagccagagcctcctgccgcagtggatttcctcgagcctgacagcggcacctgccccgaagtagatgaggagggattcacagtcaggccggacgtaactcagaacagcactgccgagccctcacgcttcagctcaagcgacagtgattttgacgatgaggagccgcggaagttctatgtgcatataaagccggcaccggctcgtgctcccgcctgttctcctgaagcggccgcggcccagctgagagcaaccgcaggctccctgatcctgccccctggccctggcggtactatgaagcgccactcctcccgcgatgccgcaggcaaaccgcagagacctcgctccgcccctcgcacgagcagctgcgctgaaaggttacagtcagaggagcaggttagtaaaaacctatttggcccacctctggagagcgcttttgaccatgaggattttactggttcttccagcctcggctttaccagttctccttctcccttttcttcctcaagtcccgagaatgtggaagactcaggccttgatagtccttcacacgctgctcctggaccgagccctgatagctgggtgcctaggcccggtacgccacagtcacctccttcctgtcgcgccccaccacctgaagctcgtgggatccgcgcccctcccctgcccgactctcctcagccactggcgtcttcccccggcccttggggcctggaagcactggcaggaggtgacttaatgcccgccccggcagacccgactgctcgcgagggcctggccgcccctcctagacgcctgcgcagccgcaaagtgtcgtgtccattaacgagaagcaatggcgacctcagccgcagcctcagtccaagccccttgggcagctcagcggcatccactgccttagagcgaccctcatttctgagccagaccgggcacggggtcagccgcggccccagtcctgtagtccttgggtctcaggacgcactccccattgccactgcattcactgaatatgtacatgcctatttccgcggacatagtccttcctgcttagccagggttacaggagagcttacaatgaccttcccagctggaatagtaagggtcttctctgggactcctccaccccctgtcctgagttttcgactggttcatactacggctatcgagcattttcagcccaacgccgatttgctgttcagtgacccgtctcagtccgaccccgagactaaagatttctggcttaacatggccgctttaaccgaagccctacagaggcaggccgaacagaatccaaccgcttcttattataatgtggtactacttagatatcagttttctaggccgggcccacagtctgtgcccctacaactgtcagcacattggcaatgtggagcaactctgacgcaggtcagtgtggaatatggatatagaccaggagctaccgcagtaccaacaccgctgacgaatgtgcaaatcctcctgccggtgggcgagcctgtcacaaacgtccgcctacaacccgctgccacctggaacctcgaagaaaagcgactgacatggagactgcctgacgtttctgaggctggtggcagcggacgtctgtctgcttcatgggagcctctgagtggaccgagcacaccatcacccgttgctgcacagtttacaagtgagggcacgaccctctcaggcgtagatttagaactcgtcggctcaggatacaggatgagtttggtcaagcgaaggttcgccacagggatgtacctggtgtcctgctag

SEQ ID NO: 187725 - DNA, 2670 bp, Artificial Sequence
  Description of Artificial Sequence: Synthetic coding sequence
atgagctacttcggcgagcacttctggggcgagaagaaccacggctttgaagtgctttaccattctgtcaaacaaggtcctatcagcacaaaggagcttgcagactttattagggagcgggccactatcgaggaaacctactccaaagccatggccaagctttctaagcttgcttctaatgggacacctatgggcacctttgctcccctatgggaagtgttccgggtgtccagtgacaagcttgccctgtgccatctcgagctcactagaaaactccaggatctgattaaggatgtgctcagatatggggaagaacagctcaagacacacaagaagtgcaaagaggaggtcgtttccaccctggatgctgtgcaagtcctgagtggggtctctcagttgttgcccaagagtagagaaaattacctgaacaggtgtatggatcaggagagactgagacgtgaatcaactagtcagaaggagatggacaaggccgagactaagactaagaaggctgctgaaagcctgaggagaagcgtggagaagtataattccgcgagagccgacttcgagcagaaaatgttggactccgccctgcggttccaggcaatggaagagactcacttacggcacatgaaggcactcctgggcagttacgcacactcagtggaagatacccacgtgcagattggtcaggtgcacgaagaatttaagcagaacatagagaacgtctctgtggaaatgctcctgaggaaatttgccgaaagtaagggaactggaagggagaaacccgggcccttggactttgaagcctattctgcagctgcattgcaggaagcgatgaaaagactgcggggagcgaaagcattccgattacccggactctctaggagagagagagaaccagagccaccagctgctgtggatttcttagagccagacagcggcacttgccccgaggtggacgaggaaggctttacagttcggccagatgtgacccagaattctactgcagagcccagcaggtttagtagcagtgactctgactttgatgatgaagaaccgcgcaagttttatgtgcatattaagcctgctcccgctcgcgctccagcttgcagccccgaagccgccgccgcccagctcagagctacagccggcagtcttatactcccacctggcccaggtgggaccatgaagcgccattcttctagggacgccgcagggaagccgcagcggccccgcagcgctcctcgtacaagttcttgcgccgaaagactacagtcggaggaacaggtgtctaaaaacctgttcggcccacctctcgaatctgccttcgatcatgaggactttacgggttctagtagtctgggatttacgagcagcccatcacccttttctagctccagtcctgaaaacgttgaagatagtggactggatagcccttcccacgcggcgcccggtccatcgccggactcttgggttcctaggccgggaactccgcagtctcccccctcttgtagagcgcccccccctgaagctagagggatccgggccccccctttgcccgactcgcctcaacctctagcttcctcaccaggaccttgggggctggaggcacttgctggcggggacctgatgcctgcccctgccgacccaacagctcgagagggcctggccgctcctcccaggcgtctccgaagtcggaaggtgtcctgcccattgacacgatctaacggggacctcagcaggagccttagcccttccccacttggtagcagtgccgctagcaccgcgctcgagcggccttcattcttgagccaaactgggcacggcgtatcccggggaccctcccctgtggtcttggggtctcaggatgccttgcccatcgccaccgccttcacagaatatgtccacgcatacttccgtgggcacagcccctcttgtctggctagagtaactggtgaacttaccatgacattcccggccggcatagtccgcgtgttctctggcacccctcccccacccgttctgtcctttaggctcgttcatactaccgccatcgagcactttcaaccaaacgctgacctcttgttttccgatcctagccagagcgacccagagactaaggacttttggttgaatatggctgcgctgaccgaggctctccaacgtcaggccgaacaaaatccaacagcctcctattataatgtggtgcttctgcgatatcagttttctagacccgggccgcagtcggtgcccctccagctgtcagcacattggcagtgcggcgcaacattgacgcaggtgagtgtagaatatggatatagacccggagctactgctgtccctaccccgttaacaaatgtccagattttgctgcccgtgggagagccagtcaccaacgtgaggctgcagcccgccgcaacttggaacctggaagagaagagacttacatggcgtctgcctgacgtttctgaggccggagggagtgggcggctgtctgcatcctgggagccactttccggaccaagtacaccatcacccgtagctgcacagtttacatccgaagggaccactctcagcggggtcgacctggaactggtcgggtctggctatcgcatgtccctcgtcaagagaaggttcgcaacaggcatgtacctcgtctcctgttag

SEQ ID NO: 187726 - DNA, 2670 bp, Artificial Sequence
  Description of Artificial Sequence: Synthetic coding sequence
atgagctacttcggcgagcacttctggggcgagaagaaccacggcttcgaggtcttataccattccgtgaaacagggaccaatttctacaaaggagctggccgactttattagggaacgcgccacgatagaggaaacatacagcaaagccatggccaaactctccaagctggcctccaacggtacccctatgggcacatttgctccactgtgggaggtgtttcgcgtcagttctgataaactggccctgtgtcacttagagctcactaggaagctacaggacttgattaaggacgtactcaggtatggggaagagcagctaaaaacacacaagaagtgtaaggaagaagtggtttccaccctcgacgcagtacaggtgctctccggggtttcacagctgctgcccaaatcacgagaaaactacctcaaccgctgcatggatcaagaaaggttgcgacgtgagagtaccagtcaaaaagagatggataaggcagaaacgaagacaaaaaaagcggcagagtccctacggcgctcagttgagaagtacaattcagctcgcgctgactttgaacagaaaatgctggattccgctttgaggtttcaagcgatggaggagactcacttacgccatatgaaagcactgctggggtcatatgcccactccgttgaggatacccatgtgcagatcggtcaggtgcacgaggagttcaaacagaacattgaaaatgtgagtgttgaaatgctactgcgaaaattcgcagagtccaagggcacagggagggagaaaccaggccctctcgatttcgaggcttattccgcggctgctctgcaggaggcaatgaagagactgcgcggcgctaaggcctttcggttgccagggcttagccgcagggagcgagaaccagagccgccagctgccgtggatttcctggaacccgacagtggcacctgtcccgaggtcgatgaggagggctttacagttcgacccgacgttacgcagaattccaccgcagagcctagtaggttctccagttctgattccgattttgacgacgaggaaccacgaaaattctacgtgcatataaagccagcccccgcccgagcaccggcctgttccccagaagctgccgcggcgcagcttcgggccactgccggcagcctgatactgccacccggccctggagggaccatgaaacgccatagctcccgggacgcggcagggaaaccccagaggccgcgatccgcccctaggacgagttcatgcgcggaacggctccaatcagaggagcaagtgagcaagaacctatttggccccccactggaaagcgcatttgaccacgaggacttcaccggatcctcatccctcggatttacctccagcccttccccctttagcagttctagccccgagaatgtggaggactccggccttgacagccctagccatgccgcccctggtccttctcctgatagctgggtgcctcgcccaggcaccccacagtctcctcccagttgcagggctccacccccagaagctaggggcatcagagcccccccgctgcccgatagtcctcaaccactcgctagtagccctggaccatggggcctggaggctttggctggtggagaccttatgcccgcaccggcagaccccacggcaagggagggactcgccgcacctccgcggaggttacgctccaggaaggtgagttgtcccctgaccagaagcaatggggaccttagtcggagcctctcaccaagccctctcggtagtagtgcagcctctactgcactggaacgcccgtcatttcttagtcagactggccacggagtatcccgcggaccctcaccagtggtgctcgggtcacaagacgccctgcccatcgctaccgccttcacagaatatgtgcatgcatatttccggggacactctccatcatgcctggctagggtgacaggcgaactcaccatgacatttccagctggcatcgtccgcgtgttctcaggaactcctcctcctccagtgcttagttttagactagtgcacacgaccgctatagaacacttccagcccaatgcggatctgttgttctctgatccctcccagtccgaccctgagaccaaggacttctggttaaacatggccgctttaactgaagctctccagcgtcaggccgagcagaacccgactgccagttactacaatgttgtgttactccggtaccagttcagcaggccaggaccccagtcggttccactccaactgtcggcccattggcagtgtggcgctacacttactcaggttagcgtcgagtatgggtatagacccggggcgactgccgtccctaccccactcaccaacgtacagatcctcctgcccgtgggcgagccggttaccaacgtacgcctacaacctgcagcaacctggaatctggaggaaaagcgtttaacctggcgactgcctgacgtgagtgaggctggcggctcaggtcgcctgtccgccagttgggaacccctttccggcccctcaactccatcaccagtggcggcccagttcacttccgagggaaccaccctctccggggtggaccttgaactcgttgggagcggataccgtatgtccttggtcaaacgcaggtttgcaaccggcatgtacttggtgagctgctag

SEQ ID NO: 187727 - DNA, 1137 bp, Artificial Sequence
  Description of Artificial Sequence: Synthetic coding sequence
atggtgatggcctacttcgtggagaacttctggggcgagaagaactccggctttgatgtgctgtatcacaacatgaagcacgggcagattagtactaaagagctggccgacttcgtgcgagaaagggcgaccatagaggaagcatatagcaggtccatgactaagctcgctaaatcggcttctaattactcacagctaggcacatttgcgccagtctgggatgtctttaagacatctaccgaaaagttagccaactgtcaccttgatctggtgcgcaaactgcaggagctaattaaagaagtccagaagtatggtgaggagcaggttaagtcacataaaaagaccaaagaggaggttgccggaaccctggaagccgttcagactatacagtccataacccaggctctgcagaaatctaaggagaattataacgccaaatgtgtggaacaagaaaggttgaagaaggaaggtgccacacagcgggagatcgaaaaggccgccgtgaagtccaaaaaggccaccgacacgtacaaattgtacgtcgagaagtatgccctggccaaggctgacttcgaacagaagatgaccgagactgctcagaagttccaggatattgaagagactcacctgattcacattaaagaaatcattgggagcttgagtaacgccattaaggaaatacacctccagattggacaggtccatgaggaattcatcaataatatggctaacaccactgttgagtcgctgatccagaagttcgccgagtcaaagggtaccggaaaagagcgccctggtctgatcgaattcgaggaatgcgatacagcctctgcagtggagggcataaaaccacgcaagcgcaaaactttcgctctcccgggtattataaaaaaggagaaggacgccgaaagcgtgtggtctttcactgtggtggcccaagtgggaatgcagtggcgcgacctgggcctgctgcatagtcctccccccaggttcaagcgttttagttcctacctgtccttaccgagtagctggaattatggggcacatcaccacatctggcttatcttttgcatattcagccgagacagagtgagcccttactggccaggttggtctcgcactcccgacctgcgatag

SEQ ID NO: 187728 - DNA, 2433 bp, Artificial Sequence
  Description of Artificial Sequence: Synthetic coding sequence
atggtgatggcctacttcgtggagaacttctggggcgagaagaacagtgggttcgatgtgctctaccataatatgaaacacggtcagattagtactaaagaattagcagactttgtgagggagagagcaacaatcgaagaagcttactcccgatctatgaccaagctggcgaaatctgcatccaactatagccagctcggcaccttcgctcctgtgtgggatgtgttcaagacaagtaccgagaaactcgccaattgccacctggacctggtcagaaaactacaggagctcatcaaggaggtccagaagtatggggaagagcaagttaagagtcacaagaagacaaaagaagaagtggccggaactctggaagcagtgcaaaccatccagagcatcacccaagcgctccagaagagcaaggagaactataatgcaaagtgtgtggaacaggaaaggctcaagaaggagggagccacccagagagaaattgaaaaggccgccgttaagtcaaagaaggccaccgatacatacaagctctatgtcgaaaaatacgctctggctaaggccgacttcgagcagaagatgaccgagacagcgcagaaattccaggatatagaagagacacacttaatccacattaaagagatcatcggtagcctgtcaaacgcaatcaaggagatccatctgcagatcgggcaagtgcacgaagagtttattaataatatggcgaacacaaccgtggagagccttatccagaagttcgccgagagcaagggtactgggaaggaacgccctggactgattgagtttgaggagtgtgacacagcctctgcagtggaggggataaaacctcggaaaagaaaaacctttgcccttcccggtatcataaaaaaagagaaagacgccgagagtgtggagtgtcccgacgctgacagcctgaacattcctgacgtcgacgaagaagggtatagcatcaaacccgagacgaaccagaacgacacaaaggaaaaccacttttactctagcagcgatagcgattcggaagacgaggagccaaaaaaatacaggatcgaaattaaacccatgcatccgaacaactcacatcacacaatggcttcactggatgagctgaaggtcagtatcgggaatattaccctgagccctgccatcagcgtcagtaccaatacccgcctcaataggaattttaacgacgaagaattgaccaaaagcaagccatccgccccgcccaacgaaaagggcacatcggacctcctagcctgggatccactgttcgggccctcgctggatagctctagctcctctagtctgaccagttcttctagcgcacgccccacaaccccactgagcgtgggaacgatagtgcctccccccaggcctgcctctagacccaaacttacgagcggcaagctgagcggcataaatgagatccctcgtcccttcagtccaccagtcaccagtaacacgtctccaccacctgccgcccctctggcacgggctgaatcctcatcctctatttctagctccgctagcttgagtgccgccaatactccgaccgtgggggtgagtcgtggtccatcccccgtttcactgggtaaccaggatacactgcccgtcgctgtggctttgaccgagagtgtgaatgcctacttcaagggggccgacccaacgaagtgtatcgtaaaaattaccggtgatatgactatgagcttcccttcaggcatcataaaagtgttcacaagtaatcctacacctgcggtcttatgtttcagggtgaaaaacatcagcagactggagcagatcctgcctaacgctcagctcgtgttctccgacccttctcagtgcgacagcaacacgaaggacttttggatgaacatgcaagcggttaccgtgtacctgaaaaaactctcggagcagaatcccgcagcatcctattacaatgttgacgtgcttaagtatcaagtctctagcaatgggattcagtccacacctttaaacctggccacctattggaagtgtagtgctagcaccactgacctgcgtgttgattacaagtataatccagaagccatggtggccccttcagtgctgtcaaatatccaggtggtggtccccgttgacggaggcgtgacaaacatgcagtcactgccccccgctatttggaatgctgaacagatgaaggcattctggaagttatcaagtatctctgagaagagcgagaacgggggctcagggagcttaagagcaaagttcgatctgagcgaggggccatccaaaccaactacactcgccgttcagttcctgtcagaaggatcaactctgtctggagtggacttcgaacttgtgggaaccgggtaccggctgtctttaatcaaaaaacgttttgccacgggcaggtatcttgctgattgttag

SEQ ID NO: 187729 - DNA, 2433 bp, Artificial Sequence
  Description of Artificial Sequence: Synthetic coding sequence
atggtgatggcctacttcgtggagaacttctggggcgagaagaactccgggtttgacgtcctctatcacaacatgaaacatggacagatttctactaaggagctggccgatttcgtccgggaacgcgctaccattgaggaggcgtactcccggagcatgactaagctggccaagagcgcctcaaactattctcagctgggtacctttgcccccgtgtgggacgtatttaagacttcaacagagaaactcgcaaactgccatctcgacttagttcgaaaacttcaggaattgatcaaggaggtccaaaaatatggcgaggagcaggttaagtcgcataaaaaaactaaagaagaggtcgctggtaccctggaggcagtccagaccatccagtcaatcacacaagctctgcagaagtctaaggagaattataacgccaagtgcgtcgagcaggagcgactgaagaaagaaggcgccacgcagcgagagatagaaaaggccgctgtgaagagtaagaaggctacagatacatacaaactgtatgtggagaaatacgcgctggctaaagccgattttgagcagaaaatgaccgaaaccgcccagaaattccaggacatcgaggagactcacctgatccacatcaaagaaattattggttccctgtctaatgccataaaggaaattcacctgcagataggacaggtccacgaagagttcatcaataatatggctaacaccacagtggaaagcttaattcagaaattcgctgagtctaagggcacaggaaaggaaagacccggcctgatcgaattcgaagagtgtgacacagccagcgcagtggaaggcattaagcctcgcaaaaggaagacgttcgctctcccaggtataattaagaaagaaaaggacgctgaaagcgtcgaatgtccagatgcggattcactcaatattcctgatgtggatgaggagggttacagcattaaaccagagactaatcaaaatgacacaaaagaaaaccatttttactcctccagcgacagtgactcagaagatgaagaacccaagaagtaccgaattgagatcaagcctatgcacccaaataactctcaccataccatggcctccctagatgagcttaaggttagcataggtaatatcacgttgtctccagctatttcacgtcactcacccgtccaaatgaaccgaaacctctccaatgaagagctgaccaagagcaaaccttccgcccctcctaacgagaaggggacaagcgatctgttggcttgggatccactattcggcccgtccctggacagtagctcatcaagctctctgactagttcaagctctgctcgccccactactccactctctgtgggcacgatcgttcccccaccacggcccgcttctaggcctaaactgacttcaggcaagctttccgggattaacgagatcccgcgccctttcagtcctcctgttacctctaacacgagccctccccccgccgcccctttagcccgcgcggagtcatcttcttccatcagtagttcagctagcctcagcgcagctaacactcccacggtcggagtcagccgtggccccagtccagtctcattaggcaaccaggacaccttgcccgtcgctgtcgctctaacagaaagtgtgaatgcctactttaaaggcgctgacccaaccaaatgtatcgtgaagatcaccggagacatgaccatgtcttttccgtctgggatcatcaaggtgtttacaagtaacccaacacccgccgtactgtgctttagggtcaagaacatttccagactggagcaaatcttgcccaacgcgcagctggttttcagcgacccctcccagtgcgatagcaataccaaggacttctggatgaacatgcaggctgtgaccgtttacttgaagaagctgtctgagcagaacccggcagcaagctactataatgtggatgtactgaagtaccaggtctcttccaacggcattcagagcaccccgctgaatttggctacgtactggaagtgttctgcatccaccacagacctgagggtcgactacaaatacaatccggaggctatggtcgctccctccgtcctatcaaacatccaggtggtagttccagtcgacggaggagtcacaaacatgcaatctctgccaccggctatatggaacgcagagcagatgaaagccttctggaaacttagcagcattagcgaaaagtctgaaaatgggggctctgggtcactgagagctaagttcgacctgtcagaggggccaagcaagcctaccaccctggctgtgcagtttctgtcagagggaagcaccttgagtggagttgatttcgaactagttggcaccggttataggctatctttaatcaagaaacgctttgccactgggcgttatttggcggactgttag

SEQ ID NO: 187730 - DNA, 2334 bp, Artificial Sequence
  Description of Artificial Sequence: Synthetic coding sequence
atggtgatggcctacttcgtggagaacttctggggcgagaagaactccggattcgatgttctgtaccacaatatgaagcacggtcagatttccacgaaagaactagctgacttcgtgagggaaagggctactatcgaagaggcttatagccggtcaatgacaaagctcgctaaatccgccagcaattacagtcaactcggcacattcgcgcctgtgtgggacgtgttcaagacatccacagagaagctggccaattgccacctggacttagtaaggaagttacaggagttaatcaaggaagtacagaaatacggagaggaacaagtgaaaagccataagaaaacaaaggaagaggtagctgggacattggaagctgttcagactatccaatctatcacccaagctctgcagaaaagcaaggaaaactacaatgcaaagtgtgttgagcaggaaaggctcaaaaaggagggggctacccagagagagatagagaaagctgcggtgaagtccaagaaagcgacggacacttacaagttatacgtggagaagtatgcccttgctaaagccgacttcgagcagaagatgacagagaccgctcaggttcatgaggagttcattaacaatatggctaatactacagtggaatcactgatccagaagttcgctgaatcgaaaggaactgggaaggagcgccctggcctgattgaattcgaggagtgtgacaccgcttctgccgttgagggcatcaaacccagaaagcggaagaccttcgcactgcctgggatcatcaagaaggagaaggatgccgagagcgtcgaatgtccggatgctgattcactgaatatacccgacgttgacgaggaaggttactctattaagccagagacgaaccaaaacgacacgaaggagaaccacttctattcgagctctgattccgacagcgaggatgaggagccaaagaaatatcgcattgaaatcaaaccgatgcatcctaacaactcccatcacacaatggcctccctggatgagctgaaggttagcattggtaacatcaccctgtccccggccatctccagacacagccccgttcagatgaataggaacctttctaacgaggagttgacgaagagtaagccaagcgctccacctaatgagaagggtacctcagacctactggcctgggaccccctgttcgggcctagtctcgacagcagcagcagtagctcactgacaagttccagctctgccagacctaccacacccctatcagttggtacgattgtgcctcctccacggccagctagcagacccaagcttacaagtggaaaactgtctgggattaatgagatacctagacccttctcaccacccgtaacctccaatacatcccccccaccggctgccccgctcgctagggcagaatcatccagcagtatcagcagttcagcctccctttctgctgccaatacacccacagttggcgtctcaagagggcccagcccggtctccctcggtaaccaggatacattgcctgtggctgttgccctaacagaatctgtgaatgcatacttcaaaggagccgaccctaccaagtgtattgttaagatcacaggagatatgaccatgtccttccccagcggaatcattaaagtatttacatctaaccccacacccgccgtactctgtttccgggtcaagaatatttcaagacttgagcagatactgcccaacgcacaactcgtttttagcgacccttcccagtgtgacagtaacacgaaagacttttggatgaacatgcaagcagtcacagtctacctcaaaaagctttctgaacagaacccggccgctagttactataacgtagatgttctcaaatatcaagtgtcctcaaatggcatccaatccacaccccttaatctggctacatattggaaatgtagtgcctctaccacagacttacgagtagattacaagtataaccctgaggcaatggtggccccaagcgtcctctcaaatatccaggtcgtcgttcctgtggacggcggggttaccaacatgcagagtctgccccctgctatttggaatgccgaacagatgaaggcgttttggaaattgtcttcaatctcggaaaagagcgaaaacggcgggagcggcagtttaagagctaagtttgacctctctgagggccccagcaagcccaccacccttgccgtgcagtttctgtcagaaggcagtacactgtcaggtgtcgactttgagctggtgggcactggatatcgcctctctctcatcaaaaaacggttcgccacgggccgctatctagccgactgctag

SEQ ID NO: 187731 - DNA, 1668 bp, Artificial Sequence
  Description of Artificial Sequence: Synthetic coding sequence
atggcccggcccgacgacgaggagggcgccgccgtggcccccggccatccactggctaagggatacctgcctctgccgaggggggcccctgtagggaaagaatcggtggaattacaaaatgggcctaaagctggcacgttcccggttaatggtgccccccgtgatagcctggcagctgcaagcggcgtcctcgggggcccacagactccactggctcccgaggaagagacccaggccaggctcctgccagcgggagctggtgctgagacccccggggccgaaagctcccccctgccgctaacagccctttctccgcgccgctttgtggtgttgcttattttttcactttattcactggtcaatgcattccagtggatccagtatagcattatatcaaacgtgtttgagggcttttacggcgtcactctgctgcacattgactggttgagcatggtttacatgctggcctacgtgccgttgatctttcctgcaacttggctgttggatacccgtgggctccgcctcacagcccttctggggagcggactgaattgcctgggtgcctggatcaaatgtggttcagtacagcagcatttgttctgggtaaccatgttggggcagtgcctttgctctgtggcacaggtttttatacttggactcccctctcgaattgccagtgtctggttcggccctaaggaagtgagcacagcctgtgctacagctgtcttgggcaatcagctcggaaccgcagtgggctttctgcttcctccagttctggtgcctaatacgcagaacgacacaaatctgctggcctgtaatataagcactatgttctacggtacgtctgctgtagccactttactcttcatcctcactgctatagcatttaaggagaaaccacggtatcctcccagtcaggcccaagcagccctccaggattcaccaccagaggaatactcttataagaagagcatcaggaacctgttcaagaacatcccctttgtgctgcttcttattacctacgggatcatgacgggtgccttctattccgtgtccactctgctgaaccagatgatccttacctactatgagggagaggaggtcaatgctggacgaatcggcttgaccctagtggtcgcgggcatggtcgggtccattctgtgtggcctatggctggattacacaaagacctacaagcagacaactttgatcgtctacatattgagttttatcgggatggtgatcttcacgttcacactggatctgaggtacatcataatagtttttgttacaggtggtgtcctgggatttttcatgaccggttatttgcctttagggttcgagtttgcagtagagattacgtatcccgaaagcgaggggactagttctggactgctgaacgccagtgcacagatcttcggcatactgtttacactggcccagggaaagctgacttccgattacgggcctaaggctggaaacattttcctgtgcgtatggatgttcattggcattattctgacagcattgattaaatctgatctgcgccgccacaatatcaacatagggatcaccaatgttgacgtgaaagctattcccgcggattcccccactgaccaggagcctaagactgtgatgctcagcaaacagtcagagagtgcgatatag

SEQ ID NO: 187732 - DNA, 2469 bp, Artificial Sequence
  Description of Artificial Sequence: Synthetic coding sequence
atgggcttcggcagcgacctgaagaacagccacgaggccgtgctgaagctgcaggattgggagctccgtctgctcgaaacagttaaaaagttcatggccctgagaattaagagcgacaaagagtatgcctccacgctacaaaacttgtgcaatcaagtagacaaggaaagtacagtgcagatgaactacgtgtccaatgtgtcgaaaagctggttgctgatgatccaacaaactgagcagctgagccgaattatgaaaacccacgctgaggacctgaattctggaccccttcaccggttgaccatgatgattaaggacaaacagcaggtgaagaaaagctatataggggtccatcagcaaatagaagccgagatgatcaaggttactaaaacagagctggaaaaactgaagtgtagctatcggcaattaattaaagaaatgaactcagctaaggagaaatacaaggaggcacttgccaaggggaaagagacggaaaaagcaaaggagcgatacgataaggccactatgaagcttcatatgctgcataatcagtatgtcctggccttgaaaggggcacaattacaccagaaccaatactacgacattaccctcccactgctgctggacagtctgcaaaaaatgcaggaggaaatgatcaaggcactgaaagggatatttgacgaatattctcagatcaccagtctggttaccgaggagattgtcaatgttcataaggagattcagatgtctgtggagcagatcgaccccagcactgaatacaacaattttatcgatgtccatcgaacaaccgccgccaaggagcaggaaattgaatttgacacctcgcttctggaagagaatgagaacttgcaggcaaacgagatcatgtggaacaatctcaccgccgaaagccttcaggttatgctgaagacgttggccgaagaactaatgcaaacacagcaaatgttgcttaataaggaagaagcggtattagagctggagaagcggatcgaagaaagcagtgagacatgtgagaagaagtctgacattgttctgctgctatctcagaagcaagcactagaggaactgaagcaaagcgtccagcagctcagatgtaccgaagcaaagtttagcgcccaaaaggagttattagaacagaaggttcaggagaatgatggcaaagaacccccacctgtggtcaattatgaggaggacgcgcgttctgttaccagtatggaaaggaaagagcggctatcgaaatttgagagtattaggcactccattgctggaattatcagaagccctaagtccgctcttggatcttctgccctatcggatatgatttccatctcggagaagccactcgctgagcaggactggtatcacggggctataccccgtatcgaggcacaggaactcctcaaaaagcagggggatttccttgtacgcgagtctcatggaaaaccaggagaatacgtccttagtgtttattctgatggccagcgcaggcacttcattattcaatacgttgacaacatgtacagattcgaagggaccggtttctctaatatcccacagctgatcgaccaccactatacaaccaaacaagtgatcactaagaagtcgggcgtggtcctgttgaaccccatcccaaaagacaaaaagtggatcctgtcccacgaagatgtcatcctgggggagcttctcggtaagggcaactttggggaagtgtataaagggaccttgaaagataagacatctgtagcagtgaaaacttgcaaagaagacttgcctcaagagctgaaaatcaaatttctgcaggaggccaagatacttaaacagtacgaccaccccaacatcgtgaagctgattggagtctgtacacagaggcagccagtttacattatcatggaacttgtctcaggcggcgatttcctgacatttctgagacgaaagaaagatgagttgaaactgaaacagttggtgaagttctctctggacgccgctgccggtatgctgtacctggagagcaaaaactgcatccacagagaccttgccgctcgcaattgtctcgttggcgagaacaatgttttaaaaattagtgacttcggaatgagccgtcaggaggacggcggagtttattcctcatctggcctgaaacagatcccgatcaaatggaccgccccggaagcattgaactacggcagatactcaagcgagtctgatgtctggtcctttggcatcctcttatgggaaactttttctctaggcgtctgcccatacccaggcatgacgaaccagcaggccagggagcaggtggaacgagggtaccgcatgtccgcaccccagcactgtcctgaagatatcagcaagatcatgatgaaatgttgggattataagccagaaaatcgtccaaagttctcagagcttcagaaagagcttaccattatcaagcgtaaactgacttag

SEQ ID NO: 187733 - DNA, 1944 bp, Artificial Sequence
  Description of Artificial Sequence: Synthetic coding sequence
atgaagctgcacatgctgcacaaccagtacgtgctggccctgaagggtgctcagcttcaccagaaccagtactacgacatcaccctgcctctactgctggattcccttcagaaaatgcaggaggagatgatcaaggcactgaaaggaattttcgatgaatacagtcagattacgagtcttgtaacggaagagatagtcaatgtgcacaaggagatccagatgtcagttgagcagatcgatccatctacggaatacaacaattttatcgacgtccataggacaacagccgctaaagaacaggaaatcgaattcgatacctcactgctggaagaaaatgaaaacctgcaggccaacgagattatgtggaataacttgaccgccgaaagtctgcaggtcatgcttaagacgctggctgaagagctcatgcagacccagcaaatgctcctgaacaaagaagaggcagtactggagttagagaagcgaatagaggagtcatctgaaacctgcgagaaaaaatccgatatcgtactgctgttgtcacaaaagcaggccctggaagaactgaagcagagtgttcagcaactcagatgcacagaagccaaatttagtgctcagaaagaactgttggagcagaaggtgcaggaaaacgatggaaaagagcccccgcctgtcgttaactacgaagaggacgccagatcagtgaccagtatggagaggaaggaacgtctaagcaagttcgagtccatacgccactcgatcgccggcattatccggtcccctaaaagcgcactcggctccagcgctcttagtgacatgatctccattagcgaaaagcctttagccgagcaagactggtaccatggcgcaattccccgcatcgaagcacaggaactcctcaaaaaacagggggatttcctggtaagggaaagccacggcaaacctggtgagtacgtactgtcagtgtattccgacggacagcgccgccattttatcatacagtacgtggacaatatgtatcgctttgagggcactggtttctccaacatacctcagcttatcgaccatcattacacaacaaagcaagtcatcaccaagaaatctggagtggtgctgttaaatcccattcccaaagataaaaagtggatcctgagccacgaagacgtgatattaggcgagctactgggaaagggcaattttggagaagtgtacaaagggactcttaaggacaaaaccagcgtcgcagttaaaacctgcaaggaagacttgcctcaggaactaaagataaagttcctgcaggaagcaaagatcctgaaacagtacgatcatcctaatatcgttaagttgattggcgtatgcacccagcgacaaccagtgtacatcatcatggagctggtttctggcggagactttctcacctttttgcggcggaaaaaggatgaattaaagctcaagcaactggtcaagttcagcctcgatgccgcggccggaatgctatacttggagtccaaaaactgtatacacagagacttggccgcacgaaattgtctggtgggggagaacaacgtcttgaaaatctcggactttggtatgtctagacaggaagacggcggtgtgtattctagtagcgggttgaaacagatccccattaaatggacagcgcccgaggctctaaactacggacgatactcatcagaaagtgatgtgtggtcttttgggatcctgctgtgggaaactttctctctgggggtgtgtccatatccaggaatgaccaatcagcaggctagagaacaggtggagcgaggctataggatgtccgctcctcagcattgcccagaggatatcagcaagattatgatgaaatgctgggactacaaacccgagaaccgacctaagttctctgaactccagaaggaactaaccattatcaagagaaaattgacctag

SEQ ID NO: 187734 - DNA, 981 bp, Artificial Sequence
  Description of Artificial Sequence: Synthetic coding sequence
atgggcttcggcagcgacctgaagaacagccacgaggccgtgctgaagctgcaagattgggagctccgcttactggagactgtgaagaagtttatggccctgagaatcaagagcgataaagaatacgccagtaccctgcagaatctttgtaatcaagtggataaggaatccactgttcagatgaactatgtctccaatgttagcaagagttggctacttatgatccaacaaactgagcagctcagtcgcatcatgaaaactcatgccgaggatctcaactcgggtcctctccatcgactcacgatgatgatcaaggataaacaacaagtgaaaaagtcctatataggggttcatcagcagatcgaagcagagatgattaaagtgacgaagactgaactcgagaagctgaagtgcagctaccgccagctgattaaagaaatgaacagtgctaaggagaagtataaggaagctctggccaagggaaaagaaaccgagaaggcaaaggagagatatgataaggcaacaatgaaactgcatatgttacacaatcaatacgttctggcactcaagggggcacaattacaccagaaccaatattacgatatcacgctgcctctgcttctcgattctctgcaaaaaatgcaagaagagatgattaaagctctgaaaggcatctttgacgagtattctcagattaccagcttagtaacagaggaaattgtcaatgtccacaaagagatacagatgtcagttgagcaaattgatccttccaccgagtataataacttcattgatgttcacagaactacagccgcaaaagaacaggagatagaatttgataccagtctgctcgaagaaaatgaaaatctccaggccaacgagataatgtggaataacttaacggctgaatctttgcaagtcatgaaagagcgccgcgggtatccgaatctgaatttattcgtgatacagctcctggaatag

SEQ ID NO: 187735 - DNA, 3855 bp, Artificial Sequence
  Description of Artificial Sequence: Synthetic coding sequence
atgcacgtgttcatcgtgggcatgagcctgagcagcgtgaccctggcctctgcccttcaggttaggggggaggctctgtcagaggaggaaatctggtctctgctctttctcgccgctgaacagctgctcgaagacctgagaaatgactcaagcgactacgtagtctgtccttggagcgctttattgagcgctgcaggatccctctcattccagggccgagtttcacatatcgaggcagctccattcaaagcacctgagctcttgcaaggccagtctgaggacgagcagcctgacgcttcgcaaccactgcagctgtgtgaacctctacatagtatccttctaacaatgtgcgaggaccagccccaccgacgatgcaccctccagtcggttctagaggcttgccgggtacacgaaaaagaagtgtcggtttaccccgcccccgctggacttcacattaggaggttggtgggcctcgtcctggggaccatttccgaagtcgaaaagagggtggtggaagagtcatctagtgtccagcagaacaggtcatatctcttacgtaagcgattgcgcggcactagtagtgaaagtcccgcggcccaggcaccagaatgtctgcacccatgccgcgtgagcgaaaggtctacagagacccagtcttctcccgagccacattggagcacattaacacacagccactgctcactgcttgtgaaccgtgccctgcccggggccgatcctcaggatcagcaggcaggacgacgcctaagttctggctccgtccacagcgccgccgattccagttggccaacgacaccttcacagcgggggttcctccaacgaaggagcaagttctctagacctgagtttatactgttagccggggaagctcctatgaccctgcacctcccagggagcgtggtgactaaaaagggcaagagctacctggcactgagagacctgtgtgtggtccttctgaacgggcaacacctcgaagttaaatgtgacgtggaaagcacggtgggagcagtgtttaatgctgtcactagcttcgctaatctggaggagctcacctattttgggttggcctacatgaagtccaaggaattttttttcctggattcagagacgcgcctctgtaagatagccccggagggatggagagagcagcctcagaagaccagtatgaataccttcaccttatttctgcgcattaagttcttcgtttcccactatggcctactacaacacagtttgaccagacatcagttctacctgcaactcaggaaagatattctggaagagagactctattgcaatgaggaaatcttattacaattaggagtgctcgccctccaggcagagttcggcaactacccaaaagaggttgaatccaagccctacttccatgtcgaggactatatccccgcttcacttatagagagaatgaccgcgctaagagtgcaggttgaggtgagcgagatgcacagattatcttctgccctgtggggagaagatgctgaactgaagttcctacgggttactcagcagttgcccgaatacggggtactcgtacatcaggtgttctccgagaagcgacgccccgaagaggagatggcactgggaatatgcgccaagggtgtgatcgtttacgaagttaagaacaattcacggatagccatgctgcgctttcagtggcgggagacaggcaaaatttcaacttatcagaaaaagttcaccatcacatcctcagtgacgggaaaaaagcacacctttgtgacagactccgctaagacttccaaatatctgctggacctttgcagtgcgcagcatggcttcaatgcgcagatgggatctggtcaaccttcccatgtgctctttgaccacgacaagtttgtgcaaatggctaacttatctccagctcatcaggcacgttctaagcccctcatctggattcagagactgagttgctccgaaaacgaacttttcgtgtctagactgcagggggctgccgggggcctgctttccacgtctatggataactttaatgtggatgggtctaaagaggctggcgcagaagggataggccggtctccatgtactgggcgggaacagttgaagagcgcttgcgttatccagaaacccatgacatgggactcactgtctggccctcccgtgcagtctatgcacgccggttcaaagaataaccgcagaaaaagctttatcgctgaaccaggtcgtgagatcgttagggtcacactgaaaagggacccccaccgaggttttgggttcgtgataaacgaaggcgaatactctggccaggccgatccaggcatattcatctcctcaatcattccaggcggacctgccgaaaaggccaaaaccatcaagcctggcggacagatcttggcattgaatcacattagcctggagggattcactttcaacatggcggtccggatgatccagaattctccagataacattgagttaattattagccagtcgaaaggggtgggggggaacaatccagatgaggagaagaatagcactgctaattcaggcgtctcatcaactgatattttgagctttggttaccaggggtcattattgtcccatacacaggaccaggatcggaacaccgaggagctggacatggccggtgttcaatcactggtcccccgcctgagacatcagctgtcattcttgcccttaaagggcgccggatcatcctgccccccttctccgccagaaattagcgccggcgagatctacttcgtggaactcgtgaaagaggacggaacactgggcttctcagtaactggggggattaatacatctgttccctacggaggcatctacgtcaagtcaattgtgcccggaggcccagccgcaaaggaaggacagatattacagggggaccgtctgctgcaagttgatggagttatcctttgcgggctaacccataagcaggccgtccagtgcctcactggacctgggcaagtggccagactggtcctggaacgcagagttccgcggagtacccaacaatgtcccagcgccaatgactcgatgggggatgaaagaacagctgtgagcctcgttaccgcattgcccggcaggcctagcagctgcgtatccgtcactgatgggccgaagttcgaggtaaagttaaaaaagaatgccaatgggctgggtttctccttcgtgcagatggaaaaagagtcctgctcacacctgaagagcgatctcgtccggattaaaagacttttccctgggcagcccgccgaagagaatggcgctatcgccgctggggacatcatcctggccgtcaacgggcgctctaccgaaggacttattttccaggaagtactgcatctgctccgtggcgcaccgcaggaggtgacactgctactctgtcggccaccaccgggcgcgttgccagaactggaacaagagtggcagacgccagagctttccgctgataaggaattcactagagctacttgcaccgattcctgtacctcaccaattctggaccaggaagatagctggagagattccgcttcgcccgacgccggcgaagggctcggactcagaccggagtcttctcaaaaagccatccgcgaggctcagtgggggcaaaaccgcgagagaccttgggcgagttcactcacgcactctcccgagagccatccccatttgtgcaaactccatcaagagcgcgatgaatcgacactggctacctctcttgaaaaggacgtaagacaaaattgttatagtgtttgtgacatcatgcggctaggcagatattctttctcctctcctttgaccagattgagcacagacatcttctag

SEQ ID NO: 187736 - DNA, 3930 bp, Artificial Sequence
  Description of Artificial Sequence: Synthetic coding sequence
atgcagcccctgaccaaggacgccggcatgagcctgagcagcgtgacactggctagcgcgctacaggtaagaggggaagccttgtctgaggaagaaatctggagtctcctgtttctcgctgccgaacagctgcttgaagacctcagaaatgattcatccgattacgtggtttgtccatggtctgcactcctgagcgcggcgggaagcctctctttccagggacgagtctcgcatattgaggccgcgccttttaaggctcctgaattactgcaggggcaatccgaggatgagcagcccgatgcatctcagatgcatgtctacagtctcgggatgacactgtactggagcgccggatttcacgtgcccccccaccagccattgcaattatgcgagcccctccactccattctactgactatgtgtgaagaccagccacaccggcgctgcactctgcagtcagttctggaagcatgtcgggtacacgaaaaagaggtttcagtctaccccgcacccgccggcctgcatattagaaggctcgtcggtcttgtgctcggaacaattagcgaagtcgagaagagagtggtggaggagagctcctcagtacagcagaatcgctcctatctgctgcggaaacggctgcggggaacaagtagtgagagtcctgctgctcaggctcctgagtgtctgcacccgtgcagggttagcgaaaggtctactgagacacagagcagccccgaaccccactggtctacactgacgcactctcattgttctctgctggttaatcgtgcacttccaggtgcagaccctcaggatcaacaggcaggaagacggctgagcagcgggtcagtgcactccgccgccgactcctcgtggcctactactcctagtcagcgcggcttccttcagcggaggagtaaattctcccgcccagaattcattctgctggctggagaggcaccaatgaccctccacctcccaggctcagtggtcacaaagaagggcaagagctatctagcccttcgcgatctgtgtgtggtgctgcttaatgggcagcatctagaggttaagtgcgatgttgaaagcacagtgggagccgtgtttaatgcagtcacttccttcgccaacctggaggagctgacctattttggacttgcctacatgaagagtaaggagttttttttcctagactcggagacgcgcctgtgtaagattgccccagagggatggcgcgaacagccccagaagacctccatgaatacctttacactcttcctcagaattaagttctttgttagccactacgggttgctacagcattccctaacaagacatcagttttaccttcagctaaggaaggatatattggaggaaaggctctattgtaatgaggagattctgttgcaattgggagtgttagctctccaagccgagtttggaaactatcctaaagagcaagtggaaagcaagccttacttccacgttgaagactacatacctgcttcacttatcgaaaggatgacagccttgcgcgtgcaggttgaagtctcagagatgcaccggctcagcagcgctctctggggggaagacgccgaactcaagtttctgagggtgacgcagcaactgcccgagtatggcgtgctggtccatcaggtttttagtgagaaacgacggccagaggaagaaatggccctgggcatctgcgcaaaaggagtgatcgtgtacgaagtcaagaataactctcgtatcgcaatgttgcgctttcaatggagagagacgggaaagatttccacttaccaaaaaaagtttacaatcacctcttccgtgacggggaaaaagcacacgtttgtgacagacagcgcaaagacctctaaatacctgcttgatctgtgctctgcgcagcacggcttcaatgctcagatggggtctgggcagccctctcacgtgctgttcgaccacgacaaatttgtgcagatggctaaccttagccccgcccatcaggccagatcgaaaccactcatttggatccagcgtctatcatgtagtgaaaacgagctgttcgtcagcagactgcagggagctgccggggggctgttgtcaacatccatggacaatttcaatgtggatggctcgaaggaagcaggggctgaagggataggcagaagcccgtgcactggacgagaacagttaaagtcagcctgcgtgatccagaagccaatgacatgggatagtctgtctggaccccccgtccagagtatgcatgcaggctcaaagaacaatagacggaaatcttttatagcagagcctggcagggagattgtgcgggtcactctgaagcgtgacccccaccggggtttcggttttgtgattaatgagggcgaatatagtgggcaagccgatccagggatattcatttcttcgatcattcctgggggtccggccgaaaaagccaagacgataaaacctggggggcagatcctagccttaaatcatattagtttggaaggattcactttcaatatggcagtgcggatgatccaaaattcacctgacaatatcgaactcattatcagccagtctaagggggtcggcggtaacaatcctgacgaggagaagaattcaacagcaaactcaggcgtttccagcacggatattctgtcctttggttaccaggggtcccttttgtcacatacccaggatcaggaccggaacacggaggagttggacatggcaggcgtccagtccctggtcccccggctgcgtcatcagctgtcgttcctcccactgaaaggggccggctcatcgtgtcccccgagcccccccgagatctcagctggtgaaatttactttgtagaattagtgaaagaggacgggacactgggcttttccgtcacagggggcattaacacctccgttccctatggaggcatctacgttaaatccatcgtaccaggtgggcccgctgcaaaggagggacagattctccagggcgataggttgctacaggtggatggtgtaatcctctgcggcctcacccacaaacaagcagttcaatgcttgactggccctggccaggtcgctcggctggtgctcgaacgaagggtacctaggtctactcagcagtgcccatcagccaacgattccatgggagacgagagaaccgctgttagcctggtcacagcccttcccgggaggccatcctcttgtgtgagcgtcaccgacggacctaagttcgaggtgaagctgaagaagaacgccaatggcctgggtttttctttcgttcagatggaaaaggagtcctgctcccatttaaaatccgatttggtccgcattaagcggctattccctggccaaccggccgaagaaaatggtgctattgccgccggagacatcatcttagccgttaatggacgcagcaccgagggattgattttccaggaagttctgcacctgcttcgcggcgcccctcaagaggtgactttactcctatgccggccaccacctggagccctccctgagctcgagcaggaatggcaaaccccagaactctcagcagacaaagagttcacccgggccacctgcactgattcctgtacaagccccatcctagaccaggaagacagttggcgcgattcggccagtcccgatgccggggaaggtttggggctgcggccggaatcctctcaaaaagcaattagagaggcacagtgggggcagaatcgcgagcgcccttgggccagttcattgactcattccccggagagtcatccccatctgtgcaaacttcaccaggagcgtgacgagtccacactggctacttccctggagaaggatgtgaggcagaattgctacagcgtgtgtgacataatgcggctggggcggtatagcttcagttcgcctctgacgaggctgtctacagatatcttttag

SEQ ID NO: 187737 - DNA, 3834 bp, Artificial Sequence
  Description of Artificial Sequence: Synthetic coding sequence
atgagcctgagcagcgtgaccctggccagcgccctgcaggtgcggggagaggcactgagcgaagaggaaatctggagcctattattcctcgccgccgaacaactgctggaagatctcaggaacgacagttctgactatgttgtatgtccttggagcgcactcctgtccgcagccggttccctctcgtttcaggggagggtgagtcacatcgaggcagctccatttaaggctcccgaactgctgcagggtcagagtgaggacgagcagccggatgcctcacagcctttgcaactgtgcgagcccctgcacagtatactgctgaccatgtgcgaggaccagccacacagacgctgtactttgcagtcagtactcgaagcatgtagggtccatgaaaaggaggtctctgtgtaccccgcacctgccggtctgcatatccgacggctcgttggccttgtgcttggcacgatttcagaggtggagaagcgggttgtggaagagagcagcagcgtgcagcagaacaggagctatttgctccgcaaaagacttaggggcacatcttccgagagtccagccgcgcaggccccagaatgtctccacccttgcagagtatccgaaaggtctaccgagacacagagcagccctgaaccacactggtctacactgacccacagccattgttctctgctggtgaacagagccctgcctggagcggacccccaggaccagcaagccggacgacggctgtcttccggtagcgtgcactctgccgccgattcctcatggcccacaacaccaagccagagggggtttctccagagaagatccaagtttagtcgcccagagtttatactcctggcaggcgaggcccctatgaccctccatcttcccgggtctgtggtgactaaaaaaggcaagagctacctagccctaagggacctctgtgtggtgttattgaacgggcagcatttagaggtgaaatgcgatgtggagagtacagttggagctgtgttcaacgctgtcacgagcttcgcaaaccttgaagaactaacgtattttggtctcgcttacatgaagagcaaggagttttttttcctggatagcgagaccaggttatgcaaaatagctcccgagggatggagggagcagcctcagaaaacttctatgaacaccttcacccttttcctaagaatcaagtttttcgtgtcccactacggtctgttgcagcattccctgacaaggcatcaattctatctgcaactcaggaaggatattctggaggaacgtttatattgtaacgaagaaatcctcttgcagctgggcgttctcgcattacaggccgagtttggaaactaccctaaggaagtggagtctaaaccgtatttccacgtagaagattacatacccgcaagtttgattgaacgcatgaccgctctgagggtgcaggtagaggtctctgagatgcatcgcctctcatccgctttatggggcgaagatgcagagcttaagttcctccgcgtcacacagcagctgccagaatacggtgtgttggtgcaccaggtgttcagcgaaaagcggagacctgaggaagagatggcattagggatttgtgctaaaggtgttattgtgtatgaagtcaagaataatagcagaatagcgatgcttcgcttccaatggagagaaacgggaaagatttccacctaccagaagaagttcaccattacatcttctgtgacaggcaaaaaacatacctttgtgaccgattcagcgaaaacttctaagtacttgctagacctgtgttctgcacagcacggttttaatgcacagatggggtccggacaaccatcccacgtcttgtttgaccatgataagttcgtgcagatggcaaacctgtcacccgcccaccaggcccgttccaagccccttatctggatacagcgtctgagctgtagtgagaatgagctgtttgtatcacgcctgcagggcgcagctgggggcctgctgagcacgagcatggacaattttaatgtagacggcagcaaggaggcaggggcagaaggcatcggaagaagtccatgtaccgggcgggagcagttgaaaagcgcgtgcgttattcagaagccaatgacttgggatagcctgagcggccctcccgttcagtcaatgcacgcaggctctaagaataaccgcagaaaatcctttatcgctgaacccgggagagagattgtgcgtgtcaccctgaagcgggaccctcatcgcggcttcggcttcgtgatcaatgagggcgagtattccggccaggctgatccaggaatatttatttcctcaattatccccggagggccggccgagaaagcaaaaacgattaagcccggcggccagatcctggctcttaaccacatctccctggaggggttcaccttcaacatggcggtgcggatgatccagaacagtcccgacaacatcgaactaattatcagtcaatccaaaggagttggcggcaataaccctgatgaggagaagaactctaccgcaaactccggcgtgagtagcactgatatcttatccttcgggtatcagggtagcctgctttctcatacccaggaccaggaccggaacactgaggagctggatatggccggcgtgcagtcgctcgtgccccgactcagacaccaactatcttttctcccactaaaaggagccggctctagttgccccccaagtcctccagagatcagcgccggcgaaatctacttcgtggaattggttaaagaggacggcacattgggctttagcgtaaccggcggtattaacacctcagttccttatggaggcatctacgtgaagtccatcgtgccaggcggcccagctgctaaggagggccagatcctacagggcgacaggctcctacaagttgacggtgtgatactgtgcggcctgacacataaacaggcggtccaatgcctgactgggcccggacaggtggctcggctagttctggaacgtcgggttccacgatcaacacagcagtgtccatctgccaacgatagcatgggtgacgagaggactgcggtcagcctggtgaccgctctgccaggaaggccttcatcctgcgtttccgtgacagacggacccaagtttgaagtgaagctgaagaagaacgcgaacggactaggcttttctttcgtgcagatggaaaaagagtcgtgcagccacttgaaaagcgatctggtgcggatcaagcgacttttccctggccagccagcagaggaaaatggtgcgatcgcagctggcgacatcattctcgctgtgaatgggaggtctactgagggactaattttccaggaggtgttacacctcttgagaggggctccgcaggaggtgacactactcctctgtcgccccccaccaggagcgcttcccgaacttgaacaggagtggcaaacccctgagttgtcggctgataaagaattcacaagggccacctgcacagactcctgcacctcacccatcttagaccaagaagattcttggcgggactccgcgtcccctgatgcaggcgagggcctaggccttcgaccggagagctctcaaaaggccatcagggaggctcagtggggacaaaaccgagaaagaccctgggcctccagtcttacacactcccccgaaagtcaccctcatctgtgtaaattgcaccaggaaagagacgagtccacattggcaacttccctcgagaaggatgtgagacaaaattgttacagcgtctgtgacatcatgcgccttggccgctacagcttttcaagtccgctgaccagactgagtaccgacatcttctag

SEQ ID NO: 187738 - DNA, 786 bp, Artificial Sequence
  Description of Artificial Sequence: Synthetic coding sequence
atgggcgacgagcggaccgccgtgagcctggtgaccgccctgcccggacgaccaagctcctgcgtgagtgtgacagacggaccaaagttcgaggtgaagctgaagaagaacgccaacggcctcggatttagctttgttcagatggaaaaagaatcttgctcccacctgaagtctgatttagttcgaattaagagactgttccctgggcagcctgccgaagagaatggagccattgccgcaggcgacatcattctggccgtcaacgggcgtagtaccgaaggattaatcttccaagaagtgttacacctcttgcggggcgcgccgcaggaagtgaccctgttactgtgccggcctccccctggggcactccccgaattggagcaggagtggcagactcccgagttgagcgcagacaaggagtttacaagagcgacttgcactgatagctgcacatcccctatccttgaccaagaggacagctggcgagatagtgccagtcccgatgcgggtgagggcttgggtcttcggcctgaatcttcccagaaggccattagagaggcacagtggggccaaaaccgagagaggccctgggctagctccctgacacactcaccagaatcacaccctcacctgtgcaagctccatcaagagagagatgaatcaaccttagctacctccctggaaaaagacgtccgtcagaattgttattcagtatgcgacatcatgagactgggacggtactctttctcttcacctcttactcggctttccactgacatcttttag

SEQ ID NO: 187739 - DNA, 3936 bp, Artificial Sequence
  Description of Artificial Sequence: Synthetic coding sequence
ttcagcagccaccggaccaagagcagcggctggcccccccccagcggaacttggggactttcccaggtgccaccttacggatgggaaatgaccgccaaccgagatgggagagactactttattaatcacatgacgcaggcaattccattcgatgaccctagactggaaagttgccaaattattcctccagctccaagaaaagtcgagatgcggagggatccagttctggggtttgggtttgttgctggctccgaaaagcctgtcgtggtgcggtccgtcaccccaggcggtccttctgaaggtaagttgatccccggtgatcagatagtcatgataaacgacgagcccgtcagtgctgccccccgagagcgggtaatcgacctggtaagatcgtgcaaggaaagcatcctcctaacagtcatacaaccctacccgtcccccaaaagtgcgtttatctctgctgccaaaaaagcacgattgaagtcaaatccagtgaaagtacgcttcagcgaagaggttatcatcaacggccaggtctctgagactgtgaaagataatagtttgttattcatgccaaacgtgctgaaggtgtacctagagaacggccagaccaagagctttcggttcgattgctccacctctatcaaggacgtgatcctgacattgcaagaaaagctctccatcaaaggcattgagcacttcagcttaatgcttgagcagcgaactgagggcgccggcacaaaactgctgctactgcatgagcaggaaacattaactcaggttacgcagcgccccagcagccataagatgagatgtctcttccggatcagcttcgtgcccaaggaccccatagacttgcttagaagagacccggtcgcatttgagtatttgtatgtccagtcttgtaacgatgtagtgcaggaaaggttcggccctgaacttaagtacgatattgcactccgacttgccgccctacaaatgtacattgccaccgtcacaaccaaacagacccagaagatctcactgaaatacatcgagaaggagtgggggcttgagacttttctgccttccgctgtcttacagtcaatgaaggaaaagaatatcaaaaaagcgttgtcacacttagtgaaagcaaatcagaatctggttcctcctggaaaaaagctgtctgcactccaggccaaagtgcactacctaaaattcctctctgatttgagactctacggaggtagagtgttcaaagctactttagtgcaggctgaaaagaggtcagaagtgaccctactggtcgggccccggtatgggatctcccatgtgattaacactaaaaccaatttggtggccctcctggcagacttctcccacgtcaatcggatagagatgttcagtgaggaagagtccctggtcagggtagagctgcatgtactcgatgtaaaacctattactctcctgatggaaagctccgacgctatgaatctggcctgccttacagctggctactacagacttttggtggacagcagacgctccatctttaacatggccaacaaaaagaatactgccacccaagaaaccgggccagaaaataaaggtaagcacaacctgttgggacctgactggaattgtatccctcaaatgacaacatttatcggcgagggtgaacaggaagcacagataacctatattgactctaagcagaagactgtggagatcactgattcaaccatgtgtcccaaagaacataggcatctttatattgataacgcatattcatccgatggacttaatcagcagctgtcccaaccgggagaggcaccctgcgaggccgattaccgcagtctggctcagagaagtttactgactctgagtggccctgaaactctgaagaaagctcaggagagcccccgcggagctaaggtttcatttattttcggggacttcgctctggatgacgggatttctcctccaacgcttggatacgagacactactggacgaggggccagagatgctcgaaaaacaaagaaatctgtacatcggtagtgctaatgatatgaaaggactggatctgacgccagaggcagaaggtatccagttcgtggagaatagcgtctatgcgaatataggcgacgtgaagagcttccaagccgctgaggggatcgaggagccgcttcttcacgacatctgctatgccgaaaacactgacgatgccgaggacgaggacgaggtgtcctgtgaggaagacctggtggtgggggagatgaaccaaccagccattctaaacttatcaggcagttctgatgacatcatagaccttaccagcctcccacctcccgaaggggatgacaacgaggatgactttctgctgagatccctgaatatggcaattgcagcccccccaccgggctttagggacagcagtgatgaggaggattcccaatcccaggcagcaagctttcctgaggataaagagaagggatcctccttacagaatgacgaaatacccgtgtccttaattgatgcagtgccaacttccgcagaaggaaaatgcgagaaagggttggacaatgcggtggtctctactcttggagcgctggaagccctctccgtcagcgaggaacagcagacaagcgacaattcaggagtggccatacttcgcgcctactctcccgaaagctcctcagactctggcaacgagaccaattcatctgaaatgactgagagcagcgagctcgcaacggcccaaaagcagagtgagaatctgtctaggatgtttctggcgacccacgaggggtatcatcctcttgctgaggagcagactgagtttcccgcctccaagacccccgcaggcggcctgcctccgaagtccagccatgcacttgccgcccgcccagccaccgaccttccgcccaaagttgtgccaagtaagcaattactgcactctgaccatatggagatggagccggaaactatggaaaccaaatccgtgacggattacttttctaagctgcatatgggctctgtggcgtattcatgcaccagtaaacggaagtccaaactcgcagatggtgaagggaaagcacctccaaacggcaacacgaccgggaagaaacagcagggcacgaagaccgctgaaatggaggaggaagcgtccgggaagtttggaacagtctcatcaagagactctcaacatctgagtacattcaatctggagcggactgctttccgtaaagattcacaaaggtggtacgtcgctaccgaaggcggcatggccgagaagagcggcctggaggcagctactggtaagacattccccagggccagcggtctcggagccagggaagcggaagggaaagaggagggggcccccgatggggaaacaagtgacggaagcggcctcggccagggagatagattcctcaccgacgtgacctgtgcttcgtccgcgaaggacttggacaacccagaggacgctgactcatccacatgtgaccacccaagtaagctgcccgaagccgacgagtccgtggcacgactgtgtgactatcatctggcgaagagaatgagtagcctgcagagtgaggggcacttctccctgcagtcttcacagggcagctccgtggatgccggttgcggtacggggtcttctgggagcgcatgtgcgactccagttgagtcccccttgtgtcccagcttaggtaaacacctcatccctgatgcatctggcaaaggcgtgaactatatcccttctgaggagagagcacccgggttgccaaaccacggggctactttcaaggaattgcatccccaaacagaggggatgtgcccccgtatgacagtgcccgcacttcacaccgcaattaatacagagcccttatttggcactctgagagatggatgccacagactcccgaaaataaaggagactacggtgtag

SEQ ID NO: 187740 - DNA, 3969 bp, Artificial Sequence
  Description of Artificial Sequence: Synthetic coding sequence
atggacgtgttcagcttcgtgaagatcgccaagctgagcagccacagaaccaaaagcagtggttggcctccacctagcggtacctgggggctgagccaagtgcccccttacggctgggaaatgactgctaatagagacggacgggattactttatcaaccatatgacacaggcgatcccttttgatgaccctcgacttgagtcgtgtcaaatcattccccccgctccccgtaaagtggaaatgcgacgggatcctgttctcggctttgggtttgtggccggttcagagaagccagttgtagtcagatcagttaccccgggggggccaagtgaaggcaagcttatccccggcgatcagattgtgatgattaatgatgagccagtatccgccgccccccgcgagcgtgtcattgatctcgtcaggagttgtaaggagagcatactgttgacggttatacaaccataccctagccccaagtctgcctttatttcagcggccaagaaagcccgccttaaatccaacccagtcaaggtgaggttctctgaggaggtcattataaacgggcaggtttccgaaactgtaaaagataacagcttactgtttatgcctaacgttctgaaagtctatttggaaaatggccagacaaaaagtttccgtttcgactgcagcacaagtatcaaggatgtaatcctgacactacaggagaagctctccataaaggggatcgaacacttttctctgatgctcgaacagcgcaccgagggcgccggaaccaagctgctcctgctgcacgaacaggagaccctaacccaggtaactcagcgcccttcttctcacaagatgcgctgtctgtttcggattagctttgttccaaaggaccctatcgacttgctgcggcgtgaccctgtggccttcgagtatctgtatgtacagtcctgcaatgatgtggttcaggaacggttcgggcctgaactgaaatatgatatcgcacttcgtctcgcggcccttcagatgtatatcgcaaccgtgacgactaaacagacccagaaaataagtttaaagtacatcgaaaaggaatggggcctggaaacctttctaccttctgcagtgctgcagtcaatgaaagagaagaacatcaagaaggcactgtcgcatctggtgaaggctaaccagaatttggtgccgcctggcaagaaactcagtgctctacaagcaaaggttcattacctcaagtttcttagtgacctgcgcctctatggcggccgcgtgtttaaggcaacattggtgcaggccgaaaagcggtccgaggtgacgctgcttgtcggtccccgatacggaatcagccatgtgattaacactaaaaccaatttggtcgctctgctggcagatttcagccatgtcaaccgtatcgagatgtttagtgaagaggagagtctcgtgagggtggagttgcacgtgttggatgtgaagcccatcacactgctgatggaatcaagtgatgccatgaatcttgcctgtctgactgccggatactaccgtctattagtcgactcccgtaggtcaatcttcaatatggcgaataagaaaaacaccgctactcaggaaactggacctgaaaacaagggaaagcacaatctgctggggccggattggaactgtattcctcaaatgactacttttatcggggaaggggaacaggaagcacagatcacgtacatcgattccaagcagaagactgttgagattaccgattccacgatgtgccccaaagagcaccggcacctgtacatcgataacgcttatagcagcgatggcctgaaccagcaattaagtcagccgggggaggctccttgtgaggctgattacaggagcttagcccagcgctctctgcttacactaagcggccccgagacactaaaaaaagcccaggagtccccacgtggagccaaggtaagtttcatctttggggattttgcgctggatgatggcattagtccccccaccctgggatatgagacactgctggatgagggcccagaaatgctggaaaaacagcgcaatctgtatatcggttcagctaatgacatgaagggcttagacctgacccctgaagcagaaggtatacaattcgtcgagaactccgtgtatgcgaacattggtgatgtgaaaagcttccaagccgccgagggaatagaggagcccctactgcacgatatctgttacgctgagaatacagatgacgcagaggacgaggacgaagtatcttgcgaagaagacttggttgttggggagatgaaccaacctgcaattctgaatcttagtggaagttccgacgacattattgatctaaccagtctgccaccccctgaaggcgacgataatgaagacgactttcttctcaggagcctcaacatggcgattgccgcccccccccctgggtttcgcgactcgtctgacgaagaagacagccaaagccaagccgcctcctttcctgaagacaaagagaaggggtcgtccctacaaaatgacgaaatccccgtgagcctgattgatgcagtgcctacgagtgccgaggggaagtgcgaaaagggtcttgacaacgccgtggtcagcactttaggtgccttagaggcactgtctgtctcagaagaacagcagacctctgataactccggcgtggcaattctccgcgcatatagcccagaatcatccagcgacagtggtaatgagacgaattcctcggagatgacagagagtagcgaactggccaccgcccaaaagcagagcgaaaatctaagcagaatgtttttggctacacacgagggataccacccactggctgaagagcagacagaattccctgctagcaaaaccccagccggaggactccctcccaaaagctctcatgccctggcggcaaggcccgcaactgatctgccccccaaagtggttccctctaaacaactgctacactcagaccatatggagatggagcctgaaactatggagactaaaagcgttacagattattttagcaaactgcatatgggaagtgtggcttatagttgcacatccaagcgcaaaagtaagctggcagacggcgaaggaaaggcacctcctaatggcaacaccaccggcaagaaacagcagggcactaagacagcagaaatggaggaagaggccagcgggaaatttggtaccgtatcaagtcgagatagtcagcatttgtctactttcaacctggagcggacggctttcaggaaagactcccagcgatggtatgttgctaccgagggcggcatggcagaaaagagcggactcgaagccgccactggaaagacattcccccgcgcaagcggcctcggtgcgcgcgaagctgaaggcaaggaggaaggagcccctgatggggagacctcagacggaagtgggctgggccagggagacaggttcctcacagacgtgacctgcgcctcatctgcgaaggacttagacaatccggaggatgccgatagtagcacttgcgatcacccttccaaactgcctgaggccgacgagtctgtggcgcgtctctgtgactaccacctcgccaaacggatgagcagtctgcaaagcgaaggacatttttcactgcagtcctcacagggaagctccgtggacgctggatgtgggacaggctcatccggctcggcctgcgccacccctgtggaatcaccactgtgcccatcactcggaaagcacctgattccagatgcttctgggaaaggggtaaactacatccccagtgaggagcgagcccccggtctacccaatcatggcgcaacctttaaagagcttcatcctcagacagaaggcatgtgcccgaggatgactgtgccagccctccataccgctatcaatacagaaccactgtttggcacactgcgggacggctgccatcgattgccaaagattaaagagactaccgtctag

SEQ ID NO: 187741 - DNA, 3942 bp, Artificial Sequence
  Description of Artificial Sequence: Synthetic coding sequence
aagagccacagcccccaccggaccaagagcagcggctggccccccccttctgggacttgggggttgagccaagtgccaccgtacggctgggagatgacagcaaatcgggatgggagggactatttcattaatcacatgacacaagctattcccttcgatgaccctcgactggagagttgccagattattccaccggcacctaggaaagtggagatgaggagggacccagtgcttggatttggctttgtggccggctcggagaaacctgtagtggtccggagtgtcacaccaggcggtccgtcggaaggaaagcttatcccgggggaccagatcgtcatgatcaatgatgagcccgtgtctgctgcccccagggagagggtcattgatctcgtacgaagttgcaaagagagcatcctcctcaccgtgattcagccttatccatctcctaagtccgcctttatctctgctgccaagaaggccagactcaaatccaatcccgttaaggtgagatttagcgaggaagtgattatcaatggacaagtcagtgagaccgtcaaagacaacagcttgctttttatgccaaatgtgctgaaggtgtacctcgagaacgggcaaacaaaaagctttcggtttgattgttccacttcgatcaaggatgtaatccttacactgcaggaaaagctctcaataaaaggaatcgaacacttctccctaatgctcgagcagagaactgagggcgccggaacaaagttactattactccatgaacaggagacactgactcaggtgactcagcgaccgtcatctcacaagatgagatgcctgttccgtatcagctttgttcccaaggatcctatcgatcttctccgcagagatccagtggcatttgaatatctgtacgtacagagctgcaatgatgtggtccaggaaaggttcggcccggaacttaagtacgatattgctctccgcctggccgcgttacaaatgtatatcgctacggtcactactaagcagactcagaagatctccctgaagtacattgaaaaggaatggggcttggagacatttctaccctccgccgtattacagagtatgaaggaaaaaaatattaagaaggccttgagccatctggtgaaagccaaccagaacctggtcccaccaggtaagaagttaagcgcccttcaagcgaaagttcactatttgaagtttctgtctgatcttcgcctgtacggcggacgcgttttcaaagcgacacttgtgcaagccgagaaacgcagcgaggtgactctgctggtcgggccacggtacgggattagccacgttatcaacaccaaaaccaaccttgtggcattgctggcagattttagccacgtcaacaggattgaaatgttctcagaggaggaatctctggttcgtgttgaacttcatgtcctggacgtgaaaccaattacgctactgatggaaagtagtgacgcaatgaacctcgcctgtttaactgcgggctactatcggctgttagtggactcccggaggtcgattttcaacatggctaataagaaaaacacggcgacacaggaaacaggtcccgagaacaaaggaaaacacaatctgctggggccagattggaactgtatcccacagatgactaccttcatcggcgaaggagagcaagaggcgcagattacctacatcgactctaagcagaaaacagtagagattactgatagcacaatgtgtcctaaagaacataggcacctgtacatcgataacgcctactcatccgatggtcttaatcagcaattatcacaaccaggggaggcaccgtgtgaggcggattatcgatctctggctcaacgaagcctcctaacactgtcgggacccgaaactctgaagaaggcccaagagtcccctcgcggtgccaaggtaagctttatctttggagatttcgccttggacgatggtatctccccaccaaccctcggatacgagacgctgctggatgaagggccggagatgttggaaaagcagcgaaacctgtacataggcagcgccaatgatatgaaggggctagatttgacccccgaagctgaagggatacagtttgtggaaaactccgtgtatgcaaacatcggagatgtcaaatccttccaggccgctgaaggcattgaagaacctttactgcatgacatatgttacgccgaaaacacagacgatgccgaagacgaggacgaggtgtcttgcgaggaagacttagtggtgggagagatgaaccaaccagcaatcctcaacctgagcgggtccagcgacgacatcatcgatcttacaagcctacccccccctgaaggagacgacaatgaagatgacttcctcctccgtagtctaaacatggccatcgccgcccccccgcctggctttagagacagctcagacgaggaagattcacagtcccaggccgcatcctttcctgaagacaaggaaaaaggaagcagtctgcaaaatgacgagattcctgtgtcccttatcgatgcagtgcccacaagcgctgagggtaaatgtgaaaaaggacttgataatgctgttgtttcaaccctgggcgctctagaggcattgtccgtcagtgaagaacagcaaacgtccgataacagcggcgtggccatactcagagcctattctccagaatctagctcagatagcggaaacgagactaattcttctgaaatgaccgaatcaagcgaactggccaccgcgcagaaacaaagtgaaaatctctctagaatgttcttggccactcacgagggatatcaccctctggccgaagaacagactgagttccccgctagcaagacacctgccggggggctgccaccgaaatcctctcacgccttagccgctagacctgcgacagaccttcccccgaaggtggtgccaagcaaacaactgctgcatagcgaccatatggaaatggagccagaaaccatggagacaaagtctgtgactgattacttcagtaagctgcacatgggctccgtcgcatacagttgtacttctaaaagaaagtctaagctcgcagatggagaaggtaaggcacctccaaacggaaatacaaccggaaaaaagcaacagggaaccaaaaccgctgaaatggaagaggaggcctcagggaagttcgggacggtgagcagtagggactcacagcatttgtctacctttaatctggagcgcaccgctttccgaaaggatagtcagcggtggtacgttgccacggaggggggcatggccgaaaagtctggacttgaggcagctacaggtaagacttttccccgggcttctggtctcggagcaagggaggccgaggggaaggaggagggtgctcccgacggagagacatcagacgggtccgggctgggccagggagacaggtttctcacggatgtgacctgtgcaagctccgctaaagacctggacaaccctgaagacgcggattctagcacatgtgatcacccttctaagctaccagaggccgatgagagtgtggcacggttgtgcgattatcacctggctaagcgcatgtcgtctctgcagtcggaaggccatttctcactgcagtcatctcagggctcctccgtggatgcagggtgtggaaccggctctagtgggtccgcctgcgctacccccgtagagagcccactgtgccctagtctggggaagcaccttatcccagacgcttcaggaaaaggggtgaattatatcccatcggaggagcgagccccaggcctgcccaatcacggtgctaccttcaaggaattgcacccacagacagagggcatgtgtccacgcatgaccgttccagcattgcacacggctataaatacagagcctcttttcggtactctgagggatggctgccatagactgccgaaaattaaggaaaccacgggctag

SEQ ID NO: 187742 - DNA, 1794 bp, Artificial Sequence
  Description of Artificial Sequence: Synthetic coding sequence
atgttcgccagctgccactgcgtgccccggggccggcggaccatgaaaatgattcactttcggagcagcagtgtcaagtctctgtcccaagaaatgagatgtacaatcaggcttctcgacgactccgagatcagttgtcatattcaaagggagaccaaaggtcagttcctgatcgaccacatttgtaattactacagtctgctggaaaaggattactttggcataagatatgtggaccccgagaagcagcgtcattggctagaaccaaacaagagcatctttaaacagatgaagacacatcctccatacaccatgtgtttcagagtcaaattttatccacacgaacctctcaaaatcaaggaagagctcaccagatacctgttatatcttcagatcaagcgagacatctttcacggtcgacttttgtgcagtttcagtgacgcagcataccttggcgcttgtatcgtccaggctgaattaggcgactatgatcctgacgaacaccctgaaaactacatttctgagtttgaaatatttccaaagcagagtcaaaaactggagcgtaaaatagtggaaattcacaaaaacgagctccggggccaatctccaccggtggctgaattcaacctattgctcaaagctcataccttggaaacctacggggtggacccacatccatgtaaagatagcacggggacgaccacattcctcggctttactgccgccggattcgttgtgttccagggcaacaaacgcatccacctgattaaatggcccgacgtctgcaaactcaagttcgagggtaaaacattctatgtgatcggcacccagaaggaaaagaaggcaatgttagccttccatacgagtacgccagccgcctgcaagcacctgtggaaatgcggagtcgagaatcaagcattctataagtacgctaagagctcacaaataaaaacagtgtctagttcaaagattttctttaagggctctagatttaggtatagcggcaaagtagctaaagaggtggtggaggcatcctccaaaatccagcgggagccacccgaggtacatcgagcaaacattactcaatcgaggtccagccactctctgaataaacagctcattattaatatggaaccccttcagccattactgccaagcccaagcgagcaagaagaggaactacctctcggggagggagtacctctgccaaaggaagagaacatatccgcccccctcatcagctccagcccagttaaagccgcgcgtgagtacgaagaccctccatcggaggaagaagataagataaaagaggagccactgaccatatccgagctagtgtacaatcctagtgcttccttgctgccaacgcctgtagacgatgacgagattgacatgttattcgactgccctagtcgcctcgagctggagcgggaagataccgattcatttgaagatttggaagccgatgaaaacgcttttttgatcgctgaagaagaagaactgaaggaggctcgacgggccctctcttggtcgtatgatatactaaccgggcacattcgggtcaatccgctcgtcaagagtttcagtcggttgctggtcgtgggcctcgggctgctattgtttgttttcccacttttgctgctgcttctggagtctggcatagacttatcatttctctgcgagatcagacaaacccccgagtttgaacaatttcactatgagtactactgcccacttaaagaatgggtcgccgggaaagttcatttgatcctgtatatgctcggttgttcttag

SEQ ID NO: 187743 - DNA, 642 bp, Artificial Sequence
  Description of Artificial Sequence: Synthetic coding sequence
atgcaggccgaggagaccaagggcatcggcatcaccagcatggccaagtgcctggttaagatccaaactagacgatctctccaattgcatatggtcaaccactgtaacagtaatgtcttcgtccgtctgctgcggttgggcagtaaagtgaccgcccggaatactggcgtacccctgcccaaggaggaaaacatttcagccccgttgattagttcttctccagtgaaagcagcccgagaatacgaggatcccccaagcgaagaagaggataagataaaagaagaacccctgactatttccgagttagtatataacccttctgcaagcctgcttcccacacccgttgacgatgatgaaatcgatatgctttttgattgcccctctagactcgaattggaacgtgaagacactgactcttttgaggatctggaagctgatgagaacgccttcctaattgccgaagaagaggaactgaaggaggcccgtagagctctgtcgtggtcctacgatattctaacgggacacataagggtaaatccgttggtgaagtccttttccaggctgctagtggtcgggttggggcttcttctttttgtgtttcccctgctcttgctgctgttggaatccgtgtccatgcaatag

SEQ ID NO: 187744 - DNA, 804 bp, Artificial Sequence
  Description of Artificial Sequence: Synthetic coding sequence
atgtgcttccgggtgaagttctacccccacgagcccctgaagatcaaggaggagctgacccgttatctattgtacctgcaaataaaaagagatatatttcacgggaggctcctgtgctccttctctgatgcagcctacctgggcgcctgtattgtccaggcggagctcggggactatgatcccgatgagcacccggaaaattatattagtgagtttgagattttccccaagcagtcccagaaactggagcgcaagatagtggagattcataaaaatgagctgagaggacagagcccgcccgttgcagagttcaacctgctgctgaaggcccacacattggagacctacggggttgatccccatccttgtaaagacagcactggaaccacgacgtttctgggatttacagccgccggattcgttgtcttccaggggaacaaacgaattcacctgattaaatggcccgacgtgtgcaagttgaaatttgagggcaaaaccttctatgtgatcggcacacagaaggagaaaaaagctatgctggccttccatacatcgacacccgctgcctgtaaacatttatggaaatgcggcgtggaaaatcaggccttctataagtatgccaagagctctcagataaaaacggtgtcctcgagtaagatcttcttcaaaggtagtaggtttcggtacagcggaaaagtggctaaagaggtggtggaggcttcctcaaagatccagcgagagccgccagaagtgcatcggtgcgttcaaaagaaaatctgttcatgctttggggttacgtggtag

SEQ ID NO: 187745 - DNA, 1089 bp, Artificial Sequence
  Description of Artificial Sequence: Synthetic coding sequence
atggtgttccggcggggccagagcccccccgtggccgagttcaacctgttgctaaaagcccacacgctggagacgtacggtgtggatccccatccctgtaaggattctaccgggactacaaccttcctggggttcacagccgcaggcttcgttgtctttcaggggaacaaacggatccatctgatcaagtggccagatgtctgcaagctcaagtttgagggcaagactttttacgtgatcggtacgcaaaaggagaaaaaggccatgttggcattccacacaagcaccccagccgcctgtaaacatttatggaaatgcggggtggagaatcaggcattctataagtatgccaagtccagtcagataaagacggtgagttctagcaaaatcttctttaagggcagcaggtttaggtacagcggcaaagtcgccaaagaggtggtagaggccagcagtaagatccagcgggagccacctgaagtccatagagccaatattactcagagtcgttcaagccactccctcaataagcagctcatcattaatatggagccactgcagccattgcttccatcgccttccgaacaggaagaagaacttcccctgggtgaaggggtcccattaccgaaggaggagaacatctccgccccactcatcagcagcagccctgtgaaagctgcccgcgagtacgaagaccctccatcggaggaggaggacaagatcaaggaagaaccactgactatttccgagcttgtttataacccttccgctagccttctgccgacaccagtggacgacgacgagatcgatatgctgtttgattgcccttctcgacttgagctagaacgcgaggataccgattctttcgaagatctagaggccgacgagaacgcctttctgatcgccgaggaggaggaattgaaggaagcaagacgggccctcagttggtcttatgatatacttaccggccacatcagagttaatcctttggtcaagagcttttccaggctgctggttgtcgggctgggcctgttattgttcgtgtttcccctgctgttgttgctgctggagtccgtgtcaatgcagtag

SEQ ID NO: 187746 - DNA, 1671 bp, Artificial Sequence
  Description of Artificial Sequence: Synthetic coding sequence
atgttcgccagctgccactgcgtgccccggggccggcggaccatgaaaatgatacactttaggtcctcctcagttaaaagccttagccaagagatgaggtgtactattcgcctgctggatgatagtgaaatatcttgccatattcaaagagaaacaaagggccagtttctcattgatcacatttgcaattactatagtttattagaaaaagattattttggaattcggtacgtagatcctgagaaacaaagacactggctcgagcccaataagtctatcttcaagcaaatgaaaacacaccccccctacacaatgtgctttagggtgaagttttatccccatgagcccctcaaaatcaaggaggaactgactcgctatcttttgtacctgcagatcaagcgcgacattttccacggaaggctgctatgtagcttcagcgacgcagcctatctcggtgcttgtattgtgcaggcagagctgggggattacgatcctgatgaacaccccgaaaactacatcagcgagtttgaaatctttcctaagcagtcccaaaagctggagcgcaagatagttgagatccacaagaacgagcttcgagggcagagtcctcccgtagctgaattcaatcttctccttaaggcacatacacttgaaacctatggggtcgacccacacccttgcaaagattcaaccggaaccacgacctttctgggattcaccgccgccggattcgtggtcttccaaggcaacaagaggatccacctgatcaagtggccagatgtgtgtaaactgaaatttgagggcaaaaccttttacgtcatcggaacacagaaagagaaaaaggccatgctggcattccacacctctacacccgctgcctgtaagcacctgtggaaatgcggcgtggagaatcaagcattttacaaatacgctaaaagttcccagataaagactgtgtctagctccaagatctttttcaaagggtcacgattccgctactccggaaaggtggcgaaggaagttgtagaagcttctagcaaaatccagcgcgaacctcccgaggtacaccgcgcaaacattactcagagccgaagcagccattcattaaataagcagctgataatcaacatggaacctctgcaacctttattaccttctcctagtgagcaagaagaagaattgccccttggagaaggggttccactgccgaaggaggagaatatctccgctccgctgatctcaagttcccccgttaaagccgcccgagagtacgaggaccctccatccgaggaggaggacaaaatcaaggaggagcctctaacaatttcagaacttgtgtataatccatccgcctcgctgctgcccacacctgtggatgacgatgagatcgacatgctcttcgactgtccgtcccgtctggagctagaaagggaagacacggacagttttgaggatctggaggccgacgagaatgctttcctgatcgctgaggaggaggagctgaaagaggcgagaagggccctctcctggtcatatgacattcttacagggcacatcagagtaaaccccctagtaaagtcattctccaggttgctggtggtgggcctgggcctgctgctttttgtgttcccactcctgctcttactgctagagtcggtgtctatgcagtag

SEQ ID NO: 187747 - DNA, 423 bp, Artificial Sequence
  Description of Artificial Sequence: Synthetic coding sequence
ggcaccaccaccttcctgggcttcaccgccgccggcttcgtggtgtttcaaggcaataaaagaatccacctgatcaaatggcctgacgtatgtaaactgaaatttgagggaaagactttttacgtaatcgggacgcagaaggagaagaaagccatgctggccttccacacttctactcctgctgcctgcaagcatctctggaaatgtggggtcgaaaatcaggccttttacaagtacgcaaaatccagccagattaaaacagtgagctcctcaaagattttcttcaagggctctagatttcggtactccggtaaggttgccaaggaggtggtggaagccagtagcaagattcagagagaaccgcctgaggttcaccgctgtgttcagaaaaagatttgctcttgttttggggtaacttggtag

SEQ ID NO: 187748 - DNA, 2145 bp, Artificial Sequence
  Description of Artificial Sequence: Synthetic coding sequence
atgctgcacctgaaggtgcagttcctggacgacagccagaagatcttcgtcgtcgaccagaagagctctggaaaggcactgtttaatctcagctgcagtcacttgaacctcgcagaaaaggagtatttcggcttagaattttgtagccattctggaaacaatgtctggcttgagttgctgaagcctattactaaacaggtgaagaacccgaaggaaattgtgtttaagtttatggtgaaattctttccggtagacccgggccacctgagggaagaattgacacgctatctattcacgctgcagatcaagaaagacctggctctcggacgcctaccctgtagtgacaattgtacagcactgatggtctcccacattctgcaatctgagctgggggactttcacgaggagacggaccgtaaacacttagcccaaacccgctacctgcccaatcaggattgtctcgagggcaaaatcatgcacttccaccagaagcacatcggccgatctcccgccgaatccgacattctgctcctggacatcgcgcgaaagctggacatgtatggaatccgacctcatcctgcgtccgacggggagggaatgcagatacacttggcagtggcccacatgggagtcttggtgctgcgcggcaacacgaaaatcaatacattcaattgggccaaaattagaaagctgtcttttaagcgcaaacatttcctaattaagctccacgctaacattctagttctgtgcaaggacactctggaatttacgatggccagtcgcgacgcgtgtaaggctttctggaagacatgtgtggaatatcacgcctttttccgcttatctgaggagcccaaatcgaaaccaaagaccctgctctgtagcaagggctctagtttcaggtacagcgggagaacacaacgccagcttcttgaatacggcagaaaaggtcggctcaaaagcctgcccttcgagcggaaacactacccaagccagtaccacgagcggcagtgtcgaagctcccccgatctgctgtcggacgtgagcaagcaggtggaagacttgagactggcctatggaggcggatattaccagaacgttaacggtgtacacgccagcgagcctgtccttgagtccagacgacgtaactccgccctcgaagtaactttcgcgactgaactggaacactcaaagccagaggcagatccaacgctcctgcatcagtcccagtcatcgtccagttttccattcatttatatggatcccgtgttcaacaccgaacctaatcccaatccggatcccagggacatattttccgagcgctctagtctgagctcattccaaacgtcctgcaagtttagcggaaatcatatgtctatctactcagggctcaccagcaaggtaagaccagctaagcagctcacatacactgatgtgccctacatcccctgtacaggacaacaagtgggcataatgcccccccaggtgttcttctatgtagacaagcctccccaagtacctcgctggagtccaatacgcgccgaagaacgtacctccccacactcatatgtggagccaaccgcgatgaaaccagccgaaaggagcccaaggaacatcaggatgaagtcattccagcaggaccttcaggtgctgcaggaggcaattgcccggacctccggaagatctaacattaatgtagggttggaggaagaagaccctaacctggaagacgcattcgtatgcaacatccaggagcagacccccaaaaggagccagagccagtcggatatgaagaccatccgttttccctttgggtctgagtttagacctttgggcccatgtcctgccctttcacacaaggccgatctgttcacagacatgttcgccgagcaggaactgcccgccgttctgatggatcagtccactgccgagagatatgtggcttccgagagcagcgattcagagtctgagatcctgaaacccgattattacgccctttatgggaaagaaatcagaagtcctatggcccgaatacggttaagttcagggagcctgcaactggacgaggaggatgaagacgcctactttaacaccccaactgctgaggatcgcacatctctgaagccatgcaattactttctagcatag

SEQ ID NO: 187749 - DNA, 1785 bp, Artificial Sequence
  Description of Artificial Sequence: Synthetic coding sequence
atggtgagccacatcctgcagagcgagctgggcgacttccacgaggagaccgatcggaagcacctggcccagacccgttacttgccaaaccaggactgcctcgaaggcaagattatgcatttccaccagaaacacatcggtcgatcacccgcggagagcgatattctgctgttagatatcgcaaggaaactggacatgtatggaatccgaccccaccccgccagcgatggcgagggtatgcaaatccacctcgctgtcgcacatatgggcgtgctggtgctccgcggcaacactaagatcaacacatttaattgggcgaaaatccgcaagctttcgtttaaacggaagcacttcctcattaaactacacgcaaacattttagtgctgtgtaaggacactttggagttcaccatggccagcagagatgcatgcaaggctttctggaagacgtgtgttgagtaccatgcattcttccgtttgagcgaggagccaaaatccaagccgaaaaccctgctctgctcaaagggtagctcctttcgctattctgggagaactcagagacaacttttggagtacgggaggaaaggcaggctgaaatcactgccttttgagagaaagcattacccgtctcagtatcatgagagacagtgcaggagctctcccgacctcttgagtgacgtttctaagcaagtcgaagacttaaggctcgcctatggcggaggatactatcaaaacgtgaacggtgttcatgcctccgaaccagttttagagtcccgtcggcggaattccgctctggaggtcacatttgcgactgagcttgaacatagtaagcctgaggctgatcctacacttctgcatcagtcacagagctcttccagcttcccattcatttatatggatccagtgttcaatacggagcctaatcctaatcccgacccgagggacatcttttccgagcgtagctcacttagtagctttcagaccagttgcaaatttagcggaaaccacatgagcatctactctggccttacctccaaggttcgcccagccaagcagcttacatatacagatgtcccctacattccatgtactggacaacaggtcgggataatgcccccccaagtgtttttctatgtggacaaaccaccccaagtgccgcgctggtctccaattcgggcagaagaacgcacttcccctcactcctatgtggaacccaccgccatgaagcctgcagagaggagcccccggaacattcggatgaagagctttcaacaggacctgcaagtcctgcaggaggctatcgcccgtacctctggccgatccaatatcaatgttggtctggaggaagaagacccgaatctcgaggatgcctttgtgtgtaatatccaagagcagacgccgaagagatcccagagccagtctgatatgaagacaatccgtttccccttcgggtctgagttcaggccattgggcccctgccccgcactcagtcataaagcagatttgtttacagacatgtttgctgagcaggaactgcctgctgtcttgatggatcagagcaccgcggagcgctatgtggcatcggagtcatcggattccgagtctgaaatactgaaacccgactattatgcgctgtatggcaaggaaatacgatctcctatggctagaatccggctaagcagcggaagcttgcagttagacgaggaagacgaagatgcatactttaacactccgaccgccgaagaccggactagcctgaagccatgcaattattttctggcctag

SEQ ID NO: 187750 - DNA, 2043 bp, Artificial Sequence
  Description of Artificial Sequence: Synthetic coding sequence
atggccctggacggcatccggatgcccgacggctgctacgccgacggaacctgggagctgtccgtgcacgtgacagatctgaaccgcgatgtgaccctgcgggtcacaggggaagtgcatattggcggagtcatgctaaagctggttgagaaactggacgtaaagaaagattggtctgatcacgcattatggtgggagaaaaagcgaacctggttgttaaagactcattggaccctggacaaatatggtattcaggctgacgcaaaactgcagttcactcctcagcataagctgctgagactgcagttaccaaatatgaaatatgtaaaggttaaggttaacttctctgatcgggtctttaaggctgtttcggacatttgcaagaccttcaacatccgccaccctgaggagctgtcgttgcttaagaaacccagggatccgacaaaaaaaaaaaagaagaagctggatgaccagtctgaggacgaagccctggagttggaaggccctctgatcacacctgggtctggttctatttattcctctcctggtttgtactccaaaaccatgacaccgacctacgatgctcacgacggatcaccactgtcacccacctcggcctggttcggtgactctgccctatcagaagggaatcctggcattctcgcggtcagtcaacccattaccagccccgaaatcctggctaaaatgttcaaaccccaggccttgctggacaaggctaagatcaatcagggctggttggattcatccaggtcattgatggagcaagacgtaaaggagaacgaggcactgttgcttaggtttaagtattattcattcttcgatctcaatccaaaatatgatgcaatacggatcaaccagctctacgagcaggctaaatgggccatcctgctcgaggagatagaatgtactgaggaggaaatgatgatgttcgcggccctccagtaccatattaacaaactgagtatcatgacttcggagaatcacctgaataacagcgacaaggaggtagacgaggtggacgccgcacttagcgatttagagatcactctcgaaggagggaaaacttctaccatacttggggacattacaagcattccagaactggccgactatataaaggtgtttaaacccaagaagctgaccttgaagggttacaagcaatattggtgcaccttcaaagacactagcatatcctgctacaagtctaaagaagagagctccggtactcccgcccaccagatgaatctgaggggctgtgaggtcacacctgacgtcaatatcagcgggcaaaaattcaacattaaactcttaattcctgtcgccgagggtatgaatgagatatggttgcggtgtgataacgagaagcagtacgctcattggatggctgcctgcaggcttgcttcgaagggcaagactatggcagacagcagttacaatctcgaggttcagaacatcctcagctttttgaagatgcaacatctcaatcccgatccccaacttatcccggagcaaataacaactgatattaccccagaatgcttggtttccccccggtatctgaaaaagtacaaaaataagcagatcaccgctcgaatcctcgaggctcaccagaatgtagcgcagatgagcctcatagaggcaaaaatgcgcttcatacaagcctggcagtcgttgcctgaatttggcataacccacttcatcgcccggttccagggcgggaaaaaagaagaattaatcggaattgcatacaaccgtcttatccgcatggatgccagtacgggcgacgcaatcaaaacgtggaggttctccaatatgaaacagtggaatgtgaactgggagatcaaaatggtcaccgtcgaattcgcagacgaggttaggttgtctttcatttgcaccgaagtggactgtaaggtcgtgcacgagtttatcgggggatatattttcctgtctacgcgggccaaggaccagaatgaatccctggatgaggaaatgttctataaactgacctctgggtgggtctag

SEQ ID NO: 187751 - DNA, 2064 bp, Artificial Sequence
  Description of Artificial Sequence: Synthetic coding sequence
atggccctggacggcatccggatgcccgacggctgctacgccgacgggacgtgggagctttccgtgcatgtcactgatctgaatcgggatgtgactctccgggtgacgggcgaagtccacataggcggcgtaatgctgaagctggtagagaaactggacgtgaaaaaagattggtctgatcacgctctgtggtgggagaagaagcgcacctggctgctgaaaacacactggacattagacaagtacggaatccaagccgacgctaagcttcagtttactcctcagcacaagttactgaggctgcaactgccgaacatgaagtacgtgaaagtgaaggtgaacttcagcgaccgagtctttaaagcggttagcgatatctgcaagaccttcaatattcggcacccggaggagctttcgttactcaaaaagccacgggatcccacgaaaaagaagaagaaaaagctcgatgaccagtccgaggatgaggccctggaactggagggaccccttattacccccggctctggttcaatctactcgtcccccggcctttattctaagacaatgacaccaacctacgacgcccatgatggctctcccctgagtccaacatctgcctggtttggtgattctgctttgtcagagggaaatcccggaattctggcggtgagccagcctattacaagccccgagatcttggcaaagatgttcaagccacaggctcttctggataaggctaaaatcaaccaggggtggctggatagcagcaggagcctgatggaacaagacgtgaaggagaatgaagccctgctgctgcggtttaagtattatagcttttttgaccttaacccgaagtatgacgccatccgcattaaccaactctacgagcaggccaagtgggcaatcctcctggaggaaatcgagtgtacagaggaggagatgatgatgtttgccgccctgcagtaccacataaacaaactgtccatcatgacctccgagaatcacttgaataactctgataaagaggtcgatgaagtagatgccgcccttagcgacctagaaataaccctcgagggtggcaagacaagcacgatcctgggggatattacttccatcccagagttggccgattatatcaaggtgtttaagcccaaaaagttgactctgaaaggttacaaacaatactggtgcacttttaaagataccagcattagctgttataaaagcaaggaggagtcttccggcacgcctgcccaccagatgaatctacgtggttgcgaggtcaccccggatgtgaatataagcggtcagaaatttaacattaagctgctgattccagtggccgaggggatgaatgagatctggctgcgctgcgacaacgaaaagcagtatgcccattggatggcagcatgtcgacttgccagtaagggtaaaactatggccgattccagctacaatttagaggtgcagaatattttgagcttcctgaagatgcagcacctgaatccagacccacagctcattccagagcagataactacggatattactcccgagtgcctggtgtccccgaggtacctgaagaaatataaaaataaacagccaggatacatccgggacttgatcaccgcccgcatcctagaggcacaccaaaatgtcgcccaaatgagcctgatcgaagcgaagatgaggtttattcaggcgtggcagtcgctccctgaatttggtattacccatttcatcgctaggttccagggcgggaaaaaggaagagctgatcggcatagcttacaaccggctgattagaatggacgcttcgaccggagatgcgattaagacctggagattttctaacatgaaacaatggaatgttaactgggagataaagatggtgacagttgaattcgccgatgaggtacggctgagttttatctgcactgaggtggattgtaaagttgtgcatgaattcatcggtggttacattttcctgagcacaagggccaaggaccagaatgaatcattggatgaggagatgttttataagctgacctcaggttgggtatag

SEQ ID NO: 187752 - DNA, 2043 bp, Artificial Sequence
  Description of Artificial Sequence: Synthetic coding sequence
atggccctggacggcatccggatgcccgacggctgctacgccgacggcacttgggagcttagcgttcacgtgaccgacctgaaccgggatgtgacattgcgcgtgaccggagaggtgcatatcgggggggtgatgctgaagctggtcgaaaagctggacgtgaagaaagactggtccgatcacgctctatggtgggagaaaaaaaggacttggctgctcaaaacgcattggaccctggacaaatatgggattcaagccgacgcaaagctccaatttaccccccagcataagttattaagacttcaactccctaacatgaaatatgtcaaggtgaaggtcaacttcagcgaccgcgtgtttaaagctgtgagtgacatatgtaagacgtttaatatcagacaccccgaagaactaagtctcttaaagaagcctcgcgatccaacaaaaaagaagaaaaagaaactcgacgatcagagcgaggacgaggccttagagctggaaggccctctaattacgccaggctccggcagcatctactcatctccgggactgtattcaaagactatgactcccacatacgacgcccacgatggatctccattgagccccaccagcgcatggttcggagattcagccctcagtgagggaaatcccggcatactcgctgtttctcagcccataacatcccctgagatccttgcaaagatgtttaaaccacaggctctgctggacaaggcaaagatcaaccaggggtggctggactctagccggagcctgatggagcaggatgtgaaagagaacgaggccctcctgctccggttcaaatactactcgtttttcgatttgaatcccaaatacgacgcgattagaattaatcagctgtacgagcaggccaaatgggctatactgttagaagaaatcgaatgcacagaagaggagatgatgatgtttgccgcactgcaatatcatattaataaattgagtattatgacctccgaaaaccacctgaacaactcagacaaagaggtggacgaggtcgacgctgcactctccgacctggaaataacactcgaaggcggcaagacatcgactatcctgggtgatatcacgtcaatcccggagctcgccgactatatcaaggtgttcaagcccaagaagcttacacttaagggctataagcagtactggtgtacttttaaagacacatccatcagctgctataagtcgaaggaggagtcttcagggacacctgcgcatcagatgaatttgcgcggatgcgaagtcaccccggacgttaacattagcggtcaaaaatttaacattaagctcctcattcccgtcgctgaaggaatgaacgagatctggttgcgttgcgacaacgagaaacaatacgctcattggatggctgcatgtagattggcctctaagggcaaaacaatggccgactcttcctataatttagaggtacaaaatatcctgtctttcttgaaaatgcagcacttaaatcccgacccccagctgataccagaacagattaccactgatattaccccagagtgtctggtgagtccaagatatctaaagaaatataagaacaagcagataacagccaggatcttagaagcacaccagaacgtggcgcaaatgagtcttatcgaagccaagatgcggttcatccaagcatggcagagcctcccggaattcgggatcacccacttcattgctcgtttccagggtggaaagaaggaggagctgatcggcatcgcttataatcgcctgatcaggatggacgcatcgactggagacgccatcaaaacctggcggttcagtaacatgaagcagtggaatgtcaattgggaaattaaaatggttacagtggagttcgcagacgaggtccggttgagctttatttgcaccgaggttgactgcaaggtagtgcacgaatttattggaggctatatatttctgagcacaagggccaaggaccagaatgagtcccttgatgaagaaatgttttacaaattgacctcgggctgggtgtag

SEQ ID NO: 187753 - DNA, 1902 bp, Artificial Sequence
  Description of Artificial Sequence: Synthetic coding sequence
atggccctggacggcatccggatgcccgacggctgctacgccgacggtacctgggagctgtcagtgcatgtaacggacctgaaccgcgatgtgactcttcgagttacgggcgaagtgcatatcggaggagttatgctcaagctggtcgaaaaactggacgtgaagaaagactggagcgaccatgccctgtggtgggagaagaaacgtacatggctcctgaagactcattggacccttgataagtacggtatacaggcagacgctaaactgcaattcacaccgcagcacaaactcttgcgcttgcaactgcctaatatgaaatatgttaaggtcaaggttaattttagcgatagagtgtttaaggctgtgtcagacatatgtaaaacatttaacatccgacatcctgaggaactcagtctgcttaagaaaccaagagaccctaccaaaaaaaaaaaaaaaaaacttgacgatcaaagcgaggacgaggccctcgagcttgaggggcccctcattactcctggcagcggcagcatttactcctcgcctggcctttatagcaagactatgactcctacctacgatgcacacgatggttcacctctgagccccacgtcagcctggtttggtgacagcgctttaagtgagggtaaccccggtatcctggctgtcagccagcctattaccagccctgaaattcttgctaaaatgttcaagccacaagcactgctagataaggccaaaattaatcaaggttggctggattcatcccgatcattaatggagcaggatgtaaaggagaacgaagcgttactgttgcgattcaagtattacagcttcttcgatcttaatcccaagtacgacgcaattaggattaaccaattgtatgaacaggcgaagtgggccatccttttggaagagatcgagtgtacggaagaagaaatgatgatgttcgcagcgctccaatatcatattaacaaactgtccatcatgacaagcgaaaatcacctgaacaactcagataaagaggtagacgaggtcgatgccgctctgtcagatctggaaattactttggagggcgggaaaacgagtaccattctgggtgatataacgtccattccggaacttgcagattatatcaaagtgtttaagcccaaaaaacttacactaaagggctacaagcaatactggtgtaccttcaaagatacatcaatcagctgctataaaagcaaagaagagagttccggcaccccagcgcatcagatgaatctcaggggttgcgaggtcacccccgatgtgaatatcagcggtcagaaatttaacatcaaattgctgatacccgtcgctgaagggatgaacgagatctggttaagatgcgataacgaaaaacagtacgcacactggatggcagcttgccggctggcatccaagggcaaaacaatggcggatagttcttacaatcttgaggtgcaaaacatactgtctttcttaaagatgcaacatctgaatccggatccacaactgattcccgagcaaatcacaacagacatcacaccggaatgtctcgtctctcccaggtacctcaaaaagtacaaaaacaagcagccagggtacattcgggacctaatcacagctagaatcttggaagcacaccagaatgtggctcaaatgagtctcattgaagcaaagatgcggttcattcaagcctggcagagcctacccgagttcgggatcactcatttcattgccaggttccagggtggcaagaaggaagagctgattgggatcgcctacaaccgtttgattcggatggacgcgtccactggagacgccattaagacttggaggttttcgaatatgaagcaatggaatgttaactgggagatcaaaatggtgaattcttag

SEQ ID NO: 187754 - DNA, 2064 bp, Artificial Sequence
  Description of Artificial Sequence: Synthetic coding sequence
atggccctggacggcatccggatgcccgacggctgctacgccgacggcacctgggagctgtcagtccacgtgaccgacctgaaccgggatgtgaccctgcgcgtgacgggcgaagtgcacataggaggcgtcatgttaaagctggtcgaaaaactcgatgtgaagaaggactggagtgaccacgccctttggtgggagaaaaagcggacttggcttctcaagacgcactggacgctagataagtacggcattcaggctgacgcaaagctgcagttcactcctcagcacaaattgttgcgcttgcagctgcctaacatgaagtacgttaaggtgaaagtcaactttagcgatcgcgtttttaaagccgtaagtgatatttgtaagactttcaatataaggcacccagaggaactgtcccttcttaagaaaccaagggatcctaccaagaaaaaaaaaaagaagctggacgaccagagtgaagatgaagctttggagctggaagggcccctgataacaccgggtagcggatccatctatagcagcccaggactgtatagtaaaaccatgactcctacttacgatgcccatgatggctctcccctatcccccacgtcagcttggtttggagatagcgccctgtccgagggaaatcccggcatccttgcagtctctcaaccaattacgtcgcctgagattctggccaagatgttcaagccgcaagcactgctggacaaggccaagatcaatcagggttggctcgacagcagcagaagcctcatggaacaagacgttaaagagaacgaggccctgttgcttaggtttaagtactactctttctttgatctgaacccaaaatacgatgctattagaattaatcaactgtacgagcaggctaaatgggcaatcctactcgaggaaatcgaatgtactgaagaggagatgatgatgtttgctgcattgcaataccatatcaacaaacttagtattatgacttcagagaaccatctcaacaacagtgacaaagaagttgatgaggtggacgccgccctgagtgacctcgagattacgctcgaaggtggaaagacatcaacaatattgggtgacattacatcaatcccagaattagcagattatattaaggtctttaagcccaaaaaacttaccctgaaaggctataaacaatactggtgtacattcaaagacacaagcatttcctgttacaagtccaaggaggagtcctctggtactcccgcccatcaaatgaacttacgcggttgcgaggtgactccagacgtcaatatctccggacagaagtttaatatcaagttgctcattccggtggctgagggaatgaatgagatctggctcaggtgtgacaacgagaagcagtacgcgcattggatggcagcgtgtagactggctagtaagggcaagaccatggccgactcgagctataacttagaggtacaaaatatcttgtcttttctcaagatgcaacatctcaatccagatccccagctgatccctgagcagatcacaactgatataacccccgagtgtctagtaagcccccgctacttaaaaaaatacaagaataaacagcccggctatattcgggacctgatcacagccaggattttggaggcacaccagaacgtggcccaaatgtctctgattgaagctaagatgaggtttattcaggcctggcagtctctgccagaattcgggattacacacttcatcgcccgctttcaaggcggaaagaaagaagaattaatcgggatagcttataatcgactgattaggatggacgcctctactggcgacgcgatcaagacctggaggttctccaatatgaagcagtggaatgtcaattgggaaattaagatggtgaccgtcgagttcgcggatgaggttcgactaagcttcatctgtactgaagtggactgtaaggtggttcacgagtttatcggcggatacatattcttgtctactcgcgcaaaagaccagaatgaaagcctggatgaagaaatgttctataaactcactagcggatgggtgtag

SEQ ID NO: 187755 - DNA, 462 bp, Artificial Sequence
  Description of Artificial Sequence: Synthetic coding sequence
atggccctggacggcatccggatgcccgacggctgctacgccgacggtacctgggaattgtcagtccatgttaccgatctgaatagggatgttaccctccgggttacaggggaagtgcatatcggaggagtgatgctgaaactggtcgagaagctagatgtgaaaaaggattggtctgaccacgctctgtggtgggaaaaaaagcgaacatggttacttaagacccattggactctggacaagtacggaatccaagccgacgcaaagttacaattcacgccgcagcacaaattgttgcggctgcagttgcccaatatgaagtacgtgaaagtaaaagtgaacttttccgatcgggtgttcaaggccgtctctgacatatgcaaaacgttcaatatcagacaccctgaggagctgtctctgctgaagaaaccacgtgatccaactaaaaagaaaaaaaagtag

SEQ ID NO: 187756 - DNA, 2004 bp, Artificial Sequence
  Description of Artificial Sequence: Synthetic coding sequence
atggccggcatgaagaccgccagcggcgactacatcgacagcagctgggagctgcgtgtcttcgtcggtgaggaggacccagaggcagagtccgttacactccgcgtgacaggagagagtcacattggcggggttttactgaagatcgtggagcagatcaatagaaagcaggattggtcagaccatgctatttggtgggagcaaaaacggcagtggctactgcagacacactggaccttggataaatatgggatcctggccgatgcccggctgttcttcggcccccagcatcgcccagtcatcctgaggttgccgaacagacgggctctcaggctgcgggcttcgttctcacagcctctgttccaggctgtagctgccatctgtagactcctatcaataagacaccccgaggaactttcacttctcagggcccccgagaagaaggagaaaaagaagaaagaaaaagaacctgaagaagagctttacgacctctcaaaggtggttctcgccggcggcgtggcgccagctctgtttagggggatgccggcccatttctcggactctgcccaaacagaagcatgctaccatatgttatcccgaccacaaccgccccccgacccattgctgctgcagaggctccctcgcccttcatctctctccgataagacacagttgcattccaggtggctcgattcaagtagatgcctaatgcagcaggggatcaaagctggggacgcactgtggttaagatttaagtactattcttttttcgacctcgatccaaaaaccgaccctgtgcggctaacccagctgtacgagcaggcacggtgggatctgctcttggaggagattgattgcaccgaggaggagatgatggtctttgctgccctgcagtaccacattaacaaactgagccagagcggggaagttggagagcccgccggcaccgatccaggcctcgatgatttagacgtcgccctctcaaacctggaggttaaactggagggcagcgcccctaccgatgtcctagatagcctcacaaccatacctgagctgaaagaccatctaagaattttcagaatcccaagacgcccacgtaaactgaccctgaagggctatcggcagcattgggtcgtgttcaaagagacaactctgtcctactacaagtcacaggatgaagcccctggtgatccaatacagcaactcaatctgaaggggtgtgaggtggtgccggacgtaaatgtcagcggccagaagttctgtatcaagctgttggttccatcacccgaaggcatgagcgaaatctatctgaggtgtcaggacgagcagcaatacgcgaggtggatggctggctgccggttggccagtaaagggcgcaccatggcagatagcagctacacttcggaggtccaggcaatactggcattcctctccctccaaaggactgggtccggcgggcccggcaatcatccacatggcccagatgcttctgccgaaggcctgaatccctacggcttggtcgcccctagattccagaggaagttcaaagctaaacaactgactccccggattctggaggctcatcagaatgtggcccagctttcgctggccgaagcccaactcagattcattcaggcatggcaaagtcttcccgactttggaataagctacgtcatggtaagattcaagggtagcagaaaagacgagattttgggtatagccaacaaccgacttataaggatagatttagctgtgggagatgtagtaaagacctggcggttcagtaatatgcgtcagtggaatgtcaactgggacatcagacaggtggctattgagttcgatgagcacattaatgtggccttctcttgcgtgagtgctagctgcagaatagttcacgagtatataggaggatatattttcctgagcacgagagagcgagccaggggggaggagctcgatgaggacttgtttctccagcttactggaggccatgaagctttctag

SEQ ID NO: 187757 - DNA, 1992 bp, Artificial Sequence
  Description of Artificial Sequence: Synthetic coding sequence
atggccggcatgaagaccgccagcggcgactacatcgacagcagctgggaactccgggtgttcgtaggcgaggaggatcccgaggccgagagcgtgactctgcgggtcaccggcgaatcccacatcggcggggtgctattgaaaattgttgaacagatcaacaggaagcaggactggagcgatcatgctatatggtgggaacagaagcgccaatggctgctacagacacactggactctagataagtatggcattctcgccgatgcccggctctttttcggtccacaacatagacccgttattctgaggctgcctaaccggcgggctctgcggctcagagctagcttttcccagcccttgttccaggccgtcgctgctatctgtcgtcttctttcaattcgccatccggaggaactgtctctgctaagagctcctgagaaaaaagaaaaaaagaagaaggagaaggagcccgaggaggagctgtatgatctatccaaggtcgttctggccgggggagtggcacccgctctgtttcggggtatgcccgcacacttttcagactctgcacagaccgaggcctgttaccacatgctgagcaggccgcagcctcctccggacccactgctgttgcagcggcttccccggccttcaagtctctccgacaaaacccagctgcattctcgatggcttgacagctctcgctgtttgatgcaacagggaattaaagccggggatgcattgtggctgaggttcaagtattactcattcttcgatctggatcctaaaactgaccccgtacggctgactcagctctacgagcaggcgcgctgggacttgttgttggaggagatcgactgtactgaggaagaaatgatggtttttgcggcactccagtatcacataaacaagcttagccaatccggcgaagtcggcgagccagccgggactgaccccggcctggacgacctagatgtggccctatcaaacctagaggtgaagttggagggctccgcgcctaccgatgtgctcgatagcctgacaactattcctgagctcaaggaccacttgaggatcttcagaccacggaagctgaccctgaaggggtatagacagcattgggtggtcttcaaagaaacaaccctgtcctactacaagtcacaggacgaggctccaggagaccctatccagcaactcaatctcaaagggtgcgaggtggtgcctgacgtgaacgtgtctggccagaagttctgtataaagctgctggtcccaagcccggaagggatgagcgagatctacctcaggtgccaggacgagcagcagtatgcccgctggatggctgggtgcaggcttgcaagcaaaggtaggaccatggctgactccagctatacttcagaggtgcaggccatcctggcatttctcagcttgcagcgcacaggaagcggaggaccaggaaaccacccacatggacccgatgccagtgccgaaggactgaatccttatggactggtcgcccctcgcttccagcggaagtttaaggctaagcagttaacacctcgcattcttgaggcccatcagaacgttgcacagttgtctctggccgaggcccagctgcgtttcatccaagcatggcagtctctgccagacttcggtatcagctacgtgatggtacgctttaaaggcagtcgtaaggatgagatcctggggatagccaacaacaggttgataagaatagacctggcagttggcgacgtggtgaaaacatggcgcttttcaaatatgagacagtggaacgtgaactgggacataagacaggtggcgatcgagtttgacgaacatattaatgtggcttttagctgcgtctccgcctcttgtagaattgtccacgaatacatcggtggatatattttcctctcaacacgagagagggcccgcggcgaggaacttgatgaggatctcttcctacagctgactggcgggcacgaggcattctag

SEQ ID NO: 187758 - DNA, 861 bp, Artificial Sequence
  Description of Artificial Sequence: Synthetic coding sequence
atggccggcatgaagaccgccagcggcgactacatcgacagcagctgggagctcagggtattcgttggcgaggaagatcccgaggccgaatctgtaacgctgagagtgacaggcgagagccacattggaggagtcttacttaaaattgtggagcagatcaatcgcaagcaggactggtcagatcatgccatatggtgggagcagaaaagacaatggcttttgcaaacacactggacgctcgacaagtacggaatccttgctgatgccaggttgttctttggtccacagcatcgacccgtgattctgagactgcctaatagacgcgctctcaggctgcgagctagcttctcgcagcccctttttcaggcggttgcagcaatctgcaggctgctgagtattcgccacccagaagagctgtcgctgttgcgggcccctgagaaaaaggaaaagaaaaaaaaagagaaagagcccgaagaagagctgtacgatctttccaaggtggtcctggctggaggggtcgccccggcactctttagggggatgccagcccacttctcagactccgcacagactgaagcttgttaccatatgctcagccggcctcaacctcccccagatcccctcctgctgcaaagactgccacgaccctcttctttaagtgataaaacacagctccacagtcgatggctggacagttcgagatgcttgatgcaacagggaatcaaggcaggggacgctctgtggcttcggtttaaatattactctttctttgatctagatccaaagacagaccctgtgcgccttactcagttatacgaacaagcccgctgggatctactcctagaggaaattgattgttag

SEQ ID NO: 187759 - DNA, 555 bp, Artificial Sequence
  Description of Artificial Sequence: Synthetic coding sequence
atggccgccgccggcggcgcccggctgctgcgggccgccagcgccgttctgggagggccagccggccgctggttgcatcacgcgggctcccgcgccggctcttcagggcttcttcgtaaccggggaccggggggatctgctgaggccagcaggagtttgtccgtgagtgctcgagctcggagctcctctgaagataaaatcactgttcacttcattaaccgcgacggggaaacactaactacgaaagggaaggtaggggactcactcctagacgtcgtggtggagaataatttggacatagacggttttggagcgtgcgagggtaccctggcgtgttccacctgtcatctaatttttgaggatcatatctatgagaagctggatgccatcactgacgaagagaacgacatgttagacctcgcctatggccttaccgatcggtcccgcctcggctgtcaaatttgtctgacaaagtctatggacaatatgaccgttcgcgtccccgagacagtggccgatgcccggcagagtatcgacgtcggcaagacttcatag

SEQ ID NO: 187760 - DNA, 1494 bp, Artificial Sequence
  Description of Artificial Sequence: Synthetic coding sequence
atggccagccggtgctggcggtggtggggctggagcgcctggccccgcaccaggcttccccccgctgggagcaccccaagcttctgccatcatttttcaacccaggagaagactcctcagatctgtgtcgtcggatcaggcccagccgggttttatacagcacaacatctgctaaaacatccacaggctcatgtcgacatatatgagaagcagcccgtgccttttggactggtcagattcggtgtcgctcctgaccaccctgaagtgaagaatgtgattaacactttcacgcagactgcacattccggtcgctgcgctttttgggggaacgtcgaggtggggcgtgatgtgacagtgcccgagctgcgcgaagcttaccacgccgtggttctgtcatatggggctgaagaccacagggccctcgagatacccggcgaggaattacctggggtgtgctctgctagggcgttcgtgggatggtacaacggcctccccgaaaatcaagaattagagcccgacctgagctgcgacaccgcagttatattgggtcaggggaacgttgctctagatgtggctaggatcctcctcacaccaccagagcacctggaagctcttttactgtgtcaaagaacagatatcaccaaggccgcgctgggagtcctgcgccagtccagagtgaagacagtatggttggtaggtaggcgaggccccctgcaggttgcgttcaccatcaaggagctgcgggaaatgattcagctgcctggagcaagacctattctcgaccctgtggattttctaggcctccaggacaaaataaaggaggtgccacgcccccgaaaacggctgaccgagcttctgctgcgaacggccacagaaaagcctgggcccgcggaggcggcacggcaagcttcggcttcacgcgcctggggccttcggtttttccgatctcctcagcaggtgctgcccagccctgatgggcgcagggctgccggtgtgaggttggctgtcacacgtctcgaaggagtggacgaagctactcgcgctgttcccactggcgacatggaagacctgccatgtggtttggttcttagctctatcggctataagtctcggcccgtagacccttctgtgccttttgatagcaaactcggagtgattcctaatgtagaaggaagagtcatggacgtgcctggcctttattgtagcggatgggttaagcggggccccaccggtgtaatcgccacaacaatgacagacagctttctgacaggtcaaatgctgctgcaggacttgaaggcggggttgctcccctctggcccacgccccggctacgcagccatccaagcacttctctcttcacgcggggttcggccagtatcatttagcgactgggaaaagctggatgcagaggaggttgcccggggacaaggcactggtaaaccccgcgagaaattagtcgatccccaggagatgcttcgtcttctcggccactag

SEQ ID NO: 187761 - DNA, 1569 bp, Artificial Sequence
  Description of Artificial Sequence: Synthetic coding sequence
atggccagccggtgctggcggtggtggggctggagcgcctggcccaggactcggctgccgcctgctggatccactccaacttttggtggttcagacgaggtgagggaccctgccaatgcaaaggctctgcggaataagagacggcggatgcaggtgcgcgtaaaattaggcaagttccagctgctgttagatattcaggaaaaaaccccccagatttgcgtggttgggagcggccctgcagggttctacactgcgcagcacctcctgaagcatccacaagcccatgtcgatatatacgagaagcagcccgtcccgtttggcctggtgcgattcggcgtggcaccagatcacccggaggttaaaaatgttattaatacattcacccagacagctcacagtggccgctgcgcattttgggggaatgtggaggtagggcgcgatgtgaccgttccagaattgcgggaggcttatcatgccgtagtgctgtcttacggagcagaagaccaccgggcgttggagatcccgggagaagaactgcctggagtatgcagtgcgcgggcctttgtgggctggtacaatgggctgcccgaaaatcaagagttggagcctgaccttagctgcgatacggccgtgatccttgggcagggaaacgtggcactcgatgtggcacgaattttgttaaccccacccgaacacttggagcgtaccgatattaccaaggctgccctcggagttctgagacagagtcgagtcaagaccgtgtggctggtgggaaggcgtgggcctctgcaagtggcctttaccattaaagagctgcgcgagatgattcagctgcctggggcgcggcccattctagatccggtggactttctgggtctgcaagataagattaaggaagtgcccaggcctaggaaaagactgaccgagctgttactacggaccgcgaccgaaaagcctggtccggcagaggccgctcggcaggcctcagcctctcgcgcatggggactgaggttttttcggagccctcaacaagtgcttccaagccctgatgggcgccgcgctgcgggggtgcgtctcgccgtcactcggctggagggagttgatgaggcaactagagcggtccccaccggagacatggaagacctgccttgcgggctggttttgagtagcatcgggtacaaaagtagacccgtcgacccgagcgtccctttcgactcaaaattaggggtgatcccaaacgtcgaaggaagggttatggatgttccgggactttattgctctggctgggtgaagcgcgggcctactggggtcatagccaccaccatgactgattcctttctgactggccagatgctgctgcaggacctgaaagcggggcttctcccttcgggcccccgacccggttacgccgctattcaggctctgttgtcatctaggggcgtgcggccagtgtcctttagtgattgggagaagctagacgccgaagaagttgctcggggccagggcaccggcaaaccaagggagaagctggttgacccccaggagatgctgcgcttgctggggcattag

SEQ ID NO: 187762 - DNA, 1356 bp, Artificial Sequence
  Description of Artificial Sequence: Synthetic coding sequence
atggccagccggtgctggcggtggtggggctggagcgcctggcccagaactaggttaccccctgccggaagtacaccctcattttgccaccactttagtacacaggaaaaaacaccccagatctgcgttgttggaagcggcccagctggattttatacggcacagcacctgctgaaacagcacccccaggcacacgttgacatctatgaaaagcagccagtgccattcgggttagtgcgattcggggtggctccggatcaccctgaagtgaagtcctacggagcagaggaccatcgagccctcgagatcccgggcgaagagctcccaggcgtgtgtagcgccagggcattcgtaggatggtataatgggctaccagaaaaccaggagctggaaccagatctctcatgcgacacagccgtgattttaggtcaggggaatgtcgctctcgatgtggcccgaatacttctgaccccacccgaacacctcgagcgcaccgatataacaaaagctgctctgggcgttttaaggcagtccagagtgaagactgtttggcttgtgggcagaagaggacctctgcaagtcgcctttacaatcaaggagctcagggagatgattcaacttccgggagcccgccccatccttgaccctgtcgacttccttgggttgcaagacaaaattaaggaagtaccacgccccaggaagcgccttaccgaactcctgcttagaacggctaccgaaaagccaggccctgcagaggcagcccggcaggccagcgcctcgcgagcatggggcctccgcttcttcagaagtccacagcaggtgttaccctcccccgatggccggagagctgctggggtccgcctggctgtaaccagactggaaggtgtagacgaagcgaccagagcagtgccaactggcgatatggaagacctgccttgcggccttgtcctgtccagcatcggttataaatccagacctgtggaccctagtgtcccctttgattcaaaactcggcgtcatccctaacgtcgagggccgagtcatggacgtgcccgggttatactgttccgggtgggtcaagaggggtcccacgggcgtcattgcaacaaccatgaccgacagttttctgaccggacagatgcttctgcaggatcttaaggctggcctacttccaagcggcccaaggcctgggtacgccgcaatacaggcccttttgtctagccggggagtgaggccagtcagctttagcgattgggaaaaactcgatgccgaagaggtggcccgcgggcaaggcaccggcaagccccgcgagaaacttgtggatccacaagagatgcttcgcttgcttggacattag

SEQ ID NO: 187763 - DNA, 1605 bp, Artificial Sequence
  Description of Artificial Sequence: Synthetic coding sequence
atggccagccggtgctggcggtggtggggctggagcgcctggcccaggacgcgtttgccccccgctgggagcacaccgagtttttgtcaccatttctctactcaggaaaaaacgccccagatttgtgtcgtgggaagcggtccagctgggttttatacagcgcagcatcttctgaaacgcgtggaagctctgtgctctcaaccaagggtactaaattctcctgcactctctggggaaggcgaagatctcggtgcctcccagcctctctcacttgatccaacctcctgccatccagtccctcagcagcaccctcaggcccacgtggacatttatgaaaaacaaccagttccgtttggtctagttaggttcggtgttgccccggaccatccagaggttaagaatgtgatcaacactttcacgcagacagcccactccggccgatgcgccttttgggggaacgtagaggtcgggcgagatgtgactgtgccagaactgcgggaggcctaccacgctgtggtactctcttacggggctgaggatcatagagctttggaaatcccgggagaggagcttccaggcgtgtgctctgctcgcgcatttgtcggctggtataatggactgcctgagaatcaggagctggagcccgatctgagctgtgacactgcggttattctgggccagggtaacgttgcacttgatgtggccagaattcttctgacccccccagaacacctcgagcgcaccgacatcacaaaagctgccctgggcgtattacggcagtccagagttaaaacagtgtggttagttggtagacgtgggcccctccaggtggctttcactattaaagaactacgggaaatgatccagctgccaggagctcggcctatcctggatccagttgactttcttggactgcaggacaaaatcaaggaagtgcccagacctagaaagcgacttacagagctattgctgcggaccgcaacggagaagcctggacccgccgaagctgcgaggcaggcgagcgcatctcgcgcctggggactgcggttcttccggagtccccagcaggtgcttccctcaccagatggaaggcgcgccgcaggtgtgcggctggcagtgaccaggctggaaggggtggatgaagctacaagggctgtgcccaccggcgatatggaagatcttccctgcggactcgtgctgtcatccattgggtataagagtagaccggttgacccaagcgtaccatttgactcaaaactgggagtaattcccaacgtcgaaggccgggtgatggacgtccccgggctgtattgtagtggatgggtgaagcgtgggccaactggtgtgatcgccacaactatgacagattctttcctaaccggacagatgttgctgcaggatctaaaggcggggctcctcccttctggccctaggccaggttatgccgccatccaggcattgctgtcctcccggggagtgaggcccgtatctttttccgattgggaaaaactggatgcagaggaagtagcaaggggccagggaaccggaaaacccagggagaagctggttgatcctcaggaaatgctccgcttgcttggccactag

SEQ ID NO: 187764 - DNA, 1146 bp, Artificial Sequence
  Description of Artificial Sequence: Synthetic coding sequence
atgaccacctgcaaggccggcgtggtgcccctggccagccagcagcacccgcaggcacacgtggatatttatgagaagcagcctgtgccattcgggttagtccggttcggagtagcccccgaccatccagaagtcaagaacgttatcaacacctttacacagaccgcacactcaggccggtgcgcgttttgggggaatgtcgaggtggggcgggacgtgactgtgccagagctgcgggaggcatatcacgccgttgtcttgagttacggagcagaggaccacagggctttggaaattcccggggaggaacttcctggcgtctgcagcgctagggcctttgttggctggtacaatggccttcccgagaaccaggagctagagcctgatctttcatgtgacacagccgtgatactagggcagggcaatgtggcccttgacgtcgcaaggattctcctcactccccccgagcatctggagcgaaccgacataaccaaggccgctttgggtgtgttgagacagtcccgagtgaagacagtatggttggtgggacggagaggaccgttgcaggttgccttcaccattaaagagctgcgagaaatgattcagctccctggagccaggccaattctcgatccagttgatttcctgggacttcaggacaaaatcaaagaagtcccacggcccagaaagcgactgaccgagttgctgctccgaacggcgaccgaaaagccgggaccggctgaggccgcccggcaggcctcagccagtcgggcctggggtcttaggttcttcagatcgcctcagcaggtcctcccttcgcccgacggacggcgagcagccggagtgcgattggccgtcacgcgcttagaggtgtcactcatgttcctcaaggacaccccctttccaggactgtgccatcctcccggcgttgcccataccctgcccaaccgcgtatcgatgcggccccccgtgcagtgccctcgagaaacttggaagacttcactcgttgggtggtgtagcgctgccctcggtattcgcgccgcccttagtacacaggcctgtccactgactccaagcctaggttcgagtcctatgtggcgggcagggctgtggatgtgccaggcctctacagctgccgccggatag

SEQ ID NO: 187765 - DNA, 1320 bp, Artificial Sequence
  Description of Artificial Sequence: Synthetic coding sequence
atggaggacaaggaccgggagcacccccaggcccacgtggacatctacgagaagcaaccagtcccctttggactggtccgctttggagtggcaccagatcaccctgaagtcaaaaacgtgattaacacattcactcaaactgcgcacagcggccgttgcgctttctgggggaacgtcgaagtggggagagacgtgactgttcccgaactgcgagaggcgtatcacgctgtggtcctctcatacggcgcagaagatcaccgcgccctagagatacccggagaagagttgccaggtgtgtgttctgccagagctttcgtggggtggtacaacggccttcccgaaaaccaggagcttgagcccgatctctcctgcgatactgcagtaatcttgggacagggcaacgtagctttggatgtcgcaaggattctgctgactcctccagagcatctagagagaacagacatcacgaaggcagccctgggcgtgcttcgccaatcccgtgtcaaaacagtttggctggtgggccgtaggggtcccctgcaagtcgcattcaccattaaggagcttcgcgagatgattcagctccctggagctcgacccatactggatccagtcgatttcttgggcctccaggataagattaaagaggtgccgagaccaagaaaaaggctcacagaactattgctcaggactgccactgaaaagcccggaccagctgaagcagccaggcaagcttctgccagtcgggcttgggggctgagattctttcgttctcctcagcaggtgttaccttcacccgatggccgaagggccgccggggtaagactcgctgtcacaaggcttgaaggcgtagacgaagccaccagagccgtgccaactggggacatggaagatctgccatgtggccttgtgctatcttctattggctacaagtctcgtccagtggatccctccgttccattcgacagtaaattgggagtcatcccaaacgtcgaggggcgcgtgatggatgttcctggattatactgctctggctgggtaaagcgcggacctactggagtgatagccacaactatgacagatagcttcttaacaggccagatgcttctccaggaccttaaggcaggcctgctgccaagcggtccacgacccggatacgccgctatacaggctcttctgagttcccgcggagttaggcccgtaagctttagtgactgggaaaagctcgatgccgaagaggtggcaagagggcagggaactggtaagccgcgggaaaagctggtggacccacaggagatgttaagactgctaggccactag

SEQ ID NO: 187766 - DNA, 1494 bp, Artificial Sequence
  Description of Artificial Sequence: Synthetic coding sequence
atggccagccggtgctggcggtggtggggctggagcgcctggcccagaaccagactccctccagctggctctaccccatctttctgccatcacttctcaacccaggagaagaccccccagatctgtgttgtgggatccggcccagcgggcttctatacagcgcagcacctgcttaagcacccacaggctcatgtggatatttacgagaagcagcccgtcccttttggactggtgcgattcggagtggccccagatcatccagaggtgaaaaatgtgattaacaccttcactcagaccgctcatagtggtagatgtgctttttggggcaatgtcgaagtgggacgagatgttacggtgccggagctgagagaggcttatcatgccgtggtcctgagctacggggcagaagaccatagagcactggagatcccaggcgaagaactgccaggggtctgctctgcacgggcctttgtcggctggtacaacggactgcctgagaatcaggagcttgaaccggacctaagctgtgacactgctgtgatactcgggcagggcaatgtggccttagacgtcgctagaatcctgctcaccccgcccgagcacctagaggcactcctgttgtgccaacggaccgatattaccaaagccgcactgggagttctgaggcaaagtagggtcaaaactgtgtggttagtagggaggagggggcctttgcaagtggcattcacaatcaaagagttgcgggagatgattcaactgcctggggcccgtcctatcctcgaccccgtggatttcctggggctgcaggataaaatcaaggaagtgcccagaccacgcaaacgtcttactgagcttctcctgaggacagcaactgagaaaccaggacccgcagaggcagcgcgccaagcttccgcatctagagcatgggggctgcgcttctttcggagtcctcagcaggtcctgccaagtccagacgggagacgagcagcaggcgtcaggctcgccgtcacaaggttggagggcgtggacgaggctactcgtgccgtcccaacaggcgacatggaggatcttccatgtgggctagtgctctcaagcattggatataaaagccggcccgtcgatccatctgtcccttttgattcgaaactgggcgtgatcccaaacgtggagggaagagtcatggacgtgcccggtctgtattgctccgggtgggtaaagagaggccccaccggggtgatcgctacaacaatgaccgactcattcctcacggggcagatgctgttgcaagatctgaaggccggactactaccctcgggacccagaccaggctacgccgccattcaggccttactgtctagcagaggggtgaggcccgttagttttagtgactgggagaagctggatgccgaggaagtggcacgtggccaggggaccgggaagcctcgcgaaaagcttgtggacccacaggaaatgctccgcctgctggggcattag

SEQ ID NO: 187767 - DNA, 1452 bp, Artificial Sequence
  Description of Artificial Sequence: Synthetic coding sequence
atggccagccggtgctggcggtggtggggctggagcgcctggccccgaaccaggctgccacctgcaggctccaccccatccttttgccaccatttttccacccaagagaaaacccctcaaatctgcgtggtgggcagcggcccagctggattctatacggcccaacacctcctcaaacaccctcaagctcatgtggacatctacgagaagcaacctgtgccgtttgggctggtgaggttcggggtggccccggatcatcctgaagtgaagactgctcattcaggtagatgcgctttctggggaaacgtggaggtggggcgtgacgttactgtgcctgagctgagagaagcttatcacgctgtcgtcctctcttacggtgccgaggaccatagggccctggagatacctggggaggagcttcccggtgtctgttccgctagggccttcgtagggtggtacaacggcctgcctgagaaccaggaactggaacccgatctgtcatgtgatactgccgtgatcctgggtcagggcaatgtggccctggacgttgcccggatcctccttactccccctgaacacctggaaaggactgatatcacgaaggccgctctgggagttctgcggcagtctcgagtgaagactgtctggctcgtgggtaggcgggggcccctacaggttgctttcacaatcaaggagctccgcgaaatgattcagctgcccggtgcgagaccaattcttgatcctgtggatttcttggggctgcaggacaaaatcaaggaggttcccagacctcgaaaacgtctgaccgaactcctcctgagaacagctaccgagaaaccaggaccagccgaagcagctaggcaagcttcagcctcccgtgcatggggtctgagattctttaggtccccgcagcaggtgctgccatctccggacggccggagagctgccggcgtccgattagccgtcacacgcctggaaggcgtagacgaagccactcgggcggtgccaacgggggacatggaggacttgccctgtggtctggttttatcctcaattgggtataaaagcaggccagtagatcccagtgtgcccttcgatagtaagttgggtgtcattccaaacgtggaagggagggttatggacgtacccggactctattgtagtggctgggtaaaacggggcccgactggggttattgccactaccatgactgactcgttcttgactggccagatgttgctgcaagacctcaaggctggtctgctgccgagtggccccagacctggctacgctgctattcaggctctactatcttccagaggcgtgcgtcctgttagcttctctgattgggaaaagctggacgcagaagaggtagcccgtgggcagggaaccggcaagccccgagagaaacttgtggacccacaagaaatgcttaggctgcttggccattag

SEQ ID NO: 187768 - DNA, 1881 bp, Artificial Sequence
  Description of Artificial Sequence: Synthetic coding sequence
atggccgtgagcggcttcaccctgggcacctgcatcctgctgctgcacatttcatatgtagctaactacccgaacggcaaagtgacccagtcctgccacgggatgatccctgagcacggccattcccctcagtctgtgccagtccacgacatctatgtgagtcagatgaccttccgaccaggcgaccagattgaggtcactctgtccgggcacccatttaaaggcttcctgttagaagcaagaaatgcggaggatctgaatgggcctcccatcggttctttcacgttaattgacagtgaggtcagccagctgctgacttgtgaggacatccagggatcagcagtgtctcaccgaagcgcttctaagaagactgagataaaagtatactggaatgccccctcctccgcacccaaccatacacagtttctcgttaccgtggtcgaaaagtataaaatctactgggtcaagataccaggccccattatttctcaaccgaacgccttcccctttacgactccaaaggctacagtggtcccattaccgacactgccccctgtgtcgcaccttacaaagcctttctcagccagcgattgtggcaataaaaagttttgtataaggtccccgctgaattgcgatcccgaaaaggaagcctcttgcgtcttcctgtcattcactcgggacgaccagtccgtaatggtggaaatgtcaggcccatctaaaggatacctgtccttcgctctgtcgcatgatcagtggatgggtgatgatgatgcttacctctgtatacacgaggatcagacagtgtacatccagccatcacacctgactggccgttcccaccccgtgatggatagccgtgatacgttagaggacatggcctggcgactggccgacggggttatgcagtgctccttcagacgcaatatcaccctaccaggtgtgaagaaccggtttgacctgaacacttcgtactacattttcctggccgacggcgctgcaaatgatggacgaatttacaaacactctcaacagccactaatcacctatgagaaatatgatgtcacagattctcctaagaatattgggggttcacactccgtgttattactgaaagtacacggagccctgatgttcgtggcatggatgaccacagtgagtataggggtgcttgttgctcgattcttcaagcctgtgtggagcaaagccttcctccttggcgaagcggcatggttccaggtccaccgcatgctcatgttcaccacaaccgtgctcacttgcattgcatttgtaatgcctttcatatatagagggggctggagccgacacgcagggtatcatccttatctgggttgcatcgtgatgacacttgctgtgctgcagccccttttagctgtcttccgtccacccttgcacgacccccggcggcagatgtttaattggacgcactggagtatgggaaccgccgctcgcatcattgccgttgccgcgatgtttttaggcatggacctgccaggactgaacctgcctgatagttggaagacgtacgccatgacaggctttgtggcatggcatgtaggcactgaggtcgttctggaactcaaatactggatgatgacagaatttcgctccttctctcacttactgcagtggaagcagcgagtcatgctcttaaaaagacagtgttggcagtttatgtcggtgggcatgcttctgtttagcagctatttctatctgcaatctactatttacgaacaggcgaaaacccttgcctttgcaggtcaggtcatcatcataattaaaccaaagaagctcgaagcttgcccggattgcctcgagcacatttgtgagttttccctcggtaggcttgggtcatgcttgtag

SEQ ID NO: 187769 - DNA, 1779 bp, Artificial Sequence
  Description of Artificial Sequence: Synthetic coding sequence
atggccgtgagcggcttcaccctgggcacctgcatcctgctgctgcatatttcctatgtagccaattacccaaacggcaaggtaactcagagctgtcacggtatgatacccgaacatggccactctccccagagtgtccccgtgcatgacatttacgtgtcacagatgacatttcggccaggggaccagatagaggtgacactctcaggtcatccctttaaggggtttctccttgaagcaaggaacgctgaagacctcaatggtcccccaataggctccttcacgctgatcgactccgaagtgtctcagttgctgacatgcgaagacatacaaggctctgccgttagtcatcgctccgcctccaaaaagaccgaaataaaagtttactggaatgcccctagttccgctcctaatcacacccagtttctggtgactgtggtggagaagtacaaaatttactgggtgaaaatccctgggcccattatctctcagccaaatgctttcccatttacgacacccaaggcgacagtcgttccattacctacattgccaccggtctcccatctaactaagccattcagtgcttcagactgtggcaacaaaaaattctgcattcgaagccctttaaattgcgatcccgagaaagaggcctcttgcgtcttcctttcatttaccagggatgatcagtccgtgatggtcgaaatgtctgggccctccaaaggttatctgtcctttgcgctgtcccacgaccagtggatgggcgatgatgatgcgtatctctgtattcatgaggatcagacggtttacatccagcccagtcatttaacgggaaggtcacacccagtcatggattctcgggacactctcgaggacatggcatggcgactagctgacggtgtgatgcagtgctccttcaggagaaacattactctgccaggggtgaagaatagattcgatctcaacaccagctattacatatttttggccgacggcgctgctaacgatggtaggatttataagcacagccaacagcccctcatcacctatgaaaaatacgatgttaccgatagcccaaagaatattggtgggtctcattctgtgctgctacttaaagtgcatggcgccctcatgtttgtggcttggatgactacggtgagcatcggcgtactggtagcacggttttttaaaccggtgtggtccaaagctttcctgctgggggaggcggcctggttccaggtccacagaatgctgatgttcacaactacagtgctgacatgcattgccttcgtgatgccgttcatttaccggggggggtggtcaagacatgccgggtaccatccttacctggggtgcattgtcatgaccctggccgtgctccagccccttctggctgtgtttcgccctcctctccacgacccgaggaggcagatgttcaattggacgcactggagcatgggaacagcagctagaataatcgccgttgcagcaatgtttctaggaatggatcttccagggctgaatctgcccgattcctggaagacgtacgcaatgaccggcttcgtggcttggcacgtcggcactgaagtcgtgttggaagttcatgcctacagactgtcacgaaaggtcgagattctagatgacgataggatccaaattctccagtctttcactgctgtggagacggagggccatgcctttaagaaggccgtgctggcaatatacgtgtgcggtaacgtgacatttctcatcattttcctgtccgctataaaccacctgtag

SEQ ID NO: 187770 - DNA, 729 bp, Artificial Sequence
  Description of Artificial Sequence: Synthetic coding sequence
atgctgagctgcttccggctgctgagccggcacatcagccccagcctggccagcttgagacctgtccgctgctgcttcgccctgccactgagatgggcccccggccgaccactggacccccgccagatcgctccaaggaggcctctcgcagccgcggcctctagccgtgaccccacaggccctgcagccggccccagccgggtccgtcagaatttccatccagacagcgaggccgccataaaccgccaaatcaacttagagctttatgcttcctacgtatatctgtccatggcctactacttctcccgagacgacgtagctttgaacaatttcagcaggtactttctccatcagagcagggaagagacggagcacgccgagaagctgatgcgcctgcaaaaccagcgcggcggtagaatcaggctccaggacatcaaaaagcccgagcaggacgactgggagagcggactgcacgcgatggagtgcgcactgttgctggagaagaatgtaaaccagagcttgctggagctgcatgcgctggcttccgacaaaggagatccccacctctgtgactttcttgagacctattacctcaatgaacaggttaagagtattaaagagctaggagatcatgtccacaatcttgtgaaaatgggagccccagatgctggactggccgagtacctctttgacacacatacactgggaaacgagaacaaacagaactag

SEQ ID NO: 187771 - DNA, 552 bp, Artificial Sequence
  Description of Artificial Sequence: Synthetic coding sequence
atgaccaccgccagcaccagccaggtgcggcagaactaccaccaggactctgaggcggctataaatcgacaaataaatcttgagttatacgcctcttacgtctacctaagcatgtcttactatttcgatcgcgacgacgttgcgctgaaaaacttcgctaaatatttcctgcatcagagccatgaagagagagaacatgctgagaagctgatgaaacttcagaaccagaggggtggacgtattttcctccaggacattaagaaaccggattgcgatgactgggagtctggcctaaatgccatggagtgcgctctccacttggagaagaacgttaaccagtcactcttagaactccataaactggcaaccgacaagaacgatccacatctgtgcgacttcatcgagacacattatctgaacgagcaggtgaaggcaattaaggaacttggggatcacgtgaccaatctacgaaaaatgggagccccggaaagtgggctggcagagtacttattcgataagcatactttgggagactcggataacgaaagttag

SEQ ID NO: 187772 - DNA, 699 bp, Artificial Sequence
  Description of Artificial Sequence: Synthetic coding sequence
agcggcttccccgccagcaccgtgctgggccggaaccccgccctggtgccccaccccgggaggcctcccattgcgtcaccaccatctcctctgcacagaaccttggggctgcctcagggccccaggcggctcagtctcgtggccgccatgactactgcctctacatcccaggtgcgccagaactaccaccaggattcagaagccgcaatcaacagacagattaatctcgaactgtacgcctcatacgtgtacctttctatgtcctactactttgacagggacgatgtcgccctgaagaattttgctaagtactttcttcatcagagccatgaggaacgcgagcacgcagagaagttgatgaagctccagaaccaaagaggaggccgaattttcctgcaggatataaaaaaaccagactgtgacgactgggaatcaggtttgaacgctatggagtgcgctctgcatctggaaaagaatgtcaaccaatctttgttagaactccataagttggccactgacaagaacgatcctcatttgtgcgattttatcgagactcactatctgaacgagcaggtgaaagccattaaggaactgggtgaccacgtgactaacctaagaaagatgggtgctccggaaagtgggctggccgaatatcttttcgacaaacacaccctgggtgattcagacaatgaaagctag

SEQ ID NO: 187773 - DNA, 462 bp, Artificial Sequence
  Description of Artificial Sequence: Synthetic coding sequence
atgaccaccgccagcaccagccagagctactacttcgaccgggacgatgtggccttaaagaattttgctaagtacttcctgcaccagtcccacgaagagcgagagcatgcagagaagcttatgaagttacagaatcaacgcggagggcgtatttttctacaggacattaagaaacccgactgtgacgattgggagagcggacttaacgcaatggagtgtgctctgcacctggaaaagaatgtgaatcagtccctgttagaactgcacaagctcgccacagataagaatgatccacatctgtgtgatttcatcgaaacccactacctgaatgaacaggtcaaagctattaaagaactgggcgaccacgtaaccaaccttcgaaaaatgggtgcacccgagtctggcctggccgagtacctgtttgacaagcatactctgggcgattcagataacgaaagctag

SEQ ID NO: 187774 - DNA, 552 bp, Artificial Sequence
  Description of Artificial Sequence: Synthetic coding sequence
atggccaccgcccagcccagccaggtgcggcagaagtacgacaccaattgcgacgcggcgatcaatagccacattaccctcgaactgtatacaagctacttgtacctgtctatggccttctattttaaccgggacgatgtcgctctcgagaattttttcaggtatttcctgaggctttcagatgacaaaatggagcacgctcagaagcttatgcgcctgcagaaccttcgcggcggccatatttgcctgcacgacataagaaaacctgagtgtcaaggatgggagtctggattggtggctatggagtctgccttccacttggaaaaaaatgtgaaccaatccctcctcgatttgtatcagctggctgtcgagaagggcgatcctcagctgtgccactttctagagtctcattacttgcatgagcaggttaaaacaataaaagagttaggcggctacgtgtccaacctgcgcaagatctgtagcccagaagccgggcttgccgagtacttatttgacaaattaacacttggcggccgtgtgaaggaaacttag

SEQ ID NO: 187775 - DNA, 528 bp, Artificial Sequence
  Description of Artificial Sequence: Synthetic coding sequence
atgagcagccagatccggcagaactacagcaccgacgtggaggccgccgtcaacagcttggttaatctgtatctgcaagcctcttacacttatttatcactggggttttacttcgaccgagacgacgtggctctcgagggagttagccacttctttcgcgagctggccgaggagaagagggaaggatacgaaaggttgctgaagatgcaaaatcagcggggagggcgtgcgttatttcaggacatcaaaaagcccgcagaggacgaatggggcaagacccccgacgccatgaaggccgcgatggctctggagaagaagctgaaccaggcgctactcgatctccacgcactgggatcggccaggaccgacccacacctttgtgacttcctcgaaacacatttcttggatgaagaggtgaagctgatcaaaaaaatgggagatcatttgaccaacctgcatcggctcgggggacccgaggctggactcggggagtatctgttcgagcgcctcactcttaaacatgattag

SEQ ID NO: 187776 - DNA, 573 bp, Artificial Sequence
  Description of Artificial Sequence: Synthetic coding sequence
atgagcagccagatccggcagaactacagcaccgacgtggaggccgccgtaaactcactcgtcaacctttatctccaggccagctacacttatctctccctcggattctattttgatagggacgacgttgcactcgagggagtaagtcatttctttcgagaactggcggaggaaaagagggagggatacgagcggctccttaagatgcagaatcagagaggcgggcgcgctctgttccaagacatcaagaagccagctgaggacgaatggggaaagaccccagatgctatgaaagcagcaatggccttggaaaagaaactgaatcaggcgctgcttgacctgcacgcactcggtagtgcccgcacagacccacatctttgtgactttctggaaacgcactttctcgacgaggaagtgaagcttattaagaaaatgggcgaccatcttacaaacctgcaccgcctgggggggcctgaagccggccttggggaatatctgtctaagggaagccttagctctactacaaaaagcctgctatcacccgccactagtgagggaccccttgcaaagtag

SEQ ID NO: 187777 - DNA, 1272 bp, Artificial Sequence
  Description of Artificial Sequence: Synthetic coding sequence
atgcggagcctgggcgccaacatggccgccgccctgcgggccgccggtgtcctcctcagagatcccctggctagctcgagctggcgggtgtgtcagccctggcggtggaagtcgggcgccgcggccgccgctgttaccacagagacagcgcaacatgcccagggcgcaaaacctcaggtgcagccgcagaaacggaagcctaaaactggaatattgatgctgaacatgggtgggcccgagactctgggagacgttcatgatttcttgcttcgcctgtttttggaccgcgacctcatgactctgcccattcagaacaagcttgccccgttcatagccaagcggcgcacccccaaaatccaggagcagtacaggagaattggcgggggcagccccataaaaatttggacttcaaaacaaggggaaggtatggtaaagctattggatgagctgtcccccaacacagcaccccacaaatactacatcgggttccgttacgtacatcccctgacagaggaagccatcgaggagatggagagagatgggctcgagcgtgcgattgcgtttacacagtatccacaatacagttgctcgactaccggaagctctctgaacgccatttacaggtactacaaccaggtaggacgcaagcccactatgaagtggagtacaattgatcgttggcctacgcaccacctgctgatccaatgcttcgctgaccatattttaaaggaactcgatcatttccctcttgaaaaacggagcgaggtggtcattctgttcagcgcccacagcctcccaatgagcgttgttaatagaggagacccttacccccaggaagtgtccgccacagttcagaaagtcatggagcggttagagtactgtaacccctatcgcctggtgtggcagtctaaagtgggccccatgccctggctaggaccgcagactgacgaaagtataaaagggttgtgcgaacggggtagaaagaatatcctccttgtgccaatcgcatttacaagcgatcacattgaaacattgtacgagctagacatcgagtatagccaagttcttgccaaggagtgcggtgtggaaaacattcgaagagcggagtcactcaatggcaaccccttgttttctaaagcactggctgacctggtccatagtcacattcagagcaacgaactttgtagcaaacagctcactctgagttgtccactttgtgtgaatccagtgtgcagagaaaccaagtctttcttcactagccagcagctctag

SEQ ID NO: 187778 - DNA, 1290 bp, Artificial Sequence
  Description of Artificial Sequence: Synthetic coding sequence
atgcggagcctgggcgccaacatggccgccgccctgcgggccgccggcgttctgttgagagaccccctcgccagttcttcatggcgcgtctgccagccttggaggtggaaatcaggagctgccgcagccgcagttaccacagagactgcacagcacgcccagggcgctaagccgcaggttcagccacagaaacgctacgagagcaatatcaggaagccaaaaacaggcattttaatgctcaatatggggggacccgaaacactaggagatgtacacgatttcttacttaggctctttctggatagggatttgatgaccctgccaatccaaaacaaactggccccattcatagcaaagagaaggacacccaagattcaagagcaataccggcgaatcgggggcggttctcctatcaaaatatggacgtctaaacagggtgaggggatggtcaagctcctggatgagctgtcacctaacacggctccgcataagtattatatcggattccgctatgtgcacccactcacagaggaagccattgaagagatggaacgagacggactggagagagccattgcattcacacagtaccctcagtattcttgctccaccaccggttcctcattgaacgctatttaccgctattacaatcaggtgggaagaaagcccacaatgaagtggagcacaatcgaccgatggccaactcatcacctcttgatccagtgcttcgcagaccacattctgaaggaactagaccatttcccgctggagaaacgtagcgaggttgtcatcctcttctccgcgcattcattgcctatgtccgtggttaaccggggagatccgtacccgcaagaagtctctgccacagtgcaaaaggtaatggaacgccttgagtattgcaacccataccgcctggtctggcagtcaaaagtgggtcctatgccctggcttgggccccagacggacgagagcatcaaaggcctctgcgagcgcggccgcaagaacatccttctcgtaccgatcgccttcactagcgaccatatcgagaccctgtacgagctggacattgaatactcccaggtcctcgcaaaagagtgcggagtcgaaaatattcggcgcgccgaatccttgaatgggaacccattattcagcaaagcattagcagaccttgtccatagtcatatccagagtaacgaactatgttccaaacagttgacgctgtcatgcccactatgcgttaaccctgtctgcagagaaacaaagagcttcttcactagccagcagctctag

SEQ ID NO: 187779 - DNA, 1149 bp, Artificial Sequence
  Description of Artificial Sequence: Synthetic coding sequence
atgggcctgctgctgcccctggccctgtgcatcctggtgctgtgctgtggcgccatgtctccaccgcagctggccttaaatcccagtgcgctgttgagccgtggttgtaacgatagtgatgtcctcgccgttgccggcttcgcgctccgtgacatcaataaggaccgcaaagatgggtacgttttgcggctcaaccgggtcaacgacgcacaggagtatagacgcggaggcctagggagtctcttctatctcacactcgatgtgctggagactgattgccacgtgcttcgtaaaaaagcctggcaggattgcggcatgaggatcttcttcgagagcgtttacggccagtgcaaagccatcttttacatgaataatccaagtcgggtcctgtacctggctgcctacaactgtacgcttcggccggtcagcaagaagaagatctacatgacgtgccctgattgcccttcaagtattccgacggattccagtaaccaccaggtgttagaggctgctacagaatctctcgctaaatataacaatgagaatacttcgaaacaatacagtctgttcaaagtcacaagggcctcaagccaatgggtggtcggcccgagttacttcgtggagtacctcataaaggaatccccctgcacaaaatctcaggcttcatcctgcagtttgcaatccagcgacagcgtgccggttggtttatgtaaaggcagtcttactcggacgcactgggagaaatttgttagcgtcacatgtgacttcttcgaatcacaagcgcctgccaccggcagtgagaatagtgctgtgaatcagaagcctacaaatttacctaaggttgaagagtcacaacagaagaatactcctcccacggactctccgagtaaagctggaccgcgcggctccgttcagtacctccccgacctcgatgataagaatagccaggagaagggacctcaggaggcctttccagtccacttggatctgaccacgaacccacagggggaaactcttgatataagcttcctctttctagagcctatggaggagaagctggtggtgctcccattcccaaaagagaaagcccgcacggcagagtgtcctggacctgcccagaacgcaagcccactggtcctccctccttag

SEQ ID NO: 187780 - DNA, 1149 bp, Artificial Sequence
  Description of Artificial Sequence: Synthetic coding sequence
atgggcctgctgctgcccctggccctgtgcatcctggtgctgtgctgtggcgctatgagccccccgcaacttgctctcaaccctagcgccctcctttctagagggtgtaatgacagcgacgtgctggctgtcgcaggcttcgcgctgcgtgacataaataaggaccgaaaagatggatatgtgctgcgtctgaaccgggtgaatgatgctcaggagtaccggagggggggcctggggtccctgttttaccttacccttgatgtgcttgagactgactgtcatgtcctgcgaaagaaagcttggcaagactgtggaatgaggattttctttgaatcagtgtacgggcagtgcaaagccatcttttatatgaacaacccctctcgcgttttatacctggccgcctacaactgcacactgaggcccgtatctaagaagaaaatatatatgacttgccccgattgcccgagctccattccaaccgactcctcaaaccaccaggttctggaggctgcaacagagtccctcgcaaagtacaacaatgaaaacacctcgaagcagtatagcctctttaaggtgactagggcgtcttctcagtgggtggtgggtcccagctacttcgtagaatacttgatcaaagaatccccctgtacaaagtcacaagcgagctcatgctcccttcagagtagcgatagtgtgcctgttggcctgtgtaagggttctctgacgaggacacactgggagaaattcgtttccgtgacatgtgacttttttgagagtcaagcccccgctactggctctgagaactctgccgtcaaccaaaaaccaacgaacctcccgaaggttgaagagtcccagcagaagaatacaccaccgacggatagtcccagcaaagccggaccccgaggttcagtccagtacctcccagacctcgatgacaaaaattcacaagaaaaggggccccaggaagccttcccagtgcacctggacttgacaactaaccctcagggagaaacactggacatctcctttttatttctagagcccatggaggagaaactagtggtcctgcccttccccaaggagaaagcacggaccgccgagtgccctggccctgctcagaacgcatcgcctctagtcctcccaccttag

SEQ ID NO: 187781 - DNA, 705 bp, Artificial Sequence
  Description of Artificial Sequence: Synthetic coding sequence
atgacctgccccgactgccccagcagcatccccaccgacagcagcaatcaccaggtcctggaggccgccaccgagagcctcgccaagtacaataacgagaacacgtccaagcagtacagcctatttaaggtcacccgcgccagcagccagtgggtggtgggccctagctacttcgtggagtacctgatcaaagaatctccttgtacaaaaagccaggcatcaagttgttccttacagtccagtgactccgtgcccgttggactgtgcaaagggagtctcacccggactcattgggaaaaatttgtgtcagttacctgcgattttttcgagagccaggcgccggccactggcagtgaaaatagcgcggtaaatcagaaacctaccaacttgccaaaagtcgaggaatcacagcaaaagaatacgccacctacagactcaccgagtaaggctggcccccgtggtagcgtgcaatatctgcccgacctggatgacaagaatagtcaagagaagggaccacaggaggcctttcccgtgcacctggacctgaccaccaatccacagggggaaacacttgatattagcttcctttttctcgaacctatggaagagaagttggtggtgttaccattccctaaagagaaggctcggactgctgaatgtccaggtcctgctcagaacgccagtccattggtgctgcctccgtag

SEQ ID NO: 187782 - DNA, 717 bp, Artificial Sequence
  Description of Artificial Sequence: Synthetic coding sequence
atgcggcagagcggcgccagccagcccctgctgatcaacatgtaccttcccgaccctgttggggacggcttgtttaaggatggaaaaaatcccagttggggccctctttctccagccgtgcagaagggcagcgggcagatccagctgtggcaatttttgcttgagctgctggccgaccgggctaatgccggttgcatcgcatgggaaggcggacatggcgagttcaagctaaccgatcctgacgaggtggcaagacgctggggggagagaaagtcaaaaccgaacatgaattatgataagctgagtagagccctccggtactactacgacaaaaacataatgtccaaggtccacggcaagcgctacgcgtataggtttgatttccagggactggcgcaggcttgccaacctccaccggcccatgcccacgccgccgctgctgcagcagccgccgctgcagccgcccaggacggagctttgtataagctgcctgctggcctcgccccattgccctttccgggcctctctaagttgaacctgatggcagcctcagccggagtagctcctgccgggttctcctactggccaggacccggccccgcggctacagcggccgccgccacagccgcgttgtaccccagcccgtcacttcagcccccccccggaccatttggggctgtggcggcggcaagccaccttggaggacactatcactag

SEQ ID NO: 187783 - DNA, 1416 bp, Artificial Sequence
  Description of Artificial Sequence: Synthetic coding sequence
atggacagcagctgccacaacgccaccaccaagatgctggccaccgcccctgccagggggaacatgatgtccacgtcgaaacccctggccttttcaatcgagaggattatggccagaactccagaacctaaggccttacccgtcccacacttcctccagggtgcactgccaaaaggcgagccaaaacattccttgcacctgaattcatctatcccctgtatgatacccttcgtacccgtggcttacgacacctctcctaaggctggcgttaccgggagtgagccacggaaagccagccttgaagccccagcagctccggccgcggtcccatcagccccagctttcagttgcagtgacctgctgaactgcgcactgagtctcaagggggacctcgctagagacgccctgccactgcagcagtataaattggttcgacccagggttgtcaatcacagctcatttcatgccatgggcgctctatgttatctcaatcggggagacgggccttgtcaccccgccgcaggagtgaacatccaccctgtcgcatcctacttcttaagttctcccctgcaccctcagcctaaaacttacctggccgaaagaaataaactagtcgtgccagccgtggaaaaatacccttcgggtgtagcgtttaaggacctcagccaggcccagctccagcactatatgaaagaatccgctcaactgctctcggaaaaaattgcatttaagaccagcgatttctcccggggatcgccaaacgccaagcctaaagtattcacatgtgaggtctttaatgctcattataatttgaccagacatatgcccgtccatactggcgcaagaccatttgtttgcaaagtttgtggtaagggcttccggcaggctagtactctctgtaggcataaaattatccacacacaagagaagcctcacaagtgtaaccaatgcgggaaagccttcaacaggtcaagtacactgaatacacacaccaggatccatgccggttacaagccattcgtgtgtgaattctgtgggaagggctttcatcagaaaggcaactataagaaccataagctgacccactctggagagaaacagtttaaatgcaacatttgtaacaaggcattccaccaggtttataacctcacttttcatatgcacacgcacaacgataagaaacccttcacatgtcctacttgtggaaaggggttctgcaggaacttcgacttgaaaaaacatgttcggaagttgcacgactccagtctcggactggctcgaacgccagctggcgagccaggcacagagcctccccctcctctgccacagcaaccccccatgacattgccaccactgcagccccccctgcccactcctgggcctttgcagcccggcctgcaccagggtcatcagtag

SEQ ID NO: 187784 - DNA, 108 bp, Artificial Sequence
  Description of Artificial Sequence: Synthetic coding sequence
atggacagcagctgccacaacgccaccaccaagatgctggccaccgctcccgcccggggaaacatgatgtccaccagcaaacccttggccttttccattgagcgctag

SEQ ID NO: 187785 - DNA, 1278 bp, Artificial Sequence
  Description of Artificial Sequence: Synthetic coding sequence
atggacagcagctgccacaacgccaccaccaagatgctggccaccgccccagctcggggcaacatgatgtctacctctaagcctctggcttttagcatcgagaggataatggctaggactccagagcccaaagctcttcccgtccctcacttcctccagggggccctgccaaagggggaacctaagcactccctgcacctgaactcttcgataccttgtatgatccccttcgtgccagttgcctatgatacatcaccgaaagctggagtgacgggctctgaaccccgcaaagcatctttggaagcacccgcagctcccgcagccgttccctccgctcctgccttctcctgctccgatctgctgaactgcgctctgagcctcaagggcgacctggctcgcgacgctctaccactccaacagtacaagctcccaaagacctatttggccgagcggaacaagctggtcgtcccagccgtagagaagtatccctctggcgtcgccttcaaagacctttcccaagcccagttacaacattacatgaaagaatccgcacagctgctcagtgagaaaattgcgttcaagacaagcgattttagcagagggtcacccaatgcaaaacctaaggtgttcacttgcgaggtgtgtggtaaagtcttcaacgctcattacaacttgactcggcacatgccagtgcatactggtgcccggccctttgtatgtaaggtatgcggaaaaggatttcggcaggcaagtaccctgtgccggcacaaaattattcatacgcaggagaagccgcacaaatgcaatcagtgtggtaaggctttcaaccgatcttccacgctgaatactcatacaagaatccatgcaggttataagccgtttgtgtgcgaattctgcggcaaaggttttcaccaaaagggcaattataaaaaccataagctgacccattcaggcgaaaagcaattcaagtgcaacatatgcaataaagcattccaccaggtttacaatctaactttccacatgcacacacacaacgataagaaaccgttcacatgccccacctgtggcaagggtttttgcaggaatttcgatttgaaaaaacacgtgcgtaaactccacgacagcagccttggtctggcacgcacacctgctggcgaaccaggtacagagccgccgccacccctgccacagcaacctcctatgaccctgccgccactccagccgcccctcccaacccctggcccgctgcaacctggtctgcaccaggggcaccagtag

SEQ ID NO: 187786 - DNA, 1428 bp, Artificial Sequence
  Description of Artificial Sequence: Synthetic coding sequence
atggacagcagctgccacaacgccaccaccaagatgctggccaccgcacccgcacgaggtaatatgatgagcacaagtaaacccctggcgtttagcatcgagagaatcatggctcggacccccgagcctaaagctctgccagtgccacacttcttacagggggccctacccaagggcgaacctaagcactctttgcacctcaactccagtattccatgcatgatcccctttgtgcccgttgcctacgacacgtctccaaaggcaggggtgactggttccgagccaagaaaggcctcgctggaggcccctgccgcgcccgcggcggtgccatctgctcctgcattttcttgtagtgacctcttgaattgtgccctgagtctcaaaggggacctggcccgggatgcactgccactgcaacaatataaactcgtacgcccccgggttgtcaatcactcttcattccatgcaatgggggcactgtgctatctgaacagaggcgacggtccctgccaccccgccgccggggttaacatccaccctgtcgcgtcttactttctcagctcacccctccatcctcagcctaaaacctacctggccgaaagaaacaagctggtcgtgcctgcagtcgagaaatatccgagtggggttgcattcaaggatttgagccaggcgcaactacagcactacatgaaggagagcgcccagttgctgtcagagaagatcgccttcaagaccagcgacttttcacgaggaagccccaacgcgaagccgaaggtctttacgtgcgaagtttgtggcaaggtctttaacgctcattacaacttgactcgccacatgccagtacacacaggcgctcgcccctttgtgtgcaaagtgtgtggaaaaggtttccgacaggcgagtaccctctgcaggcataaaattattcatacccaagagaaaccgcacaagtgcaatcagtgcggcaaagctttcaatcggagcagcacactgaacacacataccaggattcacgccgggtacaaacctttcgtctgcgaattttgcgggaagggattccatcagaagggcaattacaaaaatcacaaactgacacacagcggcgaaaagcaattcaagtgcaatatatgcaacaaagcctttcatcaggtgtataacctaacctttcacatgcatacccataatgataagaaaccctttacatgcccaacttgcgggaaaggattttgccgtaactttgatttaaagaagcatgtgcgcaagctgcatgattccagtctggggctagcccgcacgcccgcaggggagcctgggactgagccaccgccccctttgccccagcagccacctatgacgctgcctcctctacagccacctttaccaacaccgggtcccctgcagcctggacttcatcaaggtcatcagtag

SEQ ID NO: 187787 - DNA, 1380 bp, Artificial Sequence
  Description of Artificial Sequence: Synthetic coding sequence
atggccagcagcgccagcctggagaccatggtgccccccgcctgccctagggccggggcgtccccagccacgtccaaaactcttgcgttcagcatcgaacgtattatggccaagacgtccgagccaagagctcccttcgaacccagacccggcgcactggaggcagatggatcccagggcaaaaagttgctcaacctttgcagcccgctcccatgtatgattcccttgcagccactgggctatgaggtgccctccaagacattgctgtcttattcagagctgtggaagtcttccctaagggcaggaggtggaggcgggggggggggcggcgggggcggcgggggcggaggagctcctgtttgtggggcttctggcctgtgcaagaccaattgcggcgtctgttgtaaggctgagctgggcctggcgccatccgctctgcccgcaggccgtgtgatcaaacctcaagtcattaatcaggccgtcgggttgcctgcctctggctctctgtactactttaattacctcgattcgacagcctacccaccctctgagctgctgagcggccaccttttccctagtggattgctaaatgcacaggcccccgccgctctagcagcccaccccaaactattcctattagagaacgcaaaacttgctggcctcgctgccgacaaattccctcacccagcaccctatccccacaaggaaaggttgccagccccactagagcaggtgctcaaagagaacagcgccctgaccgctgaaagaggcggagttaagggtcattctaaattacctggagggagtgcggacggtaagcccaaaaatttcacttgtgaggtctgcggaaaggtgttcaacgctcactacaatctaactcggcatatgcctgtgcacactggtgccaggccttttgtatgcaaagtctgtgggaaaggatttcgccaagcctccacgttgtgccgacacaaaataatccacacacaagaaaagccgcacaagtgcaatcagtgcggcaaagcatttaaccgctcatctacactgaatactcacattaggattcatgctggttacaaacccttcgtgtgcgagttctgcggaaagggtttccatcagaaaggtaactataagaatcacaagctgacgcacagtggcgaaaaacaatacaagtgcaccatttgtaataaggcgtttcaccaggtttataatttgacctttcatatgcatacccacaacgacaaaaagccttttacatgcgccacttgcggcaagggtttctgccgcaattttgacctgaagaagcatgtaaggaagctgcacgactcagtgggtcccgccgccccgtccgcaaaggatctaactcgcacggtgcaatcttag

SEQ ID NO: 187788 - DNA, 1380 bp, Artificial Sequence
  Description of Artificial Sequence: Synthetic coding sequence
atggccagcagcgccagcctggagaccatggtgccccccgcctgcccacgcgccggcgcttccccagccacttcgaaaaccctcgctttctccattgagcggatcatggccaaaaccagcgaaccacgggcacctttcgagcctaggcccggagccctggaggctgacggcagtcaaggcaaaaaattgcttaatctttgtagtcccctcccatgtatgattcccctgcagccattggggtacgaggtgccatccaagactctgctctcctatagtgagctgtggaaatcttcgttacgagctgggggtggcggtggaggtggcggaggcggggggggcggaggtggaggggccccagtgtgtggggcttcaggcctgtgcaagaccaattgtggtgtgtgttgcaaagcagaacttggtctagcaccaagtgcgttgcctgccgggagggtgataaagccccaggtgatcaaccaggcagtcggacttccagcttcggggtccctctattacttcaactatcttgatagcaccgcctaccctccaagcgagctcctgtcaggacatctcttcccaagcgggttgctgaatgcccaggccccggctgccttagccgcccacccaaagttattcctgctcgagaatgccaagctcgctggcctcgctgccgacaaatttccacaccctgctccttacccccacaaggagcgactccccgcaccactggaacaggtactgaaggagaatagcgcactcacagcagagaggggtggtgtgaagggccactctaaactccccggaggtagcgcagacggcaagcccaaaaatttcacatgcgaagtgtgcggcaaagtgtttaacgctcactataatttgactcgccacatgcctgtccatacaggtgctaggcctttcgtgtgtaaggtctgcggtaaaggattcagacaagccagtaccctatgccggcataaaattatccatactcaagagaagcctcacaagtgtaaccagtgcggcaaagctttcaacaggtctagcaccctaaacacccacatcagaattcacgctggttacaagccgtttgtttgcgaattttgcgggaaggggttccaccaaaaaggaaattacaaaaaccataagctcacacattcaggtgagaaacaatataagtgcactatttgcaataaggccttccaccaggtgtataatctcacctttcacatgcatactcataacgataagaagccctttacgtgcgccacttgcggaaagggcttctgtcgcaattttgaccttaaaaaacacgtccgtaagctacacgactctgtgggtccggccgctccgagcgcaaaagatctgacgcggactgtccagagctag

SEQ ID NO: 187789 - DNA, 1380 bp, Artificial Sequence
  Description of Artificial Sequence: Synthetic coding sequence
atggccagcagcgccagcctggagaccatggtgccccccgcctgcccacgcgctggagcaagccctgcaactagcaaaacactagctttctctatagaaagaatcatggcaaaaacatctgaaccacgggctccctttgagccaagacccggtgccctcgaagcggacggcagccaggggaagaagctgctgaacctgtgcagccctctgccatgtatgattcccctccagccccttggctacgaagtgccttctaaaacccttctatcctacagtgaactgtggaagtcttctctgcgggccggcggaggaggaggcggggggggaggggggggtggagggggcggaggggcaccagtatgtggggccagcgggctgtgtaagactaactgcggtgtctgctgcaaggccgagctcgggcttgccccaagtgccctgcctgctggaagggttataaaacctcaagtgatcaaccaggctgtcgggctcccggccagcggctctctctattattttaactacctcgacagtactgcgtaccccccaagtgagctcctaagcggccacttattcccaagcggcctgctgaacgcacaagcccccgctgctctggctgcccatcctaaacttttcttgctggaaaacgcgaagctagctggcctcgcagcagataaatttccccacccagcaccataccctcacaaggaacgtttacctgcgccgctggagcaggttctgaaggagaactcagcactcacagccgaacggggcggcgtgaagggccactccaagctacctggtggctcagcagacggaaagccaaagaactttacctgcgaagtttgcggaaaggttttcaatgcacattacaatctgaccaggcatatgccagtgcacacaggggcacgccccttcgtgtgtaaagtttgtgggaaggggtttcggcaggcttccaccctctgccgacacaagattatccacacccaggagaagcctcacaagtgcaatcaatgcggcaaggcttttaatcggagttccaccctcaatactcacatacgtatccacgccggatacaagcccttcgtttgcgagttttgcggcaaagggttccaccagaagggaaactacaaaaaccacaagctcactcattctggcgagaagcagtacaaatgtactatctgtaacaaagcttttcatcaggtgtacaacctgacatttcacatgcacacacacaatgacaagaaacccttcacttgtgccacttgcgggaagggcttctgcagaaactttgacctgaagaagcacgttagaaaactccacgactcagttggccccgccgccccaagtgccaaggatttgacccggacagtccagtcatag

SEQ ID NO: 187790 - DNA, 1140 bp, Artificial Sequence
  Description of Artificial Sequence: Synthetic coding sequence
atggccgccaccgccgccgccgtggtggccgaggaggacaccgagctgcgggatcttttggtccagacattggagaattcaggcgtcctgaataggatcaaagctgaactaagagccgccgtgttcctagcgcttgaggaacaagaaaaagtagagaacaaaacccctttagtgaatgagtcactgaagaaatttttaaacaccaaggatggtagactcgtcgccagtctggtagctgagtttctgcagttctttaatctggattttacactggcagtatttcagccagaaacgtccacactccagggtctcgaagggcgggaaaatctcgctcgcgacttgggtatcatcgaagctgaagggacggtcggaggccccctgttgctggaagttattcgccggtgccagcaaaaagaaaagggccccaccacgggcgagggcgctctggacctaagcgacgtgcactcaccacccaagtcacccgaaggaaagacgagcgcccagaccacaccatctaagaaggccaacgatgaggccaaccagtcagatacatccgtatctctcagcgaacccaagagtaagtcatctctgcacctattgagccatgaaactaagattggtagtttcctgtccaatcggactctcgacggtaaggataaagccggcctgtgccccgacgaggacgacatggaaggggactcttttttcgatgatccgatccctaagcctgagaaaacctacggactcaggaaagaacccaggaagcaggcaggtagtctggcatcattatcggatgctccacctttgaagtctggcctgagctcattagccggagcgcccagcctcaaagattccgagtccaagcggggtaacacagttctgaaagatcttaaactgatttctgacaagatcggatcgctagggctcggaaccggggaagacgacgattacgttgacgatttcaacagtacgagccacaggtctgaaaaatccgaaataagtatcggagaagagattgaagaggacttaagtgtggagatagacgacataaatacatccgacaagttggatgacctcactcaggatttgaccgtgtcacaacttagtgatgtagcggactatctcgaagatgttgcttag

SEQ ID NO: 187791 - DNA, 1200 bp, Artificial Sequence
  Description of Artificial Sequence: Synthetic coding sequence
atggccgccaccgccgccgccgtggtggccgaggaggacaccgagctgagggatctgttggtgcagacactcgaaaactccggggtgctgaacagaatcaaggccgagctccgcgcagctgtgtttctggctctagaggagcaggaaaaggtagaaaataaaaccccccttgtgaacgagtctctcaaaaagttcctgaatacaaaggacggacgcctcgtcgccagtctggtcgcagagtttctgcagtttttcaatctggactttaccctggctgtttttcagcccgagactagcacacttcagggcctggaaggtcgggagaatcttgctcgagacctgggcatcatagaggcagagggcacagttggtggtcccctgctgctggaggtgatccggaggtgccagcagaaagagaagggaccgactaccggcgaaggcgctctggatctgtctgatgtgcactcccctcccaaatctcctgagggcaagacctctgctcagacaacccccagcaagattccccggtacaagggacaggggaaaaaaaaaacatccggtcagaaagccggggataaaaaggccaatgatgaagctaaccagtctgatacgagcgtgtctctgtcagaacctaagtctaaatcatccctgcacctactatctcacgagacaaaaattggctccttcctaagcaataggactcttgatggtaaggataaggccggcttgtgccctgacgaggacgacatggaaggtgactcattctttgacgacccaatccccaaacctgaaaaaacatatgggctccgcaaggaaccaagaaagcaggcggggtcgctggcaagcctgagtgacgctccccccctgaaatccggactgtctagccttgcaggagcccctagcttgaaggactccgagtcaaagcggggcaacacagtcctcaaagacttgaaattaatcagtgataagatcggaagtctggggctgggaaccggagaggatgatgattatgtggatgatttcaacagtacctctcacaggtctgagaaatcagaaataagtattggcgaggaaatagaggaggacctgtcagtagaaatcgatgacattaatacttccgacaagttggacgatctaacccaggacttgaccgtctcccagctgtctgacgtggcagactatctggaagatgttgcatag

SEQ ID NO: 187792 - DNA, 1095 bp, Artificial Sequence
  Description of Artificial Sequence: Synthetic coding sequence
atggccgccaccgccgccgccgtggtggccgaggaggacaccgagctccgggatctgctggtacagaccctggaaaactccggcgtactcaacaggatcaaggccgaattaagggccgctgtctttcttgctctcgaggagcaggaaaaggtggagaataagaccccacttgtcaacgagtccctcaagaagtttctgaatacaaaagacggtcgcttggtcgctagcctcgtggccgagttcctccaattctttaaccttgactttaccctagcggtgtttcagccagagacgagtacactccagggcttagagggacgagaaaacctggcgcgcgacctgggcattatcgaagcagagggaacggtgggtggccccctgctgctagaggttatccgtagatgtcagcagaaggagaagggaccaacaacaggtgagaaagctaatgacgaggccaaccaaagtgacaccagcgtgtcgcttagtgagccgaaatccaaatcttcattgcacttgctgtcccatgagactaaaatcggctcattcctgagcaatcggacgcttgacggtaaagataaagccggcttatgccccgatgaagatgatatggaaggagactccttctttgatgatcctattccaaagcctgagaaaacctatgggctccggaaggagcccaggaagcaggccgggtccctggcatccctgtccgatgcccctccactgaaatccggcctttcgagcctagctggagcccccagcctgaaagattcggagtcaaagaggggcaataccgtgctcaaagacctcaaactgattagtgataagataggcagtctgggtctaggcaccggggaggatgatgactatgtggacgactttaactcaacttctcaccgatcagagaagagtgaaatcagcatcggcgaggaaatcgaagaagacctgtcagtggaaatcgacgacatcaatacatctgataagacaattacacagctggagtgcttactttcaatcggggcactgcatttcaaaaacaccgcagatatttttaaggtgattttcattcttctcaataagatcttgccaatctag

SEQ ID NO: 187793 - DNA, 420 bp, Artificial Sequence
  Description of Artificial Sequence: Synthetic coding sequence
atgagcagcctgcccgtgccctacaagctgcccgtgagcctgagcgtgggctcctgcgttataatcaaagggactccgatacactccttcatcaatgacccacagcttcaagtagacttttacacggatatggacgaggactccgacattgctttcaggttcagagtgcactttggcaatcatgttgttatgaataggcgagaattcggaatctggatgctggaggagacaaccgattatgtccccttcgaggatgggaagcaatttgagctgtgcatctatgtccattacaatgagtacgaaatcaaggtgaatggtatacgcatatatgggttcgtgcacagaattccaccctcttttgttaaaatggtccaggtgtctcgggatatttccctcaccagcgtttgtgtctgtaactag

SEQ ID NO: 187794 - DNA, 8616 bp, Artificial Sequence
  Description of Artificial Sequence: Synthetic coding sequence
atgcggcggggccggctgctggagatcgccctgggcttcaccgtgctgcttgcgtcatacacaagtcacggcgccgatgctaatctcgaagccggaaacgtcaaagagacgagagcgagtagggctaaacgcagaggagggggcgggcacgatgccctgaagggccctaacgtctgtgggtcccggtataacgcttattgttgccccgggtggaagacccttcccggcgggaaccagtgcatcgtgcccatctgtcgtcactcctgcggtgatggtttctgttctcgtccgaatatgtgtacctgtccctctggacagattgcaccttcatgcgggtcgcgatccatccagcactgcaacattcggtgcatgaacggtggttcttgttctgatgaccactgcctgtgtcagaagggttacatcggcacccactgtggtcagcccgtttgcgagtctggctgcctcaatggtggcagatgcgtggcccctaacaggtgcgcctgcacgtatggtttcaccgggccccaatgtgagcgcgattaccgaactggcccttgctttaccgtcatctccaaccaaatgtgccaagggcagctgtctggcatcgtgtgcacaaagaccttgtgctgcgcaaccgtgggacgtgcttggggtcatccctgcgagatgtgcccagcacaacctcacccttgtcgccgcgggtttattcctaacattcgcactggcgcctgccaagatgtggatgaatgccaggccatccctggcttgtgtcaggggggaaattgcattaacaccgttggttcgttcgaatgcaaatgccccgccggacataagctgaacgaggtgagccagaaatgcgaggatattgacgaatgttcaaccattccgggaatctgtgagggtggcgaatgtacgaacacagtgagttcttacttttgtaaatgccccccagggttttacacgagccctgacggaacaagatgcattgatgtaaggccgggttactgctacacagccctgactaatggccgctgttcgaatcaactcccgcaaagtatcaccaagatgcagtgttgttgtgatgccggtcggtgttggtcgcccggggtgactgtcgctccagaaatgtgtccaattcgggcaactgaagattttaataagctctgttctgtcccgatggtgattccaggtagacctgagtacccacctcctccgctcggccctatcccccccgtgctccctgtgcctccaggtttccctcctggccctcagatccccgtgcccagaccaccggttgaatacttgtatccctcaagagaacctcctagggtgttgccagtgaacgtgaccgactattgccaactcgtgcggtacctctgtcagaatggccgctgtatcccaacacctggttcatgccgctgtgagtgtaataaaggattccaattggatctgagaggcgaatgtattgatgtggatgagtgcgagaaaaacccctgtgccggaggagaatgcattaataaccaagggagctatacctgccagtgcagagccggataccagtccactttgacccggaccgagtgcagggacatagatgagtgcttacagaacggcagaatttgcaataatggcaggtgtatcaatactgacggcagttttcactgtgtctgtaacgcggggtttcatgtgactagggacggcaaaaactgtgaggacatggatgagtgctccatccggaacatgtgcttgaacggaatgtgcattaacgaggatggttcctttaaatgcatctgcaagccaggatttcagctcgcgtcggatggacgatactgtaaggatatcaatgagtgcgaaacacccgggatatgtatgaacgggaggtgcgtcaacactgatggatcgtatcggtgtgagtgtttcccaggactggccgtcgggcttgatggacgggtgtgtgtagacacacacatgcgcagtacttgctacggaggttataagagggggcagtgcataaaaccactgtttggggccgtgactaagtctgagtgctgctgcgcatcaactgagtatgccttcggggagccatgtcagccatgtcccgcccagaattctgccgagtatcaggcactgtgttcttcaggtccaggaatgacatctgctggttcggatatcaacgaatgcgctctggatccagatatttgtcccaatggcatatgtgaaaatctacgggggacatataagtgcatatgtaactctggctacgaagtggatagcacagggaagaattgcgtggacatcaacgagtgtgtgttgaatagcctcctgtgcgacaatgggcagtgcaggaatacacctggcagcttcgtttgtacttgccccaaggggtttatctacaagccggatcttaagacctgcgaggacattgatgagtgtgaaagttcgccatgtattaacggtgtgtgtaaaaacagtccaggcagttttatatgcgagtgttcctctgagtcaacgctggatcccacaaaaactatttgcattgagacgattaaggggacctgttggcagaccgttattgatggcaggtgcgagatcaacattaatggagctacactgaaaagccagtgctgtagtagcctcggagcagcatggggtagcccttgcacgctctgccaggttgatccgatttgtgggaaaggatattcccgtatcaaaggcacccagtgtgaggacattgatgagtgtgaggtgtttcctggggtgtgcaagaatgggttatgtgttaatactagaggcagctttaagtgtcagtgtccttctggcatgaccttggacgctaccggaagaatctgcttggatatcagactcgaaacgtgcttcctgcggtatgaggatgaggagtgcacacttcccattgcaggacgccataggatggacgcttgctgctgctcggtgggcgcggcttggggtaccgaggaatgtgaagaatgccctatgcgaaatacacctgaatatgaggagctgtgcccccgcggcccaggtttcgccaccaaggagatcacaaacggcaagcctttttttaaagatattaatgaatgcaagatgattccgtcgctctgtactcatggaaagtgtcgcaacaccatcggaagcttcaagtgtagatgtgacagcggttttgcacttgactctgaagagcgcaactgtacagacattgatgaatgtcgcataagccccgacttatgtggccgcggccagtgtgtcaatacgcccggggactttgagtgtaagtgcgatgagggttacgagtccggctttatgatgatgaagaactgcatggacattgacgaatgtcaacgggatccacttctctgcagaggcggagtctgtcacaacactgagggctcctatcggtgcgagtgcccgccggggcaccagctgtcccccaacatcagtgcctgcatcgacataaacgagtgtgagttgagcgctcacctatgccccaacggacggtgtgtgaacctgattggaaaatatcaatgcgcatgtaaccccggctatcactcaactccagataggctcttttgtgtggatatagatgagtgctctatcatgaatgggggatgtgaaaccttttgtactaactccgaggggtcttatgaatgtagctgccagccaggctttgccttaatgcccgatcaaagatcttgcaccgatatcgatgaatgcgaggacaaccctaacatttgtgacggagggcagtgcaccaacattcccggagaatatagatgtttgtgttacgacggcttcatggcttccgaagatatgaagacgtgcgttgacgtgaatgagtgcgatcttaatccaaacatctgtctgagcgggacatgcgaaaacacaaaaggaagtttcatatgtcactgcgatatgggatacagtgggaagaaaggcaaaactggctgtacagacatcaatgagtgcgagataggggcacacaactgtggaaagcacgccgtttgcactaatacagctggctcatttaagtgtagctgtagtccagggtggataggggacggaatcaagtgtaccgacctcgatgagtgctccaacggaacgcatatgtgctctcagcacgcggattgtaaaaatactatgggatcctatcgttgtttatgcaaagaaggctataccggagacggtttcacctgcaccgacctcgacgagtgctccgagaacttaaacctctgcgggaatggacagtgtctcaatgctccaggcggttatcggtgtgaatgtgacatgggcttcgtcccttcagccgacggtaaagcgtgcgaggacatcgacgagtgctccctgcccaatatctgtgtgttcggaacgtgccataatttacctgggctcttccgatgcgaatgtgaaataggatatgaactagaccggtccggcggtaattgcactgacgttaacgaatgcctggatcccactacttgtatttccggcaattgcgtgaacactcccggctcctatatatgtgactgcccaccggacttcgagcttaatccaacacgagtcgggtgcgtggacactcgcagcggcaactgttaccttgacatccggcccaggggagataatggggataccgcttgctccaatgagatcggcgtgggcgtgagtaaggcaagctgttgttgctctctgggcaaggcctggggcaccccttgcgaaatgtgccccgcagtgaatacctctgagtacaagatcttgtgccctggcggagagggctttaggcctaacccaataacagttattcttgaggatattgatgaatgccaggagctgcctgggctctgtcagggagggaagtgcatcaacacgttcgggagtttccagtgtcgctgcccaacagggtattatctcaacgaagacaccagggtgtgcgatgatgtgaatgagtgcgaaactcctggcatttgcgggccaggaacatgttacaacaccgtagggaactacacgtgcatttgcccccccgactacatgcaggtcaacgggggcaataactgtatggacatgcggcgctctctgtgctaccggaattactatgctgacaatcagacttgtgacggggaactgctcttcaacatgactaagaaaatgtgttgctgcagctacaacatcggtagggcctggaacaaaccttgcgaacagtgtccaatcccaagcacggatgaattcgctactttgtgtggaagtcaacggcctggcttcgtgatagacatttacaccgggctccctgtggacattgatgaatgtcgcgagatacctggagtctgtgagaacggagtttgcatcaacatggtgggaagctttagatgtgaatgccctgtggggtttttttacaacgataagctgcttgtctgtgaagacattgacgaatgccagaatggtcctgtctgccaaagaaacgctgagtgtattaacaccgcaggttcatataggtgtgactgtaagcctggatatcgattcacctccaccggacaatgcaatgaccgcaatgagtgtcaggaaatccctaacatctgttcccatggccagtgcattgacacagtgggttctttttactgtctgtgtcacaccggcttcaagactaatgatgatcagactatgtgtctggatatcaacgagtgtgagagagacgcttgcggaaatggaacctgtaggaatacaattggcagctttaattgtagatgcaaccatggattcatcttgagtcacaacaatgactgcatcgatgtggacgaatgtgcttccgggaacggtaatctgtgccggaacgggcagtgcatcaatactgtgggctcctttcagtgtcagtgcaatgagggctatgaggtggcacctgacgggcgtacatgtgtggatatcaacgagtgcttgctggagcctcgtaagtgcgcacctggtacctgtcagaatttggatgggagctatagatgcatttgtccgcccggatacagcctccagaacgagaagtgtgaggacatagacgaatgcgtggaagagcccgagatttgtgccctcgggacctgtagtaacaccgagggctcattcaagtgtctatgccccgagggtttcagtctgtccagcagcgggcgccggtgtcaggatttgcggatgagctactgctacgcgaagtttgagggaggaaagtgctcttctcctaagagtcggaatcacagcaagcaggagtgctgctgcgcattgaagggggagggctggggggatccatgtgagctatgccccacggaacctgatgaggccttccgtcagatatgcccctacggatcggggatcattgtggggcctgatgatagcgctgtggacatggacgagtgcaaagagcctgacgtctgtaaacacggccagtgcattaacaccgacggcagctatcgatgcgagtgtccttttggctacatcctcgccggcaatgaatgtgtggacaccgatgaatgctcagttggtaatccctgcggaaatgggacctgcaagaatgtcattggtggtttcgaatgtacttgtgaggaaggctttgaaccagggcctatgatgacctgcgaggatattaacgaatgcgctcagaaccctttgctgtgcgcattccgttgtgttaacacttatggaagctacgagtgcaagtgtccagtcgggtatgtattgcgagaggaccgacgaatgtgcaaggatgaagacgagtgtgaggagggaaagcatgactgtacagaaaaacagatggaatgcaaaaatttaatcggcacttatatgtgcatatgcgggccgggctatcagcgccgtccagatggtgagggatgtgtggacgagaacgaatgccagacaaagcccggtatctgcgaaaacggaagatgcctgaatacacgaggatcctacacatgtgagtgcaacgacggcttcacagcaagtccaaatcaggacgaatgcttggacaatcgtgaagggtactgctttactgaagtgctacagaacatgtgccaaatcgggtcgagtaacaggaaccccgtcaccaaaagcgagtgttgctgcgatggggggagaggatggggtccacactgtgagatctgtcccttccagggtacagtagcgtttaaaaagttgtgccctcacggtagaggatttatgactaatggggccgatatcgatgagtgtaaggtaatccacgacgtgtgtcgaaacggagaatgtgtaaatgatcgcggaagttaccactgcatctgcaaaaccgggtataccccagacatcaccgggactagttgcgtagacttgaatgagtgcaatcaggccccaaaaccatgtaacttcatttgcaaaaacacagaaggaagttaccagtgtagttgccccaaagggtatatactccaggaagatggtcgcagctgtaaagacctcgacgaatgcgctactaaacaacacaattgccagttcctgtgtgttaataccatcgggggttttacttgtaaatgcccccccggctttactcaacatcatactagctgcatagacaacaacgaatgcacgagcgatatcaatctgtgtgggtctaagggcatttgtcaaaacactcccggctccttcacgtgtgagtgccagcggggattttcactagatcagacaggatcaagttgcgaagatgtggatgaatgtgagggaaatcataggtgtcagcacggttgtcagaatattatcggggggtatagatgctcatgtcctcagggatacctgcaacattaccagtggaatcagtgcgtggatgagaatgaatgtctgtctgcgcacatctgtggcggggcatcttgtcacaatactcttggcagttataaatgcatgtgccccgccggttttcaatatgagcagttcagcggaggctgccaggacattaacgaatgcgggagcgctcaagcaccctgttcctatgggtgctccaacaccgaggggggatatctctgtggatgcccacccggatattttagaattggtcaggggcattgcgttagcggtatggggatggggcggggaaaccccgagccgcctgtgtcaggcgaaatggacgacaatagcctctctccagaggcctgctatgaatgtaagattaacggttatcccaagagggggaggaagaggagatcgaccaacgagactgacgcctctaatattgaagatcagagtgagacagaggccaatgtgagtctcgcttcatgggacgtggaaaaaaccgcgattttcgcatttaatatcagccacgtgagtaacaaggtacggatactcgagctactacctgctcttactaccctcacaaatcacaatcgttacctgatcgagtcaggcaatgaagacggattctttaagatcaaccagaaagagggcatctcctatctccattttacgaagaagaagcctgtagccggtacctatagccttcaaatctcctcaactcccctgtacaaaaaaaaggagctgaatcagctcgaagataagtacgacaaggactacctgtccggtgagctgggtgataacctgaagatgaaaattcaggttctgctccactag

SEQ ID NO: 187795 - DNA, 2958 bp, Artificial Sequence
  Description of Artificial Sequence: Synthetic coding sequence
atgggcttcgtgcccagcgccgacggcaaggcctgcgaggacatcgacgagtgctctctgcctaacatctgcgtatttggcacatgccacaacctacccggtctctttcgatgcgaatgcgaaattggctatgagctagataggtccggcggcaattgtactgatgtcaacgaatgtctcgacccaacgacttgtatctccggtaactgcgtgaacactccaggatcctatatttgtgactgtcctcctgatttcgagttgaatccaacccgcgtgggctgtgtagacacccgcagcggcaattgctacctggacatcaggccacggggggacaacggtgatactgcttgtagtaacgaaatcggagtgggcgtgtccaaggcctcatgttgttgctccctggggaaggcttgggggacaccttgcgaaatgtgtccagctgttaatacaagcgagtacaagatcctgtgccccgggggagagggtttccgccccaaccccattaccgtgatccttgaagatatagatgagtgccaggagctcccaggcctgtgtcagggtggcaagtgcatcaacacatttggtagtttccagtgcagatgcccaactgggtattacctgaatgaagatacccgagtctgtgacgatgtgaacgagtgtgaaacgcctggcatttgtggaccaggaacatgttataacacagtcgggaactacacttgtatttgccccccagactacatgcaggttaatggaggtaataactgtatggatatgcgccgcagtctgtgttacagaaactactacgccgataaccagacatgcgacggcgagctgctcttcaacatgaccaagaagatgtgctgctgtagctacaatattggtcgtgcttggaacaagccctgtgaacagtgccctatccccagcaccgacgagtttgccaccttatgtggctctcagcggcccggttttgtgatcgacatctacactgggctgcccgtggacatcgatgagtgtcgggaaattccaggagtgtgcgagaacggtgtgtgtatcaacatggtgggctcatttcggtgtgagtgcccggttggctttttttataacgacaagttacttgtttgtgaagatattgacgagtgccagaatggccccgtatgccagaggaacgccgagtgcattaatactgctggctcttataggtgcgactgtaagcccggttaccgctttacctctacaggacagtgcaacgatcggaatgaatgccaagagatccccaacatttgttcccatgggcagtgtatcgatacggtagggagcttttactgtctctgccacacaggtttcaagaccaacgacgatcagacgatgtgcctggacattaacgaatgtgagcgggatgcgtgcggtaatggcacatgcaggaatactataggatcctttaattgccgctgcaaccacggattcattctctctcataacaatgactgtattgatgtggatgagtgcgcatctggcaacgggaatctgtgtcgcaacggtcaatgcattaataccgttggctccttccagtgtcaatgcaacgaggggtacgaggtggcaccagatgggagaacatgcgtcgacatcaacgagtgcctgcttgaacctcgcaaatgtgccccaggcacctgtcagaatttggacggatcttataggtgcatctgccctccaggctacagtctgcagaatgaaaagtgcgaagacatcgatgaatgcgtcgaggagcctgagatatgcgccctgggcacctgtagtaacaccgaaggttccttcaagtgtttgtgcccggaaggtttcagtctctcttccagcggaaggcggtgccaggatttgcgaatgagctactgttacgctaagttcgagggtggaaagtgcagttcccccaagagcagaaatcactccaagcaggaatgttgctgcgctctgaagggggagggatggggggatccgtgcgaactgtgtccgaccgaacccgatgaagcctttcgccagatttgcccctatggttctggcatcattgtcggccctgatgactccgctgttgatatggatgagtgtaaagaacccgatgtgtgcaagcacggtcagtgtatcaataccgatgggagctaccgttgcgaatgtccgtttggatacatactggcaggcaacgagtgtgttgatactgacgagtgctccgttgggaatccttgcggaaacggaacttgcaaaaacgtcatcgggggctttgaatgcacctgcgaagagggattcgagcccggccccatgatgacttgcgaggatattaatgaatgtgctcagaaccctctcctctgtgcattcagatgcgtgaacacatacgggtcctacgagtgcaaatgccccgtggggtatgtgttgcgagaagaccgccgaatgtgtaaggacgaggatgagtgcgaggaggggaagcatgactgtaccgaaaagcaaatggagtgcaagaacctcatcgggacgtacatgtgcatttgcgggcctggctatcagcgtagaccggatggcgaggggtgcgtggatgaaaacgagtgccagacaaagccaggcatatgcgagaatgggaggtgcctgaatacaagaggtagttacacttgcgagtgtaatgacggtttcaccgcctcgcctaaccaagatgagtgtctggatgttatcctttcccttctcctgttgagtcctgcctttccctcttgcttcttctcacctcgcaccattggaaaaggaactgcatcacaacggtgttataaaacgtgcgtccggtcagcaccagccactggaactccatccccgaatcggaatgccgccgtcacggagggcgaagcgggcgtgccgacagtgaggtccgctctatcccgcggcctgtggcttagtaggaattctgtgccaatggctgaggactcctag

SEQ ID NO: 187796 - DNA, 3450 bp, Artificial Sequence
  Description of Artificial Sequence: Synthetic coding sequence
atgcggcggggccggctgctggagatcgccctgggcttcaccgtgctgttagcctcatatacttcccatggcgcagatgccaatctagaggccggcaatgtgaaggagacgcgggcatcgagagccaaacgcagggggggaggtgggcacgacgcacttaagggccccaatgtttgcgggtccaggtacaacgcctactgttgccccggctggaagacccttcctgggggcaaccagtgcattgtgcccatctgtagacactcctgtggggatggcttctgctcccgacctaacatgtgcacatgcccgtctggtcagatcgcccccagctgcgggtctcgaagtattcagcactgcaatattagatgcatgaacggcggatcttgttctgacgatcactgcctctgtcagaagggctatatcggaacccactgtggccagccagtgtgtgaatccggctgcctgaacgggggccgatgtgtcgctcccaaccgctgcgcatgcacgtatggattcacagggcctcagtgtgagcgagattaccgcaccggtccctgtttcaccgttatctcaaatcagatgtgtcagggccagctgagcggcatcgtctgcaccaagaccctgtgctgcacatacattaacgaatgcgagatcggcgcacataactgtggtaagcatgctgtatgtacgaatactgcaggttcgttcaagtgttcttgcagccctgggtggattggggacgggattaaatgcactgaccttgatgaatgctcaaatggaacccacatgtgctctcagcacgctgactgcaaaaataccatgggatcctacagatgcctgtgcaaggaggggtacacaggggacggatttacctgtactgacttagacgagtgctctgaaaacctcaatctctgtggtaatggtcagtgcctcaacgcccctggcggctacagatgcgaatgtgatatggggtttgtgccatcggccgatgggaaagcctgtgaagacatcgacgagtgctcactaccgaacatctgcgtgtttggcacatgccataacttacctggcctcttccgctgtgagtgcgagatcggctacgaactggaccggtctggaggaaattgcactgacgtcaatgagtgtctggatccgaccacctgtatcagcggaaattgcgtgaatacacctggtagttacatttgcgattgcccccccgactttgaactcaacccaacacgtgtcggatgcgtcgacacccggtcagggaactgctatctggacatacgcccgcgcggggacaatggtgacaccgcttgctcgaacgaaattggggtgggggtgtcaaaggcgtcgtgctgctgcagccttggtaaggcctggggcacgccttgtgagatgtgcccggctgtcaatacctccgaatacaaaattctttgcccggggggagagggctttaggccaaaccctataaccgtcattctggaggatatcgacgagtgtcaagaactgccggggctatgtcagggcgggaagtgtattaacaccttcgggtcattccagtgtagatgtccaaccgggtactacttgaacgaagatacccgggtgtgtgatgatgtgaatgaatgcgaaacccccgggatatgtggccccggcacgtgctataacacggtgggtaattacacttgcatctgccccccagattacatgcaggtgaacggaggcaacaactgtatggacatgcggaggtcattgtgttaccggaattactacgcggataaccagacttgtgatggagaactgctgtttaacatgactaagaagatgtgttgttgctcctacaacatagggagagcgtggaataagccttgtgagcagtgtccgatcccaagcacagatgagttcgcaacactctgtgggagccaaaggcctggattcgtaatcgatatttacactggactgccagtcgacatcgatgagtgtcgcgagatcccgggagtgtgcgagaacggagtgtgcattaatatggtcggctcctttcggtgtgaatgtcccgtggggtttttttataatgataagcttctcgtgtgtgaggatattgatgaatgccagaatggcccggtctgtcaaaggaatgctgagtgtatcaacaccgctggcagctataggtgtgactgcaagcctggatatagattcacaagtacaggccagtgcaacgataggaacgagtgccaggaaattcctaacatatgtagccatgggcagtgtattgatacagtggggagtttttattgcctgtgtcataccggatttaagactaatgatgatcagaccatgtgcctggatatcaatgagtgtgagcgcgacgcttgcggtaacgggacctgtcgtaataccattggcagcttcaactgcagatgtaaccatgggtttattctgagtcacaacaatgactgtatcgacgtggatgagtgcgccagcggcaacgggaatttgtgtagaaacggacaatgcatcaatacggtgggttcctttcaatgtcagtgtaacgaggggtacgaagtagctcccgatggtcggacctgtgttgacatcaatgaatgtttgttggagccccgaaaatgtgcaccgggcacttgccagaacctcgacggcagctacagatgtatttgccctccaggctactctttacagaatgaaaagtgtgaggacatcgacgagtgcgtggaagaacctgaaatctgcgcccttggcacgtgctcaaacaccgagggaagtttcaagtgcttgtgccccgagggatttagcctatcatctagcggtcgtcgatgtcaagacctgcgcatgtcttactgttatgccaaatttgagggcgggaaatgcagcagccctaaaagtaggaatcatagcaagcaggagtgttgctgcgctctgaagggagaagggtggggagacccttgcgagctctgccccacggaacccgatgaggctttcaggcagatctgtccctacggatctggaattatcgtggggcctgacgacagtgccgtggatatggacgagtgcaaagagccggatgtctgtaaacacggtcagtgcatcaatacagatgggagctacaggtgtgagtgcccattcgggtacatcctcgccggcaacgaatgtgtcgatactgacgagtgctccgttggtaatccatgcggaaatggtacgtgtaagaatgtcattggaggttttgagtgtacgtgtgaggaggggttcgaaccagggccaatgatgacctgtgaggatataaatgagtgtgcccagaaccctctgctgtgtgcctttcggtgcgttaacacttacggatcctatgaatgtaaatgccccgttggttatgtgctgagggaagaccggaggatgtgcaaagatgaggacgaatgtgaagaagggaagcatgattgtacatag

SEQ ID NO: 187797 - DNA, 8739 bp, Artificial Sequence
  Description of Artificial Sequence: Synthetic coding sequence
atgggccggcggcggcggctgtgcctgcagctgtacttcctgtggttaggatgcgtggtgttgtgggcccaggggaccgccggtcagccccagccccctccccccaagccgcccaggcctcaaccaccaccccagcaggtccgtagcgcgaccgcaggctccgagggcggttttctggctccggagtacagggaagagggcgcagctgtggccagccgggtcagaagacgcggccaacaagatgtgttgcgcgggcctaacgtttgcgggtctcgttttcacagttactgctgccctgggtggaagacgctccctggcggaaaccagtgtatcgtgcctatatgcagaaattcttgcggagacggattctgttctagacctaacatgtgcacttgctcaagtggacaaatctcttcaacttgtggtagtaagagcattcaacagtgttccgttcggtgcatgaatggtggaacctgcgcagatgatcattgtcagtgtcaaaaagggtacattggaacctattgtggccaaccggtgtgtgagaacggatgccagaacggcgggcgttgtattggcccaaaccggtgcgcctgtgtttatggattcacggggccccagtgcgagcgtgactatcgcactggaccctgcttcacccaggtcaacaatcagatgtgccaggggcagctgaccggcatcgtgtgtacaaagactctgtgttgtgctacaatcggaagggcctggggacacccatgtgagatgtgccccgcgcaacctcagccctgcaggcggggatttatccccaacattaggacaggtgcatgccaggatgttgatgagtgccaggccattcctggtatatgccaggggggcaactgtattaataccgtgggcagcttcgaatgtcgttgccccgcaggacacaaacagagtgaaacgacacagaagtgcgaagacatcgacgagtgttccataataccaggcatctgtgaaaccggcgagtgcagcaatacagtgggaagttacttctgtgtctgcccaaggggatacgtgacaagtaccgacggatcacgttgtattgaccagaggactgggatgtgcttctcgggtctagtcaatggaaggtgtgcacaggagctgcccggacgaatgacgaaaatgcagtgctgttgcgaacccggtaggtgctgggggatcggcactatccctgaggcctgccctgtacggggttccgaagagtacaggagattgtgtatggatgggctccctatgggtggaatccctggtagcgctggctcccgccctggaggcacaggaggaaatggcttcgccccatccggaaacggcaacgggtacggaccaggcgggaccggcttcataccaattcccggagggaatggctttagcccgggcgtgggtggcgccggagtgggggctggtggccagggaccaattataaccgggctcactatattaaaccagacaattgacatctgcaagcatcacgctaacctctgtttgaacggacgctgtatccccactgttagttcttacaggtgtgagtgcaacatggggtataagcaggatgctaacggtgactgcatagatgtcgacgaatgcacgtccaatccctgcactaatggagactgcgtcaatacccctggctcatattactgtaagtgtcatgccggcttccagagaactccgaccaagcaggcttgcatcgacattgacgagtgtattcagaatggtgtcctgtgcaaaaacggaagatgtgttaatacggacggttccttccaatgcatttgcaacgcagggttcgagcttacgaccgacggcaagaattgtgtcgatcacgacgagtgtacaacgacaaacatgtgtcttaacggaatgtgtatcaatgaggatggcagcttcaaatgcatttgtaagccaggcttcgtgctagcacctaacggacgttattgtacggacgtggacgaatgtcagaccccagggatctgtatgaatggacattgcattaactcagagggctcgtttagatgtgattgtcctcccggcttggctgtggggatggacggccgagtatgcgtcgatacccacatgaggtccacttgctatggggggattaagaaaggcgtctgcgtgagacctttcccgggcgcagtgacaaaaagtgagtgctgctgtgctaacccagactatggcttcggcgagccctgtcagccatgccccgctaagaactcagcggagttccacgggctttgcagttccggggtcgggatcactgtggatgggagggatatcaacgagtgcgccctggatccagacatttgtgctaacgggatatgtgaaaatctgcggggctcataccgctgcaactgtaacagtggctatgagccagatgcaagcggacggaactgtattgatatcgacgaatgcctcgtcaacaggctgttatgtgataacggactctgccgcaacacacccggttcttacagttgtacctgcccgccaggatatgtgttcaggaccgagaccgagacctgtgaggacatcaatgaatgcgagtccaacccctgtgttaacggagcgtgccggaacaacttgggtagctttaattgtgagtgcagtcccgggtcaaagctgagttcaacaggtttgatttgcatcgacagcttgaaagggacatgttggctcaacattcaggacagtcgatgtgaggtcaacatcaatggggccaccctcaagtccgaatgctgcgcaacacttggcgcggcctggggctccccttgcgaacgatgcgagctggatacagcatgcccccggggactggccaggatcaagggggtgacctgcgaggacgtcaacgagtgtgaggtcttccccggggtttgcccgaacgggcggtgcgtgaatagcaagggttcttttcactgcgaatgccccgagggcctcactcttgacggcaccggccgggtttgcctcgatatcaggatggaacaatgttacctgaaatgggatgaagatgagtgtatccatcccgtgccagggaaattccgaatggacgcttgctgttgtgccgtaggagccgcatgggggaccgagtgcgaggagtgtcccaagccaggtactaaggagtatgaaacactgtgcccccggggcgcaggttttgccaatagaggagatgtactaactggacgccctttttacaaggacatcaatgagtgcaaagccttccccggcatgtgtacatacggaaagtgtcgaaataccattggaagcttcaagtgtcgatgtaatagtggctttgcccttgacatggaagagagaaactgtaccgatattgatgaatgtcgtatctctcccgacctgtgtggctcggggatttgtgttaatactccgggctcgtttgaatgtgaatgttttgaaggctacgaatcaggcttcatgatgatgaaaaactgtatggacatagacgagtgtgaacgcaacccactgctctgtagagggggtacatgtgtgaacactgaggggtcgttccaatgtgactgccctctgggtcacgagctttcccccagtagagaagactgcgtcgatatcaatgaatgtagcctttcggacaatctctgtaggaatgggaaatgtgttaacatgatcggcacctaccaatgcagctgtaaccccggataccaggcgacaccagaccgtcagggctgtactgacattgacgagtgtatgattatgaacggtggatgtgacacacagtgcaccaatagcgaagggtcctacgaatgttcttgcagcgaggggtacgcactgatgcctgatggacgctcatgcgctgatatcgatgaatgtgagaacaaccccgatatctgtgatggaggacagtgcaccaacatcccaggcgagtatcggtgcctctgctatgatggctttatggcatctatggatatgaagacctgtattgacgtgaacgaatgcgatcttaactcaaatatttgcatgtttggtgaatgcgaaaatacaaagggatctttcatctgccactgccagctggggtactcagtgaagaaggggacaaccggttgcacggacgtggacgagtgcgagatcggcgcacacaactgtgacatgcacgcatcttgtctgaatatccccgggtctttcaagtgctcttgccgtgaaggatggattgggaatggcataaaatgtatagacctcgacgagtgctcaaacggtacacatcaatgcagtattaacgcccagtgcgtaaacacacccggctcttatcggtgcgcatgctccgaaggttttaccggcgacggattcacatgctctgacgtagacgaatgcgctgagaatataaacttgtgtgaaaacggacagtgtctgaacgtgcctggagcgtatagatgtgagtgcgagatgggcttcaccccagcgtccgattcccgatcttgccaggatatcgatgagtgctcattccagaatatttgcgtatttgggacttgtaacaacctgcctggaatgttccactgcatctgtgatgatgggtatgaactggatcgcaccgggggaaactgtaccgatattgatgaatgcgccgaccctatcaattgtgtgaacggactgtgcgtaaatactcctggccgatacgaatgcaactgccctcccgattttcagctgaatcccactggagttggttgcgtagacaaccgtgttggcaactgttatctcaagtttggtcccaggggagacggttccctgagctgtaacactgagattggcgtgggcgtgagtcgaagctcctgttgttgcagcttgggcaaggcatggggtaatccctgtgagacctgccctcccgtgaattcaacagagtattacacactgtgcccggggggcgagggcttccgtccgaatccaatcacaattatccttgaggacatagacgagtgtcaggaacttccaggtctttgtcagggcggtaactgtataaataccttcggtagcttccagtgcgaatgtccacaggggtattacctgtctgaagacactcgtatctgtgaggacatagacgaatgctttgctcatccaggtgtttgtggccctggaacttgttacaataccttagggaattatacctgtatctgccctcccgagtacatgcaggtgaacggcggacacaactgtatggacatgcgcaaatctttttgctataggtcctacaacggcacaacatgtgagaatgaactcccgtttaatgtgacgaagcgcatgtgttgctgtacctacaatgtcggtaaagcttggaataagccctgtgaaccttgccccacacccgggacagctgatttcaagacaatttgtgggaatatacccggcttcacgttcgatattcatacgggaaaggcagtggacatagacgagtgcaaggagatccccggcatatgcgctaacggcgtgtgtatcaatcaaatcggttcctttaggtgcgagtgtccaacgggtttctcctacaatgatcttctgctcgtgtgtgaggatattgacgaatgcagcaatggggacaatctgtgccagaggaatgctgattgcattaacagccccgggtcttatcggtgcgagtgtgcggccgggttcaaactgagtcctaacggtgcatgtgtcgacaggaacgagtgtcttgagattccgaatgtgtgcagccacggcctgtgtgtagacctccaagggagctaccagtgtatttgccacaacgggtttaaggccagccaggaccagactatgtgtatggacgttgatgaatgtgagcggcacccttgtggaaatggaacttgcaaaaatacagttgggtcgtataactgcctatgctacccagggttcgaactgacccataacaacgattgtttggatatagacgaatgctcctcgttttttgggcaggtgtgtaggaacggacggtgtttcaatgaaattggctccttcaagtgtttatgcaacgaagggtatgaactgactcccgacggtaaaaactgcatagacacgaatgagtgtgtggcgctgcctggatcttgttctcccgggacttgtcagaacctggagggtagctttaggtgtatctgccccccagggtatgaggtgaagtctgaaaattgcattgacatcaacgagtgcgatgaggacccaaacatttgtctgtttgggtcctgtactaacacgccaggaggttttcagtgcttgtgccctcctggttttgttttgtctgacaacgggaggaggtgcttcgacactcggcaaagtttttgcttcacaaacttcgagaacggaaagtgtagcgtccctaaggcttttaacacaaccaaggctaagtgttgttgcagtaagatgcccggcgaggggtggggcgacccctgcgagctatgtccaaaggacgatgaagtcgcattccaggacctgtgcccatacggacatgggacagttccaagtctgcacgatacaagggaagatgttaatgagtgcctcgaatccccaggtatctgttcaaatggccagtgcatcaacacagatggatctttccgctgtgaatgccctatgggttataacctggattataccggggtgcgttgtgtggacactgatgagtgcagtattgggaacccctgtgggaatggaacctgcaccaacgtgataggttctttcgaatgcaactgcaacgaaggctttgaaccagggccaatgatgaattgcgaagatataaacgaatgcgcacaaaaccccctcctgtgtgcatttcgctgcatgaacacattcggctcttacgaatgcacttgtccgattggctatgctctgcgggaggatcaaaaaatgtgtaaagacctggacgagtgtgccgaagggctgcatgactgcgagtctcgtggcatgatgtgtaagaacctcattggcacctttatgtgtatttgtccccctggaatggctaggcggcctgacggtgaaggctgcgtggatgagaatgaatgcaggacaaaacctggcatatgtgagaacggccggtgtgttaacataatcgggtcttacagatgtgagtgtaatgagggattccaatcatccagcagcggcactgaatgcctggacaaccgccaggggctgtgtttcgctgaggtgcttcagacaatctgtcagatggccagctcaagccggaatcttgtcacaaaatcagagtgctgctgtgacgggggccgcggctggggacaccaatgtgagttgtgccctctgccagggaccgcccagtacaagaaaatctgtccacacggacccggatacaccaccgatggcagagacattgacgaatgtaaagtgatgcccaatctttgcacaaatggccagtgtatcaataccatggggagtttccggtgcttctgtaaggtaggatataccaccgatatttcagggactagctgcattgatctggacgaatgttctcagtctccgaagccttgcaactatatctgcaaaaacaccgaaggctcctaccagtgttcttgccctagaggctatgtgcttcaggaggacggaaagacttgcaaggacctggatgagtgtcagactaagcaacacaactgccagtttctgtgtgtgaatactttagggggttttacttgcaagtgcccccccggctttacgcagcaccacacagcgtgcatcgacaataatgagtgcggctctcagccatctctatgcggagcaaagggtatatgtcagaacacccctggaagcttctcctgtgaatgtcagagggggttttccctcgacgctaccggtctgaattgtgaggatgtggacgagtgcgatggcaaccatcgttgccagcatggatgccagaacatactgggcgggtacagatgtggctgccctcagggctacatccagcactaccagtggaatcaatgcgttgatgagaatgagtgttcgaatcctaatgcatgcggctctgcttcgtgctacaatacgctggggagttataagtgtgcctgtccttctggtttttctttcgaccagttctccagtgcatgccatgatgttaacgagtgctcctcatccaagaatccgtgcaattacggatgttctaacacggagggcgggtacctctgtggatgtccacccggctactatagggtcgggcagggacactgcgtcagcggaatgggctttaacaaagggcaatacctctccctggacacagaggtggacgaggagaatgccttgtcccccgaggcatgctatgagtgtaaaattaatggatacagtaagaaggacagtcggcaaaaaaggtccattcacgagcccgacccaacagctgtggagcagatttctctggagtctgtagacatggacagtccagtgaacatgaaattcaaccttagccacctggggagcaaagagcacatactggaattgagacctgccatccagccacttaataaccacattcggtatgtgatcagccagggtaacgacgacagtgtcttcagaatccaccagcgcaacgggctctcttatctgcacacggcaaaaaagaagctgatgcctgggacttacactctggagatcacttccattcccctgtacaaaaaaaaagagctgaagaagcttgaggaaagtaacgaggatgattatctcctgggtgaacttggcgaggcactgagaatgcggctccaaattcagttatactag

SEQ ID NO: 187798 - DNA, 8739 bp, Artificial Sequence
  Description of Artificial Sequence: Synthetic coding sequence
atgggccggcggcggcggctgtgcctgcagctgtacttcctgtggcttggctgtgtcgtgctctgggcgcaaggaacagccggacagcctcagccaccaccacctaaaccccccagaccccagccgcccccacagcaggtaagatcagcaactgccggcagcgagggtggattcctagcgccagagtacagagaagagggcgctgccgtggcatcaagagttcgccggcggggccaacaggacgtgctcagaggccccaatgtgtgcggttcccgatttcatagctattgttgtccaggatggaagacccttccaggaggcaaccagtgcatcgtcccaatttgtcggaatagctgcggagatggattttgttcaagaccaaacatgtgcacatgtagcagtggtcagatctcctcaacctgcggctctaagagcatccagcagtgctcggttcggtgcatgaacggaggcacatgtgcagacgaccactgccagtgccagaaaggttatatcgggacatattgcggccaacccgtctgcgagaacggatgtcagaacggagggcggtgtattggccctaaccgatgcgcctgtgtgtacgggttcacggggccccagtgcgagagagactatcggacagggccttgcttcacacaggttaacaaccagatgtgccagggacaattgacaggtattgtatgtacaaaaaccctgtgctgcgcaactataggacgagcctgggggcacccatgcgaaatgtgtcctgcccagccgcagccatgtcgccgcggcttcatccccaatattaggacaggcgcatgtcaggatgttgatgagtgccaagcaattcctgggatttgccaggggggcaattgtatcaataccgtcggctctttcgaatgccggtgccctgcaggccataaacagtctgaaactacccagaagtgtgaagacatcgacgagtgtagtatcattcccggaatctgtgagaccggtgagtgttctaataccgttgggtcatacttttgtgtatgcccccgaggatacgtcaccagtacggacggtagtaggtgtatcgaccaaaggactggcatgtgcttcagtggcctggtcaacggacgttgtgcccaagaacttccaggcaggatgacaaaaatgcagtgctgttgtgaacctggacggtgctgggggataggaactatccctgaggcgtgccctgtgagaggaagcgaggaatatcgcaggctctgcatggatggactgccaatgggggggattcccgggagtgctgggtcccggccaggcgggactggcggcaatgggttcgccccctccggcaatggcaacggatacggacccggaggcactggcttcatcccaattcccgggggaaatggcttttctccgggagtgggtggggccggagtcggcgccggcgggcaggggcctatcatcactgggttgaccatcctaaaccagacaattgatatatgtaagcaccacgccaacctgtgccttaatgggcgttgcatcccgaccgtcagcagctatagatgtgaatgcaacatgggatacaagcaggacgccaacggggactgtatcgacgtggatgaatgtacctctaatccgtgtaccaatggggattgtgtcaacactcccgggagctattactgcaagtgtcacgcaggtttccaaaggacaccgactaagcaggcttgtattgatatcgacgaatgcatacaaaacggggtgctatgcaaaaacggcaggtgtgtgaacaccgacggctcttttcaatgcatttgtaacgccggttttgagctgaccacagacggaaagaactgcgttgaccacgacgagtgtaccacaactaacatgtgtctaaatggcatgtgcattaatgaagatgggagctttaagtgtatctgtaagcctgggtttgtcctagcgccaaatggccgatactgcaccgacgtggatgagtgccaaacaccagggatatgtatgaatggtcattgcatcaattctgaggggtcctttcgctgcgattgtcctcctggtctggccgtcggcatggacgggagggtgtgcgtggatacccacatgcgctccacttgctatggtggaatcaaaaaaggagtgtgcgttaggccctttcccggagcggtgacaaagagtgagtgctgctgcgctaatcccgactacggattcggtgagccatgccagccatgccccgctaagaattcagctgagtttcatgggctgtgttcttcaggagtgggcatcactgtggacggcagggacatcaacgagtgcgctctggacccagacatctgtgccaatggcatctgcgagaacctccggggctcttatcggtgtaattgtaacagcggctatgagcccgatgccagcggccgcaactgcattgacatcgatgagtgtttggtcaataggctcttatgtgacaacggcctgtgccgaaacacgcctggctcttattcatgcacttgcccgccaggatatgtgtttaggaccgaaaccgaaacctgtgaagacatcaatgagtgcgaatccaacccatgcgttaacggtgcctgtagaaacaacctgggcagcttcaattgtgagtgctccccaggaagcaagttgtctagtaccggcctcatatgtatcgatagcctcaaagggacatgttggcttaacatacaagatagccggtgcgaagtgaacatcaatggcgccactcttaagagtgagtgctgcgccacattgggcgccgcctggggatccccttgtgaacggtgcgagttggatacggcctgcccccggggactagcaagaatcaagggagtgacatgcgaggacgtcaatgagtgcgaagtcttccccggcgtgtgccctaacggtcgctgtgtgaattctaagggtagctttcactgtgaatgccctgagggcctcactctcgatggcaccggaagagtgtgcctagacatcaggatggagcagtgttatttgaaatgggacgaggacgaatgcatccatcccgtgcctggcaagtttaggatggacgcctgttgctgcgctgtgggcgcagcctggggaacagagtgtgaggaatgccctaaacctggcactaaggaatacgagacactttgcccgagaggcgccggatttgctaatcgcggagatgtgctcaccggaagacctttctataaagatatcaatgagtgcaaggcttttccaggaatgtgcacgtatggtaaatgtaggaacacgattggtagcttcaaatgtcgctgcaactcaggttttgccttggatatggaggagaggaactgcacagatatagatgagtgccggattagcccagatctttgcggatcaggcatttgtgtaaatacgcctggcagcttcgagtgcgagtgctttgaggggtacgagagtggcttcatgatgatgaaaaactgtatggacatcgacgaatgtgaaagaaacccactcctgtgtagaggcgggacctgcgttaacaccgagggatccttccagtgcgattgccctctcgggcacgagctcagccctagcagagaagactgtgttgacattaacgagtgctccctctccgacaacctatgtcgcaacggaaagtgtgtgaatatgatagggacatatcagtgttcatgcaatcccggctaccaggccacccctgacaggcaaggatgtaccgatatcgatgaatgcatgattatgaatgggggttgcgacacacagtgtaccaatagtgaaggttcctacgagtgttcttgctctgaaggctatgcactgatgccagacggccgaagttgcgcagacatcgatgagtgtgaaaacaacccagatatctgcgacggggggcagtgtacaaacatacccggggagtacagatgcctgtgctatgacggcttcatggccagcatggacatgaaaacctgtatagatgttaacgaatgtgacctcaacagtaacatctgtatgttcggggagtgtgagaatactaaaggttcattcatttgtcactgccagctaggatattccgtcaaaaagggaacgaccgggtgcactgatgttgatgagtgcgagattggtgctcacaactgcgacatgcacgcttcctgcctgaatattcctggctcattcaagtgctcctgtagggaaggttggattggaaacggaattaagtgtatagacctagatgaatgctctaacggaacgcatcaatgtagtataaacgctcagtgcgtgaatactcctggcagctatcgctgtgcgtgtagcgaagggttcacaggcgacggattcacttgttcagacgttgacgagtgcgccgagaatattaacctctgtgaaaacgggcagtgtctaaatgtgccaggtgcttatagatgtgaatgcgaaatggggttcactccagcttccgattcacgatcatgccaggacattgacgagtgcagttttcagaacatttgcgtatttggcacatgtaataatttgcctggcatgttccactgcatctgcgacgatggttatgagcttgataggaccggagggaattgtacagatattgatgagtgtgctgatcctatcaactgcgtgaatggactgtgcgtaaacacccccggtcgctatgagtgtaactgtcccccggacttccagctcaaccctactggagttggctgtgtggataatcgcgttggtaactgctatctgaagtttgggcccagaggcgatggatcccttagctgcaacacggagatcggcgtgggggttagcaggtcctcatgctgctgtagccttggtaaggcctggggaaacccttgcgaaacctgccccccggtaaatagtacagagtattacacgctgtgcccaggcggcgaggggttccgacctaatccgatcactatcattctcgaagacatcgacgagtgtcaggaacttcctgggttgtgccaagggggcaattgtatcaatacatttggcagctttcagtgtgaatgtcctcagggatattacctctcagaagatacgcgcatctgcgaggatatcgacgaatgcttcgcccatccaggcgtctgtggaccaggtacgtgttacaacacactgggtaattacacttgcatttgcccccctgagtacatgcaagtgaatgggggccacaattgtatggatatgaggaaaagcttctgctatagaagctacaacggaaccacgtgcgagaacgagctccctttcaacgtaacaaagcgaatgtgttgttgtacatacaatgtcgggaaggcatggaacaaaccatgcgagccatgccccaccccaggaaccgcagatttcaaaactatctgcggtaatattcccggattcacattcgacatccacaccggaaaggcagtggatattgatgaatgcaaagagattccaggcatttgtgcaaacggagtctgcataaatcaaatagggagctttcggtgcgaatgcccaactggtttctcctataacgaccttctactcgtgtgcgaagacatagatgagtgttccaacggggataatctgtgccagagaaacgccgattgcattaatagtcctgggagctaccgatgcgagtgcgccgccggattcaagctgagcccaaatggagcctgcgtggatcggaatgagtgtctggagattcccaacgtgtgcagtcatggactgtgcgtggatctgcagggttcttatcaatgcatttgccataacgggttcaaagcaagtcaggaccagactatgtgtatggacgtggacgagtgcgaaagacacccatgtggtaatgggacttgtaagaacacggtcggctcctataactgcctttgctatcctggcttcgagctcactcataacaacgattgcctggatattgacgagtgttctagcttcttcggtcaggtttgccggaatggacgctgcttcaacgaaataggcagctttaaatgtctctgcaacgagggctacgaactgactccggatggcaaaaattgtattgatacgaacgaatgtgttgccctgcccggctcctgcagccccggtacatgccagaaccttgaggggagcttccggtgcatctgtcctccaggctatgaagtcaagtctgagaactgtatcgacattaatgagtgcgatgaagaccctaacatttgtctgttcggctcatgtactaacacaccgggggggttccagtgcctttgcccccctggcttcgtgctgagtgataacgggaggaggtgttttgacacaagacaaagcttctgtttcactaactttgaaaacgggaagtgttcggttccaaaagctttcaacactactaaggccaagtgttgttgctccaagatgccaggcgaaggatggggcgatccctgtgaactgtgtcctaaagacgacgaggttgcttttcaagatctttgtccgtatggtcacggcactgtcccatcgctacacgatacccgggaggatgtgaatgagtgtctcgagtcgccgggtatttgctcaaacgggcagtgcatcaacacagacggttccttcaggtgcgagtgtcctatgggatacaacctggactataccggggttcgttgcgttgatactgacgagtgcagtattggaaatccttgcggaaacgggacatgcaccaatgtcataggaagcttcgagtgtaactgcaacgaggggtttgaacctgggccaatgatgaactgtgaggatattaatgagtgtgcgcaaaatccactactctgtgcatttcgatgcatgaatactttcggatcgtacgagtgcacatgtccgatcggctatgccctgagagaggatcagaagatgtgtaaggatctggatgagtgcgccgaggggttgcacgattgtgagtcccgaggcatgatgtgtaaaaatctgattgggacttttatgtgtatatgtccacctggaatggcccggcgtcctgatggggagggttgcgtcgacgagaatgagtgtagaaccaaacccggaatctgtgaaaacgggcgctgtgtgaatataattgggtcataccgatgcgagtgtaacgagggtttccagagttctagctccggaacagaatgtcttgacaatagacagggcctgtgttttgctgaagtgcttcagacaatctgccagatggccagctctagccgaaacctagtcactaagtcagaatgctgctgcgatggcggacggggctggggccaccaatgtgaactttgtccactcccggggaccgcgcagtacaagaagatatgccctcacggccctggatacacaaccgacggcagagatatcgacgagtgtaaagtgatgcctaacttatgtacaaacggccagtgtattaataccatggggagctttcgatgcttttgtaaagtcggatataccacagatatctcagggaccagttgcatcgacctggacgagtgttctcagagtcctaagccgtgtaattacatctgcaagaacaccgagggatcatatcagtgctcttgccccagaggctatgttctacaggaagacggcaagacctgtaaagatttggatgagtgtcaaactaagcagcataactgtcagtttttgtgcgtgaacactttgggcggcttcacctgtaaatgtccgcctggtttcacccagcaccatactgcttgcattgacaacaatgagtgcgggagccagccctcgctctgcggggctaaaggaatttgccaaaatacccccgggagcttcagttgcgagtgtcagagggggttctcactggatgccacggggttaaactgtgaggacgtcgacgaatgcgacggaaaccataggtgtcagcatggatgtcagaatattcttggcggatatagatgtggctgtcctcaaggatatatccaacactatcagtggaaccaatgcgtagatgagaacgaatgttcaaaccccaacgcgtgcggctctgcttcttgttacaacacactagggtcttacaagtgtgcctgtccttcaggcttcagtttcgatcagttctctagtgcatgccacgatgtaaacgaatgttcaagcagcaagaacccttgcaactacggttgcagtaatacagaaggaggttacctgtgtggctgccccccaggatattaccgggtggggcaggggcactgcgtgtccggtatgggcttcaataaggggcagtatctgagtctcgatactgaagtggatgaggaaaacgccttgtccccagaagcgtgctacgaatgcaagatcaatggctacagcaagaaggatagcagacagaagcgcagcattcatgagccggacccaaccgcggtagaacagatttctctagagtctgtagacatggatagccctgtaaacatgaagttcaatctgtcccacttgggaagtaaagagcatatcctggagttacgcccagcaatacagcctctgaacaaccatatccggtatgtcattagccaaggcaacgacgactcggtcttccgcattcaccagagaaatgggctgagctatttgcacacagctaagaagaaactgatgcccggcacctatacacttgagattacgtcaatacctttatataagaaaaaggaactgaaaaagctggaagaaagtaatgaggacgactacttgctcggtgagctcggcgaagccctgaggatgagactgcagatccagttgtactag

SEQ ID NO: 187799 - DNA, 597 bp, Artificial Sequence
  Description of Artificial Sequence: Synthetic coding sequence
atgggcctgcggaagggccacggcaccctgggccagggcctgagcgctctgcagagcgaacaaggcaggctgatccagttgctgagtgaatcccagggccatatggcccacttggttaattctgtgtccgatattctcgacgccctgcaacgcgatagaggcctcggtaggcctcgaaacaaagccgatctgcaaagggccccagccagagggactaggccgagaggctgcgcaacaggttcgcgacctcgcgactgtctcgacgttctgctgagcggacagcaggacgatggagtgtactccgtttttcccacccactatccagctggcttccaggtgtactgcgatatgaggaccgatgggggagggtggactgtcttccagagacgggaggacggaagcgtgaacttcttcagaggctgggacgcgtaccgggacggctttggccggttgacaggcgaacattggctcggtcccttagactggtgcactctgtctttggccctgctcgtgcccgtagctcccagccctacaccgcctcatagcttcgttaacgtgttacaccctcccgttcctggggggccaacactgcagtag

SEQ ID NO: 187800 - DNA, 912 bp, Artificial Sequence
  Description of Artificial Sequence: Synthetic coding sequence
atgggcctgcggaagggccacggcaccctgggccagggcctgagcgccctccaatcagaacaaggccgcctcatccagttgctttccgagagtcagggacacatggcgcacctggtgaattccgttagcgacatcctggacgcactacagagagacagaggcctgggccgtcctcggaacaaggccgacctccagcgcgccccggccaggggcacacgcccccgcggctgtgctacaggatccaggcccagagattgcctcgacgtactacttagcgggcaacaggacgatggggtgtactccgttttccctactcattatcctgcaggcttccaagtttactgcgacatgagaaccgatggtggcggctggaccgtattccagaggagagaagacgggagcgtaaacttttttagagggtgggatgcctatagggacgggttcgggagattgaccggcgaacactggctggggttgaagaggatccatgcgctcacaacacaggcggcctatgagctccacgtagaccttgaggattttgagaacggcactgcctacgcacgttacggcagctttggggtcggcctgttcagcgtggaccctgaggaagacggctaccctcttacagtcgcagactattccggtacggcaggcgattcacttctgaagcactcggggatgaggtttaccactaaggacagagactctgatcacagcgaaaataattgtgcagctttttaccggggtgcttggtggtatcgaaattgtcacacttcaaatctgaacggccagtatctgaggggggctcacgcctcatacgcagatggtgtagaatggagtagctggaccggctggcagtattctctgaagttctccgaaatgaagataaggccagtccgcgaggatcggtag

SEQ ID NO: 187801 - DNA, 1386 bp, Artificial Sequence
  Description of Artificial Sequence: Synthetic coding sequence
atggtgaacgaccggtggaagaccatgggcggcgccgcccagctggaagatcggccaagagataagccacagaggcctagctgcgggtatgtgctgtgtacggtgctcctggccctggctgttttactcgcggtggccgtgactggggccgtcctgttcctgaatcacgcccatgccccaggaactgcgccacctccagtggtgtcaaccggggccgcttcagccaacagcgctttggtaactgtcgagcgcgctgactctagccacctgtctattctcatcgatccacgatgccccgacctgaccgactcattcgcaagactggagtctgcgcaagcgtccgttttgcaggcactcactgagcatcaagctcaaccccgactggtcggcgaccaagagcaggaacttctcgatactctagccgatcagttgcctaggctgctggcaagggcgtctgaactgcagaccgagtgcatgggcctgcggaaaggtcacggtactctcggtcagggcctatccgccctgcagtccgaacagggacgtctcatccagctgctcagcgaatcacaggggcacatggcacacttggtgaactccgtttcagatattctggacgcccttcagagggatcgcggactcggacgccctagaaataaagccgatctgcagcgggcgcctgccagggggacccgcccaaggggatgtgcaacggggtcaagacccagggactgtcttgacgtgcttctctcaggacaacaagatgacggcgtttatagcgtatttccaactcattatccagcgggcttccaggtgtattgcgatatgaggactgacgggggcgggtggacagtgttccagaggcgtgaggacggtagcgtcaattttttccgcggttgggatgcttatagggatggatttggccgcctaacaggagagcactggctcggcttgaaacggattcatgccctgactacccaggccgcctatgagcttcatgtcgacctggaagactttgagaacggcacagcgtatgcacgctacggatcctttggtgttggtttgttcagtgtggaccccgaagaggacgggtatcccttgactgtggcagactacagcggtaccgcaggagactctctgctgaaacactccggtatgaggttcaccaccaaggaccgcgactccgaccacagcgagaataactgtgctgccttttaccgaggcgcctggtggtacagaaactgtcatacctccaatctgaacgggcagtacctacggggggcccacgctagttacgctgatggtgtggagtggtcctcctggaccggctggcaatatagtcttaaattctctgagatgaagatccgtccagtgcgtgaggacaggtag

SEQ ID NO: 187802 - DNA, 933 bp, Artificial Sequence
  Description of Artificial Sequence: Synthetic coding sequence
tgaaccggcgccgtgctgttcctgaaccacgcccacgcccccggcaccgctccgcccccggtggttagcaccggcgcagcatccgcaaactctgccctggtgaccgtcgagagagcggattcatctcatttgagtattctgatcgatcctcgctgtccagaccttaccgattcattcgcccgcttggagtccgcgcaggcctcagtgctccaggctctgacggaacaccaggctcagccgaggttggtcggggatcaggaacaggaactcctagacactctagctgaccagctgcctaggctgctcgccagagccagtgagctccagacagaatgcatggggctgaggaaaggccatggcactttgggccaggggctcagcgcactccagtccgaacagggtcggctcatccaactgctgagtgagtctcagggccatatggcccacctggtgaattcagtaagtgatattctcgatgcactccagcgggatcggggcctgggaaggcctcggaataaggccgacctccaacgagcaccggcacgggggactcgccctagggggtgtgctaccggcagtaggcctcgggactgtctcgatgttctcttaagtggccagcaggacgatggtgtctattcagtgttcccaacacactacccggccgggtttcaagtgtactgcgatatgcgaacggatggaggggggtggacggtgtttcagcggagggaagacggttccgtgaacttttttagagggtgggacgcatatagagacggattcggccggctgacaggcgagcactggctggggcccttggactggtgcacactcagtttagcgctgctggttcccgttgctccctctcccaccccaccccatagttttgtaaacgttctgcaccctcctgtcccaggcggtcccaccctgcaatag

SEQ ID NO: 187803 - DNA, 1386 bp, Artificial Sequence
  Description of Artificial Sequence: Synthetic coding sequence
atggtgaacgaccggtggaagaccatgggcggcgccgcccagctggaagatcggcctcgggataagccccagagacccagctgcggctatgtgctctgtaccgtgttactcgcgctagcagttctgctcgccgttgccgttaccggcgccgtactctttctcaaccatgctcacgcccccggcactgcgccccctccagttgtttccacaggagcagcgtccgcaaactcggccctggttaccgtggaaagagccgactcctcccacctgtccattctaattgaccctaggtgcccggatctcaccgattcatttgctagactggagtcggcgcaggcaagcgtgctacaggcactcactgagcaccaggcacaaccccgcctggttggagaccaggaacaagagctccttgacaccctggctgaccaactgcctcgtctgcttgctcgtgcttcggagctgcagaccgaatgtatggggcttcgaaaagggcatggcaccctgggccagggcctgagcgctctccagagcgaacaaggtcgcctgattcagctactctccgagtcccaggggcatatggcgcacctcgttaacagcgttagcgatattctagacgctctgcagagagatcgggggttaggccgaccaagaaacaaagccgacctgcaaagagcccctgccagagggaccaggccacggggctgcgcaacgggctcccgccctagagattgtcttgacgtgctgctgagcgggcagcaagatgatggagtgtactccgtctttcccactcactatcctgctgggttccaggtgtactgcgatatgcggacagacggaggcggctggacagtattccagagaagggaagatggctcagtgaacttctttaggggttgggatgcctacagggacggctttggacgtctgaccggcgaacactggctcggtctgaaaagaatccatgcgctgacaacacaggctgcatacgaactgcacgttgacttggaagactttgagaacggaacggcatatgctaggtacggctccttcggcgttggactgttctcggtagatccagaggaggatggttatccactcactgtggctgattactccggcacagctggggactcgctgttaaagcatagcggcatgaggtttacaaccaaggaccgcgacagcgaccactcagagaacaactgcgctgcattctataggggagcttggtggtatcgaaactgccatacatccaacctgaacggccagtacctgagaggggcgcatgcaagctacgcagatggcgtggagtggtcatcttggaccggctggcagtatagtctcaagtttagcgaaatgaagatccgacccgtccgggaagaccgctag

SEQ ID NO: 187804 - DNA, 870 bp, Artificial Sequence
  Description of Artificial Sequence: Synthetic coding sequence
atggtgaacgaccggtggaagaccatgggcggcgccgcccagctggaggacagaccccgggacaaaccacagcggccaagctgtgggtatgtgctgtgcactgttcttttagctctggctgtactgctggctgtggccgtcaccggtgcagtactctttttaaatcacgcacacgcgcctggcaccgcaccaccccccgttgttagcacaggagctgcgagcgctaattcggcgctggttactgtggaacgggctgattctagccatttatccatattgattgatcccaggtgtccagatcttaccgacagttttgctcggttagaaagtgcccaggcgtcagttctgcaggctttgacagagcaccaagcccaacctaggctggtcggcgatcaagaacaggagctgctggacacgctagccgatcaactgccgcgcctgttagcccgagctagcgagcttcagacggaatgcatgggtctacgcaaaggccatggaacactgggccagggcttatcggctttgcagagcgagcagggccggcttatccagctgcttagcgaatctcaaggtcatatggcccatctggttaactccgttagcgacatcctggacgccctgcagcgcgacagaggcttaggacggcctcgcaacaaggcggacttgcaaagagcccccgcccggggaactcgtccacgtggctgtgccacgggatccagacctcgggactgcctggacgtccttcttagcggccagcaagacgacggagtttattccgttttcccaactcactaccctgcgggcttccaagtctattgcgatatgcgtaccgatgggggaggctggaccgtcttccagcgacgggaatag

SEQ ID NO: 187805 - DNA, 540 bp, Artificial Sequence
  Description of Artificial Sequence: Synthetic coding sequence
atggtgaacgaccggtggaagaccatgggcggcgccgcccagctggaggatcgtccaagggataagccacaggcgcggaaactgcgcttgagagaaagacctagttgtgggtacgtgctgtgcactgtgctgctggccctagctgttctgctggctgtggctgttacaggggctgtgctattcctgaatcatgcccacgccccgggcacagcccctccccctgtggtttccacaggtgcggcttccgccaacagtgccctggtgaccgttgaacgcgccgatagttcccacctgtcaattttaattgacccgcgatgccccgacttgactgacagctttgcccgcttagagtccgcccaagcaagcgttctacaagcactgacagagcatcaggcacaaccacgattggtgggggaccaggagcaggaacttctggatacgctcgccgaccagctgccacggttgctcgccagagcgtccgagctgcagacagaatgtatgggcttacggaagggccatggaaccctcggccaggggtag

SEQ ID NO: 187806 - DNA, 1170 bp, Artificial Sequence
  Description of Artificial Sequence: Synthetic coding sequence
atgcggcgggtgaccctgttcctgaacggcagccccaagaacggcaaagtcgttgctgtgtacggcactctgtctgacttgctgtccgtggcttccagcaagcttgggatcaaggccaccagcgtgtacaacggtaaaggtggcttgattgacgacatcgctctgatccgggatgatgatgtgctctttgtgtgcgagggagagcccttcatcgaccctcagactgattctaagccgcctgagggtctccttgggtttcacacagactggttgaccttgaatgtcgggggtcgatattttacaacaactaggagcacccttgtcaacaaggagccagactcaatgctcgcacacatgttcaaagataagggagtctggggaaataaacaggatcaccgaggtgcgtttctgattgatcgctccccagagtatttcgagccgatcctgaactacctgaggcatgggcagctgatcgtgaacgatggcataaatttgctgggggttctcgaagaagcaagattcttcggaatcgattctttaatagagcatcttgaggtagccattaaaaactcccagcctccagaggaccacagccctatcagtcgcaaggagtttgtcagattcctactcgctacacctaccaagtccgaactgcggtgtcaagggctgaacttctcgggcgccgatttgagccggctggatctcaggtacattaattttaaaatggcgaacctgtcgagatgtaacctggctcatgcaaatttatgctgcgcaaatctggagcgagcagacttgtcaggctcagtgctggactgtgctaacctccagggggtgaagatgttgtgtagcaatgccgaaggggcaagcctgaaactgtgtaattttgaagatccaagtggtttgaaagctaacctagagggggctaacttgaaaggcgtcgacatggagggatcccaaatgaccggcataaacctccgggtggctactctcaagaacgctaagttgaaaaactgtaatttgagaggcgcaacgctggccggtacggatctcgagaactgcgatttatctggctgtgacctgcaagaggctaacttgagggggtctaacgtgaaaggagccattttcgaggaaatgctcaccccactccacatgagtcaatctgtcaggtag

SEQ ID NO: 187807 - DNA, 939 bp, Artificial Sequence
  Description of Artificial Sequence: Synthetic coding sequence
atggccaaggtgttcagcttcatcctggtgaccaccgccctgaccatggggcgggagataagcgctctcgaagactgtgcccaagaacagatgcggctgagagcacaggtccgcctactagagactcgggtgaaacaacagcaggtgaaaatcaaacagctgctgcaggagaacgaggtccagtttctcgataagggcgatgaaaacactgttatcgacctaggcagcaagcgccaatatgccgactgtagcgaaatctttaacgacggctataaactgtcggggttctacaagataaagcccctccagagccctgctgagttttccgtttattgtgatatgtcagacggcgggggctggaccgtcatccagcggcgtagcgacgggagcgagaactttaatcgcggctggaaagactacgagaatggctttggtaactttgtgcaaaagcacggggagtactggctcggcaacaaaaatttgcatttcttgacgactcaggaggattataccctcaaaattgatctcgccgacttcgagaagaacagcagatacgctcagtataaaaatttcaaggttggggacgaaaagaatttctacgaattgaatatcggagagtacagtgggacggcaggcgactcactggcaggtaactttcaccccgaggtgcagtggtgggcgtcgcaccagcgtatgaagttctccacttgggatagggatcatgacaattatgagggaaattgcgcggaggaagatcagtctggctggtggtttaaccgctgccactccgccaacctgaatggagtctactatagcggtccgtacactgcaaagacagataacggaatcgtttggtatacctggcacggttggtggtacagcctgaagtctgtggtgatgaagattcgacccaatgattttattcccaacgtgatatag

SEQ ID NO: 187808 - DNA, 939 bp, Artificial Sequence
  Description of Artificial Sequence: Synthetic coding sequence
atggccaaggtgttcagcttcatcctggtgaccaccgccctgaccatgggaagagagatctccgcattagaggattgtgcccaggagcagatgcgattgagggctcaggtcaggctccttgagacaagggttaagcaacagcaggttaagatcaaacagctgttacaggaaaatgaagtgcagttcctggataaaggcgacgagaacactgtcatcgacctggggagcaagaggcagtacgcggactgctctgagatttttaatgacggatataagctaagtggattctacaagatcaagccattacagtctccggctgaattttccgtgtattgcgatatgtctgacggaggagggtggaccgtgatacagcggaggtcagacggatccgaaaattttaatagagggtggaaggattacgaaaacggcttcggtaacttcgtgcagaaacatggggagtattggctaggcaacaagaacttacatttcctaaccactcaggaagattatactttgaagatcgacctggcagacttcgagaaaaattctaggtatgcccaatacaagaattttaaagtcggagacgagaaaaatttttatgaactgaacatcggcgagtactccggcacagccggagactctttggcaggtaactttcatccggaggtgcaatggtgggcgtcgcatcaacgtatgaaattcagcacctgggacagggatcacgataattacgaaggtaactgtgccgaggaggatcaaagcggctggtggtttaacagatgtcatagcgccaatctgaacggagtgtactattccggtccttacaccgcaaagactgataatgggatcgtgtggtacacctggcatggttggtggtactctttgaagtcagtcgtgatgaagataaggcctaatgacttcataccaaacgtcatctag

SEQ ID NO: 187809 - DNA, 939 bp, Artificial Sequence
  Description of Artificial Sequence: Synthetic coding sequence
atggccaaggtgttcagcttcatcctggtgaccaccgccctgaccatgggcagagagattagcgctcttgaggactgcgcacaggaacagatgagattgagagcacaggtgaggttacttgagactagggtcaagcagcagcaggtcaagatcaagcagttgctgcaggagaatgaggtgcagttcctcgacaagggcgacgagaataccgttattgatctgggaagtaagcgccagtacgcagattgctcagagattttcaacgacgggtataagttatcagggttttataaaatcaaacccctgcagagccctgctgaatttagtgtctactgcgacatgtcagatggcgggggctggactgtcatccagcgccgttctgacggaagcgagaattttaaccgtggctggaaggattacgagaatggcttcggcaattttgtccagaagcatggagaatactggctgggcaataagaacctgcatttcctcacaactcaggaagactataccctcaaaattgacctggccgactttgagaagaactccagatacgcacagtataaaaatttcaaggtgggtgatgagaagaacttctatgagttaaatatcggagagtacagcggaactgcaggtgattctctggctgggaattttcatcccgaggttcagtggtgggcatctcaccagcgcatgaaatttagtacatgggatagagaccacgataattacgagggcaactgcgcagaggaggaccagtccggctggtggttcaacaggtgtcattctgcaaatctcaatggggtgtactactcaggtccttacaccgctaaaactgataacgggatagtctggtacacatggcatggctggtggtactctttgaagagcgtggtcatgaaaatccgccctaacgatttcataccaaatgttatctag

SEQ ID NO: 187810 - DNA, 939 bp, Artificial Sequence
  Description of Artificial Sequence: Synthetic coding sequence
atggccaaggtgttcagcttcatcctggtgaccaccgccctgaccatgggcagagaaatcagcgcattggaggattgcgctcaggagcaaatgcggttaagggcccaggttaggcttctcgaaacgcgggtcaaacaacagcaggtcaagatcaagcaactcctccaggagaatgaggtacagtttctagataagggcgacgaaaatactgtaattgaccttggctctaagagacagtacgccgactgtagtgagattttcaacgacggctataagctgtcggggttttacaagatcaagccccttcagtcgcccgcggagttctctgtttactgtgacatgtctgatggtggggggtggactgtgattcagcgccgaagtgacggctcagagaactttaatcgaggctggaaggactacgagaacggtttcggtaactttgtgcagaagcacggggagtactggctgggaaacaaaaatctgcatttccttaccacacaggaggattatactctgaagatcgacctggccgatttcgaaaagaactcccggtatgctcagtacaagaacttcaaggtgggcgacgaaaaaaatttctacgaacttaacataggagaatattcaggaacagcaggggactcccttgcagggaacttccatcctgaggtccagtggtgggcctcccatcaaaggatgaagttctcaacttgggaccgggatcatgataactacgaagggaactgcgccgaagaagaccaaagtgggtggtggttcaatcgttgccatagcgccaatctcaatggggtctattactctggtccttataccgccaagacagacaacgggatagtttggtatacctggcacggctggtggtattcactaaagtccgtggtcatgaagatcagaccgaacgacttcatcccgaatgtcatttag

SEQ ID NO: 187811 - DNA, 939 bp, Artificial Sequence
  Description of Artificial Sequence: Synthetic coding sequence
atggccaaggtgttcagcttcatcctggtgaccaccgccctgaccatggggcgcgagatcagtgctcttgaggactgtgcacaggaacagatgcgccttagggcccaggtgcgcctcctggaaacaagagtgaagcagcagcaggtgaagatcaaacagctgttacaagaaaacgaagtccagttcctggataaaggggatgagaatactgtgattgatcttggatcgaagcgccagtatgcagactgttccgagatctttaacgacggctataaactgtcagggttctacaagataaagccgttacagagcccggcagagttctcagtgtattgcgatatgtctgacggcggaggatggacggtgattcagcgcaggtcggacggatccgagaatttcaaccgcggctggaaagactacgagaatggttttggaaacttcgtgcagaaacacggggaatattggcttggaaacaaaaacctgcacttcttgacaacacaggaggattatactctgaagatagatctggcagacttcgagaagaacagtcggtatgctcagtacaagaatttcaaagtcggggacgaaaagaatttttacgaattgaacatcggggagtactcaggaacagcaggggattccctcgcggggaatttccacccagaggtgcagtggtgggctagccaccaaagaatgaagtttagtacctgggatagggatcacgataattacgagggcaactgcgccgaggaggaccagtcagggtggtggtttaatcgctgtcactccgccaatctgaatggagtttattattctggtccttacaccgccaagacggacaatggaattgtctggtacacttggcacggttggtggtactctttaaagagcgttgtgatgaagatccggccgaatgattttattcctaacgttatctag

SEQ ID NO: 187812 - DNA, 939 bp, Artificial Sequence
  Description of Artificial Sequence: Synthetic coding sequence
atggccaaggtgttcagcttcatcctggtgaccaccgccctgaccatgggaagggagatcagcgcacttgaggactgcgcccaggagcagatgcgtttgcgcgcacaagtgagactactggagactcgtgtcaaacagcagcaggtcaaaataaagcagttgctccaggaaaatgaagtgcagttcctggataagggggacgagaatacggtgatagacctgggatccaagcgtcaatatgctgactgttccgaaattttcaacgacgggtataagctgtccggcttctacaagattaaacctctccagagtccagccgaattctccgtatactgcgacatgtccgatggaggaggctggacagtcattcaacgccggtctgacggctccgagaatttcaaccggggctggaaggattatgagaacggtttcgggaacttcgtccaaaaacatggagaatactggctgggcaacaagaacctacacttcctgactactcaggaggactatactctgaaaatcgacctggcagacttcgaaaaaaacagtcggtacgcccaatataaaaactttaaagtcggggacgaaaaaaatttttatgaattgaacatcggtgagtattcgggaaccgcgggagatagcctagcaggtaactttcacccagaggtacaatggtgggcctctcaccagcggatgaaattttccacatgggatagagaccacgataattatgagggcaactgcgctgaggaggatcagtctggctggtggtttaaccgctgtcattctgcaaatcttaacggcgtgtattactctgggccctacaccgccaagactgataacggcatcgtatggtacacctggcacgggtggtggtattctctgaagtctgtagtgatgaagattcgccccaatgacttcattcccaatgttatctag

SEQ ID NO: 187813 - DNA, 849 bp, Artificial Sequence
  Description of Artificial Sequence: Synthetic coding sequence
atgcggctgcgggcccaggtgcggctgctggagacccgggtgaagcagcagcaggtaaaaataaaacagttactgcaggaaaatgaagtgcaatttctggataagggagacgaaaacactgtgattgacctgggatctaagagacaatatgctgactgctccgaaatcttcaacgacggctataaactgtctggcttttacaagataaagcccctgcagagtcccgccgagttttccgtgtattgtgatatgagtgatggaggcgggtggacagttatacagagaaggtccgatgggagtgaaaattttaaccgaggctggaaagactatgagaatggctttggaaatttcgtacagaaacatggcgaatactggctaggcaataagaacctgcactttctcactacacaggaggattacacactgaagattgacctggccgatttcgaaaaaaactctaggtacgctcagtataaaaatttcaaagttggtgacgaaaaaaacttttatgagctcaacatcggcgagtactcggggactgctggagatagtctggcaggaaacttccaccctgaggtgcaatggtgggcaagccatcagcggatgaagttttccacttgggatcgcgaccatgacaactacgaggggaattgcgctgaggaggatcaatcaggttggtggttcaatcgatgccacagcgccaatctcaacggcgtgtattatagcggaccttatacggcaaagacagacaacggtatcgtgtggtatacatggcacggttggtggtattcgctcaagtctgtggtgatgaaaattaggcccaatgatttcattcctaatgtaatctag

SEQ ID NO: 187814 - DNA, 939 bp, Artificial Sequence
  Description of Artificial Sequence: Synthetic coding sequence
atggccaaggtgttcagcttcatcctggtgaccaccgccctgaccatgggaagagaaataagtgcattagaggattgtgcacaggagcaaatgcgtctgcgcgcccaggttcgtctcctcgagactagggtgaaacagcaacaagttaagatcaaacagctgctccaggaaaacgaagtgcaattcttggataagggagacgaaaacactgtaattgatcttggatccaagcggcaatacgccgactgctctgagattttcaatgatggctataaactcagcggattttacaagattaagccactgcaaagcccagcagaattctcggtgtactgtgatatgtctgacggtggaggctggaccgttatacagaggcgcagtgatggctctgagaatttcaacaggggctggaaggattacgagaatggcttcggcaacttcgtgcagaaacacggcgagtactggctagggaacaaaaacctacacttcctgactacacaagaagattataccctgaaaatagacctggccgacttcgagaaaaatagccgctatgcccagtacaaaaattttaaagtcggggacgagaaaaatttttacgagttaaacatcggtgagtactctgggaccgccggagatagtcttgccgggaacttccacccagaagtacagtggtgggcatcccatcagagaatgaagttctccacatgggaccgggatcacgacaactatgaggggaactgcgccgaagaagaccagagtggctggtggttcaacaggtgtcactccgcaaacctgaacggggtctactactctggtccatacacggctaaaacagataatggcatagtgtggtacacatggcacgggtggtggtactccctgaagagcgtggtaatgaaaattaggccaaacgactttattccgaatgtcatttag

SEQ ID NO: 187815 - DNA, 1320 bp, Artificial Sequence
  Description of Artificial Sequence: Synthetic coding sequence
atgaagctggccaactggtactggctgagcagcgccgtgctggccacctatggttttctagtggtcgcaaacaacgaaacggaggagatcaaggatgagagggctaaggatgtgtgcccggttagattagaatcgcggggtaagtgcgaagaggccggggagtgcccataccaagtaagcctgcctcctctcacaattcagctccctaagcagttttctcgcatagaggaggtttttaaagaggtgcaaaatttgaaagagatcgtaaactccctgaaaaaaagttgccaggattgcaaacttcaggctgacgataacggagatcctggccggaatggacttctcctgccatccacaggcgctcccggcgaggtgggagacaatagggttagggagctcgagagtgaagttaacaaactcagtagcgagcttaaaaatgccaaggaagaaattaacgttctgcacgggaggctagagaaattgaaccttgttaacatgaataatatcgagaactacgtagattctaaagtcgcgaacttgactttcgtggtcaattccctggatggaaaatgtagcaaatgtccttcacaagagcagattcagtcccgtcccgttcagcacttgatctataaagactgctctgattactatgcgattggaaagcgtagctctgaaacctaccgggtgacacctgatccaaagaactcctcttttgaagtttactgcgacatggagacgatggggggcggatggactgtgctgcaggctaggctcgatggaagcactaattttacaagaacttggcaggactacaaggcggggttcggtaatctccgtcgcgagttctggctgggcaatgacaaaattcatttgctaactaaaagcaaggaaatgattctgcgcattgatctggaggacttcaatggggtcgaattgtacgccctctatgaccagttctatgtggcaaatgaatttctcaagtacaggctgcatgttggcaattataatggaacggccggagacgcactccgttttaacaagcactataatcacgacttgaaattttttactacccctgacaaagacaatgatcgctacccatctggaaattgcggcctgtattacagtagcggttggtggtttgacgcatgcctgagtgctaacctcaacggaaagtactaccaccagaaatatcgaggtgtcaggaacgggatcttttggggaacttggccaggcgttagtgaagctcaccccggcggctacaagagctccttcaaagaggctaaaatgatgattagacccaaacacttcaaaccttag

SEQ ID NO: 187816 - DNA, 1095 bp, Artificial Sequence
  Description of Artificial Sequence: Synthetic coding sequence
atgaccagcgagctggacatcttcgtgggcaacaccaccctgatcgacgaagacgtgtatcgattatggttagacgggtattccgtcacggacgccgtcgccttgcgcgtgcgcagtggcatcctcgagcagactggcgcaaccgccgcagtgttgcagtccgataccatggaccattacagaactttccatatgttggagcggttactgcacgcaccgccaaaattacttcatcaactgatttttcagatccctcccagccgtcaggccctgctgattgagcggtattacgccttcgacgaagcgtttgtgcgagaggtcctggggaagaaacttagcaaaggaacaaaaaaagatcttgacgacatcagtactaaaaccggcattacactgaaatcttgccgccgccagttcgacaatttcaagcgggttttcaaggtggtcgaggaaatgcgcggttccttggtcgataatattcagcagcactttcttctatcggaccgattggcccgtgactacgctgctatcgtgttctttgcaaataatagatttgagacagggaagaaaaagcttcagtatctgagctttggagattttgcattctgcgcggagctcatgatccaaaactggacactgggagcagtcggcgaggccccaactgatcctgacagtcagatggacgacatggacatggatctcgataaggaatttcttcaggaccttaaagagctgaaagttttggttgccgataaggaccttctggacttgcacaagtccctcgtgtgtacagcgctgcgcgggaaactgggagtcttctcagagatggaggcgaacttcaagaatctgtcccgcgggctggtgaacgtcgcggctaagctcactcacaataaagacgtccgggatctgttcgtcgatctggtcgagaaattcgttgaaccttgcaggagtgatcactggccactgagcgatgttcgattcttcctgaaccagtactcagcgtccgtacattctttagacgggttccgccaccaggcactgtgggaccgttacatgggcacactaagggggtgcctcttacgattgtaccacgattag

SEQ ID NO: 187817 - DNA, 1074 bp, Artificial Sequence
  Description of Artificial Sequence: Synthetic coding sequence
atgaccagcgagctggacatcttcgtgggcaacaccaccctgatcgacgaggatgtctacagattgtggctggatggatactccgtcacggacgcagtggcacttcgggtccgcagcggcatactggagcaaacaggcgctacagccgctgtgctccaatcagacacaatggaccattatcgcacatttcacatgctggaaaggctgctgcacgcaccccccaaactgttacatcaactcattttccagatacctccatcaagacaagcattgctcattgaaagatattacgcgttcgacgaagccttcgtgagagaagtccttggcaagaagttgagcaagggaactaaaaaagacttagacgacatctcaactaagactgggattaccctgaaatcctgtcggcgccagttcgataatttcaaaagagtgttcaaagtggttgaggaaatgaggggaagcctggtggacaacatccagcagcactttcttctctcagataggttagccagagactacgccgcgatcgtctttttcgcgaataaccgttttgagacgggtaaaaagaagttgcagtacctgtcgttcggagacttcgcattttgcgcagagttaatgattcaaaactggaccctgggagctgtagattcccagatggatgatatggacatggatctcgacaaagaattcctgcaagatcttaaggaactgaaggtgctggtggccgacaaagatctcttggacctccacaagtccctggtgtgcaccgcactccggggtaaactgggcgtattttccgaaatggaggccaactttaagaacctaagtaggggtctcgtgaatgtcgctgccaagctgactcacaataaggatgtaagagacctgttcgtcgaccttgtcgagaagtttgtagagccgtgtcggtctgaccactggcctttaagcgatgttagattttttctgaaccagtactccgccagcgttcacagcctggatgggttccgacaccaggcgctgtgggataggtatatgggcacactccgcggctgtctgctgcgactttaccacgactag

SEQ ID NO: 187818 - DNA, 1989 bp, Artificial Sequence
  Description of Artificial Sequence: Synthetic coding sequence
atgtggagctggaagtgcctgctgttctgggccgtgctggtgaccgccaccttatgcaccgcccgaccctcccctacactcccagaacaggcccagccatggggggctccagtggaagttgagtctttcctggtccaccctggcgatctgctccaattacgctgccgcctgcgggatgatgtgcagagcattaactggctgcgcgacggcgtccagctggctgaatcgaaccgaactcggattactggagaggaggtggaggtgcaggacagcgttccagccgactccgggctgtacgcatgcgtaacatctagcccgagtggcagtgatacgacatacttcagtgtgaatgtcagcgatgcccttccctcttcggaagatgacgatgacgatgatgacagtagttccgaggagaaggagaccgacaacacaaagcccaaccgtatgccagttgccccttactggacctctcctgaaaagatggagaaaaaactccacgccgtacccgctgcaaagaccgttaaatttaagtgtcccagcagtggaaccccgaaccctacattacggtggcttaagaatggcaaagagtttaagccggaccataggatcggtggatataaagtgcgctacgcaacgtggagcattattatggactccgtagtaccttccgacaaagggaattacacatgtatcgtggagaacgagtatggctccatcaatcacacgtatcagctcgatgtagttgagagaagtccgcatagacccattctgcaggctggactgcctgctaataagaccgtcgcgctgggcagcaacgtggagtttatgtgtaaagtgtacagtgatccgcaaccgcatatccagtggctgaagcacattgaagttaacggctccaagatcggacctgataatctaccctatgtgcaaatactcaaaaccgctggcgttaacacaacagataaggaaatggaagtgctgcatctgcgaaatgtctcattcgaagatgcaggggagtacacttgcctggctgggaatagtatcggactgagtcaccactctgcatggctgaccgtactggaggcgctggaggaacggccagcagtgatgacgtcgcccttgtatcttgagattataatttactgtaccggggcatttctcattagctgcatggtcggaagcgttattgtctacaagatgaagtccgggacaaagaagtccgatttccacagtcagatggccgtgcataaactggcaaagagcatcccgctgaggaggcaggtgacagtttctgcggatagctctgcctccatgaactcaggagttctcttggtgcgtccctcaaggctgtcgtccagcgggacgcctatgttggcaggcgtcagcgagtacgagctccctgaggaccctaggtgggaattgccccgcgatcgcctggttctggggaaaccactgggggaagggtgcttcgggcaggtagtcctggctgaggccattggattagacaaagacaagccaaatagggtcaccaaggtggcagtgaaaatgttaaagtcagacgcgaccgaaaaagacctgtcggatctgataagcgagatggaaatgatgaagatgatcggaaagcataagaatatcattaacctgctgggtgcatgtacgcaggatggccccttgtacgtgatagttgagtacgcatccaaaggaaatctccgggaatatctccaagcacgtcggcctccaggcttagagtactgctacaatcctagtcacaatcctgaggagcaactttcttccaaagatctcgtgtcgtgtgcttaccaggtggctcgggggatggagtatctggcgtcaaagaaagtttggaaccttaaagctccccttgtacacacccctaggcccggatcccaggagtgtcctggcgatcgtggccagtgtgacgaagattcccggttgtggccgaggactgggcatagccctcataggctactatag

SEQ ID NO: 187819 - DNA, 1104 bp, Artificial Sequence
  Description of Artificial Sequence: Synthetic coding sequence
atgtggagctggaagtgcctgctgttctgggccgtgctggtgaccgctactctatgtacagcacggccttcccctactctgccagaacaggcacagccctggggcgcccctgtggaagttgagtcatttctagtgcatcccggagacctcctgcaactccggtgtcgactgagggacgacgtgcagtctatcaattggctccgcgacggggtccagttagccgaaagcaatcgaacacggattactggtgaggaggtagaggtccaggattccgtgccagcggacagtggcttgtacgcatgtgttaccagctccccctcgggctcggacaccacctacttttccgtgaacgtgtccgtgccgatcgacgctctacccagctctgaggacgatgacgacgatgatgatagcagcagcgaggagaaagagacagacaatacaaaaccaaacccagtggccccgtattggaccagccctgagaaaatggagaaaaagcttcacgccgttcccgccgccaagacagtcaagtttaaatgcccaagcagcgggacccctaacccgactcttcgctggctcaagaacggtaaagaatttaaaccagatcacagaattggtgggtataaagtaaggtatgccacctggagcattatcatggacagcgtggtccccagcgataagggcaactatacctgcattgttgagaacgagtacggaagtattaaccacacgtaccagctcgacgtggttgaaagatctccgcaccggcctattctgcaagctggccttccagctaataaaacagtcgccctggggtcaaacgtggaattcatgtgtaaggtctattccgacccacagccacacatacagtggctcaaacacattgaagtgaacggatccaagatcgggccagacaacctaccgtacgtgcagattctgaagcatagtggcataaacagctcagatgcagaggtcctgacactgttcaatgtcacagaagcccagagtggagagtatgtctgcaaggtcagcaactatatcggggaggccaaccagtccgcttggctcacagtgactcgcccagtcgccaaggactgttggagttag

SEQ ID NO: 187820 - DNA, 2196 bp, Artificial Sequence
  Description of Artificial Sequence: Synthetic coding sequence
atgtggagctggaagtgcctgctgttctgggccgtgctggtgaccgcaactctttgtacagcgcggcccagtcccaccctgccagagcaggatgctctgccttcctccgaagatgatgacgatgacgatgattccagcagcgaagaaaaggagacggacaacaccaaaccgaatcctgtcgccccatattggacaagccctgaaaagatggagaagaaattacacgctgtgcctgccgccaagacagtgaagtttaagtgtccatcttctggaacgcccaacccaaccctgaggtggctgaaaaatggcaaggaatttaagcccgaccaccggataggggggtataaggtccgttatgccacctggtctattataatggactctgtggtccccagcgataaaggcaactatacttgtatcgtcgagaatgaatatggttcaattaatcatacgtaccagctggatgtggtggagcgatcaccacatcgtccaatcctgcaggctggcctgccagccaataaaacagtcgccttgggctcaaacgttgaatttatgtgtaaggtctactccgacccacaaccgcacatccagtggctgaagcacatagaggtgaatggcagcaaaatcggcccagataatcttccatatgtccaaattctcaagaccgctggagttaataccaccgataaagagatggaagtccttcaccttcgcaatgtttctttcgaggatgccggagagtatacctgcctagcaggtaactcaattggcttgagccaccacagcgcctggttaacagtcctggaagccttggaagagcgccccgcggtgatgacatcccctctctatttagagatcattatctattgtacaggcgccttcctgatttcatgcatggttggttctgtcatcgtatacaagatgaagtccggtactaagaagtctgattttcacagtcaaatggctgtacataaactcgccaagtctatacctctgaggagacaggtcaccgtgagcgctgactccagcgcaagcatgaatagcggcgtgctactggtgcgcccttcaagactctcatcatccggcacgccaatgttggctggagtatcagagtacgaactcccagaggaccccaggtgggaattgccgcgggatcgcctggttttgggaaaaccccttggagagggctgtttcggccaggtagtgctggcagaagccattgggctggacaaagacaaacctaatcgagttacaaaagtagcagtgaaaatgctgaagtctgacgcaaccgaaaaagatctcagcgatctgatctccgagatggagatgatgaaaatgatcggaaagcataagaatatcatcaacctgctgggagcctgtacacaggacggtccactgtacgtgatagtcgagtacgcaagcaagggtaatctccgagagtacctgcaggcccgtagaccaccaggcctggaatactgctataatcccagccacaacccagaagaacagctgagtagtaaagatctcgtcagctgcgcatatcaggtcgcccggggtatggaatacctggcttcgaagaaatgcattcaccgggatctcgcggcccgtaacgtgctggtaactgaggacaatgttatgaagatcgcagacttcggcttggcgagagacatacatcacattgattattacaagaaaactactaacggtagattgccggtgaagtggatggcccccgaagccctgttcgaccgaatctatacccatcagagcgatgtatggagtttcggcgtgctgctttgggagatcttcaccctgggaggcagcccttacccgggggtaccagttgaagaactgttcaagctcctcaaagagggtcatcggatggacaagcccagcaattgtacaaatgagctatacatgatgatgagagattgctggcatgccgtgcctagtcagcggcccacattcaaacagctggtggaagatctggataggatcgttgccctgacctctaaccaggagtacctcgatctttcaatgccattagatcagtattcacctagcttccctgacaccaggagctctacttgcagcagtggagaagacagtgtattctctcatgagccactgcccgaagagccttgtctgcctcggcatcccgcacagttggccaatggagggctcaagagacgttag

SEQ ID NO: 187821 - DNA, 2439 bp, Artificial Sequence
  Description of Artificial Sequence: Synthetic coding sequence
atggccgccgtgacccgggacttcggcgagatgctgctgcacagcgggagagtgcttcccgccgaggcccagccctggggagcgccagtcgaggttgaaagtttcctggtgcaccccggcgaccttcttcagctgcggtgcaggctgagagacgacgtgcagagcatcaattggctccgggacggggtgcaattggccgagagtaataggacaaggatcacaggggaggaggtggaggtccaggatagtgtgcccgcagattcgggtctttatgcatgtgtgactagcagcccctccggcagcgataccacctatttctcagtcaacgtctccgatgctctcccgtcctcagaagatgatgatgatgacgacgactcatcctccgaagagaaggaaaccgacaatactaagcccaataggatgccagttgccccctattggacctcgccggagaagatggaaaagaaactccacgcagtgcctgccgcgaagaccgtcaagtttaagtgtccctcatccggcactcccaatcccactttgaggtggttaaaaaacgggaaggaatttaagcccgatcacagaattggcggctataaggtgcgatatgccacttggtccatcatcatggactctgtggtgccctctgacaaggggaattatacctgtattgtagaaaatgaatacggcagtatcaaccacacctaccagctggacgtcgttgagcgaagcccacaccgcccgattctgcaggccggcttgccagccaacaagaccgtggcgttgggtagtaacgttgaatttatgtgtaaggtgtattccgacccacagcctcacatccagtggcttaaacacattgaagtcaacggcagcaagatcggacccgataacctgccatacgtccagattctgaagacagccggggtcaacaccactgacaaggagatggaagtcttgcacctcagaaatgtgtccttcgaagacgcaggggagtatacttgcctggccggcaatagtatcgggctgtctcaccacagcgcttggctaacggtcctcgaagcactggaagagaggccagctgtgatgacctcaccgttgtatttggagatcatcatctattgtaccggagcattcctgatatcatgcatggtcgggagtgtgatagtgtacaagatgaaatccggcactaagaaatctgatttccactcccagatggcggtgcacaagcttgccaaatccatccctcttaggagacaagtatcagcagattcgtcagcctcaatgaattcaggagtcttacttgtgaggccatcccgactctccagtagcggaactcccatgctcgctggcgtgtccgagtacgagctccctgaggatcccagatgggagcttccacgggatcggctggtgctcggcaaaccccttggggaaggctgctttggccaggtggtgctggcagaggcgatcgggctcgataaggacaaaccaaaccgcgtgacaaaagtggctgtgaagatgcttaaatcagacgctacagaaaaagatctctctgatttgatcagtgaaatggagatgatgaaaatgattggaaaacacaaaaacatcatcaatctgctgggagcctgcactcaagacgggcctctgtatgttattgtggaatatgccagcaagggcaatctccgcgaataccttcaggcccgccgcccaccagggcttgagtactgctacaatccgagccataatcctgaggaacaactgtcctccaaggatttggtttcatgtgcttatcaggtggctcgcgggatggagtacctggcctcaaagaaatgtatacatcgtgacctcgccgctcgaaatgttcttgtgactgaagataacgtcatgaagattgcagacttcggtctggctcgggatatacatcacattgactactacaagaagaccactaatggacgcctcccggttaaatggatggcccccgaggctctgttcgacaggatctacacacatcagtccgacgtgtggtcctttggcgtcttgctgtgggagattttcaccctgggcggctcaccatatcccggagttcccgtggaagaattgtttaaactcctgaaggaagggcacagaatggataaacccagcaattgcacaaatgaactgtatatgatgatgcgtgattgttggcatgccgtgccttcacagaggcccacatttaagcagctcgtcgaagacttagaccgcatcgtcgctctgacttccaatcaggaatacctggacctgtcaatgcctcttgatcagtattctccttccttccccgacactagatcctctacatgctcttccggcgaagatagtgtgttcagtcacgaacctcttccggaagagccctgcctaccacggcacccagcccagctggccaacggcgggctgaaaaggcggtag

SEQ ID NO: 187822 - DNA, 2469 bp, Artificial Sequence
  Description of Artificial Sequence: Synthetic coding sequence
atgtggagctggaagtgcctgctgttctgggccgtgctggtgaccgccactttgtgcaccgccagaccatctccaacattgcccgagcaggctcaaccttggggcgcacctgtggaggtcgagagttttctggtgcaccctggcgatctcttacagttgagatgccgcctgcgggacgatgttcaatccataaactggctcagagatggcgttcagctggccgaaagcaatagaaccagaatcacgggggaggaagtggaggtacaagattcagtgccagctgacagtggtctctacgcctgcgtcactagctccccaagcggctcagataccacttatttttccgtgaatgtgtcagtgccaatcgatgctcttccctcttcggaggacgacgatgacgacgatgacagcagttcagaagaaaaggagaccgataacaccaagcctaatcccgtcgccccttactggacttcccctgaaaagatggaaaagaaactgcatgctgttcctgccgccaagaccgtaaagttcaagtgccctagtagcggcacgccaaaccccaccctccggtggctaaagaatggaaaagaatttaaacccgaccatcgtattggtggatataaagtgcgatacgcaacctggagcattataatggactccgtggtgccgagtgacaaagggaactacacatgtatagtggagaacgagtatggaagcataaaccatacataccagctggacgttgtagagcgcagtccccatcgccctatactgcaggctggcctgcctgcgaacaagacagtggccctcgggtccaacgtggaattcatgtgcaaggtgtactccgacccacagccccacatccagtggctgaaacacatcgaggtcaacggctctaagattggacccgataacctgccttatgtgcagatcctcaagcacagcggcattaattcgagcgatgcggaggttctcacactctttaatgtcacggaggcccagtcgggtgaatacgtctgcaaggtgagcaattacatcggtgaagccaaccaatccgcttggctgacggtgactaggccagtactcgaggagcggcctgcagttatgaccagcccattgtacctggagatcataatctactgcacaggagcatttctgattagctgtatggtgggctccgtgatcgtgtataagatgaaatctgggactaaaaaatctgatttccatagccaaatggcagttcacaaactcgcaaagtctatcccactccgtaggcaggttaccgtttcggctgattcttccgcttcaatgaatagcggggtcctcttggttcggccaagtcgtctgagctctagcgggacacctatgttggcaggagtgtctgagtacgagcttccagaagaccctaggtgggagctccctagggaccggctggtgcttggcaaacctctaggtgagggctgttttgggcaggtggtcctggcggaagccattgggctggacaaagacaagcccaatagagtgaccaaagtggccgtgaagatgctgaagtcggacgcaaccgagaaggatttgagcgacctgatctcggagatggaaatgatgaaaatgattggtaaacataagaatatcataaaccttctgggagcgtgcacacaagatggccctctgtacgtgattgtggagtacgcctcaaagggaaacctccgggaatacttacaggctcgaaggccgccaggtcttgagtattgttacaatccatcccataaccccgaagagcaactgtccagcaaggacctggtgtcatgtgcgtatcaggttgctagagggatggagtacctcgcttctaagaagtgcattcatagggatctagccgcccggaacgtgctggtcacagaggacaacgtcatgaaaatcgccgactttggccttgctcgggacatccaccacatcgactactataagaagaccacgaacggtagactgcctgtgaaatggatggcccccgaggctctgttcgatagaatatatactcaccagtccgacgtgtggtcttttggggtcctcctgtgggagatcttcaccctcggtgggagcccttaccctggcgtgcctgtggaggaactcttcaaactcctaaaggaaggacatcggatggataagccttcaaattgtactaacgagctctacatgatgatgagagactgctggcacgctgttccatcccagcgaccaaccttcaaacagcttgtcgaggatctggacaggatcgttgcgctgacgtcaaatcaggagtaccttgatctctccatgcctctggaccaatattccccaagtttcccagatactcggtcctccacgtgttcatcaggagaagacagtgtcttctcacatgaaccattgcccgaggagccctgcttacctcgacatcccgcccagctcgctaatgggggtctcaaaagacgctag

SEQ ID NO: 187823 - DNA, 2202 bp, Artificial Sequence
  Description of Artificial Sequence: Synthetic coding sequence
atgtggagctggaagtgcctgctgttctgggccgtgctggtgaccgccactctgtgcacagcacgaccgtctcctaccttgccagagcaggacgctctgccctcctcagaagatgatgatgacgacgatgattcaagctccgaagagaaggaaacagacaatactaagccgaaccgaatgccagtcgctccttactggacaagccctgagaaaatggagaagaaacttcacgcagtgcccgccgctaaaacagtgaaattcaaatgcccctcatcaggcaccccaaaccctaccctcagatggctcaagaacggcaaggaattcaagccagatcatcggatcgggggctataaggtacgctatgcaacatggtcgattattatggattctgtggttcccagtgataaggggaactacacttgtattgtggagaacgagtacggatcgattaatcacacctatcaactcgacgtcgtagagagatctccgcacaggccgatcctgcaagcaggacttcccgcaaacaaaactgtggctctgggcagcaacgtggaatttatgtgcaaggtctattcagatccacagccacatatacagtggttgaagcatatcgaggtgaatggcagcaagatcggtcctgataatctaccgtatgtccaaatattaaagacagccggggtcaacacaacagataaggaaatggaagtcctccacctacggaacgtgtctttcgaggacgccggtgaatatacgtgcttagccggaaacagcatcgggcttagtcaccattctgcctggctaacagtgctggaagcccttgaggagcggcctgctgtgatgacttcacctctctacttggagatcatcatttactgcaccggagcatttctgatctcgtgcatggtgggcagcgtcattgtgtataagatgaaatccggcaccaaaaagtccgattttcatagccagatggcagtccacaaattggcgaaatctattccacttcgtagacaagtcactgtgtctgccgactcctcagcgtcaatgaatagtggtgtgctactggtacgccccagccgcttatcctctagcggaactcccatgctggccggggtgagtgagtatgagctgcccgaggatcctcggtgggaactgccaagagacaggcttgtgctgggcaaaccactcggagaagggtgttttggacaggtagtgctggccgaggccattggtctcgataaagataagccaaatcgcgtgactaaggttgccgtgaaaatgctgaagtcagacgccacagaaaaagatctgtccgacttaatctcagagatggagatgatgaagatgatcggtaagcataaaaacattatcaatctgttgggggcctgcactcaggatgggcccctttatgtgatagtcgagtatgcatccaagggaaacctcagagaatacttgcaggcgagacgacctccaggcctggaatactgctataatccatcacataaccccgaggaacagctctcttctaaggacctggtctcttgtgcctatcaagtggcgagaggaatggagtacctggcatctaagaagtgcattcatcgcgatctggctgcccgcaacgtgctcgtgactgaagacaatgtgatgaagatcgcagatttcggtctcgcacgtgatatccaccacatcgactattacaagaaaacaaccaatggccgattacctgtgaaatggatggcgccggaagctctctttgatcgaatctacacccatcagtcggacgtgtggagcttcggcgtgctactttgggagatatttaccttaggggggagcccgtatcctggtgtgccagtcgaggaactctttaaacttttgaaagaaggacacagaatggacaagccgtccaattgcacaaacgaactatacatgatgatgcgcgactgctggcacgccgtgccctctcaacgacctaccttcaaacagttggtggaagatctggaccgcattgttgctcttacttctaatcaggaatatcttgacctgagcatgcctctggatcaatactcgccttcatttccagacacaaggtcctctacgtgttccagcggcgaggatagcgtgttcagccacgagccccttcctgaagagccctgccttccccgccatcctgcacagctggctaatggagggctgaaaagaaggtag

SEQ ID NO: 187824 - DNA, 2463 bp, Artificial Sequence
  Description of Artificial Sequence: Synthetic coding sequence
atgtggagctggaagtgcctgctgttctgggccgtgctggtgaccgccaccctctgcacagcgcgcccctccccgaccctccccgagcaagcgcagccctggggtgcccctgtagaagtggaaagcttcctcgttcatcccggggaccttctccagctgcgatgtcgcctgagggatgatgttcagtctataaattggctgagagatggcgtgcagttagccgagtccaatagaactaggattactggcgaagaggtggaagtgcaggacagcgtgcccgccgattcggggctgtacgcttgcgtcacgtcctcaccaagtggatccgatactacgtatttttcagtcaatgtgtcagacgccctgccgtcaagcgaggatgatgatgatgatgatgactcttcgtccgaagagaaggaaaccgataacaccaagcccaacccggtggccccctattggacatctcccgaaaaaatggagaagaaattacacgccgttcccgcagcaaaaaccgtgaagttcaaatgtcctagctctggcaccccaaaccccacccttcgctggttgaagaacggcaaggaattcaaaccagaccatagaatcggcggctataaagttcggtacgccacttggtccattatcatggatagtgtcgtccccagcgataaggggaactacacctgtattgtggaaaatgagtatggcagtatcaatcatacctaccagttagacgtcgtggaaagatcgcctcacagaccaattttacaggcgggcctcccagccaataagacggtggctctggggagcaacgtagaatttatgtgtaaagtgtattccgacccccagccacacattcaatggttgaagcacatcgaggttaatggctccaagattgggcctgataatctcccctacgtccagattctaaaaaccgcaggcgtgaatacaacagataaagagatggaggtactacacctccgtaacgtaagcttcgaggacgcgggagagtacacctgccttgccgggaattctatagggttgtctcatcactcagcctggctgactgtgctggaggccctggaggaacgcccggccgtgatgacatcacccctgtacctcgagattattatttattgtacaggcgctttcctaatctcttgtatggtgggttccgtgatcgtgtataagatgaagtcaggaacaaagaagagcgacttccatagtcagatggcagtccataaactggctaagtctattcctttaaggcgccaggtaactgtttctgcagacagctcagcatccatgaactccggcgtgctactggtaaggccctcacgactcagcagctccggcacacccatgctggctggtgtgagtgaatacgagctgccggaagacccccggtgggaactgcctcgagataggctggtgctaggcaagccgttaggggagggttgttttggacaggtagtccttgccgaggcaatcgggttggacaaagacaaacctaacagagtgaccaaagtcgctgttaaaatgctcaagtctgatgctacagaaaaagacctctccgacctcatcagcgagatggaaatgatgaaaatgatcggtaagcacaagaatatcatcaaccttctcggggcctgtacccaggatggtcctctgtatgtgatagtcgaatacgcctcaaagggcaacctgagagagtatctgcaggccaggagaccccctggcctggagtattgctacaatccatctcataacccagaagagcagttgagctcgaaggatctggtaagctgtgcgtaccaggtcgctcgtgggatggaatacctcgcgtccaaaaagtgcattcatagggatctggcggccagaaatgtccttgttacagaggacaacgtgatgaagattgccgactttggcttggctagggacatacaccatatcgattattacaaaaaaaccacaaatggacggctacccgtcaagtggatggctcccgaggccctgtttgacagaatttatactcatcaatccgacgtgtggtcttttggagtgcttctgtgggagatcttcacactaggaggctctccatatcctggagtgcctgtggaagaattgttcaagctactgaaggagggacacaggatggacaagccctcaaattgtacaaatgagctctatatgatgatgcgggattgctggcatgctgttccttcccagcgccctacctttaaacagttggttgaggatctggatagaattgttgcactaactagtaaccaggaatatctggacttgagtatgcctctggaccagtatagtccctcatttcccgatacaagaagctcgacatgttcctccggtgaagacagtgtgttcagccacgaacctcttcctgaggaaccctgtcttcctcggcacccggcacagctggcaaatgggggcctaaaacgccgatag

SEQ ID NO: 187825 - DNA, 2202 bp, Artificial Sequence
  Description of Artificial Sequence: Synthetic coding sequence
atgtggagctggaagtgcctgctgttctgggccgtgctggtgaccgccactctatgtacagctcgaccttcccctacccttccagaacaagacgcccttccatcctctgaagatgatgatgacgatgatgattcctcctccgaggagaaggagacagataataccaaacccaatcctgttgccccgtactggacttcgccagagaaaatggagaagaagcttcatgcagtcccagctgcaaagaccgtgaaatttaagtgtcctagcagtggtacacccaatcctactctccgttggctgaagaacgggaaagagttcaagccggaccaccggattggcggatataaagtgaggtatgccacctggtccatcattatggacagcgtggtcccttctgacaaaggcaattacacttgtattgtcgaaaacgagtatggctctatcaaccacacttaccaactagatgtcgtggaacgatcaccacatcgacccattttacaggcgggcctgccggccaacaagaccgttgcattgggctcaaatgtcgagttcatgtgcaaggtctattctgacccccaaccacatattcagtggctgaagcatatcgaggtgaacggctcgaagatcggacccgataacctgccatacgtacagatacttaagcattccgggattaacagcagcgacgcggaggtactgactttgtttaatgtgactgaagctcaatctggggaatacgtgtgtaaagtgagcaattatataggagaagctaatcaatccgcctggctgactgtgaccagacctgtggctaaagcgctggaagaaagacccgcagtcatgacgagccctctgtatctcgagattataatttactgtaccggagctttccttatatcctgcatggtagggtcagtgatagtttataagatgaagtctggcaccaagaagtcagactttcactctcaaatggcggtgcacaaactggcaaaatccattcccctgagacgacaggtgaccgtgagcgccgatagttctgcaagcatgaatagcggggttctgcttgttagaccttctcgcctttcatcaagcggaacccctatgcttgcaggagtttccgagtatgagctgccagaagaccctaggtgggagttgcctcgcgaccgcttggtgctgggtaagcctctgggcgagggttgtttcgggcaggtcgtgctcgctgaggcaatcgggttggacaaggacaagccaaaccgagtgacgaaggttgccgtaaagatgctgaagtccgacgccactgagaaggatttgagcgatcttatttcagagatggaaatgatgaaaatgatcgggaaacacaagaacatcattaatctcctgggtgcatgcacgcaggatggccctctgtacgtaatcgtcgagtacgcctctaaaggtaacctccgcgagtacctgcaagccagaagaccacccgggttagagtactgctacaacccaagccataaccctgaggagcaactatcttccaaagatttggtttcttgtgcctaccaagtcgcacgtggtatggagtacctggcctccaaaaaatgtattcacagagatctggctgccagaaacgttctcgtcactgaagacaacgtgatgaagatcgccgacttcggtttggcgcgagatattcatcatatcgactactataaaaagacaacaaacggccgactgcccgtcaaatggatggcaccggaagcattgttcgacagaatttatacccaccagagcgatgtgtggagctttggcgtgctgttatgggagatcttcacgttgggggggtcaccttatccgggggttcctgtggaggagctgttcaagctgttgaaggagggccatcggatggataaaccttcaaattgcacaaatgaactttacatgatgatgcgggattgttggcatgctgtgcctagccagagaccaacttttaaacagctggtagaggacctggatcgcatcgttgccttaacgagtaaccaggagtacctcgacctctccatgccccttgaccagtactccccttcattccctgacactcgctcttctacctgtagttcaggagaggacagcgtgttctcacatgaaccccttcctgaagaaccctgcctgccccgacaccccgcccagttagccaacggcggccttaaaaggagatag

SEQ ID NO: 187826 - DNA, 2463 bp, Artificial Sequence
  Description of Artificial Sequence: Synthetic coding sequence
atgtggagctggaagtgcctgctgttctgggccgtgctggtgaccgccaccctgtgcactgctcggccaagcccaacattgccggagcaagcacaaccatggggggccccagtcgaggtggaaagctttctagtgcatcctggggacctccttcagttgcgctgccgactgcgagacgatgttcaatcaatcaattggttaagagacggcgtacaactggcagaaagcaaccgaacccggattacgggcgaggaagtggaggtgcaggactccgtgcctgccgactcagggttgtatgcatgtgtcactagttccccatctgggagcgacacgacttacttctctgttaacgtgtcagatgctctgccttcatctgaagacgatgacgacgacgacgacagcagtagcgaggaaaaggaaaccgataacactaagcctaacccagtcgcgccttactggacaagtcccgagaaaatggaaaagaaattgcatgcggttcctgccgctaaaaccgtgaagttcaaatgtccctcctcaggcacccctaaccccacactccgttggctgaaaaatggtaaggaatttaagcccgatcaccgaatcggtggctataaggtgaggtacgccacatggagcatcatcatggacagcgtagtaccctccgacaagggcaactacacttgtatcgttgagaatgagtacgggagtatcaaccacacttaccagctcgatgtagttgagaggtcgccacaccggccgattctgcaggccgggctccctgcgaacaaaaccgttgctctaggctcaaatgttgagtttatgtgcaaggtctacagtgatccgcagccccacatccaatggctaaaacacattgaagtgaacgggtcaaaaatcgggcccgacaatctcccatacgtacagattctgaagacagctggtgtcaatacgacagataaggagatggaggtgctccacttaaggaatgtgagcttcgaagatgcgggggaatatacctgtctggctggaaatagcatcggcctgtcgcatcactcagcatggctcaccgttctggaggctttagaagagagacctgccgtgatgacatcacctctttacttggagataatcatatactgcactggggcgttcctgatttcttgcatggttgggagcgtgatcgtgtataagatgaagtctggcaccaagaagtctgacttccatagccagatggccgtgcataaactcgccaagtccatccccctccggcgacaggtgacagtcagcgctgatagcagcgcctccatgaactcaggcgtgctactcgtgaggcctagtaggctgtcctccagtggcacacccatgctcgctggagtgtcagagtacgagcttcccgaggatccgcgctgggaactgccacgtgaccgcctggtgctgggaaagcccctgggtgagggctgtttcggccaggtggtcctggcagaggcaatcggcctggacaaagacaagccaaatagggtgacaaaggtggctgtgaaaatgcttaagagtgacgccaccgaaaaggatttgagcgacctgattagcgaaatggagatgatgaaaatgattgggaaacataagaatatcattaatctgctgggagcctgcacccaggatggacccctctatgtgatagtcgagtacgctagcaaggggaacctcagggagtacctgcaggccaggcggccccccggtctcgaatattgctacaatcccagtcataaccctgaggagcagcttagctccaaggatttggtgtcttgtgcatatcaagtggccagaggaatggagtatctggctagtaaaaagtgtattcaccgtgacctggcggctcggaatgtgctcgtgacagaagataacgttatgaagatcgctgattttggcctggcccgcgatatccatcacatagattactacaagaagaccaccaatggaagactgcccgttaagtggatggcgccagaggcgttgttcgacagaatttacacccaccagagtgacgtgtggagttttggagtgttgctttgggaaatttttacccttggtgggtcaccttacccgggcgttccggttgaagagctgtttaaactgctgaaagaaggacaccggatggacaagccaagtaattgcacaaacgagctgtacatgatgatgcgggattgctggcacgccgtgccgagtcagagaccaactttcaagcaacttgtggaagatttggataggattgtggcattgactagtaatcaagagtacctcgatctcagcatgcctctggaccagtattcaccttcattcccagatactaggtctagcacttgtagcagcggtgaggacagtgttttcagccacgaacccctccctgaggaaccttgtctcccgagacacccggctcagctagcgaatggtggactgaaacggagatag

SEQ ID NO: 187827 - DNA, 2463 bp, Artificial Sequence
  Description of Artificial Sequence: Synthetic coding sequence
atgtggagctggaagtgcctgctgttctgggccgtgctggtgaccgctacgctttgtacagcacggccatcacccactctccccgagcaggctcagccatggggagcaccggttgaagtggagtccttcctggtccacccaggtgacctgctacagttgagatgccgcctaagggatgatgtgcagtccatcaattggctgagagatggggtgcagttagccgaatctaatcgcactcgcatcaccggtgaagaagttgaagtgcaggactcggttccggccgattctggcctttacgcctgtgtcacatcaagcccatcaggtagcgatactacatatttctcagtgaatgtgtctgacgccctgcctagcagtgaagatgatgacgacgacgatgacagctcgtccgaggaaaaggagactgataacacaaagcctaatccagtggccccctactggacctcccccgaaaaaatggaaaagaaactccatgcggtgccagctgcaaagaccgtaaaattcaaatgtccatcttctggcaccccgaacccaacattgcggtggttgaaaaatggaaaggagttcaagcctgatcacaggatagggggatacaaagtgagatatgccacttggagtatcattatggatagcgtagttcctagtgacaaaggaaactatacttgcatcgtggagaatgaatatggctccattaaccacacctatcagctggacgtggtggagagatccccacaccgtcccattctccaggcagggctgccagctaataaaactgtggccctgggatcaaatgtcgaattcatgtgtaaagtgtattctgaccctcagccccatatccaatggctcaaacacattgaggttaatggttccaagattgggccggacaacctgccatacgtgcagattctgaagacagccggtgtgaatacaacagataaagagatggaagtcttacacctgaggaatgtgtcttttgaggatgcaggcgaatacacttgcctagctgggaactctattggcctgagccatcattccgcctggctcactgtcctagaggcactagaagaacgccctgctgtcatgacatccccactgtacctggaaattatcatctactgcaccggtgccttcctgatcagttgcatggtgggatccgtcattgtgtacaagatgaaatccggaacaaaaaagtcagacttccacagccagatggccgtgcacaaactggcgaagtctatacccttgaggagacaggttacagtatccgccgacagcagcgcgtcgatgaatagcggcgtgcttttggtgaggccctcaaggctgtcatctagtggcaccccaatgcttgcaggagtgtcagaatacgaactccctgaagatcctcgttgggaactgccgcgagaccgcctcgtgcttgggaaaccactgggagaaggttgcttcggccaggtggtactggccgaggccatcggcctggataaggataaacccaatcgcgtgacaaaagtcgctgttaagatgctgaaaagcgacgccactgaaaaagatctgtctgacttgatatctgagatggaaatgatgaaaatgatcggcaaacataagaatatcattaacctgttgggagcgtgcacacaggatggcccattatatgtcatcgtggagtacgcctcaaaaggaaaccttagggagtatcttcaagcccgcagaccaccagggctggagtattgctacaacccttctcataaccccgaagagcagttgtcatctaaggacctcgtcagttgcgcgtatcaggtcgcccgcgggatggagtatctggcctcaaaaaagtgtatccaccgggatctggcagcacgcaacgtgctagtgacagaagacaatgtaatgaagatcgcagatttcggacttgctcgggatattcaccacattgactattataaaaagacgactaacggaaggctcccagttaaatggatggcccctgaagcactgttcgatagaatttatacccatcagtcagatgtgtggagtttcggtgttctcctgtgggaaatctttactcttggcgggtctccataccctggggtccccgtagaggagctcttcaaactactgaaggaggggcataggatggataagcccagcaactgtacaaacgagctgtacatgatgatgagagactgctggcatgctgtgccttcccagcgcccaacctttaagcagcttgtagaagatctcgacagaattgtagccctgacgagcaatcaggagtatttagacctgtccatgcctctagaccagtattccccctctttcccagacacaaggagcagtacatgctcctccggggaggatagcgtctttagccacgagcccctccccgaggagccttgcctaccccggcaccccgcccagttggcaaacggagggctgaagcgtcgatag

SEQ ID NO: 187828 - DNA, 324 bp, Artificial Sequence
  Description of Artificial Sequence: Synthetic coding sequence
atgtggagctggaagtgcctgctgttctgggccgtgctggtgaccgcaactctgtgtacggccagaccatctccaacactgcccgaacaggctcagccatggggggcgcctgtagaggtggaatcgtttcttgttcaccccggggacctactgcagctgaggtgtagactgcgcgacgacgttcaatccatcaattggcttcgggacggcgttcagctggcggagtcaaatagaacaaggatcacaggagaagaagtggaggtgcaggatagtgtcccagccgactcagggctgtatgcatgtgttacttcttcgccttcttag

SEQ ID NO: 187829 - DNA, 2562 bp, Artificial Sequence
  Description of Artificial Sequence: Synthetic coding sequence
atggaggcccgggtgagcctgaagcggcggatcgagctgaccgtggagtacccatggcggtgcggtgcattgagtcccacgtcaaattgtcggaccggcatgtggagttggaaatgtcttctgttttgggccgttctggtaaccgcaacgttatgcacagcaaggcctagcccaacccttcccgagcaagcacaaccatggggtgccccagtggaggtcgaatctttcctcgttcatcctggcgacctgctgcagttgaggtgccgcctgagggatgatgtccaaagtatcaactggctacgggacggtgttcagttggctgaatccaacaggacccgcatcaccggggaggaagttgaagttcaggattccgtcccagccgactcgggcttgtacgcatgcgtaactagctccccgagcggctctgacaccacttactttagcgtaaatgtatctgatgctcttccctcctctgaagatgacgacgatgatgatgactcatcctcggaagaaaaagagacggacaacactaaacctaacccagtggcgccatactggactagtccagagaagatggagaagaagctccacgcagtgccggcagccaagacggtaaaatttaaatgcccatctagtggaaccccaaaccccaccctgagatggctaaaaaacggaaaagagttcaaacctgatcatcgtatcgggggatataaagtcaggtacgctacttggtctattataatggatagtgttgtaccgagtgacaagggaaactatacatgcatagtagaaaatgagtacggttctataaatcatacgtatcaactggacgtggtcgagaggagccctcatcggccgatcctgcaagctggattgcccgctaataaaaccgtcgcacttgggtcaaatgttgaatttatgtgtaaggtatatagcgatccacagcctcatatccagtggttgaaacacatagaggttaacgggtccaagatagggcccgataacttaccgtacgtacagatcctgaaaaccgccggcgtgaacacaacggataaagagatggaggtgctgcatttacgcaatgtgtctttcgaggacgcaggcgaatatacctgcttggcagggaatagtatcggtctgagccaccactctgcctggcttacagtgctggaggctcttgaggagcggccggctgtgatgacaagtcccctgtatctggaaatcatcatctactgcactggcgctttcctgatctcctgcatggtaggctctgtcatcgtgtataaaatgaagtctggtacaaagaagtccgattttcactcccagatggctgttcacaagttagccaagagcattccccttaggagacaggtaaccgtcagtgcagatagtagcgcatctatgaattccggagtcttgttagtgcgcccgagccgcttgagctcctcggggacaccgatgttggccggcgttagtgaatacgagctacccgaggatccccgctgggagctaccccgggacagactggtcctgggtaagcctctgggggagggatgttttgggcaggtggtgttggccgaggccatcggcctagataaggataaacctaaccgggtaaccaaagtggctgtgaaaatgctgaaatccgatgcaaccgagaaagacctctctgacctaataagcgaaatggaaatgatgaaaatgatcgggaagcataaaaatattataaacctgctgggcgcgtgcacacaagatggccccctgtatgtgattgtggaatatgcctcgaagggcaatctgagagaatacctgcaggcacgccgcccaccaggactggagtactgctacaatcctagtcataatcctgaggaacaattgtcctccaaggacctcgtgagctgtgcttatcaagtagcaagggggatggagtatctggcttcaaagaagtgtattcatcgagacctggctgctagaaacgtattggtgacggaagataacgtgatgaaaatcgctgacttcggactggccagggacatccaccatatcgattattacaagaaaacaaccaatggccgcttaccggttaaatggatggcgcccgaggcgttattcgacagaatctacacacatcagtccgatgtttggtccttcggcgtccttctctgggagattttcacactaggagggagtccatacccaggcgttcccgttgaggaactattcaaattgctgaaggagggccaccgcatggataagccttctaattgcaccaacgagctgtatatgatgatgagagactgctggcacgcagtgccaagccagagacctaccttcaagcagctggtggaagacctggatcggatcgtggctctgacctcaaaccaggagtatctggatctgtccatgccacttgatcagtacagcccgtcttttccagatactcggtcttccacctgtagctccggagaggactctgtgttcagtcacgagcccctgcccgaggagccgtgcctccctcgccatcctgctcagcttgccaacggcggactgaagagacgctag

SEQ ID NO: 187830 - DNA, 168 bp, Artificial Sequence
  Description of Artificial Sequence: Synthetic coding sequence
atgtggagctggaagtgcctgctgttctgggccgtgctggtgaccgctaccctttgcacggctcgaccctcccctacattgccagaacaggacgctctgccgagctccgaggatgatgacgatgatgacgattcaagcagtgaggaaaaagaaacagataatacctag

SEQ ID NO: 187831 - DNA, 6 bp, Artificial Sequence
  Description of Artificial Sequence: Synthetic coding sequence
atgtag

SEQ ID NO: 187832 - DNA, 2469 bp, Artificial Sequence
  Description of Artificial Sequence: Synthetic coding sequence
atgtggagctggaagtgcctgctgttctgggccgtgctggtgaccgctacactttgtacagcgcgcccctccccaactttacctgaacaggcacaaccctggggagcccccgtggaggtagaatctttcctggtccacccgggagatctgctgcaacttagatgcaggcttagggatgatgttcaatcgataaattggctaagagatggcgtacagctggcagaaagcaaccggacaagaatcaccggagaagaagttgaagttcaagattctgtcccggccgacagcggcctctatgcttgcgtgacttcttctcctagcgggtctgacaccacctattttagcgttaacgtgagtgatgctctcccctcttccgaagatgacgacgacgacgatgatagctcaagcgaggagaaggagactgacaataccaagccgaacaggatgccggtcgccccatattggacttcccccgagaagatggaaaagaaactccacgccgtccccgctgcaaagaccgttaaatttaagtgcccatcatctggtacacccaatcccaccctgcgctggttaaaaaacggaaaggagtttaaacccgaccaccggatcggcggctacaaagtaaggtatgcaacctggtcaatcatcatggacagcgttgttccatccgacaagggcaactatacttgtattgtggagaacgagtatgggtccatcaatcacacgtaccagctcgatgtggtggagcgctctccacaccgtcctatcctacaggctggcctgcccgctaataagacagtagcgctaggcagcaatgtggaatttatgtgtaaagtgtacagtgatccacagccccatatccaatggttgaaacacatcgaggtcaatggctccaaaatcgggccagacaacctgccctatgtacagattctgaaaactgctggagtcaacacaacagataaagaaatggaggtgttgcacttgcgcaacgtctccttcgaggacgcaggagaatatacatgtctcgctggcaattctattggactgagtcatcactcagcatggctgaccgtactggaagccttggaggaaaggcccgccgtaatgacgtcacccctttatctcgagatcatcatctactgtaccggtgccttcctgatatcctgcatggttggatcagtgattgtttacaaaatgaagtctggcaccaagaaatcggacttccatagtcagatggctgttcacaagctcgccaagtcaattcccttacgccgccaggtgactgtgtccgctgactcaagtgcctctatgaattccggggtacttctcgtgcgcccctctagactctcttcatcaggcacacctatgcttgcgggcgtgagtgagtatgagctgcctgaagaccctagatgggaattgccccgggacagacttgttctggggaaaccacttggagaggggtgcttcgggcaggtagtgctcgccgaggccattggcctggacaaggacaaacctaaccgggttacaaaagtggcagtcaagatgctgaagtctgacgccacagagaaagacctttccgacctcatatctgaaatggagatgatgaagatgattggcaaacataagaacatcattaatctgctgggcgcctgcacacaggacggtccgctgtacgtcatcgtcgagtacgcttccaagggaaatctgcgagaatacttacaagcgaggcgccctccaggcctcgagtactgctacaacccctctcacaaccctgaggaacaattgagttcgaaggacctggtcagttgtgcctatcaggtggctcgggggatggagtacctcgcctccaagaaatgcatacacagagaccttgccgcccgcaatgtgctcgtcaccgaagacaatgtgatgaagattgcagatttcgggctcgcccgagatatccaccacatcgactattacaaaaagacgacgaacgggagactgcctgttaagtggatggccccagaagccttattcgacaggatctacacccatcaatccgatgtgtggtcattcggggttttgctttgggagatctttacgctaggggggagcccctatccaggcgtgcccgtagaagagctgtttaagcttctgaaggaaggtcatagaatggacaagccgtcgaactgcactaatgaactctatatgatgatgagagactgctggcatgctgtaccaagccagcggcccactttcaaacagctggtcgaagatctcgatcgcattgtggcgctgaccagcaatcaagagtaccttgatctgagcatgcccctcgaccaatacagcccatccttcccagatacacgctctagtacgtgttcttcaggagaggatagcgtcttctcccacgagcctctgccagaagagccttgtctgccccgccaccccgcccaactggctaatggaggcctaaagcgacgctag

SEQ ID NO: 187833 - DNA, 897 bp, Artificial Sequence
  Description of Artificial Sequence: Synthetic coding sequence
atgtggagctggaagtgcctgctgttctgggccgtgctggtgaccgctacactttgcacagcgcgcccatcacccaccctaccagagcaggcgcagccttggggagctccagtagaggtagaaagctttcttgttcaccccggggatcttctgcagctcaggtgccggctgcgcgacgacgtacaatccatcaactggctgcgcgatggagtgcagttagccgaaagcaataggactcgaatcactggagaagaggtagaagttcaagattctgtgccggcagactctggattatatgcctgcgtgacgtcttccccttccggcagcgatacaacgtacttcagcgttaacgtatccgatgccttgcccagcagcgaggatgacgatgacgatgacgactcttccagcgaggagaaagaaactgataacaccaagcccaaccgcatgcccgttgcaccctactggacatcacctgagaagatggaaaaaaagttacacgctgtgcccgccgcaaagacggtaaaattcaagtgcccctcttccggaacacctaacccaaccctgcgttggttgaaaaacggcaaggaatttaagcctgatcaccgcatcggcggctacaaggtgcgatatgcgacttggtccattatcatggactcagtggttccgtccgataaaggaaattacacatgtattgtggaaaatgagtatgggtctattaaccacacttatcagttggatgtggtagaaagatctccacataggccgatacttcaagcagggctgcccgcaaacaaaactgtggccctaggttcgaatgtcgaatttatgtgtaaggtctactctgacccacagccgcatatccagtggctcaagcacattgaggtaaatggaagttag

SEQ ID NO: 187834 - DNA, 438 bp, Artificial Sequence
  Description of Artificial Sequence: Synthetic coding sequence
atgtggagctggaagtgcctgctgttctgggccgtgctggtgaccgcgacactgtgtactgcgaggccttcaccaaccctaccggaacaggacgcgctacctagctccgaggacgatgatgacgacgatgattcaagcagcgaggaaaaagaaactgataacacaaagcccaacccagttgccccctattggactagtccagagaaaatggagaagaaactgcacgctgttccagccgcaaagaccgtgaagttcaagtgccccagttcagggacaccaaacccaaccctgagatggctgaagaacggaaaggaattcaagcctgaccaccgaattggaggttacaaagtccggtacgctacgtggtctataatcatggattccgtcgtgcccagtgacaagggcaactacacttgcatagtcgagaacgaatactag

SEQ ID NO: 187835 - DNA, 429 bp, Artificial Sequence
  Description of Artificial Sequence: Synthetic coding sequence
atgtggagctggaagtgcctgctgttctgggccgtgctggtgaccgccactctgtgcacagcgagaccaagcccaacccttccagaacaagacgctctgcctagttccgaggacgatgacgacgacgacgacagtagttctgaggaaaaagagaccgacaacacaaagcctaaccgcatgccagtcgctccttattggaccagtcctgagaagatggagaagaaacttcatgcagtgccagccgcgaaaacagttaagttcaagtgccccagctccggcacccccaatcctactttgagatggcttaagaatggcaaagaattcaagcccgatcacagaatcggggggtataaagtacgctatgctacgtggtctattataatggactcggtagttccatcggataagggcaactacacttgcatctag

SEQ ID NO: 187836 - DNA, 258 bp, Artificial Sequence
  Description of Artificial Sequence: Synthetic coding sequence
atgtggagctggaagtgcctgctgttctgggccgtgctggtgaccgctactctctgcaccgcccgcccatctcctaccctacccgaacaggacgccctgccttcctcagaagatgacgacgacgacgatgattccagctcggaggagaaagaaacggataacaccaagcctaacccagtggcaccttactggacttctccagaaaaaatggagaagaaattgcacgctgtccctgcggctaaaactgtgaaattctag

SEQ ID NO: 187837 - DNA, 2463 bp, Artificial Sequence
  Description of Artificial Sequence: Synthetic coding sequence
atgtggagctggaagtgcctgctgttctgggccgtgctggtgaccgccactctttgtactgcaagaccttcccccacgctgcccgaacaggcccaaccttggggggcccccgtggaggtagagtctttcctggtgcatcccggggatctgctgcaattgcggtgcaggcttcgcgatgatgtacagtccatcaactggttgagagacggtgtccagctggccgagagtaatagaactcgcataaccggtgaggaagtagaggtccaggattcggttcctgctgatagcgggctctatgcttgcgtaacttctagccccagcgggtcagataccacatatttctctgtcaacgtcagtgatgctctcccatcttcggaggacgacgacgacgacgatgacagttcgtccgaggaaaaggaaaccgacaataccaagcccaacaggatgccagttgccccctactggacgtcacccgagaagatggagaagaaactgcatgcggtgcctgctgccaaaacagttaagttcaaatgcccatcctccggcaccccaaacccgactctgcgctggctgaaaaatggtaaagaattcaaaccagaccatagaatcggagggtacaaggtgcgctacgctacttggagtatcatcatggatagcgtcgttcctagtgacaaggggaactacacttgtattgtcgagaatgagtacggcagcattaaccatacctatcagctcgatgtggtggaacgctcaccacatcggcctatcctccaagcaggtctgcctgctaacaagacagtagctttaggatctaacgtggagttcatgtgtaaggtgtactccgaccctcagcctcacattcagtggctgaagcacatcgaggtcaatggttcaaagattgggccggacaacttaccctacgtacaaatcctgaagacagcgggtgtgaatacaactgataaggaaatggaggttctgcatctgcgcaacgtgagtttcgaagatgctggagagtacacatgtctggcaggtaactctattgggctgtcacatcacagcgcctggctgacagtattagaggcgctggaggagagaccggctgtcatgacatcccccctgtatctggagatcatcatatactgtaccggagcattcctaatcagctgtatggtggggagcgtgattgtgtataagatgaagtcaggcacaaagaagagcgacttccacagtcaaatggcagtgcacaagcttgcaaaatctatacccctgagaaggcaggtgtccgcggattcatccgcatccatgaactccggcgtgcttctcgtgcgcccttcccgcctctcttcgtctggaacaccaatgttggctggtgtttcagagtacgaacttccagaggacccacgctgggagttaccacgagaccgactggtcctgggaaagccgctaggggagggctgttttggtcaggtggttctggcagaggctatcggcttagacaaagataaaccaaatcgggttacaaaagtggcggtgaagatgctaaagtccgatgcaacagaaaaagacttgtcggacttaatctccgagatggagatgatgaaaatgatcggtaaacacaagaatatcatcaatctgcttggcgcttgcacccaagacgggcctctctacgtaatcgtggagtacgcttccaaaggcaacctgcgcgagtacctccaggctcgccggcctcccgggctcgaatattgctacaaccccagccacaatccagaggagcaactgagcagcaaagacttagtttcttgcgcctaccaggtggccagggggatggaataccttgcctccaagaagtgcatccacagagatctcgcagccagaaacgtgctcgtaaccgaggataatgtaatgaagattgctgatttcggcctcgcccgcgatatccatcacatcgactattacaagaaaacaaccaatggcagacttcccgtcaaatggatggcccctgaagccctatttgatcgtatatacacacaccagtcagacgtgtggtcgtttggcgtcctgctctgggaaatctttacactgggagggtcaccgtatccaggagtacccgtcgaagagctgttcaagctgctcaaggaaggacacagaatggacaagcccagcaattgtacaaacgaattatatatgatgatgagggactgttggcacgccgtgccctcacaaaggccgacattcaagcagctcgtggaggatcttgaccggatcgtagcactgaccagcaatcaagaatacctagacttgtctatgcctcttgaccaatacagtcccagcttccccgatacccgatctagcacatgcagctcaggagaagactccgtgttcagccatgaacctctccccgaagagccctgtctcccgcgtcaccccgcccaactcgccaatggcggcctaaaaaggcgctag

SEQ ID NO: 187838 - DNA, 2010 bp, Artificial Sequence
  Description of Artificial Sequence: Synthetic coding sequence
atggtgagctggggccggttcatctgcctggtggtggtgaccatggccacacttagcctggctcgtccttcattcagcctggttgaggatacgactctggaaccagaggatgccatttcatcaggcgacgatgaggacgacacggatggagccgaggacttcgtgtcggagaactccaacaataaacgggcaccatactggaccaatacagagaagatggaaaagcgcctccacgcagtgcccgccgcaaataccgttaaatttcgctgccccgctggcggcaatcccatgccaacaatgaggtggttaaagaacgggaaggaatttaaacaagagcacagaatcggggggtacaaagttagaaatcagcattggtccctcatcatggaatccgtggtgccctccgataaaggcaactacacctgcgtggttgagaacgagtacggctccatcaatcacacatatcacctggatgtggtcgagcgcagtccgcaccgtcctatcttgcaggcaggtctccctgctaacgcgtccaccgtggtaggcggggatgtagaatttgtatgcaaagtctattcagacgctcagccacacattcagtggataaaacacgtagagaaaaacgggtcaaagtacggccctgacggactcccatacctgaaggtactgaaggctgctggcgtgaatacgacggacaaagaaattgaggtgctctatatcagaaatgttacattcgaggatgcgggagagtacacatgcctagcgggaaattccattggtatctcgttccactcagcatggttgaccgtcctgccagctcccggacgcgagaaggaaattactgcgagtccagactacctagagatagcaatatactgcattggggttttcctgattgcctgcatggtagtcaccgtaatcctttgccgcatgaaaaatactacaaaaaaaccagacttctcaagtcagccggcagtccacaaactgactaagagaattccgctccggcgccaagtctccgctgagtcatcttcttctatgaattctaacactccactggtcagaatcacaaccagattgtcctccacagctgacacccccatgctagctggggtgtccgagtatgaactgccagaggacccaaagtgggaatttccaagagacaagctcacccttggcaagcctcttggagaagggtgcttcggacaggtagtgatggcagaggctgtgggcatagacaaggacaagcctaaggaagccgtgacagttgctgttaagatgctgaaggatgatgccaccgagaaggacctctcggatctggtttccgagatggagatgatgaagatgattggcaagcataaaaacatcatcaatctgctcggagcttgtacgcaggacggccctctctatgtgatcgtagagtatgcatctaaaggcaacctgcgcgaataccttagagccagaagaccgcctggcatggagtacagctacgacattaacagagttccggaagagcagatgactttcaaagacctggtgagctgcacataccagttggccagaggcatggaatacctcgcatctcagaagtgcattcatcgcgacttggcggcaagaaatgttctagtaactgagaacaacgtcatgaagattgcagactttggccttgcgcgcgatattaacaatatcgattactataagaaaaccaccaacggccggctccccgtgaaatggatggcccctgaggctcttttcgatcgagtttacacccaccagtcagatgtatggtcctttggagtcctaatgtgggagattttcaccctgggcggatccccgtaccctggcatccccgtcgaggagctatttaaactactgaaagagggtcacaggatggataaaccagcaaactgcactaacgagctctatatgatgatgcgcgactgctggcatgcagtaccatcgcagcgcccgaccttcaaacagctcgtcgaggaccttgataggatttag

SEQ ID NO: 187839 - DNA, 2460 bp, Artificial Sequence
  Description of Artificial Sequence: Synthetic coding sequence
atggtgagctggggccggttcatctgcctggtggtggtgaccatggccacactctccctggcaaggcccagcttctccctggtcgaggacaccaccttagagcctgaagaaccccctaccaaatatcaaatcagccaacccgaggtgtatgtcgcggcaccgggagaaagtctcgaagtcaggtgtttactgaaggacgctgccgtcatatcctggaccaaagatggcgtgcacctgggacctaacaacaggactgtgctcattggtgaatatctacagattaagggtgccactcccagggattccggcttgtacgcctgtactgcttctcgcactgttgatagtgaaacttggtacttcatggtcaatgtgaccgatgctattagcagcggtgatgacgaggatgacaccgacggcgcggaggactttgtaagtgaaaacagcaacaacaagcgggcaccttattggacaaatactgaaaaaatggagaagcggttacacgcagtgccagctgctaacaccgtgaaatttcgatgccccgctggtggaaaccctatgccaactatgcgttggctgaagaacggaaaggaatttaaacaagagcaccgcatcggaggatacaaagtgagaaaccaacactggtctctcattatggagagcgtggtgccatccgacaagggcaactacacatgcgtagttgaaaatgagtatggatccatcaatcacacttatcacttggacgtggtggaaaggagtccgcatcgtcctatactacaggccggcctccctgctaatgcttctactgtggttgggggcgacgtagagttcgtttgtaaggtctactccgatgcccagcctcatattcagtggatcaaacatgtcgaaaaaaatgggtctaagtacggaccggatggtctgccttacctcaaggtcctgaaagccgcaggagtcaacaccacagacaaagaaatcgaagtgctttacatccgcaacgtgaccttcgaggacgcaggggaatatacatgtctagctggcaacagcattggtatcagctttcatagcgcttggttaaccgtgctgccagcacctggcagggaaaaggaaatcacagcatcccccgattatttagagatcgcaatttactgtataggtgtgttcctcatagcttgcatggtcgtcactgtgatactgtgcagaatgaagaacactactaagaaacctgacttttcgtctcagcccgcagttcacaagctaaccaagcgtattcctttgcgaaggcaagtatctgcagagtcaagctcttcaatgaattcgaatacccccctcgtgcggatcacgactcgcctgagtagcacagccgatactccgatgcttgcaggcgtgtccgaatatgaactgcctgaggatccgaagtgggagtttccaagagacaagctgaccctgggcaaacctctcggggaaggttgctttggccaggtggttatggcagaggcggtaggaattgacaaggataaaccaaaagaagccgtgaccgtagcagtcaagatgctaaaagacgacgccaccgaaaaggatttgagcgacttagtgagtgagatggaaatgatgaagatgatcggtaagcataagaacattattaatctccttggcgcctgtacccaggatggccctctgtacgtcatcgtggaatatgcatccaaaggaaatttaagggagtacttaagagctaggagaccccctgggatggagtacagttacgacattaacagagttcctgaagaacagatgaccttcaaggacctggtgagctgtacctatcagcttgcgcggggtatggagtatctggcctcgcagaagtgcatacaccgggaccttgcagcaaggaacgtgctggtcaccgagaataatgtcatgaaaatcgctgattttggactggccagggatattaacaatattgattactataagaaaactaccaacggccggctgccagtgaaatggatggcccccgaggctctttttgatagggtgtatacccatcagtccgatgtttggagctttggagtgctcatgtgggagattttcacccttggggggtctccctacccggggattcccgtggaagagctgttcaagctgctgaaagaaggacaccgaatggataaacctgccaattgcaccaacgaactgtatatgatgatgagagattgctggcacgcggttccttcccagcggcccactttcaagcagctcgttgaggatctggatcggatcctcacccttacgactaatgaagaatacctagacctgagtcagccattagagcaatatagtcccagctatccagacactcgctccagctgttcgtctggggatgattctgtcttctcccccgaccctatgccttacgagccttgcctacctcaatatccgcacattaatggctccgtcaagacgtag

SEQ ID NO: 187840 - DNA, 2358 bp, Artificial Sequence
  Description of Artificial Sequence: Synthetic coding sequence
atggtgagctggggccggttcatctgcctggtggtggtgaccatggctaccctcagcctcgcccgccctagctttagcctcgtggaagatactactctggagcctgaggaacctcccaccaaataccaaatctcccaaccagaggtttacgtcgcggctcctggggagagcctggaagtgcgctgtttactcaaggacgccgccgttatatcatggaccaaggacggtgtgcatctcggacccaacaatagaacagtacttattggcgagtacttgcagatcaaaggcgctacaccgcgcgattctggtctttatgcgtgtactgccagtaggaccgtggacagcgagacttggtactttatggtgaatgtcactgatgcaatctcctcaggcgacgacgaggatgatacagatggcgccgaggacttcgtctcggaaaactctaataacaagcgcgctccctactggaccaatacggagaagatggagaaacgcctccacgcggtcccagccgccaataccgtcaagtttcggtgtccggctggaggaaatccaatgcccactatgcggtggctgaagaacggaaaggaatttaaacaggaacatcgtataggaggttataaagtgaggaaccagcactggtcactgatcatggagtccgtggtgccgagcgacaaagggaattatacctgtgttgtcgagaatgagtatggatctataaaccacacttaccatctggatgtcgtggagaggtcaccacatcggcctatcttgcaggccggccttcccgctaatgcctcgacagtcgttgggggtgatgtcgagttcgtatgcaaggtgtactcggatgcccagccccatattcagtggatcaagcatgtggagaaaaacggatctaaatacgggcccgatggcttaccatatcttaaagtcctaaaagctgcaggtgtaaacacaacggataaggagatagaagtcctgtacatcagaaacgtgacatttgaagacgccggcgaatatacatgtcttgctggcaattccatcgggatatcctttcattcagcctggctgaccgtcctgcccgctcctggtagagagaaagagatcaccgcctccccagactatcttgagattgctatctattgtattggcgtatttttaattgcgtgtatggtggtcacagtgattctctgtagaatgaagaatacgactaagaagcccgatttctcgagtcagcctgctgtccataagctgacaaagagaattcccctgaggcggcaagtgtccgcagagagctccagttcgatgaatagtaacactcccctggttaggattactactaggctgtcttcaactgccgacacgcctatgttagcgggggtttcagagtacgaactgcccgaggatcccaaatgggagttcccaagggataaattaacgttaggcaagcccctgggcgaagggtgcttcggtcaggtggtaatggcagaagcagtagggatcgacaaggacaaaccaaaggaagctgtgaccgtagccgtcaagatgctgaaagacgatgctaccgaaaaggatctgagcgatctggttagcgagatggagatgatgaaaatgatcggaaagcataaaaacatcattaaccttttaggcgcatgtacgcaggacgggccactgtacgtgatcgtagagtacgcaagtaagggaaacctgagggagtacctgagggccaggaggccccctgggatggagtactcgtatgacattaacagagtgccggaagaacagatgaccttcaaggaccttgtgtcttgtacgtatcagcttgccaggggcatggaatatttggcttctcaaaagtgcattcatagggatctagccgcccggaatgtcctggttactgaaaataacgtaatgaagattgcagatttcggtctggctagagatatcaacaacatcgattattataagaaaacaactaacggccggttgcctgtcaaatggatggcccctgaagcactctttgaccgagtttatacccatcagagcgacgtctggagtttcggggttctgatgtgggaaatttttacattgggtggatcaccctatccaggcatacctgtggaagaactcttcaaactgttaaaagaaggacaccggatggacaagccagcaaactgtaccaatgaactgtacatgatgatgagggattgttggcatgccgtccctagccagaggcccacttttaaacaattagtcgaagatctggaccggatcttgaccctgaccaccaatgaggagtacctcgacctctcgcaacccttggagccgtactctccttgctatccagaccctcgatag

SEQ ID NO: 187841 - DNA, 2115 bp, Artificial Sequence
  Description of Artificial Sequence: Synthetic coding sequence
atggtgagctggggccggttcatctgcctggtggtggtgaccatggccaccctgtctctggcccgcccatcattttcgctagtagaggatacgacgcttgagccagaaggggctccctactggaccaacactgaaaagatggaaaaacgcctgcacgcagtcccggccgccaatacagtgaagttccggtgccctgccggcgggaatcctatgccgactatgaggtggctgaaaaatggaaaagagtttaagcaggagcacaggattggtggctacaaggtgagaaaccaacattggagcctcatcatggaaagtgtagttccttcggacaaaggcaactatacatgtgtggtggaaaacgagtacggaagcattaatcacacttatcacctcgatgtagtagaaagatccccccacagacccatcttgcaggccggcctccctgccaacgcgagcaccgtggtgggaggtgatgttgagtttgtgtgtaaggtgtattctgatgctcagccacatattcaatggatcaagcacgtggaaaagaatggcagcaaatatgggcctgacgggctgccgtacttgaaagtgctgaaggccgctggagttaataccaccgacaaagagattgaagtcctgtacatccgtaacgttaccttcgaggacgctggggaatacacctgtctcgccggtaattcaatcggcataagttttcattctgcatggcttacagtgctgcccgctccagggagagagaaggagatcaccgcaagcccagactacttagagattgcgatttattgtataggggtcttccttatcgcttgtatggtggtaacggtgatcctctgccggatgaagaataccactaagaagcctgacttctcaagtcagccagccgtgcataaacttacaaaacgaatccccctgcggcgtcaggtctctgctgaatcatccagcagcatgaactctaacacacctcttgtgcgcatcacaacaagattgtctagcactgccgataccccaatgctagcaggagtcagcgagtatgagttacctgaggatccaaaatgggaattcccacgggacaagctcaccttaggaaaacctctaggtgagggctgctttggacaagtggttatggcagaggccgtcggtattgacaaagacaaaccaaaggaagcggtaactgtcgccgtgaagatgctgaaggacgatgcaaccgagaaggacctgtctgacttagtgtccgagatggaaatgatgaaaatgattggcaaacataagaacataattaatctgctgggcgcatgtactcaagacggaccactctatgtcattgtcgaatatgcctcaaaggggaatctaagggagtatctgagagccagaagaccccccggcatggaatatagttacgacattaatcgcgttccagaggagcagatgaccttcaaagaccttgtctcctgtacctaccagctggcccgaggtatggaatacctggcatcgcaaaagtgcatccatcgcgacctggctgcccggaatgttcttgtcacggagaacaatgttatgaaaatagcagatttcggcctggcccgggatattaataatattgattactataaaaaaacaacgaatgggcgtctgcctgtgaaatggatggcccccgaggctctttttgatagggtgtatacacaccagtcagatgtgtggagtttcggagtcctgatgtgggaaatttttacgctcgggggatctccgtaccccggcattcccgtggaggaactgtttaaattgctcaaggaaggacatcgtatggacaagcctgccaattgcaccaacgagttatacatgatgatgagggattgttggcacgccgttccgtcccaacgccctactttcaaacagttggtcgaggatcttgacaggatccttactttgactactaatgaggagtatctcgacctctcccagcccctggaacagtatagcccaagttacccagatacacggagcagctgttcaagtggcgacgattcagtgttttcccccgacccaatgccatatgagccctgccttccacagtacccacatatcaatggaagcgtgaagacctag

SEQ ID NO: 187842 - DNA, 2124 bp, Artificial Sequence
  Description of Artificial Sequence: Synthetic coding sequence
atggtgagctggggccggttcatctgcctggtggtggtgaccatggcaactttatccctggcccgccctagtttttcactagtagaggatacaactctagagcctgaggatgccatcagctcgggtgatgatgaggacgacacggacggggcagaagactttgtgagcgagaattccaacaacaaacgagctccttactggaccaataccgaaaaaatggaaaaacgtctacatgccgttccagccgctaataccgtaaagtttagatgtcctgccggggggaacccaatgccaacgatgcgatggctgaagaatggtaaggagttcaaacaggagcaccggatcggaggttataaggtgcgaaaccagcactggagtctgattatggagagcgtggttccttcagacaaaggcaattacacctgtgtggtcgaaaatgagtacggctctatcaatcacacatatcacctcgatgttgtagaaaggtcaccacacaggcccatactgcaggctggactgccggccaatgctagcaccgtggtgggcggcgacgtggagttcgtgtgcaaggtgtacagcgatgcacagccccacattcagtggattaaacacgtcgagaaaaatgggtccaagtacggacctgacgggcttccttatctcaaggtgttgaaggccgctggcgtgaacactacagacaaggagatcgaagttttatacatccggaatgtgacgttcgaggacgctggcgagtacacgtgcctagccggaaacagtatcgggatctcttttcacagcgcctggcttacagtactgcctgcccctggaagagaaaaggaaatcactgcatctccagactacttagaaatagccatttattgcatcggtgtattcctgatcgcatgtatggtagtcaccgtgatcctttgcagaatgaagaacaccaccaagaaaccagatttcagctctcagcccgctgtgcacaaattaaccaagcgcattcccttgagacgccaggtcacagtatctgcagagtcaagttcatctatgaacagtaataccccacttgtacgaataacaacacggctctcctcaactgcagacacacctatgcttgctggggttagcgagtacgagctccctgaggacccaaagtgggagttcccgcgggacaagctgacccttggaaaacctctaggagagggatgttttggtcaggtagtaatggccgaggcagtgggtattgacaaggataagccgaaggaggccgtcacagtggccgtgaagatgttgaaggatgatgccaccgagaaggacctctccgatctggtgtccgagatggaaatgatgaaaatgatcgggaaacacaaaaacattattaacctgctaggggcctgcacacaagacggccccctgtatgtaattgtggagtacgcgtcaaagggtaacttgagagagtacctccgcgctaggcgcccgccgggaatggagtactcgtacgatatcaaccgcgttccagaagaacagatgactttcaaggacctggtttcatgcacttatcagctggcaagggggatggaatacctagccagccagaaatgcattcacagagaccttgctgctcgtaatgtacttgtcacagaaaataacgtcatgaaaattgccgatttcggcttggccagagacattaacaacattgattattacaagaagacgaccaatgggcgcctccctgttaagtggatggcaccggaggccctcttcgatcgcgtctatacccatcagagtgatgtgtggagcttcggcgtcctcatgtgggagatcttcacactgggagggagcccctacccagggatccctgtggaagagctatttaaactgttgaaagagggccatcgcatggacaaacctgcaaattgtaccaatgagctctacatgatgatgcgcgactgttggcatgcagtcccatcccagcgtcctacattcaagcaactcgttgaggatctcgacaggattcttactctcacgacaaacgaagaggagaagaaggtgtcgggcgcagtggattgtcacaaacccccatgcaatccatctcatctcccctgtgtcttggcagtcgaccagtag

SEQ ID NO: 187843 - DNA, 2466 bp, Artificial Sequence
  Description of Artificial Sequence: Synthetic coding sequence
atggtgagctggggccggttcatctgcctggtggtggtgaccatggccacactgtctcttgcgaggcctagttttagcctggtcgaggatacgaccctagaaccggaagaacctcctaccaaataccaaatcagccagccagaggtgtatgtggctgccccaggagagtcattggaggtgcgatgcttgttgaaagacgccgccgtgattagctggaccaaggatggagttcatttgggcccgaataataggaccgtgctaatcggcgagtatctacagatcaagggggctaccccccgcgattccgggctgtacgcctgcacagcgtctaggactgtcgactcagaaacgtggtatttcatggttaacgttacagacgcaatctcctctggcgacgacgaggatgataccgatggcgctgaagactttgtgtccgaaaactccaataataaaagggctccatattggacaaatactgaaaaaatggagaaacggctccatgccgtgccagctgccaacaccgtaaagtttcggtgccccgccggagggaatccaatgcctacaatgcgttggctgaaaaatgggaaggaattcaaacaagagcataggatcggaggatataaggtccggaatcagcattggagcctgatcatggaatcagttgttcctagtgataagggcaattacacatgtgtcgtggagaatgaatacggatccatcaaccacacgtaccacctagacgtggtcgaacgaagtcctcataggcccatccttcaggcgggcctcccggcaaatgccagtaccgtggtagggggtgatgtggagttcgtttgtaaggtatattcagacgcacagccccacatccagtggatcaagcacgtagaaaagaacgggagcaagtacggcccagacggtttaccttacctgaaggtcctaaaggctgcaggggtgaacaccaccgataaagagatcgaggtgctgtacatccgcaacgttaccttcgaggatgcaggcgagtatacttgcttagcaggcaactcgatcggcatcagctttcattctgcctggctgacagtgcttcctgctcccggaagggagaaggagattaccgcctcgccagactatcttgaaatcgctatatattgtataggggtcttcctgatcgcctgcatggtcgttacagttatcctgtgtcgcatgaagaacaccacgaaaaagcccgattttagctcgcaaccggcagtacacaagctcaccaaaagaatccccttgaggaggcaagttacagtgagcgctgaaagtagctcctctatgaattcaaacacaccccttgtgcggatcactactaggctttcctccacagctgatactcctatgctggccggagtctccgagtatgagctgcccgaagaccctaaatgggagttccctcgggacaaactgactcttggcaagccactgggagaggggtgttttggccaggtggtgatggcagaagctgtgggtattgataaggataaacccaaggaggccgtgacagtagcagtcaagatgctcaaagatgatgctaccgaaaaagacctgagcgatctagtctcagagatggagatgatgaagatgattggcaaacacaagaatattataaacctcctgggggcgtgcacacaagacggccccctctacgtcattgtcgagtatgcctcaaagggaaacctgcgagagtacctcagggctcgacggcctcctggcatggagtactcttatgacataaaccgcgttcccgaggaacagatgactttcaaagacctggtgtcctgtacctaccagctggcccgaggtatggagtacctcgcgtcacagaagtgtatacacagagacttagccgccagaaatgttttagtgacggagaataacgtaatgaaaatagctgattttggtctcgcccgagatatcaataacatcgactactacaagaagactaccaacggtcgcctgcccgtgaaatggatggcgccagaagcgctcttcgaccgagtatacacccatcagtccgatgtctggagcttcggcgtcctaatgtgggaaatcttcaccttgggaggcagtccttacccaggcatacccgtcgaagagctgttcaagctgctgaaagaagggcaccgtatggacaagccagccaattgtacaaatgagctttacatgatgatgcgcgactgctggcacgcggtaccgtctcagaggccaacattcaagcagctcgtcgaggatcttgatagaattctcactttgactaccaatgaggagtatcttgatctgtcacagcctctggagcaatattccccttcataccccgacactcgcagcagctgctcaagtggtgacgacagtgtcttctctcctgacccaatgccatacgagccttgcctgccccaatacccccatattaatggttctgtcaagacttag

SEQ ID NO: 187844 - DNA, 765 bp, Artificial Sequence
  Description of Artificial Sequence: Synthetic coding sequence
atggtgagctggggccggttcatctgcctggtggtggtgaccatggctaccctctctctggctcgaccttcctttagcctggttgaagataccactctcgagccagaggagcccccgacgaaatatcaaatctctcagcccgaggtttatgtcgcagcccccggagagtccctcgaggttaggtgcctgttaaaagatgctgctgtaataagttggacgaaggacggcgtgcaccttggccccaacaataggaccgtgctgatcggtgagtacctgcagatcaaaggtgccacacctagagattctggtctgtacgcatgcacggcatccagaacagtggattcagagacttggtatttcatggttaacgttaccgacgccatatcaagcggggacgatgaggacgataccgatggggcggaggatttcgtcagtgaaaacagcaataataagcgagcaccgtattggaccaacactgaaaaaatggaaaaaagacttcacgcggtgccagccgcgaacaccgtgaagttcagatgccctgccggaggtaatcctatgccaactatgaggtggctgaagaatggcaaagagtttaagcaggagcaccgtatcggcgggtacaaggtccggaaccagcattggagtttaataatggaatctgtggtccccagcgacaagggcaattatacctgtgtagtggagaatgagtacgggtctattaaccacacctatcatctggatgttgtgggaagccaagggctctag

SEQ ID NO: 187845 - DNA, 2043 bp, Artificial Sequence
  Description of Artificial Sequence: Synthetic coding sequence
atggtgagctggggccggttcatctgcctggtggtggtgaccatggccacgcttagcttggctcgaccttcatttagcctggttgaggacacaactctagagcctgaagacgccatcagttcaggcgatgatgaagacgacaccgatggagccgaagacttcgtgtccgaaaattccaacaacaagagggccccttattggaccaacaccgaaaaaatggagaaacgattacacgctgtgccagctgcaaatacggttaagttccgatgccccgccggcggaaaccctatgcccacaatgcgatggctaaaaaacggaaaggaattcaaacaggagcatcggatcggcggctataaagtgcgcaaccagcattggtctctaattatggagtcagtggtgccctctgacaaaggtaactacacttgtgtggtcgagaatgaatatggctcaattaaccatacataccacctggacgtagtggagagatccccacatcgtcctatcctccaggctgggctgccagctaatgcatccacagtcgttggtggtgacgtggaattcgtttgcaaggtgtacagcgatgctcaacctcacattcagtggatcaaacacgtagaaaagaatggcagcaagtatggaccagacgggcttccctacctcaaagtgctgaaacattccggaataaattcttctaacgctgaggtgctagctctgtttaacgtaactgaggccgacgccggagagtatatttgtaaagttagcaattacattggccaagccaatcagtcggcatggctgaccgttctgcccaaacagcaggccccaggccgagagaaggaaatcaccgcatcacccgattatctggaaatcgcaatatactgcatcggcgtcttcctcattgcatgcatggtcgttaccgtcatcctgtgtcggatgaaaaataccaccaagaagcccgatttttccagccagcccgccgtgcataagctcacaaaacgcatccccctccgacggcaggtgacagtgtccgctgagtcttctagttcaatgaattccaacactccgcttgtgcgtattaccactaggttgagttcgacagcggatactccaatgctggcaggcgtctcggagtatgagttacctgaagatcctaaatgggagtttccccgtgacaaactgacccttggaaaaccactgggggaggggtgcttcggccaggtggttatggctgaggctgtggggattgacaaagataaacctaaggaggctgtcaccgtcgcggtgaagatgcttaaagacgacgctactgaaaaggatctctctgatttggtgagtgagatggagatgatgaagatgatcggaaagcataagaacattatcaatctcctcggtgcctgcacccaggatggaccactctatgtgatcgtcgagtatgcctcaaagggtaaccttcgggagtatctgcgcgcgaggcgcccccccggcatggagtattcatatgatattaacagagtccccgaggagcagatgaccttcaaagacctagtcagctgcacctaccagctggccaggggcatggagtatttagcatctcagaagtgcatacatcgagacctcgctgcgcggaacgtccttgtgactgaaaataatgttatgaaaatcgcagacttcggactcgcacgcgacatcaacaatatcgactattataaaaagacgaccaatggacggcttcctgtcaagtggatggctcccgaagctttgttcgacagggtgtacactcatcagtcagacgtctggtcttttggtgtcctgatgtgggagatttttactcttggcgggtcaccataccccggaattcctgtcgaggagctgtttaagttacttaaggaaggccacaggatggataagcctgcaaactgcactaacgaactgtacatgatgatgcgcgattgctggcacgcagtgccatcccagcggccgactttcaaacagctggtggaagatctggaccgtatactcacactaactacaaacgaaatttag

SEQ ID NO: 187846 - DNA, 2310 bp, Artificial Sequence
  Description of Artificial Sequence: Synthetic coding sequence
atggtgagctggggccggttcatctgcctggtggtggtgaccatggcaactttaagtctagcacgcccttccttctccctggtagaggacacgactttggagccggaggaaccacccaccaaataccaaatctcacagccagaggtctatgttgcagctccaggcgagtctctcgaagttcgatgcttactgaaggacgccgccgtgattagctggacaaaagatggcgtgcatctaggacctaacaaccgaaccgttttgatcggcgagtatttgcagattaagggcgcaactccccgcgattcaggtctgtacgcttgcaccgcatctcggactgtggactctgaaacctggtactttatggttaatgttaccgacgctatcagttccggggatgacgaagatgacacagacggcgctgaagatttcgtctccgagaattctaacaacaagagggccccttactggacgaataccgagaagatggaaaaacgactgcacgcggtgcccgctgccaacaccgtgaagtttagatgtccggctggcggtaaccccatgcccacgatgagatggctgaagaacggcaaggagtttaagcaggagcacaggatcggcggctacaaagttagaaaccagcattggagcctgatcatggaatccgtggtccctagcgacaaggggaactacacctgtgtggtagagaacgagtatgggtccataaaccacacttatcatctagacgtcgtggaacgaagcccacacagacctattctgcaggccggacttccagctaatgccagcaccgtggtcggaggggacgtagaattcgtctgcaaagtgtacagtgacgcacagccccatattcagtggatcaagcatgttgagaagaacggatccaagtatggacctgatggactgccttacctcaaagttcttaagcatagcggtattaactccagcaacgctgaggtgctggccctgtttaacgtgacggaagcagacgcaggggaatatatttgtaaagtttccaactacattggacaggccaatcaaagtgcctggctaacggtgctgcctaaacaacaagcacctggccgcgaaaaggaaattactgcgtcccctgactatctagagattgctatctactgcataggcgtgttcctgatcgcgtgtatggtagttactgtgatcctctgtagaatgaagaatacaacgaaaaaacctgatttctccagccaaccagctgtccacaagctgacaaagcgaatcccactgagaaggcaggtcacggtgtcagcagaatcttcttccagtatgaattcgaatacaccattggtgaggatcactacccgtctgtcttcaactgccgacacccctatgctggctggggttagcgaatacgagctgcccgaagatcctaagtgggagttcccacgggacaagttgactttaggaaagcctcttggagagggctgcttcggccaggtggtcatggcggaagccgtgggcattgacaaagataaacctaaggaagcggtaacggtggccgtaaagatgctaaaggacgatgccaccgaaaaagatttgtctgatctagtctctgaaatggagatgatgaaaatgattggcaaacacaagaatatcataaatctgctgggcgcctgcactcaggatggtcctctgtacgtaatcgtggagtacgcctccaaaggaaatttacgcgaatacttacgggcacgacgaccccccggtatggaatactcctacgacataaatcgagtccctgaagaacagatgacattcaaagatctggtgtcctgtacttaccagctcgccaggggaatggagtatttggcttctcagaagtgtattcacagagacctggcagccaggaatgttctagtgacagagaacaatgtcatgaagatagccgactttggactggctcgggacattaataacatcgattattacaagaagactaccaacggacggcttcctgtgaagtggatggctccggaagccctttttgatcgggtgtatacacaccagtcggacgtatggtcatttggggtactgatgtgggagatattcaccctgggcgggagtccatacccagggatcccagttgaggagctcttcaaactcctgaaggagggtcacaggatggataagcccgcgaattgtacaaatgagctgtacatgatgatgcgcgactgttggcacgccgtgccctcccagagacccacattcaagcagctggttgaagacctagaccgaattctgacgctgactaccaacgaaatttag

SEQ ID NO: 187847 - DNA, 2307 bp, Artificial Sequence
  Description of Artificial Sequence: Synthetic coding sequence
atggtgagctggggccggttcatctgcctggtggtggtgaccatggcaactttgtccctggctcgtcccagcttctctctcgtggaggacaccacactagagcccgaggagccccccaccaagtaccagatcagtcagccagaggtgtatgtggcagcacccggagaaagcttagaagtccggtgcctgctgaaggacgctgctgtcatcagctggacaaaagacggagtacaccttggccccaacaacaggaccgtactgataggagaatatctccagattaagggggccaccccaagggattctggcctgtacgcctgcactgcatccagaacagtcgacagcgagacatggtattttatggtgaacgtcactgatgccatcagcagcggcgacgatgaagatgacacagacggggccgaggatttcgtgtccgagaattctaacaataaacgcgccccctactggaccaacacagagaagatggagaagaggctgcacgccgtgccagccgccaacacagttaaatttagatgtcccgccggagggaaccctatgccaacaatgcgatggttaaagaatgggaaagaatttaagcaggagcaccgaatcggcggatataaagtccggaatcagcattggtctctgatcatggagtccgtcgtgccatccgacaagggaaattatacttgcgtcgtcgagaatgagtacggctccatcaatcatacctatcatctggacgtggtggagagatctcctcatcgacctatcttgcaagcaggcctgccagccaacgctagcactgtggttggcggtgacgtcgagtttgtatgtaaggtttactccgacgcccagcctcacattcaatggatcaaacatgtggagaagaacggatcaaaatacgggccagatggtctgccatatcttaaggttcttaagcactctggaatcaatagctccaatgctgaggtcctcgcattatttaacgtgaccgaggccgatgccggtgagtatatttgtaaagtgtcaaactatattggacaagccaatcagtcggcctggctcacggtgctgcccaaacagcaggctcctggaagggaaaaggaaatcaccgcttcacccgactatctggagatcgccatttattgtatcggcgtgttcctgatcgcatgtatggtggtcaccgttattctgtgcagaatgaaaaatactactaagaagccagacttctcctcacaacccgccgtgcataaacttaccaaacgtattcctctgaggcgacaggtgaccgtgtccgccgaatcctctagtagtatgaattctaatactccacttgtaagaatcacaactaggctcagtagcaccgccgacactccgatgcttgctggggttagcgagtacgagcttcccgaggaccccaaatgggaattcccccgtgacaagttaaccttggggaagccgctgggggaaggatgtttcgggcaagtagtgatggctgaggccgtgggtatcgacaaggataaaccaaaagaggccgtcaccgtcgccgtgaaaatgcttaaggacgacgccacggaaaaggatctgagcgatctggtgtccgagatggaaatgatgaagatgattggtaaacacaagaatataatcaaccttttgggcgcttgtacacaggatgggcccctatacgtgatagtcgagtacgcaagcaaaggtaatctccgtgagtacttgagagcaaggaggcctccgggcatggagtattcctatgacataaatcgggtgcccgaggaacagatgacatttaaagatttggtgagttgtacctaccagcttgcccgcggcatggaatacttggcaagtcaaaagtgtatccaccgggatctggccgcccgaaacgtgctcgtcacagagaacaatgtcatgaagattgccgacttcggcctggctagggacatcaataatatagattactataaaaagaccactaacgggcggttgcccgtgaagtggatggctcccgaggccttattcgaccgcgtgtacacacatcagagtgatgtctggagctttggcgtgctgatgtgggagatctttactctcggcgggagtccttatcctggcattcctgttgaggaactgtttaagttgctgaaggaaggacaccggatggacaagcccgcgaactgtactaacgagctttatatgatgatgcgagattgctggcatgccgtcccatctcagcgacccacctttaagcagctggtggaagatctggataggattctaaccctaacgaccaatgagtag

SEQ ID NO: 187848 - DNA, 2124 bp, Artificial Sequence
  Description of Artificial Sequence: Synthetic coding sequence
atggtgagctggggccggttcatctgcctggtggtggtgaccatggccacattatcactggctcgtccaagtttcagtctggtggaggacactacactcgaacccgaaggagctccctactggacgaatactgagaagatggagaagcgtctgcacgctgtgcccgccgccaacactgtgaagttccgctgccccgcaggagggaatcctatgccaacgatgcggtggctcaaaaatggaaaggagtttaaacaagaacatcgaataggaggctataaggtacggaatcagcactggtctctgatcatggaaagtgtcgtcccatccgataagggcaactatacttgtgtggtggagaacgagtacgggtcaatcaaccacacataccatctggacgtggtagagcgatctccacaccgcccaatcttgcaggcaggactgccggccaacgcctctactgttgttggtggcgacgtggagttcgtatgcaaagtatacagtgatgctcagcctcatatccagtggattaaacacgtggagaagaatggatcaaagtacgggcccgatgggcttccgtacctgaaagtactcaaacatagtggaataaattcctccaacgctgaagtacttgcactgttcaacgtgacagaggccgatgcgggcgagtacatttgcaaggtaagtaattacatcgggcaagctaaccagtctgcatggctcactgtgttaccaaaacagcaggcccccggtagggagaaagaaattacggcctcgccagactacctggagatcgctatttactgcatcggggtttttctgatcgcatgcatggtcgttactgtcatcctgtgccggatgaagaacacaacaaaaaaacctgatttttcctctcagcccgcagtgcataaactcacgaagaggatacctctgaggagacaggtcaccgtgagtgctgaaagctccagttccatgaacagtaatactccacttgttagaatcaccacccgcctttccagtacagctgacacccctatgctagctggtgtgtctgaatacgaactccctgaagaccccaagtgggagttcccgagggacaaactgactctagggaaacctctgggcgaagggtgcttcggtcaggtcgttatggcagaagccgttggcattgacaaggacaaaccaaaggaagccgtgactgtggccgtgaaaatgctgaaggacgacgcgacagagaaggatctgtccgatttggtgagtgagatggagatgatgaaaatgattggaaaacacaagaatattataaacttgctgggggcctgtacacaggatgggccactgtacgtaattgtagaatacgcttctaaggggaacctcagagagtacctgagggcacggcgccccccaggcatggaatactcttacgatattaaccgagtcccagaagagcagatgacttttaaagacttggtgtcatgcacctaccaactggcccgggggatggaatacctcgcatctcagaagtgtatacatagagacctagccgctcgaaacgtcttggtgacagaaaacaatgttatgaaaatcgcggacttcggactggctcgagatattaataacatcgattattataaaaagacgaccaacggccgtttgcctgttaagtggatggccccagaagccttattcgatagagtgtacacccaccaatccgacgtgtggtctttcggagttctgatgtgggaaatctttactttgggagggtctccatacccggggattccggtagaagagctcttcaagttactcaaagaagggcatcggatggacaagccagcgaattgcaccaatgagctgtacatgatgatgagggattgctggcatgccgtccctagtcaacggcccacctttaaacaactggtcgaggatctggaccggatcctgaccctcaccacaaatgaagagtacctcgatctctctcagcctctggaacaatattctcctagttaccctgacacaaggagcagctgttcctccggagacgatagtgtgttttcgcctgaccctatgccctatgagccgtgtctgccacaatatccccacatcaacgggtctgttaagacttag

SEQ ID NO: 187849 - DNA, 2118 bp, Artificial Sequence
  Description of Artificial Sequence: Synthetic coding sequence
atggtgagctggggccggttcatctgcctggtggtggtgaccatggccactctatccctcgcacgcccaagtttcagtctcgtggaagacaccaccctggagccagaggaacccccaactaagtaccagataagccagcctgaggtctacgtcgccgctcccggggaaagcctggaagttcgatgtctgttaaaagacgctgccgtgatatcctggacaaaggacggagtccatctgggccccaacaataggaccgtgctcattggcgagtacctccagatcaagggcgcgacaccaagagattccggtctgtatgcctgtacagctagccgtaccgttgatagcgagacgtggtatttcatggtgaacgtaaccgacgcgatcagcagtggggatgacgaagacgacaccgacggcgccgaggattttgtaagcgaaaacagcaacaataaacgggcaccctattggaccaatactgagaagatggagaaaagactgcatgctgtccctgccgctaataccgtgaaattccggtgtccagccggcggcaatcccatgcccaccatgaggtggctgaagaacggtaaagagttcaaacaggagcaccggatcggcggctacaaagtacgcaatcagcattggagtctcataatggaatccgtggtgcccagtgataaggggaactacacctgcgtggtggagaatgagtacgggtctataaatcacacttaccacctagacgtggtcgagcggtcccctcaccggcccattctccaggccggcttacctgccaacgcaagcaccgtggttggaggcgacgtggagtttgtttgcaaggtgtattcagatgcccaaccacacatccaatggattaagcatgtcgagaagaacggcagcaagtacggccccgacggactcccatatttaaaagtgcttaaggtgtccgcagaatcttcctcatctatgaatagcaacacccctcttgtaaggattactacaagactgagctctaccgccgacacccccatgcttgccggggtcagcgagtacgaactgcccgaagacccaaagtgggaattccctagagacaagctcacacttggcaagccactgggagaaggttgtttcggtcaggtggtgatggctgaagcggtaggcattgacaaagacaagcccaaggaggctgtaacagtggccgtgaagatgttgaaggacgacgcgacggagaaggatctctcagacctggtgtcagagatggaaatgatgaagatgatcggcaagcacaagaatataatcaatctcctaggagcctgcactcaggacggccctttgtatgtaatagtggaatatgcttccaaaggcaacttgagggagtaccttcgcgcaaggaggccgcccggcatggagtatagctacgatatcaaccgagttcccgaggagcagatgacgtttaaggatttggttagttgcacttatcaactcgcaagaggaatggagtatcttgcgtcacagaagtgcatccacagagacctggctgctagaaatgtcctggtaaccgaaaataacgtaatgaagatcgctgactttgggctggccagagatataaacaatattgactactacaagaaaactacgaacggacggctgccagtcaagtggatggcccccgaggccctattcgaccgtgtgtatacgcaccaatctgacgtttggtccttcggtgtgctcatgtgggagatattcacacttggcggaagcccctatcctggcataccagtcgaggagcttttcaagttgctgaaagaaggtcaccggatggacaaaccagccaattgcactaatgagctctacatgatgatgagagactgctggcacgccgtgccatctcaaaggcctacttttaagcaactggttgaagacttggacagaatcttaaccttgaccaccaacgaagaatatctggatctgtctcagcccctcgagcagtactcaccctcttacccagacactcgatcttcttgttctagcggcgacgattcagtgtttagtcctgatcctatgccctatgaaccatgcctgccccagtatcctcacataaatggatcagtaaaaacctag

SEQ ID NO: 187850 - DNA, 2130 bp, Artificial Sequence
  Description of Artificial Sequence: Synthetic coding sequence
atggtgagctggggccggttcatctgcctggtggtggtgaccatggccacattgtctcttgctcgcccttctttctcactggttgaggataccactctggaaccggaggaacctcccaccaagtatcaaatcagccagccagaggtttacgtagcagcccccggagagtctctcgaggtgcgatgcctcttaaaagacgcggccgtgatttcctggacgaaagatggagtgcacctgggaccaaataatcgcactgtgctaattggcgagtacttgcaaataaagggggcaacccctagagactctggcctgtatgcttgcacagccagcagaaccgtcgacagcgagacatggtactttatggtcaatgtgacggacgccatctcctccggtgacgacgaagatgacacagacggagcggaagactttgtttcagaaaattccaacaacaaaagagcaccatattggacgaatactgaaaagatggaaaagagactccatgcggttcctgccgccaacaccgtcaaattccggtgtcccgccggggggaatccaatgcctactatgaggtggctgaaaaatgggaaggagttcaaacaagaacatagaataggtggctacaaagtgcgcaatcaacattggtcactgattatggaatccgtcgtgccctcggataaaggcaattacacgtgtgtggtagaaaacgagtatggcagtatcaatcacacctaccatttggatgtcgtcgctcccggccgagaaaaagagattactgcatccccggactacctggagatcgctatctattgtattggagtttttctaattgcctgcatggtcgtcactgtgattctgtgtcgaatgaaaaacacaactaagaaacctgacttttcttcccagcccgcagtgcacaagctgaccaagcggattccattgcgccggcaagtaacagttagtgccgagagcagtagcagtatgaatagtaatacacccctcgtacggattaccacgaggctttctagcaccgccgatacccctatgttggccggcgtctctgagtacgaactgccagaggatcccaaatgggagttccctcgcgataaactgaccttggggaagccattgggcgaggggtgctttgggcaagttgtcatggccgaggctgtgggaatagataaagataaacccaaagaggccgtgaccgtcgctgttaaaatgttgaaggatgatgcaactgagaaagatctgagcgatctcgtcagtgaaatggaaatgatgaagatgataggcaaacataagaatatcataaacctcctgggggcctgcactcaggatggacctctctacgtgattgtcgaatacgccagcaagggcaatctgagggagtatttgagggcaaggaggccacctggcatggaatatagttacgacattaatcgggtccccgaggagcagatgacattcaaggatttagtcagctgcacttatcagctcgcgcgaggcatggagtatttggcctctcagaaatgtattcaccgggatctggccgctaggaacgttctggtaaccgaaaacaatgtcatgaagattgcagactttggcctcgcgagggatataaacaatatagactactacaaaaagaccaccaacggacgactcccagtgaagtggatggccccagaagctcttttcgatcgcgtttacacccatcagtctgacgtgtggagcttcggtgtgctcatgtgggaaatctttactctggggggctccccttatcctgggataccagtggaagaactgtttaagctacttaaagaaggccaccgcatggataaaccagctaactgcacaaacgaactctatatgatgatgagagattgctggcacgcggtaccaagtcagcgacctacgtttaaacagctcgtggaagacctggatcgtatactaactctgacaacgaacgaagaatacctagatctcagccaacctctggagcagtactctccctcttatccagatacacgctcttcctgtagtagcggtgacgactcagtgttctcaccagaccccatgccttatgagccatgcctccctcagtatccccatattaatggctcggtgaaaacttag

SEQ ID NO: 187851 - DNA, 2469 bp, Artificial Sequence
  Description of Artificial Sequence: Synthetic coding sequence
atggtgagctggggccggttcatctgcctggtggtggtgaccatggcaaccctctccctggcccgcccctccttttctctggtcgaggacacaaccctggagcctgaggagccacccacaaaatatcagatcagtcaaccggaagtgtacgttgccgccccaggggaatcacttgaagtccgctgcctgctgaaggatgccgcggtcatcagctggaccaaggacggagttcatttgggtccgaataacagaaccgtcctgatcggcgaatacctgcagatcaagggggcaacgcccagagattctggcctgtatgcgtgtactgcttcgaggactgtcgattctgagacgtggtattttatggttaacgtaactgatgcaatctcaagtggtgatgatgaagacgatacggatggtgcagaagactttgtgtccgagaattccaataataagcgcgcaccctattggactaacaccgagaagatggagaagcggctgcacgctgtacccgccgccaacaccgtgaaattccgctgcccagccggcggcaatcctatgccaaccatgaggtggttaaaaaacggaaaggaattcaaacaagagcatagaattggcggttataaagtgagaaaccagcattggtcactgattatggagtcagtggttccctctgacaaaggcaactacacttgtgttgtagagaacgagtacggcagtattaaccacacctaccatctggacgtcgtggagaggagtccacatagacctatcctgcaggccggcctacccgccaacgcctcaacagtggtgggaggggatgtagaattcgtgtgtaaagtctactcggacgcccaaccacatatacaatggattaagcatgtcgaaaagaacggaagcaagtacggtccggatggtttgccctatctgaaagtactgaaagtgacaaaggccgctggcgtcaatactactgacaaggaaattgaggtcctctacatcaggaatgtgacctttgaagatgccggcgagtacacatgtctcgcaggaaacagcatcggaattagctttcactctgcttggctaacagtgctcccagcacctgggcgggagaaagagatcaccgcctcacctgactatctcgagatcgccatttattgcattggagttttcctgattgcttgcatggttgtgacggttatcttgtgtcggatgaagaatactacaaagaaaccagactttagttcccagcctgccgtgcataagcttactaaaagaattcccctgcggcggcaggtgtcagcggagagcagctcatcaatgaacagtaatacgcctctggtcaggatcactacacgcctttcatctactgcagatacacctatgctcgcaggtgtgagcgagtatgagttgcccgaggaccctaaatgggagttccctagggataagttgacacttggcaagcccctgggagagggatgctttggccaggttgtcatggccgaggccgtgggcattgataaggacaaacctaaagaggcggttaccgtggctgtgaaaatgttaaaagatgatgccacagaaaaggacttgtcggaccttgtgtctgagatggaaatgatgaagatgatcggcaaacacaagaacatcatcaacctcctgggcgcatgtactcaggatgggcctctgtacgtgatcgtggagtatgcaagcaagggcaacttaagagagtacctgcgggcacgcagaccccccggaatggaatattcctatgatattaatagggttcctgaagagcagatgaccttcaaggatctcgtgtcttgcacctaccaactcgctaggggcatggagtatcttgcaagtcaaaagtgtatccaccgggacctcgcggctagaaacgtgctcgtgacagagaataatgtgatgaaaattgcggatttcggactggcaagagacatcaataatatcgactactataaaaagacgacgaacggcaggctccctgttaaatggatggcccccgaagcactctttgatcgcgtgtatactcaccaaagtgacgtgtggtcttttggagtgctgatgtgggagatattcaccctgggaggatccccatatcctggaatcccagtggaggaactgttcaagttgcttaaggaggggcacagaatggataagccagccaactgtacgaacgagctgtacatgatgatgagggactgctggcacgccgtcccatcacagcggccaacttttaaacagctcgttgaagatctggaccgtattctcacgttgaccacgaacgaagaatacctagaccttagtcagcctctggaacagtactccccctcatacccagacacgcggagcagttgctctagcggcgatgacagcgtgttctcacccgaccctatgccctatgaaccttgtctgccacaatatccacatattaatgggagcgtgaagacatag

SEQ ID NO: 187852 - DNA, 2469 bp, Artificial Sequence
  Description of Artificial Sequence: Synthetic coding sequence
atggtgagctggggccggttcatctgcctggtggtggtgaccatggcaactttgagcctggcccggcctagcttctccctcgttgaggacaccactctggagcctgaagagcctcccacaaaataccaaatttctcaacccgaagtttacgtagccgcacccggggaatcactggaggtgcggtgtctgttgaaagacgcagccgtcatttcctggacgaaggacggggtgcacctaggacccaacaaccgaacagtactgattggagagtatttgcaaattaaaggagccacacctcgcgactccggactatacgcctgcacggcatcccgcactgtagactccgaaacctggtattttatggtgaatgtaacagatgcgatctctagcggtgacgatgaagatgacaccgacggcgccgaagacttcgtgtcagagaactccaataataaaagagctccttattggactaacactgaaaagatggagaagcgtctacatgccgtgcccgccgccaacactgtcaagttccggtgtcctgccgggggtaacccaatgcccacgatgagatggctcaagaatggaaaagagttcaagcaggaacatcggattgggggttacaaagtgagaaatcagcactggtccctaattatggagagcgtggtcccatctgacaagggcaattatacctgcgttgtagaaaacgaatatggctcaataaaccacacctatcacctagatgtcgtcgagcgctctccacaccgccccatattacaagcaggactccctgcgaacgcttcaacagtggtagggggggacgtggaatttgtgtgcaaggtgtatagcgacgcacagccacatatccagtggatcaagcacgtggagaagaatggctcgaagtacggacccgatggcttaccttacctcaaggtgctgaagcacagtggtatcaatagtagtaacgcggaggtccttgcgctgttcaacgtgacggaggccgacgctggagagtacatttgtaaggtatcgaactatatcgggcaggcaaaccagagtgcttggttgacagtgttgcctaagcagcaggctcctggacgagagaaagaaatcactgcctctcctgactatctggaaattgcaatctattgcattggcgtattcctgattgcgtgtatggtggtaaccgtgattctgtgtcgaatgaaaaataccaccaagaaacctgacttttcctcgcagccagcagtccataaactaactaaacgtatacctctccggcgccaagtgacagtctccgccgagtcctcatcctctatgaactccaacactcccctcgtgcgcattacaacacggctgtccagtactgctgacacacccatgctcgccggcgtctccgaatatgaacttcccgaagaccccaaatgggagtttcccagagataagctaactttaggcaagccactgggcgaagggtgttttgggcaggtagtgatggcggaggccgttggtatcgataaagacaaaccgaaggaggccgtcacagtggccgtgaagatgctgaaagacgacgctacagagaaggatttatctgacttggtgtctgaaatggaaatgatgaagatgattggtaaacacaaaaacattattaaccttctaggggcttgcactcaagatgggcccctgtatgttatcgtcgagtacgcttctaagggcaacttgagagagtatctgcgcgcccgcagaccgcccggaatggaatattcctatgacatcaatagagtacccgaggagcagatgaccttcaaagatctcgtctcttgtacttatcagttggctaggggcatggagtacctagccagtcagaaatgtatccatcgcgatctcgcagccagaaatgtgcttgtgaccgagaacaatgtgatgaagattgccgatttcgggctcgctcgagatattaacaatatagactactataagaagactaccaatgggcgcctgcccgtcaaatggatggcccccgaggcgctgttcgatagagtgtacacccatcagtccgatgtatggtcttttggtgtgctcatgtgggagatattcacactgggaggcagtccgtacccaggaatacccgtggaagagctgtttaaactcctgaaggagggtcaccgcatggacaagcccgctaattgcactaatgaactgtacatgatgatgcgagactgttggcatgccgtcccctcacagaggccaacctttaagcagctggtcgaagatcttgatagaattctgacactgaccacgaacgaagaatatctggatctttctcaacccctggagcagtactcccctagctacccggacacccggtcatcttgttcatctggggacgattccgtgttttcgcccgatcctatgccgtatgagccttgtctgcctcaatatcctcacataaatgggtccgtgaaaacatag

SEQ ID NO: 187853 - DNA, 1515 bp, Artificial Sequence
  Description of Artificial Sequence: Synthetic coding sequence
atgacccccagccccctgctgctgctgctgctgccccccctgctgctgggcgctttcccccccgcagctgcagcccgggggcctccaaagatggccgacaaggtcgtgccacggcaggttgctcggcttgggcggaccgtcaggctgcaatgtcctgtggagggggaccccccaccacttacgatgtggacaaaagacggccggaccatccacagtggctggagccgctttagggtgctgccacaggggttgaaagtgaagcaagtggaaagggaggacgctggcgtgtatgtgtgcaaagccaccaatggatttggttctttgtctgtgaactacacgcttgtagttctggacgacatctcccccggtaaggagagccttggccctgacagttcctctggagggcaagaggatcccgccagccagcaatgggctcgccccaggtttactcagcctagcaagatgcgcaggagggtgatcgctcgtcctgtgggttcatctgttcgtttgaagtgcgtggcatccggacatccaagacccgatatcacctggatgaaggacgaccaagccctcaccagacccgaggctgctgagcctaggaaaaagaaatggacactgagtctgaaaaatcttcggcctgaagactctggtaagtacacttgccgggtgtccaatcgtgcaggagccataaatgccacttacaaagtggatgtcatacagaggactagaagcaaaccggtgcttacaggaacacaccctgttaacaccactgtagacttcggcggcacgacctccttccagtgtaaggttcggagtgacgttaagcccgtgatccagtggttgaaaagggtggagtacggggctgaggggcggcataactcgaccatcgacgtggggggacaaaaatttgtcgtactcccaactggcgatgtgtggtcaaggccggacggatcctacctgaacaagcttcttatcacgcgagcgcgccaggacgatgcaggcatgtacatatgtctcggggccaacacaatgggctactctttccggagtgcgtttttgaccgtgttacctgaccccaaaccacccggacctcctgtggccagtagctcttccgcaacttcacttccatggccagtcgttataggtatccccgccggggcggtcttcatcctcgggactctgctactgtggctctgccaggctcaaaaaaagccttgcacccctgcacccgcaccacccttgccaggccaccgcccaccaggcacagcccgggatagatccggtgataaggacttaccatccctagcagcgcttagtgcgggtcctggggttggactatgcgaggaacacggctcacccgcagcccctcagcacttgctagggcctggaccggtagctgggcctaagctctatcccaagctgtatacagatatacacacacacacacatacccacagccacacacactcacacgtggaaggaaaggtacaccaacacattcactatcaatgctag

SEQ ID NO: 187854 - DNA, 1515 bp, Artificial Sequence
  Description of Artificial Sequence: Synthetic coding sequence
atgacccccagccccctgctgctgctgctgctgccccccctgctgctaggggctttcccacctgcggctgcagctagaggtcctcctaagatggctgacaaagttgttcccaggcaggtagccagattgggaagaacagtgcgtctgcagtgtccagtggagggcgaccctcctccacttacaatgtggacaaaggacggaaggacgatccacagtggctggagccgtttcagagtcctaccccagggactaaaggttaaacaggtggaaagggaggacgcgggcgtctatgtttgtaaagctacgaatggcttcgggtccctgtccgttaattacacactcgtggtgttggatgatattagccccggtaaggagagcctgggacctgacagctcgtcggggggacaggaggatcctgccagtcaacagtgggctagacctagatttacacagcccagcaaaatgcggcgcagggtaatcgcgagaccggtggggtcatccgtccgactcaaatgcgtcgccagcgggcatccaagaccagacataacatggatgaaagacgaccaagcgcttaccagacccgaggctgcagagccccgcaaaaagaaatggacgctcagcctgaaaaaccttcggcccgaggactctggtaaatacacatgtcgcgttagcaatcgcgctggcgcaataaatgcaacatacaaggtggacgtgatccagaggacccggagtaaacccgtcctcaccggcactcatccggtcaataccacagtggattttggggggactacctcttttcagtgcaaggtgcgatccgacgttaagccagtaattcagtggctgaaacgtgttgagtacggagctgaaggccgccataactctacgatcgacgttggcggccagaagtttgtggtgttgccgaccggagatgtgtggagtaggcctgacggtagctacctgaacaaacttcttataaccagggcgcgacaggacgacgccggaatgtatatttgcctcggggcgaacaccatgggttactcattcaggtcagcatttcttacggtgctgcccgatcctaaacctcctggtcctcctgtggcttctagctccagcgccaccagtctgccttggcctgttgtgattggaattcccgctggcgccgtattcatcctcgggacgcttctgctgtggctctgccaggcacagaagaaaccatgcacccctgcacccgctccgccgcttcctggacaccgccctcccggaaccgcccgagaccggtcaggtgataaggatctgccatcattggccgccttgtcagcgggccctggcgtaggactgtgtgaggagcatggatcccccgctgccccacagcacctcttggggcctgggcctgtcgctgggccaaaactctaccccaagctgtacacggacattcacacacacacacacactcattcccacacacattcacacgtggagggcaaagtgcaccagcatattcattaccagtgctag

SEQ ID NO: 187855 - DNA, 1515 bp, Artificial Sequence
  Description of Artificial Sequence: Synthetic coding sequence
atgacccccagccccctgctgctgctgctgctgccccccctgctgcttggcgcctttcctccagctgccgctgccagagggccgccgaagatggctgacaaggtggtgccacggcaggtcgcccggctgggacgaactgtacgcttgcagtgtccagtggagggggatccccctcctttaacaatgtggacaaaggatgggcgaactattcactccggctggtcacgctttcgagtgctacctcaagggctgaaggtgaaacaggtggagagggaggatgcaggagtgtatgtatgcaaggcgaccaatggctttgggtccctcagtgtcaattacacactggttgtgctcgacgacatctcgccaggcaaggaaagcctggggcctgacagcagcagcggcggccaagaagacccagcgtcacagcagtgggctaggccacgtttcacccaaccaagcaagatgcgtcgccgggtgattgcacgccctgtgggcagctctgttagattaaagtgcgtggcctctgggcacccccggcccgatatcacatggatgaaggatgaccaggccttaacccggccagaggctgccgagccccgaaaaaaaaaatggactctgtctctaaaaaatctacgacccgaggatagcggcaagtatacgtgcagggtgtccaatagggcgggcgctattaatgctacatataaagtcgatgtcatccagcgtaccagatccaaacccgttctcacaggcacccatcccgttaataccaccgtagactttggcggcactacttcctttcaatgtaaggtgcgttccgatgtgaagcccgttatacagtggctgaagcgcgtggagtatggcgctgaaggccgacacaatagcaccatcgacgtgggagggcagaaattcgtggtgttgccaacaggtgacgtctggtcgcggcctgacggatcatacttaaacaagctcctgattaccagagcaaggcaggatgatgccggcatgtacatttgtctgggggctaatacgatgggctacagcttccggtccgccttcctgaccgttttgcctgatccgaagcctccaggccccccggtcgcctctagcagctcggctacatctttgccctggcccgtcgtcatcggaatcccagccggagcggtcttcattctcggtaccctcctactgtggctatgtcaagcccagaaaaagccttgtacccctgcacccgcaccacccttgcccggacaccgcccaccggggacagcccgagatagatcaggggacaaggacttaccgtccctggccgccttaagcgcgggaccgggggtgggactgtgcgaagaacacggttcgccagctgctccacagcacctactcggaccaggcccagtggcggggccaaaactgtatcctaaactttatactgacattcacactcatactcatactcattcgcacactcattcccacgtggaggggaaagtgcaccagcacattcactatcagtgctag

SEQ ID NO: 187856 - DNA, 459 bp, Artificial Sequence
  Description of Artificial Sequence: Synthetic coding sequence
atgacccccagccccctgctgctgctgctgctgccccccctgctgctgggggcttttccccccgccgcagccgctcggggcccccccaaaatggccgataaagttgtaccccggcaggtcgcccgtcttggcaggaccgtaaggttacaatgcccagtggagggggacccaccgccattgacaatgtggaccaaggatgggcggactatccactccgggtggtctcggttcagggtccttcctcagggcctgaaggttaagcaggtcgaaagggaggatgccggagtgtatgtctgtaaggctactaacgggttcgggtctctttctgtaaattacactttggtggtgctagatgatatctcacccgggaaagagtctttgggcccggactcaagcagcggcggccaggaagaccccgcttctcagcaatgggcccgccctcggttcacccagccttag

SEQ ID NO: 187857 - DNA, 1515 bp, Artificial Sequence
  Description of Artificial Sequence: Synthetic coding sequence
atgacccccagccccctgctgctgctgctgctgccccccctgctgttaggagcgttccctccagctgcagcagctcggggaccgcccaagatggccgacaaggttgtaccacgtcaagtcgctcgacttggtaggactgttcggttacagtgcccagtggaaggggaccctccccctctgactatgtggacaaaggatggccgaactattcatagtggttggtcacgctttagggtcctccctcaaggcttaaaagtaaaacaggtcgagagggaagacgccggcgtgtacgtgtgtaaggccacgaacggcttcgggtctttgtctgtgaattacaccttggtggttcttgatgacattagcccgggcaaggagagtctgggacctgattcatcctccggaggccaggaggatcccgcatcgcaacaatgggcccgaccacggttcactcagccttccaaaatgaggagacgagtgatcgcacggcccgtcgggagctcggtacgtcttaagtgcgtcgcctctggtcatcctcggcctgacataacttggatgaaagacgatcaggcccttaccagaccagaggccgccgaaccacggaagaagaagtggacgctctctcttaagaatctgcggcccgaggatagtggcaagtatacttgtagagtaagtaacagggcaggcgcaattaatgcaacttacaaagtcgatgtcattcagcgcacaagatctaagccagtgctgacaggcacccaccctgttaatactactgtcgatttcggcggcacgacctcttttcaatgcaaagtgaggtctgatgtgaaaccagtgatacaatggcttaagagagtagagtatggtgccgagggcagacacaacagcacaatagatgtcggaggacagaaattcgttgtgctcccaacgggcgacgtctggtctaggcctgatggctcatatctgaacaaactgctaattaccagggccaggcaggatgatgccggtatgtacatttgtttaggcgctaacaccatgggctattcattcagatctgccttcctgaccgtcctgcctgaccctaagccccccggtccacctgttgcttcgagcagcagcgcaacctctctcccctggccagtggtcatagggattccagcaggagccgtgttcatcctaggcaccctgctgctgtggctctgtcaggcccagaaaaaaccatgtacgccagcgcctgcccctcccctccctgggcataggccgccagggacagcccgcgatcgcagtggagacaaggatctaccttctctggcagccttatctgctggccctggagtgggcctgtgtgaggagcatggctcccccgctgccccacaacacctcctgggccccgggccagtggccggtcccaagctgtaccctaagctttatacagatatccatactcacacacacacacactctcacactcacagccacgttgagggcaaagttcatcagcatattcactaccagtgctag

SEQ ID NO: 187858 - DNA, 243 bp, Artificial Sequence
  Description of Artificial Sequence: Synthetic coding sequence
atgacccccagccccctgctgctgctgctgctgccccccctgctgctgggcgcctttccaccagcagcggccgccaggggccccccaaaaatggccgacaaggtagtgcctagacaggtggcgaggctaggcaggacagtgagattgcagtgccccgtggagggagatccgcccccacttaccatgtggactaaagatggtagaaccatccattccggctggtccaggtttcgtgtgctgtag

SEQ ID NO: 187859 - DNA, 1326 bp, Artificial Sequence
  Description of Artificial Sequence: Synthetic coding sequence
atggccgacaaggtggtgccccggcaggtggcccggctgggccggaccgtgagactccaatgcccagtagagggagatcccccaccactgacaatgtggacaaaggacgggagaacgatccattctggttggtctaggttcagggtcctcccccaaggcctaaaggtgaagcaggtggagagagaagatgcaggcgtgtacgtttgcaaagccacaaacggatttggctccttatccgtcaattacactctggttgtgctggatgatatcagcccagggaaggagtctctgggaccggattctagctcagggggccaggaggatccggcctcgcagcagtgggcccgccctcggttcacccagcccagtaagatgcggcgacgagtaattgcaagacccgtgggctcctctgtacgcttgaagtgtgttgcttctggccatccacggcccgacataacctggatgaaggatgaccaggcccttaccagacctgaagccgcagagcccagaaaaaagaagtggaccctctccctcaagaacctacggccagaggacagcgggaagtacacgtgtagagtgagtaacagggcgggggccattaatgccacctacaaagtggatgtgatacagcgcactaggagcaagcctgtcctcaccggcacccacccggtgaataccaccgtcgacttcgggggaacgacatctttccagtgtaaagtacgatccgatgtcaagccagtgatacagtggctgaagcgcgtggagtacggcgcggaaggcagacataactccacaatcgacgttgggggacagaaatttgtcgttttgccaaccggagacgtctggtcccgcccagacggaagttacctcaataagcttctaattactagagccagacaagatgatgcaggtatgtatatttgcctgggggctaatacaatgggctactcatttagatccgcttttttgacagtgttgcctgacccaaagccgcctgggcctccagtcgccagttcttcaagcgccaccagcctgccctggcctgtggttattggcattcccgcaggggctgtgtttatcctcggtacactgcttttgtggctctgtcaggctcagaaaaagccttgcacacctgcgcccgccccaccactcccaggccaccggccccccggcactgcaagggatcgctcaggcgacaaggatttaccgtcacttgcagccctgagtgcaggtcccggagtgggtttgtgcgaagagcacggctcaccggcagctccacagcaccccaccgtagtggtagctccagatttgtgcaatttcatgtag

SEQ ID NO: 187860 - DNA, 1131 bp, Artificial Sequence
  Description of Artificial Sequence: Synthetic coding sequence
atgcagtggaccagcctgctgctgctggccggcctgttcagcctgagtcaggcacagtatgaagacgatccccactggtggtttcactatctgcgaagtcagcagtcgacttattatgatccttacgatccgtacccatacgagacgtatgagccgtacccatacggagttgatgagggcccagcctacacttacggaagtccctctcctcccgatcctcgggattgtccacaagagtgtgactgtccgccaaacttccctaccgccatgtattgcgataacagaaatttgaaatacctccctttcgtcccttcaaggatgaagtacgtgtatttccaaaataatcagataactagcatccaggagggggtgtttgacaatgccacagggctgctgtggatcgctctgcacggtaaccagatcaccagtgacaaggtcggtcggaaagtgtttagcaagttgagacacctcgaacggctgtatctcgaccacaacaatcttaccagaatgcccggaccactccctcgctcgctccgggaacttcacctggaccacaatcaaatttctcgcgtgcccaacaacgccctggaaggcctggagaatctgactgcactatatctgcagcataacgaaatccaagaggtgggctcctcgatgagagggctacgatccttgatcctgctggacctgtcgtataaccacctgcgcaaagtgcccgacggattacccagcgcccttgaacagttgtacatggagcacaataatgtgtacacagtcccagactcctattttcggggggctcctaagctgctgtacgtcaggctctcccataactcattaaccaacaatggcctcgcctccaatactttcaattccagcagtctgctggagcttgatctgtcctacaaccagttgcagaagataccaccggtgaataccaacctggagaacctctacctacaaggcaacagaatcaatgagttcagcatttcctctttctgtacagtggtcgatgttgtgaattttagtaaactccaagtcctccgcctggacgggaacgaaattaaaagatccgccatgccagccgacgcccccttatgcctgaggcttgcatccctgatcgaaatttag

SEQ ID NO: 187861 - DNA, 1092 bp, Artificial Sequence
  Description of Artificial Sequence: Synthetic coding sequence
atgcagtggaccagcctgctgctgctggccggcctgttcagcctgtcccaggcccagtatgaggatgacccccattggtggttccattatttaagatcgcagcaatccacctattacgatccttacgatccatacccctacgaaacctatgagccatacccctacggggtcgatgagggccccgcttatacctacggaagtccctcaccacccgatcctagagactgcccccaggaatgtgactgccctccaaacttcccaccttttgtgccatcccggatgaagtacgtgtatttccaaaacaaccaaatcacatctattcaagaaggcgtgttcgacaacgcgaccggcctcctgtggatagctctgcacgggaaccagatcacgtctgataaagtgggaaggaaggttttctccaagcttcgccatttagaacgtctgtaccttgatcacaataacttgacaaggatgccgggccctctgccacgctccttgcgcgagcttcatctggaccacaaccaaatcagcagggtacccaacaatgccttggagggtctggaaaacttaactgcgttgtacctacagcataacgaaattcaggaggtaggttcaagcatgcggggcttacgaagtctgattttactcgaccttagctataaccatctgaggaaagttccggacggtttaccctccgcactcgagcagttgtatatggaacataataacgtgtacacggtgcccgactcctactttcggggcgctcccaaactgctatatgtccgactgagccataatagcttgactaataacggcctcgcgtcaaacacgtttaactccagctccctgctagaattagacctttcttataaccagctgcagaagatcccaccagtgaataccaacctagagaacctgtacctgcagggaaaccgtattaatgagttcagcatcagcagcttttgtaccgtggtggatgtcgtgaacttttcgaaactgcaagtgctgaggctcgatgggaatgagattaagcggagtgccatgccggcagatgccccactttgtctcagattagcctcattgatcgagatttag

SEQ ID NO: 187862 - DNA, 594 bp, Artificial Sequence
  Description of Artificial Sequence: Synthetic coding sequence
atgaagatgaccctgatcggcggcagcaccaccagcgccgccagctctccccccaccactattccgatgacattgacacggatgcggcccaccagtctaacgcccatggggtggatgaagggtcagcccacaccaactgccctgcatcctctacagatccctgctacagcaccaaggagcgctactgcgcatcctacctctacagcaatgtactgcgacaataggaacttaaaatacctgccattcgttcccagccgaatgaaatatgtgtacttccaaaataatcagattactagtattcaggagggagttttcgacaacgctactggcctgctgtggatcgctctgcatgggaatcagatcacctccgacaaggtgggtcggaaagtcttctccaaattgagacacttagagagactctacctggaccataataatctgacccgcatgcccggacccttgccaagatccctgcgcgagctgcatttggaccacaatcagatttcacgcgtcccaaacaacgcgctggagggccgtacaagccggccatgcacctccaatactatgagaagtaggaagtgggctgtcccctag

SEQ ID NO: 187863 - DNA, 2025 bp, Artificial Sequence
  Description of Artificial Sequence: Synthetic coding sequence
atggtggtggcccaccccaccgccaccgccaccaccacccccaccgccaccgtaactgccaccgtcgtgatgaccacagctacaatggatttacgcgattggctgtttttgtgctacggacttatcgccttcctcaccgaagtcattgactccactacatgtccttctgtatgcaggtgcgacaacggatttatttattgtaacgaccggggactgacgagcattcccgcagatatccccgatgatgccaccaccctatatctgcagaacaaccaaatcaacaatgctggaatacctcaggatcttaagacgaaggtcaacgtacaggtgatttacctgtatgagaatgatctggacgaattcccaattaacctgccaagatcactgagggagctacacttgcaagataacaatgtgcgaaccatcgcgcgcgatagtctggcaaggatcccactcctggagaagttgcacctcgatgataattctgtgtccaccgtctcaattgaagaggatgccttcgctgactctaagcagctgaagctattgttcttgtccaggaatcacctaagctctattccttctggactgccgcacaccctggaggaattaaggctggatgacaacaggatttctactattcctctccacgccttcaaggggcttaattccctaagaagactggtcctagatggaaatttactggctaaccagaggatcgccgatgataccttctcccgacttcaaaacctgacagaactaagcctggtcaggaatagtctagccgctccaccactgaatttgcccagtgcccatctgcagaagctgtatttacaagacaacgccatttcacacatcccgtacaatactctcgctaagatgcgtgaacttgagcgactggatctgtcaaataataacctgaccactttaccccgcggcctcttcgacgacctgggaaatttggcccagttgttgctgaggaacaatccctggttctgcgggtgtaacctgatgtggctgagggattgggtgaaagctcgggcagccgtcgttaacgtgagggggctcatgtgccaggggcctgagaaggtgcgagggatggccataaaagatattacatctgaaatggatgagtgtttcgagacaggcccccagggcggtgtcgcaaacgcagcagcaaagacaacagccagtaatcacgcctccgccaccaccccacaggggagtctgtttacccttaaggctaaaagaccagggctcagactgcccgacagcaatattgactaccctatggcaacaggagacggcgcaaagacattagcgattcatgtcaaggctctcacggcagacagtatacggatcacctggaaagctactctccctgcaagcagtttcagactcagttggcttagacttggccactcaccagcagtgggttcaatcacagaaaccctggtgcagggcgataagactgagtacctgttaacagcactggagccaaaatctacctacattatttgtatggtgacaatggaaacatctaatgcttatgttgccgatgagactcccgtctgcgcaaaggctgagaccgccgactcttacggacccactacaacgctcaaccaagaacagaacgccggccctatggcctctctgcccttggcaggaattatcggtggcgctgtggcgctggtgttcctgtttcttgtgcttggcgcaatttgctggtatgtacatcaggccggggagcttctgaccagagagcgggcgtataacagaggtagcagaaaaaaggatgattacatggaaagcggcaccaagaaagacaactcgatactcgagatacgaggacccggactccagatgctgcctattaatccatacagagctaaggaggagtacgtcgtgcacacaattttcccttcaaacggaagcagtctgtgcaaggcgacccatacgattggatatggtacgactagaggttatcgtgacggaggaatcccagatatcgactattcttacacctag

SEQ ID NO: 187864 - DNA, 1983 bp, Artificial Sequence
  Description of Artificial Sequence: Synthetic coding sequence
atgggcctgcagaccaccaagtggcccagccacggcgccttcttcctgaaatcatggcttataatcagtcttgggttgtattcccaggtatccaagctgttagcctgtccctccgtgtgtaggtgcgatcgtaacttcgtgtactgcaacgagagatctttgacatcagtaccactgggcatcccggaaggcgtgacggtgctctaccttcacaataaccagataaataatgctggcttcccggcagaactccacaacgtgcagtccgtgcatacggtttatctgtatggcaatcagctggatgagttcccaatgaatttgcctaaaaatgttagggtcctacacttgcaggagaacaacattcagactattagccgcgccgccttggcacagctcctgaaactggaggagctacatttagacgataacagcatcagtactgtgggcgtggaggacggcgcattccgggaagctatcagcctcaaactgctatttctttctaaaaaccacctgtctagcgttcccgttgggttgccagtagacctgcaagagctgagggtagatgaaaacagaatcgccgtgataagtgacatggccttccaaaacctcacttcactcgaaagattgatcgttgacggaaacctgctcaccaacaaggggatcgctgagggcactttcagtcacctgactaaactgaaagagttttccattgtgcggaactccctatctcatcctccccctgaccttcctggaacgcatctgattaggttatatctgcaggacaatcagatcaatcacattcctcttactgctttctcaaatcttagaaagcttgagcgactggatatctccaacaaccaattacggatgcttacccagggcgtatttgataacctttcaaatcttaaacaactcacagccaggaacaatccctggttttgcgattgttccattaaatgggtgaccgagtggctgaaatacattccatcttcccttaacgtacggggtttcatgtgtcaaggacctgaacaggtgcggggcatggcagttagggaactgaacatgaacctgctgtcctgcccgactacaaccccaggactcccccttttcacacccgccccatcaaccgcttctccgaccacccagccccccacgctcagcatcccgaaccccagcagaagctacaccccgccaaccccgacaacctctaaattaccaaccatccccgactgggacggccgggagagagttacccctcctataagcgagcggattcagttaagcattcattttgttaatgacacatccattcaggtgagttggctttcattatttaccgtcatggcatataagctgacatgggtgaagatgggccatagccttgttgggggaatagtccaggaaagaatcgtctcaggagagaagcagcacctgtcactggtaaatctggagcctcgatccacataccgaatctgcctggtacctttggatgcttttaattacagagccgtcgaggacacgatctgttctgaggccactacccacgcgtcatatctcaataatggtagcaataccgctagtagtcatgagcagaccacctctcactccatgggttcaccattcctgctggctggcctcattgggggggctgtgattttcgtcctggtggtcctgctgtccgtgttttgttggcatatgcacaaaaagggaaggtacacgtctcagaaatggaagtataatcgcggtagacggaaggacgattactgcgaggcaggtaccaaaaaagacaatagtattctggagatgacggaaactagctttcaaatagtgtcacttaataacgaccagcttcttaagggggacttcagactacagcctatctacacacccaatgggggcattaattacaccgactgtcacatcccgaataatatgcgctattgcaactcctccgtgcctgacctagaacattgtcatacgtag

SEQ ID NO: 187865 - DNA, 942 bp, Artificial Sequence
  Description of Artificial Sequence: Synthetic coding sequence
atggccgtgcgggagctgaacatgaacctgctgagctgccccaccaccacccctggcttacctttgttcacccctgcaccttccaccgcctccccaaccactcagcctccgaccttatcgatccctaacccgtctcgaagctacacaccacctacgccgacgacctcaaagctgcccacaatacccgattgggacggtagggagcgggtgacccccccaatctctgagagaatacagctaagcattcactttgtgaacgacaccagtatccaggtttcttggctaagcttgtttactgtgatggcgtacaaacttacgtgggtcaaaatggggcactcacttgtaggtggcattgttcaggaacgcatcgtgtctggcgaaaaacagcatctgtctttagttaatctcgagccacgctctacgtacaggatctgtctcgtgcctttggacgcctttaactatagagctgtggaggataccatttgctctgaagcaaccactcacgccagttatttgaataacggctctaacactgcatcctctcacgagcagactacttcccactcaatgggcagcccgttcttactggctgggcttattgggggtgccgtaattttcgtcctggtggttctcctcagcgtgttttgttggcacatgcataaaaaaggaagatacaccagtcagaagtggaaatacaaccgggggcgccggaaggatgactactgcgaggccggcaccaagaaagacaactctattctggaaatgaccgagactagctttcagatcgtgtcactaaacaatgaccagctcctgaagggtgactttagactgcaaccaatctacactcccaatgggggcatcaactatacggactgtcatattcctaacaatatgcgatattgcaattcgtcagtgcccgacctggagcattgtcacacatag

SEQ ID NO: 187866 - DNA, 1983 bp, Artificial Sequence
  Description of Artificial Sequence: Synthetic coding sequence
atgggcctgcagaccaccaagtggcccagccacggcgccttcttcctgaagtcctggctcattatatcattgggcttgtattcacaggtgtcgaaactgttggcctgcccctctgtttgccggtgcgacagaaacttcgtgtattgtaatgagaggtctctgacctccgtccccctgggcatcccagagggagtgaccgtgctgtacttgcacaacaaccaaataaacaacgccggttttccagctgagctgcacaatgttcagtctgtgcacactgtctatctctacggaaatcaattagatgagttccctatgaatctcccaaaaaacgttcgggtcctgcacctgcaagaaaataacatccagactatctctagggccgctcttgcccaactactcaaactagaagaactgcacctggatgacaacagcatttccaccgtaggggttgaggacggggcgtttcgcgaagctatttctctaaaactgctatttctctccaagaaccacttgagttcagttcccgtggggttacctgtggatcttcaggagcttcgcgtggacgagaacagaattgctgtcatctccgacatggcctttcaaaacctaacctctctggaaagactcatagtcgatgggaacctgctgacgaataaggggattgctgaaggcaccttctcgcacctgactaagctaaaggagttttccattgtgcggaactctctgagtcacccgccccctgaccttcctgggactcacctaatccgactttatctgcaggacaatcagattaatcacattccactgacggcattctctaatctgcgcaagcttgagcgactggacatatccaacaaccagttgaggatgctgacgcagggggttttcgacaacctgagcaacctgaagcagctgacggcccgaaacaatccatggttttgcgattgttcaatcaaatgggttacagagtggctgaaatacatccccagttcattgaacgtgagaggctttatgtgtcaaggcccagagcaggttagaggcatggccgttagggagctcaacatgaacttattgagctgccctaccacgacgccaggcctgcctttgttcaccccagcacccagcaccgccagcccaaccacacagccgcccacgctgtctattcccaatcctagcagaagctatacccctcctactcccacaactagtaagctcccaacaatccctgattgggatggacgagagagggttacccctcctattagtgaacgaatacagctgtccattcacttcgtcaacgatacaagtatccaggtctcttggttgtcgttatttaccgtgatggcatacaagctcacatgggtaaagatggggcatagcctggtcggcggcattgtgcaggaaaggatcgtgtccggcgagaagcagcatctcagtttggttaaccttgaaccacgatccacatacaggatttgcctggtgcctctagacgcgtttaactaccgcgctgtggaagatacaatctgtagtgaggccacaacacacgcttcctacttgaataatggttcaaacaccgcatcaagtcatgagcaaaccacctcccactcaatgggtagtccgttcttgctggccggactcatcggaggagccgttatctttgtgctggtggtcttgctcagcgtgttctgctggcacatgcacaaaaaggggcgctacacgtcacagaaatggaaatataaccggggccgaagaaaggacgactactgcgaggcagggacaaaaaaggataattcaatccttgaaatgactgagacttcttttcagattgtgagcctgaacaacgaccagctgctgaaaggggactttaggctgcagcccatatatacgcccaacgggggcatcaactacacagattgccacatcccgaataatatgcgttactgtaacagctcagttcctgacctggagcattgccatacatag

SEQ ID NO: 187867 - DNA, 1950 bp, Artificial Sequence
  Description of Artificial Sequence: Synthetic coding sequence
atgatcagcgccgcctggagcatcttcctgatcggcaccaagatcggcttgtttctccaggttgctcccttgtcggtcatggccaagagctgtcccagcgtatgccgctgtgacgctggcttcatttactgtaacgacaggtttctcacttccataccgactggcatccctgaagacgccaccacactgtacctccaaaataatcagataaataatgcaggcatacctagtgatcttaagaatctactcaaagtcgagcgaatctatctttatcataattctcttgatgagttccctacgaacttgcctaaatatgtcaaagagctacaccttcaagaaaacaacattcggaccattacctacgattctttatcaaagattccatacctggaagaattgcacctcgacgataatagcgttagcgccgttagcatagaggagggagcgtttcgggactcgaactatctgaggttgctatttctgagtcgaaaccaccttagcacaataccttggggcttgcctcgcacaatcgaggagctgcggctggatgacaatcgcatcagcacaatttctagtccatcacttcagggcttaacctctctgaagcggctcgtactggacgggaatcttctgaataaccacggccttggcgataaagtgtttttcaatcttgtgaatctcacagagctgagccttgtgcgaaactcactgacggcggcgcccgtaaaccttcccggcactaacctgcgaaaattgtatctacaggacaaccacatcaacagggtcccaccaaacgccttctcctacctgagacagttataccgcctcgatatgtctaataataatttgtccaacttgcctcagggtatttttgatgaccttgacaatatcactcaactgatcctgaggaacaacccctggtattgcggatgcaagatgaagtgggtcagggactggctacaatctctgccggtgaaagtaaacgttagaggtctcatgtgccaggcgcccgagaaggtaagaggtatggctattaaggatcttaacgccgaactctttgattgtaaggattccggtatcgtaagcactatacagatcaccactgcaatccccaacacagtgtatccagctcagggacagtggccagcgcctgtgaccaaacagcccgacatcaagaacccaaagctgacaaaggaccaccagactaccggctcacccagtaggaagacgatcacaataactgtcaagtcagtgaccagcgatacaattcatataagctggaagctcgcattgccgatgacagcgttgagattaagctggctgaagttgggtcattcacctgcttttggctccattactgaaaccatcgtcacgggagagagatcagagtatctggttacagcgctggagccggactctccttacaaagtgtgcatggtgcccatggaaacatcaaatctgtacctttttgacgagactccggtgtgtatcgagaccgagactgctcctctgcggatgtacaatcccaccaccaccctcaaccgggagcaggaaaaggagccatacaagaatcctaatcttcccctggccgctattattggaggagcagtggccctagtgactatcgcactgttggcattggtctgttggtacgtacacaggaatggttctcttttctccagaaactgcgcatattcaaaggggaggaggagaaaagatgattatgcggaggctggcactaagaaagataactccattctcgagatcagggaaactagtttccagatgctgcctatcagcaacgagcccataagtaaagaagaatttgttattcacaccatttttcctccgaatgggatgaacctgtataagaataaccatagcgaatcaagttctaaccgctcttatcgagactctggcatcccagactcagatcattcccactcatag

SEQ ID NO: 187868 - DNA, 1950 bp, Artificial Sequence
  Description of Artificial Sequence: Synthetic coding sequence
atgatcagcgccgcctggagcatcttcctgatcggcaccaagatcggcctcttcctgcaggttgctccactgtctgttatggccaagtcctgtccctctgtttgtcgctgcgacgcggggttcatctattgtaacgacaggttcctcactagcataccaaccggcattccagaggacgccacgacactttatttgcagaataaccaaattaataatgccggtatacccagcgatctgaaaaatctgctgaaagtggaacgaatttacctgtatcacaattcattggacgaattccccaccaaccttcccaagtatgtcaaggagctgcacctccaggagaacaatataagaactattacatacgattcattgagcaaaatcccctatctggaggagttgcatctggacgataactcagtgagcgctgttagtattgaggaaggggcttttcgcgacagcaactatctcaggcttctgttcctgtcccggaatcacctgtctactatcccatggggcctccctcgaaccatagaagagctgaggctcgacgacaaccgtatttcaactatttccagtcctagcctccaaggacttactagtttgaagaggctggtgttagatggcaacctccttaacaaccatggcttgggagacaaagtgttttttaatttggtaaatctgaccgagctgtctctggttagaaactcactgacagcggctcccgtgaatctacctggcaccaatctaaggaagctgtatctgcaagataaccatattaatagagtgccaccgaatgctttttcatacttacgccagttgtaccgcttagatatgtctaataataatctctccaacctcccccagggaatcttcgacgacctggacaacattacccaactgatccttcgtaataacccatggtactgtggctgcaaaatgaaatgggttcgtgactggctccagtcgctgccagtgaaagttaacgttagggggttgatgtgtcaagctccagagaaggtaaggggaatggccatcaaagatctgaatgctgaactgtttgactgcaaggattcaggtatcgtgtctactattcaaattaccactgccattcccaacaccgtgtaccccgcacaagggcagtggccggcaccggtgacaaaacaacccgatatcaagaaccccaaacttaccaaagaccaccagaccaccggctccccaagtcgaaagactatcactattacagtgaagagtgtgacaagcgacacaatccacatctcctggaagctcgcccttcctatgactgccttgcggttgtcatggctcaagctgggacattcccccgcatttggctccattacagaaacaatcgtgaccggagagcggtcagagtaccttgtcaccgccctggaacccgattccccatataaggtgtgtatggtgccaatggagacatctaacctttatctgtttgacgagactccagtctgtatcgagacggaaactgcaccactgcgcatgtacaatcccaccaccacgcttaatcgcgagcaggagaaggaaccttataagaaccctaacctgcccctggccgccattatcggtggtgcagttgctcttgtgacgatagcgctgctcgctttagtatgctggtatgtgcaccggaacggaagcctgttctccaggaactgcgcatatagcaaaggacgccgacgcaaagacgactatgccgaagccggaaccaagaaagacaattctatcttggagatccgggagacctctttccagatgcttcctataagtaacgaacccatcagtaaggaagagttcgtaattcacacaattttcccgccaaatggtatgaatctttataaaaataaccattctgagtctagctcaaacaggtcttacagagactcagggatacctgactccgatcacagccattcctag

SEQ ID NO: 187869 - DNA, 1884 bp, Artificial Sequence
  Description of Artificial Sequence: Synthetic coding sequence
atgatcagcgccgcctggagcatcttcctgatcggcaccaagatcggcctgtttctgcaggtagcaccgctaagcgtgatggccaagtcctgtccttcagtgtgtagatgcgacgcaggcttcatctactgtaatgacagattcctaacatccatccccactggaattccggaggacgctactacgctctatcttcagaataatcagattaacaacgctggaatcccatccgatttgaagaatctgctcaaggtggagaggatttatctgtatcacaactctctggacgagtttccaacaaaccttccaaagtacgtcaaagagctccacctgcaggaaaacaacatacgtaccatcacgtacgactccctgtccaaaatcccatatcttgaagaactgcatttagatgataatagtgtttctgctgtcagcatagaagaaggcgccttcagagactcaaattaccttcgcctcttgtttctttcacgcaaccacctcagcacaattccctggggcctgcccagaaccatcgaggaactcaggctggatgataatcgcatttccacaatctccagcccatctctccagggactcacttccctcaaacgcctcgtcctggacggaaacttgctgaataaccacgggctgggcgataaagtattctttaatctcgtgaatttgactgagcttagcctcgtgagaaattcattgaccgccgcgcccgtgaacttaccagggactaacctgcggaagttgtacctccaggacaatcacatcaatcgcgtgccacccaacgccttttcgtatcttaggcaattgtaccggctagacatgtccaataacaacctgtcaaatctgccgcagggtatcttcgatgaccttgataacatcacacagctgattttaaggaacaacccgtggtattgcggatgcaaaatgaaatgggtgcgggactggctgcagtccctcccagtcaaggtcaatgtccgtggcctgatgtgccaggcccctgagaaggtgagaggcatggcaatcaaagaccttaacgctgaactgtttgattgcaaagacagcggcattgttagtacgattcagatcaccaccgccatcccaaatactgtctatccggcacagggccagtggccagcacctgtgacaaaacaacccgatattaagaaccccaaactcactaaggaccatcagacaaccgggtcacctagccgcaagaccattactatcaccgtgaagagcgtgacaagtgataccatacatatcagttggaaacttgctctgcccatgacagctctacgcctgagctggttgaaactaggccattctcccgctttcggcagcattaccgaaactatagtaaccggagaacgctccgagtatttagttaccgccctggagcccgacagtccgtacaaggtgtgcatggttccaatggagactagtaacctttatttgtttgacgaaactcccgtgtgcattgagactgaaacagcccctctcagaatgtacaaccccacaacaactctgaatagagaacaggaaaaggaaccctataagaatccaaacttacccctcgcggctataattgggggggccgtcgcactggtgactatcgcactgcttgccctggtctgctggtacgtccatcgcaacgggagcttgttttctagaaactgcgcttactccaagggacgccggaggaaagatgactatgcagaagcaggcaccaagaaggataattccattttggagatcagagagacaagtttccaaatgcttccaatttccaacgaaccgatctcaaaggaggagttcgtcatccacaccatattccctcctaacggtatgaacctctataaacagtcccagtag

SEQ ID NO: 187870 - DNA, 402 bp, Artificial Sequence
  Description of Artificial Sequence: Synthetic coding sequence
atgccccccagcaagccccacccccccgtggtgggcaaggtgacccaccacagcatagaactgtactgggatcttgaaaagaaggctaagagacagggaccacaggagcagtggttccggttttcaattgaggaggaggacccgaagatgcatacgtacggcatcatctacacaggatacgctactaaacacgtggtcgaggggctcgagccccgtactttatacaggtttaggctaaaggtgacctccccttcaggcgagtgcgagtatagtccactggtgtctgtttccaccacgagtagcatctggctgggaggggagccaatttcctcggaacatctccatcgggctgtctctgtgaatgatgaagatttactggtgcggatcttgcaaggcggctag

SEQ ID NO: 187871 - DNA, 849 bp, Artificial Sequence
  Description of Artificial Sequence: Synthetic coding sequence
atgccccccagcaagccccacccccccgtggtgggcaaggtgacccatcactcaatcgaactgtattgggacctcgagaaaaaagccaagcgacaaggcccccaagagcaatggttccgttttagtatcgaggaggaggaccccaagatgcatacatacggcatcatctacactgggtatgctaccaagcacgttgttgagggcttggaaccaagaactctgtacaggttccgtctcaaggttacttccccaagcggtgaatgcgagtatagccctctggtttcagtcagtacaacctctagcatctggcttggcggggaaccgatttcttcagagcatttgcaccgggccgtgtccgtgaacgacgaagatttgttagtgagaatactgcagggtgggcgggtgaaggtcgacgtacccaacaaattcggattcaccgccctcatggttgcagcccagaagggatacacaagtttgatgctggcgtgctacgccggccacctggatgttgtaaagtacttacgcagacacggtgcctcctggcaagcacgagatttggggggctgcaccgccctgcactgggccgcagacggggggcactgttctgtgatcgagtggatgattaaggatggttgtgaggtagacgttgttgacaccgggagcggctggacccccttaatgcgggtatcggccgtgagcggcaaccagagagtcgcttcattgctcatcgacgccggcgcaaacgttaatgtgaaagaccggaacggaaaaacccctctgatgtcggtggtcagcttgttggaagagagaaaaaagaagcagcggccaaaaaaatcttgtgtatgctag

SEQ ID NO: 187872 - DNA, 1116 bp, Artificial Sequence
  Description of Artificial Sequence: Synthetic coding sequence
ctgcagaagcagaagatcatgccccccagcaagccccacccccccgtggtcggcaaggtcacacatcactctatcgagctgtactgggacctggagaagaaggccaaaagacagggcccgcaggaacagtggtttagattctccatcgaggaggaagaccccaagatgcatacctacggcattatatatacaggctatgctacgaaacacgttgtcgaaggcctggaacccagaaccctgtataggtttcggttgaaggtgactagccccagcggcgagtgcgaatacagccccttagtgagtgtcagcaccacaagacctagcctgtccaaatcactggtgaagattagaatggtgaccagcgtgctgcacgggccccctaccgagaataccggagaacccatttcttcggagcatctacatcgggcagtaagcgttaacgacgaggacttgctcgttcggatcctgcagggtgggagagtgaaggtggatgttcccaataaatttggattcaccgcgcttatggttgcagcgcagaaaggctacacacgtctcgttaagattcttgtcagcaacgggacagacgttaaccttaagaatggctccggtaaggactccttaatgctcgcctgttacgctgggcacttggacgtggtgaaatatctaagacgccacggagcttcttggcaggccagagacctgggaggctgtactgccttacattgggccgctgatggcgggcactgcagtgtaatcgagtggatgatcaaggatggctgcgaagtggacgtggtcgataccggtagtggctggactccgctgatgagagtgagcgctgtttctgggaatcagcgagtggcctcgctgctgattgacgcaggggccaacgtcaacgttaaagatcgcaatggcaaaacccccctgatggtcgcagtcttgaataaccacgaggagctggtccagctactgttggacaagggtgccgacgcatccgtaaagaatgaatttggcaagggcgtgctggagatggccagggtgtttgatagacagtcagtcgtgagcttgttagaagaacgcaagaaaaaacaacgaccaaaaaagtcatgtgtatgttag

SEQ ID NO: 187873 - DNA, 1038 bp, Artificial Sequence
  Description of Artificial Sequence: Synthetic coding sequence
atggagccccagaagatcatgccccccagcaagccccacccccccgttgtgggcaaggtcacccatcactccatcgaactgtactgggacctcgaaaaaaaagctaaaagacagggcccacaggagcaatggtttcgttttagtatcgaggaagaggacccaaaaatgcacacatacggcattatctacactggctacgccacaaaacatgttgtagaaggcttggagccacgcactctttatcgattccggctcaaagtcacctcaccgtccggagaatgtgaatattcccctctcgtgtcagtgagcacaactagggaacctatatcctcagagcatctccaccgtgctgtgagcgttaatgacgaagacctgctggtgcgaattctgcagggaggtagggtaaaggtggatgtcccaaacaaattcgggtttaccgcactgatggtggccgcgcagaaaggctatactaggttagtgaaaatacttgtttcaaatgggacagatgtcaacttgaaaaacggcagcgggaaagacagcttgatgctggcatgctatgcgggtcatttagatgttgtgaagtacctgcggagacacggtgcttcgtggcaggctagagacttgggtggttgcaccgcccttcattgggccgcagatggtggccactgctctgtcatagaatggatgattaaggatggatgcgaggtagatgtcgtggacacaggttcgggatggacccctttgatgcgtgtgtcagcagtgagtggcaatcagcgtgttgcatcactgctcatcgacgcaggtgccaacgtgaacgttaaagaccgcaatggcaaaacacctctgatggtcgctgtactcaacaaccacgaggaattggtgcagctgctgcttgataagggcgccgacgctagcgttaaaaacgagtttggtaagggagttctagagatggccagagtgttcgacagacagagtgtcgtaagtcttttggaggagcgaaagaagaagcagaggccaaagaagtcttgcgtctgctag

SEQ ID NO: 187874 - DNA, 1020 bp, Artificial Sequence
  Description of Artificial Sequence: Synthetic coding sequence
atgccccccagcaagccccacccccccgtggtgggcaaggtgacccatcactccatcgagctgtactgggacctagagaaaaaggccaaacggcagggccctcaagaacagtggttcagattctcaatcgaggaggaggaccctaaaatgcacacctatggcatcatctacaccggatacgctacaaagcacgtcgtcgaaggccttgaaccaagaacactctataggtttagactgaaagttaccagccctagtggcgagtgtgagtatagccccctggtgagcgtgagtaccacccgcgaacccatttcatccgaacacctgcaccgtgcagtttcagtaaacgatgaggatctgctggtgcggatcttgcagggagggcgagtaaaggtcgatgtccctaataagttcggttttactgctttgatggtcgctgctcaaaaaggatacaccagacttgtcaaaatactggtaagcaatggaaccgatgtgaacctgaagaacggctccggcaaggactctttgatgctggcttgttacgctggacacctcgacgtcgtgaaatatcttcgacggcacggggccagctggcaggcgagagacttgggtggatgtaccgccctgcactgggctgccgacggcggtcattgcagcgtcattgagtggatgatcaaggacggttgcgaggtcgacgtagtcgacaccggcagtgggtggacaccactgatgagggtatccgctgtgagtggaaaccagagagtggcctcactcctgatcgatgctggcgctaatgttaacgttaaagataggaacggcaagaccccgctcatggtggctgtactgaacaatcacgaggagctggtccagctgttgctggataaaggcgcggacgctagcgttaaaaacgagtttggcaaaggggtactggaaatggcccgggtgtttgatcgacagtcagttgtcagcctcctggaggaaaggaagaagaaacagcgcccgaaaaagtcctgcgtgtgttag

SEQ ID NO: 187875 - DNA, 375 bp, Artificial Sequence
  Description of Artificial Sequence: Synthetic coding sequence
atgccccccagcaagccccacccccccgtggtgggcaaggtgacccatcatagtattgagttgtactgggacttggagaagaaggctaagcgccaggggccccaggaacagtggtttcgcttttccatcgaggaggaggatccaaaaatgcacacgtacggcataatatataccggatacgctactaaacacgtcgtcgagggactcgaaccacggactctttaccggtttaggctgaaggttacatcgccttctggcgagtgtgaatatagcccattagtgtccgtcagtacgaccagagaacctatctcgtccgagcatctgcacagggctgtctcagtgaacgatgaggacctgctggtacgtatcctctag

SEQ ID NO: 187876 - DNA, 402 bp, Artificial Sequence
  Description of Artificial Sequence: Synthetic coding sequence
atgccccccagcaagccccacccccccgtggtgggcaaggtgacccatcacagtatcgagttatattgggatctagagaaaaaagccaagcgccaggggcctcaggaacagtggttccgtttctcgatcgaagaagaggatcccaagatgcacacctatggcattatctacaccggatacgccaccaagcatgtcgttgagggactcgagcccaggacgctgtaccggttcaggcttaaggtgacaagcccctctggcgagtgtgaatattcaccactcgtgtcggtgtccaccacctcatcgatctggttggggggtgagcctatatccagtgagcatctccacagagctgtctccgtgaatgacgaggatttgttagtcagaatcctgcaggggggatag

SEQ ID NO: 187877 - DNA, 441 bp, Artificial Sequence
  Description of Artificial Sequence: Synthetic coding sequence
atgccccccagcaagccccacccccccgtggtgggcaaggtgacccaccattctattgaactttattgggacctggagaaaaaagccaaacgccagggcccccaggagcagtggtttagatttagtattgaggaggaagatccaaaaatgcatacatatggtattatctatacggggtacgccacgaagcatgtggtggaggggctggagccacgcacattgtatcggttcagactgaaggtaacatccccctctggtgaatgcgaatactctccactggtctctgtttcaacaacgagcgagtacagcgacagaccccactcgcccttgtccagatctatggagatgacatccaatcttgagaaaatcttctgtctctcattcggcttgacgagaagccgcaacgacaccatcttcaagcactgtaataatatatgctag

SEQ ID NO: 187878 - DNA, 600 bp, Artificial Sequence
  Description of Artificial Sequence: Synthetic coding sequence
tgagagcccatcagcagcgagcacctgcaccgggccgtgagcgtgaacgatgaggatctgctcgtgcgcatcctccagggcggccgggtgaaggttgatgtgccgaataagtttgggtttacagcccttatggtggccgctcaaaagggttatacacgcctagtgaagattttggtgagtaacggcacagacgtaaacctgaagaatggaagcggtaaagactctttgatgctggcatgctacgcagggcacctggatgtagtgaaatacctgcgaaggcacggggcatcttggcaagcgagggatctaggggggtgcaccgcgctccactgggctgccgatggaggacattgctcagtgattgaatggatgattaaagatggatgcgaggtggacgtggttgataccgggtccggctggacaccgctgatgagagtgtcggctgtctccgggaaccagcgtgtggcctcgctgctaattgacgccggcgccaacgtcaacgtgaaggacagaaatggaaaaacgcctctcatgtccgttgtgtctctgctggaggagcggaaaaagaaacagaggccaaaaaagtcttgcgtctgctag

SEQ ID NO: 187879 - DNA, 735 bp, Artificial Sequence
  Description of Artificial Sequence: Synthetic coding sequence
atggaggtgaccggcgtgagcgcccccaccgtgaccgtgttcatctccagctcactgaacactttcaggtccgagaaacgctacagccggagtcttactatcgctgaatttaaatgtaaactggagctgctagtgggcagtcccgcctcctgtatggaactggagctgtacggggtggacgataaattttattctaagcttgaccaagaagacgcactgctgggctcttatccagtcgatgacgggtgtcgtatccatgtaatcgaccacagtggggcaagactgggcgaatacgaagacgtatccagggtcgaaaaatatacaattagccaggaggcatacgaccaaagacaggataccgtgcggagcttcctgaagcgctctaaattgggcaggtacaacgaggaggaacgcgcccaacaggaagccgaggcagcacagaggctggctgaagagaaagctcaggctagcagcattccagtcggatcccgctgcgaggtcagggcggctggccagtctcctcggagaggaacggtgatgtatgtggggctcacagacttcaagccaggatattggattggagtccgatacgacgagcctctgggtaaaaatgacggtagcgtcaacggcaagagatacttcgagtgccaggcgaaatatggcgcctttgttaaacccgctgtggtcactgtcggggatttcccagaagaggattacggactggatgagatttag

SEQ ID NO: 187880 - DNA, 1497 bp, Artificial Sequence
  Description of Artificial Sequence: Synthetic coding sequence
atggacagccagaaggaggccctgcagcggatcatcagcaccctggcaaataagaacgatgaaatccagaactttatagatacccttcatcacaccctcaaaggtgtccaggagaatagttctaatatcctgagcgagctggatgaggagttcgatagcctctacagcatcttagacgaggtcaaggagtcaatgattaattgcattaaacaggaacaagcccgtaaatcgcaggaactgcagtctcaaatttcccaatgtaataatgctttggaaaatagcgaggagcttctagagtttgcgacccgatcgctcgacataaaagagcccgaagaatttagcaaagcagcccgccaaatcaaagatcgagtgacaatggcatctgccttccgtcttagtcttaagcccaaggtaagcgataatatgacccatctgatggtggacttttcacaagaacgccagatgcttcagaccctcaagttcctcccggtacctaaggccccagagatcgaccccgtagaatgtctagttgccgataactctgttactgtcgcttggcggatgcctgaggaagacaacaagatagatcacttcatacttgaacaccgtaagaccaactttgacggactcccccgcgtaaaggatgagcgatgttgggagataatcgacaatataaaggggacagaatataccctcagcgggttgaaattcgacagtaaatatatgaatttccgagtgagggcatgcaacaaggcagtcgcgggagagtacagtgaccccgtgactctcgagacgaaggccctgaacttcaatctggacaactcctcaagccatttgaacctgaaagtagaggatacatgtgttgagtgggatccaaccgggggtaaggggcaggagagcaagatcaaaggaaaggaaaacaagggtagatccggaactccttcccctaaaagaacctcggtgggatctagaccgcccgccgtgagaggttcacgagacagatttaccggcgaaagctacactgtgctgggagatacagcaatcgaatctggccagcattactgggaggttaaggcacaaaaggattgcaagtcatacagtgtaggggtagcctataaaactctgggcaagttcgaccagctcggcaaaacgaacacctcctggtgcatccacgtaaacaactggttacagaacacctttgccgccaagcacaataataaagttaaggccctagatgttacagtcccagagaagatcggggtcttctgcgactttgacggggggcagctctccttctatgacgcgaatagcaagcagctgctttactctttcaagaccaaattcacccagcctgttctccctggcttcatggtctggtgcgggggtctgagtctcagtacgggaatgcaggttcccagtgccgttagaacgttgcagaagagtgagaacggtatgactggcagcgcttcgagcctgaataatgtcgtcacccaatag

SEQ ID NO: 187881 - DNA, 438 bp, Artificial Sequence
  Description of Artificial Sequence: Synthetic coding sequence
atggacagccagaaggaggccctgcagcggatcatcagcaccctggcgaataaaaacgacgaaattcagaactttattgacactcttcatcacacgctgaagggcgtgcaggagaattcctctaatatcctcagtgagctggacgaagaatttgattctctctattctatcctggacgaagtgaaagagagtatgattaactgcatcaaacaggagcaggcacgcaagagccaggaactgcagagccagatctcacaatgcaataatgcgctggagaacagtgaagagttgctggagttcgccacacgtagcttagacatcaaggaacccgaggagttctctaaagttcacaaaaactgtatcaacactctaaacaaaggaagttgcatctttaaaaaggcctttctgttcttcttctcctttgggttcctttactag

SEQ ID NO: 187882 - DNA, 1593 bp, Artificial Sequence
  Description of Artificial Sequence: Synthetic coding sequence
atggacagccagaagtactgcttcaaggagaacgagaacgtgaccgtggataaggcctgcttcctgataagtaatatcaccatcggccccgaatccatcaatttgcagcaggaggctctgcagcgaataatttccacgttagcaaataaaaacgacgaaattcagaatttcatagacaccttgcaccacacgctgaagggtgtgcaggagaatagctcaaacatcctgagcgagctcgacgaagaattcgacagcctgtactctatcttagacgaagtgaaagaatccatgataaattgcatcaagcaggaacaggcccggaaaagccaagagctccagtcacagatctcccagtgtaataatgccctcgaaaacagcgaggagttacttgaatttgccaccaggtccctcgacatcaaagaaccggaggaattctccaaagccgcccggcagattaaggaccgggtcaccatggcctctgcctttagattgtccctgaagcccaaggtgagcgataatatgacccacttgatggttgacttctcccaggagcgtcagatgcttcagacattgaagtttttgcccgtgcctaaggccccggagatcgaccctgtcgagtgtttagtggccgataatagcgtgacagtggcttggagaatgccagaagaggataacaagattgaccatttcattttagagcaccgaaagaccaacttcgatggcctccccagagtcaaagacgagagatgttgggaaattattgacaacattaaggggaccgagtacaccctctctgggctgaagtttgacagcaagtacatgaatttcagggtgagggcctgcaacaaggccgtagccggcgagtattctgaccctgtgaccctcgagaccaaggctttaaattttaatttggacaattcctcctctcaccttaatttaaaagtggaggatacctgcgtcgaatgggatcccacgggtggaaaaggccaagaatctaagattaaagggaaggagaataaaggacggtctggcacaccaagtcccaaaaggacgtctgtcgggtctaggcccccagcggtgagaggttcaagggatcgattcaccggggaaagttataccgtcctcggcgatactgctatcgaaagcggacagcattattgggaggttaaggctcagaaggactgtaagtcctacagcgtaggggtggcatataaaaccctgggtaaattcgaccaattgggcaagacaaatactagctggtgcatccacgtcaacaactggcttcagaatacgtttgccgccaaacataataataaggtgaaggcactagatgtgaccgtccctgagaagatcggcgtgttctgtgactttgacggggggcagcttagcttttacgacgcaaacagcaaacagctcctgtactccttcaaaaccaaattcacccagcctgtgctgcctggcttcatggtctggtgtggcgggctctccctttctacaggcatgcaagttcccagcgccgtcagaacactgcaaaagagcgagaacggaatgaccgggtccgccagctcattaaataacgtcgtgacgcagtag

SEQ ID NO: 187883 - DNA, 1152 bp, Artificial Sequence
  Description of Artificial Sequence: Synthetic coding sequence
atggccagcgccttccggctgagcctgaagcccaaggtgagcgacaacatgacccacttgatggtggatttcagccaggaacgccagatgctgcagacgctgaagtttcttcccgtgcccaaagccccagagatcgaccccgtggaatgcctcgtggccgacaattccgtaactgtcgcctggaggatgcccgaagaagacaataaaatcgaccatttcattctggaacatagaaagacaaacttcgatggtctgccccgtgtgaaagacgagagatgttgggagatcatcgacaatatcaagggaaccgaatacacactgtcagggttaaagtttgattccaagtacatgaactttcgtgtacgcgcctgcaataaggctgttgcaggtgaatactctgaccctgtgacactggaaacaaaagcgctcaacttcaacctagataacagctcgtctcatttgaatctgaaagttgaagatacgtgcgtcgagtgggatcctactggaggcaagggccaggagtccaagattaaagggaaagagaataagggaagtgtgcacgtgacgagcctgaagaagcatacgagcggtaccccaagtcctaagaggacgtccgtaggatcacgtccaccggccgtaaggggttccagggaccgttttacaggtgagtcatataccgtgctgggggatactgccatcgaatcagggcagcactactgggaggttaaggcccagaaagactgcaagagttatagcgtcggggtggcctacaagactttgggcaaattcgatcagttgggcaaaaccaatacctcctggtgcatacacgtcaacaattggctccagaacaccttcgccgcgaaacataataacaaggttaaggcactggatgtgacagtgcctgagaaaataggcgtgttctgtgatttcgatggaggtcaactgagtttttacgatgctaactccaaacagttactgtattcttttaagaccaaatttactcagcccgtcttgccagggtttatggtttggtgcggagggctgagcctgagcaccgggatgcaggtaccctctgcggtgaggactcttcagaagtccgaaaacgggatgacaggtagcgcgtcctcgctgaataatgtggtcactcagtag

SEQ ID NO: 187884 - DNA, 5685 bp, Artificial Sequence
  Description of Artificial Sequence: Synthetic coding sequence
atggcccccgaggccggcgccaccctgcgggccccccggcggctgagctgggctgcccttctcctgctggctgcgctcttgcccgtggcgtcctcagctgctgcctcggtggatcatccgcttaaacctaggcatgtgaagctcctgagcaccaagatgggcctcaaggtgacctgggacccgcccaaggacgctaccagtcggcccgtggagcattacaatatcgcatatgggaaaagcttaaagtccctgaagtatattaaggtaaacgcagaaacatattcctttcttattgaggatgttgaacccggcgtagtatattttgtgctccttaccgcagaaaatcattcaggtgtgtctcggcccgtgtaccgcgcggaatcacctccaggcggtgaatggatcgagattgacgggttcccgattaaaggtcctggtccttttaatgaaacagtgactgagaaggaggtccctaacaagcctctaagggtcagagtgaggtcatctgacgatagactcagcgtcgcttggaaggcaccccgtcttagcggggccaagtctcccaggcggtcccggggcttcctgctcggctacggggaaagtgggcgtaagatgaattacgtgcccctgacaagggacgagcgtacccacgaaatcaagaagctggcgtcagaaagtgtgtacgtggtctccctacagagcatgaactctcagggcaggagccaacccgtgtatcgggcagccttaactaaaaggaaaatctctgaggaggatgagcttgatgttccggacgacatctccgtgagagtgatgagcagccagtcggtgctagtgagttgggtggatcctgttctcgagaagcaaaagaaagtagtggcgtcgaggcaatataccgtaaggtatcgtgaaaaaggcgagctggctcgttgggattataaacagattgctaatagacgcgtgctgatagaaaatttaatccctgataccgtctacgagttcgcagtgcggatttcgcagggagaaagagatgggaagtggtccacttctgtgtttcagaggactcctgagtctgccccaaccacggcccccgagaatctcaacgtttggccagttaatgggaaacctactgttgtcgctgcatcttgggatgcgctgccagagaccgaaggtaaggtgaaggagtacatcctaagttatgctcctgcactcaagccgttcggcgcaaaatcgttgacttaccctggggatacaacgtcggccctagttgacggtctgcaaccaggcgaaagatatcttttcaagatacgggcaaccaataggcgaggcctgggccctcattctaaagcatttatcgtcgccatgcccacaacatccaaggcagacgtggagcaaaatactgaagataatggaaagcctgagaagccagaaccaagcagcccttctcccagagcccctgctagctctcagcacccttcggtgccagcctctcctcaaggccggaatgccaaggacctgcttctggacttaaaaaataagatacttgctaatggaggagcacctcgaaagccccagcttagagcaaagaaggctgaggaacttgacctgcaatctacggaaatcacaggtgaagaagaactgggaagcagagaggactcgcccatgtcaccgagtgacactcaggaccagaagcggaccctcagacccccatctcggcacggccatagcgtcgtcgcaccaggacgaactgcagtgagagcacggatgccagctttaccccgtcgggagggcgtcgacaagccaggattctccctcgccacccagccgcgcccaggggcgcctccatcagcgagcgcttctcctgcacaccacgcctccacccaaggaacctcccacagaccatctctgcctgcatctctgaacgacaatgacctggtggatagtgatgaggacgaacgggccgtcgggagtttgcatcctaagggcgccttcgcgcagccgagacctgctctcagtccatctcggcagagcccttcttcggttctccgggacagaagttctgttcatccaggtgctaaacctgccagccctgcgagacgtacgccccacagtggggcagctgaggaggactccagcgcctcagcccctcccagtaggctcagtccccctcatggaggttcgtccagactgctgccaacacagccacacttatccagtcccttatctaagggaggtaaagacggggaggatgcacccgcaactaatagcaatgcccctagtagatcgacaatgagctccagcgtcagctctcatctttcgagcagaacgcaggtctccgagggggccgaggccagcgacggggaaagtcatggtgacggagatagagaagacggcggacgccaggctgaggccaccgcgcaaactctcagggccaggccagccagtggccatttccacttgctgcgacacaagccattcgcagccaacggacgctcaccctctcgcttctccattggtcgcggacctcgactgcagccttcgagctccccacagtctacagttcccagccgcgcccacccccgtgtaccatcgcactccgattctcaccccaagctgtcctccgggattcacggagatgaagaggatgagaagcccctcccggcaaccgtcgtcaacgatcatgtgccttcctctagtcgccagcccataagtagagggtgggaggacctgcgaaggtcgcctcagagaggcgccagtctgcataggaaggagccgatccccgagaaccctaagagcacaggcgccgacactcacccacagggaaagtactcatcattggcgagcaaagctcaggacgtgcagcagagtacagacgctgacacagaaggacacagtcccaaagctcagccgggctcaactgaccgccacgcctcaccagcccgcccacctgcagcgagaagtcagcagcacccatctgtgccccgacgaatgacacctggaagagcaccccagcagcaacctccaccccctgtcgctacatctcagcatcatcccgggccccaaagccgtgacgccggtagaagcccctcccagccccgtctctctctgacacaagccggccgcccacgacctacttctcagggtcggtcacactcctccagcgacccatacaccgcaagctcacgaggcatgttgccaaccgcactccagaatcaagacgaggacgctcagggaagttacgatgacgactcaaccgaagtggaggcacaagacgtacgagcgcccgcgcatgccgcaagagccaaggaagctgcagcttcactgccaaagcatcagcaagtggaatcgcccaccggcgctggcgccggaggtgaccacaggtcacaaagagggcacgctgcgagccctgccaggcccagcaggcccggggggcctcaatctcgcgcaagagttccgtccagagctgcacctgggaagtcagagccgccgagcaaaaggcctctgtccagcaagtcccaacagtctgttagtgccgaggacgatgaggaggaggatgccggtttttttaaaggaggcaaggaggatctgttatcttcatcagttccgaagtggcccagctctagcacccctcgaggagggaaggatgcggatgggtctctagccaaggaagagcgcgaacctgccatagctcttgcgcctagagggggcagcctggcccctgttaagcgccccctccctcctcctcctggctctagccctagggccagccacgtcccctccagactacctccgaggtcagctgccaccgttagtcccgtggctggcacacacccatggccccagtacacaacgagggcccccccaggccacttttcaactactcccatgttgtccctccggcagcggatgatgcacgctcgcttccggaatcccctgtctcggcaacccgccaggccctcttatagacagggatataacgggcggcccaatgtcgaaggaaaggtgttgccgggctctaatggaaagccaaacggccaacggattataaatggaccacagggtaccaagtgggtggtggaccttgacaggggcctggttctgaacgctgaaggcaggtacttgcaggattctcatggcaaccctctgcgtatcaagctcggaggggacgggaggactattgtcgaccttgagggaactccagttgtgtctcctgatggactgcctctcttcggacagggccggcacggaactccactggcaaatgcccaggataaacccatactgtccttgggagggaagcctctcgtcgggcttgaggttataaagaaaaccacacatccccctactaccaccatgcagcctaccactacaactacccccctccctacgacgaccacaccaagacctaccactgccacaacgaggcgcacaacaaccacaagaaggactaccactaggaggccaactaccacagtgcgcaccacaacgcggactacaacgacaaccactccaacccccactaccccaattcctacttgtcctcctggcacgctggagagacacgatgatgacggtaatctaatcatgagttctaatggcattccggaatgctacgctgaagaggatgaattttccggcttggaaacggatacagcagtgcccactgaagaggcctatgttatttatgatgaggactacgaattcgaaacatcccgacctccaacaacaacggagccatctaccacggcaaccacgcctcgggtcatcccagaggaaggcgcaatcagtagcttcccggaggaagagttcgatctggctgggcgaaagagatttgtcgccccctatgtcacttacctcaataaggacccttcggcaccatgcagcctaacagacgccctggatcactttcaggtggacagcctcgatgagatcattcctaacgatctaaagaagagcgatctcccacctcagcatgccccccgaaatatcactgttgtggctgtcgagggctgtcattcctttgttatcgtggactgggacaaggctacacctggagacgtggtaaccggttaccttgtttactctgctagctatgaggactttataagaaataagtggagcacgcaggctagctcagttacccatctgcctatagagaatttgaagccaaacacacgctattattttaaggtccaggcacagaatcctcatggctacgggccaatttctccctcagtcagtttcgtgacagagtctgataatcccctgctggtggtccgaccccccggcggcgaaccaatttggataccctttgcatttaagcacgatccaagctacaccgactgtcatgggcgacagtacgtcaagcgcacttggtacaggaagttcgtcggagtggtactgtgcaacagcctgcgctacaaaatctacctttcggataacctgaaggacaccttctactccattggggacagttggggcaggggcgaagatcattgccagttcgttgacagtcatctggacggtcgtactgggccccagtcttatgtggaggctctgcccactatccagggctattaccgtcaatatagacaggagcccgtgcgttttggcaacatcggatttggaacaccgtattattacgtcggctggtatgagtgcggagtgtctatccctggcaaatggtag

SEQ ID NO: 187885 - DNA, 5496 bp, Artificial Sequence
  Description of Artificial Sequence: Synthetic coding sequence
atggcccccgaggccggcgccaccctgcgggccccccggcggctgagctgggctgcactcctgcttctcgcagccctgctaccagtggcatcatccgccgccgcgtcggtggaccatcctctgaaacctcgacatgtgaagctactgtcaactaagatgggcctaaaagtcacctgggaccctcctaaggatgcaacaagccgccccgttgaacattacaacattgcctacggaaaatccctcaagtccttgaaatatatcaaggtcaatgcagaaacctacagcttcctgatcgaggatgttgaaccaggcgtggtgtactttgtgttgctaacagccgaaaaccattcgggtgtgtccaggccggtgtaccgcgccgaatctccaccagggggggaatggattgagatcgatggctttccaatcaaaggccccggtccctttaatgagactgtgaccgaaaaggaggttcctaacaaacctctcagggttcgggtgcggagtagcgacgatagactgtctgtcgcgtggaaggccccccgattatcaggtgctaaatctccacggaggagcaggggattcctgctgggatacggcgagagcggccgcaaaatgaactatgttcccctgactcgggatgaaagaacacatgagataaaaaaattagcatcggaatctgtctacgtggtgtctctacaaagcatgaatagtcagggtcggtcccaaccggtataccgggcagcgcttaccaagagaaaaatttcggaagaggacgagctggacgtgcccgatgacattagcgtccgggtaatgagcagtcagtctgttctcgtgagttgggtcgaccctgtactcgaaaaacaaaagaaggtggtggcaagccgacagtacactgttcgctacagggaaaagggggaattagcgaggtgggactacaagcaaatcgccaacaggcgggtattaatcgagaaccttattccagatacagtgtacgagttcgctgtgagaatatcacagggcgagcgagacgggaagtggagtacaagcgtgttccagagaacaccagaaagtgcacccaccacagctcctgagaatctgaacgtttggccagtgaatgggaaaccaactgtcgtggcggcatcttgggacgctctgccagaaactgagggcaaagtaaaggctagcaaagctgacgttgaacaaaacacagaagataatggaaaaccagaaaagccagaaccttctagtccatcaccacgtgcacccgcatccagtcaacatccatccgtgcccgcttctccacagggaaggaacgcaaaggatctactgttggacttgaaaaataaaattctggctaacggcggggctcccagaaagccgcaactaagggccaaaaaggcagaggaactagatttgcagtccaccgagatcacaggcgaggaggagctaggttctagagaggacagccccatgtcacctagtgacacacaggatcagaagagaactctgcgacccccctctcgacatggccactcagtcgttgctcccggcagaacggccgtacgggctagaatgccagccctcccgcgacgggaaggagtggacaagccaggtttcagcctcgcaactcagccccggcctggggctcccccttcggcgtccgccagccctgcacaccacgctagtacacagggaacttctcacaggccttctctccccgcttccctgaatgataatgatctggtcgactcggacgaagacgaacgcgctgtcggatcacttcaccccaaaggggcctttgcccagccccgcccagcactgagcccgagcaggcagtctccctcttctgtactgcgagatcgcagctctgtgcaccccggtgctaagccggcgtcccccgcccgaagaacgcctcacagcggggctgccgaagaggacagttccgcttccgcccctccttctagactgagtcccccacatggcggaagctctcgcctgctgccgacccagccccacctgagttctccactgtccaaagggggcaaggatggcgaagatgctccagctacaaactccaatgcgccctctagaagcaccatgagtagtagcgtgtcaagccacctgagctcccggactcaggtgtctgagggggccgaggcgtctgacggcgagtctcatggagacggcgacagggaggatgggggaagacaggccgaagcaaccgcccagacgcttcgtgccaggccggcctcagggcatttccacctccttaggcataagccctttgccgccaatggccggtccccaagccggttctctattggccgcggaccgagacttcagccatccagcagtccccaaagcaccgtaccgtcacgggcccacccccgggttccttcacacagcgactcacatcccaagctctcctctggaatccacggtgacgaggaggacgaaaaacctttgcccgccaccgtcgtcaacgaccatgtcccgtcatcgtctagacagcccatttctaggggctgggaagacctgagaagatcaccacagagaggcgcaagtctgcacaggaaagagcctattcccgagaaccctaaatcgacaggcgccgatacacatcctcaggggaaatatagttcactggcctcaaaagctcaagatgttcaacagagcacagatgcagacacagagggacactcccccaaagcacagcctggatccaccgaccggcatgcctctccggctcggcctcctgccgcacgctcccaacagcacccatcggtcccgcggaggatgactccaggcagagccccacagcagcaacctccccccccagtcgccaccagccaacaccaccccggcccacaatctagggacgcaggccgttcgcctagccagccacgacttagtctgacacaagccgggcgacctagacctacgtcacagggccgtagtcactctagctccgatccctatactgccagcagcagaggtatgttacccaccgcacttcagaaccaggatgaagacgctcaaggtagctatgacgatgatagtacggaagtggaggcccaggatgtgcgcgccccagcacacgccgccagggctaaggaagccgctgcgtccctgccaaagcatcagcaagttgagagtccgactggcgccggcgctggaggcgaccataggagccagcgaggtcacgccgcaagccctgctagaccctcccggccaggaggacctcagtcccgcgcccgggtgccttcaagagcggcgcctggtaaatccgagccaccatccaagaggcccctttctagcaagagccagcagtcggtcagtgccgaggatgacgaggaggaggacgcagggttttttaaaggtgggaaagaagacctgctttcatcctcagtgcccaaatggccttcctcatcgacaccgaggggcggaaaggacgctgatgggagcctggcaaaagaagagagagaacccgccattgcactggcccccagagggggatctttagctcctgtaaagcgaccgttgccccctcctcccgggagttctccacgagcctcccatgtcccatctaggctgccaccgagatccgctgctacggtttctccggtggccggcactcatccctggccccagtacactactagggctccccctggccacttctccaccacgccgatgctgagtttaagacagaggatgatgcacgctcggtttcggaaccccttatctcgccaaccagcacgcccgagctacagacagggctacaatggtcgccccaatgtggaaggaaaggtcctgcctggcagcaatggcaagcccaatgggcagcgtattatcaatggccctcaaggcacgaaatgggttgtggacctagacagggggctggtgctgaatgccgaaggaaggtacctgcaggatagccacgggaatcctttacggattaaattagggggcgatgggaggactatcgtagatctggaggggacgccagtggtatcaccagatggactgcctctgttcggccaggggcgccacggtactccgcttgctaacgcacaggataaaccaatactgagcctcggaggtaaaccgctcgtgggactggaagtgataaagaagacaacccaccccccaacgactactatgcagcccactaccacgaccacacccctacccactaccactacccctcgtccaaccacagccaccactcgcagaacgacaaccactcgccgaaccacaactcgacgaccgacaaccactgtccggacaactacacgtactactaccacaactacccccactcctaccactccaatccccacgtgtccaccgggtacactggaacgacatgatgatgacgggaacctcatcatgagcagcaacgggattcccgaatgttatgccgaagaggatgagtttagtggattggaaaccgacaccgccgttcctacggaggaagcatatgtgatttacgacgaagattacgaattcgagaccagtagaccacctacaactactgagcctagtactacagcgacaaccccgagggtgatcccggaggaaggagctattagcagctttccagaggaggaattcgacctggcaggaaggaaaagatttgtggctccatacgtcacttacctgaacaaggaccctagcgccccttgctccctcactgacgccctagatcacttccaggttgacagcttggacgagatcattccaaatgacctcaagaagtctgacctgcctccacagcacgctcctagaaacattactgtggtggccgtggagggctgccacagtttcgtgatcgtggactgggacaaggcaaccccaggagacgtcgtgacaggctacctcgtgtacagcgcttcgtacgaagatttcattaggaacaagtggagcacacaggcttcctccgtcacccacctcccaatcgaaaaccttaaacctaacacccggtactattttaaagtccaggcccaaaacccccatggctatggaccgatttctccaagcgtgtcattcgtcacggagtcggacaacccattattggttgtgcggccaccaggaggcgagcctatctggattcctttcgctttcaagcacgacccttcctacacagactgtcatgggcgacaatacgtgaaacgaacgtggtatcgtaaattcgtgggggtcgtcctctgcaactctctacggtataagatatacctgtccgataacctgaaagacacgttctattctattggagacagctggggtagaggggaagatcactgccaatttgttgattcccacctcgatgggcggacgggcccgcagtcctacgtggaagcactcccaactatccaaggatattacagacagtaccggcaggagcccgttagatttggaaacataggcttcggaacaccatattactatgtgggatggtatgaatgcggggtcagcattccgggtaaatggtag

SEQ ID NO: 187886 - DNA, 3615 bp, Artificial Sequence
  Description of Artificial Sequence: Synthetic coding sequence
atgtacgtgaccatgatgatgaccgaccagatccccctggagctgcctcccctgctcaacggggaggtggccatgatgccacacctggtgaatggagacgctgcgcagcaagtgattctggtgcaggtaaatcccggtgagacctttaccataagagccgaggatggaactttgcaatgcatacaagggcctgccgaggtgcctatgatgagccctaacggatcaattccaccaatccacgtaccccccggctacattagtcaggtaatcgaggactctacaggagtacgacgcgtcgtggtgacacctcaatctccggaatgctacccccctagctacccaagtgccatgagcccgacacaccatttgccaccctatctgacacaccatccccacttcattcacaactcccatactgcctactacccaccggtaacaggacccggagatatgcccccacagttcttccctcagcaccacctgccgcatacaatatatggcgaacaagaaataattcctttttacgggatgagcacgtacattaccagggaggatcagtattccaagcccccacataagaagttgaaggaccgccagatagatagacagaatcggctgaatagtcccccaagctcaatctacaaatcatcctgcaccaccgtctacaacggctacgggaagggccactcaggcggatcaggtgggggcggatctgggtcggggcccgggattaagaagacggagcggcgggcgcggtcctcacccaaaagtaacgatagcgatctacaggagtatgagctggaagtcaagagggtccaggacatcctaagcgggatcgaaaaaccgcaggttagcaatattcaggcccgggcagtggtcttgagctgggcccctccagtgggactgtcatgtggaccccattctggtctgtcatttccttatagttacgaagtggccttgtctgataaaggacgggacggtaagtataagatcatctacagtggcgaggagctcgaatgcaacctgaaagaccttcggcctgccaccgattatcacgtcagggtgtacgccatgtataactccgttaaaggctcttgttcagaaccggtctcatttacaactcacagctgcgctccagaatgcccatttccccccaagctcgcccacaggagcaagtcctcacttactcttcaatggaaggcacctatcgataacggatcaaagattaccaattatctgctagagtgggatgaagggaagaggaacagtggcttccgccagtgttttttcggcagccaaaagcactgcaagttgacgaaattgtgccccgctatgggttatacgtttcgccttgcagctagaaacgacattggcacttctggatattcccaagaagtggtgtgctacacgctgggcaatatcccacagatgcccagtgcaccacgtttagtcagggccggcattacctgggttacactccaatggtcaaagcccgagggatgttcacctgaagaagttatcacttatacactggaaattcaggaggatgaaaatgataacttgttccatcccaagtacacaggcgaagaccttacttgcacagtaaagaatctgaagcgaagtacccagtacaagttcagattgacagcatctaataccgaggggaagagctgcccatccgaggtccttgtgtgtactacaagtccagaccgtcctggtccccccacgcgaccactggtgaaaggccctgtgacgagccatggattctcggtgaaatgggatcccccaaaggataatgggggctcagaaatcctgaaatacctgttagaaattactgacggaaactcggaagcaaaccagtgggaagtggcgtactccggcagcgccaccgagtatacctttactcacctgaaaccaggtactttatataaattgagagcatgttgcatcagcactggcgggcattcacagtgctctgagagcctcccagtccgtaccctgagcatcgcccctggacagtgtcgcccaccacgggttttgggtagacctaaacacaaagaggtccaccttgagtgggatgtgcctgcctccgaatccgggtgtgaagtgagtgagtacagtgtcgagatgacggaaccagaagacgtcgcaagtgaagtttatcacggccctgaacttgagtgtactgttggaaacctgttgcccggaacggtgtatagattcagagttagggctctcaacgatggcggctatggaccatattccgatgtttcggagataacgacagcagccggcccccccggtcagtgcaaggctccctgcataagctgtacacctgatggttgcgtactggtgggatgggaatcacccgatagcagcggtgccgacatctccgagtaccgcctggagtggggcgaagatgaagagtcactggagctaatctaccacggtacagatacacggtttgaaatcagggatttactccccgccgcacagtattgctgtagattacaggccttcaaccaggcgggagctggcccttatagtgaactggtgctctgtcagacgccggcatctgcccctgatcctgtgtctacactatgcgttctcgaggaggagcctctggacgcctatccagacagtccgtccgcctgtctggtcctgaactgggaagagccctgtaataacggatcagaaatcctcgcatataccatcgacctcggagatacttctataaccgttggcaacaccacaatgcacgtcatgaaggacttactgccagaaacgacctaccgtatcagaattcaggccatcaacgagattggggctgggccattcagccaatttattaaagctaaaacccggccgctgccgcctcttccaccacgccttgaatgtgccgcagccggcccacagtcgcttaagctgaaatggggggacagtaatagcaaaactcacgccgcagaggacatcgtgtatactcttcagctggaagatcgcaacaaaagatttatatcgatttaccgggggccatcccatacatacaaagtccaacgcctgactgaattcacgtgctatagctttagaatccaagctgcctctgaggctggggagggaccatttagcgaaacatacactttttctacaaccaagagtgtccctccaacaattaaagccccacgagttacccaacttgaaggcaactcttgcgaaatactttgggagacagtacccagcatgaaaggcgatcccgtgaattatatcctgcaggtacttgttggccgggaatctgaatacaagcaggtgtacaagggggaagaagctaccttccagataagtggactccagacgaataccgactaccgatttagagtgtgtgcttgcaggcggtgtctggataccagccaggagctttctggagcttttagcccatcggcagccttcgtcctacagcggtctgaagtcatgttaacaggcgatatgggtagcctcgacgatcccaaaatgaaaagcatgatgccaactgacgagcagttcgcagcgataatcgtcctggggttcgccacactgtctattttgttcgcctttatcttacagtactttctgatgaaatag

SEQ ID NO: 187887 - DNA, 216 bp, Artificial Sequence
  Description of Artificial Sequence: Synthetic coding sequence
atgtacgtgaccatgatgatgaccgaccagatccccctggagctgccacccctgcttaatggggaagtggcgatgatgccacacctggtgaatggagatgccgcgcagcaggtgattctagtgcaagtgaacccaggcgaaactttcacgattagggcggaggacggtaccctgcagtgcatccaggaagtcaacgtgaaaaggcattgcctctag

SEQ ID NO: 187888 - DNA, 3615 bp, Artificial Sequence
  Description of Artificial Sequence: Synthetic coding sequence
atgtacgtgaccatgatgatgaccgaccagatccccctggagctgccccctttgttaaacggggaagtggctatgatgccgcacctggtgaacggcgacgctgctcaacaggtgatactggttcaggtgaatcctggtgagaccttcacaatccgggctgaggatgggacgctgcagtgtatccagggcccagccgaagtccctatgatgagcccaaatgggtccatcccacccatccacgtccctcctggttatatttcccaggtaatcgaggatagcaccggcgttcgtcgggtagtggtcaccccccaatcaccagagtgctatccaccatcctacccgagcgcaatgagccctacccatcaccttcccccttatctgacgcaccacccccatttcattcataactcacatacagcatactacccgcccgtgacaggccccggtgacatgccacctcaattcttcccgcagcatcacctaccccataccatctacggagaacaggaaattattccattttatggaatgtctacgtacattacacgggaagatcagtactcaaagccaccccacaagaagctcaaggaccgacagatcgaccgccagaacagactgaacagccccccctccagcatttacaaatcatcttgtactactgtatacaatgggtacggtaaggggcattcgggcgggtcagggggcggcggctctggctcaggccctggaatcaagaagactgagagacgcgcaagaagcagcccaaagtctaatgattctgatctgcaggaatatgagcttgaggtaaaacgggtccaggacatactttctgggattgagaaacctcaggtgtctaacattcaggctcgcgcagtggttctgtcttgggccccacccgtgggcctgtcttgtgggcctcactcaggcttgtcgtttccttattcctatgaagtagctctgtccgataagggcagagacgggaaatacaagattatctattctggggaggaactggaatgcaacttaaaggaccttcgccccgctaccgactatcatgttcgtgtctacgctatgtataactccgttaaaggttcttgctccgagcccgtgagctttacaactcactcttgcgcaccagagtgcccctttcctccgaaattggcacaccgctcaaaatcctctttaaccctccaatggaaagcaccaatcgacaacgggagtaagatcacaaattatctcctagaatgggacgagggcaagagaaactcaggatttagacagtgcttcttcgggagccagaagcactgcaagctcaccaagctgtgtcccgctatggggtatacattccggctcgctgctaggaacgatatcggtacctctggttactctcaggaagtcgtgtgctacaccttggggaatatacctcaaatgccatccgcccctcgacttgtccgggcgggcataacttgggttaccttgcaatggagtaaacctgaaggttgctccccagaggaagtgattacatatactctcgagattcaggaagacgagaatgataacctgttccatccaaagtacaccggagaggatctgacatgtaccgtcaagaacctcaagcggtcaacacagtacaaattcagattgacggctagcaataccgaaggcaagagctgcccatccgaggtcctcgtgtgtactacgtccccagatcgcccgggcccccccacaagaccattggtgaaagggcccgtgacttctcatggattctccgtaaagtgggatcccccaaaggataacggcggttctgaaattctgaaatatctcctcgagattaccgacggtaattccgaagccaaccaatgggaggtggcttactcgggtagtgccaccgaatacaccttcacacacctgaaacctggaacgctctacaagctgcgcgcctgttgtatatccacaggcgggcactcccagtgcagtgagagcttacccgtgaggaccttatccatcgcacccggccaatgccggcctccaagagtgcttggtcgccctaagcacaaggaagtgcatctggagtgggacgttcccgcatccgagtctggctgcgaggtttccgaatactccgtcgagatgactgaaccagaagacgtggcctctgaagtttatcacggccctgagctggagtgtacagtgggaaatctcctgccagggaccgtttacaggtttagagtcagagccctgaatgacggcggctatgggccttatagtgatgtgagcgagatcacgacagccgctggccctccgggccagtgcaaagccccctgtatctcatgcaccccagacggatgtgtgttagttggatgggagagcccagactcaagtggggcggatatcagtgaatacagacttgagtggggcgaagacgaagaaagtctcgagctgatctatcatgggacagacacaaggttcgaaatccgggatctgctccccgcggcacagtattgctgccggttgcaagcctttaatcaagcaggcgccggtccatattccgagctggtgctgtgtcaaacgccggcctctgcaccggatcctgtcagcaccttgtgcgtcctggaagaggagcccctagacgcctatcccgactctcccagcgcgtgcctagtgctcaattgggaagaaccttgcaataatggatccgagatcttagcttataccattgacctcggagacacatccattaccgtagggaataccactatgcacgtgatgaaggacttattacccgaaacgacctaccgtatcaggatccaggccatcaatgagattggcgcaggcccattctctcagttcataaaggccaaaaccaggcccctacccccgttgccgccacggcttgagtgcgctgccgctgggcctcaatctctgaaattgaaatggggagacagcaatagcaaaacccacgccgccgaggatatcgtatacacactgcagcttgaggaccgaaataagcgctttatctccatctatcggggaccctctcatacctataaggttcagagactaacggagtttacctgctatagtttcagaatccaggctgccagcgaggctggagagggcccattctcagagacctacacattttccaccactaaatctgtgcccccaaccattaaagcccctagagtaacgcagcttgagggcaattcttgtgaaatcctgtgggaaacagtccccagcatgaagggcgaccccgtgaattatatattacaggtcctcgtgggcagagaaagtgaatataaacaggtatataagggtgaagaagctacttttcagatttctggcttacagaccaatacggactacaggttccgcgtgtgcgcctgtagacgatgcctggataccagtcaggagctttccggagccttttctccttctgctgcgtttgtgctccaaagaagcgaggtgatgcttacaggagatatgggcagtcttgacgatcctaaaatgaagtctatgatgcccaccgatgaacagttcgccgcaattatcgtgctcggctttgccaccctctccatcctgttcgcctttatcctgcaatacttcctgatgaaatag

SEQ ID NO: 187889 - DNA, 3615 bp, Artificial Sequence
  Description of Artificial Sequence: Synthetic coding sequence
atgtacgtgaccatgatgatgaccgaccagatccccctggagctgcccccgctcctaaatggcgaggtcgctatgatgcctcacctggtcaacggcgatgcagcccagcaggttatcctggtccaggttaatcctggggagacatttactatccgcgccgaagacggaacccttcagtgtatacagggccccgcagaagttcccatgatgtccccgaacgggagtatccctcccattcacgtcccccccggatacatctcccaggtgatagaagactcaaccggcgtacggcgggtagtcgtgacacctcagtcacccgaatgctatcctcctagttacccatctgccatgtctccgacacaccatctgcccccgtacctcacccatcacccccattttatacacaattcacatacagcatactaccctcccgtaaccgggccgggcgacatgccgccgcagtttttcccacagcatcacctgccacatactatctacggggagcaggaaatcattccattttacggcatgtctacctacatcacacgcgaggatcagtactccaagcctccacacaaaaagttaaaagatcggcagatcgacagacaaaaccggctaaattctccaccttcatccatttacaagtctagctgcaccaccgtgtataatggctacggcaaagggcacagcggaggcagtggaggcgggggatctgggtccggacccgggataaagaagacagaacgtagggctcgttctagccctaaatcaaatgattcagacctgcaagaatatgaattggaagtgaaacgagtccaggacatactctcaggcatcgaaaagcctcaggtgtcaaacattcaggcccgggccgtagtgctctcttgggcacctcctgtaggacttagctgcggcccccatagtggtctctcgtttccctattcctacgaagtagccctcagtgataaggggagagacggcaagtataagataatctatagcggagaggaacttgagtgcaatctcaaggacttacggccagcaacagattaccacgtgcgcgtttacgctatgtataatagcgttaaagggtcctgcagcgaacctgtctcttttaccacacattcatgtgcacctgagtgccctttccctccaaagttggcacatcgatccaaaagttcattgacgctccagtggaaagcacccattgacaatgggtccaaaattacaaattacctgctcgaatgggatgaagggaaacgcaattcaggctttcgccagtgttttttcgggtcgcagaaacattgcaagctgaccaagctgtgtccagctatgggctacaccttccgattggccgcccgaaatgacatagggaccagcggctattctcaggaagtagtttgttacaccttggggaatatcccacagatgcccagcgctcctcggctggtgagggcagggatcacctgggttacactgcagtggtcaaagcccgaaggctgtagtccagaagaggtgattacttataccttggagatacaggaggacgagaacgacaatctgtttcaccctaaatacaccggagaggacctaacatgtacagtcaaaaatctgaagcgatccacacaatacaagttcaggctcacagcatccaatacagaggggaagtcttgccccagcgaggtgctcgtgtgcaccacttcaccggatcgccccgggccaccaacaagacccctcgtgaaaggacccgtcacctctcatggattctcagtcaaatgggaccctcctaaggacaatggtggctccgagatcctgaaatacttgcttgagattactgacggcaattccgaggccaatcagtgggaagttgcctactctggcagcgccactgaatatactttcacacacctgaagcccggcacgctctataaacttcgagcatgctgcatatctacggggggacacagccagtgcagcgagtccctgcccgttagaaccttgagcattgcaccgggccaatgcaggccccctcgagtccttggacggcccaagcataaggaagtgcatctcgagtgggacgtgcccgcctctgagtcgggctgcgaggtgtctgagtattcagtcgaaatgaccgagccagaggacgtagcaagcgaagtataccatggcccggagcttgaatgtacagtggggaaccttttacccggcactgtgtacagatttagggtgagggccctcaacgatggaggctacggcccatacagtgatgtaagcgaaatcacaaccgcagctggtccgccgggtcagtgcaaggctccctgcattagttgtactcctgacgggtgcgtcctggtgggatgggagtcccctgatagttctggcgctgacatcagcgaatatcgcctagagtggggagaagacgaagagtctctggagctcatttaccacggcacagacaccaggtttgagatccgtgatctgctgccggctgcacaatactgctgcaggttacaagcgtttaatcaggccggagctggaccgtattcagagctcgtgttgtgtcaaactcccgcctccgctccggacccagtgtctactctttgtgtccttgaagaagagcctctcgacgcttatcccgacagcccgtccgcctgccttgttctcaactgggaagagccatgtaataacggttcagaaatcctggcgtatacaatcgacctgggcgacacttcaatcaccgtcggaaacactacaatgcacgtcatgaaggacctgctcccggaaactacttaccggatccgaatccaggctatcaacgagattggagctggtccattctcccagtttattaaggccaagaccagacccctcccaccacttcccccacgcctggagtgtgcagcagcgggcccgcagtcgctcaagctgaagtggggagattcaaacagtaaaactcacgcagcagaggatatagtctatacccttcaattagaggatagaaataagcggtttatatcaatctaccgaggccccagccacacatacaaggtccaaaggctaactgaatttacgtgctactcatttcggattcaggccgctagtgaagctggagagggtccgttcagcgagacctacaccttctccacaacgaagtctgtgcccccaaccatcaaagcaccaagggtgactcaactcgaaggcaacagttgtgagattctctgggaaacagtacccagcatgaaaggcgaccctgtgaattacatcctccaggtcttggtcgggagagagtcagagtataagcaggtatacaagggcgaagaagccactttccagatatctggcctgcagaccaacacagactaccgcttccgggtatgcgcctgtaggcggtgtctggacacatcacaggagctgtcgggcgccttctctccatccgcggcttttgtgttgcagcgctcagaggtgatgcttacgggagatatgggatctctggatgatcccaagatgaagtcaatgatgccaaccgatgaacaatttgccgctatcattgtgctcggctttgccactctgtctattctttttgccttcattctgcagtattttctgatgaagtag

SEQ ID NO: 187890 - DNA, 627 bp, Artificial Sequence
  Description of Artificial Sequence: Synthetic coding sequence
atgttcaccaaggagaagatctggagcgaggtgatcctggtgcaggtcaatcccggggagacctttaccatcagggccgaggatggtaccctgcagtgcattcagggtccagcagaagtaccgatgatgagtcctaacgggtcgattcctcctattcacgttccccccggttacatctctcaagtcattgaggactctactggggtgaggcgcgttgtggtgaccccgcagagtcctgaatgttaccctcctagctacccttcagcgatgtcaccaacacaccatctccccccttatctcactcaccatccacacttcatccacaactctcatacagcatattatccacccgtcaccggtcccggcgacatgccaccgcagttctttccgcaacaccatcttccacatactatttacggcgaacaggagatcatacccttctatggcatgagtacttacataacacgtgaggaccagtattctaagccgcctcacaagaagctgaaggataggcagatcgatagacaaaaccgactcaactcacccccctctagcatttacaagtcttcatgtacaaccgtgtacaacggctacgggaaaggacattctggggggtcaggaggatag

SEQ ID NO: 187891 - DNA, 705 bp, Artificial Sequence
  Description of Artificial Sequence: Synthetic coding sequence
atgcccagcggctgccacagcagcccccccagcggcctgcggggcgacatggctagtctcgtgccccttagcccgtacctttccccaactgtgctacttttggtatcttgcgacctaggcttcgtgcgcgcagatcgccctccttctccagtcaacgtgacagtgacccatctcagagccaactcggctactgtaagctgggatgttcctgagggaaatatcgtcataggatactccattagtcagcagaggcagaacggaccagggcagagggtgattcgggaggttaacactacgacacgcgcctgtgctctgtgggggctggccgaagactctgactacaccgtgcaggtccggtcaataggcctacggggcgaatctcccccgggaccaagggtgcattttagaactcttaaaggatctgaccgcctcccgagcaatagcagcagccctggcgatattactgtagagggcctggacggagagcggcccctgcagactggcgaggtggtgattatagttgtggtcctgttgatgtgggcagcagttataggactgttttgcagacagtatgatatcatcaaggacaatgacagcaataacaatcctaaagagaagggaaaaggaccagagcagagcccacagggccggccagtaggcacgaggcagaagaaatcgccctctattaatacgatcgatgtgtag

SEQ ID NO: 187892 - DNA, 2478 bp, Artificial Sequence
  Description of Artificial Sequence: Synthetic coding sequence
atggtgggcaagagccagcagaccgacgtgatcgagaagaagaagcacatggcaatacccaaatcctctagccctaaggccacacaccggatagggaataccagcggaagtaaggggtcatatagtgctaaagcatatgagtctataagagtgagcagcgagctgcagcagacctggacaaaacgcaagcacggtcaggaaatgacgagcaagtcacttcaaaccgacacaatcgtagaagagaagaaggaggtaaagctggtggaggagacagtggttcctgaggaaaagtctgcagatgttagagaagccgcaatcgaactgcctgagtccgtgcaggacgttgaaatccctccaaatatcccatcagtgcagctaaagatggataggagccagcagactagtaggaccggctattggacgatgatgaacattccaccagtggaaaaggtcgacaaagaacaacagacctactttagtgagagtgaaatcgtagtcatctctcgacccgactcttcttctaccaaatctaaggaagacgcactgaaacacaaaagcagcggtaaaatcttcgcgagcgaacacccagagttccagccagccacgaactcaaacgaagagattggccaaaaaaacatcagccgcactagtttcactcaggaaaccaagaaggggcctcccgttctgctggaagacgagttgcgggaggaggtaaccgttcctgtggtgcaggaaggtagtgcagtgaagaaagtcgcttctgcggaaatcgagccaccctcaacggagaagttcccggccaagatccaacctcccctggtggaggaagccaccgctaaggctgaacctaggcccgccgaggagacacacgttcaagtccagccgagtacagaggagactccagatgctgaggccgccacggccgtggcggagaactcggtcaaagtgcagccacctccggcagaggaagcgcccctggtggagtttccggctgaaatccaaccacccagtgcagaagaatctccatcagtggaattattggccgagatcctcccaccctctgccgaggagtctccctcggaggagccaccagctgagatcttgcccccgcctgccgaaaagagtccttcagtggagctgttgggagagattcgctcccctagtgctcagaaagcacccatcgaggtccagccccttcctgctgagggcgcgctcgaggaagctccggcaaaagtggaacctcctacagtggaggagacactcgccgacgtgcagccgctgctcccagaagaggctccaagggaggaagcgagggagctccagctcagcaccgcgatggagacacccgcggaggaagctcctacagaatttcagagtccattgcccaaggagacaaccgctgaggaggcctctgccgaaatccagctgctcgccgcaacagagccgcccgcagacgagacacctgcagaggccaggagtccgttgagtgaagaaacatcagctgaggaggctcatgccgaagttcagagcccactcgcggaggagaccaccgcagaagaagcttctgccgagattcagctgctggctgctattgaggctcctgccgacgaaaccccagcagaagcccagagcccactctctgaggagacatccgcagaggaggcgcctgcagaagtccagtcaccatcagccaagggcgtgtcgatcgaagaagcccccctcgagctgcaacccccatccggcgaagagacgacagccgaggaggcgtccgccgccattcagttgctggccgctacagaagcttctgcagaggaagcacccgccgaggttcagccaccacccgctgaagaggcgcccgctgaggtgcaaccccccccggcagaggaagctcccgccgaggtgcaacctccccccgctgaagaggcccccgcagaagtgcagccacctcccgccgaggaagctcctgctgaagtgcagccacccccggccgaggaagccccggccgaagtgcagccgcctcctgcagaggaggccccagcagaagtacaatctcttcccgcagaggaaacacctattgaagaaaccctcgcggccgttcattctcctccagccgatgacgtcccagccgaagaggcctctgttgacaagcattcgcccccagcagacttgttgctaaccgaggaatttccaattggcgaagcgtcagccgaagtcagcccaccgcctagcgagcagacgcccgaagacgaggccctcgtcgagaatgtgtctacagagtttcagtccccccaggtggccgggatccctgctgttaaactggggtctgtagtgctagaaggggaggccaaatttgaggaggtgagcaaaatcaactcagtactcaaggacctctccaacactaacgacggccaagcccctaccctagaaattgagtccgtgtttcacatagagctgaagcagcgccccccggagctgtag

SEQ ID NO: 187893 - DNA, 2157 bp, Artificial Sequence
  Description of Artificial Sequence: Synthetic coding sequence
atggtgggcaagagccagcagaccgacgtgatcgagaagaagaagcatatggcgatccctaaaagcagcagcccaaaagccacacaccgaattgggaatacctcagggagtaaaggtagctacagtgccaaagcatatgagagcatcagagtttcatcagaactgcagcagacatggaccaagaggaaacatgggcaggaaatgacgtctaagagtctccaaaccgacacgatcgtggaggaaaaaaaggaggtgaagcttgtcgaagaaacggtggtgccagaagagaaaagcgcagacgtccgcgaagctgcgatcgagttaccagagagcgtccaggacgtggagatccccccaaacattccttctgtgcagctgaagatggatcggagccagcaaacaagccgcacaggatattggactatgatgaacatcccgcctgtcgaaaaagtggataaagagcagcaaacctatttcagcgaatcagagatagtcgttatttctcgccccgattcctcctctacaaaatcgaaggaggatgccctgaaacacaagtcgtcaggtaagatctttgcttctgaacaccccgagtttcaacccgcaaccaatagcaatgaggaaattggacagaagaatatatcacgaacctctttcactcaggagaccaagaagggacctcctgtgcttctcgaagacgaactgcgggaggaggtgaccgtgcccgtagtccaggagggcagcgccgtaaagaaagtagcatctgctgaaatcgaacctccgtctaccgagaagttcccagctaagatccagccgccacttgtggaagaggctacagccaaagccgaacctcgccccgctgaggaaactcacgttcaggtacaaccttccaccgaggagactcctgacgcagaggcagctaccgctgtggctgaaaatagcgtgaaggtgcagccacctcctgctgaggaagcccctctggttgagttcccagctgaaatccaaccccccagcgccgaagagtcaccttccgttgagctactggcggaaatcttgccaccctctgccgaagagtctccgtccgaagagccgccagcagagatcctaccaccgcccgcagagaaatcaccaagcgtcgagctgcttggcgagattcggtctcccagcgcccagaaggcccctattgaagtgcaaccactcccggcggaaggagcgctcgaagaagctcctgccaaagtggaacctcccaccgtggaggaaaccctagccgatgtgcagccattactgcctgaggaggctcctagagaggaggcaagagaactccagctgagcacggccatggaaacacctgccgaagaggcaccaactgagtttcaaagtccactccccaaagagacaacggctgaggaggccagtgcagaaatccaattgctggccgccaccgagacttctgcggaggaggctccagcagaagttcagtccccctcagcggaagaagcgccagcggaggtgcagcctccacccgccgaagaagcccctgcagaggttcaacccccaccagcggaggaagcgccagcggaagtgcagcccccccccgccgaggaggcacctgccgaagttcagcctccacccgccgaggaggcgcccgcggaggtccagcctccacccgctgaggaagcaccagctgaggtccaacccccgcctgctgaggaggcgcctgctgaagtgcagagcctcccagccgaagagacccccatcgaggagactctggctgctgtccacagtcctccagccgacgatgtgcccgccgaggaggcgtcagtggacaagcatagcccacccgccgaccttttgctaacagaagagttcccaatcggagaggcaagtgccgaggtcagccctcccccatcggagcagaccccggaagacgaggccctagtggagaacgtttcaacagagtttcagtccccccaagtggctggcatcccagccgtgaaactgggcagcgtggttctggaaggggaagccaagttcgaggaggtgagcaaaatcaattctgtcctgaaagacctgagtaataccaacgatggacaggctccaactctggagattgaatccgttttccacatcgagctgaagcaaagaccacccgaactatag

SEQ ID NO: 187894 - DNA, 2052 bp, Artificial Sequence
  Description of Artificial Sequence: Synthetic coding sequence
atggagcgggccgcccccagccggcgggtgcccctgcccctgctgctgttaggaggtctggcactgttggctgcaggtgttgacgctgatgttctgctggaagcgtgctgtgcagatggccacagaatggctacccaccaaaaagactgctctctgccatatgcaacagaaagcaaggaatgtaggatggtgcaggaacagtgctgccactcccagctggaagaacttcactgcgccacaggtatttctctggctaatgaacaggatcggtgcgcaaccccacatggtgacaacgccagcctagaagctactttcgtgaagcggtgttgtcactgctgcttattggggagggccgctcaggctcagggacagtcttgtgagtattccttgatggtagggtatcagtgcgggcaagtgtttcaggcgtgctgcgtaaaatcacaggaaacaggtgacctggacgtgggggggttgcaagagaccgacaaaattatagaggtggaagaggagcaggaagacccatacctcaacgacaggtgccgcggggggggaccatgtaagcagcagtgcagagacacgggcgacgaggtggtgtgttcatgcttcgttggataccagctgctttccgatggcgtgtcttgtgaggatgtgaacgagtgtataaccggatctcatagctgcaggcttggcgagtcttgtatcaataccgttggttccttcaggtgtcagcgggactcttcatgtggaaccggatacgaattgacggaggataatagctgcaaagatatagacgagtgcgagagcggaattcataattgcttgcctgactttatctgtcagaacacgttgggctctttcaggtgccgtccaaagcttcagtgtaagtctggctttatccaggacgcgctggggaactgcattgacattaatgagtgcctttctatatcagcgccttgtcctattggtcatacctgcataaacacggaaggctcctatacatgtcaaaagaacgtgcctaattgtgggcgcggataccacctcaatgaggagggcacacggtgtgtggacgtagacgagtgcgccccacccgcagaaccgtgtgggaaaggccaccgatgtgtcaattcccctggttcctttagatgcgagtgcaagacagggtactattttgacggcataagtcggatgtgcgttgacgtaaacgaatgccaaagataccccggaaggctttgtggacacaagtgcgagaatactcttggctcatatctttgctcatgtagtgttgggtttaggctgtcagtagatggccggtcttgtgaggatattaatgagtgttctagttctccttgcagccaggaatgtgctaatgtatacggcagctatcagtgctactgcagaagagggtaccagctttcagatgtcgatggcgtcacctgtgaagatattgacgagtgcgcgctacccaccgggggacacatttgctcctaccgctgtattaatatcccgggctccttccaatgctcatgcccgagttcaggataccggctggcacctaacggaagaaattgtcaggacatagacgagtgcgtgaccggaatccacaattgcagcattaatgaaacctgttttaatatccagggaggattccgctgcctcgcctttgaatgtcctgagaactaccgcaggagcgcagcaacgagatgcgagcggctgccatgccacgaaaaccgcgaatgcagtaagttaccactccgcatcacgtactaccatctcagttttccaactaatatacaggctccagcagtggtttttagaatgggcccctcatcagcggtgcccggcgactcgatgcaattggccatcacaggaggcaatgaggagggctttttcactacccgcaaagtgagccctcacagcggcgtggtggcactcactaagcccgtgcctgagccgagagatctgctactgaccgttaagatggatctgagtcgccatggcacagtttccagtttcgtggctaagctgtttatttttgttagtgcagaactgtag

SEQ ID NO: 187895 - DNA, 2112 bp, Artificial Sequence
  Description of Artificial Sequence: Synthetic coding sequence
atggagcgggccgcccccagccggcgggtgcccctgcccctgctgttactgggtgggctggccttgctcgcggctggcgtcgatgctgacgtactgctggaggcgtgttgtgccgatggtcacagaatggccacacaccaaaaggactgcagtctgccatatgctacggagagtaaagagtgtaggatggtgcaagaacagtgttgtcatagtcaactcgaggaacttcactgcgccactggaatttccctggcaaacgaacaggaccgctgtgcaactccgcatggtgacaacgcttctttggaagccaccttcgtcaagcgttgttgccactgctgccttttgggcagggctgcccaggctcagggccagtcatgcgaatattctctgatggtcggctatcagtgtggacaggtattccaggcctgctgtgtcaagtcccaggagacgggtgaccttgatgtgggcggactgcaagaaaccgataagattatcgaggtggaagaggagcaggaggatccatacctgaatgacaggtgcaggggagggggaccatgcaaacagcagtgtagagacaccggagacgaggtagtctgcagctgtttcgttggctaccagcttctgtcggatggggtgtcctgcgaagacgtgaatgaatgtattacaggcagccactcttgtaggttaggggaaagctgtattaacacggtgggatcatttaggtgccaacgggattcgtcatgtggcactgggtacgagctaactgaggataattcatgcaaagacattgatgagtgtgagtcaggaattcacaattgtttaccagactttatttgccagaatacgctcggtagttttcgatgtcgtccaaagctgcagtgtaagtcaggattcatacaggacgcgctgggcaattgcattgacattaatgagtgcttgtccattagcgcaccctgccccattggccacacatgtatcaataccgaaggctcctacacgtgccaaaagaacgtccctaattgcggcagaggctaccatctgaacgaagagggaactcgctgcgtcgacgtcgacgagtgtgctccccctgccgaaccttgcgggaagggacacagatgtgtgaatagccctggatctttcaggtgcgagtgtaagaccggatactatttcgacggcattagtaggatgtgcgtagatgtgaacgaatgccaaagatatcctggtcgactctgcggtcacaaatgtgaaaacacgttaggctcttatctttgttcatgctccgttggattccgactttccgtagatgggcgtagctgtgaggacatcaatgagtgctcatcctccccgtgttcccaggagtgtgcaaatgtgtacggatcataccagtgctactgtagacggggataccagttgtcggacgtggatggcgtgacttgtgaagatatcgacgagtgtgccctcccaaccggtggacatatatgtagctaccggtgtataaacattcctggctcatttcagtgctcgtgtccatctagcgggtatcgtctcgccccaaatgggagaaattgccaagacatagatgaatgcgtgacagggatccacaattgtagcattaatgaaacgtgtttcaatattcaaggcggttttcgctgccttgcttttgagtgccccgagaattataggaggtcagccgccaccctgcaacaggaaaaaacagacaccgtgcgttgcattaaatcctgccgcccaaatgacgtcacatgtgtcttcgatcctgtccatactatttctcataccgttatttccctcccgacgtttcgagagtttacccgccccgaggaaatcatctttcttagggcaattactcctccccatcctgcgtcacaggcaaacatcatctttgatatcaccgaaggcaacctgagggacagttttgacataatcaaacgctacatggacggtatgactgtcggcgtcgttaggcaagtgcgcccaatcgttggcccctttcatgcagtcttgaagctagaaatgaattatgtggtggggggtgtggttagccatcgaaatgttgtgaacgtccacatctttgtaagcgaatactggttctag

SEQ ID NO: 187896 - DNA, 1701 bp, Artificial Sequence
  Description of Artificial Sequence: Synthetic coding sequence
atggagcgggccgcccccagccggcgggtgcccctgcccctgctgcttctaggagggttagctctgctggctgccggagtggacgccgatgtcttgctagaggcctgttgcgcggatgggcaccggatggctactcaccagaaggattgttctcttccctacgccactgaaagtaaagaatgtcgtatggtgcaggagcagtgctgccattcccagctggaggaattgcactgcgccaccggaatttcattggccaatgaacaagaccgttgcgctacacctcatggagataatgccagcctcgaagccacatttgttaagcggtgctgtcattgctgcctgttgggacgcgccgctcaggctcagggccaaagctgcgagtatagcctgatggtgggctatcagtgcgggcaagtttttcaggcttgctgtgtcaaaagccaggaaacaggagatctcgatgtcggaggtctgcaagagaccgataaaattattgaagttgaagaggaacaagaagacccatacctaaacgatcgatgccgaggcggcgggccttgtaaacagcagtgtcgggatacaggagatgaggttgtgtgttcttgttttgttggataccaactcctttctgatggcgtgtcgtgcgaggacgtcaatgagtgcataaccggaagccacagctgtcgcctgggcgaaagttgcattaacacagtcggctcctttcgatgtcagagggactcttcatgtggtacaggctacgagttgactgaggataactcgtgtaaagacatcgatgagtgcgagtccggcattcacaattgtctgcctgactttatctgccagaatacactgggatcttttcgatgcaggccaaagctccagtgtaaaagtggttttatccaggacgccctgggcaattgcatagatattaatgagtgcttaagtatttctgcaccatgcccaattggacacacatgcatcaatactgagggcagctatacctgtcaaaaaaacgtgccaaattgcggtcgcggctatcatcttaatgaagaagggacccggtgtgtagacgtggacgaatgtgccccccctgccgagccatgtggcaaagggcacaggtgcgtgaactccccaggatccttcagatgcgagtgcaaaacaggctactacttcgacggaatctcgcgcatgtgcgtggacgtgaatgagtgccaacgctaccccgggcgtctctgtgggcacaaatgcgagaacacactgggctcctacctgtgttcttgcagcgtgggttttcggttgagcgttgacgggaggagttgcgaggacattaatgagtgctcttcttcaccgtgttcccaggaatgcgcgaatgtctatggcagctatcagtgctattgccggcggggatatcagctgagcgatgtcgacggagtgacgtgcgaggatatcgacgaatgcgccctccctacgggtggacacatttgttcataccgctgcatcaatattccgggatcattccagtgctcctgccccagctctggatacaggctggcgcccaacggcaggaattgtcaggacatagacgagtgcgtgaccggaatccacaattgtagtatcaatgagacctgctttaacatccagggcggcttccgatgtctagcctttgaatgccccgagaattaccgtagaagtgcagcaacatag

SEQ ID NO: 187897 - DNA, 2112 bp, Artificial Sequence
  Description of Artificial Sequence: Synthetic coding sequence
atggagcgggccgcccccagccggcgggtgcccctgcccctgctgctgttaggaggactggctctgcttgcagccggggttgatgctgatgtgttactggaggcgtgttgtgcagatggccatagaatggccactcaccagaaagattgtagtctcccctacgcgaccgagtctaaggagtgtcgcatggtgcaagaacagtgttgtcactcccaattggaggaactgcactgcgctacagggatcagtctggcaaatgagcaggacaggtgcgctactccacacggcgataacgcgtctctcgaagccactttcgtgaagcgatgctgccattgttgtctcctcgggagggccgcccaggctcaggggcagtcttgcgagtattcgttaatggtaggctatcagtgtggccaggtgttccaggcatgctgtgtgaagtcgcaggaaaccggtgatctggacgtgggcgggttgcaggaaacagataagatcatcgaagtagaggaggagcaggaagacccctatctgaatgacagatgcagaggaggcggtccctgcaagcaacaatgtagggataccggggacgaggtcgtgtgttcttgctttgtggggtaccaactcctatctgacggggtgagttgcgaggatgtaaacgaatgtattacaggctcacactcatgccgcctgggcgagtcatgcataaatacagtgggatcatttcgctgccagagggatagctcttgcggcacaggatatgaattgaccgaggataattcctgtaaagatatcgacgagtgcgagtctggcattcacaactgcctaccagatttcatttgccagaatacactaggaagtttcagatgtagaccgaagttgcagtgtaagagcggttttattcaggacgccctggggaattgcatcgacatcaacgagtgtcttagcattagcgccccttgccccatcggacatacctgtataaacactgaaggatcgtacacctgccagaaaaacgtgccgaactgtgggaggggatatcatctcaatgaggaggggacaaggtgcgttgacgtggatgagtgtgccccccctgcagagccgtgcggtaaaggccacaggtgcgtcaacagtcctgggtcattccggtgtgaatgcaaaaccgggtactactttgacggaatttcgcgaatgtgcgtcgatgtcaatgaatgccagaggtacccaggtcggctgtgcggtcataagtgcgaaaacacgttgggttcatatctgtgctcttgcagtgtgggattccgcctatccgttgatggacgctcatgcgaagatataaacgagtgtagctccagtccttgttctcaagagtgtgccaatgtctatggctcgtatcagtgctactgtaggcgcgggtatcagttatctgatgtggatggtgtgacctgtgaagatatagacgagtgcgcgctgcccaccggaggacatatctgctcctaccggtgtattaacatacccggctccttccaatgttcgtgcccgagctctggctatagactggcccccaatggtaggaattgccaggatatagatgagtgtgtcactggaattcataactgtagtatcaacgagacctgctttaacatccagggtgggttcagatgtttggcttttgagtgtcctgaaaactacagaaggagtgctgctactcaaaaatctaaaaaaggaagacagaacacacctgcaggcagttccaaggaggattgtcgggtgctgccctggaaacagggtctggaggacacacacctggacgcatatctgccctgctgccggcgttttacgaggcccgaggaaattatattcttgcgagctatcacaccgcctcatcccgcatcacaggctaacattatattcgacattaccgaggggaacttacgtgatagctttgatattattaaaagatacatggacgggatgactgtgggggtggtcagacaagtgcgccctatagtcggaccatttcacgcagtcctgaagttagaaatgaactatgtggtgggtggggtggtatcccacagaaatgtggtcaacgtgcatatttttgtctccgagtactggttctag

SEQ ID NO: 187898 - DNA, 2166 bp, Artificial Sequence
  Description of Artificial Sequence: Synthetic coding sequence
atggagcgggccgcccccagccggcgggtgcccctgcccctgctgctactggggggcctggcactgttagccgccggggtggacgctgacgttctgcttgaagcttgctgcgccgatggacataggatggccactcatcagaaagactgttctctgccctacgcgaccgaatccaaagagtgcagagcagtgggactcgcatccctgtgccaggatctgaacggcgcttgggctgtgtggaaggtcggccgggcatcacaggccgaggggacagcctctgcgagggcacaacgcagggggatggttcaggaacagtgttgtcacagccagctcgaggagcttcactgtgccaccggaatttccttagctaacgagcaggacaggtgcgccaccccccacggcgataatgcctccttggaagccacatttgttaagcggtgctgtcattgttgtttactgggaagggctgctcaggcacagggccagagttgtgaatacagtctgatggtcggctaccaatgcggccaagtgttccaggcgtgttgcgttaagagtcaagagaccggagatcttgacgtggggggcctgcaagagacggacaagatcatcgaagtcgaggaggagcaggaggacccatacttgaacgacaggtgccgcggtggcggaccttgtaaacagcagtgcagagataccggggacgaggtggtgtgtagctgcttcgtcggctatcaattgctctccgatggcgtcagctgcgaagacgtcaatgagtgtataaccggttcccatagttgtagactcggagaaagctgtatcaacacggttgggagcttccggtgtcagagggattcgtcatgcgggactggttacgagcttactgaggataattcctgtaaggatattgatgagtgcgaaagtggaattcataactgtctgccagattttatctgccagaacactctaggttcttttaggtgccggcccaaactgcaatgcaagagcgggtttatccaggacgctctgggcaattgtattgatatcaacgagtgcttaagtatatctgccccatgtcctattggccacacgtgcataaataccgagggtagttacacctgccagaagaacgtgcccaattgcggtcggggatatcaccttaacgaagaagggacgcgttgcgtcgacgtggatgaatgtgccccccctgcagaaccctgcggtaaaggccataggtgcgttaattctccaggatcctttcggtgtgagtgtaaaactggctactatttcgatgggatctcgagaatgtgcgtggatgttaacgaatgccagagatacccaggacgtttgtgtggacacaaatgtgaaaacactcttggcagttatttgtgtagctgttccgtgggatttagactgtccgtagatggcagatcttgtgaggatatcaacgaatgctcaagctccccatgctcccaggagtgtgccaacgtatacggttcttatcagtgttattgtcgccgaggctaccagctcagcgatgtggatggcgtcacatgtgaagacattgacgaatgcgccctccctaccgggggccacatctgttcgtacagatgcataaacatacccgggtcttttcagtgctcttgtcctagttccggataccgtctagccccgaacggccggaattgccaagacatcgacgagtgtgtcaccggcatccacaactgctctattaatgaaacctgtttcaacatccaaggaggattccgatgtctagccttcgaatgccccgaaaactatcgtagatcagccgcaacgagatgcgaacggttgccctgtcatgagaatcgagaatgcagtaaattacctctgagaattacctactatcacctcagctttcctacaaacatccaggcgcccgccgtggtgtttcggatggggccttcatctgcagtacccggggatagtatgcagttagccatcacaggggggaacgaggagggattttttacaacgcgtaaggtatcacctcattcaggagttgtggccctgaccaaaccagtgccagaaccccgagatctcctgctgacagttaaaatggacttgtcaagacacggtaccgtgagtagtttcgtggccaaactcttcatctttgtgtcagccgaactctag

SEQ ID NO: 187899 - DNA, 570 bp, Artificial Sequence
  Description of Artificial Sequence: Synthetic coding sequence
atgaacagctacacccggggcagccggcggcccagcgccaaggccgctagccctgctgccagcgtgacgtctcgggtgtcacccagcggccctggcgtgcctgtggacgcagacgtcctgctggaggcatgctgcgcagatggtcaccggatggctacccaccagaaggactgcagtctaccctacgccaccgagtctaaagagtgtcggatggtccaggaacagtgctgtcattcccagctagaggagctgcattgtgccacaggcataagtttagccaacgagcaggatcgttgtgccacccctcatggagacaatgctagtctggaggccacctttgtaaaacggtgttgccactgttgtctgctgggccgggcggcacaggcccagggccaatcttgtgagtactctctaatggtgggttaccaatgtggccaggtctttcaggcctgctgcgtgaagagccaggaaacgggggacctggacgtgggcgggctacaggaaactgataaaataattgaagtagaggaagagcaggaagatccctatttgaacgaccgctgtaggtag

SEQ ID NO: 187900 - DNA, 81 bp, Artificial Sequence
  Description of Artificial Sequence: Synthetic coding sequence
atggccacccaccagaaggactgcagcctgccctacgccaccgagagtaaagagtgccggatggttcaggaacagtgctag

SEQ ID NO: 187901 - DNA, 1806 bp, Artificial Sequence
  Description of Artificial Sequence: Synthetic coding sequence
atggagcgggccgcccccagccggcgggtgcccctgcccctgctgctgttgggggggctagcactgcttgcagccggggtggatgctgacgtgctgctcgaggcttgctgcgccgacggacataggatggccacgcatcagaaagactgttcactcccttatgccactgaaagcaaggagtgtcgcatggtgcaagagcaatgttgccacagccagctcgaagagttacactgtgctacaggaatctctttggctaatgagcaggatcgatgcgcgaccccccacggggataacgcatccctggaggcaacatttgtgaagcgctgctgtcattgttgcttgcttggccgagctgcccaggctcaaggccaatcttgtgaatattcccttatggtgggataccagtgcggacaggtgtttcaggcttgttgtgtcaagtcacaggaaacaggtgatctcgacgtgggaggactgcaggagaccgacaaaatcatcgaggtggaggaggaacaagaagatccctatctgaatgaccgctgcagaggaggaggtccctgtaagcagcaatgccgggacacaggcgacgaggtagtgtgcagctgttttgtcggctaccagctcttatccgatggcgtctcatgcgaggatgtgaatgagtgtatcactggttcccatagttgtaggctgggggaaagttgcattaacactgtagggtcatttcggtgccagcgagacagcagctgtggcacggggtacgaactaacagaggataattcctgcaaggacattgatgagtgtgaaagtggcattcacaattgtttaccagatttcatttgccaaaatactttgggaagcttccggtgccgtcctaagcttcaatgtaagagcggctttattcaagacgccctcgggaactgtattgacattaacgagtgtctgagtatttccgccccatgcccaataggccacacatgcattaacaccgagggatcgtatacttgccagaagaacgttcctaactgtggacgcgggtatcaccttaacgaagagggcactcgctgcgtggacgttgacgagtgcgcacctcctgcagaaccatgtgggaaaggccaccgctgcgtgaattccccagggtcattccgctgcgagtgtaagaccgggtactactttgacggaataagtaggatgtgtgtggacgtgaacgaatgtcaaaggtaccccggtaggctgtgtgggcacaaatgcgaaaatactctgggctcctatttgtgttcgtgctccgtcggttttcgactttctgtagacggcagaagctgtgaggacatcaacgagtgtagtagttcaccctgctcacaggaatgcgctaatgtctacggcagctaccagtgttattgtagacggggataccagctctccgatgtcgacggtgtgacttgtgaggacattgatgagtgtgccctaccgaccggcggccatatttgcagctatcgatgtataaatattcctggttcattccagtgtagctgcccatcatccggctatcgactggccccgaacggacgcaactgtcaggatattgacgaatgcgttacaggcattcataactgcagtatcaatgagacatgctttaacattcaaggtggttttcggtgtttggccttcgagtgccccgagaattaccgacgcagcgccgccacacagaagtctaaaaaaggacgccaaaacacaccagcaggctcaagcaaggaggattgccgtgtgctgccctggaagcagggcttggaggatacacatctggatgcatag

SEQ ID NO: 187902 - DNA, 198 bp, Artificial Sequence
  Description of Artificial Sequence: Synthetic coding sequence
atggccacccaccagaaggactgcagcctgccctacgccaccgagtccaaggagtgtcggatggtgcaggagcagtgctgccattcccagctggaggagttgcattgtgccaccggaatcagcctggccaatgaacaggatcgctgtgcaaccccccatggggacaatgcttcccttgaggcgacctttgtgaagtag

SEQ ID NO: 187903 - DNA, 546 bp, Artificial Sequence
  Description of Artificial Sequence: Synthetic coding sequence
tgccggatggtgcaggagcagtgctgccacagccagctggaggagcttcattgcgcaactggcatctctctggccaacgaacaggacaggtgcgctactccgcacggagacaacgccagccttgaggccaccttcgtgaagcgatgctgccactgttgcctcctagggcgggccgctcaggctcaggggcagtcctgtgagtacagccttatggttggataccagtgtgggcaggtgttccaggcttgctgtgtgaaatcccaggaaacgggcgaccttgacgttggcggactgcaggagaccggaggcggcccttgcaaacaacaatgtcgagatacaggagacgaagtggtgtgttcgtgctttgtgggttaccagttgttgtccgacggggtatcctgtgaggatgtcaatgagtgtataaccggtagccactcctgtaggctgggtgagtcatgcatcaatacggtgggtagcttccggtgccagagggactctagttgcggcaccggctatgagctgaccgaggacaatagctgcaaatag

SEQ ID NO: 187904 - DNA, 420 bp, Artificial Sequence
  Description of Artificial Sequence: Synthetic coding sequence
atggccacccaccagaaggactgcagcctgccctacgccaccgagtcaaaggagtgtagaatggtccaggaacagtgctgtcatagccagctcgaggagctgcattgtgcaacggggatatccctcgcaaacgaacaggaccgctgcgccaccccacacggtgacaatgcaagccttgaagctactttcgtgaaacggtgttgccattgttgtctgttgggacgtgccgcgcaggcacagggacaatcctgtgaatactcactaatggtgggctaccaatgcgggcaggtgttccaggcatgttgcgttaagtctcaggaaaccggtgacctggatgttggtggacttcaagaaacagacaaaattatagaagtggaggaagagcaagaggacccttacctaaacgataggtgccgctag

SEQ ID NO: 187905 - DNA, 519 bp, Artificial Sequence
  Description of Artificial Sequence: Synthetic coding sequence
atggagcgggccgcccccagccggcgggtgcccctgcccctgctgctgctcggcggacttgcgttactggccgcaggggttgatgcggatgtgctgctggaggcctgttgcgccgatggccatcggatggccactcaccagaaggactgcagcttgccttacgctaccgagtccaaagaatgtcggatggtgcaagaacagtgctgccactcccaattggaggagctgcactgtgcgaccggcattagtctggcaaacgagcaagacaggtgcgctaccccacatggcgacaacgcaagcttggaagccaccttcgtcaaaagatgctgccattgctgtctcctgggacgggcagcccaggcccaaggacagtcctgtgagtacagccttatggtcggataccagtgtggtcaagtttttcaggcctgttgcgttaagtcccaggagaccggagatctggacgtcgggggcttgcaggagacgggcgggggcccttgtaagcagcagtgcagagactag

SEQ ID NO: 187906 - DNA, 3555 bp, Artificial Sequence
  Description of Artificial Sequence: Synthetic coding sequence
atggtgctgctgtgggagcccgccggcgcctggctggccctgggcctcgcactcgcattaggcccaagcgttgcggccgccgctccacgtcaggactgtacaggggtcgagtgcccccccttggagaattgtatagaggaggccttggaacctggtgcttgctgcgccacctgtgtgcagcaggggtgtgcatgtgagggataccagtattatgactgcctccagggcggctttgtgcgcggccgcgtgcctgccggtcagtcgtactttgtggattttggatcaacggaatgctcttgtcccccgggtggggggaagatctcctgtcagttcatgctttgtccagaactgccaccgaattgcatcgaagctgttgttgtggccgattcctgcccgcagtgtgggcaagtgggttgtgtgcatgccggtcataaatatgctgctgggcataccgtgcacctgccgccttgtagggcctgccactgccccgatgctggtggcgaactgatatgctatcagctgcccggctgccatggaaacttctcagatgcagaggagggcgatcccgaaagacactatgaagatccatattcttacgatcaagaagtcgcggaggttgaggcagccacggcactcggtggcgaagtccaggccggcgccgtccaggctggggcaggaggaccaccggccgcgctgggtggaggcagtcagcctctgtcaaccatccaggcccccccttggcccgcagtgctcccgcgccctacagccgccgccgcactaggtccaccagctcctgtgcaggccaaagcgcgacgggtgaccgaagattcggaggaagaagaagaggaggaggaagagcgcgaagagatggcagtgactgaacagcttgcggccggcggtcatcggggacttgatgggctacctaccaccgccccagctggaccttcgctccccatccaggaggagcgggcggaggctggtgcccgagcggaggccggcgcccggcccgaggaaaacctgatactggacgcgcaggctaccagcagatcgacaggacccgagggcgtcacacatgccccaagtcttggtaaagccgccctcgttccaacccaggccgtgccgggtagcccccgcgaccccgtgaagccctccccacacaacattctctcaacatccctccccgacgcagcctggatcccaccaactcgtgaagttccaaggaagccacaggtcttgccacattcacacgtcgaagaggacacagacccaaacagcgtgcacagcataccccgctcatcccccgaaggctcgactaaggacctgatcgagacttgttgtgccgccggtcagcagtgggcaatcgacaacgacgagtgtctggagattcccgaatctggcacagaggacaatgtctgtaggactgctcaacgccactgttgcgttagttacctgcaagaaaagtcatgtatggcaggtgttctgggggccaaagagggggagacatgcggtgctgaagacaatgattcatgcgggatatccctatacaaacagtgttgcgattgctgcggcctcggattgagagtgcgggccgaaggtcagtcatgtgaatctaacccaaaccttggatacccatgcaaccatgtaatgttgagctgttgtgaaggtgaagagcctcttatagttccggaggtacgtagaccccctgaaccggcggccgcccctagaagggtaagcgaagcagagatggcaggccgggaggcgctgtcactcggtactgaggccgaactaccgaacagcttgcccggagatgaccaagatgaatgtctcctgctgcccggtgaactttgccaacatctgtgtatcaatactgtaggatcttaccactgtgcctgctttcccggcttttctctgcaggatgacggaagaacctgtcggcctgaaggacatcccccacagcctgaagccccacaggaacctgcactgaaatccgagtttagtcaggttgcctccaacacaatccccttaccattgcctcagccaaatacctgtaaggacaatgggccttgtaaacaggtatgttctaccgtcggcggctctgccatttgcagctgtttccctggctacgcaataatggcagacggagtgtcttgcgaggacatcaacgagtgcgtgactgatctgcacacctgctccaggggagagcactgcgtgaacacactgggttccttccattgttacaaagctctcacatgcgagccagggtatgctcttaaggacggcgagtgcgaagacgtggacgagtgtgccatgggcacgcacacctgccagcccggattcttgtgccaaaatacaaaggggagtttttactgtcaggccagacagcgctgtatggacgggtttctgcaggacccagagggtaactgcgttgatatcaatgagtgcacatccctgagcgaaccatgccgccccggctttagttgcatcaatacagtcggttcatacacttgtcaacgaaaccccctgatttgcgctcgaggttaccatgcatcggatgatggcacaaaatgcgtggacgtgaatgagtgtgagacaggagtgcatcggtgcggggaaggacaggtatgtcacaacctcccaggctcatatcgctgtgactgtaaggcaggctttcaaagggacgcgttcggcaggggatgtattgacgtgaatgagtgttgggcctcgccagggaggctgtgtcagcacacttgtgaaaatacacttggaagctatagatgctcctgcgcttccggctttctgttggccgccgatggcaagagatgcgaagatgtcaatgaatgcgaagcccaaagatgctcacaggaatgcgcaaacatttatgggtcttatcaatgctattgccgacagggctaccagttggctgaagacggccatacatgcactgacattgacgaatgcgctcaaggcgctggtatcctgtgtacgtttcgatgcttaaacgtgcctggctcataccaatgtgcttgtcctgagcagggatacacaatgactgcaaatggccggtcctgcaaagatgtggacgagtgcgctcttggcacacataactgttctgaagccgagacctgccacaatatccagggatccttcagatgtttgcgctttgagtgtccacccaattacgtgcaggtgagcaaaactaaatgtgaacgaacaacctgtcatgattttttggagtgtcaaaattcgcctgcacgaattacccattatcagctcaacttccagactggtctgcttgtgcccgctcacattttccgcataggtcccgctcctgccttcaccggagacacgattgccctaaatatcatcaagggtaacgaggagggctacttcgggacccgcaggcttaatgcctacactggcgtcgtctatcttcagcgagccgtcctggagccgcgagatttcgccctcgatgtggaaatgaaactctggcgacaaggttcagtcaccactttcctagctaagatgcacattttcttcacgaccttcgctttatag

SEQ ID NO: 187907 - DNA, 3696 bp, Artificial Sequence
  Description of Artificial Sequence: Synthetic coding sequence
atggtgctgctgtgggagcccgccggcgcctggctggccctgggcctggctctcgccttgggaccgtccgtcgccgcagccgcgcctagacaggactgcactggtgtcgaatgtcccccgctcgagaactgcatcgaagaggcgctcgaaccgggcgcttgctgtgccacgtgcgttcagcagggctgcgcctgcgaaggataccagtactatgattgccttcagggagggttcgtacgcggaagagtgcctgctggtcagtcctattttgttgattttggctccaccgagtgtagctgcccaccaggaggtggaaagatctcatgccaattcatgctgtgccccgagcttccgcccaattgtatcgaagctgtggtcgtggcagattcttgccctcagtgtggccaggttggatgcgtccacgcggggcacaagtacgccgctggtcataccgtacatctgccaccatgcagggcatgtcattgtcctgatgccggaggcgagttgatttgctaccagctaccgggttgccacggcaacttttccgacgccgaagagggagatccggaacgacactacgaagacccttacagctacgatcaggaagtcgctgaggtcgaggcagctaccgccttggggggcgaagtgcaggctggtgccgtgcaggccggcgcaggaggcccacccgcggctctgggcgggggaagtcagccgctgagcaccattcaggcccccccatggccagccgttctgcctaggcccacggcggcagccgcgttgggaccgcctgcccccgtacaagccaaagcccgcagagttactgaagacagcgaagaggaagaggaagaggaagaagagagggaggaaatggcagtaacagaacagttagctgccggtggacacaggggtttggacggcctaccaactactgccccggccggacccagtcttcccatacaggaagaaagagccgaggccggcgccagggctgaggctggcgcccggcctgaggagaaccttatcttagatgcgcaggccacatctagatcaactgggccagaaggtgttactcacgccccatcactgggaaaagctgcactggtacctacacaagccgtgccaggtagcccaagagaccccgtgaaacccagtccacacaacattctgagcacatcactgcctgatgcagcatggatcccaccaactagggaagtccccaggaagcctcaggtgctgcctcactcacacgtcgaggaggataccgaccctaattcagtgcattctatcccaaggtcatctcctgagggctccacgaaagacctgatcgagacatgttgtgccgccggccagcagtgggctattgacaacgacgagtgcctggaaatcccggagagcggaactgaagataatgtctgccgcacggctcagaggcattgttgcgtatcttaccttcaggaaaaatcgtgcatggctggtgtgctgggggcaaaagagggtgaaacgtgtggtgctgaagacaacgatagttgtggcatttccttatataagcagtgctgtgattgctgtggcctggggctgcgcgtgagggcagagggacagtcttgcgagagcaacccaaacttgggctacccgtgtaatcatgttatgctaagctgttgcgaaggcgaagagccgctcattgtgcccgaggtccggagacctcccgaacccgccgccgcccctcggcgtgtttcggaggcagagatggccggacgagaggcattgtccttgggaacagaggccgaactgcccaacagtttgccgggcgatgaccaggacgaatgtcttcttctgcccggcgaactgtgtcagcatctgtgtataaacactgtggggtcctatcactgcgcgtgtttccctggtttcagcttacaggacgacggcaggacatgtaggccagaggggcaccccccgcaacccgaggcacctcaagagccagcactgaagtccgaatttagtcaggtggccagcaataccatccccctgccactcccacaacccaatacttgcaaggacaatggcccttgcaagcaggtgtgctcaacagtaggtgggagcgctatctgttcctgctttcctgggtatgcaattatggcggacggtgtctcttgcgaggaccaggacgaatgtttgatgggcgcgcatgactgcagccgccggcagttttgtgtgaacactctgggttcattctattgtgtgaatcacactgtgctgtgtgcagacggatacatcttgaacgcgcacaggaaatgcgtcgatattaatgagtgtgtgaccgacctacatacatgctctagaggagagcactgtgtcaataccctaggctctttccattgctataaagccctgacatgcgagccaggatatgcactcaaggatggcgagtgcgaagacgttgatgaatgtgccatgggaactcacacctgtcaacctggattcctctgtcagaataccaaaggttcgttttactgtcaagctaggcagaggtgtatggatgggtttctacaggaccccgagggcaactgtgtggatatcaacgaatgtacatccctgagcgagccttgtaggcctggattttcctgtattaacacagtgggctcctatacctgtcagcgcaacccccttatttgcgcccggggataccacgctagcgacgacggaactaagtgcgttgacgtgaatgaatgcgaaaccggtgtacatcggtgcggcgagggacaagtctgtcataatctgcccggctcatatcggtgtgattgcaaggcaggcttccagcgggatgctttcggtcggggctgtatcgatgttaacgagtgctgggcttctccaggaagattatgtcagcacacttgtgagaacacattaggatcttacagatgcagttgtgcctctggatttctgttggccgcagacggtaagcgatgtgaagacgtgaacgaatgcgaggcccagcggtgtagccaggagtgtgcaaacatctacgggagttaccagtgctattgtagacaggggtaccagctggctgaagacgggcacacttgcacagacattgacgaatgcgcccagggcgcgggaatcttatgcacctttcgttgtctgaacgtgcctgggtcctatcagtgcgcgtgccctgaacagggctatacaatgacagccaatggccgaagctgtaaggacgtggatgaatgcgctctgggtactcacaattgctctgaagctgaaacttgccacaatattcaaggtagctttaggtgcctcaggttcgaatgtcccccaaactacgtgcaggtgtcaaaaaccaaatgcgagaggaccacttgccacgatttcctggagtgccagaactcacccgctaggataacccattaccagctgaattttcagactgggctgttggtccctgcacacatcttcagaatcgggcctgcaccggcattcacaggcgacaccatcgctttaaacatcattaagggtaacgaagaaggctatttcggcactagaaggcttaacgcctataccggcgtggtttatctgcaaagggccgtgctcgagcctcgggactttgctttagatgtcgaaatgaagctatggagacagggatccgtcacgacctttctggcgaagatgcacattttctttacgacttttgccttgtag

SEQ ID NO: 187908 - DNA, 480 bp, Artificial Sequence
  Description of Artificial Sequence: Synthetic coding sequence
atggtgctgctgtgggagcccgccggcgcctggctggccctgggcctggccctggcattaggccccagtgtggccgccgctgctccaaggcaggattgcacgggagtggagtgtcctcccctggagaactgtatagaagaagctctggaaccgggagcatgttgcgccacttgtgtacaacagggttgtgcgtgtgagggttatcagtattacgactgcctgcagggcggcttcgtaagaggccgcgtgccagctggacaaagttatttcgtcgacttcggatctaccgagtgttcctgtccccccggagggggtaagatcagttgtcagttcatgctttgcccagaactgccacccaattgtatcgaagcggtagtagtagccgactcttgtccgcagtgcgggcaggttggttgtgttcatgcagggcacaagtacgccgccggtcatacagtgcatttgcctccatgcagggcctag

SEQ ID NO: 187909 - DNA, 3696 bp, Artificial Sequence
  Description of Artificial Sequence: Synthetic coding sequence
atggtgctgctgtgggagcccgccggcgcctggctggccctgggcctggcactggcgctcggcccctcggtagcagcggcggcccctaggcaggattgcaccggggtcgaatgccctccccttgagaactgtattgaggaggccttggagcctggggcttgctgcgctacttgcgtccaacagggctgcgcctgcgagggctatcagtactacgattgcctccaggggggctttgttagaggtcgagtaccagccgggcaatcgtactttgtggactttggctccacagagtgttcctgccccccaggtggcggaaagatttcctgtcagttcatgctttgtcccgagcttccccccaactgtattgaggccgtggtggttgcagattcttgccctcaatgtggccaggtcgggtgcgtgcacgctggccacaagtacgccgcagggcatacagtccatctccccccttgccgggcttgtcactgcccagatgctggtggggagttgatttgttaccagcttcccggatgtcatggcaactttagcgatgctgaggagggggatccagaacgccactatgaggacccatattcctatgaccaggaggtagctgaagtggaagcggcgaccgctctcggaggtgaggttcaagcaggggccgtgcaggccggagctggaggtcccccggctgcactgggcggcggttcccaaccactgtctaccattcaagccccaccctggccagcagtgctccctagaccaactgctgccgccgctctaggaccaccagcacccgttcaggcgaaagctagacgcgtgaccgaggattcagaagaggaagaggaagaagaggaggaaagagaagagatggctgtgacggagcagttagcagctggaggccaccgcggcctggacggattgccaacaactgcccctgccggtcccagcctcccaatccaagaggaacgcgctgaggcaggtgcccgtgccgaggcaggtgctaggcctgaagaaaatttgatactggacgcccaggctacatcccgatcaacgggccctgagggagtcactcacgctcctagtctgggaaaagccgcccttgtcccaacacaagcggtgccagggtctccccgcgatccagttaaaccctccccgcacaacatactgagtacgtcactgccggacgccgcttggatcccacccacacgagaggtgccaaggaaaccgcaagtgcttccccattctcacgtcgaggaggacacagatcccaattccgttcactcgatacctcggtcttctcccgaggggtctaccaaagacctcattgagacctgctgtgcggcaggtcagcaatgggccatcgataacgatgagtgtctggaaattcccgagtcgggcactgaggataacgtgtgtcggaccgcccagcgtcactgctgtgttagttacttacaggagaaaagctgcatggctggcgttttaggggctaaagagggagagacttgcggggctgaggacaacgatagctgtggcatttcgctgtacaaacagtgctgcgactgctgtggtttgggtttacgagtgcgtgccgagggtcagagctgtgagtccaatccgaatctcggatatccatgtaaccatgttatgttgtcttgctgcgaaggtgaagagccattgattgtcccggaggtgagaaggccccccgagcccgctgcagctccaaggcgggttagtgaggcggagatggctggcagggaggcgctctcacttggcaccgaagcggagctccctaatagcttacctggggacgaccaggatgagtgcctgctattgcccggagagctctgccagcacttgtgtatcaacacggtggggtcctaccattgtgcatgcttccccggtttctccctgcaggatgacggaaggacctgccgaccagagggtcatccacctcagcccgaggcccctcaagaacctgctctaaaatctgagtttagtcaggtggcctctaacacaattcctctgccactgcctcaaccgaacacatgcaaagataacgggccctgcaagcaggtgtgcagcaccgtgggcggcagcgccatctgctcctgtttccccggttatgccattatggcggacggagtttcgtgtgaagaccaggacgaatgcctgatgggagcacacgactgttctaggcgacaattctgcgtgaacaccctggggagcttctactgcgtgaaccatactgttttgtgtgcggacgggtacatcctaaatgctcataggaaatgcgtggacatcaacgaatgcgtcacagatcttcacacctgttcacgcggagagcactgtgtgaacactttgggcagcttccattgctataaggccctgacctgcgagccagggtacgctctgaaggatggggaatgcgaagatgtcgatgagtgcgctatgggaacgcatacttgtcaacctgggtttctctgccagaacaccaaaggatcattctactgccaggctcgccaacgctgcatggatggattcctgcaggatccagagggcaactgtgtggacataaatgagtgtacaagcctgagcgagccatgccgccctgggttttcatgcattaacaccgttgggtcatacacatgtcagcgcaatcccctaatttgcgctaggggctaccacgcctccgacgacggaactaaatgcgtggatgttaacgagtgcgaaaccggggtccaccgctgtggggagggccaagtatgccataaccttccaggttcttacagatgtgactgcaaagccggtttccaaagggacgcgttcggccggggctgtatcgatgtaaacgaatgctgggcaagccccgggcgtctttgccagcatacctgcgagaatactctgggctcctatcgctgctcatgtgcatcaggcttcctcttagctgccgacggcaaacggtgtgaggacgtgaatgagtgcgaagctcagagatgttcccaggagtgtgcaaatatctatggaagttaccaatgctactgcaggcagggttatcaattggcagaggacggtcacacatgtacggacatcgatgagtgtgctcagggagccggtattctgtgcacattccggtgcctgaacgttcccggaagttaccaatgcgcttgcccggaacaggggtacactatgaccgccaacggcaggagctgtaaagacgtggacgaatgtgccctaggcacccacaactgcagcgaagccgagacttgtcacaatatccagggtagcttccgctgcctgcgtttcgagtgcccccctaactatgtgcaggtgagcaaaaccaaatgtgaacggacaacatgccacgattttttggagtgccagaattcccccgcgcggatcactcactatcaactcaacttccaaaccggactcctggtgcctgctcacatattccggataggacccgcaccagcttttactggcgacaccatcgctctgaatattattaaaggcaatgaagaaggatacttcgggacaaggcggctcaacgcttacactggggtggtctacctgcagcgtgccgtccttgaacctagagattttgctcttgacgtggagatgaaactttggagacaggggtccgtgactacattcctagccaaaatgcacattttcttcacaacttttgccttgtag

SEQ ID NO: 187910 - DNA, 3633 bp, Artificial Sequence
  Description of Artificial Sequence: Synthetic coding sequence
atggagaccagcctgagcctggagagcggccaccacggcagctaccgccgcggcgaccgtcctggactcgcctggaccatggttctgttatgggaacccgctggggcatggctcgctctgggactcgccctggcgctgggcccctctgttgcagcagctgctccacgtcaggattgtaccggcgtcgaatgcccaccactggagaattgcatcgaggaagccctcgagccaggggcgtgttgtgccacctgcgtgcaacagggctgcgcctgtgagggttatcagtattatgattgcctgcagggaggctttgtgaggggtcgagtgccggccggtcagtcctactttgtggatttcgggtcaaccgagtgctcttgtccgcctggaggagggaaaatttcctgtcagtttatgctctgcccagagctccctccaaattgcatagaggccgttgtggttgcagatagttgtccccagtgtggccaggtcgggtgtgtgcatgccggacacaagtatgccgccggacacacggtacaccttccaccgtgccgcgcctgtcactgccccgacgcgggtggcgaattgatatgttatcagttgccaggatgccacgggaactttagtgatgcggaggagggagatccggagcgtcactacgaagacccatacagttacgaccaggaagtggcagaagtggaggcagcgacggctttgggcggtgaggtacaggcaggcgcagtgcaggcaggcgcaggtggccctccagcggccctgggtggaggtagccagccactgtccactatccaggcaccgccttggccggcagtgctgccccggcccaccgcagcagctgctttaggacctccagctccagttcaagcaaaggctagaagagttaccgaagattctgaggaggaggaggaagaggaagaagagagggaagaaatggcggtgacagagcagctagccgcaggcggccacagaggactggacggcttgcctaccacagcccctgccggccccagtctgccgatacaggaagagagggccgaagctggtgctagagccgaagctggtgccagacccgaagagaatctgatcctggacgctcaggccactagcagaagtactggtcccgagggagtgacccatgcaccctcgctgggtaaagctgcgttggtccccacccaagcagtacccgggtccccacgggaccccgtgaagccatctccccacaatatcctttcaaccagtctgcctgatgccgcatggattccccccacacgggaggtgcccaggaagccgcaggttctccctcactctcacgtggaagaagacacagatccgaacagcgtccattccattccccgatcttcacccgaaggctcaactaaggatttgatcgagacctgctgcgcagcaggccagcagtgggccatcgacaacgatgagtgtctcgagatccctgaatctggtaccgaagacaatgtgtgtcgcacggcacagcgtcattgttgcgtgagctatcttcaggaaaagtcctgtatggctggcgttctgggcgccaaggaaggcgagacgtgcggtgcagaggacaatgatagttgcgggatctccctctataagcaatgctgtgattgctgcggactgggactccgtgtacgagccgaaggacaatcttgcgagagtaatcctaatctgggatacccgtgcaaccacgtcatgctgtcgtgttgcgaaggagaggagccacttatagtgcctgaagttcggcggccccctgagccagcagccgctcctagaagagtgtctgaagctgagatggcaggtagagaggctctctctctcggcactgaagcggagctgccaaattcgcttcctggagatgatcaggacgaatgtcttttgctgcccggagagctgtgccagcacttgtgcatcaacacagtcggatcctatcactgcgcctgctttccaggattctccttacaggatgacggtaggacgtgccgacctgaaggccacccacctcagccggaggccccccaagagcctgctttgaaaagtgaattcagccaggtggctagcaacactattcccctccccctgccccaaccgaatacctgcaaagacaacggaccttgcaagcaggtgtgtagcacagttgggggttccgcaatctgttcctgttttcctgggtatgctattatggctgacggggtttcatgcgaagatataaatgagtgcgtgacagatctccacacttgtagccggggggaacactgcgtgaataccctgggatcattccattgttataaggccctgacttgtgagcccggttacgcactcaaggacggcgagtgtgaggatgtggatgagtgcgccatgggcacacacacttgccagcctggctttctgtgccagaacaccaagggctctttctattgtcaggctagacagcggtgtatggatggatttctgcaggatcctgaaggaaattgtgtggatattaatgaatgcaccagcctatctgagccatgccgtcccggcttctcctgtattaacactgtggggtcctacacctgtcagcggaaccccctaatctgcgcccgcggataccacgcatctgacgacgggaccaaatgcgttgatgtaaacgaatgtgaaacaggcgtacatcgatgcggcgaagggcaagtgtgccataatctccctggctcttaccgatgtgactgcaaagctggatttcagagagatgctttcgggagaggttgtatcgacgttaacgagtgctgggcaagccccgggcgtctgtgtcagcacacttgtgaaaacactctcgggtcctatcgctgttcctgcgcctctggatttctccttgcagcagacgggaagagatgcgaagacgtgaacgagtgcgaggcccagaggtgcagccaggagtgcgccaacatctacggatcatatcaatgttattgtcgacagggctatcagttggccgaggacgggcacacgtgtaccgatattgacgagtgcgcccaaggcgctggtatcctttgtacgtttcgatgtctgaatgttccaggatcctatcaatgcgcctgccctgagcaagggtatacaatgaccgcaaatggacgttcgtgtaaggacgtcgatgagtgtgccttaggaactcacaactgttctgaggcagagacatgtcacaatatacagggtagctttagatgccttaggtttgaatgtccccccaactatgtgcaggtttccaaaacgaaatgtgaacggaccacttgtcacgatttcctggagtgccagaactccccagcccgaatcactcattatcaactgaatttccaaacaggactgctggtgccagcccatatcttccgtatcgggcccgcccctgctttcaccggcgataccatcgcattgaacattattaagggcaatgaggagggatacttcggtacgagaaggctaaacgcttatacgggtgtggtgtacctgcagagagccgtactggaaccaagagacttcgcgcttgacgtcgagatgaagctgtggcggcaaggcagcgttacaaccttcctggctaagatgcacatattttttactacgtttgctttgtag

SEQ ID NO: 187911 - DNA, 1347 bp, Artificial Sequence
  Description of Artificial Sequence: Synthetic coding sequence
atgcccggcatcaagcggatcctgaccgtgaccatcctggccctgtgtctgcccagtccgggcaacgcacaagctcagtgcacgaatggattcgacctcgatagacaatctggccagtgtctagacatcgatgaatgtcgaaccattcctgaagcctgtcggggagatatgatgtgtgtcaaccagaacgggggctacctctgcattccaagaacaaacccagtctatcgaggcccttatagcaatccatactcaacaccgtactccggcccgtatcctgccgcagccccgccactttctgcgccaaattatcctacgatcagtcgacctctgatctgtcgatttggctatcaaatggacgaatcaaatcagtgcgtggacgttgacgagtgcgccaccgattctcatcagtgcaaccccactcagatatgcatcaacacggaggggggctacacttgctcctgcaccgacggatactggttgttggaaggccagtgcttggacatcgatgagtgcaggtacggatactgtcagcagttgtgtgccaacgtccctggctcttactcctgtacatgtaacccaggtttcacactcaacgaagatgggagatcatgccaggacgtgaacgaatgcgcaaccgagaatccatgtgttcagacctgcgtcaacacatatggctctttcatttgccgctgtgacccaggctacgagttggaagaggacggcgtacactgtagtgacatggatgaatgcagcttctctgaatttctctgtcagcatgagtgcgtgaatcagcccggaacctacttctgcagctgcccacctggctatatcctactggatgataaccggagttgccaggatattaacgaatgcgagcaccggaatcacacatgcaatttgcaacagacctgttataatcttcagggtggatttaagtgcattgaccctattagatgcgaagagccctacctgagaatcagcgacaacagatgtatgtgtcctgcagaaaacccaggttgccgcgatcaaccgtttacaatcctttacagagacatggacgtggtgagcggtcggtccgtgcctgcggatatattccaaatgcaggccacgacaagataccctggtgcctattacatcttccaaattaagtccggtaacgagggaagagagttctatatgcgccagaccggacctatttccgctacattggtgatgacccgccctattaagggacctcgcgaaatacagcttgacttagagatgatcaccgtcaataccgttatcaacttcagagggtcgagtgtgataagacttagaatctacgtttcacaatatccattttag

SEQ ID NO: 187912 - DNA, 276 bp, Artificial Sequence
  Description of Artificial Sequence: Synthetic coding sequence
atgcccggcatcaagcggatcctgaccgtgaccatcctggccctgtgcttgccctctcccggaaacgctcaagcacagtgcacaaacggattcgaccttgatcggcaaagcggccagtgcctcgacattgacgaatgccgcactattcctgaagcatgccgtggggatatgatgtgcgttaatcagaatgggggatacctgtgcattccgaggaccaacccggtgtatcggggaccatactctaacccctactcaacaccttattctggcccctag

SEQ ID NO: 187913 - DNA, 1320 bp, Artificial Sequence
  Description of Artificial Sequence: Synthetic coding sequence
atggtgcccagcagcccccgggccctgttcctgctgctgctgatcctcgcttgtcccgagcctcgcgcatcccagaactgcctttctaagcagcagctcctttcagctatcaggcagctccaacagttactgaagggacaggaaacgcgattcgcggagggcatccgccacatgaaatcacgcctagctgctcttcagaattctgtggggcgtgtcggcccggacgcacttcctgtatcgtgccccgccttgaacactccagcggacggtcgaaaattcggatccaaatacctggtggaccatgaggtgcatttcacatgcaaccccggctttcggctggttggtccgtcgtctgttgtgtgccttccgaatgggacctggacgggtgagcagcctcactgtagaggcataagcgagtgtagctcacagccatgccagaatgggggcacctgcgttgagggcgtcaaccagtaccggtgcatatgtcctccagggaggacaggaaaccgctgtcagcaccaggctcaaacagccgcccccgaaggcagtgtcgcaggcgatagtgcattttccagagcacccagatgtgcccaggtggagcgagcacagcactgttcttgtgaggctgggttccatctgtccggcgctgccggggatagtgtctgccaggacgtcaatgagtgcgagctgtacgggcaagagggccgcccccgcctatgtatgcacgcctgtgtgaacactcccggctcatatcggtgtacatgtcccgggggctatcggaccctcgctgatggcaaatcctgtgaggatgttgacgagtgcgtcggtctccaaccagtttgcccacagggtacaacctgcattaataccggtggtagcttccagtgtgtctctccagaatgtcctgaaggttctggaaacgtcagctatgttaaaacgagcccattccagtgtgaacgcaatccatgccccatggattctcgtccctgcaggcacctacccaagacaattagttttcactacctgagcctgcctagcaacctcaaaaccccaattaccctttttcgtatggccaccgccagtgcgccgggaagggccggtcccaacagcctcagattcggaatcgtggggggcaattcccggggccacttcgtgatgcagaggtccgacaggcaaaccggcgaccttatcctggtgcagaatcttgagggcccacagaccctggaagtggatgttgatatgagcgagtatctggatcggtctttccaggcaaatcatgtaagcaaagtaacaatattcgtaagtccatatgatttctag

SEQ ID NO: 187914 - DNA, 1182 bp, Artificial Sequence
  Description of Artificial Sequence: Synthetic coding sequence
atggtgcccagcagcccccgggccctgttcctgctgctgctgatcctggcatgccctgagcctcgagcctcgcagaactgtttatcaaaacaacagctgctcagtgcaatccggcaactgcagcaactgctgaagggtcaggagactaggtttgcagagggtatccgccatatgaagagcaggttggcagcgcttcagaattctgtaggccgcgtggggcctgacgctcttcctgtgtcctgcccggccctgaataccccagccgatggcaggaaatttggatctaaatacctcgtcgaccacgaggtccacttcacttgtaatccgggcttccgccttgtgggcccttcctcagtcgtgtgtctcccgaatggtacatggactggcgagcagccccactgtcgtggaatcagcgaatgttcatctcagccctgtcaaaacggaggcacctgtgtggagggggtgaaccagtatcggtgcatctgtcccccgggccgcaccggtaaccggtgtcaacatcaagctcagactgatgtgaatgagtgcgagttgtacgggcaagaaggaaggcccaggttgtgcatgcacgcttgtgtgaatacaccagggagctacaggtgtacctgcccagggggctatcggactctcgctgacgggaagagctgcgaagacgtggatgaatgcgtaggcctccaaccagtgtgtcctcagggtactacctgcataaataccggtggatcgttccagtgcgtttcgccagaatgccctgaaggatccggcaacgtatcatacgtgaagacctcaccctttcagtgtgagcgcaatccatgtcccatggatagcagaccctgtagacacctgccaaagaccatcagtttccattatctttcactgccgagtaacctgaagacccccatcactcttttccgaatggccaccgccagcgcgcctggtcgggccgggccaaacagtttacggttcggcattgtgggcggtaattctcggggccacttcgtgatgcaaaggtctgataggcagactggtgatttgattctggtgcagaatctcgagggaccccagaccctggaagtggatgttgacatgagcgagtatctggataggtcatttcaagccaaccatgtctccaaggtcactattttcgtttcgccatacgacttctag

SEQ ID NO: 187915 - DNA, 942 bp, Artificial Sequence
  Description of Artificial Sequence: Synthetic coding sequence
atggagctggaccgggccgtgggcgtgctgggcgccgccaccctgcttctctcctttcttggaatggcctgggccctgcaggcggcagatacgtgtccagaagtaaagatggtcggcctggaaggcagcgacaaacttacaatcttacggggctgccctgggctcccaggggctcccggcccaaagggggaggcgggtactaatggcaagcgcggtgagagaggtccccctgggccccccggcaaggcaggtcctccaggccccaatggggccccgggcgagcctcagccatgtcttactggtccaagaacatgcaaggacttgcttgataggggccacttcttaagcggctggcacacaatctacctgccagattgcaggcctttaactgttttgtgcgatatggacacagatggaggcgggtggacggtctttcaaaggcgggtggatggcagtgtggacttctatagagactgggcaacatacaaacagggcttcgggagccgactaggcgagttttggctgggcaacgacaacatacacgctttaaccgcgcagggcacctcagagctgcgcgttgacctggttgactttgaggacaattatcagtttgctaaatatagaagtttcaaagtcgccgacgaagccgagaagtacaacctcgtgctcggggccttcgttgaaggatctgcgggagattcactgacattccataataaccaatccttttccacaaaggaccaggacaatgacctcaataccggtaactgcgccgtgatgtttcagggtgcctggtggtacaagaattgccacgtaagcaatctgaatggaagatatctcaggggaactcacggcagcttcgcgaacggaataaactggaagtccggcaaagggtataactacagctataaggtatcagagatgaaggttaggcccgcctag

SEQ ID NO: 187916 - DNA, 828 bp, Artificial Sequence
  Description of Artificial Sequence: Synthetic coding sequence
atggagctggaccgggccgtgggcgtgctgggcgccgccaccctgctactcagcttcctgggaatggcatgggctctacaggcggccgatacctgccctggggaacgcggacctcccggcccaccggggaaagcggggcctcctggacccaatggtgctcctggagagccgcagccatgtctaacagggccccgcacttgcaaagacctgctggacaggggacatttcctcagtggatggcataccatatacttacctgattgtagacctctgaccgtgctttgcgacatggatacagatggcggaggatggacagtgtttcagagaagagtggacggatcagtggatttttaccgggattgggctacgtacaagcagggttttgggtcgaggttgggtgagttttggcttggcaatgacaacatccacgctctgacagctcaaggcacatcagagctgcgggtggatcttgtcgatttcgaagataattaccagtttgctaaatatcgctccttcaaagtcgcagatgaagctgaaaagtacaatctggtactgggcgcttttgtggagggttcagccggcgatagcctcaccttccacaacaatcagtccttttctactaaggaccaggataatgacctgaacactggtaactgtgccgtgatgttccaaggtgcctggtggtacaagaactgtcacgtttctaacttgaatggaagatacctgagagggactcacggctctttcgcaaatggaatcaattggaagtccgggaaaggttataactattcttacaaagtgagcgagatgaaagtgagaccagcgtag

SEQ ID NO: 187917 - DNA, 564 bp, Artificial Sequence
  Description of Artificial Sequence: Synthetic coding sequence
atggagctgagcggcgccaccatggcccggggcctggccgtgctgctagtgctatttcttcacattaaaaatctgccggcccaggctgctgacacatgtccagaggtgaaggtcgtcgggctcgaaggatctgacaagttaacaattctgcgggggtgtccgggattgccaggtgcaccagggcccaagggggaagcaggggtgattggtgagcgcggagagcggggcctaccaggggcacccggaaaggcaggtcccgtagggcctaagggcgacgcgggccaatcccaatcctgcgccaccggcccacgcaactgtaaggatcttctagacagaggctatttcctgagcgggtggcataccatttatctgcccgactgccgtccactgactgttctgtgtgatatggacactgatggcggcggctggaccgttttccaaaggcgcatggatggatcagtcgatttctaccgggattgggctgcttataagcagggctttggaagtcaattgggagagttctggctgggtaacgacaatatccatgctcttacagcccaatag

SEQ ID NO: 187918 - DNA, 981 bp, Artificial Sequence
  Description of Artificial Sequence: Synthetic coding sequence
atggagctgagcggcgccaccatggcccggggcctggccgtgctgcttgtgctttttttacatatcaagaacctccctgcccaggctgctgacacctgtcctgaggtgaaagtggtcgggttggaaggaagcgataaactaacaattttgaggggctgtcctggtctgccaggcgcacccggtcccaagggggaggctggggtgattggagaaagaggcgaacggggactgcccggggcccccggcaaagcaggccctgtggggcccaagggtgatcgaggggagaagggcatgaggggcgagaagggagacgctggacagtcacagagctgcgcaacaggcccaaggaactgcaaggatctacttgatagaggctactttctgtcgggatggcatacaatctacctgcctgactgtcgccctctaaccgtgctgtgcgacatggacaccgatggaggcgggtggactgtgttccagcggagaatggatggaagcgttgatttttacagggactgggcggcttacaagcaaggatttggaagtcagctgggcgagttttggttagggaacgacaatatacacgcactgaccgcccaggggtccagcgaactgcgcgttgatctcgtggatttcgaagggaaccaccaatttgccaagtacaaatccttcaaggtggccgacgaagctgagaaatacaaactagtgctgggcgctttcgttggaggttccgccgggaacagtttgaccgggcataacaacaacttctttagtaccaaggaccaggacaatgacgtctcctctagcaattgtgctgagaaattccaaggggcctggtggtatgctgactgccacgcgagcaaccttaacggcctgtacctaatgggtccccacgaatcatatgccaacggcattaactggagcgctgctaaaggatataagtacagctacaaggtaagtgagatgaaagtccgccctgcctag

SEQ ID NO: 187919 - DNA, 1083 bp, Artificial Sequence
  Description of Artificial Sequence: Synthetic coding sequence
atggagctgagcggcgccaccatggcccggggcctggccgtgctgctggtgttgttccttcacattaagaatctccccgcccaggcagccgatacctgccccgaagttaaggtagtgggcctcgaaggatctgataagctgaccattctgcggggatgtcctggcctgcccggcgctcccggcccaaaaggtgaggccggtgttataggtgagcgaggggagagaggcctccctggggctcctggcaaggctggcccagtgggtccgaaaggagaccggggtgagaaaggaatgcgcggcgagaagggagatgcgggtcagagtcagagttgcgccacaggccctcgcaactgtaaagatttgttggatcgcggttacttcttgtctgggtggcacaccatttatctgcccgactgtagaccactgactgtactgtgcgacatggacaccgatgggggcggctggacagttttccagcggcggatggacggctctgtggacttttaccgcgactgggccgcctacaaacaggggttcggttctcagactcactcgcacgacgcacactcatgcccgtttgctccctcttctgtgaagcccccccacgcccacaatttaacccgcggaagaattatgtttctcaacatgttcacattgggtcagaaaagctttacctcattcaatgtttgcttcctaaatacgtcaggttttgaccattttccggtgtcagtggctcgtcaggtttttccctggaatttggtctcgcgtgaagagagcggtcccctgttttctagatggcattataggtgttccggacgtttatctgacttctgcgaggactttccccctccggtcattgataccggccggtctagccccccacctccaagcctgccacatccacctatgccccattcgcagcactttacacttctggagaaaggtcactttggtgtgcagaagacactcaccaagaagggggagagtttggtgggaaccttcctgcttccgacaacagctgagttcatgctgtgggctggttggctcctgggaagagataagcatctcgctttgactaaatag

SEQ ID NO: 187920 - DNA, 900 bp, Artificial Sequence
  Description of Artificial Sequence: Synthetic coding sequence
atggacctgctgtggatcctgcccagcctgtggctgctgctgctggggggacccgcctgcctgaagacccaggagcatccaagttgtcccggcccaagagaacttgaggcatccaaagtggtcctgctgccctcctgtccaggggctcccggttcgcctggagaaaagggagcccctgggccccagggcccacctggaccccccgggaaaatgggaccgaaaggggaacccggcgaccctgtgaatctcctgcgttgccaggaggggccgcggaactgccgagagcttttatcacagggcgctactttatcggggtggtatcatctttgccttccagaggggagggcgttgcctgtgttttgtgatatggacaccgagggcggtggctggctcgtgtttcagcgtcgccaagatggctccgtcgacttctttcgaagctggtctagctacagggctggatttgggaatcaggaatctgaattctggctgggcaacgagaacttgcatcagttgaccctccagggaaactgggagttgcgagtggaacttgaggattttaacggcaaccgcacctttgcccattatgccacatttcgcctgttgggagaggtggaccactaccagctggcactcggcaagttctctgagggcaccgcaggcgacagtctgagtctgcatagcggccgacctttcactacctatgacgccgaccacgattcaagtaattctaattgtgccgtaattgtgcatggggcctggtggtatgcctcctgctaccggtcgaatctgaatggaaggtatgcagtttcggaagccgccgctcacaaatacgggattgactgggcctcggggagaggagtgggacatccctataggcgcgtgaggatgatgctacgatag

SEQ ID NO: 187921 - DNA, 867 bp, Artificial Sequence
  Description of Artificial Sequence: Synthetic coding sequence
atggacctgctgtggatcctgcccagcctgtggctgctgctgctgggaggacctgcctgcctgaagacgcaggagcatccatcatgtccaggacctagggagttggaagcatccaaggtggtgttactcccgagctgccctggtgcccctggaagcccaggcgaaaagggagcacctggcccgcagggcccccccggacctccgggcaagatgggccccaagggagaacctgggccccgcaattgtcgggaattgttatcacaaggtgccactttgtctggctggtaccacctgtgcctacccgagggacgggccctgcctgtgttctgcgacatggataccgagggggggggatggctggtctttcagcgacgtcaggacgggtccgttgattttttccgcagctggagtagttaccgagcaggattcggtaaccaggaaagcgagttttggctcggtaacgaaaacctgcaccaacttacactgcagggtaattgggaactgagggtagagctggaggacttcaatggtaatcggaccttcgctcattatgccacattccggttgctcggcgaggtcgaccactaccagctggcgctcggcaaattctctgaaggcaccgccggcgatagcctgtcattgcacagcgggcgacctttcaccacctacgacgccgaccacgatagtagcaattcaaactgcgccgtgatagtccatggcgcatggtggtacgcctcgtgttatcgctctaacctcaatggtaggtatgctgtgtcggaggcggccgcccataaatatggaatcgattgggcttcaggacggggagtgggccacccttaccgacgcgtgaggatgatgctgcgctag

SEQ ID NO: 187922 - DNA, 300 bp, Artificial Sequence
  Description of Artificial Sequence: Synthetic coding sequence
atggacaccgagggcggcggctggctggtgttccagcggcggcaggacggctcagtcgatttcttccggtcttggagttcctatagggctggctttggtaaccaggagtccgaattctggctcggcaacgagaatctccaccagctgacactgcaaggtaattgggagctcagagtggagctcgaagatttcaacggcaatcgtacctttgcccactatgcaacttttagactgttaggcgaggtggaccactatcagctggctctgggcaagttctctgaaggaactgcaggcgaatag

SEQ ID NO: 187923 - DNA, 2094 bp, Artificial Sequence
  Description of Artificial Sequence: Synthetic coding sequence
atggccgagaccagccccgagcccagcggccagctggtggtgcactcggacgcccactccgataccgttctggcctcttttgaggaccagcgaaaaaaagggttcttatgcgatatcacccttatcgtggagaatgttcattttcgggcacacaaagcattactggcggcttcctccgaatacttcagcatgatgtttgctgaggagggggaaatcggtcagagtatctacatgctggagggcatggtcgccgataccttcggcattttgctagagtttatctatacggggtaccttcatgcatctgaaaaatccacagaacagatcctggccacagcacagttcctaaaagtttacgacctagtcaaggcttacacagacttccagaacaaccacagcagccctaaacctaccaccctgaatacagcgggggccccagtggtagtgatcagtaataaaaagaatgatccacctaagagaaaacgggggcgacctaagaaggtgaacaccttacaggaagagaagagtgagcttgctgccgaggaagagattcagctacgagtaaataacagcgtgcagaatcgccaaaacttcgtggtaaagggagacagcggcgtattgaacgaacagatcgccgctaaggagaaggaagagtccgaacccacatgcgagccctcccgtgaagaggaaatgcccgtggagaaagacgagaactacgaccccaaaaccgaggacggtcaggcctcccaatctaggtactctaaaagacgaatttggaggtctgttaaactgaaggactacaaactcgtgggggatcaggaggatcatggttccgcaaaacgaatttgcggcaggcggaaacgaccgggcggcccagaggctcgatgcaaggattgtggtaaggtcttcaagtataaccacttcctcgctattcaccagcgttcccataccggggagcgccccttcaagtgcaatgagtgcgggaaaggatttgctcaaaaacactctctgcaagtccacacgcggatgcacaccggtgagagaccgtatacctgcacagtgtgctctaaagcgcttaccactaaacactcgctgctagaacatatgagtctacattcaggccaaaagtcttttacttgcgatcagtgtggcaaatacttctctcaaaatcggcagttgaagtcccattaccgcgtccacacaggccactccctgcccgaatgcaaagactgccacaggaagttcatggacgtttcccagctgaagaaacacctccgaacccacacgggggagaagccctttacttgcgagatttgcgggaaatcatttaccgcaaaaagctcgctgcagacccacatacggattcaccggggcgaaaaaccatattcttgtggaatttgcgggaagagtttcagcgactcctctgctaaaaggcgacattgcatactgcacacaggaaagaaacctttttcctgtccagagtgtaatctgcagttcgctaggctagataacctgaaggcccatctgaagatccactccaaggaaaaacatgcttctgatgcctcaagcatctccggctctagtaataccgaggaggtgcggaatattctacagttgcagccgtaccaactgtccacctcaggggaacaggagattcagctgctagtgacagacagtgtgcacaacattaatttcatgccagggccgtcccaaggcatttccatcgtgaccgccgagagcagtcagaatatgaccgccgaccaggcggccaacctgacactgttgacgcagcaacctgaacaactgcagaatctcatactgtcagctcaacaggagcagaccgaacatatccagtcacttaacatgatagaatcccagatggggccgtctcaaactgaaccagtgcacgtgatcacactctctaaagagacgctagaacacttgcacgcccatcaggagcagaccgaagagttgcacttagccaccagcacctctgatcctgcccagcacctgcagctcacgcaggagccgggaccacccccaccaacccatcacgtcccgcagcctacaccactcgggcaggagcagtcctag

SEQ ID NO: 187924 - DNA, 420 bp, Artificial Sequence
  Description of Artificial Sequence: Synthetic coding sequence
atgggccagaagggcagcagcggcctgttccgggccgtgagcgcctttggggtggtcggctttgtgcggttccttgagggctactacatcgtgttgatcacaaagcgcaggaaaatggctgatataggtggtcacgcaatctataaggtggaggacaccaatatgatctatatccctaacgatagtgtcagggttacacacccagatgaagcgagatacctgcgcatctttcagaacgtcgatctctcaagcaacttctacttcagttattcttacgatctctcccacagcttgcaatacaatctgaccgtgctccgaatgcctctcgagatgctaaaaagcgagatgacccaaaacaggcaggagagctttgacatctttgaggacgagggcttgattacccagggcggatccggatag

SEQ ID NO: 187925 - DNA, 411 bp, Artificial Sequence
  Description of Artificial Sequence: Synthetic coding sequence
tgactgttcgaggagctgtacgaggaccacggcgacaccctgagccttcaatacggcggcagtcagctggtacacagagtgaagacctatcggaagatcgccccctggactcaacactcgaaggacataatgcagaccctgtcacggtattatagcaacgcattttccgatgccgacaggcaggactctatcaatttgtttctgggcgtgttccacccgactgaagggaaacctcacctctgggagttgcctaccgacttttacctgcatcataagaacacaatgagactcttgcctactcggcggagctatacatactggtggaccccagaagtgattaagcacctacctctcccctatgatgaaggttttctagcacgctcccctgccaacttagagtgcagtaactag

SEQ ID NO: 187926 - DNA, 300 bp, Artificial Sequence
  Description of Artificial Sequence: Synthetic coding sequence
atgaccagcagcgcccgggacttcatgcccaagaccgtgggcatcgatccttccccgttcacggttagaaaaccagacgaaaccgggaagagtgtccttgggaacaagtccaatcgcgaggaagccgtgctgcaacgcaagaccgcagcttccgctcctccacctccctccgaggaagcagttagttcctcctcggaggatgactcaggtaccgaccgcgaagaggaaggtagtgtttctcagaggtcaacacctgtgaagatgaccgatgcaggggatagcgccaaggtgacagagtag

SEQ ID NO: 187927 - DNA, 1806 bp, Artificial Sequence
  Description of Artificial Sequence: Synthetic coding sequence
atgaccggctacctgcggatcttccagaacgtggacctgagcagcaacttctattttagttactcttacgacctgagccattctctgcagtataacctgacagtgcttcggatgccactcgagatgctgaagagtgaaatgacccagaatagacaggaaagtttcgacatctttgaggatgagggcctgatcactcagggaggctccgtggatcaggctgaccccttcgctcacgtggctgcgctgcatttcgaccaaatgtttcagcggttcggatctcctatcattattctgaacctggtgaaagagcgtgaaaaacgcaaacatgaacgaatcttgtccgaagaactcgtggctgccgtgacctatcttaaccaattcctgcctccagaacacaccatcgtttacattccttgggacatggcaaaatataccaaaagcaaactgtgcaatgttctggaccggctgaacgtaatagcagagtctgtggtgaagaagaccggcttctttgtgaatcggcccgacagctactgttctattctgcggcctgatgagaaatggaatgagctcggtggttgtgtaatacccacaggacggctacagactggtatactgcggactaactgtgtggactgccttgaccgcacaaatactgcacagtttatggtcggtaaatgcgccctggcctaccagttatatagcctggggctgatcgacaagcccaaccttcagttcgacactgatgccgtgcgtctttttgaggaattatacgaagatcatggggacactctgagtctgcagtacggaggcagccaacttgtacatcgcgtaaaaacctatcgcaagattgcaccatggacgcagcactcaaaggacatcatgcagacactctcaaggtactattccaacgctttttctgatgctgacagacaggacagtataaacctgtttctgggggtgttccatccaaccgagggtaaaccgcatctttgggagcttcccactgacttttacctgcaccacaagaacaccatgaggctgcttcctacgaggcgctcatatacgtactggtggacacctgaagtgatcaagcacctgcccttgccatacgacgaggtgatttgcgccgtcaacctgaagaagctgatcgtgaaaaaatttcacaagtatgaggaggagattgacattcataatgagttttttaggccgtacgagctgagttcctttgacgacaccttctgtctcgccatgacatcttcagcaagagatttcatgccaaaaactgtcgggattgatccaagtccatttacagttcgcaaacctgatgaaaccggtaagagcgtcttaggtaataagtcaaacagggaagaagccgtgttgcagcgtaaaacggccgccagcgcacctccccctcccagcgaggaagctgtgagctctagtagcgaagatgacagtggcactgatcgggaagaggagggtagtgtcagtcagagaagcacccccgtcaagatgacagacgcgggcgactccgccaaagtaactgagaatgtggtgcaaccaatgaaggagttatatgggataaacctgagcgatggactgtcagaagaggacttttccatctactctagaacgccgataagcgcgttctcgcaggacaacatctacgaggtgcagccccctcgggtggatcgcaaatcaacggagatatttcaggcccatattcaggctagtcaagggattatgcaacccctcggcaaagaggacagtagcatgtaccgcgagtatattcggaatcgctatctttag

SEQ ID NO: 187928 - DNA, 714 bp, Artificial Sequence
  Description of Artificial Sequence: Synthetic coding sequence
atgcggtacttcctggtgggcagcaacaacgccgagaccaagtacagagtgctgaagatcgatcgcaccgagccgaaggatctcgtgatcatagacgatcgtcacgtgtacactcaacaggaagtacgcgagctgttggggcgactggatctgggaaatcgcacaaagatgggccagaaaggcagctctggtctgtttcgcgccgtgtccgcattcggagtcgtgggattcgtgcgcttcttggaagggtactatattgtactgatcacaaagcggcgcaagatggcagatatcgggggacacgctatttataaagtggaagacaccaacatgatctacatccctaatgactctgttcgagtaactcaccctgacgaggctagatatctccggattttccagaatgtcgacctttcctcaaatttttatttctcatactcgtacgatctgtcacactcccttcaatacaacttaacagtcttgaggatgcctctcgaaatgctgaagtctgagatgacccagaatcgacaggagagcttcgatatcttcgaggatgagggcctgataactcagggtggatcaggggtgttcggcatatgtagcgagccctatatgaaatatgtctggaatggcgaattgcttgatataatcaagtccactgtacaccgggactggctgttatatattatccacggattctgtggccaatcatag

SEQ ID NO: 187929 - DNA, 969 bp, Artificial Sequence
  Description of Artificial Sequence: Synthetic coding sequence
ctgtaccaggtgagcacccacgagcagagcgagagcgcccacggcaggaccggcccatcaactggtggtcgacaaaggagccgacatgagcaagccagagactcttcaaggcacagtgcgtctcaggaaggtcaagacacaatcaggggacatccaggcagctcacggggtgggcgtcaggggtcacattacgaacagagcgtggattcctccggccattctgggtcccatcatagtcacacaacatcccaggagcgttccgatgtctcgcgcggacagagcggttctcgatccgttagccgccagaccaggaatgaaaaacagtcaggcgatggctctcggcattctggctctcgccaccatgaggcctctagccgcgcggactcgtccaggcatagtcaggttggacagggccaatcctccggccctaggacctctaggaatcagggctctagcgtatctcaggacagtgattcccagggtcattcagaggactcagaacgccgatccggcagtgcctcgaggaaccaccacggttcagctcaggaacagagcagggacggatccagacatcctcggtcccaccatgaagatagagccggccacggacatagcgccgagagttcacgtcagagtggaacccaccacgctgaaaacagtagtgggggtcaggctgcttcttcgcatgagcaagcccgcagcagcgccggcgagcgccacggttctcaccaccaacagtccgccgacagtagcagacactcagggatcgggcatggacaggcttcctctgccgtgcgtgatagtggtcaccggggatcctcgggatcacaggcttctgattcggaaggacacagcgaagattcagacactcagagcgtgtctgcccatggccaggctggcccccaccaacagtcccatcaggaatctacccgaggccggtctgctggccggagtggaagatcagggtag

SEQ ID NO: 187930 - DNA, 969 bp, Artificial Sequence
  Description of Artificial Sequence: Synthetic coding sequence
ctgtaccaggtgagcacccacgagcagagcgagagcagccacggctggaccggaccaagtacccgcggccgacagggcagccggcatgagcaagcgcaggactccagccggcacagtgccagccaagatgggcaggatacaattagaggacatccggggtcatctcgaggagggagacagggttatcaccacgaacattccgtcgactcttctggacattctgggtcacaccatagccacactacttctcaaggacggtcggacgcaagccgcggccagagcggctctcgaagtgccagcaggaccactagaaatgaagagcagagcggagacgggagtcgacactctggtagccgtcaccatgaagcttccacccatgccgatatttctaggcactcccaagctgtacaggggcagtcggaggggtcgcggcgctctcggcgccagggttcttcagtgtctcaggatagtgactcagagggacacagtgaagattccgagaggtggtccggaagtgcctcccggaatcaccgcgggagcgtgcaggagcagtccagacatggctcccgccaccccaggagtcaccacgaggacagggccgggcacggacactccgctgatagaagcagacagtctggcaccaggcacgccgaaacaagtagcggaggccaggccgcatcatcccacgaacaagccaggagcagcccgggtgaacggcatggatcgaggcatcaacagtcagcagatagctctagacactctggtatccctcgagggcaggcctcctccgcagttcgagatagcaggcattggggttcttcgggatcacaggcctccgattctgaggggcatagcgaggaatcggatacgcagtcagtgtccggccatgggcaggctggaccccatcagcagagtcaccaggagtccgcaagggatcgctctggcgggagatcaggaaggtccggctag

SEQ ID NO: 187931 - DNA, 12186 bp, Artificial Sequence
  Description of Artificial Sequence: Synthetic coding sequence
atgagcaccctgctggagaacatcttcgccatcatcaacctgttcaagcagtacagcaagaaagacaagaatacagataccctaagcaaaaaggagctgaaagaactgctggagaaggaattccggcagatcctcaagaatcccgacgatccagatatggtggacgtgttcatggaccatctggacattgatcacaataagaagattgacttcactgagtttctcctgatggtttttaaactcgcccaagcctactatgagtccacaaggaaggagaatctccctatttcgggccacaagcacagaaaacactcacaccatgacaaacatgaagacaacaaacaggaggagaataaggaaaataggaagcgaccctcatctctggaacggcgtaataaccgcaagggcaataaaggacgctcaaagagcccaagggagacagggggcaagaggcatgaatcttcctccgagaaaaaggagcgtaagggatactctccaactcatcgcgaagaagaatacgggaagaatcaccacaattccagcaaaaaggaaaagaataaaacagagaatacgaggctgggcgataaccggaagcgcctgagtgagaggctcgaagagaaggaagataacgaggagggcgtttatgattacgagaacacggggaggatgacccagaagtggatacagagcggccatattgctacttactatacaatccaggatgaagcttacgatacaaccgattccctgcttgaagagaataagatttatgaacgttctcgctctagcgacggtaagtcttctagtcaagtgaacagatccaggcatgagaatacctcccaagtgcccctgcaggaatcaaggacacggaagcggcgagggtcacgagtgagccaggatcgtgactctgagggccattcagaggattctgaacggcactccgggtctgccagccgcaaccaccatggaagcgcctgggagcagtcacgcgatgggtcccggcatccccggagtcatgatgaagatagggcctctcatggccattctgctgactccagcagacagagcggcactaggcatgcagagacaagcagcagaggacaaaccgcaagtagccacgagcaggcacgctcttccccgggggaaagacacggaagcgggcaccagcaatccgctgatagctcacgccatagcgcaactgggcggggccaggcttcttccgcagtctcagatcgtggacaccggggaagcagcggaagccaggcatccgacagtgaagggcattcagagaacagtgatacccagagtgtgtcggggcatggtaaagccggcctgagacagcagtcacatcaggagagtacacgcgggcggagcggtgaacggtctggccggtcagggtcctctctatatcaggtctccacccacgaacagcctgacagtgcccatggcagaaccggcacgtctaccggaggtcgccaagggtcccaccacgagcaggctcgcgattcatcccgtcacagcgcgagccaagagggccaggatactattcgagggcaccccggctcttctaggggaggacgccagggaagccaccatgaacaatctgtcaaccgcagtggccacagcggtagtcatcactcacacactacttcacagggaaggagcgacgccagccatggccaaagcggtagccgctctgcctctcggcagacacgcaatgaggaacagagtggggatggcacccggcattcagggtctagacaccacgaggcctcatcccaggccgatagctctaggcatagtcaggttggtcagggacagtcttccggcccccgtacatctaggaatcagggatccagtgtatcccaagatagcgactcccagggccattcagaagatagcgaaaggtggtctggcagcgcttccaggaatcatcatggttccgctcaggagcagagcagggacggatcgcgccacccaaggagccaccacgaagatcgggctggccatggtcactcggcagactcctcaaggaaaagtggcacacgacacacccagaatagctcctccggtcaggcagcttccagccatgagcaggctaggagctctgccggagagcggcacggcagtcggcaccagctccagtcagctgattctagccggcactcaggtactggacatggtcaggcgtcttccgctgtccgcgattctggccaccggggatcatccggctctcaggcaacagacagcgaaggtcacagtgaggactccgatacccagagcgtctcaggccacgggcaggccggccaccaccagcagagtcatcaagagtccgcccgagatcggtctggtgaacgttcacggagaagcggtagctttctgtatcaagttagtacacataagcagagcgagtcttctcatggatggaccggcccaagcaccggtgtccgacagggtagtcaccatgaacaggcaagggacaatagccggcactctgctagccaggacggccaggacaccatacgtgggcatccaggaagctctcggcgcggccgtcaaggctcacaccatgaacagtccgtggacaggtccgggcattccggctcacaccatagtcacactactagtcagggccggtccgacgcctccaggggacagtccggcagtcgttccgcctcaagaaccacaagaaacgaggagcagtctcgagacggctcacgccacagtggaagcagacaccatgaggccagcagccacgccgatataagcaggcacagccaggctggacaaggccagagcgaaggctctcgtactagtcgacggcagggttcatccgtgagccaagacagcgactctgaggggcactccgaggactccgagaggtggagtggtagtgcctcacgcaaccatcgaggatccgcccaggaacagagtcgacatggctcacgacacccccgctcacatcacgaagatagggccggccacgggcatagtgcagattcctctcgacaaagcggcactccccatgcagagactagctctgggggccaagccgcaagcagccacgaacaggcccggtcaagtcccggcgagaggcatgggagcaggcaccagcaatctgccgactcatctagacattcaggcatcccacggcgtcaggcttcatccgcagtgcgtgattctggtcactggggtagctctggaagccaggcgtctgattcagaagggcactctgaggagagcgatactcagtctgtgtctggccacggacaggacggcccacaccaacagagccaccaggaatcggcaagagattggtcaggtgggaggtctggtagatcaggctcatttatctaccaagtgtccacacacgaacaatccgaatctgctcatggtagaaccaggaccagcacaggtaggcgccagggaagccatcacgaacaggccagagattcttctcggcacagcgcgtctcaagagggccaggataccattcgcgctcaccccggctctcggagaggagggcgccagggatctcaccatgagcagtcggtagaccgttcggggcattccggcagtcaccactcccacactacctcacagggaaggtccgatgcgtcccacggccagtctgggtcgagaagcgcttcgaggcaaactagaaaagacaagcagagcggcgatgggtctagacattccggcagccgccaccacgaggctgctagctgggccgacagctctcgtcattcacaggtggggcaggaacagtcttctggatcacggacatcacggcatcaggggtcctcagtatcccaggatagtgatagtgaaagacactccgacgactcggaacggctgagcgggagcgctagcagaaaccaccatggatcctcccgagaacagtccagagacgggtcccgccatcccggcttccaccaagaggaccgtgccagccatggccactctgccgacagctctcggcagtcaggcactcaccacacagaaagtagcagccacgggcaggccgtatccagccatgagcaggcaagaagttctccgggagaacgccatggcagtaggcatcagcagagcgctgacagctcccgacactctggaatcggacatcgccaggcctcctcggccgtaagggactctgggcatagggggtctagcgggtctcaggtgaccaactctgagggacatagcgaagatagcgacacgcagagtgtctcggcccatgggcaggcggggccgcaccaacagtcgcacaaggagtcagccagggggcagtctggggagagctccggccgctcgcgctcgtttctttatcaggtcagctctcacgagcagtcagaaagcacccacggtcagaccgccccctcaaccggcggccggcaaggcagtcgacatgaacaggccaggaactccagccgtcattcggcttcccaggacggccaggatacgatccgcgggcaccccggcagctcgcgtgggggccgccagggctcttatcatgaacagtccgtggacagatcagggcatagcggataccatcactctcacaccactccgcaggggcggtccgacgccagccacggacagagcggaccaaggtctgccagtagacagacacggaatgaggagcagagcggcgacggctcaaggcatagcgggtcacggcaccacgaaccctcaacaagggccggtagcagtaggcatagtcaggtcgggcagggggaaagcgcaggatcaaaaacctcaaggcgccagggaagtagtgtttcccaagatcgggatagcgagggtcactcagaggactccgagcgtagatctgaaagtgcctcacgcaaccattacggcagcgcccgcgaacagtctcgacatggatcccgcaacccccgatctcaccaagaggatagggcctctcacggacactcagcagaatcgagtaggcagtccggcactcggcacgccgagaccagtagcggaggccaggccgcgagtagccaagagcaagcccggagctcaccgggtgagcggcacggctcgcgtcaccaacagagcgcagatagcagcactgactcgggaacgggccgacggcaggactcctcggtggttggggatagcggcaaccgaggtagcagtggttcccaggcttctgattccgaagggcacagcgaggagagcgatactcagagtgtcagtgcgcatgggcaagctggaccacaccagcagagccaccaggaatccaccaggggccagagcggagaacgctccggtcggtccggcagtttcttatatcaggtctctacacatgagcaatctgagtccgctcatggcaggacgggacctagtactggcggccgacagcggagccgccacgagcaggcacgtgattcaagccgtcactcagccagccaggaaggccaagataccataagaggacaccctggatccagccgcgggggccggcagggctcccactatgagcagtcagttgacagcagtggtcatagtggctcccaccacagccatactacctcccaggagcgcagcgacgtgtcccgtggacagagtgggagcaggagtgtctcccgtcagactcgtaacgaaaaacagagtggagacggcagtagacactccgggtctcgacatcacgaggcatcctcgcgggccgacagctccaggcatagccaagtcggacaggggcagtcctccggcccccggaccagcaggaaccaggggtctagtgtgtcacaagatagcgattcccagggacactcagaggattctgaacgatggagcggatcagcttcccgaaaccatctgggctctgcatgggagcagtcccgagatggaagcaggcatcctgggagccaccacgaagaccgcgccggacatgggcactctgcagatagctctagacagtcaggcaccagacacaccgagagctcttcaagggggcaggcggcttcaagccatgagcaggcccgcagcagtgctggcgagcggcacgggtctcatcaccagctgcaatctgccgattcatcacgtcatagcggcatcgggcacggccaggccagttctgctgtcagggattctggacacagaggatactccggaagtcaggctagcgattctgaaggccacagtgaggactctgacacacagagcgtgagcgcacaaggtaaggcggggccccatcagcagtcacacaaggagtccgcccgtggccagtcgggagagagttctggtcggtcgggctcgttcctgtaccaggtttctacccacgaacaatccgagtccacccatggacaatcggcaccaagcacgggtggcaggcaggggtcacattatgatcaggcacaggactccagcagacatagcgcatctcaagagggacaagataccataaggggccacccagggccatcacgcgggggaaggcaggggagtcaccaagaacagagcgtggaccgtagtggtcactctgggagtcatcactctcacacaacatcccagggccgctctgatgcatccagaggccagagtggctctagatctgcaagtagaaaaacttacgataaagaacagagcggtgacgggtctcgacattctggctcacaccatcacgaggcatcgtcttgggctgactcatctcgtcactccctggtgggccagggtcagagcagcgggccacggacctctagaccccggggcagctctgtaagtcaggactccgatagcgagggacacagtgaggacagcgaacgccgctcaggctccgcttctcggaaccaccacgggagtgctcaggagcagtcaagagatggctctcgacacccgcgctctcatcatgaggaccgcgccggtcacggacactcagccgagagcagtcgacagtcagggactcaccatgcagagaactcctccggggggcaggctgcctcttcacacgagcaagcgcgctcctcggccggcgaaagacacggtagtcaccatcagcaaagtgctgactctagtcggcattcgggcatcgggcatgggcaggcgagctccgcagtaagggatagcggccacaggggcagttccggctcccaggcatctgacagtgaaggacacagcgaagattccgacacacagagcgtcagcgctcacggccaggcaggacctcatcagcagtcccaccaggagagcacccggggacggtccgccggaagaagtggccgcagtggttcctttctgtaccaggtgtccacacacgagcagagtgagagtgcccatggtcgaacaggaacatccacggggggaaggcagggcagccaccataagcaggccagagactcttctcggcacagcacttctcaggagggccaggacacaatccacgggcaccctggctcgtcaagtggcgggcgccagggctctcactacgaacaattggtagatcgatccggccacagcgggtcacatcacagccataccacttcccagggcaggtctgacgcctctcatgggcactctggatccagatctgcctctagacaaactaggaacgatgaacagagtggggacggctccagacattccggttctcgccatcacgaggcatcaagccgggcggattcatctgggcacagtcaggttggtcaaggacagtctgagggtcctagaaccagccggaactggggtagctccttttcccaggactccgattcacaggggcacagcgaggacagcgagagatggtcagggagtgcctcccggaatcatcatggaagcgctcaggagcagctccgagatgggagccgccaccctcggtcacaccaagaggatcgggctggccacggacacagcgcggatagcagtcggcagtctggcacacgccatacacaaacctctagtggaggacaggccgcgagcagccacgaacaggcgcggtcctctgcaggggaaaggcatggcagccaccatcaacagtccgccgactcttcaagacactcaggaatcggacatgggcaggcatcttctgctgtgagagattccggccataggggttatagcggatcccaagcatccgataatgagggtcattccgaagactcagacactcagagcgtcagcgctcatgggcaggcaggcagtcaccaacaaagtcatcaggagagtgccaggggccgcagcggagagaccagcggccacagcggaagcttcttgtaccaggtcagtacgcacgagcaatctgaatcctcacacggctggaccggcccctccacaaggggaaggcagggcagcaggcacgaacaggctcaggattccagccgccattcagcgtctcaggatgggcaggacaccatcaggggccaccccggtagtagcagggggggccggcagggatatcaccacgagcacagcgtagattcttcgggccactcaggcagtcaccactcccacacaacctcccagggtagatcagacgcgagccgaggtcaaagcggcagccggtccgcttcacggaccacacggaatgaagagcagtcaggagatggaagcagacattctggcagtagacaccatgaagcctccactcacgcggacatctctagacattcacaggcggtgcagggccagtccgaaggcagcagacggtcacggcgccagggcagctcagtcagccaggactcagactctgaagggcacagcgaggactccgagaggtggtctggaagcgctagcaggaaccaccatgggagcgcccaagaacagctaagggacgggtcacgccacccccgctctcaccaggaggacagggcagggcacggtcattctgcagattcttctcggcagtccggaacgcgacatacacagacttctagcgggggccaagccgcctcaagtcacgagcaggctcggtcttctgcaggagagagacacggcagccatcatcagcagtccgctgactcatcccgccatagcgggatcggacacggtcaggctagcagcgcagtacgagatagcggccacagaggctactcagggtcacaagcatccgacaacgaagggcacagcgaggattctgatacccagagtgtctccgctcatggccaggctggaagccaccaacagtcccaccaggaatctgctcgaggacgtagcggcgagacttcaggccatagtggctcctttctgtatcaggtgtcaactcacgagcaaagtgagtcatcccatggttggacggggccttccactcggggccgacagggctccagacacgaacaagcccaagatagctctcggcactcggcgtcacaatacggccaagataccatcagagggcatcccggatccagccggggtgggcgccaggggtatcaccatgaacactcggtggacagttctggacattccggctcccaccatagtcatactacctctcaggggcgctcggatgccagtcgcgggcagtcaggatccaggtctgcaagcagaacaacccggaatgaggagcagagcggtgacagctccaggcactcggtgtctaggcatcatgaggcctctacacacgctgatatttcaaggcactctcaagccgtccaaggacagagcgaaggatccagaaggtctcgcagacagggatccagcgtgtcccaggattctgacagtgaaggccattccgaagattcggagcggtggagcggttccgcttccaggaaccataggggcagtgtacaagagcaaagtcggcatgggagccgacatcccagaagtcatcatgaggatcgggcggggcacggccactccgcggaccgatcgagacaatccgggacccgccatgctgaaaccagtagcggcggtcaggctgcatcgagtcacgaacaggcgaggagcagccctggcgagagacacgggtcccgtcaccaacagagcgcggacagctcaaggcattctggcattcctagaggccaagcaagttcagcagtcagggacagtcgtcattggggatcttcaggcagccaggcctctgattcggaggggcacagcgaggaaagcgacactcagagcgtgagtgggcacggtcaagcagggccacaccaacagagccaccaggagtccgcgcgagaccggtcaggcggcaggtcgggaaggagcgggtcgttcttgtaccaggtcagcacccacgagcagagcgaaagcgcccacgggcgtacccggacatcaacgggaaggcgccaaggaagtcatcacgagcaggcccgtgatagctccagacattccgcctctcaagaaggtcaagacaccatccgcgggcacccaggtagcagccgtcgggggcgacaggggtctcattacgaacagtccgttgacagatctggacatagcggatcccaccacagccacaccacgtctcagggacgctctgatgcatcaagggggcagtccggcagtaggtccgctagtaggcaaaccaggaacgacgagcaaagtggggatggatccagacactcttggtctcatcaccacgaggctagcactcaggcggattcaagccgtcactcccagtctggtcaggggcagtcagctgggccccgcacctctagaaaccagggttcctccgtgtctcaggattcggactcccagggccattcagaagatagcgagagatggtccgggtcggcaagccgcaatcaccgggggagtgcgcaggagcagtccagggatggcagccgtcatcccacatctcatcacgaagatcgggcgggacacggccactctgccgaatcctcacgacagtccggtacccaccatgctgaaaactcctccggcggtcaggcggcatcaagccacgagcaagccagatctagcgcaggtgagaggcacgggagccaccaccagcagagcgcagacagtagtcggcactccggaatagggcacgggcaagcctcctcggccgttagggacagtggacaccgcgggtcctctggaagccaggcttccgactccgaagggcatagcgaagacagcgacacacagtctgtgtcggcccacggccaagctgggccacatcagcagtcacaccaggagagcacacgcggccggtccgctggccgcagtggtaggtcaggcagtttcctgtaccaggtcagcactcatgaacagagcgagagcgctcacgggcgcgctggtccgtccacaggtggacgtcaggggtcgcggcacgagcaggcccgcgactccagccgccattccgccagtcaggagggacaggataccattagaggccatccgggatcacgtagaggcggaagacagggctcttaccacgaacagtcagtcgatagaagcggacactccggctcccaccacagtcatacaactagccaaggcagaagtgacgccagccatgggcagagcggctctagaagcgcatcaagggagacgcgaaatgaagagcaatcgggtgatgggtcccgccactctggctcccgccaccacgaagcttccacacaagctgacagctctaggcatagtcagtccggacagggggagagtgctggcagtagacggtctagacgacaaggctcatcggtttcccaagattccgattcagaagcctatcccgaagacagtgaaagaaggtctgaaagcgcctcccgaaaccaccacggaagctcacgggagcagagtagagacgggagccgccatcccggttcttcccacagggacactgccagccacgtccagtcctcacccgtgcagagcgacagcagtactgccaaggagcacggccatttcagtagtctttctcaggactctgcgtaccatagtggcatccagagcagggggagcccccatagctcctcttcataccactaccagtcagaggggacggaacgccagaagggtcaatcaggcttggtctggagacatggtagctacggcagtgctgactacgactacggggagtctggcttccgtcatagccagcacggtagcgttagctacaacagtaatcccgtggttttcaaggaaaggtccgatatttgcaaagcatctgccttcggaaaggaccaccctagatactatgcaacttacataaacaaggatcccggactctgcggccactcgtccgacataagtaagcagctcgggttcagccagtcccagaggtattattattacgagtag

SEQ ID NO: 187932 - DNA, 969 bp, Artificial Sequence
  Description of Artificial Sequence: Synthetic coding sequence
ctgtaccaggtgagcacccacgagcagcccgacagcgcccacggccggaccggcacaagcactggcggacgacagggctctcaccatgagcaggcccgcgactcaagccgacacagcgcctctcaggaagggcaggataccatccgaggccaccctggaagttcacgtgggggaagacagggtagtcatcatgagcagtctgtcaataggagtggccactccggttctcatcattcgcacaccacatcccagggccgtagcgatgcctcgcatggccaatccggcagccgtagcgcgtctcgccagacaaggaatgaggagcagagcggggacggtactaggcacagtggttccaggcaccacgaggcatcctctcaggctgatagtagccggcactcccaggcggggcaggggcagagcgaaggaagccgtacaagccgtagacaaggatcctctgtgtcacaagactccgactctgaaggccacagcgaggattcagaaagatggagcggatcagcatcacgtaaccatcgcgggagtgcacaggaacagagcaggcacggctcccgccatccaaggtcccaccacgaagacagggccggccatggccactccgcagatagtagccgccaaagcggaaccccacatgcagagacatcctccggtggacaagccgcatcttcacatgaacaggcccgtagttccccaggggagcgacacggcagtagacaccaacaatccgccgatagttcaaggcattccggcattccgcgcaggcaagctagctccgctgtccgggattctgggcactggggatcctccggctcccaggcaagcgacagcgaaggtcatagcgaagaatctgacacacagtctgtcagcggacacggacaagacggaccccaccagcagtcccaccaagagtccgccagggactggagcggcggacgcagtggacgcagcggctag

SEQ ID NO: 187933 - DNA, 3402 bp, Artificial Sequence
  Description of Artificial Sequence: Synthetic coding sequence
atgcggagccggggcagcgacaccgagggcagcgcccagaagaagtttccaaggcataccaagggccacagcttccagggacccaagaatatgaagcataggcaacaggacaaagattccccctcagaatcagacgtcatactaccatgtccaaaggctgagaagccccattccggcaatggccatcaagccgaggatctgagccgcgatgatctcctgttcttgttgtccatacttgaaggcgaactgcaggctcgtgatgaagtgatagggatccttaaagctgagaagatggatctggccttattagaggcacagtatggatttgtgacccccaagaaagtgttggaagcactgcagagggatgcatttcaggcaaagagtactccttggcaggaggacatctacgagaaaccgatgaatgaactcgataaagttgttgagaaacataaagagtcctacaggcggatattggggcagctgctggtggccgagaagtctcggcgccagacaattttggagctggaggaagaaaagcgcaaacacaaagagtacatggagaaatcagatgagttcatatgcctattagaacaggaatgtgagcgtctcaagaagctaatcgatcaggagataaaatcccaggaagaaaaagaacaggagaaggagaaacgggtgactacactgaaagaagaactcaccaagctgaagtcttttgcactgatggtggtggatgagcagcagcggctaaccgcacaactgactctacaacgtcagaagattcaggaactcactaccaacgctaaggagactcacacaaaactggccctcgcagaggctcgggtgcaggaagaagagcaaaaggctactcgtctagaaaaagagctccagacgcagacaacaaagttccaccaggatcaggatacaatcatggctaaactgacaaacgaggattcacaaaaccgacagttgcagcaaaagttagccgccttgagtaggcagatcgatgagcttgaggagaccaatcgttctctgcggaaggccgaggaggaactgcaggacattaaagagaaaatcagtaaaggagagtacggcaatgcaggtatcatggctgaggtggaggaactccgtaagcgggtgctggatatggagggcaaagatgaggagctgattaaaatggaggagcagtgtagagacctgaacaagaggcttgaaagagaaactctgcaaagtaaggatttcaagctggaagtggagaaactatcaaaacgcatcatggcactggagaaattggaagacgccttcaacaagtcaaaacaagaatgttatagcttaaagtgtaatcttgagaaggaaaggatgaccactaaacaactatctcaggagttagagtcattgaaagtacgaatcaaagaactggaggcaattgagagcaggcttgaaaagaccgagttcacgctgaaggaggacctcaccaaactcaagaccctgaccgtgatgttcgtcgatgagaggaaaacaatgtcagaaaagcttaaaaaaaccgaggacaaactgcaggcagcctcctcacagttgcaggtggagcagaacaaggtcacgactgttaccgaaaagctcattgaagaaacaaagcgcgcgctgaagagcaagaccgacgtggaggaaaagatgtactctgtgaccaaggagagggatgatttaaagaacaagttgaaagcagaggaagaaaaaggtaacgatctcctcagccgcgtgaatatgctgaagaataggctccagagtctggaagctatcgagaaggactttcttaagaataagttgaaccaagatagcgggaaatccaccacagccctccaccaagagaacaataaaattaaggaactttctcaggaagtcgaaagactgaagctgaaacttaaggacatgaaagccattgaggacgacctgatgaagaccgaagacgaatatgagaccctcgagcgacgctacgccaacgagcgcgacaaagcccagtttcttagcaaggagctcgagcatgtgaagatggaacttgccaagtacaagttagccgaaaagacagagacatctcatgaacagtggctgtttaagcggttgcaggaggaggaggcaaagtcaggacacctgtctagagaagtggatgcgttgaaggaaaagatccatgaatacatggcgaccgaggacctgatatgtcatctccagggcgaccattccgtcctgcagaagaagctgaaccaacaggaaaacagaaatcgggacctcgggcgtgagattgagaacctgacaaaagagctggagaggtataggcatttttcgaaatcattgcggccctccttgaatgggcggcggataagcgaccctcaggtgtttagcaaagaagttcaaacagaggcagtggacaacgaacctccagattataaatctctgataccactggagagggcagtgataaatggacagctatacgaggaaagtgagaaccaggacgaggatccaaacgatgaggggagcgtactgtcctttaagtgtagccagtccacaccatgtcctgttaataggaagttgtggatcccgtggatgaaatccaaagagggccaccttcaaaacgggaagatgcaaacgaaaccgaatgctaatttcgtacagcctggcgatctggtgctgtcgcatacacccggccagcctcttcacatcaaggtcactccagaccacgtacagaatacagccaccctggaaatcacaagccccactaccgagtcgccccactcgtacaccagcaccgccgtcatcccaaattgtggaactcccaagcaaagaataaccatccttcagaacgcctccataacacctgtaaagtcaaaaaccagcacagaggacctgatgaaccttgaacagggcatgtctcctatcacgatggcgaccttcgctagagcacaaactccagaatcctgcggcagcctgacccccgagagaacgatgtccccaatacaggttttggcggtgaccggctccgcctcaagccccgagcagggccgaagtccggagcccaccgagatcagtgccaaacacgccatattccgggtgtccccggacagacagtcctcctggcagttccaacgatctaactctaattcctcctcagtaataaccacagaagacaataagatccacatacacttaggatcgccgtacatgcaggccgtagcgtctccagtcaggcctgcatctccctccgcccccttgcaagacaacagaacgcaaggcctgataaacggcgccctgaacaagaccactaacaaggttacatccagtatcaccattactcccactgcgacccctctcccacgtcagtctcaaattaccgtaagcaatatatataactag

SEQ ID NO: 187934 - DNA, 3408 bp, Artificial Sequence
  Description of Artificial Sequence: Synthetic coding sequence
atgcggagccggggcagcgacaccgagggcagcgcccagaagaagtttcccagacacaccaaaggccactccttccagggacccaagaatatgaagcatcgccagcaggacaaggactccccgtctgagtcagacgtaatcctcccttgtcccaaggccgaaaagccacacagcgggaatgggcaccaggcggaggacctttcgcgggacgatttgttgtttctcttgtctattcttgagggggaactgcaggcaagagacgaggtgatcggaatcctcaaagcagagaagatggacctggctctgttagaagcgcagtatggcttcgtgaccccaaagaaggtcctggaggcactccagcgtgacgcctttcaagccaagtctaccccttggcaggaagacatttacgaaaagcccatgaatgagctggacaaggtggttgagaagcataaggaatcctataggcgtattcttggccagttgctcgtggctgaaaagagccgcagacagacaattctggagctcgaggaggagaaacgtaagcataaggagtacatggagaagagcgatgagttcatctgtttactagaacaggaatgcgaacgacttaagaaactgattgaccaggagatcaaatctcaggaagagaaagagcaggagaaagagaagcgagtcactacgttgaaagaagagctgaccaaactcaagtcgttcgctctcatggtggtggacgagcagcagagactgaccgctcagctgaccttgcagcgccagaaaattcaagagttgaccacaaatgcaaaggaaactcacacaaaactggccctagcggaggcccgcgtgcaggaagaggaacagaaagctaccagactggagaaggaactgcaaacccagacaaccaaattccaccaagatcaggacacaataatggcaaagctgaccaacgaggatagccagaacagacagctgcaacagaagcttgctgcactttccagacaaattgacgagctggaggagactaataggtccctacgtaaggcagaagaggagcttcaagatatcaaagagaaaataagcaagggtgagtacggaaacgctggaattatggccgaggtcgaagaacttagaaagcgtgtgctcgatatggagggcaaggacgaagaactcatcaagatggaggaacagtgtagggatctcaataagagacttgagagggagactttgcagtcaaaggattttaagctagaagtagagaagctttctaagcggatcatggcattggaaaagctggaagacgctttcaataaatcaaaacaggaatgttactcactgaagtgcaacctggagaaagagaggatgacaactaagcagctgtcccaggagcttgaaagtttgaaagtgcgcattaaggagctggaggccatagagagcaggcttgaaaagaccgaatttacgctgaaggaggacttgactaagctgaaaacattaaccgtgatgtttgtggatgagcgtaagaccatgagcgagaagcttaagaagacggaagataaactccaggccgcatccagtcagttacaggttgagcagaataaggttaccactgttacagagaagcttatagaagagactaagcgcgcccttaagagcaagacagacgtcgaggagaagatgtactcggtgaccaaggaaagagacgaccttaagaacaaactgaaggctgaggaggaaaagggaaatgatctattatctcgggtaaatatgctgaagaacagactgcaatctttggaagccatcgagaaggattttctcaaaaacaagctcaatcaggatagcggaaagtccaccacagcattacaccaggagaataacaagatcaaggagctcagccaggaagtcgaacgcctgaaactgaaactgaaggatatgaaggcgatagaagacgatctaatgaagaccgaagatgagtatgaaactctggaaagaagatacgccaatgagagggacaaagcccagtttctgagtaaagaactggaacacgtgaagatggaactcgctaaatacaagcttgccgagaagacagaaacgtcacacgagcagtggttgtttaagcgcctgcaagaagaggaagccaagtccggtcatctttccagagaggtggatgcattgaaggaaaagatccatgagtatatggcaaccgaagatcttatatgccaccttcaaggtgatcacagcgttctgcagaaaaaactcaatcagcaggaaaaccgaaaccgggacctagggagggaaattgagaacttgaccaaggaactcgagcggtaccgccatttttccaaaagtcttagaccgagtctgaacggcagacgcatctctgatccacaagtctttagcaaggaggtgcagactgaggccgtcgataatgagcctcccgactacaagtctctcatacccctggaacgcgccgtgattaacggccaactctacgaagaatccgagaatcaggatgaagaccctaacgatgaagggagtgtgctaagcttcaaatgcagccagtctaccccatgccccgtgaaccgaaagctgtggatcccgtggatgaagtctaaagaggggcacctacagaacggaaagatgcaaacaaagcctaacgctaactttgtgcagcctggggatctggttttgagtcacacccctgggcagccacttcatatcaaggtgaccccagaccatgtccagaatacagctacattggagattaccagcccaactactgagagcccacatagctacaccagtactgccgtgattccaaactgcggaactcccaagcagagaatcactatccttcagaatgcctccatcacccctgttaaaagtaagacctccactgaggacctgatgaaccttgaacagggcatgagtccaatcacaatggctacattcgccagggctcagacccctgagagctgcggctcgttaacccccgaaagaactatgtctcctatccaagtgttagccgtcactggctctgctagtagcccagagcagggaaggtctcccgagcctaccgaaatatcagctaagcacgctatttttcgggtatcccccgacaggcagagcagctggcagtttcagaggagcaacagtaattctagcagtgtgatcaccacagaagacaacaaaattcatattcatttgggcagtccatacatgcaggctgtggcatcccctgttaggccggcctccccttcagccccattgcaggacaatagaacccaggggctgattaatggggcccttaataagaccactaataaagtcacatccagtatcacaattacacctaccgcaaccccccttccccgccaatctcagatcacagtcgaacccctgctgctgccccactag

SEQ ID NO: 187935 - DNA, 2682 bp, Artificial Sequence
  Description of Artificial Sequence: Synthetic coding sequence
atggtggtggacgagcagcagcggctgaccgcccagctgaccctgcagaggcaaaagatccaggaattgaccacaaatgctaaggagacccatactaagctcgctttagcagaagctcgcgtccaggaggaagagcagaaggccactcggttggaaaaagagttacagacacaaaccactaagttccaccaggaccaggatacaataatggcaaagctcacaaatgaagactctcagaaccgccagctacagcagaagctggcagcgctgtctcgccaaattgacgagctggaggagaccaaccgaagcctgcggaaggctgaagaggaactccaggacattaaagagaaaatcagtaagggggagtatgggaatgctgggattatggccgaggtggaggaactgcgaaagagagtactagacatggaaggaaaggacgaagaacttatcaaaatggaggaacagtgcagagacctcaataagagattggagcgcgaaacactccaaagtaaagacttcaagcttgaggtggagaagctgtccaagcggatcatggcattggagaaactcgaggacgcttttaacaaaagcaaacaggaatgctacagcttgaaatgcaatctcgagaaggaacgcatgactaccaagcaactgagtcaggagttggagtcacttaaagtgcgtattaaggagctggaggccatcgaatcaaggttggagaaaaccgaatttaccctgaaggaggaccttactaagcttaagacccttaccgtgatgttcgtggacgagcgcaaaacaatgtccgaaaagctgaaaaagactgaggacaaactccaggcagcatccagtcagctccaggttgagcaaaataaagttaccacagtaacagaaaaattaattgaggagactaagagggccctgaagagcaaaactgacgtagaagaaaaaatgtactctgtcacaaaagaaagagacgatctgaagaataaactcaaggccgaagaagagaaagggaatgacctgctgtctcgggtgaacatgctgaaaaatcgcctgcagtcacttgaggccattgaaaaggattttcttaaaaacaaactaaaccaagactctggcaagagtactacagctctacatcaggaaaataataagatcaaagaactctcacaggaagtcgaacgccttaaactcaaattgaaggatatgaaagcgattgaagacgacctgatgaagacggaagacgagtacgagacgttggagcgacgttatgcaaacgagcgcgataaggctcagttcctgagcaaggaacttgaacatgtgaaaatggagttagccaagtacaaactggcagagaagaccgagacctcccatgagcagtggctgtttaagcggctgcaggaggaggaagctaaatcaggtcatctgtcacgggaggtcgacgcgttgaaagagaaaatccacgaatatatggcaacagaggatctgatttgccatctccagggcgaccactccgtcttacagaaaaaactgaaccagcaggaaaaccgtaaccgggacttaggcagggaaattgaaaatttgaccaaagaattggagcggtacagacatttctcgaaatcactcaggcccagtctgaacggacgccgtatctcagatccccaagtgttctccaaagaagtgcagaccgaggcagttgacaatgaacctcccgattataaaagtctgattcctttggagcgcgcagtgattaatgggcagctgtatgaggagtctgagaaccaagacgaagatcctaacgacgagggttcagtgctgtcctttaagtgctcgcagtccacaccctgtcccgtgaaccgcaaactgtggataccatggatgaagagcaaagaggggcacctgcagaatggcaaaatgcagacaaaaccgaatgcaaatttcgtccagcccggtgacctcgtactgtcccatacacctggccagcctctgcatattaaggtgactccggaccatgtccaaaatacagccaccctggaaattaccagtccaactacagagagcccccacagctacacctctacagctgtgattcccaattgtggcacccctaagcaacgcatcaccattttgcagaacgcctcaataactcccgtaaaaagtaagacctccactgaggacctaatgaacctagagcagggcatgagtcctatcactatggccacctttgctcgcgctcagacacctgagtcttgtggaagcctgactccagaacgcaccatgtcccccatccaggtgctcgccgtgacgggcagcgcgagctctccagaacagggacgaagtcccgagcccactgaaatttcggcgaaacacgccatcttcagagtctcaccagataggcagtccagctggcagttccagcgttccaattcgaactcctcgtcggtgataaccacagaagacaacaaaattcacatacatctgggaagcccttacatgcaagctgtcgcgagtcccgtgaggccagccagcccgtccgccccccttcaggacaacagaacacagggactgatcaacggggctcttaataagacaactaataaagtcacctcaagtattaccatcactcccaccgccactccactgccaaggcagagtcagatcaccgtctctaatatatataattag

SEQ ID NO: 187936 - DNA, 768 bp, Artificial Sequence
  Description of Artificial Sequence: Synthetic coding sequence
atgcggagccggggcagcgacaccgagggcagcgcccagaagaagttccctagacatacgaaaggccactcattccagggccccaagaacatgaagcatcgtcagcaggataaggattctccctctgagtccgatgtgattcttccctgtcctaaggccgaaaagccacactccggtaacggacaccaagccgaagatctgtcaagggacgacctgttatttctcctgagcatcctggagggggaactgcaggcacgagatgaagtaatagggatcctgaaagccgagaaaatggatctcgcactcttggaggctcagtacgggttcgtcacccctaaaaaggtgctcgaggcccttcagagggacgcctttcaggctaaaagtactccgtggcaggaagacatctacgaaaagcctatgaatgagctagacaaggttgtcgagaagcacaaggagtcctaccgcagaattcttgggcagctgcttgtagctgagaagtccaggaggcagacgatcctggaactggaagaggaaaagcgaaagcataaggagtacatggagaagtctgacgagttcatctgcttgcttgagcaagaatgtgagagatggtcgcttgcccttttgccgcggttagagtgcaacggtatgattctggcccactgcaatttgtgtctgctgggctcctccgattcccctgccagcgcctttcaggtggccggtataacagggacccgtcaccacgcccagctggtcttcgtgtttctctag

SEQ ID NO: 187937 - DNA, 2640 bp, Artificial Sequence
  Description of Artificial Sequence: Synthetic coding sequence
atggtggtggacgagcagcagcggctgaccgcccagctgaccctgcagcggcagaaaattcaagagctcacgacaaacgcaaaggagacgcacactaaattagcattggcggaggcccgcgtgcaggaagaagagcagaaagccacccgactcgaaaaagagttgcagacacagactacaaaatttcaccaggatcaggatacaatcatggctaaactcactaatgaagactcccagaaccggcagctgcagcagaagctggctgcccttagccggcagatcgacgagctcgaggagaccaatcgaagtctgaggaaggctgaggaggaacttcaggacattaaagagaaaatctcaaagggtgagtacgggaatgcaggtatcatggccgaggtggaggaactgattaagatggaagagcagtgcagggatctgaacaaacgtttggaacgggagacattgcagagcaaagattttaagctcgaggtggaaaagctgagcaaacggataatggcactggaaaagttagaggatgcctttaataagagcaaacaggaatgctattctctgaagtgcaatctcgagaaagaaagaatgacaaccaaacagttgtcacaggagttagagagcttgaaggtccgaataaaggagctcgaggccattgaaagccgcttggaaaaaaccgagtttacattgaaagaagacttaaccaaactgaaaactctgaccgtgatgttcgtcgacgaacgcaaaaccatgagcgaaaagcttaaaaagacagaggataaactccaggcggcttcttcgcagttacaggtggaacagaacaaggtgactaccgtcacggagaaactgatcgaggagacgaaaagagccctgaagtcaaagactgacgtggaagaaaaaatgtattcagttaccaaggaacgcgacgatctgaagaacaagctgaaggccgaagaagagaaggggaacgatcttctcagcagagtaaatatgctcaaaaatcgcctacagtccctcgaggctatcgaaaaagattttctgaaaaataaactgaatcaggattctgggaaaagcaccaccgccctgcatcaggaaaataacaaaatcaaggagttgtcccaggaagtcgagcggctaaagctgaagcttaaagatatgaaggccatcgaagatgatttaatgaagactgaggatgagtacgaaactctagaacgaaggtacgctaacgagagggacaaggctcagttcctgtcaaaagagctcgagcatgtgaaaatggagctcgcaaagtacaagctcgctgagaaaactgaaacatctcacgagcagtggctattcaaacgactgcaggaggaggaagctaagagcggccacctgtccagggaagtggacgccttgaaggaaaaaattcatgaatacatggctacagaggacctgatctgtcacctgcaaggagatcactcagttctgcagaaaaaattgaaccaacaggaaaatagaaaccgagatctggggagggagattgagaacctcacaaaggagctggaaagatacagacacttctccaagagtctgagaccttcattaaatggacggaggatctctgacccacaggtgttctccaaagaggtgcagaccgaggctgtggataatgagcctcctgactacaagtccctgatcccactagagcgggcagtcattaacgggcagctctatgaagaatctgagaaccaggatgaagatcccaatgacgaaggttctgttttgagcttcaagtgttctcagagtacaccttgtccagttaatcgaaaactttggatcccatggatgaagtccaaggaggggcacctgcagaacggcaagatgcagaccaagccaaacgcaaacttcgtgcagccgggcgacctcgtactgtcccacactcctgggcagccgttgcatattaaggtgactcccgatcatgttcagaatactgcgacgctggagattacatctcctactactgaatctcctcatagttacactagtactgccgtgatccccaattgtggcacgcccaagcagagaattaccatactccagaacgcgtccattacgcctgtgaaaagtaagacctccaccgaggatctgatgaatttagaacaggggatgtcgcccatcaccatggctaccttcgcccgggcccagacaccagagagctgcggcagcctcacccctgagagaaccatgtcccctatccaggttctggccgtgaccggaagcgcatccagccccgagcaagggcgtagccctgaacccaccgaaatcagcgctaagcatgctattttccgtgtgagcccagaccgtcagagctcctggcaatttcagcggtccaatagtaatagctcaagcgtgatcactaccgaggacaacaaaatacatatccatctcggatccccctacatgcaggcggttgcttctccagtgcggccggcgagcccctcagccccactccaagacaataggacacaaggcctcattaatggcgcacttaataagacaaccaacaaggtcactagctcgatcactattactcctaccgcaactcccctgcctcgccagtcgcagatcaccgtgagcaacatctacaattag

SEQ ID NO: 187938 - DNA, 2688 bp, Artificial Sequence
  Description of Artificial Sequence: Synthetic coding sequence
atggtggtggacgagcagcagcggctgaccgcccagctgaccctgcaaagacagaagatacaggagttgactacaaacgccaaggaaacccacacaaaattggcactcgccgaggcaagagtccaggaggaggagcagaaggccacaaggttggaaaaggagcttcaaacccagacaactaagttccatcaagatcaggacacaataatggcaaaactgacaaatgaggactcccagaatcggcaactgcaacagaaactggcggctctgtctaggcagatcgacgagctggaggaaaccaatagatccctgcggaaagctgaggaagagctgcaggacattaaagaaaagattagtaagggcgagtatggcaacgctggcatcatggccgaggtagaggagctgaggaagcgggttctggacatggagggcaaggatgaagagctgatcaagatggaggagcagtgtagagatttgaataagaggttggaaagggaaactctgcaatctaaagatttcaagttggaagttgagaaactgtctaagcgtataatggcactggaaaagttggaagacgcattcaataaaagcaagcaggaatgctactcgctgaaatgtaacctggagaaggaaagaatgacaactaagcagctgtcccaggagttggagagcctgaaagtgcggatcaaggagctcgaggccatcgaaagccgcctcgaaaaaaccgaatttacattaaaggaagacctgacgaaactgaagactctgactgtcatgtttgtagatgagcgaaagacaatgagcgagaaactcaagaaaaccgaagataagctccaggccgcgtcaagccagctgcaagtggaacagaataaagtcactacagtgaccgagaagctgatcgaagagactaagcgggctctgaaatccaagacggatgtcgaggagaagatgtactccgtaaccaaggagcgggacgatctgaagaacaagctcaaagccgaagaggagaaggggaatgacctgctgagccgggtgaatatgctgaagaacagactgcagtctctggaggcaatcgagaaggacttcctgaagaataagctcaaccaggacagcgggaagtcgaccaccgccctgcatcaggagaataacaaaataaaggagctctctcaagaagtggaacggttgaaactaaagttgaaggatatgaaggcaatcgaggatgatctgatgaagacagaagatgagtacgagaccctggagaggcgctacgccaacgagcgcgacaaagcgcagttcctgagcaaggaactggagcacgtaaaaatggagctagccaagtacaagctcgccgaaaagacggaaacctctcatgagcagtggttattcaaaagactacaagaagaggaggcgaagagcgggcacctaagtcgcgaggtggacgccctgaaggagaagattcacgaatacatggccactgaagatctaatttgccatttacaaggcgatcactcagtcttgcagaagaaattaaaccaacaagaaaataggaaccgggacctgggccgagagattgagaaccttacgaaggagctggaacgctaccgccatttctcaaagtctcttcgcccgagtctgaacggaagaaggattagtgaccctcaggttttcagcaaagaggtgcagaccgaagctgtggataatgaacctcctgactacaaatcactcattcccctcgagcgtgccgtaatcaatggtcagctgtatgaagagtctgagaaccaagatgaagaccctaacgacgagggatctgtgctgagcttcaagtgctcccaatctacaccttgtccagtgaacagaaaactgtggattccatggatgaaatccaaggaaggccatctgcagaatgggaaaatgcaaacgaagcccaatgcgaatttcgtccaacctggcgaccttgtcttgagtcacactcctggccagcctctgcacattaaagtgactccagatcatgtccaaaatacagcaactctagaaataactagtcccaccaccgagtccccacacagttatacatccacagccgtgatccctaactgtggcacacctaagcagagaataactattcttcagaatgcgagcattactcctgtgaagtcaaagaccagcaccgaggacttaatgaatcttgagcaggggatgagccccattacgatggcaacatttgcgcgggcccagacaccggagagctgcggctctttaacccctgaacggactatgagcccaattcaggttctggccgtcacgggctccgcatcctccccagaacagggaaggagtccagaacctacagagatctctgcaaaacatgcaatattccgggtcagtccagatagacagagttcatggcagttccagcgctcaaacagtaatagctcttctgtcattacaaccgaagataataagatccacatccacctgggcagtccgtacatgcaagccgttgcgagcccagtgcgtccagccagccccagtgcacctctgcaggacaatcgcacccagggtctgattaatggcgctctgaacaaaactacaaacaaagtaacatcctcgattacgatcacgcctaccgcgacccccctgcctcgccaaagccagatcactgtcgaacctcttcttctcccccactag

SEQ ID NO: 187939 - DNA, 2136 bp, Artificial Sequence
  Description of Artificial Sequence: Synthetic coding sequence
atggccctggagaagctggaggacgccttcaacaagagcaagcaggagtgttactccctgaagtgtaatttggagaaggaacgaatgaccactaaacagctgagtcaggagctggagagccttaaggtgcgcatcaaggagttagaagcaattgagtcacgcctggagaaaaccgaatttactttgaaagaggatctgactaaactgaagacattgactgttatgttcgtggacgagcgaaaaaccatgagcgagaagctgaaaaaaacagaggataagcttcaagccgctagctcccaattgcaggtcgagcaaaataaagtgacaactgtgactgagaagctgatcgaggaaaccaaacgggcactaaaatctaagactgacgtggaagaaaaaatgtattcagtcacaaaagagcgggatgacctgaaaaataaactgaaggcggaggaggagaaaggtaacgatctgcttagcagagtgaatatgctgaagaatcgcctgcagtctctggaggctatcgagaaagattttcttaagaacaagttgaaccaggatagcggtaaatccactacagcactccatcaggaaaacaataagattaaagaactgtcccaggaagtcgagagacttaaactgaagctcaaagacatgaaggcaatcgaggatgatcttatgaaaactgaggatgagtacgagactctggagcgccgctatgccaacgagcgggataaagctcaattcttgtccaaagagctggagcacgtaaaaatggagttggctaaatacaagctggctgaaaaaactgagacctctcacgaacagtggctctttaaacgcttacaggaggaagaagctaaatctggccaccttagccgcgaggttgacgccctcaaggaaaagattcacgaatatatggcaacagaggatctgatttgccatctgcagggggatcacagcgtcctccaaaaaaaacttaatcagcaagaaaataggaatcgggatctgggcagggaaatcgagaatctgaccaaagaactggaacgctacagacatttcagtaagagtctccgaccaagcctcaatgggagacgcatcagtgacccacaagtgtttagtaaggaagtccagaccgaggctgtggataatgagccccccgattataagtcccttatacccctcgagcgagcagtcattaacggccagttatacgaagagtcagagaatcaggatgaggaccctaacgatgaagggtcggtgctctcgttcaaatgttcacaatctacaccctgccccgtgaaccggaaactgtggattccctggatgaagtcgaaagagggccacctccagaacggcaaaatgcagactaaaccgaacgctaatttcgtccagcctggtgacctggtcctatcccatacgcccggccaaccattgcatataaaagttactcctgatcatgtgcagaatacagcgaccttagagattacatcccctacaacagaatcccctcacagttatacaagcactgcggtgattcccaattgcgggacgcctaagcagcggatcacaatcctccagaacgcttctatcacccctgtgaaaagtaaaacttccaccgaggatctgatgaatctggaacaaggcatgagccccattaccatggccacatttgctagggcacagactccagagagctgcggttccttgacaccagaaaggactatgtcccccattcaagtgttagccgttacaggtagtgcttcaagcccggagcaaggtcgctcaccagagccaacagaaatatcagccaaacacgccatatttagagtgagccctgaccgacagtctagctggcagttccagcgcagtaactccaactcgagctcggtgattaccactgaggacaataagattcatattcacctcggaagcccatatatgcaggccgtggcttccccagtccgaccagcctctcccagcgccccactgcaggataaccgcactcagggcttaatcaacggcgcacttaacaaaacaaccaacaaggtgactagttctattaccattacaccaaccgctacccctttgccccgtcaaagccagatcacggtggagcctctgttgctgccacactag

SEQ ID NO: 187940 - DNA, 2514 bp, Artificial Sequence
  Description of Artificial Sequence: Synthetic coding sequence
atggtggtggacgagcagcagcggctgaccgcccagctgaccctgcagcgacagaaaattcaggagctcaccacaaacgcgaaggagactcatactaagctcgctctggccgaggccagggtacaggaagaagagcagaaggctacccgcctcgaaaaagaacttcagactcagactacaaagttccaccaagaccaagacacgatcatggctaaactgacaaatgaagactcacaaaacagacagctccagcaaaaactggcagccctcagccgacagatcgacgagctggaggagacaaaccgaagtctgagaaaggctgaagaagagctgcaggatattaaggagaaaattagtaaaggcgagtacggaaatgcgggaatcatggccgaagtagaagagctgagaaagcgtgtgctagatatggaggggaaggatgaagagcttatcaaaatggaagaacaatgtcgcgacctcaataagcgccttgagcgagaaacgctccaaagcaaggactttaagttggaggtcgagaagctgtctaagaggatcatggctctagagaaattggaagatgcttttaataaatccaagcaagaatgttacagtttaaagtgtaatttggaaaaagaacggatgactaccaaacagctctcacaggagctggaatcactgaaggtccggattaaggagctggaggccatagagtccagactggaaaagaccgagtttaccctaaaagaggaccttaccaagctaaagacgcttaccgtaatgtttgtggacgagcgcaagactatgtccgagaagttgaagaagaccgaggataagctgcaggcagcatcgagtcaacttcaggtggagcagaacaaggtcacaacagtgaccgaaaagctgatcgaagaaaccaagagagcactcaagagcaaaaccgatgtcgaggagaaaatgtatagcgtgactaaggagagagacgacctgaaaaacaagcttaaagcagaagaggagaaaggtaacgacctgctctccagggttaacatgcttaagaaccggttgcagtcgctggaagctatcgagaaagatttcctcaagaacaaactcaaccaggattccggcaagtctaccactgctctgcaccaggaaaataacaagattaaagaacttagccaggaggtagagcgcttaaagttgaagctgaaggacatgaaagctatcgaggatgacctgatgaaaacagaagatgagtacgagacattagaacggcggtatgccaatgagagagacaaggcacagttcctgtccaaagagttagagcacgtaaaaatggaactcgccaagtacaagctcgccgagaaaactgaaacatcacacgaacagtggctgttcaagcgactgcaagaagaggaggccaaatctggtcacttatccagagaggtggatgctttgaaagaaaagatccacgagtacatggccaccgaggacctcatctgccatctccagggtgaccattctgttttgcaaaagaaactcaatcagcaggagaatcggaaccgcgacctcggacgcgagatcgagaatttgactaaggagttggagaggtaccgtcacttcagcaaatcgctgaggccgtcgctgaacggacgcagaatatctgatcctcaggtgttttctaaggaggtgcagacagaagccgtcgataacgaacctcccgactataagtccctgattcccctggaacgcgcggttatcaatggccagctttacgaggaatcagagaatcaggatgaggacccaaatgacgaaggcagcgttctgtcgttcaagtgtagccagagtacaccttgcccagtgaacaggaagctgtggataccatggatgaagtccaaggaaggtcatttacagaatggtaagatgcagacaaaacctaatgccaattttgtacagccgggggacctggtgctaagtcataccccaggccagccactccacattaaggtcacccctgaccatgtgcagaatacggcgactctcgaaattactagtcccacaaccgaaagcccacactcctacacttcaaccgcagtaattcctaattgcgggactcccaagcagaggatcacaatcttgcagaacgctagtattacacccgttaaatcaaagaccagtaccgaagaccttatgaatttggaacaagggatgagccctattaccatggcaactttcgccagggctcagaccccagagagctgcgggtcacttaccccagagagaacaatgtcgcccattcaagtgctggccgttactggatcagcaagcagccctgagcaggggcgctccccagaaccgacagagatctctgctaagcacgctatattcagagtatcccccgaccgacagtctagctggcagtttcagaggagcaactctaattctagctctgtgataactactgaggacaataagatccacattcatcttggttctccatacatgcaggccgttgccagcccatag

SEQ ID NO: 187941 - DNA, 7944 bp, Artificial Sequence
  Description of Artificial Sequence: Synthetic coding sequence
atgagcagcagccacagccgggccggccagagcgccgccggcgccgcccccggaggtggcgtggacacaagggacgcggagatgcctgccaccgaaaaagatttggctgaagatgccccgtggaagaagatccagcagaacaccttcaccagatggtgcaacgaacatcttaaatgtgtgagcaaaaggatcgctaatttgcaaacagacctatccgatggactgcggctgattgccttactggaagtgctgtcgcagaaaaagatgcacaggaaacacaatcaacggcccacatttaggcaaatgcaactagagaatgtaagtgttgctctggagttcttggatagagagtccattaaactggtgtcaatcgactcaaaggcgattgtagacggtaacctaaagctgatacttggccttatttggacattgatactccattatagcatttcaatgcccatgtgggatgaagaggaagacgaggaggctaagaaacagactccgaaacagcgactcttggggtggatccagaataaattgccgcaacttcccatcaccaatttcagtcgtgattggcagtccggccgggcactcggagctctggtggactcctgtgctcctggcctctgtccagactgggactcatgggatgcttcgaagccagttacgaacgcgagggaagccatgcaacaagccgacgattggcttggaattcctcaggtgatcaccccagaagagattgtggaccctaacgtcgatgagcactctgtgatgacttaccttagccaattccccaaggctaaactgaagcccggtgcacccctgcgtcctaagctcaacccaaaaaaggccagggcttacgggcctgggattgagcccaccggcaatatggttaagaaacgcgccgagttcactgtcgagacgcggtctgctggccagggtgaggtccttgtctatgttgaagatccagctggccatcaagaagaggccaaagtgaccgcgaacaatgacaaaaaccggactttctctgtgtggtacgtgccagaggtgaccgggactcataaagtgactgtcctgtttgcagggcagcatatcgccaagtcccctttcgaggtgtatgttgataaatcacagggtgacgcaagtaaggtcaccgcccaaggcccaggtctggaaccaagcggcaatatcgcaaacaagaccacttactttgagatctttacggcaggcgcgggtacaggggaagtggaagttgtaatccaggaccccatgggtcagaagggcaccgtcgagccgcagctggaagcccgaggagactccacgtaccgctgctcctatcagcctaccatggagggcgttcacacagtccacgtcacattcgctggggtgcccatcccacgctccccctacactgtcactgtgggccaggcatgtaatccttccgcttgtagagcagtggggcgggggctccagccaaaaggcgtcagagtgaaggagacagcagatttcaaggtctatacaaagggggctggttcgggagaactgaaggttaccgttaagggacccaagggcgaggaaagagttaagcagaaagaccttggagatggggtctacgggttcgagtactatcccatggttccaggcacctacatcgtcactataacttgggggggacaaaacattggtcgatcaccctttgaggtaaaggttggcaccgaatgcggtaaccaaaaagtgcgtgcttggggccctggtttagagggcggcgtcgtcggcaaatctgccgacttcgtggtcgaggctatcggcgacgatgtgggcacgttaggattctcagtggagggcccaagccaggcaaaaattgagtgcgatgacaaaggcgacggctcatgtgacgtcaggtactggccgcaggaggccggtgagtatgccgtccacgtactttgcaattcagaagacattagactgtccccattcatggcagatatccgtgacgctccccaagatttccaccccgatcgagtcaaggcccggggtcccggcctcgagaagaccggagttgccgtgaacaaaccggctgaattcaccgtggacgctaaacacggaggcaaagctcccttacgggttcaggtgcaggataatgaaggctgtccagtagaagccctggtcaaagataacggaaacggcacctattcgtgtagctatgtcccacggaaacctgtgaagcacaccgcaatggtttcatggggcggtgtctcaatccctaacagcccttttagagtaaacgttggggcaggatcacaccccaataaggtgaaggtttacgggccaggggtggcaaagactggccttaaagcccatgaacctacctactttaccgtagactgtgcagaggccggccagggagacgtttcaattgggattaagtgtgctcctggagtggtagggccagccgaagcagacattgattttgatatcatccgcaatgataatgatacgttcaccgttaaatacacccccaggggtgccggaagttacacaatcatggtgctgttcgcagatcaagcgactcccacatcacccatccgcgtcaaagtagagccttcgcacgatgccagtaaagttaaggcagaaggtcccggcctgtctcgtaccggtgttgaacttgggaagcccacacacttcaccgtgaacgctaaggccgcaggcaagggcaagttggacgttcaattctctggactcaccaaaggagatgctgtcagggacgtggacattatcgaccaccatgataacacatacaccgtcaagtatacccccgtgcaacagggccccgtcggcgtaaacgtaacctacgggggagatccaattccaaaaagccctttcagtgtagccgtgtctcccagcttggatctgtcaaaaatcaaagtgtccggtctgggggagaaagtagatgtgggcaaggaccaggagtttaccgtaaaatctaaaggcgccggcggacaagggaaagtcgcttcaaaaattgtgggtccaagcggggctgctgtgccctgtaaggtcgagccagggctaggggcggataactcggtggtacggtttctcccacgggaggaaggcccctacgaggttgaggtgacgtacgacggcgtgccagtccctggaagtcccttccctctggaggcagtggccccgactaagccttccaaagtcaaggctttcggaccaggcctccaaggaggctctgctgggtcgcctgcaaggttcacaattgatactaagggggcaggtaccggggggctcggcctgacagttgagggtccctgcgaggcacagctggagtgcctggacaatggagatggcacatgttcagtatcatacgtgccaaccgagccaggggactataacatcaatattttgtttgctgacacgcatatacctgggtcaccatttaaggctcatgtggtgccttgtttcgacgctagcaaagtaaaatgctcaggaccagggttagagcgcgctacagccggggaagtgggtcagttccaagttgattgttcttccgctggctctgcagagttgaccatcgaaatatgttctgaggctggcttgcccgcagaggtgtatattcaggaccacggcgacgggactcacactattacctacatccccctatgccctggagcctatacagtcaccatcaagtacggcggccaacctgtgccaaacttccccagcaaacttcaggtggaacctgcagtcgatacctcaggagtgcaatgctacggtcctggcatagaggggcagggagtcttcagagaggctaccactgagttttcagtggacgcccgtgcactcacgcagaccggggggccccacgttaaagcccgcgtggcaaacccatctggaaatctaaccgaaacatacgtgcaggacaggggagatggcatgtataaagtggagtacaccccatatgaagaaggactacattctgtggacgtaacatacgatggaagccctgttcccagctctccctttcaagtgcccgtgaccgagggctgcgacccatcccgagttagagtccacggcccaggcatccagagcggcaccaccaataaaccaaacaagtttactgtcgagacacgcggggcagggacaggtggtctgggcctcgctgtcgaaggaccttccgaagctaaaatgtcatgtatggataacaaagacggatcttgcagtgtggagtatatcccctacgaagctggaacatatagcctcaacgtaacatatggcggccatcaagtgcctggctcccctttcaaggtgcctgtgcatgacgtgactgatgcttcgaaggtgaagtgttctggtccgggactatcaccaggaatggtgagagccaacctgccgcagagcttccaggtggacacaagtaaggcgggtgttgcacctctccaagttaaggtccaggggcctaaggggctggtcgagcctgtagatgtggtggataatgcggatggcactcaaacagtaaactacgtgccttccagggagggcccctacagcatctcagtcctctatggggacgaggaagtaccgcggagcccgttcaaggtcaaggttctgccgacccacgatgccagcaaggtcaaagcgtcaggcccgggcctaaatactactggagtacccgcaagtctgcctgtggaattcaccatcgacgcaaaagatgcaggtgaagggttgttggcagtgcaaatcacagatccagagggaaaaccgaaaaagactcatattcaggataatcacgatggaacatacaccgttgcatacgtgcccgatgtgacgggcaggtatacaatcttaattaagtatgggggggatgagattccatttagtccctatcgggtgcgtgcagtaccaacgggcgacgcctccaagtgcactgtgaccgtatctatcgggggacacggccttggtgccggtatcggcccaactattcagatcggagaggagacagtcattacggtcgacacaaaagccgcaggcaagggcaaagtcacttgcaccgtgtgtacccccgatgggtcggaggttgacgttgacgtggtcgagaatgaggatggcacttttgatatattttataccgcaccccagccaggtaagtatgtgatttgcgttcggttcggcggtgagcatgtgcctaatagtcccttccaggtgacagctctggccggggaccaacccagtgttcagccgccgctacggtctcagcagcttgcgccgcagtatacatatgcccagggcggccaacagacctgggcacctgaaagaccgcttgttggtgtgaatggccttgacgtgacatccctgcgtcctttcgaccttgtgattccctttacaatcaagaaaggtgaaattacaggcgaagttcgtatgccctccggaaaggtggcgcagccaacgattactgacaataaagacggaacagtcaccgtgcgttatgcgccgtccgaggccggcttgcatgagatggacatcagatacgataacatgcacattcccggaagcccccttcagttttatgttgattatgtgaactgcggacacgtcactgcctatggccccggcctaacacacggcgttgtgaacaagccagcgaccttcactgtgaacaccaaagacgccggcgagggtggtctgtccttagcaattgagggtcccagtaaggccgaaatctcatgtaccgataatcaagatggtacctgctccgtgtcttacttacccgtcctcccgggcgattactccatcctggtgaaatataatgaacagcacgtgcctgggagcccttttacagcaagggtaacgggtgacgattcaatgaggatgagccacttaaaagtagggtctgccgccgacatccccatcaacatatccgagacggacttatcactccttacggctaccgtggttccaccaagtggccgcgaggagccatgcctgcttaagaggctccgcaacggacacgtcgggatttccttcgtccccaaggaaactggtgagcatctagtgcatgtaaaaaagaacggccagcacgtggctagttcccctatcccggtggtgatctcacagtccgaaatcggtgatgcttccagggtgcgcgtatcaggccaaggactgcatgagggccatacctttgagcccgccgaatttataatcgacacccgcgacgccggctacgggggcctgagtctaagcatcgaaggcccttctaaagttgatatcaatactgaggatctggaggatgggacttgccgagtcacctattgcccgactgaaccaggcaactacatcattaatattaagttcgccgatcagcacgtgccgggatctccatttagtgtgaaagttaccggggagggccgcgtgaaggagtctataaccaggagaaggagagcacctagcgtggccaatgtgggctcacactgcgatctctcactgaagatccccgagatctcaattcaagatatgaccgcccaggtcaccagcccgtcgggaaagactcatgaagcggaaattgtggaaggcgagaaccatacctattgtatcagatttgttcctgcagagatgggaacacacacagtctcggttaaatataaggggcagcatgtacctgggagcccgtttcagttcacagttggcccccttggcgagggcggggcccataaggtcagagctggcgggcccggattagaacgagcggaggcaggtgttccagccgagttctcaatatggacccgcgaggccggagcgggggggctggcgatcgcagtcgagggccccagcaaagcggagatttcatttgaagaccggaaagacgggtcttgtggagttgcttatgtcgttcaagaaccaggcgattatgaagtctctgtcaagtttaacgaggaacacattcctgattcaccgttcgtggttcctgtcgcgtctccatcaggggatgctaggaggctgaccgtatcatctctgcaggaatctggcctgaaggttaaccagccggcctcttttgccgtgtctttgaacggggccaagggagctattgatgccaaagtgcatagcccctccggtgcgcttgaagaatgctatgttaccgagatcgatcaggacaaatacgccgtgcggtttattcccagagagaatggcgtgtatctgatcgatgtgaaatttaatggaacccacatacctggttcacccttcaaaatacgcgtgggtgaaccggggcacggaggtgaccctggtttggtgtccgcctatggagctggcctggagggtggcgtgaccgggaatccggctgagttcgtggttaacacttcgaatgcgggggccggtgccctgtccgtgacaatcgacggcccttcaaaagtaaagatggattgccaggagtgtcctgaaggctatagggtcacgtatacgcctatggcaccaggtagctacctgatcagcatcaaatacggcgggccataccacatcgggggatcaccttttaaggctaaggtaacggggcctcggctcgtgtctaaccatagcctccacgaaacgagcagtgtgttcgtggacagtctgacgaaagccacatgcgctcctcagcacggggctcccggccctggcccagctgatgcctccaaagtagtggcaaagggccttggactgtccaaagcatacgtgggtcagaaatctagctttacagtggattgtagtaaagctggtaacaacatgctcttggttggagtgcatggcccccgcactccatgtgaggagatactggtaaagcacgtcggtagtcgtctgtacagcgtatcctaccttcttaaggacaagggggagtacactttggtcgtgaaatggggcgatgagcatattccaggaagtccttatcgtgtcgtggtgccttag

SEQ ID NO: 187942 - DNA, 6948 bp, Artificial Sequence
  Description of Artificial Sequence: Synthetic coding sequence
atgcccgccaccgagaaggacctggccgaggacgccccctggaagaagattcagcaaaacacttttacgcgctggtgcaatgaacacctcaagtgtgtgtctaaacgtatcgccaatctccagacagacttaagtgatggcctgcgattgattgccctgctggaggtcttatcgcagaagaagatgcacagaaagcataatcagcgacctacctttagacagatgcagttagaaaacgtgtcagttgctctggagtttctagatcgtgagtctattaagctcgtctccatcgactccaaggctatcgttgacgggaacttaaaactgattttaggcttaatctggaccctcattctccattatagcatatcaatgcccatgtgggacgaagaggaagatgaagaggctaaaaaacagacccccaaacagaggctcctcggatggatacagaataaactgcctcaacttccgattaccaatttctcccgcgactggcagagcggacgagcgctgggcgccctagtcgattcttgcgccccaggactctgcccggattgggattcttgggacgccagtaaaccggttacaaacgcccgcgaagctatgcagcaagccgacgattggctggggattccccaagtgatcacacccgaggagatcgtagaccccaacgttgatgagcacagtgtcatgacttacctgagccaattccccaaggctaagttaaagcccggtgctccgcttcgcccaaaactgaacccaaagaaagctcgggcctatggcccaggaatcgaaccaacaggtaacatggtgaaaaagagggcagaattcaccgttgaaacgaggtctgcaggacaaggagaggtgctggtctacgttgaagaccctgcaggccaccaagaggaggccaaggtgactgcgaataacgacaaaaacagaactttcagcgtgtggtacgtgcccgaagttaccggcactcacaaggtgacggtcctgtttgctgggcaacacattgccaagagtccatttgaggtctatgttgacaagtcccagggggacgcgagtaaagtgaccgctcagggaccgggtttggagccttccgggaacatagcaaacaagactacttactttgaaatatttaccgcgggtgctggaactggggaagtagaagtcgtgatccaggatccaatggggcagaagggtaccgttgagccacagctagaggcccgtggtgactcgacatatagatgttcctaccagcccaccatggaaggagtgcacacagttcacgtgacttttgccggcgtgcccattcccaggtctccgtacacggtgaccgtgggccaggcctgcaacccctcagcctgtcgtgctgttggccgtggcttacagcccaagggcgtgcgggttaaagagacggccgatttcaaagtttacacgaaaggcgccggcagtggggaactgaaggtgacggttaaagggcctaaaggcgaggaacgggtcaaacagaaggatctgggagatggggtttatggctttgagtattaccctatggtacctggcacctacatcgttaccattacttggggcggccagaacattggaagatctccatttgaagtaaaggtgggcaccgaatgcggcaaccagaaagttagagcttgggggcctggactggagggaggcgtggtgggaaaatccgctgatttcgtcgtcgaggctattggggacgacgtgggcactttaggattctccgttgaggggccctctcaggctaagatcgaatgtgatgataagggcgacggctcttgcgacgtgcggtactggccacaggaagccggcgagtacgccgtgcatgttctctgcaattcagaggatattagactgtccccattcatggcagatatcagagacgcccctcaggattttcaccctgacagagtaaaagcccgggggccaggcttagagaaaactggcgtggcagtgaacaaaccagccgaatttacagttgatgctaagcacggtggtaaagcccctctgcgagtgcaggtgcaggataatgagggctgccccgtggaagccctggtgaaagacaatggcaatggtacttacagctgctcctatgtgccacgcaagccagtgaagcatactgcaatggtatcatggggcggcgtttctatccctaactctcctttcagagtgaacgtcggtgctggctctcaccctaacaaggtgaaagtgtatggcccgggggtggcaaaaaccgggctgaaggcccacgaacccacttactttacagtggactgcgcagaggccgggcaaggagatgtgtccatcggcatcaagtgtgcgcccggagtggtcggtccagcagaggccgacatcgacttcgatatcataagaaacgataatgacactttcacagtgaaatacactcctcgtggggcggggagttacactattatggttctcttcgcagatcaggcaactcccactagccccatccgagtgaaagtagaaccctctcacgacgccagcaaggtaaaggcagaggggccaggtctcagccgcaccggagttgaactgggaaagcccactcatttcactgttaatgccaaggccgctggtaaggggaagctggatgtccagttcagcggtttgaccaagggggacgctgtgcgcgacgtggatattatcgatcatcatgacaatacctataccgttaaatacaccccagtgcagcagggtccagtcggagtgaacgttacatatggcggcgacccaatacctaaaagcccatttagcgtggcagtgtctccaagcttggacttgtctaaaatcaaggtgtcaggtctgggtgagaaagtcgatgttggaaaggaccaggagtttacagtgaagagtaagggcgctggagggcaggggaaagtggcaagtaaaatcgtaggcccgagtggagcggcggtgccatgtaaagttgaacctggcctcggggcagataattccgtggtccgattcctcccacgggaggagggcccatacgaggtggaggtgacttacgatggcgtgccagtgcctggctctccatttcctcttgaggcagtagcacccacgaagccttcgaaggtgaaagcatttggcccaggactgcagggcggatctgccggaagcccagcaaggttcaccattgatacaaagggagctgggactggaggccttggccttacagtggagggtccctgtgaagctcagctggagtgtctcgacaacggggacggcacttgcagcgtgtcctatgttccaacagaacccggcgattataatataaatatcttattcgcagacacacacatccccggctctccattcaaagcccacgtagtcccgtgcttcgatgcttccaaggtgaagtgctcaggcccaggtttggagagggccactgccggagaagttggacaatttcaggtggactgttcttcggcaggatcagccgagctgaccatcgagatttgctcagaagccggtctacccgccgaagtttacatccaggaccacggcgacggcactcacacaataacctacattccactgtgcccaggggcttacacagtcaccatcaagtatgggggccaacctgtgcccaatttcccctcaaagctgcaagtagagcccgccgtggacaccagcggggtccagtgctatggtcccgggatcgaggggcagggtgtgttccgggaagcaaccactgagttttcagttgatgcgcgggcccttacccagaccggcgggccccacgtcaaggcacgcgtggccaatcccagcgggaacctcaccgaaacatacgtgcaggacaggggtgatggtatgtacaaagtggagtatacaccgtacgaggagggcctccatagcgtggatgtgacctacgatggatctcccgtcccaagctcacccttccaggtgccagtgacagaaggttgtgacccttccagggtgcgtgtgcacggaccagggattcagagcgggacaacaaacaagcccaataaattcacagtcgaaactcggggcgccggaacgggcggtctagggcttgctgtagaaggcccatcagaggccaagatgtcatgtatggacaataaagacggaagctgcagtgtagagtacatcccctatgaggctggaacctacagtcttaacgtgacttatggtggacaccaggtaccaggctcgccattcaaggtcccagtccacgacgtgacagatgcatcaaaagtaaaatgctccggacctgggttgagcccgggaatggttcgagccaacttgccacagagtttccaggtggatacctcaaaggctggtgtggccccactgcaggtgaaggtccagggcccaaagggacttgtggaaccagttgacgttgtcgataacgctgatgggacacagactgtgaattacgtgccaagccgagagggtccatactccatctccgttctctacggggatgaggaagtgcctcggagccccttcaaggtgaaggtgctccctacacacgacgctagtaaagtcaaggcgtccggacctggcttgaacaccacaggcgtgcccgcatcactccccgtcgaatttacaatagacgcaaaagacgcaggtgagggactccttgccgtgcagattaccgatcccgaaggtaaacccaaaaagactcatatacaggacaaccatgacgggacatacactgtggcctatgtcccagatgtgactggaaggtacaccattctgatcaaatatggcggagatgaaattcccttcagcccttacagagtgagagctgtccctacaggggatgcaagcaaatgtaccgtgacggtttcaattggcggtcatggcctgggggccgggataggcccgactatacagatcggagaagagacagtcattacagtggacacaaaagcggcagggaaagggaaggtaacttgcacggtgtgtactccagatggctccgaggttgacgtagacgtggtggagaacgaggacggcactttcgacatattctacactgctccgcagccaggcaaatacgtgatctgcgtgcgttttgggggggaacatgtgcctaactcccccttccaggtcacggccctggctggagaccagccctctgttcaacctcccttgcggagccaacagttagccccccagtatacttatgcccagggaggccaacagacctgggcccctgagaggccacttgtgggggtgaatgggctggatgtgacttccctgaggcctttcgacctagtgatcccctttacaattaaaaaaggcgaaatcactggtgaagtgcgaatgccgtcagggaaagttgctcagcccactattaccgacaacaaagacggtacggtgactgtccgctatgctccctctgaggccgggctgcacgaaatggacataaggtacgataacatgcatatcccaggttcccctcttcaattttatgtggactacgtaaattgcggtcacgttaccgcctacggccctgggctgacacacggagtggtaaacaaacctgctacctttaccgtgaacactaaggatgccggagaaggcggcctcagcctcgccatcgaagggccgagcaaagccgagatttcttgcactgataatcaggacgggacctgctccgtgagttacctgccagtgctacccggggattatagcatcttggtcaaatataatgagcagcacgtcccgggatctcccttcacagcccgcgttacgggagacgactccatgcgcatgtcccacctcaaggtgggatctgccgcagatatcccaattaacatttccgaaatctccttcgaggatcgaaaggacggaagctgcggcgtagcgtacgtcgtgcaggagccaggcgactacgaggtatcggtcaagttcaatgaggagcatatccccgattcacctttcgtcgtcccagtggccagcccctctggggatgctcgcagactgactgtgagcagcctgcaggaatcagggctcaaagtgaatcagcccgcctcatttgcagtgagcctgaacggagcgaagggggcgattgacgcaaaagtacactcaccttctggtgctctggaagaatgctatgtgactgaaattgaccaggataagtatgcagtgaggtttattccccgggagaacggcgtgtacctcatcgacgtcaagtttaatggaacccacattcccgggtccccattcaaaatacgcgttggagaaccgggacatggcggtgatcctggactagtgagtgcctacggggccggcttagaaggtggggtgacgggcaatcctgcagagttcgtggtcaacacatctaatgccggcgcaggggccctgagcgtgactatcgacggtccctcaaaggtgaaaatggattgccaggagtgtcctgagggatatagggtgacgtatactccgatggctccagggtcatacctcatttctattaagtacgggggcccataccatatcggcggtagtccttttaaagctaaggtaacgggcccaaggctcgtatctaatcacagtttacacgagacttcttcagtctttgtggattcccttacaaaggccacatgtgcccctcagcatggtgctccagggccagggccggcggatgctagcaaagtggttgcaaaaggactgggtctgtctaaagcctacgtcggccagaaatcctcctttaccgtggattgttctaaggccggaaataatatgctgctcgtcggcgttcatggccctaggacaccctgcgaggagattctcgtgaagcacgtgggctcgcgcctgtatagtgtgtcttaccttttaaaggacaaaggcgagtacacgttggtggtgaagtggggtgacgaacacattcccgggtccccctatagggtagtagtgccctag

SEQ ID NO: 187943 - DNA, 2343 bp, Artificial Sequence
  Description of Artificial Sequence: Synthetic coding sequence
atgcccagcggcaaggtggcccagcccaccatcaccgacaacaaggacggcactgttacagtgcggtatgcaccttccgaagccggcttacatgaaatggacataaggtacgacaacatgcatatccctggaagccctctccaattctatgtggattatgtgaactgcgggcacgtcactgcatatggcccgggcctgacgcacggagtggtgaacaagcccgccacattcacagtcaataccaaggacgccggggaaggcgatgattctatgaggatgagccatctgaaggtcggctctgctgctgacattccaatcaatattagcgaaactgacctgtcattactgacagctacggttgtacctccctccggtcgggaggaaccctgtctactgaagaggttgcggaatggccatgtggggatttcgttcgtccccaaggagacaggcgagcacttggttcacgtgaagaaaaatggacaacatgtggctagctcgccaataccagtcgttatcagccagtccgaaattggcgacgccagcagagtgcgagtgtctggccagggcttgcacgaggggcatactttcgaacccgcagaattcatcatcgatacaagggacgcaggatacggaggcctctccctgtctattgagggtcccagtaaggtggatatcaacactgaagatcttgaagacgggacttgtcgagtgacctattgtcctacggagccgggcaattacattattaatattaagtttgcagatcagcacgtgccaggatcacctttctctgtgaaggttacaggagaggggcgagtgaaggagtctatcacccggcgacggcgggctccctccgtggcaaatgtaggttcgcactgtgacctctccctgaaaatcccagagatttccattcaagacatgactgctcaagttacttcgcccagtgggaagacacacgaggccgagatcgtcgagggcgaaaaccacacctactgtatacgctttgtgcctgccgagatgggaacccataccgtatctgtaaagtacaagggtcagcacgtccctggcagcccttttcagtttactgttggtcctttgggggagggaggggcccataaggtgcgggcgggtggacccggtctcgagcgcgcagaggctggagttccagctgaattttctatttggaccagagaggccggggctgggggcctggccattgcggtggagggcccaagcaaggccgagatttctttcgaggatcggaaggacgggtcatgcggggtggcttacgtggttcaagaacctggggattacgaggtgagtgttaaattcaatgaggagcacatcccggattccccttttgttgtacccgtcgcctccccaagcggtgatgctcggcggctcacagtgagcagcctccaagagtcgggattaaaagtgaatcagccggcatcttttgcagtgagtctgaacggtgccaagggagcgattgacgcgaaagtacacagtccctccggcgcactcgaggaatgctacgtgacggagatcgaccaagacaaatatgctgtgcgtttcatccccagagaaaacggggtctatttaattgacgtgaaattcaatggcacacatattcctggatctccttttaagatccgcgtaggcgagcccggccacgggggcgacccagggttggtcagcgcgtacggggctggtttagagggcggggttactggcaatcccgccgaattcgtggtgaacaccagtaatgcaggcgcgggtgccctgagtgtgaccatcgatggcccatccaaagttaagatggattgtcaggaatgtccggagggttatcgggtgacgtacaccccgatggctccaggaagttatctcatcagcataaagtacggcggtccctaccacatcggcggatctccctttaaagccaaagtgacgggcccgcggctggtatctaaccacagcctacacgagacgtcctccgtgtttgtagactcgttaaccaaggcaacctgcgcaccccagcatggcgctccaggccctggccctgcagacgctagcaaggtggtggccaagggcctgggactgtcaaaagcatatgtgggccagaagtcttcatttactgtcgattgcagcaaagccggaaacaatatgctgctagtcggcgttcacgggcctagaacaccgtgcgaggaaatcctggtgaagcacgtgggctcccgcctatacagcgtcagttatctcttgaaagacaaaggggaatacaccttggtggtgaagtggggtgacgagcacatccccggcagcccttatcgggtcgtggtgccctag

SEQ ID NO: 187944 - DNA, 7920 bp, Artificial Sequence
  Description of Artificial Sequence: Synthetic coding sequence
atgagcagcagccacagccgggccggccagagcgccgccggcgccgcccccggaggaggtgtagacacacgcgacgcagagatgcctgccaccgaaaaggaccttgcagaggacgccccatggaagaagatccaacaaaacacattcactcgctggtgtaacgagcatcttaagtgcgtctctaaacggatcgcgaatttgcagaccgacttgagtgacgggcttagactgatcgccctcctggaagttctttctcagaagaaaatgcacaggaaacataaccaaagacctacttttaggcagatgcagctggagaacgtttctgttgcactcgaatttttggatcgtgaatccatcaagctagtttccatcgatagcaaagccatagtggatgggaacctgaagctgatcctcggcctcatatggacactcatcttgcattatagtatctcaatgcctatgtgggacgaggaagaggatgaagaggccaagaagcagaccccaaagcaacgactgctgggatggatccaaaataaactccctcagctgcctatcacgaactttagtcgggactggcagtccggacgggcacttggagcccttgttgatagctgtgctccaggcctctgtcctgattgggattcctgggatgcgtcaaagcccgttactaacgctagagaggcaatgcagcaggcagacgactggctcggcattccacaagttattacacctgaagagatcgtggaccccaacgtggatgagcactcagtcatgacgtacctgagtcagttccctaaggctaaactgaagcccggtgctccactaaggcctaaactgaacccaaagaaagcgagggcgtacggacccggcatcgagccgacaggaaacatggttaagaaacgtgcggaatttaccgtggaaacacgctccgctgggcaaggagaagtgttggtttatgttgaagaccctgcagggcatcaggaagaggcaaaggtcactgccaacaacgataaaaatagaaccttctcagtgtggtacgtgcccgaagtaactgggacccacaaggtaactgttttatttgccggccagcacattgccaaatctccctttgaggtctacgtcgataaatcacagggcgacgcgtctaaggtgactgcacaagggcccggactagagccttccggcaatattgctaacaaaacaacttattttgaaattttcacagcaggcgctgggactggagaagtcgaagtggtgatacaggacccgatggggcagaaaggcactgtcgaacctcagctggaggccaggggcgactcaacctatagatgctcttatcaacccactatggaaggagtccacactgtccacgtgacctttgccggcgttccaatcccaagaagtccatacactgtcactgtcgggcaagcttgtaacccatctgcttgccgggccgtcgggcgagggctccagcccaagggcgtgcgagttaaggaaacagcagatttcaaggtttacaccaaaggcgctgggagcggagagttaaaagtgacagtgaagggtccgaaaggggaagagcgagtgaagcaaaaagacctgggcgatggagtctacggctttgagtactatccaatggtcccaggaacctatattgtcacaatcacctggggtggccagaatatcggaagatcgccctttgaggtgaaagtaggaactgaatgtggaaaccagaaggtgcgggcatggggacctggtctggaagggggcgtcgtcggtaagtcagccgattttgttgttgaagcaattggagacgacgtcgggaccctgggtttctccgttgagggcccttcgcaggccaaaatcgaatgcgatgataagggtgacggcagttgtgacgtcagatactggcctcaggaagctggcgagtacgctgttcacgttctatgtaatagcgaagatatccgtctttcgcctttcatggctgacattcgggacgcacctcaagatttccaccctgaccgagtcaaggcgcgcggcccaggcctggaaaagacgggcgtagccgtcaataagcctgcagaattcaccgtcgatgctaagcacggtggcaaggctcctctcagagtgcaagtgcaggataatgagggctgccccgtcgaagccctggtcaaggataatggcaatggcacctattcatgcagctatgtgccgcggaaacccgtcaagcataccgcaatggtctcctggggcggagtctccatcccaaactcacctttccgcgtcaatgtaggagccggttcacatccaaacaaagtcaaggtttacgggcctggtgtagccaagaccggtttaaaagcgcacgagcctacttacttcaccgtggactgtgcggaggctgggcagggtgacgtgagcattggtattaaatgcgctccgggggtcgttggtcctgcagaggctgatatagattttgatattatacggaacgataacgacacattcacagtgaagtacacgccaagaggcgccgggtcttataccatcatggtactgtttgccgatcaggccacccccactagccctatccgggtcaaagtggaaccttcgcatgatgcatccaaggtaaaagctgaaggacctgggctgagccgaaccggtgtggagctagggaaaccaacacactttaccgtgaatgccaaagccgcgggaaagggtaagctggatgtgcagttttcgggccttacaaaaggcgacgctgtgcgggacgtagacatcattgatcatcatgacaatacctacacagtgaaatataccccggttcagcaggggcccgtgggggtgaatgtcacgtacggcggggaccccatccccaaaagcccattctccgttgccgtatctccatctctcgatctgagcaaaataaaggtctccggtcttggcgaaaaagtggatgttggcaaagaccaggagttcacagtaaaatcaaagggtgctggagggcagggcaaggtagcttcaaaaattgttggaccatccggcgcagctgtaccatgcaaggtcgagccggggctgggcgctgacaactcggttgtgcgttttctgcctagagaggaaggtccttatgaggttgaagtgacgtacgacggcgtgccggtgccaggtagtcccttccctcttgaagctgtggcaccgacgaaacccagcaaggttaaagccttcggtccgggactgcaagggggatccgcaggatccccggctcgcttcacaatcgataccaagggcgcgggcacaggcggactggggcttacggtggagggcccttgcgaagcccagttggagtgcctggacaatggggacggcacatgttccgtgagctatgtgcccactgaaccaggggattacaatatcaatatcttgtttgccgatactcatatccctgggtctcccttcaaggcccacgtggttccctgtttcgacgccagtaaggtgaagtgcagtggacctgggctggagcgcgcgacagccggtgaggttgggcaatttcaggtcgattgctccagcgccggctcggctgaactgaccattgaaatatgttctgaagctgggttaccagccgaggtttatattcaggaccatggtgatggcacccacaccataacttacattccactgtgtcccggcgcatacacagtgacaattaagtatggaggccagccagtgcccaattttccgagcaagctgcaggtggaacctgctgtagacacctcgggggtacagtgctacgggcctgggatagaggggcagggagtgtttcgcgaagccaccaccgaattctctgtggacgctcgagccctcactcaaaccggaggcccacacgttaaggcaagagttgccaatcccagtggcaacttaacagagacctatgtccaggaccgtggggacggcatgtacaaagtcgagtacacaccctatgaggaaggcctgcacagcgtggatgtcacctacgacggttcacccgtcccatcatctccttttcaagtacctgtgaccgagggctgcgatccgtctagggtgcgtgttcacgggcccgggatccaaagtggcacaaccaataagcccaacaaattcacagtagagaccagaggggcaggcactggtgggcttggcctggcggtggaaggccctagcgaagctaagatgagctgcatggacaataaagacggcagttgtagtgttgaatacattccctacgaagccggaacctatagtctaaacgtgacatacggaggccaccaggtgccaggttcacctttcaaagtgccagttcacgatgtcacggacgcctccaaggtcaaatgtagcggcccaggtctgtcaccaggaatggtgcgggccaatttaccccagtccttccaagtggacacctctaaggctggcgtggcccccctgcaggtcaaggttcaagggccaaagggcttggtggagcccgtcgacgtggttgataacgcagatggcacacagaccgtgaattacgttccctcacgcgagggtccctattccattagcgtcctgtatggcgatgaggaggttcctcggtctcctttcaaggttaaggtcttgcctacacacgacgcctcaaaggttaaagctagcgggcccggcctgaacacaactggcgtgcccgcttctctcccggtggagttcaccattgatgcaaaggacgcaggagagggcctactggctgttcagatcaccgatccggaagggaagcccaagaagacacacattcaggacaatcacgacggcacatacaccgttgcctacgtacctgacgtcactggacgctacacgattcttataaaatatggaggcgacgaaattccattcagcccataccgcgtgagggctgtgcccactggggatgccagcaaatgtacagtgaccggagctggcataggcccaacaatccagataggggaagagactgttatcacagtagatacaaaggccgcaggaaagggcaaagtgacctgcactgtttgtactccagacggaagcgaagtggacgtggacgtcgttgaaaatgaagacggcactttcgacatattctatacggcaccccagcccggaaaatacgtaatttgcgtgagatttggcggagagcacgtgccgaattctccctttcaagtgacagccctggctggcgaccaaccctccgtgcagccacctctcagaagccagcagctggcacctcagtatacctatgcccagggaggacagcagacctgggcccccgagaggcccctagttggggtcaatggcctggatgtcacgagcctccgcccttttgatctggttattcctttcaccatcaaaaagggagagatcactggtgaagtccgcatgccttccggtaaagtcgcgcagcctaccatcactgacaataaggatggtaccgttaccgtgagatatgcaccgtcggaagctggcctgcacgagatggacatacgttacgataatatgcatatccctgggtctccattgcagttctatgtcgactacgtgaattgcgggcacgttaccgcctacgggcctggattgacccacggcgtggtgaacaagcctgccaccttcaccgttaatacgaaagacgcaggcgagggtggactttcacttgctatcgaaggaccctcgaaagccgagatttcgtgcaccgacaaccaagacggtacttgcagcgtgagctatctaccggttcttcccggagattactccattctcgtaaagtacaatgagcagcacgtcccagggagccccttcaccgctcgcgtcacaggagacgactcgatgagaatgagccatctgaaagtgggaagcgctgcagacattccaataaacatttctgagaccgatttgagcttactgactgccacagtcgtgccacctagtggtcgagaggaaccttgtctattgaagcgcttgagaaacggacatgttggtatcagttttgtacccaaggagacaggggagcacctcgtgcacgtcaagaagaacgggcagcacgttgcatccagtccaatccccgtagtgatctcccagagcgagataggggatgcctcaagagtgcgggtcagtggacagggcctacacgagggccatacatttgaacctgccgaatttatcatcgacacaagagacgccggatacggtggtctgagtctctctattgaggggccctcaaaggtggacataaatacagaggatctcgaagatggcacgtgccgcgttacttactgcccaaccgagccagggaactatatcatcaatatcaaattcgcagatcaacatgttcctggtagtccctttagtgtgaaggttaccggggagggccgagttaaggagagtatcacccggcggcggagggcaccttccgtggcaaatgtgggaagtcattgtgaccttagcctcaaaatcccagaaatctctatacaggacatgacagcacaggttacctccccttcaggtaaaacccatgaagctgaaattgtcgagggcgaaaaccatacgtattgtatcagattcgttcctgctgagatgggcacccacacagtttcagttaaatacaagggccagcacgtccctgggtccccctttcagttcacagtagggccactgggtgaaggaggagcccacaaggtgcgggctggtggtcctggacttgagagagccgaagcaggcgtgccagctgaattctctatttggacccgtgaggctggtgctggcggcctcgccatcgccgtggagggtccaagcaaagccgagatttcattcgaagatcgaaaagatgggtcttgcggcgtggcttatgttgttcaggagccaggtgactacgaagtgtctgtgaagtttaacgaagagcacattcctgactcccctttcgttgttcccgtggccagcccttctggagatgctcgcagattaaccgtgagctccctgcaggaaagtgggttaaaggtcaaccagccagcgtctttcgcagtgagcctgaacggcgcgaagggtgccatcgatgccaaggtgcatagtccgtctggagccctggaagagtgctacgtaaccgaaatcgaccaggacaagtatgccgtgcgctttatcccacgcgaaaatggggtctacctgattgatgtcaagtttaatggaactcatatccccggaagcccattcaaaataagagtcggggaaccaggccacggcggagatcccggcctcgtgagcgcgtatggagccggactggaagggggcgtgacaggcaaccccgctgaatttgttgtgaacacctcaaacgccggagctggagcactgagtgtcaccatagatgggcctagcaaggtaaagatggactgtcaggaatgcccagaagggtaccgcgtcacatacacccctatggcaccaggttcataccttatctccatcaaatatggcggaccttaccatataggcggctctcctttcaaagcgaaagtgaccggccctaggctggtttctaaccacagcttgcatgagacctccagcgtgttcgttgattccctgaccaaggccacttgcgccccacagcatggcgctccagggccaggcccggccgatgcgtccaaagtggtcgcgaaggggctaggtttgagcaaggcctacgtgggccagaagtcttcttttactgtggactgcagcaaggccgggaataacatgctgctggtcggagtgcacggccccaggacaccttgcgaagagattctcgtaaaacacgttggctccagactatacagcgtgtcatatcttctgaaggataagggagagtatacgctcgtcgtaaagtggggagatgaacacattccaggctccccttaccgggtggttgtgccttag

SEQ ID NO: 187945 - DNA, 7809 bp, Artificial Sequence
  Description of Artificial Sequence: Synthetic coding sequence
atgcccgtgaccgagaaggacctggccgaggacgccccctggaagaagatccagcagaacacgttcactaggtggtgcaatgagcatcttaagtgcgttaacaagcgcattggcaacttacagactgaccttagcgacggattgaggttaatagctttgttggaggtcctgagtcagaagaggatgtatagaaaatatcaccagcggcccacttttcgtcagatgcagctcgaaaacgtctctgtggcgctcgaattcctcgaccgggaatcaatcaagttggtttctatcgactctaaggccatcgttgacggtaatctcaaacttattcttggtctggtgtggactttgatccttcactatagtatctctatgcccgtctgggaggacgagggagatgatgacgcaaaaaagcaaacccctaaacagcgtctgctgggatggattcagaacaagataccctacctgcccattactaactttaaccaaaactggcaggacggtaaagctctgggggctctggtcgacagttgcgcaccaggactgtgtccggattgggaatcctgggacccgcagaagccggttgataatgctcgggaagctatgcagcaggcagacgattggctcggggtgccacaggttattactcctgaggaaattattcatccagatgtggatgagcactccgtgatgacctatctgagtcaatttcctaaggctaagctgaagcccggggccccactgaagcccaaactcaatccaaaaaaggctagagcctatggcaggggcatcgagcccacaggaaatatggttaaacagcccgctaagttcaccgtcgacacgatctcagctggccaaggagatgtgatggtcttcgtagaagacccagagggaaacaaagaagaggcacaggtgacacctgatagtgacaaaaacaaaacctacagtgtcgaatatttaccaaaggtcactggacttcacaaggtgaccgttctgtttgcaggccagcatattagcaaaagcccatttgaagtcagcgtcgacaaggcacagggggacgcctcaaaagttaccgcgaaaggcccaggcctcgaagcagtgggaaacattgctaataagcctacctattttgacatatacactgcaggagccggtgtcggcgatataggggtcgaggtggaagacccccaaggtaagaacactgtggagttacttgtggaagataagggaaatcaggtatatcgatgtgtgtataaacctatgcagccgggcccgcacgtcgtgaaaatcttctttgccggtgatactataccaaagagccctttcgtggtgcaggtcggtgaggcctgtaatcctaacgcatgccgggcctcgggtcggggtctgcagcccaaaggggtccgcatccgggagaccacagatttcaaggtcgacacaaaagccgccggatccggagagctgggagtgacgatgaaagggcccaaaggcctggaagaactagtgaagcagaaggattttctggacggggtttacgcctttgagtactatcccagcacccccggccgatactctatcgcaatcacctggggcggccaccacatcccaaagagcccatttgaggtgcaagtgggacctgaagctggcatgcaaaaggttagggcttgggggccaggactgcacgggggcattgttgggcgttccgcagactttgtcgttgagagcatagggtccgaggtcggctccctcgggttcgctattgaaggcccatctcaagccaaaatagaatacaatgatcagaacgacggatcttgcgatgtaaaatattggcctaaggagccaggggagtatgctgtgcacataatgtgcgacgacgaggatattaaagattcaccatatatggcttttatccatccagcaacgggaggatataacccagatctggtgcgagcctatggtccaggtctggaaaaatctgggtgtattgtcaacaatctggctgagttcactgtcgacccaaaagatgctggcaaagcccctcttaagatttttgcacaagatggcgaaggtcaaaggattgacatccagatgaaaaatcggatggacgggacatatgcgtgctcatatacgcccgtgaaggccatcaagcacacgattgcagtggtgtgggggggggtcaatatcccacacagcccttacagagtgaatatcggacaggggagtcaccctcagaaggtcaaggtctttggacctggtgtggaaagaagtggcttaaaggctaatgagcctactcactttacagtcgactgcaccgaagcgggcgagggagacgtgtcagttgggatcaagtgcgacgctagggtgctgagtgaggacgaggaggacgtggacttcgatattatacataatgcaaacgacacttttacagttaagtacgtaccaccagctgctggtagatacacaattaaagtcctgtttgcctcgcaggaaatccctgccagccccttcagggtgaaggtcgacccttcacacgatgctagtaaagtcaaggcagagggccctggtctgtctaaggctggagtggagaacggcaaaccaactcattttacagtgtacaccaagggcgctggcaaggctccgttaaatgtgcagttcaatagtccccttcccggtgacgcagtaaaagacctggacataattgataattatgactattcccacaccgtaaaatacacgcctacacagcaagggaatatgcaagtactggttacctacggcggggatccaatcccaaaaagtcccttcacagtgggggtcgctgctcccctggatctgtccaaaataaaactgaacggtctagagaatagagttgaagtcggcaaagatcaagagtttacagtcgataccaggggagccgggggccagggcaaactggacgtgaccattctctccccatcaaggaaagtagtgccctgccttgtaacccctgtgaccggaagagagaactccacagcaaagtttattccacgcgaagaaggtctctatgccgtggatgtcacatatgacggtcaccctgtccccggcagtccatatacagtggaagcgagtttaccacctgacccatccaaggtgaaagctcatggacccggactcgagggaggcctggtgggaaaaccagctgagtttactatcgacaccaaaggagccggcacaggtggcctgggactgactgtggaaggcccatgcgaggccaaaatcgaatgcagtgataatggcgacggaacctgttctgtgtcttacctgcctaccaagcctggagagtactttgtgaatatcctgttcgaagaggtgcatatccccggctcgccgttcaaagctgacatcgaaatgccgttcgacccttctaaagttgtggcctctggcccaggcttagaacacggtaaggtgggggaggccggactcttatccgtagactgttccgaggccgggcccggtgccctcggattggaagccgttagcgatagcggtactaaagcggaggtatcaattcagaacaacaaggacggaacctatgcagtgacgtacgtacccctaactgccggaatgtataccctgacaatgaagtacggcggggaactcgtcccacatttccccgcacgcgtgaaagtggaacctgcggtggatacaagccgcataaaagtgtttggccccgggatcgagggcaaagatgtcttccgggaggccacgaccgatttcacagttgatagcagacccctgactcaggttggaggagatcatataaaggcccacattgcgaatccttcaggcgcttctactgaatgtttcgtgacagacaacgctgatggaacctaccaggtggagtacacaccattcgaaaagggcctgcatgttgttgaagtcacatacgatgacgttccaatccctaatagcccattcaaagtggccgtgactgagggttgtcagccctccagagtgcaggcccaaggccccggtcttaaagaggcatttaccaacaagcccaacgtattcacagtcgtgacacgcggggccggcatcggcggcttgggcattaccgtcgaaggtcctagcgagagcaagatcaactgccgggacaacaaggacggatcctgcagcgccgaatacatcccctttgccccaggagactatgatgtaaatatcacatacggaggcgcccacatcccgggatcacccttccgcgtgcctgtcaaggacgttgtggaccctagcaaagtaaagattgcgggacctgggcttggtagcggagtccgcgctagagtacttcagagtttcactgtcgactctagcaaggccggtctcgctcctcttgaggttagggtgctcggacctaggggactggtggagcctgttaatgtcgtggacaacggggatgggacacacacagtaacgtataccccttcacaggaggggccctacatggtatccgtgaaatacgccgacgaggaaattccgcggtccccctttaaagtcaaagtcctgccgacctacgacgcctcaaaggtgaccgccagtggacctggattgtcttcttacggggtgcccgcctctttgccagtcgactttgcaatcgatgcgcgggacgcaggcgagggcctactggccgtccaaatcactgaccaagaaggcaaaccaaaacgggctatcgttcacgacaataaggacggcacctacgctgtaacctacattcctgataaaaccggccgctacatgattggcgtgacatacggaggtgacgacatccccctttcaccctatcggattcgggcgacacaaaccggcgacgcatctaagtgcctcgcgacaggtcccggtatcgctagcaccgtcaaaacaggggaggaggtgggctttgtggtggacgctaagactgccggaaagggaaaggttacttgcaccgtgctgacacccgacggcactgaggccgaggcagatgtcatagaaaatgaagacggcacgtacgacattttttacactgcggccaaacctggcacatacgtgatttacgttaggtttggcggggtggacattccgaactcaccttttactgttatggccacagacggtgaagtgaccgccgttgaggaagcaccagtcaatgcttgtcctcccgggttccgaccctgggttaccgaggaagcttacgttcccgtgtccgacatgaatgggctaggcttcaagccattcgatctagtaattcctttcgccgtgaggaagggcgaaattacgggcgaggttcacatgcccagtgggaaaaccgccacacctgagatcgttgacaataaagatgggaccgtgacagttagatatgctcccaccgaggtcggattgcacgagatgcatatcaaatatatgggtagccatattccagaaagcccacttcagttctacgtgaattatccaaactctggatctgtttcagcctacggccctggactggtatacggggttgccaataagacggctacatttaccatcgtcactgaggacgccggagaaggtgggctggacctcgctatcgagggcccttccaaggctgaaatttcttgtattgataacaaagatggcacgtgcactgtcacttatcttccaacactccctggcgactatagcatcttggtgaaatacaacgataagcacataccaggctctccctttacggctaaaatcacggacgactcccggagatgttctcaggtcaagcttggcagcgctgccgacttcctgttggacataagcgagacagacttgagctcattgaccgcctccatcaaagctccttccggtcgggatgagccttgcctcctgaagagacttccaaacaaccacattgggatctcattcatccccagggaagtgggagaacatctggtgtccattaaaaaaaatggaaaccatgtggcaaatagcccggtgtctataatggtggtacagagcgagattggcgacgcgcggcgggccaaagtttacggtcgggggctaagcgaaggccgcactttcgagatgtccgattttatagtggatacacgcgatgccgggtatggcgggatctccctggcggttgagggcccttccaaggtggatattcagaccgaagatctcgaggacggcacctgtaaagtgagctactttcctaccgtgcctggcgtgtacattgttagtaccaaattcgccgacgagcacgtgccgggtagcccgtttactgttaagatctctggggaaggcagagtgaaggaaagcattactagaacctcacgagcccccagcgtggccaccgtggggtccatctgcgacctgaacctgaaaatccccgagatcaactctagcgatatgagcgctcatgtgacatcaccctccggtagagtgacggaggcagagatcgtgcctatgggcaagaactctcactgcgtcaggtttgtccctcaggagatgggcgtacacaccgtgagcgtgaaatatagaggtcagcatgtgactggctcacccttccagtttacagtgggacctctgggtgaagggggcgcgcataaggtgcgcgccgggggccccggtttggaacgaggagaagccggcgtgcctgccgagtttagcatatggaccagagaggccggggccggcggactgtccatcgctgtagagggcccttccaaagccgagatcacttttgatgatcacaagaacgggtcatgcggtgtctcctatatcgcacaggagcctgggaattatgaggtgtcgatcaaatttaatgatgagcatatccccgagtcgccctacctggtgcccgtgatcgcaccaagtgacgatgcccgcagattgaccgtgatgagcctccaggaatctggcttaaaggttaaccagcctgcttcattcgctatccgactgaatggcgccaagggaaagattgatgccaaggtgcacagtccgagcggagccgtagaagaatgccatgtgtcagagctggagcccgacaaatatgccgttcggtttatccctcacgagaatggggtgcacacgatcgacgttaagtttaacggctcgcatgtcgtggggagcccgtttaaggttagagtaggcgagcccggccaggcagggaaccctgcactggtgtctgcctacggcacagggctggaaggcgggacgacaggtattcagagcgagttctttattaatactactagggccggtcccggcacattgtccgtcaccatagagggcccctcaaaggtcaaaatggattgtcaggagaccccagaggggtataaggtgatgtacaccccaatggccccagggaattacctcataagcgtcaaatatgggggaccaaatcacatcgtgggctcaccgtttaaggctaaagtgacagggcagagattggtaagtccgggctctgcgaatgagacttcttcaatcctggtggagagcgtgacgaggtcatccactgagacctgttacagtgctatacccaaagcctccagtgacgccagtaaggtcacgtccaagggagctggcctgagcaaagcattcgtcggccagaaaagctctttccttgtggattgctccaaggcgggctctaacatgctcttgataggcgttcacggccctacaaccccatgcgaggaagtatctatgaaacacgttggcaaccagcaatataatgtgacctatgtcgtcaaagaaaggggcgactacgtgctggcagtgaaatggggggaggagcatatcccagggtctccattccacgttacggtgccttag

SEQ ID NO: 187946 - DNA, 7686 bp, Artificial Sequence
  Description of Artificial Sequence: Synthetic coding sequence
atgcccgtgaccgagaaggacctggccgaggacgccccctggaagaagatacaacagaacacatttacacgatggtgcaatgaacacttgaaatgcgtcaacaagcgcatcggcaatctccaaaccgatctgagcgatggtctgcgtctgatcgcgctcctcgaagtcctttctcagaagagaatgtatcggaagtaccatcagaggcctacttttcgtcagatgcagctagagaacgtctctgttgctctggaattcttggatagggagagcatcaagctcgtctccatcgactctaaagctatcgtggacgggaacctcaaactgatcctcggcctggtgtggacactgattctccactactcaatttccatgcccgtgtgggaagacgaaggagacgatgacgccaagaagcagacccccaagcagaggctcttgggatggatccagaataagatcccatatctacctattacgaattttaatcagaattggcaggacggcaaggcactgggcgcattggtggacagttgtgctcctgggctgtgtcccgactgggaatcttgggacccgcagaaaccagtggataacgctagagaagctatgcagcaagctgatgactggctcggcgtgccgcaggtgatcaccccagaggaaatcatccatcctgatgtggatgaacactccgtcatgacttatcttagtcaatttcccaaggccaaactgaaaccaggcgcccctctgaaacccaaactaaatccaaagaaggcccgcgcttacggaaggggcatagagcctaccggcaacatggtaaagcagccggccaagtttaccgtcgatacgatttccgctggtcagggcgacgtgatggtgttcgtggaggatcccgagggcaacaaggaggaagctcaggtcacccctgacagcgacaagaacaaaacatactccgttgagtacctgccgaaagtcaccggccttcacaaagtaaccgtgctattcgctgggcagcacatcagtaagtctccatttgaagtatctgtggacaaggcccagggtgacgctagcaaggtcaccgccaaggggcccgggctagaggctgtgggaaatatagctaataaaccaacatattttgatatttacaccgctggagcaggggttggggacatcggtgtcgaggtggaggatcctcaagggaaaaacaccgtcgagcttcttgtggaggacaagggaaaccaggtgtataggtgtgtatacaagcccatgcagcctgggccccatgttgtgaaaattttttttgcaggcgacaccattcctaagtcgccttttgtcgtccaggttggggaagcttgtaatcccaacgcatgccgggcttctggacgggggctccaacccaagggcgtgcgaattcgggaaactacggactttaaggtggataccaaagcagcaggaagtggagaactgggggtgaccatgaaaggccccaagggccttgaagagttggtgaagcagaaggattttttggacggtgtgtacgcttttgagtattacccctccacccccgggcgttattctattgcaatcacgtggggcggtcatcatattcccaagagcccgttcgaggttcaggtgggtcccgaggccggaatgcagaaagtgcgggcctgggggcccggtctgcacgggggcatcgtaggcagaagtgctgacttcgtggttgaaagcataggttcagaagtgggaagtctgggatttgccattgaaggtccctctcaggcaaagatcgagtataatgatcaaaacgatggcagttgtgatgtgaaatattggccaaaagagcccggcgagtacgcggttcacatcatgtgcgacgatgaggacatcaaggattcgccatacatggcctttatccatcctgctactgggggttataaccccgatcttgtgcgggcctacgggcctggtctggaaaagagtgggtgcatcgtgaacaatctggcggagttcaccgtcgatcctaaagatgctggcaaagccccactgaagattttcgcgcaggatggagagggacagaggatcgatatacagatgaaaaatcgcatggacggcacatacgcatgctcatacaccccagttaaggctatcaaacatactatcgccgttgtgtggggtggagtcaacatccctcactctccgtaccgagtgaacatcggacaggggtcccatccccagaaggtgaaagttttcggcccaggagtcgaaaggtccgggctcaaggctaacgaaccaacccatttcactgtggactgcaccgaggccggggaaggcgatgtgagcgtgggtataaagtgcgacgctcgcgtactgtcagaggatgaggaagatgtcgatttcgacatcattcacaatgcgaacgatacttttactgtcaagtacgtgccacctgctgccggccgttacaccatcaaggtactttttgcatcgcaggagattccggcgtcaccatttcgggtgaaggtcgaccccagccacgatgcgtcaaaggtgaaggccgagggacctggactgagcaaggcgggagtggaaaacgggaagcctacccacttcaccgtgtacaccaagggggccggtaaggcccccttgaatgtgcaattcaacagcccgttgcccggggatgccgtcaaggatttggacattatcgataattatgattattcacacaccgtcaagtatactccaactcagcaggggaatatgcaggtgcttgtgacctacggaggcgaccccatccctaaaagtcccttcactgtgggggtggccgcaccccttgatttgtccaagatcaagctgaatggccttgagaacagagtcgaagtgggcaaggaccaggaattcactgttgacaccagaggagctggagggcaaggaaaactggacgtcacaatcctctcacccagccgtaaagtggtcccatgccttgtgacacccgtcacaggccgcgaaaatagcacagcaaaattcattccgcgagaagaggggttgtacgccgtagacgtgacatacgacgggcacccagtgccaggttccccatacaccgtcgaggcgagccttcccccggaccccagcaaggtgaaggcccatggtcccggattagagggcgggctggtgggtaaaccagctgagttcacaattgatacaaaaggcgccggcacgggtgggctcggattgaccgtggaaggtccttgtgaggcaaagatagaatgttccgacaatggtgatggcacctgtagtgtttcctatctcccaaccaaacctggagaatactttgtcaatatactgtttgaagaggtgcacatcccgggaagtcccttcaaagcggacatagaaatgcctttcgacccgtctaaagtggtggctagcgggcctggtctcgaacacggcaaggtgggggaagcagggttgctttctgtcgattgctccgaggcaggtccgggagctctgggcttagaagccgtaagtgacagcgggacaaaggccgaggtgtccatccagaacaataaggatggaacctacgccgtgacctacgtcccactgaccgcgggcatgtacaccctcactatgaagtatggtggcgaactggttcctcacttccccgcaagagtgaaggtggaacccgcagtggatacttcccgcataaaagtcttcggccctggaatcgaggggaaggacgtattccgtgaagccaccacagactttaccgttgacagcaggccgctaacacaggtaggtggagaccatattaaagctcacattgcgaatccttccggggcaagtaccgagtgtttcgtgacggacaatgctgatgggacttatcaagtggagtatactcctttcgaaaagggcttgcacgtagttgaggtcacctatgacgacgtgcctatccccaatagccccttcaaggtggctgtgacagaaggctgccagccatctcgggtgcaagcacaaggtcccggcctgaaggaggcattcaccaataaacccaatgtgttcaccgttgtgacccgtggcgcgggaattgggggtctgggcatcaccgtagaaggcccatccgagtctaagattaattgccgggacaacaaagacgggtcttgcagcgctgaatacataccatttgcccccggggactatgacgttaacatcacatacggcggtgcgcacattcccgggtcccctttccgagttccggttaaggatgtggtcgatccctccaaagtcaaaatcgccggccctgggctcggatctggcgtaagggcgagggtgttgcagtctttcaccgtggattcctcgaaggctggcctagccccattagaggtgcgggtactggggccaagggggctggttgagccagtgaacgtcgtggataatggtgacggaactcacacagtgacctacacgccatctcaagaagggccttatatggtgagcgtcaagtatgctgacgaggaaatccccagatctccattcaaggtcaaggtgctcccgacgtatgatgcaagcaaggtgaccgcttccggccctggcctgagtagctacggtgtcccagcctctctgccggtggatttcgctatagacgcacgcgatgccggggagggcttgctcgcagtgcagatcactgaccaagaggggaagcctaaaagggccatcgttcacgataataaggatggtacttatgcggttacctacataccggataagacaggtcgatacatgatcggtgtaacatatggtggcgatgatattcctctgtcaccctaccggattagagccacacagaccggagacgcctccaaatgtctcgccaccggccctggcatagccagtacagtgaaaacaggagaggaggtagggtttgtggttgatgccaaaactgcaggaaaaggcaaggtgacatgtactgtgctgacccctgacgggaccgaggctgaggccgatgtgatcgagaatgaggatggtacgtatgatatcttttacacagcggccaaacctggcacgtatgtcatatacgttaggttcgggggggtcgacattccaaacagtccattcactgtgatggccactgacggcgaggtcacggctgtagaagaagcacctgttaacgcctgtccacccggttttagaccatgggtaactgaagaagcttacgttccagtctcagatatgaacggactgggattcaagcctttcgatctggtaattcccttcgcagtccgaaagggtgagattacgggtgaagttcatatgccgtccggtaagaccgctactcccgaaatcgtggataataaggatggcaccgtcactgtgagatacgctccgaccgaggtcggcctccacgagatgcacatcaagtatatggggtcacatatacccgagtctccgctgcagttttacgttaactatcccaacagcggtagtgtgagcgcttacggcccaggcctggtgtacggcgtggctaacaaaactgctaccttcactattgtcacagaagacgctggagagggcgggctcgatttggctattgagggtccaagcaaagccgaaatcagctgcatagacaataaggatggtacatgcactgttacttatttaccaactctccccggagactattcaattctggtgaaatacaatgataaacacattcctggaagcccttttacagcgaaaatcaccgacgatagcagacgctgtagtcaggtcaagctgggctccgctgccgatttccttctcgacatctctgaaactgacttgtcaagcctgactgcgtctattaaggccccatctggacgtgacgagccctgccttcttaagcggctcccaaataatcatatagggatttcattcattccgcgcgaggtaggggaacatctggtatccatcaaaaaaaacggaaaccatgtggccaactcccctgtgagcattatggtggtacagagtgagattggggacgctcgtcgagcgaaagtgtacggtagaggactctcagaaggtcgcacattcgaaatgagcgactttattgttgatacaagggacgcaggatacggagggatatccttggcagtggagggtccgtccaaagttgatatacagaccgaagacttagaggatggaacctgcaaagtgtcctacttcccaactgtgcctggagtttacattgtatctacgaaattcgccgacgaacacgtccccgagatcaattcatccgacatgagcgcccacgtcacttcaccctcagggcgcgttacggaagcagaaattgtgcccatgggcaaaaacagtcattgtgtgcgatttgtgcctcaggagatgggcgtacataccgtcagcgtcaaataccggggccaacacgtaaccggttcaccctttcagttcactgtggggccacttggcgaaggcggggctcacaaggtgagagccggagggcccgggctggagaggggggaggccggtgtgcccgccgaattcagtatctggactagggaagccggggccgggggcctgtccatcgccgttgaaggaccttctaaggccgagatcacctttgacgaccacaagaacggatcctgcggcgtctcctatatcgcccaggagccgggaaactacgaagtatcaatcaagtttaatgacgaacatattcccgagtccccttacctcgtcccagtgattgccccctccgacgacgcgaggcgcctgaccgtgatgtcattgcaggagtcaggcctgaaagtgaatcagcccgcatctttcgccataagactcaacggcgcgaaagggaagatagacgcgaaggtgcactccccatccggggccgtggaggagtgtcatgtctcagagttggaacctgacaagtatgcagttcggttcatccctcatgagaacggagtccacactatcgatgtgaagtttaatggctcccatgtagtcggctccccatttaaggtgcgggtaggcgagccagggcaggccggcaatcccgccctggtgagtgcctatgggactggcttggaggggggaactaccggtatccagagcgagttcttcattaacactacgagggccggcccaggtaccctcagcgtcactatcgaaggtcccagcaaggtcaaaatggattgccaggaaacgcccgagggatataaagttatgtacactcccatggctcccggcaattacctgatcagcgtgaaatacggaggaccaaaccacattgtggggagcccttttaaggccaaggttactgggcagcggctggtgtcacctggttctgcgaacgagactagctccattctcgtggagtccgtgacacgtagtagcacagaaacctgctactccgctatccccaaggccagtagcgatgccagcaaagtaacttccaagggtgccggcctgtctaaagcattcgtggggcagaagtcttccttcctggtcgactgctccaaagccggcagtaatatgctgctcattggcgtgcatggccccactacaccctgtgaggaagtttctatgaagcacgtcggcaaccaacagtataacgtgacttacgttgtgaaggaacggggcgattatgtgctggcggtaaaatggggggaggagcatattccagggtctcctttccacgtgaccgtgccatag

SEQ ID NO: 187947 - DNA, 6453 bp, Artificial Sequence
  Description of Artificial Sequence: Synthetic coding sequence
atgcccgtgaccgagaaggacctggccgaggacgccccctggaagaaaatacaacagaacaccttcacacggtggtgcaacgaacaccttaagtgtgttaacaaacggatcgggaacttgcagaccgatctctctgatggcttgcggctcattgcgctgctagaggtgttgagccaaaagcgcatgtaccgcaagtaccaccagagaccgacctttaggcaaatgcaactggagaatgtctcagttgccctggagtttctagatcgagagtcaatcaagctggtgagcatcgattctaaggccatcgtggacgggaatctcaagcttattctagggctggtctggaccctcatcttgcactactctatttcaatgcccgtttgggaagacgagggcgacgacgatgctaaaaagcagacacctaagcaaaggctcctgggctggatccagaacaagattccttatctgcccatcaccaacttcaatcagaattggcaggacggtaaagcactgggggccctggtggatagttgtgctccaggattgtgtcccgactgggaaagctgggaccctcaaaagccggtggacaatgctagggaggcgatgcagcaggctgatgattggcttggtgtgccacaggtgattactcccgaagagatcattcacccagacgtcgacgagcactctgtgatgacttatctgagccaattccccaaggcaaaattgaagccaggggccccattaaaaccaaaactaaatcctaaaaaggcgcgggcctacggaagagggattgaaccgaccggaaacatggtgaaacagccggcaaagttcaccgtggacaccatttccgctggccagggagacgtgatggtgttcgtggaagatccagaaggcaataaagaagaagcccaggtgacccccgattccgacaaaaataagacctatagcgtggagtacctccccaaagttacaggacttcacaaggttaccgtcctctttgcaggccaacatatttccaaatcccctttcgaggtcagcgttgataaggctcagggcgacgcctccaaagtgacagccaagggcccaggactggaggccgtgggcaatatcgcgaacaaacccacctacttcgacatttacactgctggagctggggtgggtgacattggcgtcgaagtggaggacccccaggggaagaacacggtggagttacttgtcgaagataaaggcaaccaggtgtacagatgcgtatataaacctatgcaaccaggtccccacgtggtcaaaatttttttcgctggggacaccattcctaaaagcccattcgtcgtgcaagtaggagaagcctgcaatcctaacgcttgtagggcctctggtcggggtctgcagccaaaaggcgtgagaataagagaaaccacggacttcaaagtggacacaaaggccgccggaagcggggaactgggcgtcacaatgaagggccctaagggactagaagagttagttaagcaaaaggatttcctcgatggggtgtacgcctttgagtactatcctagcacaccaggcagatattccatagccattacctggggtggccatcacatccccaagagtccatttgaagtccaggtcgggcccgaagccggaatgcaaaaggttagagcctgggggcctggcctccacgggggaatcgtgggccggagcgccgactttgtagtggagtctatcggatcagaggtgggaagtttaggttttgctatcgagggaccttcccaggcaaagattgagtataacgaccaaaatgacggttcctgcgacgtaaagtactggccaaaggaacccggtgaatacgccgtccacattatgtgtgacgatgaggatatcaaagactctccttacatggccttcatccaccccgcaacaggaggatacaatccagatttggtccgggcatacgggccaggactagaaaagagcggatgcatcgttaacaacctggccgagttcacagtggatcccaaagatgctggcaaggccccactcaagatctttgcacaagacggggaaggtcagagaattgacattcagatgaagaaccgtatggatggcacctacgcttgcagctacacgcccgtgaaggccatcaagcacaccattgcggtggtgtggggcggcgtgaacattccccatagcccgtatcgcgtgaacatcgggcaggggtcgcatccccagaaggttaaggtgtttggaccaggagtggaacggagcggactgaaggccaatgagcctacccattttactgtggattgcactgaagcgggagagggtgacgtgtccgtcggaatcaaatgcgacgctcgggttttatctgaggatgaagaggacgtggacttcgacatcattcacaacgctaacgatacttttaccgtgaagtatgttccaccggcagcaggccgctacacaattaaggtgctcttcgccagccaggaaatccctgcgtctccatttagagtgaaagttgacccttctcatgatgctagtaaagtaaaggccgagggccccggcctgagcaaggcaggcgtagagaatggtaagcccacacacttcactgtgtatactaagggggccgggaaagccccactgaacgtacagtttaattcccctctgccaggtgacgcagtgaaggatctcgacatcatagacaactatgactacagccatacggtgaagtatactccaacacagcagggaaacatgcaagtcttggttacttacggcggagacccaatcccaaaatcgccatttactgtcggagtcgcggcccctttggatctgagcaagatcaagctaaatggcttagaaaaccgggtcgaggtgggtaaggaccaggagtttactgttgatacacgaggagcgggcggccaggggaagttggacgtcacaatcctgtcccccagcagaaaggtggtcccatgtctggttacacccgtgaccgggagggagaattcgactgcgaagttcatccccagggaagagggtctctacgcagtagatgttacatatgacggacacccagtacccggttctccttacaccgtagaagcgtccctgccccccgaccctagtaaggtgaaggctcatggccctggactcgagggcggcctggttggaaagcctgctgagtttacgatcgacacaaagggcgcaggtacaggggggctcggactgaccgtagaggggccctgtgaggctaaaattgaatgttcagataacggagatggtacttgcagtgttagctatttacccacaaaacccggggagtacttcgtgaatatcctgttcgaggaggtgcatattcctggctccccgtttaaggccgacatcgaaatgccctttgaccccagcaaagtcgtggccagtgggcccggattggagcatggaaaggtcggtgaggccgggctgctgtctgtcgattgtagtgaggccggtcccggagctctcggcttggaggcagtgtcagattccggtaccaaagccgaggtttcaatccaaaacaacaaagacggcacttatgctgtgacatatgtgcctctcaccgccgggatgtatacactgactatgaagtacggcggcgaactggtgccacacttccccgcgagggtcaaggtggagcctgccgtcgacacctcacgaattaaggttttcggtcctggcatcgaaggtaaggatgttttccgcgaggcaaccacggacttcactgtggactcccgacctctaacccaggtgggtggtgatcacattaaggcacacatcgctaatccatcaggggcgtccactgagtgctttgtgaccgacaacgcagacggaacctatcaggttgagtacacgccatttgagaaaggcctacacgtggtggaagtgacttatgatgatgtccccatccctaactctccatttaaagtcgccgttaccgagggctgccagcccagcagagtccaggcccagggccctggactgaaagaagccttcacaaacaagcctaatgttttcactgtagtgaccagaggggccggcattggcggtctgggcatcaccgtggaaggtccttccgagtctaagatcaactgtagagacaacaaggacggcagttgctcagccgagtacatcccgttcgcccccggagattacgacgtgaatataacctatggcggcgcccacatccccggctcccccttcagagtacccgtgaaggatgttgtggatccgtctaaggtgaagattgccggccccggattgggctctggagtgcgcgccagggtcctgcagtcgtttactgtcgacagtagcaaagcaggtctagcgcccctagaggttagagtgctcgggcctcgcggcctagttgagccggtcaatgtagttgacaacggagacggcacgcacacagtgacttatactcctagccaggagggtccatacatggtaagcgtgaaatatgccgatgaggagatacctaggtcaccctttaaggtaaaggttctgcctacatatgacgcgtccaaagtgacagcaagcggccccggcctgagcagctacggagtccccgcatctctgcctgtagacttcgctatcgatgcaagagacgcaggagagggcttgctcgccgtccaaatcacagatcaggagggtaagccaaaacgcgccattgtgcatgacaataaagatggaacttatgctgtgacatatattccagataagacaggcaggtatatgataggcgttacctatggcggcgatgacataccattatccccgtacaggattagggcgactcaaacgggcgatgcatcaaagtgccttgcgaccgggcctggcatcgcctctaccgtgaagaccggcgaggaagttggttttgtggtcgacgccaagacagcaggcaagggaaaggtcacttgcactgtgttgacccctgatggcacagaagccgaggctgatgttattgaaaatgaagatggcacgtatgatatcttctacaccgcggcgaagccggggacgtatgtgatctatgttagattcgggggcgtcgacattccgaacagtccgtttacagttatggcaaccgacggcgaagttaccgcagttgaggaggctcccgtgaacgcatgtccccctggattcagaccttgggtaaccgaggaggcatatgtccccgtgtccgatatgaacggtctgggcttcaagccttttgatctggtgataccctttgccgtgcgaaagggcgagatcacaggcgaggtgcatatgccaagcgggaagaccgcaacacccgagattgtggacaacaaagacggcacggttactgtacgctacgctccaacagaggttggattacacgaaatgcacattaaatacatgggcagtcatattccagagtcccctctgcagttctatgtgaattatccgaattccggcagtgtgagcgcatacggtcccggcctggtgtatggcgtagcaaacaagacagcaacgtttacgattgtaacagaggacgccggggaaggcgggctcgatcttgctattgagggaccctcaaaagcagagatttcttgcattgataataaggacgggacctgcacagtgacctacctgcccactctgccgggggactattccattctggtgaagtacaatgacaagcacatccctgggtctcccttcaccgccaaaattactgatgatagcaggcgctgctctcaggtgaagcttggatctgccgcagattttctgctcgacattagcgagacagacctctcctctctgaccgccagcatcaaggcccctagtgggagagacgaaccgtgccttctgaaaaggttaccgaacaaccacatcggtatcagctttattccgagagaggtcggagaacacctggttagtattaaaaaaaatgggaatcacgtggccaacagcccggtttccatcatggttgttcaatcagagattggcgatgcacgaagagcgaaggtgtatgggagggggctgtccgagggccgcacattcgaaatgtctgacttcatcgtggatacaagggatgccggctacggtgggatcagcctggctgtcgaaggcccgtccaaggtggacattcagacggaggacttagaagatgggacatgcaaagttagctacttcccgaccgtccccggggtctacatcgtgtctacgaagtttgctgacgagcacgtgccaggatccccattcacagtcaaaatctcaggcgaggggagagtaaaagaaagtattacaagaacatcacgggcacctagcgtcgcgacagtgggatcaatctgtgacctgaatttaaaaataccaggggtgcgagtgatgaactgctcagcccagatattgtggggctggagagtgcagtttcatacaggatcccgtaaccaacagcagtag

SEQ ID NO: 187948 - DNA, 7737 bp, Artificial Sequence
  Description of Artificial Sequence: Synthetic coding sequence
atgcccgtgaccgagaaggacctggccgaggacgccccctggaagaaaatccaacagaatactttcaccagatggtgtaacgagcacctgaagtgcgtgaataagaggatcggcaatctccagaccgacctatccgacggcttacggctgatcgcactgctggaggttctttctcagaagcggatgtatagaaagtatcaccagcgccccacgtttagacagatgcagttggagaatgtaagcgttgctctggagtttttggaccgggagtccataaaattggtgagcatagactctaaggcgatcgtcgacggtaacctgaaactgatcttaggactggtgtggacgcttatactgcactacagcatttcgatgccagtttgggaagatgaaggcgacgatgatgcaaaaaagcaaactcctaagcagcgactacttggttggattcagaacaagattccatatctgccgattacaaatttcaatcagaattggcaagatgggaaggcgttgggcgccctagtggacagttgcgctcccggactgtgtcctgactgggaatcctgggacccccagaagcctgtcgataatgcgagagaagccatgcaacaagccgacgactggcttggagtgccacaagtcattaccccggaggaaataattcaccccgacgtagacgaacatagtgtgatgacgtacctgagtcagttccccaaagcaaaactcaaacccggagctccactaaagcccaaacttaatcccaaaaaagctagagcatatggcagaggtatagagcctaccggtaacatggttaagcagccggccaagttcaccgtcgatactattagcgctggccagggcgatgtgatggtgttcgtggaggatccggaagggaataaagaggaagcgcaagtcacaccagactctgataaaaataaaacctacagtgtggaatacctacccaaggtgaccggtctgcacaaggtcacagtgctgttcgcaggtcagcacatatcgaaatctcccttcgaggtttcagtggataaggctcagggcgacgcctctaaggtaacggccaagggcccagggcttgaggccgtaggcaatattgctaacaaaccaacgtacttcgatatatacaccgcaggcgctggggtcggcgacatcggagtggaagtggaggacccacagggcaaaaatactgtggagctgcttgtggaagataaggggaatcaagtgtacaggtgcgtgtacaaaccaatgcagcctggtccacacgtggttaagatattctttgcgggcgacactatccctaaatccccttttgttgtgcaggtgggtgaagcttgtaatccaaacgcatgtcgcgcctcgggcagaggcttacagcctaagggggtgcggataagagagacaacagactttaaggttgataccaaggctgccggttctggagagctgggagtgactatgaaggggcctaagggcctcgaagagttggtgaagcaaaaggacttcctggatggagtttatgccttcgagtattaccctagcacccccgggaggtacagcatagctattacatggggcgggcatcacattcccaaaagccctttcgaggtgcaggtcggacctgaagccggcatgcagaaggtgcgagcttggggccccggcctccacgggggcattgtgggccgttcggcggattttgtggtggagtccattgggtcagaggtaggctctctgggtttcgccatagagggaccctctcaggcaaaaatcgagtacaacgatcagaatgacgggagctgcgatgttaagtattggcctaaagagcccggcgaatacgcagtacacattatgtgcgatgatgaggatattaaagactctccttatatggcatttattcatcccgcaaccgggggatacaaccccgacctcgtccgggcctatggaccaggcctggaaaagagtggatgtatcgtcaacaatctggccgagtttactgtggacccaaaggatgcaggaaaggctccgcttaaaatttttgcccaggatggcgaagggcaaagaatcgacatccaaatgaaaaaccggatggatggcacgtacgcctgttcatacacccctgtgaaggcaatcaagcacacaatcgctgttgtgtggggcggggtgaacatcccacactcgccttatagagtcaacattgggcagggatctcacccacagaaggtgaaggtttttgggcccggcgtggagcggtcgggtttgaaagccaacgagcctacacacttcacagtagactgtacagaggctggcgagggggacgtctcagttggaatcaaatgcgacgcaagggtgctcagcgaagatgaggaggatgtggactttgacatcattcacaacgccaacgatactttcacagtcaaatacgtccccccagccgccggaagatacactatcaaggtccttttcgcttcacaggagatacccgcgagcccgtttagggtcaaagtcgatccttcacatgacgcttctaaggtaaaggccgagggccccgggctcagcaaagccggcgtggaaaatggtaaaccaacacatttcaccgtgtacaccaaaggtgccggtaaagccccactgaatgtccagttcaacagtccactgcctggagatgcagtcaaagaccttgacataatcgataattatgattattcccacacagtgaagtatacacccacccagcagggaaatatgcaggtgctcgttacatacgggggcgacccaattcctaaatctcccttcactgtcggagtggccgcacctctcgatctgagcaaaataaagctaaatggcttagagaaccgggtggaggtgggcaaagaccaagaattcactgtcgataccaggggagcgggaggccaggggaaacttgacgtaacaattctgtctccttctcgcaaggtggtgccctgtttggttacgcctgttactggacgcgaaaactccactgcgaagtttataccccgggaggaggggctgtacgcagtcgacgtcacatatgatggacatccagttcccggcagtccatacaccgtggaagccagtctgccgcccgatccttcaaaggtcaaggcgcacggacccggcctcgaaggaggcctggtcggtaagccagccgaatttacgattgacaccaaaggagccggcaccgggggcctggggctcacagttgaagggccctgcgaggccaaaatcgagtgctcggacaacggtgatgggacttgcagcgtgtcatatctgcctaccaagcccggagagtacttcgtgaatattctgttcgaggaggtccatattcccggatcaccgttcaaggccgacatcgagatgccattcgatccctcaaaagtggttgcctcagggccagggctagaacacggcaaagtcggggaggccggtctcctctctgttgactgcagtgaggccggacctggtgctcttggtttagaagccgtctccgatagcgggacaaaggcagaagtgtcaattcagaataacaaagacggcacgtacgctgtgacatatgtgcccctcacggccgggatgtacacccttactatgaagtacgggggtgagctagtccctcatttccccgccagagtgaaggttgagccggcagtggacacatccaggatcaaggtttttggacctgggatcgaaggaaaagacgtatttagggaggccactacagattttaccgtcgacagtcgacccctaacacaggtgggcggagaccatatcaaggcccacattgccaatccgagcggcgcctcgactgagtgttttgtgactgacaacgcggacggaacgtaccaggtggagtatacacccttcgagaaaggactgcatgtggtggaggttacttacgacgacgtgccgattcccaatagcccttttaaggtggcagtcaccgaaggctgtcaaccttctagggtgcaggctcagggccccgggctcaaggaggcctttaccaataagcctaatgtttttactgtcgtcacaaggggggctgggattggcggcctcggtatcaccgtcgagggccctagcgagtctaaaatcaattgccgcgacaataaagatggatcatgtagcgccgaatatatcccctttgctcctggggactacgatgtgaatatcacatatggaggagcccatatccccggatcccctttccgtgtgcctgtgaaggacgtggtcgacccaagcaaagttaagatcgcagggcctgggctgggatcaggtgttcgcgcacgggtattacagtccttcactgtggacagcagcaaggcgggtcttgcccccctggaggtccgggtactcggccctcgtggactggtagagccggttaatgtggtcgataatggggatggaactcacactgttacatacacgccatctcaggagggcccttatatggtgtcagtaaagtacgccgacgaagagattccaaggagtccctttaaagttaaggttttaccaacctatgatgcctctaaagtgacagctagtggccctggcctgtctagctacggggtccccgctagcctaccagttgacttcgctattgatgctagggatgcaggggagggcctgctggccgttcagattaccgaccaggagggtaaacccaagcgggcaatcgtccacgataataaggacggaacatacgcagttacttatatacctgacaagacaggcaggtatatgatcggggtgacttatggcggcgatgacatccccctgtcaccttataggattcgtgctactcagaccggggacgctagtaaatgcctcgccactggcccgggaattgcctcgactgttaagacaggcgaagaagtgggcttcgtcgtagacgcaaaaaccgccggtaaggggaaggtcacatgcaccgttctgacccctgacggaaccgaggccgaagcagacgttatcgaaaatgaagacggcacgtatgatatcttctacacagccgctaaacccggcacctatgtgatatatgtccgatttggaggtgtcgatattcccaactcaccgttcaccgtgatggtgacagaggaagcctacgtccccgtgagcgacatgaacggcctgggattcaagccatttgatctggtgatcccattcgcagtgagaaagggcgagattactggggaagtgcacatgccttccgggaagactgcaacacccgagatcgtggataacaaggacggaaccgtcaccgttaggtacgcccccaccgaagtggggttgcacgaaatgcatataaagtacatgggatcacacatccccgaaagccctctgcagttctatgtcaattatcctaactccggatctgtctctgcctatgggccaggcctagtgtacggggtggcaaataagacggcaacgttcacaatcgttaccgaagacgccggcgaggggggtctggacctggcaattgaagggccaagcaaggcagagatctcttgcatcgacaataaggatggcacttgcacagtgacttaccttcccaccttgccaggcgattattccatacttgtcaagtacaatgacaagcacattcccggatcgcccttcacagccaagattaccgatgacagccggcgatgctcgcaggttaaactgggtagtgcggcggacttcctacttgatatctccgagacggacttgagctcactgactgcttccattaaggctcctagcggccgggatgagccttgtctgctaaagcgtcttcctaacaatcacatcggtatttcttttatcccacgggaggtcggagagcacctggtgagcatcaagaagaacggcaaccatgttgcgaactcacctgtttctatcatggtcgtgcaaagcgagattggcgacgccaggcgagctaaggtgtatggccgcgggctctccgaggggcgcaccttcgagatgtcagatttcattgtggatactcgtgatgctggttacggtggcattagcctggctgtagagggaccgagtaaggttgatattcagacagaggacctagaggacggaacgtgcaaggtctcgtattttcctacagtgcccggcgtttacatagtgtctaccaagtttgcagacgaacatgtacctggttcaccctttaccgtgaagatttcaggagagggacgcgtaaaagaatcaatcaccagaaccagccgagccccctccgtggccaccgttggttctatatgtgatctgaacctgaaaatcccggagataaacagttctgacatgtctgctcatgtcactagcccttcagggcgcgtgacagaggctgagatagtgccaatggggaagaacagccattgtgtaaggttcgtcccacaagagatgggggtgcacaccgtatcagttaagtaccgagggcagcacgtaactggcagccctttccagttcaccgtcggcccactaggagaaggcggggcacataaggtgagggccggagggcccggcctggagcgcggtgaggccggagttcctgctgagttcagcatttggacaagagaagccggagccggtgggctgagcattgcagtggagggcccatctaaggccgagatcactttcgatgatcacaagaatggcagctgcggcgttagctacattgcgcaggaaccaggcaattatgaggtctccatcaagtttaacgatgaacatatcccggaaagtccatatttggtgccagttatcgcacctagcgacgacgctcgtaggctgaccgtcatgagcttacaggagtcagggctcaaggttaatcagcctgccagtttcgccattcgccttaatggagcaaaaggaaaaattgacgctaaagttcacagccccagtggggctgtggaagagtgtcacgttagtgagctggaacctgataaatatgccgtgcggttcatccctcatgaaaatggtgtgcacactattgacgttaaatttaatgggagccatgtggtgggttcaccatttaaggtgcgtgtgggggaacccggccaggcgggcaaccccgccctggtgtcagcctatgggacaggcctagaggggggaactaccggtattcaatctgagttctttatcaacacaactagggccggcccagggaccctgagcgtgaccatagaggggcctagtaaggtcaaaatggactgtcaggagacacctgaagggtacaaggtgatgtatacaccgatggcccccggaaactacttgatcagcgttaaatatggaggccccaaccacatcgtggggagccctttcaaggccaaggttacggggcagaggctggtctcccccggcagtgctaatgaaacatcatctatcctggtcgagagtgtcacaaggagttctacagaaacctgttattcggctatccccaaagccagctccgatgcctccaaggtgacctctaagggagctggtctgtccaaggcctttgtggggcaaaaatcttcctttcttgtagactgctccaaggccgggtctaacatgctgcttatcggggtccacggtcctactacaccttgtgaagaagtttctatgaagcacgtcggcaaccaacagtataatgtgacttatgtcgtgaaagaacggggggattatgtgctggccgtaaaatggggggaggagcacattcccggatcccccttccacgtgactgtgccctag

SEQ ID NO: 187949 - DNA, 7269 bp, Artificial Sequence
  Description of Artificial Sequence: Synthetic coding sequence
atgcaggagcacagcacccggcggcggagcctgagcctgtgccccgattgggagagttgggatcctcagaaacccgtagacaatgctcgcgaagccatgcagcaggctgacgattggttaggagtgcctcaggtgatcacccccgaggagatcatccaccccgacgtggacgaacacagtgtgatgacctatctatctcagttccccaaggccaagctgaagccgggagctcctttaaagccaaaattaaatcccaagaaggccagagcctatggaagagggatagaacccaccggtaatatggtgaaacagcctgcgaaatttactgtagatacaatctcagccggccaaggcgacgtgatggtgttcgtggaagatccagaaggcaacaaagaggaagcccaggttacccccgatagcgacaagaacaagacctattccgtggagtaccttcctaaagtgaccgggctacataaagtcaccgtcttgtttgcaggccagcacatcagcaagagtccttttgaggtgtccgtggataaagcccaaggagacgctagcaaagtgactgccaaggggcccggcttggaggctgtagggaacatcgctaataaacccacttacttcgacatttacacggcaggtgccggcgtaggagacatcggtgttgaggttgaagacccccaaggaaagaatactgtggagctgctcgtagaggacaagggaaatcaggtgtaccggtgcgtgtacaagccaatgcagcccggccctcacgttgtgaagatcttcttcgccggagacacaatccctaaatctcccttcgtggtccaggtcggcgaggcctgcaacccaaacgcttgccgagcctctggccgcggtctgcaaccaaaaggggtgaggattcgcgagaccaccgactttaaggtagatacaaaagccgctggaagtggagagctgggggtgacaatgaaagggcccaagggcctcgaggaattggttaaacagaaggattttctcgatggggtgtacgcttttgagtactacccttcaacacccggtaggtactcaatcgccatcacgtgggggggacatcacattcccaagagcccattcgaagtgcaggtgggcccagaagcggggatgcagaaagtgagagcatgggggcctggcctacacggcggcatcgttggcagaagcgccgattttgttgtggagtccattggtagcgaggtcgggtccctgggctttgctattgaaggtccatctcaagcgaagattgagtataatgaccagaatgacggctcctgtgatgtgaagtactggccaaaggaaccgggcgaatacgccgtacacatcatgtgtgacgatgaggacatcaaggacagtccctacatggcttttatccaccccgccactggcgggtataacccagatttagtccgcgcgtatggcccggggctcgagaaatctggttgtatcgtcaataatctggccgagtttaccgtcgatccaaaagatgctgggaaggccccactgaaaatcttcgcccaagatggtgaggggcaaagaattgatatccagatgaagaatcgcatggatggcacttacgcatgttcatacacccccgttaaggctattaaacataccattgcagtggtgtggggcggcgtaaatattccacatagcccttatagagtgaacatcggtcagggatcccatccacagaaagtgaaagtgttcggccctggagtcgagcgctcggggctcaaagcaaacgagccgacacactttacggtggattgcaccgaagccggagaaggcgacgtctcggtgggaataaagtgtgacgcccgcgtgctgtctgaggacgaggaggatgtggacttcgacatcattcacaatgcaaacgacacctttacagtcaagtacgtgcctccggctgcggggcgatacactatcaaggtgctcttcgcttcgcaggaaattcctgcctcccctttcagagtcaaggtggacccttctcacgatgcaagcaaggtgaaagccgaaggccccggcctgagcaaagcaggagtagaaaatgggaagcctacccacttcaccgtttatactaaaggagctggcaaggcacctctcaatgtgcaatttaactcccctctgccgggggacgctgttaaggatctcgatataatcgataattacgactattctcacaccgtgaaatacacacccactcagcagggaaatatgcaggtgctcgtgacatatgggggtgatcctattcctaaaagcccattcacagtaggcgtggccgcccccttagacctgagcaagattaaacttaacggacttgagaatcgggtggaggtcgggaaggatcaggagttcaccgtggacacaagaggagcagggggacaggggaaactagacgtgacaattctgtctcctagccgtaaggtggtcccatgcctggtcactcctgtgacaggtcgggagaactctaccgctaagttcataccacgggaggaaggtttgtacgcagtagatgtcacatacgatggtcatccagttcccggctctccatacactgtggaagccagcctacctccagaccctagcaaggtgaaagcccacggtccaggattagagggcggattagtcggaaagcctgccgaattcactattgacaccaaaggagccggcactggcggtctgggcctgactgtagagggtccatgtgaggctaagatagagtgctcagacaatggtgatggcacatgctccgtttcctatttgcctaccaagcccggcgagtactttgtgaacatcctattcgaagaggtccatatcccggggagcccctttaaggcagatatcgagatgccatttgatccctcaaaagtggttgcctcaggccccggcctggagcatggaaaggtaggtgaggcaggcctgttatcggtggactgctccgaggcgggaccgggtgctttaggccttgaggccgtgtctgattcaggaaccaaggcagaggtgtccatccaaaacaacaaggacggcacatatgccgtgacgtacgtaccacttaccgctgggatgtacactcttactatgaagtacggcggtgaactggtcccccatttccctgcccgggtgaaagtggagcccgcggtggacacgagtcgtattaaggttttcggccctggaatcgagggaaaggatgtgtttagagaggctactacagatttcaccgtcgactctcgcccgctcactcaggtcggcggagaccacatcaaagcacatatagctaatcctagcggcgcttcaactgaatgttttgtgaccgacaatgccgacggaacataccaggtggagtacacccctttcgagaagggcctgcatgtggtggaagtgacatatgacgatgtgcctatcccgaattccccgttcaaagtcgcagtgacagaaggatgtcaaccatcccgggtgcaagctcaggggcccggcctgaaggaggcctttactaataagcccaatgtgttcacagttgttacccgcggggccggcattggaggcctgggtattaccgtggaaggtccttccgaaagcaagataaactgtcgagataacaaagacggcagctgtagcgccgagtacattccattcgctcctggagattacgacgtgaatatcacctatggtggggcccatattcctgggtccccatttagggtacccgtcaaggatgtagtggacccgtctaaagtgaagatcgcaggccccggactgggctcaggggtgagggcacgcgtactccaaagcttcaccgtggacagtagcaaggctgggctcgccccgctggaggtcagggtcctagggcccagaggcctcgtggaacctgtcaacgtcgtagacaatggcgacggtacgcatactgttacctacaccccctcgcaggaagggccttacatggtttccgtcaagtatgcggatgaggagataccgcggagtcccttcaaggtgaaggtgcttccgacctatgatgcatccaaggtcaccgcttcaggtcccggactatcttcttacggggtgcccgcatcgctgccagtggattttgctattgatgcgagggacgccggagaaggtctgctggccgtgcagataacggaccaagaagggaagcccaagagggctatagtccacgacaataaggacggaacctacgcggtgacttacattcccgacaaaaccggccgatacatgataggcgtgacatacggaggggatgacattcctctgtccccgtataggatcagagcaacacaaaccggagatgcctccaagtgcctggcgactgggcccggcattgccagcacggtcaagaccggggaagaagtaggcttcgtcgtcgacgcaaaaactgccggaaaaggtaaagtgacgtgcaccgtgttgacgccagatggcacggaggcagaggcggacgtcatcgagaacgaggacggcacttacgacatcttttacacagctgccaagccaggtacttatgtcatctatgtcaggttcggaggggtggatatcccaaattctccatttaccgttatggctaccgatggagaagtgacagccgttgaggaagctccagtaactgaggaggcatacgtgccagtgtccgacatgaatggacttggctttaagccctttgacttagtgataccgttcgccgtcagaaaaggtgagatcacgggtgaagtccacatgccgtctggtaagactgctacgccagagattgtcgacaacaaagatggaacagtcactgttagatacgcacctaccgaggttggcttgcacgagatgcacatcaagtacatggggtcccacatccccgagtcccccctccagttctatgtcaattatcccaactctgggagcgtgagcgcttatggccccggtttggtctatggagttgcaaacaaaaccgccacattcacaattgtgactgaggatgctggcgagggcggcctcgacctggcaatcgaaggcccttccaaagccgagatctcctgtatcgacaacaaggacgggacgtgtacagtgacgtatctacctaccctgccgggagattacagtattctcgtgaagtacaacgacaaacatattcctgggtctccttttactgccaagattaccgatgattctcgccggtgtagccaagtgaaactggggagtgctgcagatttccttttggacattagtgagaccgacttgagttcactcaccgcttccataaaagcccccagcggccgggatgagccctgtctcctgaagcgtttgcccaataaccatatcggtattagttttatcccgcgagaagttggagaacatctcgtaagcataaagaaaaatgggaatcatgttgccaatagccctgtgtccatcatggttgtccagagcgagatcggggatgcccggagagcaaaagtgtacggccggggcctctctgagggacgaacttttgaaatgtctgacttcattgtcgacacccgcgatgcgggctatggaggtatctctttagcagttgaaggcccgtctaaagtggatatccagacagaggacctggaagatggtacatgcaaagtgtcatatttcccaaccgtgccaggcgtgtacattgtttcaactaagttcgccgacgaacacgtaccgggcagtcccttcactgtaaagatttcaggggagggacgcgtcaaagagagtatcaccaggactagtcgcgcccccagcgttgcgaccgtggggtctatatgcgatctgaacctgaagataccagagattaactcatctgacatgagtgcccacgtgacctcaccctctgggcgagtgacagaggcggagatcgtgcccatgggtaaaaactcacactgtgtacgctttgtcccacaagagatgggagttcacacagtttctgtgaagtatagaggccaacatgtaacaggcagccccttccaattcacagtaggtcccctcggcgaggggggagcgcacaaggtgcgggccggcgggccaggacttgagaggggagaggctggcgtaccagccgagttttcaatttggacgagggaggcaggtgccggagggttaagcatcgccgttgagggacccagtaaggcagagattacattcgacgatcacaagaatggaagttgcggtgtctcctatattgcgcaagaacccggcaactacgaagtgagcattaagtttaatgatgaacatatccccgagtccccctatttggtcccggtaatcgcgccctctgacgatgccaggaggctgactgtgatgtcactgcaggagtccggcctgaaggtgaaccaacccgcctcctttgcaattagattaaacggagcgaaagggaaaattgacgccaaagtacattccccaagtggggccgtggaagagtgtcacgtgagcgagctggaaccagataaatatgcggttcgatttatcccacacgaaaatggagttcatacgatagatgtcaagttcaatggctcccatgtggtggggtcaccatttaaagtcagggttggcgaaccaggacaagccgggaatccagctctcgttagcgcgtacggaactgggctggagggagggacaaccgggatccagagtgaatttttcatcaacacaacccgcgctggccctggaaccctttctgtcacgattgaaggaccctccaaggtgaagatggattgccaagagacccccgaaggatacaaggtgatgtatacacctatggctccaggaaattatctcatttctgtgaagtatggtggaccaaaccacatcgtgggtagcccttttaaagcgaaggtgactggtcagaggctcgtgagtcccgggagcgccaacgaaacatccagcatcctggtcgagtccgttacgagatcttccacagagacttgctattcagccattccaaaggcgtcaagcgacgcgtccaaggtcacctccaagggcgctgggctgagcaaagcctttgtgggacaaaaatcaagctttcttgtggactgttccaaagccggcagcaacatgctgctgatcggcgttcacggtcctacaaccccgtgtgaagaggttagcatgaagcatgtcggtaaccagcagtataatgtcacttacgttgtcaaggagcgaggggattatgtgctcgccgtcaagtggggtgaagagcatatacctgggtccccattccatgtgacagtgccttag

SEQ ID NO: 187950 - DNA, 7776 bp, Artificial Sequence
  Description of Artificial Sequence: Synthetic coding sequence
atgcccgtgaccgagaaggacctggccgaggacgccccctggaagaagattcagcagaataccttcacgagatggtgtaatgagcacttgaaatgtgttaacaaaaggattgggaacttacaaacagatctgtccgatggtctgagactgatcgcactgctagaagtactttcacaaaaaaggatgtatagaaagtaccaccagagaccaacctttagacagatgcaactggagaatgtctcagttgcgctcgagtttcttgatcgggagagcattaagttagtgtccatcgactcgaaggctattgtcgatggcaacctgaaattaatccttggcctggtgtggactctgattctccattactctatctccatgcctgtgtgggaggatgagggagatgacgacgccaagaaacaaacccctaagcagagactactgggctggatccagaacaaaatcccttacctgcccatcacgaatttcaaccagaattggcaggatggcaaagccctgggagctctagtggattcttgcgccccgggtctctgccccgactgggagagttgggacccacagaaaccagtcgacaatgcccgcgaggccatgcagcaggccgatgactggctgggtgtgcctcaggtaatcacccccgaggaaattatccatccagacgtggatgagcactctgtcatgacatacctctctcagtttccaaaagcaaagctgaaacctggggctccacttaaaccgaagttaaacccgaagaaggccagggcctacggaagaggcattgaaccgaccgggaacatggtgaaacagcccgcaaagttcacagtcgacacgatatctgcgggacagggcgacgtcatggtgttcgtggaagacccggaaggaaataaggaagaggcccaggtcacccccgattccgataagaataaaacgtatagtgtggaatatttacccaaagtgactggtctgcacaaggtgaccgtgttgtttgctggtcagcatattagcaagagcccatttgaagtctccgtcgacaaagcccagggcgacgccagtaaagtcacagctaagggacctgggttagaagctgtcggcaacattgcaaacaaaccgacttatttcgatatttacacagccggagctggggttggtgatatcggggttgaggttgaggacccccagggcaaaaacacggtggagcttttggttgaggacaagggaaaccaggtatatcgatgtgtctataaacctatgcaacctggcccacatgttgtaaagattttctttgcaggtgacactattcccaagagcccctttgtggtgcaagtcggcgaagcttgcaatcccaatgcttgccgggcttccggccggggcctgcaacccaagggtgtgcggatccgcgagactactgatttcaaagttgacaccaaggccgccggtagtggtgaattgggagtgacgatgaaggggcccaagggtctagaggaactggttaagcagaaagacttcctggatggagtttacgccttcgaatattatccttcaacacccggacgctatagtatcgctatcacgtggggcgggcaccacattccaaagtcaccctttgaggtgcaggtggggccagaggccgggatgcaaaaagtccgcgcatgggggcctggcctacacggaggtattgtggggcgtagcgcggactttgttgtggagtccataggaagcgaggtgggttcactcggcttcgcaatcgaggggccatcccaggccaagattgaatacaatgatcagaacgacggctcctgtgatgtgaagtattggcctaaagagccaggtgagtacgctgtgcatatcatgtgcgatgatgaagacataaaggactctccatatatggcctttattcatcctgcgactggcggttataatcctgatctcgtacgagcctatgggccaggcctggagaaaagtggctgtatcgtaaataaccttgcggaatttaccgtggatccaaaggacgctggcaaagcacctctcaaaatcttcgctcaggacggcgagggacagcgcatcgacatccaaatgaagaaccggatggacggaacgtacgcctgtagctatacccctgtaaaagccatcaagcatactatagccgtggtgtggggaggagtgaacatccctcacagcccatatcgcgtcaacatcgggcaaggatcacaccctcaaaaggtgaaggtctttgggccgggcgtggaacgaagcgggctgaaagcaaacgagcccacgcatttcacagtagattgcaccgaggcgggcgaaggagatgtgagcgtcgggatcaagtgcgacgcccgggttctgtctgaagatgaggaagatgtagacttcgacatcatccataatgccaacgatacttttaccgtcaaatacgtgcctcctgctgccgggaggtatacaatcaaggtgttattcgctagccaggagattccggccagtccatttagagttaaggtcgaccctagccacgacgcatctaaggtgaaggcagaggggcctggcctctccaaggccggcgtagaaaatggcaaacccacccattttacagtctacaccaaaggagccggtaaggcgcctcttaatgtccaatttaacagtcccctgcccggagatgccgtgaaggatctcgacatcattgataactatgactattctcacaccgtcaagtatacaccaacacagcagggcaacatgcaggtgctagtgacatacgggggcgatccaatccccaagtcccctttcacagtaggagttgccgcaccccttgacctgagcaagatcaagctgaatgggcttgaaaaccgcgtcgaggtgggcaaagatcaagaatttacagtcgatactaggggggctgggggccagggtaagctggacgtgaccatattgagcccttccagaaaggtagtgccatgtctggtgacacctgttaccggcagagaaaacagcaccgcgaagtttattcctcgggaggagggcctgtatgctgtggacgttacctacgacgggcatcctgtaccagggagcccctatacagtggaagcctcccttccccccgatccttcaaaggtcaaagcccacgggcctggactggaggggggtctagtggggaaacctgcagaatttacaattgataccaaaggcgccggcaccggcgggttaggtctgactgtagaggggccatgcgaggctaagatcgagtgctccgataacggcgatgggacctgttctgtgagctacctgcccacaaagcctggcgaatattttgtcaacatcctcttcgaagaggtccatatcccgggatcaccctttaaggcagacattgagatgccttttgacccttcaaaagtcgtagcttcagggccgggcctggagcatgggaaggtgggggaggccggattgttaagcgtagattgtagcgaggccggcccaggagccctgggccttgaagctgtgtctgactctggcacaaaagccgaagtatctatacagaacaacaaagatggaacgtacgccgtcacctacgtgccactgactgccggtatgtacaccctgacaatgaagtacggaggggaactcgtaccccacttcccagcacgagtaaaggtcgagccagcagtggacacatctcgtatcaaggttttcggacctggaattgaaggcaaagacgtgtttagggaggccactactgattttaccgtggattcaagaccactgacccaggtgggaggcgaccatataaaggcccacattgctaatccttcaggcgcatccacggaatgcttcgtcacagacaatgcagatggcacttatcaggtcgagtatactccctttgagaaaggattgcatgtggtggaggtgacgtacgacgatgtgccaataccaaattccccgtttaaggtcgcagtcactgaggggtgccagccttctcgtgtgcaggcacaagggcctggtctgaaggaggcctttaccaataagcctaatgttttcacggtagtgacaaggggcgcaggcatcggtgggctcgggatcacagtggagggcccttcggaatccaagatcaactgcagggataacaaagatggctcttgtagcgccgaatacattccttttgcccctggtgattatgatgttaatatcacttatggaggtgctcatatccccggttctccgttccgcgtacctgtgaaggatgtggtggacccctccaaggttaaaattgctggacctggactaggctccggcgtgagggcccgagttctccagagtttcaccgtggattcctccaaagcaggtctcgccccactagaggtccgagtattgggaccccgagggctggtcgagcccgtcaacgtcgtcgacaatggtgacggaactcacaccgtgacatacactcctagtcaggagggaccatacatggtgtcagtaaaatatgctgatgaagaaatcccccgtagcccctttaaggtgaaagtgctacctacatacgacgcttcaaaagtcaccgcaagtggacctggactttctagctacggagtgccagcaagcctgcccgtggacttcgctattgacgcaagagacgcgggcgaaggactgttggcagtacaaattaccgaccaggagggaaaacccaaaagggccatcgtccatgataacaaggacggaacttatgcagtcacttacatcccagataagaccggccgatatatgataggtgtgacctacggaggggatgacatccctctatccccctaccgtatcagagctacccaaaccggtgatgcctctaagtgcttagcaactgggccgggcatcgccagcactgtcaagactggggaagaggtcggatttgtcgtcgacgccaaaactgctggcaaaggtaaggtaacttgcacagtactgactcctgacggaacagaggccgaggccgatgtgatcgagaatgaagatgggacctacgacatattctatactgccgctaaaccaggcacttatgtgatctacgtaagattcggaggtgtcgatataccgaattctccttttaccgtgatggctactgacggcgaagttactgcagtggaggaggcacctgtgaccgaggaagcctatgttcccgtctctgacatgaacggactggggtttaaaccctttgatctcgttattccattcgccgtccggaagggggagatcaccggtgaggtgcatatgccttcgggcaaaactgcaacccccgaaattgtggacaataaagatggaacggtgacggtgaggtatgctccaacagaggtggggcttcacgagatgcatatcaaatatatggggagccacatcccagagtcccctctccagttttacgtgaattaccccaattcaggctcagtgtctgcgtacgggccgggcctggtgtacggggtagccaataagactgccacttttaccattgtgacagaagacgccggagagggcggcctagacctagccatcgagggaccgtccaaagcagagatctcttgcatcgataataaagatggtacttgcacagtcacgtaccttccaactctgccaggggattactcaatcttagtaaaatacaacgataagcatatccccggctcaccatttaccgcaaagattacagacgactccaggcggtgctcccaggttaagctcggctccgccgcggacttcctcctcgacatctccgagaccgaccttagctcattgaccgcctctatcaaagcccccagtggccgggatgaaccatgtttgttgaagcgccttccaaataaccacatcgggatatcgtttatccctagagaggttggtgagcaccttgtgagtattaagaagaatggtaatcatgtggctaactccccagttagtattatggtggtccagtccgaaatcggagacgcacggcgcgcaaaagtgtacgggcggggactgagcgaagggaggaccttcgagatgtccgacttcatcgttgacacccgggacgctggctacggtggcatatcactggcggtggagggccctagcaaagtggacatccagaccgaggacctagaggatgggacctgcaaggtgtcatatttccccacagtgcctggcgtgtacatcgtttccactaaattcgctgatgagcacgtgccagggagcccgttcaccgtcaagatttctggggagggtagagttaaagaaagcattaccagaacctctcgggcaccctctgtcgctaccgtgggctctatttgcgaccttaatctcaaaattcccgagatcaattctagcgatatgtccgcccatgtaacctcaccgtccgggagagtgactgaggcagaaatcgttcccatgggcaagaactcccactgcgtgcggtttgtcccccaggagatgggtgtacacacagtctcagttaagtatcggggacaacatgtgactgggtctcccttccagttcaccgtaggaccgctgggtgaaggaggcgcccacaaagtgcgcgctggtggccccggactcgaaagaggcgaggcaggagttcccgcagaattttccatctggacacgggaagccggggccgggggcctctccattgctgtggaaggcccgtcaaaagcagaaataacgtttgatgatcacaaaaacggtagctgtggcgtatcatatattgctcaggagcccggcaactacgaagtttcaattaaattcaacgacgagcacatacctgaaagcccataccttgtgcctgttatcgccccctccgacgacgcccggagactcacagtcatgtcccttcaggaaagtgggctgaaagtcaaccagccagcttctttcgcgatccgcctcaacggagcaaaaggaaagatcgacgccaaagtccactccccctcaggtgctgtcgaggagtgtcatgtgagcgagctggagccagacaagtacgccgtgcggtttatccctcatgagaatggtgtccacacaatagacgttaagtttaacggaagtcacgtggttggatccccctttaaagtgcgcgttggtgagcccggccaggctggcaaccctgctttagtttcagcctatggaaccggcctcgaaggagggactactggtattcaaagcgagttttttatcaatacaactcgggctggacccggcaccctgtcggtaactatagaaggaccttctaaggttaagatggactgtcaagaaacgccggaaggatacaaggtgatgtacactccaatggctccgggaaactatctgattagtgttaagtatggggggccaaaccatatcgttggctctcctttcaaagccaaggtgaccgggcaacggttagtatcaccgggctccgctaatgaaacatcttctatcttggtggagtcagtaaccagatcaagtaccgagacctgctattctgccataccaaaggctagtagcgacgccagtaaagtgacatccaagggcgccggtttgtctaaagcctttgtggggcaaaagtcgagctttctggtcgactgttctaaggcagggtcgaacatgctattgattggggtccatggccccaccactccatgcgaggaggtgtccatgaagcatgtgggaaaccagcagtacaatgtcacatacgtggttaaggagagaggcgactatgtacttgcagtcaagtggggagaggagcacatcccaggcagcccctttcacgtgaccgttccttag

SEQ ID NO: 187951 - DNA, 408 bp, Artificial Sequence
  Description of Artificial Sequence: Synthetic coding sequence
tgactggccgtggagggccccagcaaggtggacatccagaccgaggacttggaggacggtacgtgcaaggttagctacttccctacagttcccggcgtctacatcgtctcgaccaaattcgcggatgaacatgtccccgaaattaactcaagcgacatgtccgcacacgtgaccagcccgagcggtcgggttaccgaggctgaaatagtccctatgggaaaaaatagccactgcgtgcgttttgttccccaggaaatgggagtacacacagtgtccgttaagtatcgcggtcagcatgtgaccgggtcccctttccagttcacagtgggacccctgggcgaaggcggagcccacaaagtaagagcaggtggtcctggtcttgagaggggcgaggctggcgtcccctag

SEQ ID NO: 187952 - DNA, 7902 bp, Artificial Sequence
  Description of Artificial Sequence: Synthetic coding sequence
atgcccgtgaccgagaaggacctggccgaggacgccccctggaagaaaattcagcagaacacttttacgcgctggtgcaatgaacatctgaaatgcgtcaacaagcggattggaaacttacaaacagatctgagtgacgggctgcggctgatcgcattgttggaggtgctctcacagaagcgtatgtaccggaagtatcatcagcggcccaccttccgtcagatgcagctagaaaacgtctcagtggccctcgaatttctcgacagagaatctatcaagctcgtaagtatcgattctaaggcgatcgtggacggtaatctcaaattgatcctagggttggtatggaccctgatacttcactactccatttctatgccagtctgggaggatgaaggggatgatgacgctaagaaacagacgccaaaacagagactacttggctggatacagaataagatcccctacctgcctatcacaaactttaaccagaactggcaggacgggaaggccttgggcgccttggttgattcctgtgcacctgggctgtgccctgactgggaaagttgggatcctcagaagcccgtcgataatgccagagaggcgatgcagcaggccgacgactggctcggggttcctcaggtgattacccctgaggagatcattcaccccgacgtggacgagcattcagtaatgacttatctgtcacagttccccaaagctaagctgaaaccaggtgctcctctcaaaccgaagctgaatcccaagaaagcccgtgcatatggcaggggcattgagccgacagggaacatggtgaaacagccagcaaagtttaccgtagatacgatcagtgcaggacaaggagatgtcatggtgttcgtggaggatcctgagggcaacaaagaggaggcgcaggttactccggattccgacaagaacaagacttattcagtggaatatctgccaaaggtgacgggcctgcacaaagtgactgtcttgtttgcaggacagcatatctccaaatctccttttgaggtttcggttgataaagcccaaggggatgcaagtaaggtgaccgctaaaggcccgggcctggaagccgttggcaacatcgcaaataagccgacctactttgacatctataccgctggtgccggcgtcggggatatcggcgtggaggtcgaggacccacagggaaagaatactgtcgagctgctggtcgaggacaaggggaatcaggtgtatagatgcgtatacaagcccatgcagccaggacctcacgtcgtaaagattttctttgccggcgacaccatccccaaatcacccttcgtcgtccaggttggcgaggcttgcaacccaaatgcttgccgagcatccggtcgaggactccagccaaaaggagtgcgaatccgagaaacgacagacttcaaggttgacaccaaggccgccggtagcggagaactgggcgtgaccatgaaaggtcccaagggtctggaagaactggtgaagcagaaggattttctggatggcgtctacgcatttgagtattatccaagtactcccggcaggtacagcatagccattacgtggggtggacatcatattcccaaatccccttttgaggtgcaagttgggccagaggctggcatgcagaaggtccgggcttgggggcccgggctgcatggggggattgtcggaagatctgctgatttcgtggtcgagagcataggcagcgaggtcggatccctgggtttcgcaatcgagggaccatcccaagctaagatagaatataatgaccagaacgatggcagctgtgatgttaagtattggccaaaggagcctggcgagtacgcggtccacatcatgtgtgacgacgaggacattaaggatagtccatatatggcgtttatacatccagctaccggaggttacaatccagacctggtgagggcttatgggcccggcctcgaaaaatcagggtgtatcgtgaacaatctggcagagttcactgttgacccaaaagacgctggaaaagcacctttaaaaatcttcgctcaggacggcgaggggcagaggattgacattcagatgaagaacaggatggacgggacctatgcctgcagctatacaccagtaaaggctattaaacacaccatcgctgtagtgtggggaggcgtaaacatacctcacagcccctatcgggtaaacatcggacagggctcccatcctcagaaggtcaaggtgttcggaccgggcgtcgagagatctggcctgaaggctaatgagcctacccattttacggtggactgtaccgaggccggtgagggcgacgtgagtgtgggcataaagtgtgatgccagagtgctgtcagaggatgaggaggatgtggacttcgacattatccacaatgccaacgacacctttaccgttaaatatgtacctcctgccgccggacgatacacaatcaaagttctgttcgctagccaagaaattccagcatccccctttagagtaaaagtggacccaagtcatgacgcctcaaaagtcaaggctgagggacctggcctgagtaaagctggcgtcgagaatggaaagcccacccatttcaccgtttacacgaagggcgctggcaaagccccccttaatgtgcagttcaacagcccacttcccggagatgcagtcaaagacctggatataattgataactacgattattcacacacagtcaagtatactcctacgcagcaggggaatatgcaggttctggtcacttacggcggcgaccctattcccaagtccccattcactgtaggggtggctgccccgctggacctcagtaaaattaagctcaacggccttgaaaacagggtggaggttgggaaagaccaggagtttacagtggatactcgcggggccggcgggcagggcaaactcgacgtgactattctgagtccctcgcgcaaagtggttccttgcctagtgacccccgtgactggccgggaaaatagtacagctaagttcatccccagggaggagggcctttacgctgtggatgtgacatacgacggccacccagttcccggctccccttatacggttgaggcaagccttcctccagacccttcaaaggtgaaggcccacggccccggactggaggggggcctggtcggcaagcccgccgagtttacaattgacaccaaaggagccggcactggaggtttaggcctgacagtggagggtccctgcgaagccaagatagaatgttctgataatggggatggcacgtgctcagtctcctacttacccacaaagcccggagagtattttgtcaacatactgtttgaagaggtgcacattccaggctcacctttcaaagcggatattgagatgccattcgatccaagcaaggtggtggcctcgggccctggtctggagcatggtaaagttggtgaggcggggctcctgtcagtcgactgcagcgaagccggacctggcgcattgggactcgaagctgttagcgacagtggtacgaaggccgaagtcagcatccagaacaacaaagacggtacctacgcagtgacatatgtcccgctgacagccggaatgtacacacttacaatgaagtacggaggcgaactggtgccacacttcccagcaagggtcaaggtcgagcctgcggtcgatacatccaggatcaaagtgtttggaccgggaatcgagggcaaggatgtgttccgcgaggcaaccacagatttcaccgtcgatagcagacctttaacacaggtcggcggtgatcatataaaggcccacatcgctaatccttcaggcgcctccaccgagtgttttgttaccgacaatgctgacggcacctatcaggtggagtatacaccgtttgaaaaggggctccacgtggtggaagtgacctacgatgatgttcccattccaaatagcccatttaaagttgctgttacggagggatgccaaccttcaagagtacaggcccagggcccaggactgaaggaagcttttaccaacaagcccaacgtctttaccgtggttacccggggggctggtattggcggtctgggcatcaccgtcgaagggccatctgagtcaaagatcaactgccgcgataataaggatggatcttgctccgccgagtatattcccttcgcacccggtgattacgacgttaatattacctatggcggcgctcacattcctggaagtccctttcgcgttcccgtaaaggacgtcgtcgacccaagtaaggtcaagatcgcagggccaggcctgggatctggagtgcgggcaagggtgctccaatccttcaccgtcgattcctcaaaggcgggcctggcgcccctcgaagtccgcgtgctgggccccagggcggacgataccgacagccagtcttggagatcgcctctgaaggccctaagcgagttctttaagggtgaccccaagggggatttcaacaaaacaggcctggtcgaacccgtgaatgttgtggataatggcgacggaactcacaccgtgacatacactccatctcaggaggggccgtacatggtgagtgtcaaatacgccgacgaggaaatcccccgaagccctttcaaggtgaaagttctaccgacctatgatgcatcaaaagtgactgcctccggaccaggcttgagctcatatggtgtgcctgcttcactgcctgtggattttgctattgatgccagagatgctggcgagggcctgttggctgtgcaaatcacagatcaggaaggcaagcccaagcgcgctattgtgcatgacaataaggacggcacctacgccgtgacatacatcccggataagaccggaagatacatgataggcgttacatatgggggtgacgacatcccgctttctccttatagaattagggctactcagactggagacgcttctaaatgcttggctacgggacctggcatcgcatccaccgttaaaacaggcgaggaggtgggattcgtcgtcgacgcgaaaactgccggcaagggcaaagttacttgtaccgtgctcaccccagatggaaccgaggcagaggccgatgtcattgagaacgaagacggaacctacgatatcttctacacggctgccaaaccgggaacctatgtgatttacgtgaggtttgggggagtggacatcccaaatagtccgttcaccgtgatggccaccgatggggaggttaccgccgttgaggaagcaccagtgaatgcctgccctcctggttttaggccgtgggtcactgaggaggcctacgtccctgtctcagatatgaatggactgggctttaagcctttcgacctggtgatccccttcgccgtcaggaagggcgaaattactggagaagttcatatgcctagcggaaagaccgcaactcctgaaatcgttgataataaagacgggacggttacagtccgctacgctcctacggaggttgggctgcacgagatgcacataaagtacatgggaagccatatccccgagtctccacttcagttttatgtgaactaccccaacagcggatcagtaagcgcttatgggccaggcctggtctatggagtggccaacaagactgccactttcacaatcgtgaccgaagacgcaggtgagggtgggctagacctagccattgagggccccagcaaagctgagattagttgtattgacaacaaggatggcacttgtactgtgacatacctgcctacgttgcccggtgattactccatccttgtgaaatataatgacaagcatatcccgggctctccctttaccgctaagattaccgatgacagccgccgctgctctcaagttaagctgggctcagccgccgacttcctcctggatatctccgagactgatctgtcatccttaactgcctcaataaaggctccatccgggcgggacgagccatgtctgctcaagcgattacctaacaaccatattgggatctccttcatcccaagagaggtcggcgagcacttagtgagtataaagaagaacgggaaccacgtagcaaatagccctgtaagtatcatggttgttcagtctgagatcggcgatgcgaggcgggccaaggtgtacggtcgcgggttgtctgaagggcgcacattcgagatgtccgattttatcgtggatacccgcgacgcaggttatgggggtatttcactggcagtggagggaccaagtaaagtggacattcagaccgaagatttggaggatggaacctgtaaagtcagctatttcccaactgtgccaggcgtctacatcgtgagcacaaagttcgctgacgagcacgtacctggatccccctttaccgttaagatatccggtgaaggcagggtcaaggagtcaattaccaggacatcacgcgctcccagtgtggccactgtcggctccatatgtgacctgaatctaaaaatccccgagatcaatagcagcgacatgtccgcccacgtgaccagcccttccggacgggtcacagaggctgagatcgtcccgatgggcaagaacagtcactgtgttagatttgtgcctcaagagatgggcgtgcatacagtgagcgtgaagtataggggacagcacgtgacgggcagtccgttccagttcactgtaggcccactgggcgaggggggagcacataaagtgagggccggcggccctggcctggagcgaggagaggccggggtgccagcagagtttagcatttggaccagagaggcaggagctggcggactatctatcgcagtggagggaccgagcaaagccgaaatcacattcgatgaccataaaaatggaagctgcggagtatcatacatcgcgcaagagcctgggaactatgaggtctccatcaagttcaacgatgagcatataccagaatcaccttacttagttcctgttatagcaccaagtgatgacgctaggaggctcacggtgatgtcgctccaggagtccggacttaaagtaaatcagccagcctcctttgccataagactgaacggcgcaaagggaaaaatagacgctaaggttcactcccctagtggggcagtcgaggagtgtcacgtgagtgagctggaacccgataagtacgccgttcggttcatcccgcacgagaatggggtgcacacaatcgacgtcaagttcaatgggtcccacgtggtcggatctccttttaaggtgagagtgggagagccaggccaggccggcaacccggccctggtctctgcatatggcaccggactggaaggcggcacaacaggtattcagtcggaattctttataaacacaacaagggctggtccgggcacattatcggtgaccatcgaaggaccttccaaagtaaagatggattgccaggaaacgcccgagggttacaaggtcatgtacacacccatggctccagggaactaccttatctccgttaagtatggaggaccgaatcacatcgtgggtagcccttttaaggccaaggtgaccggccagagattggtatccccaggctctgccaatgaaacaagctcaatcctcgtggaaagcgtaactcgcagttccacagagacctgttacagcgcaatccccaaagcttctagcgacgcctccaaagtgaccagcaaaggcgcagggctcagtaaagcatttgtcggacagaaatcttcttttctcgtggactgcagcaaggccggatccaacatgctgctgataggcgtgcacgggcccaccacgccgtgcgaagaagttagcatgaagcacgtggggaatcagcagtataacgttacatatgtggttaaggagcggggagactacgtcctggcagtgaaatggggtgaggagcatatcccaggatctcctttccatgttactgtgccctag

SEQ ID NO: 187953 - DNA, 8178 bp, Artificial Sequence
  Description of Artificial Sequence: Synthetic coding sequence
atgatgaacaacagcggctacagcgacgccggcctgggcctgggcgacgagactgacgaaatgccatcaaccgagaaggacctagcggaagatgcaccatggaagaaaatccagcagaatacttttacccgctggtgcaatgaacacttgaaatgtgtgggaaagcggctgacagatctccaacgcgacttaagcgatggcctgcggctgatcgcgctgctagaggtcttgtctcagaagaggatgtataggaaattccaccctcgaccaaatttccgccagatgaaactggagaatgtgagcgttgcattggaattcctggaacgggagcacattaagcttgtctcaattgattccaaagctatcgtagatggaaacttaaagctgattttgggcctgatctggacactgatactccattactccataagcatgcctatgtgggaggatgaagacgatgaggacgctcggaagcagacaccaaagcaaaggttactgggatggattcagaataaagtgccccaacttcccatcaccaattttaacagagactggcaggacggcaaagccctgggggcactggtggacaactgtgcaccaggactgtgcccagactgggaagcctgggacccaaatcaacccgtggagaacgccagggaggccatgcagcaagctgacgactggctcggcgtcccgcaagtaatcgcgccagaagagattgtcgatccaaatgtggacgagcacagtgtgatgacttatctaagccagttccccaaggccaagctgaagccaggggccccagtccgatctaaacaactcaacccaaaaaaagcgatcgcgtatggtcccgggatcgaacctcaaggtaatactgtcttgcaaccagcccattttacggtccaaacagtcgatgcaggggtcggagaagtgcttgtgtacattgaagaccctgagggacacaccgaagaggccaaggtggtccccaacaatgacaaagaccgaacctacgcggtgtcctatgtgcccaaggtagccggcctgcacaaagtgacggtcctatttgccggccaaaacatcgagcgatcccctttcgaagtcaacgtgggtatggccctgggggatgcgaacaaagtttccgctcgaggccccggccttgagccagtgggtaatgtggcgaataagcctacctacttcgacatttataccgccggagccgggacaggcgatgtagccgttgttattgtcgatccacagggacgcagggatactgtcgaggtggcactggaggataaaggagatagtacattccgctgcacttacagacccgccatggaggggccacacacagtgcacgtcgcattcgcgggagcacctatcaccagatccccgtttccagtacatgtctctgaagcgtgtaatccaaacgcatgtcgggcttccgggcgcggactgcagcctaagggggtgcgcgtcaaagaggtggcagatttcaaggtcttcactaagggagccggaagcggcgagttgaaagttacagtgaaaggcccaaagggaaccgaagaacccgtgaaggtgagggaggcaggggatggcgtgtttgaatgcgaatattatccagtggtgcccggcaaatacgtggtgactatcacatggggcggctacgccatcccacgctcaccatttgaggtgcaggtatcccctgaggccggtgtacagaaggtacgtgcttggggaccggggctggagaccggacaggtgggcaagtccgccgattttgttgtcgaggctatcggcactgaggtaggtacactgggctttagtatagaaggtccgagccaggccaagatcgagtgcgacgataagggagatggctcctgcgacgtgcgttattggccaactgagcctggagagtatgctgtgcatgtgatctgtgacgacgaagatattcgggattcaccttttattgcccacatcctgcccgctccacctgattgttttccggataaagttaaggcatttgggcccgggctcgaacccacggggtgcatcgtcgataagccagctgagtttaccattgatgcgagagcagcgggcaagggggatctaaagctgtacgcccaggatgctgatggctgccccatcgatattaaggtgataccaaatggagacggtacctttcgatgcagctacgtgcctacgaaacccataaagcacaccatcatcatctcctggggaggagttaacgtgcctaagtctccattcagagtcaatgtgggcgagggatcccatcccgaacgcgttaaggtgtacggacccggtgtagaaaaaaccgggctgaaggccaacgagccaacatacttcactgtggattgttcagaggccggccaaggggatgtttctatcgggatcaagtgtgcccccggagtagtaggtccggccgaagccgatattgacttcgatattatcaaaaacgacaatgacactttcaccgtgaagtacaccccacctggggcaggcagatataccatcatggtgctgttcgctaaccaggaaattccagcctccccgttccacataaaagtcgatccatcccacgatgccagtaaggtgaaggccgaaggccccggcctgaatcgcactggggtcgaagtgggtaagccaacccacttcaccgtattaaccaagggtgctggcaaagccaaactcgatgtgcaattcgcgggaacagcaaaaggtgaagtagtcagggacttcgaaatcatcgataaccacgactattcctatacagtgaagtatactgccgtccaacagggcaatatggccgttaccgttacctatggcggcgaccctgttcctaagagtccttttgtcgttaacgtcgcacctcctctcgatttgagtaagatcaaagtgcagggactaaattcaaaggtggccgtggggcaggagcaggcattcagcgtcaacacaagaggtgccggaggacaaggacaactcgatgtgagaatgacgagcccttctagaagacctattccctgtaaactggaaccgggcggaggcgccgaagcccaggctgtcagatatatgccgcctgaagagggtccatataaggtggacataacctacgatggccatcccgtgcccggcagtccttttgctgtggagggcgttttacctcctgacccaagcaaggtgtgcgcctacgggcctggtctgaaaggcgggctggtcggaacacccgcaccgttctctattgatacaaagggtgcgggcactggcgggttagggcttacagtggaggggccgtgtgaagcgaagatcgagtgtcaggataatggtgatggcagctgtgcggtcagctatttgcccaccgagcctggggagtataccatcaatatcctttttgccgaggcgcatatacccggctctccattcaaggctacgattcgccctgtcttcgacccgtccaaggtgagggccagtgggcctggcctagagcgaggaaaggtcggggaggccgccacttttaccgtggattgctcagaggcaggcgaagcagaactgactattgaaattttgtccgatgccggggtgaaggctgaggtcctgatacacaacaacgccgacggcacgtatcacatcacatacagccccgcgtttccaggcacttatacaattacaatcaagtacggcgggcatcctgtccctaagtttcctacaagggtgcatgttcaaccagctgtagatacatccggggtgaaggtgagcggtcctggcgtcgaaccccacggagtgcttcgtgaagtgaccaccgagtttactgtggacgccagatctttaactgctaccggggggaaccacgtaaccgctagagtgctgaaccccagcggcgccaagacagatacctacgtcaccgacaatggggacgggacctaccgggtgcaatacaccgcctatgaagagggagtgcacctggtggaggtgctgtacgacgaggtggccgtgccaaagtccccgtttagggtaggcgtcaccgaggggtgtgatcctacacgcgtgagggcattcgggccaggacttgagggcggtctagtgaacaaagccaatagatttacagtggaaacgagaggcgctgggacaggggggctgggtctggccattgaaggtccttctgaagccaagatgtcctgcaaagataacaaggatggaagctgcactgtggaatatatacctttcactcccggtgattacgacgtgaatattacttttggcggacgccctatccccggctctccattccgggtgcctgtaaaggatgtcgtggaccccgggaaggtcaagtgttccggcccgggactgggtgcaggagttagagctcgggtgcctcaaacctttacagttgactgcagtcaggctggaagagcccctctccaggtagcagttcttggccctaccggagtggcagagccagtggaggtccgagacaacggcgacggaacccacaccgttcattatacacctgctacagacggtccatatacagtggctgtgaagtacgccgaccaggaggttcctcgcagccccttcaagatcaaggtactacctgcacacgacgcttcaaaggtacgtgcgtccggacccggtttgaatgcaagcggtatccccgccagcttacccgtggaatttaccatcgacgcccgtgacgccggggagggattgctcacagttcagattttggatcccgaaggaaagcccaagaaggccaatattagagataacggggatgggacgtacaccgttagctacttgcccgacatgtccggcagatatacgatcactataaagtatgggggcgatgaaatcccctactccccatttcgcatacatgccttgcccactggcgacgcctccaagtgcctagtgaccgtgagcatcggcggacacgggcttggagcatgccttggaccaagaattcaaatcggacaggagaccgtgatcactgtggacgcgaaagccgcaggggaaggcaaagtcacatgtaccgtgagtactcctgatggcgccgagctcgacgtggatgttgtggaaaatcacgatggcactttcgatatctattataccgcacctgaacccggaaaatacgtgattacgatccggtttggcggtgagcacatccccaacagtcctttccacgtcttggcatgtgatccgctccctcacgaagaagagccatctgaagtccctcaactaagacagccctacgcccctccaagacctggggccaggcccactcactgggcaaccgaagagcccgtggtgcccgttgagcctatggagtccatgctgagacctttcaacctggtgataccatttgccgtacaaaagggggagctgacaggcgaggtgagaatgccatcaggtaagacagcacgccctaatataacagacaataaggacggaacaatcacagtccgctacgctcctacggaaaaaggattacaccaaatgggtatcaaatacgatgggaaccatattcctggtagccctctacagttctacgtggatgctataaacagcaggcacgtttccgcctacgggccaggcctatcacacgggatggtcaacaagccagccacctttacaattgtaacaaaggacgcaggcgagggtggattgagcttagccgtagagggacctagcaaagctgagattacgtgtaaggacaataaggacggtacatgcacagtaagttatctgcccacagcccccggagattattccattattgtgcggtttgacgataagcatatcccgggcagtccatttactgccaagataacaggggacgattccatgaggacaagccaactgaatgttggaacaagcaccgatgtgagcttaaagataactgagtcagacctgagccaattaactgctagcatcagagctcctagcggcaacgaagagccatgtttgctgaaacggttaccaaaccgccacatcggcatctcgttcacacccaaggaggtaggcgaacatgttgtcagtgtgcggaagtcaggcaagcatgtgactaatagtccctttaagattctggttggcccctctgaaattggcgatgcctccaaagtgagagtgtgggggaaaggcctgagcgagggacatacgtttcaggtggccgagtttattgtggatacacggaatgcaggttacggaggactcggtttgtccatcgagggaccgagcaaggtggatatcaattgtgaggacatggaggacggcacctgcaaagtgacctactgcccaacagagccggggacttatattattaatataaagttcgcggataagcatgtgccaggttccccttttacagtgaaagtgaccggcgaaggcagaatgaaggagagcattactcggagacgtcaggctccttccatcgctacaattggatctacatgtgacctcaacctcaaaattcctgggaactggttccagatggtctccgcgcaggagcggttaacacgcacctttaccaggagcagccacacatatacccgaactgagagaactgaaatctcgaaaacacgcgggggagaaacgaaaagagaagtgcgggtagaagagtcaacacaggtggggggtgatccatttcctgccgtatttggagatttcctcggtagagagcggttaggaagttttggcagtattacacgtcagcaagagggtgaagcatcctcccaggacatgaccgctcaggttacctctccgtccggcaaagtggaggcagctgagatcgtcgagggggaagactcagcctattctgtgcggttcgttccacaagagatggggccacacacggtggcagttaaataccggggacagcatgttccgggcagtccctttcaattcaccgtggggcctctcggagagggtggcgctcataaggtgcgcgcaggcggcaccgggctggaacgtggagtcgccggcgtgcctgccgagttctcgatatggacacgagaagcgggcgcaggaggattatcaatagccgtggaaggccctagtaaggctgaaatcgcgtttgaggaccggaaggacgggagctgtggggtgtcctatgtggtgcaagagcctggggattatgaggtcagcatcaaattcaatgacgaacacataccagactccccattcgttgtgcctgtggcttctctgagtgatgacgcccgccgccttactgtcaccagtttgcaagagaccggcctgaaggtcaaccagccagcatcatttgcagtgcagctgaacggggcgcgcggagtcattgacgccagggtgcacaccccatccggcgccgtcgaagaatgttacgtgtctgagctggatagcgacaaacacacaatccggtttattcctcacgaaaacggtgtgcactccattgacgtcaagtttaatggagcacacatccctggttccccatttaagattagggtcggcgagcaatcacaggccggcgacccggggctagtatctgcttatggccccggactggagggcggcaccacaggggtcagcagtgagtttatagtgaatactctcaacgcaggcagtggtgcattatccgtaacgatcgacgggccttctaaagtacaactggactgcagggagtgcccagagggccatgttgtcacctatacacccatggctcctggcaattacctgatcgcgattaagtacggaggaccacagcatattgtgggatccccctttaaggctaaggtgacaggccctcggctgtcgggtggacattccctgcatgaaacttctacagtgctggtggaaaccgtcacaaagagctcttccagccgaggcagttcttactcctccatacccaagttctcttccgacgcatccaaggttgttaccaggggccccgggctcagccaggcctttgtgggccaaaaaaactcgttcactgtcgactgttccaaggccgggacaaacatgatgatggtaggagttcacgggcctaagacaccatgtgaagaggtgtatgttaagcatatgggcaaccgtgtgtataatgtgacctatacagtcaaagagaaaggtgactacatactcatcgtcaagtggggggacgaaagcgtccccggatcgccctttaaggtgaaggtcccgtag

SEQ ID NO: 187954 - DNA, 8079 bp, Artificial Sequence
  Description of Artificial Sequence: Synthetic coding sequence
atgatgaacaacagcggctacagcgacgccggcctgggcctgggcgacgagactgatgaaatgccttcaaccgagaaagatctcgccgaagacgccccatggaagaagatccaacagaatacatttaccaggtggtgcaacgagcacctcaaatgtgtggggaaacggctgacagatctccaacgcgacttgagtgatggcctccggctgatcgctctcctggaggtgttgtctcagaaaaggatgtaccggaagttccacccgcgtccaaacttccgccaaatgaagttagagaacgtctcagtggcactggagtttttggaacgcgagcatataaaactcgttagtatcgatagcaaggccatcgtcgacgggaatctcaagcttatcctgggtcttatttggactctcatcctccactattctatctcaatgcccatgtgggaggacgaagatgatgaggatgctagaaagcagactcccaaacaacgacttttaggatggatacagaacaaagtgcctcagctgcctataaccaatttcaatcgcgactggcaggacgggaaggccttgggtgccctcgtggataactgcgcaccgggactttgtcccgactgggaggcctgggatcctaaccagcctgtggaaaatgcccgggaagctatgcagcaggcagatgattggctgggcgtaccgcaagtcatcgcccccgaggaaatagttgatccaaacgtggatgaacattctgtcatgacctacctgtcgcaattccctaaagccaaactcaagccgggcgcccccgtcaggtcaaaacagttgaaccccaaaaaggccatcgcatatggcccgggcatagagcctcagggaaataccgttttgcagcccgctcatttcacggtccagacggtggacgctggagtcggagaagtgctcgtatacattgaagaccctgaaggccatacggaagaagccaaggttgtgcctaataacgataaggaccggacatatgctgtcagctatgtgcccaaggtggccggactgcacaaagtcaccgtgctgttcgccgggcaaaacattgaacgctctcccttcgaagtaaatgtcggcatggccttgggcgacgcaaataaagtttccgcccgcggccccggcctggagccggtgggcaatgttgcaaataagcccacttactttgatatctataccgcaggagctgggacaggcgatgtagccgtggtaattgtcgaccctcagggcaggcgagataccgtagaagtggctctcgaggataagggagattccacctttcgctgtacataccggccagctatggaaggcccccatactgttcacgttgcattcgccggagcacccatcacccgttccccctttccagtgcacgtgtctgaagcatgcaatcccaacgcttgtcgcgcttcggggaggggcctacagccaaagggtgtgcgtgtgaaagaggtggcagacttcaaagtttttaccaaaggcgctgggtcaggggagctgaaggtgacagtaaaagggccaaaagggacagaggagccagtaaaagttcgagaggcaggtgatggagtgtttgaatgcgaatattatccagttgttcccggaaaatatgtcgtcacaatcacatggggtggctacgccattcctagatctcctttcgaagttcaagtgtcccccgaagctggagtgcagaaggtaagggcttgggggcctggcctggaaaccggtcaggtgggtaaatcggctgacttcgtggtggaggcaattggaacagaggtgggcacactgggtttttctattgaaggaccctcacaggcgaagatcgagtgtgacgacaagggagacggctcctgcgacgtgagatactggcctacagaacccggtgaatacgcagtgcacgtcatatgtgatgacgaagatattcgcgattctcccttcatagctcacattctcccggcaccccctgattgtttccctgacaaggttaaggcctttggacccggacttgagccaaccggctgtattgtggataaaccggccgagtttaccatcgatgcgcgggccgctggcaaaggtgacctgaaactttatgcacaggacgctgatgggtgtcccatcgacatcaaagtcatccccaatggcgacggaaccttccgctgctcttacgtgccaaccaagcccatcaagcacactataataattagctggggcggggtcaatgttcctaagtcaccattcagggtgaatgtgggcgaagggtcccacccagagcgcgtgaaggtctacgggcccggggttgagaaaaccggcctgaaagccaatgagccgacttatttcacagtggattgttctgaggcaggacagggggacgtttccattggtatcaagtgcgccccgggcgtcgtcggcccagccgaagccgacatcgattttgatatcatcaagaacgataatgacaccttcaccgtaaagtacacgcctccgggcgctggacgttacactatcatggtattatttgccaatcaggaaatacctgctagcccattccatataaaagttgacccgagtcacgacgctagcaaggtcaaggcagagggtccaggcctgaataggactggggttgaggttgggaagcctactcatttcacagtgcttacaaaaggggcgggcaaagctaagctggacgttcagtttgctggtactgctaagggagaggtggtcagagacttcgagatcatcgataatcacgactattcttacactgttaagtacacagcagtgcagcaagggaacatggccgtgactgtgacttatggaggagacccagtccccaagtctcctttcgtagtgaacgtggctcctccattagacttgtccaagatcaaagtccaagggctgaattcgaaggttgcagtcgggcaggagcaggctttcagcgtcaataccaggggggctggcggccaagggcagctggatgtgcgtatgacctcccccagccgaagacccatcccatgtaagctcgagcccggtggaggggccgaagcacaggctgtgcgatatatgcctcccgaagaagggccttacaaggttgacattacgtacgatggtcatccagttcctggttccccatttgctgtggaaggggttctgccgcctgaccccagtaaggtgtgtgcctacggaccaggcctgaaaggcgggctggtcggtactcctgcccctttctcaatagacactaaaggcgccggaaccggtggtctgggactaactgtcgaaggcccctgtgaagctaaaatcgagtgtcaggacaacggggatggctcgtgtgccgtatcttatctgcccaccgaacccggtgaatacacgatcaacatactgttcgccgaggcacacatccctggcagtccattcaaagccacaatccgccctgtcttcgatcccagcaaagtcagggcttcaggccccgggctggaacgcggcaaggtaggcgaagccgccactttcacagttgactgctcagaagcgggagaggcagagctcacgatcgaaatcttatctgacgcaggggtaaaagctgaggtgcttatccataacaatgccgatggaacatatcatatcacctactcacccgccttcccaggcacatacacaataacaatcaaatacggaggacatcccgtgcccaagtttcccacgcgggttcatgtacagcccgccgtggataccagcggagtgaaagtgagcggtccaggcgtcgagcctcacggggtgctaagagaggttactactgaatttaccgtggacgctcggtctctgaccgccaccggtggcaaccacgtcacggcccgagtgctcaatccttccggagcgaagaccgatacgtatgtaacagacaatggcgatgggacctatagagtccagtacaccgcctatgaggaaggagtgcaccttgtcgaagtgctctatgacgaagttgcagtgccaaaaagccctttccgggttggcgtgactgaaggctgcgatccaacaagagtacgtgcgtttggccccggattagaggggggcttagtaaataaggctaatcgtttcaccgtggagacgcgcggtgccgggaccggcggtctgggactcgcaattgagggccctagtgaggctaaaatgagctgcaaagataataaggatgggagttgcaccgtggagtatattccctttacacccggtgactacgatgtaaatatcactttcgggggcaggcctattcctgggtcccctttccgcgtccctgttaaagacgtcgtcgaccccgggaaggtcaagtgcagcggccctggactcggagcgggcgtgagggcacgagtccctcagacatttaccgttgactgctctcaggccgggcgcgccccactgcaggtggcagtcctcggccccaccggggtcgcggagcccgttgaggtgagagacaatggtgatgggacacacacagtccattacacacctgccactgatgggccctataccgtagccgtgaaatacgcagaccaggaggtcccccgcagcccgtttaagataaaggtactgcccgcccatgacgcgagtaaggttcgggcaagcgggccagggttgaatgcaagtgggatccccgccagcttgcctgtagagtttaccatcgatgcccgagatgctggcgagggactactcacagtccagattttggaccccgaagggaagcccaagaaggcgaatattagagataatggggacggcacatatacggtcagctatctgcccgacatgagtgggcggtatacaatcacaatcaaatacggaggggatgaaatcccctactcacctttcaggatacacgctctgcctacaggcgacgcctctaaatgtcttgtgactgtaagtatcgggggtcacggattaggagcgtgtttaggaccaaggattcagatcggccaggagaccgtgattaccgtggacgcgaaggcagccggagaaggcaaagtcacttgtactgtctcaacgccggacggcgccgagctggatgtcgacgtcgttgagaaccacgatggaaccttcgatatatattacaccgcgccagaaccggggaagtatgtcatcactataaggtttggcggggagcacatccccaattccccgtttcacgtgcttgcaacagaggaaccagttgtgcccgtggaacccatggagtcaatgttacggccttttaatctagttataccctttgccgtgcagaagggagagctcaccggcgaggtacgcatgccaagcggcaagactgctagacccaatatcaccgacaacaaggacgggaccattactgtgagatatgcgccgactgaaaaaggcctccaccagatgggcatcaagtatgacgggaatcacattcccggcagtccactccagttctacgtggatgccatcaacagccgccatgtatctgcatacgggcccggactatcacacggcatggtgaataagccagctaccttcactatcgtgaccaaagatgctggggaaggaggactgagcctggcagtggaaggaccgtcaaaagccgagataacttgcaaggataataaagacgggacttgcacagtctcttatttacccacggccccaggggattattctatcattgtcagattcgacgataaacacattcccgggtctcctttcaccgcgaaaattactggtgacgacagtatgcgcacctcccaacttaacgttggtaccagcactgatgtgtcccttaaaatcacagaaagcgacctgtctcagcttacggctagcatccgggccccttccggaaatgaggaaccctgcttgctgaagagattgccaaaccgccacattgggataagcttcacccccaaggaggtaggcgagcacgtggtctctgtgcggaaatcaggtaagcatgtaactaattcaccctttaaaatcctcgtggggccaagtgaaatcggagacgcaagcaaggtgcgggtctggggcaaaggtctgagtgagggtcacacttttcaggtcgccgagttcatagtcgataccaggaatgcaggctacgggggattaggtctgtcaattgagggaccttctaaggtggatataaattgtgaagatatggaggatggtacttgtaaggtaacttattgccccaccgagccaggaacatatatcatcaacatcaagtttgccgataaacacgtcccagggtcgccttttacagtgaaggtgaccggcgaaggccggatgaaggagtctataacccgcaggcgtcaagcccccagcattgcaacaataggctcaacatgcgacctcaatctcaaaatccccggcaactggtttcagatggtgtctgcccaggaacgcctgactaggaccttcacccgttcttcccacacctacactagaacggagcgtactgagataagcaagacccgggggggagagaccaaacgcgaggtgagagtggaagagagcacacaagtgggtggtgaccctttccccgctgtttttggtgacttccttggaagggagcgcttgggctcgttcggcagcattaccagacagcaggaaggcgaagcgtcttcacaggacatgactgcgcaggttacgtcccctagtgggaaggtagaggctgctgaaatcgtggagggtgaggatagcgcatattcagtgcgctttgttccgcaggagatgggcccacacaccgttgccgtgaagtatagaggacaacacgttccagggagcccatttcagtttactgtgggccccctaggggagggtggcgcacataaagtccgcgctgggggtaccggtctggagagaggagttgcaggggtgcctgctgagttttcgatctggactcgcgaggcgggggctggtggcctatcaatagccgttgagggaccctccaaggctgagatcgcattcgaggacagaaaagatggctcctgtggggttagctacgtcgtgcaggaacccggtgactacgaagtgtccattaaattcaacgacgagcacattccggacagtccgttcgttgtgccggtggctagtctgtcagatgacgctcggcgcctcaccgtaacctctctgcaagaaacggggctgaaggtcaatcaacctgctagctttgcagtccagctgaatggagcaaggggggtgatcgatgctcgggttcataccccaagcggagcagtggaggaatgctatgtgtcagagctggatagcgacaaacataccattaggttcatacctcatgagaacggagttcactccatcgacgtgaaatttaacggggcacatatccccggctcccccttcaagatccgcgtcggtgaacagagtcaggctggagatcccggcctggtgtccgcctacggacccggtctggagggtgggactaccggggtaagcagtgagtttatcgtgaatacattgaacgccggctctggggccctttccgtcaccatcgatgggcctagcaaagtgcaactggactgccgcgaatgccctgagggacacgttgtcacctatacccctatggcaccagggaattatctgatcgcaatcaaatacggcggccctcagcatattgtggggagcccctttaaagccaaagtgacagggccgcgtctgtccggcggccattctctgcatgaaactagtacagttctggtggagacagtgaccaaatccagctcatcacgaggctccagctactcctcaatccctaaattttccagcgacgcatctaaagtcgtgaccaggggccccggactgtcccaggctttcgttggtcagaagaatagcttcaccgtagactgttcgaaagctgggactaatatgatgatggtgggagtgcatggtcctaagacaccctgtgaagaggtttacgtgaaacatatggggaatagggtctataacgtgacctatacggtgaaagagaaaggagattacattctcattgtcaaatggggtgatgaatccgtgccaggctcccccttcaaagtgaaggtcccatag

SEQ ID NO: 187955 - DNA, 264 bp, Artificial Sequence
  Description of Artificial Sequence: Synthetic coding sequence
atgcagctgttcgtgcgggcccaggagctgcacaccttcgaggtgaccggacaggaaaccgtggcccagattaaggcccatgtggcatctctggagggtatcgcgccggaagatcaggtggtccttctggctggtgctcccctcgaggacgaggcgacactgggccagtgtggggtggaggcccttacaacattggaggtcgcagggagaatgttaggagggggccagacgggggaggaggaagaggaagaccgcagcggttag

SEQ ID NO: 187956 - DNA, 228 bp, Artificial Sequence
  Description of Artificial Sequence: Synthetic coding sequence
atgcagctgttcgtgcgggcccaggagctgcacaccttcgaggtgacaggccaggagactgtggcccaaatcaaagcccacgtggcatcactggaaggtatcgcaccagaggaccaggtcgttttgctggcgggagcgccattagaagatgaagctactctgggccagtgtggagtggaggcactaacgacactggaagtcgctggccgcatgctcgggggcgagtag

SEQ ID NO: 187957 - DNA, 297 bp, Artificial Sequence
  Description of Artificial Sequence: Synthetic coding sequence
atgcagctgttcgtgcgggcccaggagctgcacaccttcgaggtgactggtcaggaaacagtggcacagatcaaagcgttgaccaccctggaggtagctggcagaatgctgggaggaaaagtgcacggatcccttgctagagctgggaaagtccgtggacagacccctaaggttgctaagcaggaaaagaaaaagaaaaagaccgggagagcgaaacgtagaatgcagtacaacaggcgcttcgttaacgtggtcccaactttcggcaagaaaaaggggcccaacgccaatagctag

SEQ ID NO: 187958 - DNA, 330 bp, Artificial Sequence
  Description of Artificial Sequence: Synthetic coding sequence
atgcagctgttcgtgcgggcccaggagctgcacaccttcgaggtgaccgggcaggaaacagtggcacagatcaaggcccacgtggcaagccttgagggcatcgccccagaagaccaagttgttctcctggccggtgccccactggaggatgaagccactttgggccagtgcggtgtcgaggctctgaccacactagaggttgcaggaagaatgctcggcggaaaagtgcacggctctctggcacgtgcggggaaggttagaggccagacccctaaagtcgccaagcaggaaaagaagaagaagaagaccggaagagccaagcgtcggtag

SEQ ID NO: 187959 - DNA, 402 bp, Artificial Sequence
  Description of Artificial Sequence: Synthetic coding sequence
atgcagctgttcgtgcgggcccaggagctgcacaccttcgaggtgacaggccaggagaccgtggcacagatcaaggcacacgtggcctctctggagggcattgcaccagaagatcaggtggtcctcctggccggcgcccctctggaggacgaggccaccctgggccagtgcggggtggaagccctgacgacactggaagtcgcaggccgaatgttgggaggtaaagtgcatggcagtctggctcgagcggggaaagtcagaggacaaacacccaaagtcgccaagcaagagaaaaagaaaaagaagactggacgagccaaacgtaggatgcagtataatcgaagattcgtcaacgtcgtacccacattcgggaagaagaaagggccaaacgcgaatagctag

SEQ ID NO: 187960 - DNA, 228 bp, Artificial Sequence
  Description of Artificial Sequence: Synthetic coding sequence
atgcagctgttcgtgcgggcccaggagctgcacaccttcgaggtgacagggcaggagaccgttgctcagattaaggctcacgtggccagccttgaaggaattgcccccgaagaccaggttgtccttctggccggcgcccccttggaagatgaagctaccctggggcagtgcggcgtggaggccctgacaactctggaagtcgcaggtagaatgctgggcggtgaatag

SEQ ID NO: 187961 - DNA, 402 bp, Artificial Sequence
  Description of Artificial Sequence: Synthetic coding sequence
atgcagctgttcgtgcgggcccaggagctgcacaccttcgaggtgactggccaggaaaccgtagcacaaatcaaagcccacgtagcctcactcgaaggcatagcacctgaggaccaagtcgtgctgctggctggcgctccactggaagacgaggccactctgggacagtgcggtgtagaagctttaacgaccttggaggtggccggtcggatgctgggaggaaaggtgcatggcagtctagccagggctggaaaggttagaggccaaaccccaaaggttgccaagcaggagaagaagaagaagaagactggaagagccaagcggcgaatgcaatacaacaggcggtttgtcaatgtggtcccaacctttgggaagaagaagggcccaaacgcgaactcttag

SEQ ID NO: 187962 - DNA, 402 bp, Artificial Sequence
  Description of Artificial Sequence: Synthetic coding sequence
atgcagctgttcgtgcgggcccaggagctgcacaccttcgaggtgactgggcaggaaaccgttgcacagattaaagcacatgtagcatccctggagggtattgcacctgaggaccaggtggttctgctggcgggggcccccctggaagatgaggcaacccttgggcaatgcggtgtggaggccttaaccacactcgaagttgctggccggatgttgggaggaaaggtgcacggaagtctggcgagagcagggaaggtgcgcggccaaacacctaaagtcgcaaagcaagaaaagaaaaagaaaaagacaggccgggcgaaacggagaatgcagtacaatcggcgttttgtgaacgtagtccccacattcggaaagaagaaagggcccaacgcaaatagttag

SEQ ID NO: 187963 - DNA, 1563 bp, Artificial Sequence
  Description of Artificial Sequence: Synthetic coding sequence
atgagcgccggcgaggtggagcggctggtgagcgagctgagcggcggcacaggtggcgatgaagaggaagagtggctgtacggggatgaaaacgaagtggaaagacctgaagaggaaaacgccagtgcaaaccccccctcagggatagaagacgaaacagccgagaatggagtgcccaaacctaaagtaacagagacggaggatgacagcgattccgatagcgacgatgatgaggacgatgtgcacgtaaccatcggcgatattaagacgggagcacctcagtacggatcttatggcacagcacctgtgaacctgaacataaagaccggggggcgcgtttacggtaccacgggtaccaaggttaaaggagtggacctggatgcccctggatcgatcaacggcgtgccactgttggaagtggatctcgattcattcgaagacaagccttggcgcaaacccggcgcagacctatctgattacttcaactatggcttcaacgaagacacctggaaggcctattgcgagaaacagaaaagaattcggatgggcctggaggtcatccccgtgacttctacaactaacaagataacagtccagcagggacgtaccggtaactcagagaaagaaaccgctcttccgagcactaaagccgagttcacatcaccaccaagcctatttaaaacaggcttacccccgagcagacgactcccaggagccatcgacgtcattggacagacaataaccatttcccgggtggaggggcggcgtcgagcaaacgagaattctaacatacaagtactgagcgaaaggtccgcaacggaggtggacaacaacttcagcaagccaccccctttcttccccccaggcgcccctcctactcacctgcctccgccaccctttctacctcctccacctacagtgtccactgccccacctctgatcccccccccagggttccctccaccgccaggagctccccctccctcactgattcccacgatcgaatcagggcactcatcaggatacgatagtagaagcgcgcgcgccttcccatatggaaatgttgcttttcctcaccttcccggtagtgccccatcctggccgagtctggtggacacatcaaagcagtgggattattatgcacgtcgggaaaaggaccgagaccgtgaacgggacagagaccgtgaacgtgatcgggaccgggaccgagagcgggagcgaacgcgcgaacgggagagagaaagagaccacagtcccaccccttccgtgttcaacagtgatgaggaacgctataggtacagagaatacgccgagcgcggttatgagaggcatcgtgccagtcgggagaaggaagaacggcacagagagaggcggcatcgtgagaaggaggagaccagacataaaagttcaagaagtaattctcgcaggcggcacgagtccgaggagggcgacagtcaccggcgtcacaagcacaaaaagtcaaagcgctctaaggaggggaaagaggccggctccgagccagctcccgagcaggagtctacggaagccacgccggctgaatag

SEQ ID NO: 187964 - DNA, 1785 bp, Artificial Sequence
  Description of Artificial Sequence: Synthetic coding sequence
atgagcgccggcgaggtggagcggctggtgagcgagctgagcggcggtactggtggcgacgaggaggaggagtggctgtatggcggaccatgggatgtgcatgtccactccgacctggctaaagatctggatgaaaacgaagtcgaacggccagaagaggagaatgcttccgccaatcctcccagtgggattgaagacgagacagccgagaatggcgtcccgaaaccgaaagtgactgagaccgaggatgatagcgactcagactccgatgatgacgaggatgatgttcacgtcactatcggcgacatcaaaactggggccccccaatatggctcctacggaactgctccagttaatctgaacatcaaaacgggtggccgcgtgtacggtaccacgggaacaaaagtgaagggggtcgacctggacgcacccggcagcataaacggtgtccccctgctggaagtggacttagattcatttgaggataagccttggcgaaagcccggcgcagatctatccgattattttaattatgggttcaatgaagacacctggaaagcttactgcgagaagcagaagcgaattcggatggggctcgaagtgatccccgtgacatccacaacgaacaagattactgcagaggattgcactatggaggttacccctggcgccgagattcaggatgggcgcttcaacctgtttaaggtgcaacagggtcggaccggaaactcagagaaagagactgcactcccttccacaaaggccgaatttacatcaccaccgtccctgttcaagacggggctgcccccttcaagaaattcgacaagcagccaaagccagacaagcaccgccagcagaaaggctaatagctccgtggggaagtggcaggaccggtacggcagagccgagtcccccgatctcaggaggctgcctggtgcaatcgatgttatcggccagacaattactatttctagagttgaaggaaggagaagagccaacgaaaattctaacatacaagtgttatctgaacggagcgccacagaagttgacaataactttagcaaaccacctcctttttttccacccggggccccgcccacccatctaccccccccccctttcctgccgccaccaccgaccgtgtctactgccccaccacttattccacctcccggctttccccccccccccggcgcaccccctccaagcctcataccaacaatcgagtccggacactcctccggatacgattcccggagcgctcgggcgttcccttatggcaatgttgctttccctcatctgccaggttcagcaccctcttggccaagcttggtggacaccagtaagcagtgggattactatgctaggcgcgagaaagatcgcgaccgggagagggacagggatcgcgagagagaccgagaccgcgaccgcgaacgggagcggacaagggaaagggagagggaacgcgatcactccccgaccccttctgtctttaattctgacgaagagcgctacagatatagagagtatgctgagcgggggtatgaaagacaccgtgcctcaagggagaaagaggagcgacaccgggagaggcggcatcgggagaaggaagagacccggcacaagtcctcaagatcaaacagcagacggcggcatgaatccgaagagggtgattctcaccgccggcacaaacataagaaatctaaaagatccaaagagggcaaagaggccggcagcgaaccagcccctgaacaggagagcactgaggctactcccgccgagtag

SEQ ID NO: 187965 - DNA, 1767 bp, Artificial Sequence
  Description of Artificial Sequence: Synthetic coding sequence
atgagcgccggcgaggtggagcggctggtgagcgagctgagcggcggtactggcggcgatgaggaagaggagtggctgtacggggacgaaaatgaggtcgagcgtcctgaggaggagaacgcttccgccaatccaccatcaggtatcgaagacgagacagcggagaacggcgtgcccaaaccaaaggtgacggaaaccgaggacgacagcgactctgactcagacgatgacgaggatgatgtgcacgtcaccatcggtgatatcaagacaggcgccccgcagtatggcagttatggcaccgcacctgttaatctgaatattaaaaccggagggcgtgtgtacggcactaccggaaccaaagtgaagggagtggacctcgatgcccctgggtctatcaacggggttccgctgttggaagtggacctcgactctttcgaggataagccctggcgcaagcccggcgccgatttgtccgattatttcaattacggctttaacgaagacacatggaaggcctattgtgagaaacaaaagcggatcaggatggggctggaagtgattccagtcacctccaccacaaataagattacagctgaggactgcaccatggaagtcacacctggggctgagatccaggatggacggtttaatctctttaaagtgcaacagggcagaaccggaaattccgagaaagaaactgcactgcccagcaccaaggccgaattcacctcccccccatctctcttcaagaccggactgccaccaagtagaaactccacctcatctcaatctcaaacgtcaaccgccagtagaaaggccaactcctccgtggggaaatggcaggacaggtatggtcgagcagagtcccccgacctccggcggctgccgggggccatcgacgtaataggacagactatcacaatttcccgcgtggaggggcgtcgtagggccaatgaaaactcaaacatccaagtcttgagcgagagatccgctactgaagttgataataatttttccaagcccccacctttctttccccccggtgcgccccccacccatctgccacccccaccatttttgcctccccctcccactgtctccaccgcaccacccctgatcccacccccaggaatccctatcacagtacccccccctggtttccctccaccacccggcgcccctcctccctccctcataccgacaattgagtctggccactcttcagggtacgattcccgttccgccagggcctttccttatggtaacgtagcctttccccacctacccggcagtgctccgagctggccctccttggtcgatacctctaaacaatgggattattatgcccgacgggaaaaagatagggacagggagcgggatcgcgacagagagcgcgacagagatagggaccgcgagcgagagcgcacacgcgaacgggaacgggagagggatcacagtcctacacccagtgtattcaacagtgacgaggagcggtacagatatagagagtacgctgaaagaggttacgagcgccacagagcgagtagggagaaagaggagcgccaccgtgaaaggcgacaccgggaaaaggaggagacccggcataagtcgtcacgcagcaatagccgccggagacacgagagcgaggaaggggacagccatcgtcggcataagcacaagaagtctaaaagatctaaagagggcaaggaagccggcagcgaaccagctccagaacaggaatcgacagaggctacacctgccgaatag

SEQ ID NO: 187966 - DNA, 366 bp, Artificial Sequence
  Description of Artificial Sequence: Synthetic coding sequence
atggtggacatgatggacctgccccggagccggatcaacgccggcatgctggcccagtttatagacaagcccgtctgctttgtcggacggttagaaaaaattcacccgacaggtaagatgtttattctgtccgacggcgaggggaaaaatggcacgatagagcttatggaacctctggacgaagaaatcagtggaatcgtagaggtcgtgggacgtgtgacagctaaggctacaatcctgtgtaccagctacgttcagttcaaagaagattctcacccctttgacctgggcctgtataacgaagccgtgaaaattattcacgacttccctcagttttacccgctgggcatcgtgcagcatgattag

SEQ ID NO: 187967 - DNA, 1413 bp, Artificial Sequence
  Description of Artificial Sequence: Synthetic coding sequence
atgttccccgccggcccccccagccacagcctgctgcggctgcccctgctgcagctgctgctcctggtggttcaggcagtgggccgagggctgggccgagcatcaccagctggcggacccctcgaagacgttgttatagagcgctatcatattcctcgtgcctgtccaagggaggtacaaatgggcgacttcgttcgctaccattacaacggcacattcgaagatgggaagaagttcgattcctcttacgacagaaatacattggtggctatcgtcgtcggagtgggcaggctgataaccggcatggaccgcgggttgatggggatgtgtgttaacgagaggaggagactcattgtgcccccacacctggggtatggttccattggcttggcaggcctaatccctccagacgctaccctctattttgatgttgttctgctggatgtatggaataaagaggatactgtgcaggtcagtactctgctgcgccctccccattgcccccgaatggtgcaggacggagattttgtgagatatcactataacggcacgctacttgacgggacctcattcgatacgagctactcaaggaaccacacatacaatacatacatcggtcagggctacatcattcctgggatggaccaaggcctacaaggcgcatgcatgggtgaaagaagacggatcacaattccacctcatttggcttacggggaaaatgggaccggggataagatacccgggagcgctgttcttattttcaacgttcatgtgatcgatttccataaccctgctgacgtggtggaaattaggaccctgtctagaccgagtgaaacatgtaatgagaccacaaaactaggagatttcgtgcgttaccactacaactgttccctattggatggaactcagctgtttacaagccacgattacggggccccgcaggaggccaccctcggtgccaataaggtgattgagggcttagacactgggcttcaggggatgtgtgtaggcgagaggaggcaacttatcgtgcctccgcacctcgcccacggcgaatctggggcacggggggtgccggggtcagccgtgttgttgttcgaggtggagcttgtaagccgcgaggatggcctccctacgggctatctgttcgtctggcataaggacccgccggccaatctgttcgaggacatggacctaaacaaagatggggaagttccacctgaggaattctccacttttatcaaggcacaggttagcgaaggcaagggcagactcatgcctggccaggatccggagaagacgatcggcgacatgttccaaaatcaggataggaaccaggatggcaagattaccgtggacgaactgaaactcaagagtgatgaggacgaagaacgggtccacgaggaactatag

SEQ ID NO: 187968 - DNA, 1749 bp, Artificial Sequence
  Description of Artificial Sequence: Synthetic coding sequence
atgttccccgccggcccccccagccacagcctgctgcggctgccccttcttcagttgcttcttctagtcgtgcaggctgtgggcaggggactgggccgcgccagtccagcaggcggacccttggaggatgtggtgatagagaggtaccatattccccgcgcctgtccccgggaggtacagatgggagatttcgtgcgttatcactataatggcacattcgaggacggcaagaaattcgactcctcctatgataggaatactctcgtggctattgtagtgggagtgggtcggctaataacggggatggacagggggctaatgggtatgtgcgtcaacgagcgcaggcggctgatcgtgcccccccacctaggatacgggagtatcggattggcggggctgatcccccctgatgctacactctattttgacgtcgtgctgctggacgtttggaacaaggaagatacagtacaggtctccactctcttgcgccctcctcattgccctcgcatggtccaggatggcgactttgtcagatatcactataacggtactttgctggatggaacgtcttttgacacttcctacagcaagggagggacttatgatacgtatgtgggatcagggtggctgatcaaggggatggatcaggggctgctgggcatgtgtcctggggaacggagaaagattatcatccctccctttctggcgtacggcgagaaaggctatggaactgtgatccctccccaggcttctctggtgttccatgtactgctgatcgacgtgcacaacccgaaggatgctgtccagttggaaaccctcgagttaccgccgggatgcgttcgacgggcaggtgccggagactttatgagataccattataacggctccttgatggacggcaccttatttgattcttcgtacagcaggaaccacacctacaatacctacatcggtcagggatacatcatcccagggatggatcagggtttacagggcgcatgcatgggggaacggcggaggattaccattcctcctcatttggcctacggagaaaatggaaccggtgataagatacccggctcagcagttcttatttttaacgtccacgtaattgatttccataaccctgctgatgtcgtcgaaattcgtaccctctcccggcctagtgaaacgtgtaacgaaaccacaaaactcggagacttcgtacggtatcactacaactgcagtttactggatggcacccagttgttcacttcccacgactacggtgcaccccaggaggcaacacttggagccaataaggtgatagaaggcctggatacaggcttacagggaatgtgcgtgggggagcgccgccagctgatcgtgcccccccaccttgcacatggcgaatcaggggcacgcggcgtgccagggtctgcagttctgttatttgaagttgaacttgtatccagggaagatgggttacccacagggtacctgttcgtatggcacaaggatccccccgccaacttgtttgaggacatggacttaaacaaagacggcgaggtccccccagaggaattctccacctttattaaagcgcaagtgtccgagggaaagggaaggctcatgccagggcaggaccccgaaaaaacaataggggatatgtttcagaatcaggaccgcaaccaggatggtaagattacagtggacgaactaaaactgaagtcagatgaggatgaggagcgtgtgcacgaggaattatag

SEQ ID NO: 187969 - DNA, 1629 bp, Artificial Sequence
  Description of Artificial Sequence: Synthetic coding sequence
atgttccccgccggcccccccagccacagcctgctgcggctgcccctcttacagttgttactgttagtcgtgcaagccgtcggacgcggattgggaagggcctccccggccggaggaccgttggaagacgtggtgattgagaggtatcacataccaagagcatgccccagggaggtccaaatgggagactttgtaagataccactacaacggcacttttgaagatggaaagaagttcgactctagctacgataggaacactctcgttgcaatcgtggtcggtgtcggcaggctgatcacgggcatggataggggtttaatgggtatgtgtgtgaatgagcgaagacgtctcattgttccacctcacctaggttacggatcgattggcctggccggactgatcccacccgatgctactctttacttcgatgttgtgcttctcgatgtttggaacaaagaagataccgtgcaggtttcaaccctactgcgaccaccccactgtccaagaatggtgcaggacggagacttcgttcggtatcattacaacggaaccctgcttgatgggacctcgttcgacacttcgtactccaagggtgggacctacgacacctacgtaggctcgggatggctgattaagggcatggatcagggattgctgggtatgtgccctggagagcggcggaaaatcatcattccaccctttctcgcttacggggagaaaggctacggcaccgtcattcctccgcaggctagtcttgtcttccacgtccttctaatcgatgtacataaccctaaggacgccgtccaactggaaacactggaactaccacctggctgtgtgcggagagctggggcaggagacttcatgagataccattacaacggttctctgatggacggtaccctcttcgactcttcctactctcgcaaccacacatacaatacatacattgggcagggctacattatcccaggaatggaccagggactgcagggcgcgtgtatgggggagcggagaagaattaccataccccctcatcttgcctatggggagaacggtactggcgataagattcccggatcagccgtgctgatattcaacgtccatgtcatagacttccataacccagccgatgtcgtcgaaatcagaaccctaagccgcccgtcggaaacgtgtaatgagaccactaaattgggagacttcgtgcgataccattacaattgcagtttgcttgacggcacccagttatttaccagtcatgactacggagcaccccaggaggctactttaggagctaacaaagtgattgagggactcgatacgggcctgcagggaatgtgtgtgggcgagcgccgtcaactgattgtgcctccccatctcgcacacggcgaatccggggcccgtggcgttcccggctccgccgtgcttctcttcgaagtggagctggtgagcagagaggatgggctgcccactggatatctcttcgtttggcacaaggacccgccagccaacttgttcgaggacatggatctcaataaagatggtgaggtccccccagaagagtttagcacttttattaaggcccaagtatcagaaggcaaaggcccccacgcttgggcggggccttag

SEQ ID NO: 187970 - DNA, 246 bp, Artificial Sequence
  Description of Artificial Sequence: Synthetic coding sequence
atgggcgacttcgtgcggtaccactacaacggcaccttcgaggacggaaagaagtttgacagctcttacgatcggaatactctggtggccatcgtggtgggggtggggagactgattacaggcatggacaggggcttgatgggaatgtgcgttaacgaacgccgcagactcattgtgccaccccacctggggtacggatccatcgggctggcgggcctgatccctcccgacgcaaccctgtactag

SEQ ID NO: 187971 - DNA, 1161 bp, Artificial Sequence
  Description of Artificial Sequence: Synthetic coding sequence
tgaatcgacgtgcacaaccccaaggacgccgtgcagctggagaccctcgagttgccacccggctgcgttcggagagctggggccggcgatttcatgcggtaccactataacggttccttgatggatggcacactgttcgactcttcctattcacggaaccatacctacaacacatacattggccaaggctatattatcccgggcatggatcaggggttgcagggggcatgtatgggcgaacgtcgacgaattaccatcccaccacacctggcctatggtgaaaacggtacagattctatcggctttcttcagggatctgccccacttagaccattccgctctggagagggacaaccatctcttgggagagaagggggttacggcaagacagaacccgcctaccctcaagacccagcagtcttgggcgctagcgtctcatctcctgtgaagtgggcctcccacgccgatccacagggtgataagattcctggcagtgcggtacttatttttaatgtccacgtgatcgactttcataacccagctgatgtagtcgaaattcggaccttgtcacggccatccgagacatgtaacgagaccaccaagctgggtgatttcgtgcgttaccactacaattgcagtttgttggacggcacccagctctttacttcccacgattatggtgctccacaggaggcaacgttaggggcgaataaggtgatcgagggcctcgacacagggctgcagggcatgtgtgtcggtgaacggcggcagttgatcgtgcccccccacctcgcgcacggcgaaagcggtgcccgcggggttcccggatccgctgttctgctcttcgaagtggaactcgtcagccgcgaagacgggctcccaaccggttatctgtttgtctggcacaaggatccacccgctaatttgtttgaggacatggacctgaataaggacggcgaagttccacccgaagaattcagcacttttataaaggcacaggtgagcgagggaaaaggaaggctgatgcccggacaggaccccgaaaagaccatcggtgatatgtttcaaaaccaggaccgcaatcaggacggcaagattactgtcgacgaactgaagctgaaaagtgacgaggatgaggagagagtccacgaggagctctag

SEQ ID NO: 187972 - DNA, 1068 bp, Artificial Sequence
  Description of Artificial Sequence: Synthetic coding sequence
atgcggtaccactacaacggcagcctgatggacggcaccctgttcgactcctcttactcccggaaccacacttacaacacatacatcggacaaggctacattatcccaggcatggaccaaggactgcaaggcgcgtgtatgggcgagagaaggagaatcacaatcccaccccacctcgcatacggcgagaatgggactgatagcatcggcttcttgcaagggagcgcacctctgagaccatttcgatcaggagagggccaaccaagcctgggccgcgagggggggtatggcaaaactgagcccgcttatccacaggatcctgctgtgctgggagcatcagtcagtagtcctgtcaaatgggccagtcacgccgaccctcagggcgacaagatccccgggagcgcagtgcttatttttaatgtccatgtaattgattttcacaatcctgccgacgttgtggaaattaggactctctcaagaccaagcgaaacttgtaacgaaaccaccaagctaggggatttcgtccggtaccattacaactgttctcttttggatggaactcagctcttcactagtcacgactatggagctcctcaggaggctaccctaggtgccaataaagtgatagaagggttagacacgggcctgcagggcatgtgcgtgggggagcgacggcagctgatcgtgccacctcacctggcccatggggagtccggagcgaggggggtcccagggtcagccgtactcctgttcgaagtcgagctggtgagccgtgaagacgggctgcccacaggctatctctttgtgtggcacaaggacccacctgccaacctttttgaagatatggatcttaataaagacggggaagtcccaccagaagagttttctacatttattaaggctcaggtttccgagggtaagggtcggctgatgcctgggcaggaccctgagaaaaccataggagatatgtttcagaatcaggacaggaatcaagacggaaagatcactgtagacgagctcaaactgaaatcagatgaagatgaagagcgcgtgcacgaggagctctag

SEQ ID NO: 187973 - DNA, 327 bp, Artificial Sequence
  Description of Artificial Sequence: Synthetic coding sequence
atgggcgtggagatcgagaccatcagccccggcgacggccggacctttcccaaaaaagggcagacttgtgtcgtacactatactggcatgctgcagaatggtaagaaatttgattcctcacgagatcggaacaaaccgttcaaatttcgcataggaaagcaagaggtcatcaagggcttcgaagagggcgccgcccagatgtccctcgggcaacgcgctaagctgacttgcacccccgacgtagcctacggggcgacaggtcatcccggtgtcatcccccccaacgcaactcttatcttcgatgtagagctgcttaacctcgaatag

SEQ ID NO: 187974 - DNA, 243 bp, Artificial Sequence
  Description of Artificial Sequence: Synthetic coding sequence
atgggcgtggagatcgagaccatcagccccggcgacggccggacctttcctaagaagggccagacatgcgtggtgcactataccggaatgctgcagaatgggaaaaaatttgacagcagccgggatcgtaacaaacccttcaaattccgcattggcaaacaggaggtcattaagggcttcgaggaaggcgcagcccagctaggaccattgtctcccctcccaatttgtccccacccatgctag

SEQ ID NO: 187975 - DNA, 429 bp, Artificial Sequence
  Description of Artificial Sequence: Synthetic coding sequence
atgcggctgagctggttccgggtgctgaccgtgctgagcatctgcctgtccgcagtcgcaactgcaaccggagccgagggaaagagaaagttgcaaatcggagttaaaaagcgggttgaccactgtcccataaagagccggaagggggacgtcctccacatgcactacaccggcaagctcgaagatggcaccgagtttgattcgtctttaccccaaaaccagcccttcgtgttttccttgggcactggccaggtcatcaaaggatgggatcagggccttttaggcatgtgcgaaggcgagaaaagaaaactggtaatcccaagcgagcttggatacggagaacgcggtgctcctcctaaaatcccaggcggggctactctggtcttcgaggtggaactgctgaagatcgaacggagaactgagctctag

SEQ ID NO: 187976 - DNA, 429 bp, Artificial Sequence
  Description of Artificial Sequence: Synthetic coding sequence
atgcggctgagctggttccgggtgctgaccgtgctgagcatctgcctgtcagctgtagcgacggccactggcgctgagggcaaaaggaagctgcagatcggtgtcaagaagcgggtggatcattgtccaattaagtctagaaaaggcgatgtgctgcacatgcactacactggcaagctggaagatggaacagagttcgactccagcctgccacagaaccaacccttcgttttctctctcgggactggccaggtcatcaaaggatgggaccaggggcttttggggatgtgcgagggagaaaagcggaagctggtgatccctagcgagctcggctatggcgaaaggggggcaccacccaagataccaggaggcgccacacttgtgtttgaagttgaactactgaagattgaaagaagaaccgagctgtag

SEQ ID NO: 187977 - DNA, 429 bp, Artificial Sequence
  Description of Artificial Sequence: Synthetic coding sequence
atgcggctgagctggttccgggtgctgaccgtgctgagcatctgcttgagcgccgttgctacagctacaggcgccgagggaaaacgtaaattgcaaattggcgtgaaaaagagggtggaccattgtccaatcaaaagccgcaagggcgatgtgctgcatatgcactacactggaaagttggaagatggtactgaatttgactcttccttgccacagaaccagcctttcgtttttagtctcggcaccggccaggttattaagggttgggaccagggcttactcggaatgtgcgaaggagagaagaggaaactggttatccctagtgaactgggatacggtgaacggggtgctccccctaaaatcccgggaggggccactttggtgtttgaggtagaacttttgaagatcgagaggaggacggaactgtag

SEQ ID NO: 187978 - DNA, 309 bp, Artificial Sequence
  Description of Artificial Sequence: Synthetic coding sequence
atgcggctgagctggttccgggtgctgaccgtgctgagcatctgcttgtctgcagttgctaccgcgacaggcgcggaagggaagagaaagctccagatcggcgtgaagaaaagagtcgaccactgccctattaagtccaggaaaggagacgtgcttcatatgcattatacaggaaaactcgaagatgggacagagttcgactctagcctgccccagaaccagcccttcgtgttttccctgggtacaggccaggttattaaaggatgggaccagggactgctggggatgtgcgaaggagaaaagcgctag

SEQ ID NO: 187979 - DNA, 3144 bp, Artificial Sequence
  Description of Artificial Sequence: Synthetic coding sequence
atggccgtgaccctggacaaggacgcctactaccggcgggtgaagcgcctgtattccaattggaggaaaggtgaggacgagtacgccaacgtggatgccatagtggtgtccgttggggtggacgaggagatcgtctatgcgaagtcaaccgccctacagacatggctgtttggctatgaactcaccgacacaattatggtgttttgtgatgataaaatcatcttcatggcctccaagaaaaaagttgaatttctgaaacaaatcgcaaataccaagggcaacgaaaacgccaatggcgctcctgccattacgcttctcatacgtgagaaaaacgagagtaataagagctccttcgacaaaatgatcgaggcaatcaaggaatccaaaaacggcaagaagattggcgttttctcaaaagacaaattcccgggtgagttcatgaaaagttggaacgactgtctgaataaagagggattcgataagatcgacatctccgcagtggttgcctatacaatagctgtgaaggaagacggtgaactgaacttgatgaagaaagcagcaagcataacatcagaagttttcaacaaattttttaaggaacgcgtgatggaaatagtggacgcggacgagaaggtccggcattccaagttggccgaaagcgtggaaaaagctattgaggaaaagaagtaccttgctggagcagacccatctactgttgagatgtgttaccctcccattatccagtctggtggaaattataatctgaagttctctgtcgtttccgataagaatcacatgcattttggtgccattacctgcgcaatgggcattaggttcaaatcttactgttcgaacctggtgcggacactcatggtggacccctcacaggaagtacaagagaattacaactttctcctccagctccaagaggagcttctcaaagaactgaggcacggggtgaagatctgtgatgtatacaacgctgtgatggacgtagtgaaaaagcagaaaccagaacttctcaacaagattaccaagaacttgggcttcggtatggggatcgaatttcgcgaaggatcattggtgatcaatagcaagaaccaatacaaattaaaaaaaggtatggtattctctattaatctgggcttttctgatctcaccaataaggaagggaaaaaacccgaagaaaaaacgtatgccttgttcatcggtgataccgttcttgtcgacgaagacgggccggcaacggtgttaacatccgtgaagaagaaagtaaaaaacgtcggcatattcttaaagaatgaggacgaggaggaggaggaggaagagaaggacgaagccgaagacctgctcgggaggggatcccgtgctgcattattgacagaaagaaccaggaacgaaatgacggccgaggagaagcgccgcgcgcaccagaaagagttagccgctcagctcaacgaggaagccaagaggcgattaacagaacagaagggggagcagcagatccagaaggccagaaagtccaatgtatcttataagaatccctcactgatgcccaaggaaccccatatccgagaaatgaagatttacattgacaaaaaatatgagactgtcatcatgcctgtgttcggaatcgctaccccgtttcatatagctacaattaaaaatatcagcatgtctgttgagggtgattatacatatctccgcatcaatttttactgtcctgggagcgccctcggtcggaatgagggcaatatcttccctaaccccgaggcgaccttcgtcaaggaaatcacatatcgcgcctctaatatcaaggcacctggagaacagactgtacccgctctgaacttacaaaacgccttccggatcatcaaggaggtgcagaagaggtacaagacgagagaggcagaggagaaggagaaggaaggcatcgtgaagcaggatagccttgttatcaacctgaatagaagcaatcccaagctgaaagatctgtatatcaggccaaatatcgcgcagaagagaatgcagggttcattggaagcccatgttaatggattccgctttacttccgttcggggcgataaagtggacatattgtacaataacataaagcacgcactgtttcagccttgtgatggtgagatgatcattgtcctacatttccatctaaagaacgctattatgttcggaaaaaagcgtcatacagacgtgcagttctacacggaggtcggcgagatcaccaccgacttgggaaaacatcagcatatgcacgacagggacgacctgtatgcagagcaaatggagagggagatgaggcacaagttaaagaccgcctttaaaaattttattgagaaagtggaggcccttacaaaggaggaacttgaattcgaagtaccatttcgcgatcttggctttaatggggcaccttaccggtcaacttgcctgctgcaacctacttcatcagctctagtgaacgccacagagtggcctccctttgtagttacgctcgacgaggtggaactgatccattttgagcgagtccagttccatttgaaaaatttcgacatggtgatcgtatataaagattactccaagaaggtaacaatgatcaatgctatcccagttgcctctttggacccaatcaaagaatggcttaactcctgtgatcttaaatataccgagggcgtgcaatcattgaattggaccaagatcatgaagacgatcgtagacgatcccgaaggtttttttgaacagggtggatggtcctttctggagcccgagggcgagggttctgacgctgaggaaggcgactcagaatccgagatcgaagacgagactttcaatccttctgaagatgactatgaggaggaagaagaagatagcgacgaagattacagttccgaggctgaggagtccgattatagcaaagagtcattggggtccgaagaagagtccggcaaagattgggacgagttagaagaggaagcacgcaaagctgatcgcgaaagtcgctacgaggaagaggaagaacagagccgcagcatgtcccggaaacggaaggcttctgttcattcctccggacgagggtcaaaccgtggctcccggcattcgagtgctccacctaagaaaaagaggaaatag

SEQ ID NO: 187980 - DNA, 675 bp, Artificial Sequence
  Description of Artificial Sequence: Synthetic coding sequence
atggccgccgccgtgccccagcgggcctggaccgtggagcagctgcgctctgaacagcttcctaagaaagatattatcaaatttctgcaagagcatggatccgacagtttcttagcagagcacaagctgctgggaaacatcaagaacgtcgccaagacggctaataaagatcacctggtgactgcctataatcacctgtttgaaaccaagcggtttaagggcaccgagagcatctctaaagtgtcagagcaggttaagaatgttaaactgaatgaggataagccgaaggagactaagagcgaggagacgctcgacgaggggccacccaaatacaccaaatcagtcctgaaaaaaggcgacaagactaacttccctaagaagggcgacgtggtgcattgttggtacacaggcactcttcaggatggaaccgtttttgacactaacatccagacttctgcaaaaaagaaaaagaacgcgaaacctctttcctttaaggtcggtgtggggaaggttattcggggatgggatgaagcgctgctgactatgtctaagggggaaaaagcccggctggaaatcgaacctgagtgggcctatggcaagaagggccagccagatgcaaaaataccccccaacgctaaattgacatttgaagtggaattggtggatatcgactag

SEQ ID NO: 187981 - DNA, 1374 bp, Artificial Sequence
  Description of Artificial Sequence: Synthetic coding sequence
atgaccaccgacgagggcgccaagaacaacgaggagagccccaccgcaacagtggcagagcagggggaggacataacttccaaaaaggataggggcgtcctgaaaattgttaagcgcgtggggaatggggaagaaacccccatgataggggacaaggtatacgtccactataagggaaaactgtcaaacggaaagaagttcgattcttcccatgatagaaacgagccattcgtattctctctgggaaagggacaggtgataaaagcctgggacattggggtggcaacaatgaaaaaaggcgagatttgccatctgctctgcaagcccgaatatgcctatggcagcgcaggtagcctcccaaagataccatccaacgcgacactcttctttgaaattgaattactggactttaagggtgaagacctgtttgaggatgggggtatcatccgccggactaaacgcaagggggaagggtatagcaatcctaacgaaggtgcaaccgtggagatacatctagagggacggtgcggaggccgcatgttcgactgccgcgacgtggcattcacagttggtgagggggaggatcacgatatcccaatcggaatcgataaggctctggagaagatgcagcgagaagaacagtgtatcttatacctcggaccccgctacggcttcggggaggccggaaaacccaagttcgggattgagccgaacgctgaactaatttatgaggtcaccctgaagagctttgaaaaagctaaggaaagttgggagatggatactaaagaaaagctggagcaggccgccatcgtgaaagagaaggggaccgtttattttaaaggtggtaagtatatgcaggccgtaatccagtatgggaagatcgtgagctggctcgaaatggaatatggcctgtccgaaaaggaatcgaaggcaagcgagagctttctgctggccgccttcctgaatctggccatgtgctacctgaaactgcgcgaatacactaaggccgttgagtgctgcgacaaggccctggggctggacagcgcgaacgagaagggactgtacagacgaggcgaggcacagcttctcatgaacgaattcgaatcagctaaaggcgattttgagaaggtgttggaggtcaacccgcaaaacaaggcggctcggctgcagatatccatgtgccagaagaaagctaaagaacacaatgagcgtgacaggaggatctatgccaacatgtttaagaaatttgccgaacaggacgccaaagaagaagcgaataaagctatgggaaagaaaacatccgagggcgttaccaacgagaaaggaactgattcccaggcgatggaggaggaaaaaccagaagggcacgtctag

SEQ ID NO: 187982 - DNA, 1374 bp, Artificial Sequence
  Description of Artificial Sequence: Synthetic coding sequence
atgaccaccgacgagggcgccaagaacaacgaggagagccccaccgccacagtcgcggagcagggtgaagacatcactagcaagaaagaccggggcgtacttaagattgtcaagagagtggggaatggtgaggaaacacccatgatcggagacaaagtgtacgttcactacaaggggaaactgtccaacggcaagaagtttgatagttctcacgatagaaatgagcctttcgttttctccctggggaaaggacaggtgatcaaagcatgggacatcggagtagcaacaatgaagaagggcgaaatttgccacctgctctgtaaaccagagtacgcttatggcagcgctggttcactgcccaagatcccaagtaacgcgacattattttttgaaatcgaattactcgattttaagggcgaagatctattcgaggacggggggattatccgaagaacaaagaggaaaggggaagggtattctaaccctaatgagggagcaacggttgaaatccatctggagggccgttgcggtggaaggatgttcgactgccgcgatgtcgcattcacagtgggagaaggggaggatcatgatattcccattggtattgataaggcacttgagaaaatgcaacgagaggagcagtgtattctctatctgggccctagatacgggttcggtgaggctggcaaaccgaaatttggaatagaacccaatgctgaactgatctacgaagttaccctcaagtccttcgaaaaggcaaaagagagctgggaaatggatacaaaggaaaaactcgaacaggcagccatcgtcaaggaaaagggcaccgtttattttaaggggggcaagtacatgcaagctgtgatccagtatggcaaaatcgtcagctggcttgagatggaatacggcctgtcagaaaaagagagtaaagcatccgagtccttcttgctcgctgccttcctgaatctcgcgatgtgttatctcaaactccgtgaatatacaaaagcagtggagtgttgtgacaaagctctgggcctggattctgcgaacgaaaaagggctctaccgtaggggggaagcccagttgctcatgaatgagtttgagtccgccaagggcgactttgagaaggtattggaggtgaacccccagaacaaggccgcacgcctgcagatttccatgtgccagaaaaaagcaaaggaacataacgagcgcgaccggcggatttacgctaacatgtttaagaagttcgcagaacaggatgctaaggaggaagctaataaggcgatgggcaagaagacctcagagggagtaaccaacgagaaggggacggattcccaggcaatggaggaggagaagccagagggccacgtgtag

SEQ ID NO: 187983 - DNA, 801 bp, Artificial Sequence
  Description of Artificial Sequence: Synthetic coding sequence
ctgctgatgaaggtgccccggaccatgaagaaggccccccagcccctgctgctatcacgagagcggattctccctcccaaggaccgtggggtcctgaagatagtaaagcgcgtgggtaatggagaggaaacccctatgatcggcgacaaggtgtatgtgcattacaagggcaaactgtctaacggaaaaaagttcgattctagccatgacaggaatgagcctttcgtgttttccctggggaaaggacaggtgattaaagcgtgggacattggggttgcgaccatgaagaagggagagatctgccatttactttgcaagccagagtatgcttatggatccgctgggagcttacctaagatcccctcaaacgcaaccttgtttttcgaaatcgagctactcgacttcaagggggaggatctcttcgaagacggcggaattattcgccgcactaaaaggaaaggtgagggatacagtaaccccaatgagggggcaaccgtggagatccatctggagggtaggtgcggtggacggatgttcgattgcagggacgtggccttcacagtaggcgagggtgaggaccatgacataccgatcggcatcgacaaagcgctggaaaagatgcagcgggaagagcagtgtattctgtatttgggtccccggccgaagaatccaggacgctggattcccaaaaaaaattggagccgtttaccgttaagtaaaagaagggaaccttataccagtcgctgcgtgtccccatacgccattctgagtattagcaaaaatcttttcaagtgctggtag

SEQ ID NO: 187984 - DNA, 1374 bp, Artificial Sequence
  Description of Artificial Sequence: Synthetic coding sequence
atgaccaccgacgagggcgccaagaacaacgaggagagccccaccgctaccgtggctgagcagggggaggatattacgtcaaagaaggatcggggggtgttgaaaatcgttaagcgggtcggcaacggggaagagacccccatgattggtgacaaggtctacgtccactacaaaggcaaactttccaacggcaaaaaattcgacagctcccacgaccgtaatgagccctttgttttcagtctcggcaaaggccaggtaatcaaggcgtgggacatcggcgtggccacaatgaagaaaggagaaatttgtcatcttctctgcaaaccagaatatgcgtacggatctgctgggtctctgcccaagatcccatctaatgccacacttttctttgagatcgagctgcttgacttcaagggagaagacttgttcgaagacggggggattatcaggaggacaaagagaaaaggcgagggctatagcaatcctaatgagggagcaactgtcgagatacacttagaaggtaggtgtgggggacgcatgttcgactgccgcgacgtggccttcaccgttggcgaaggggaggatcatgatattccaatcgggatagacaaggcacttgaaaagatgcagagagaagagcaatgtattttatatctcggaccacgatacggatttggtgaagccggcaagcctaagttcggcatcgaacctaatgcggaattgatctacgaagtgactcttaaatcgtttgaaaaagctaaagaaagctgggagatggacactaaagaaaaactagaacaagcagcaatcgttaaagagaaaggaactgtgtactttaaaggtggcaagtacatgcaggcagtgattcagtacggcaagattgtgagctggctcgaaatggaatacgggctgtctgaaaaggaatccaaggcgagcgaatccttcttgctggcagcctttctgaatctagcaatgtgctacctgaagttaagagagtacacaaaggcggtggagtgctgcgataaggctctagggctcgatagcgccaatgaaaagggactgtacagaaggggtgaggcccaattacttatgaacgaatttgagagcgccaagggagactttgagaaagtgttggaggtgaatcctcagaataaagccgcgagactgcagatcagtatgtgtcagaaaaaggccaaagagcacaacgagagggataggaggatttatgcaaacatgttcaagaagttcgccgagcaggacgccaaggaggaagcaaataaagcaatggggaagaagacaagcgaaggcgtcacgaacgaaaagggcactgactcccaggccatggaagaggagaagccagagggtcacgtttag

SEQ ID NO: 187985 - DNA, 1374 bp, Artificial Sequence
  Description of Artificial Sequence: Synthetic coding sequence
atgaccaccgacgagggcgccaagaacaacgaggagagccccaccgcaaccgtggccgaacagggcgaggacattacttctaagaaagatcggggcgtgctaaagatcgttaaacgagtgggcaacggcgaggagacacccatgattggcgacaaggtctatgtacactacaaggggaaactgtccaatggcaagaagtttgactcttctcatgacaggaacgagcctttcgtgttctctctcggaaagggacaggttattaaggcgtgggatattggcgtggctacgatgaagaaaggggaaatctgtcacctactctgcaaaccggaatacgcttatgggtcagccgggtcactccctaaaatcccctcaaacgccacgttgttttttgagatcgaactgctcgacttcaagggagaggacctatttgaagatggcggaatcatccgccgaactaaacggaaaggcgaggggtatagcaatcccaacgagggcgcaaccgtggagattcacctcgagggaaggtgcggcggtagaatgttcgactgtcgggatgtggcctttacggtaggggaaggcgaggaccacgacatcccaatagggattgacaaggcactggagaagatgcagagggaagagcagtgcatcctatatctcggacctcggtacggtttcggcgaggcgggtaagccaaaattcggcattgaaccgaacgcggaattaatatacgaggtgaccctcaaaagctttgaaaaagcgaaggagtcttgggagatggatacaaaggagaaactggagcaagccgctattgtgaaagagaaaggcaccgtctacttcaagggaggtaaatatatgcaggctgtgattcagtacggcaaaattgtatcatggctagagatggagtacggcctgagcgagaaggagagcaaggcttccgagtcttttttgttagccgctttcctgaacctggctatgtgttacctaaaactccgagaatataccaaagcagtggagtgttgcgacaaagctctcggcctggacagtgcaaacgagaaaggcctttacaggcgcggtgaggctcagctgcttatgaatgagtttgaatcagcaaagggagactttgaaaaggtgcttgaggttaatccgcaaaacaaggctgctcgattgcagatttctatgtgtcagaagaaagctaaagaacacaatgagcgagatcgtaggatctatgcaaacatgtttaagaagtttgctgagcaagatgcaaaagaagaagcaaacaaagcaatggggaaaaaaacctccgagggggtcaccaatgaaaaaggtacagacagccaggccatggaagaggaaaagcctgaaggtcatgtgtag

SEQ ID NO: 187986 - DNA, 837 bp, Artificial Sequence
  Description of Artificial Sequence: Synthetic coding sequence
atgttcgactgccgggacgtggccttcaccgtgggcgagggcgaggaccacgatatcccgatcggtatcgataaggcgctggaaaaaatgcaaagggaggagcaatgtatcctctacctcggccctcggtacggcttcggcgaggcaggaaaaccaaaattcggaatcgaaccaaatgccgagctcatctacgaggtgaccctcaaaagcttcgaaaaggctaaggagtcatgggagatggacacaaaggaaaagcttgagcaggctgcgatcgttaaggagaagggcaccgtgtattttaaaggaggcaaatatatgcaggccgttatccaatacgggaaaattgtttcctggctggaaatggaatatggcctgtccgagaaggaatcgaaagcctccgagtcttttttactagctgctttcttgaatttggctatgtgctacttgaaacttcgggaatacacgaaggccgtagaatgctgtgacaaagccctggggcttgattcagcaaacgagaaagggctttaccgaagaggggaggcacagctgttgatgaacgaattcgaatcggcgaagggtgatttcgagaaagtgcttgaggttaacccacagaacaaggccgcacgcctgcagatctcaatgtgccagaaaaaggccaaggaacacaacgaacgtgaccgccgaatttacgctaacatgttcaaaaaatttgccgaacaggacgcgaaggaggaggccaacaaggctatggggaaaaaaaccagcgaaggcgtgaccaacgaaaagggcacagatagccaagccatggaggaggagaaacctgaaggccacgtgtag

SEQ ID NO: 187987 - DNA, 807 bp, Artificial Sequence
  Description of Artificial Sequence: Synthetic coding sequence
atgaccaccgacgagggcgccaagaacaacgaggagagccccaccgcgactgttgctgaacagggggaagatatcaccagcaagaaagaccgcggtgtcctcaaaatcgtgaaaagagtcggtaacggagaggagacacccatgattggcgataaggtgtatgtccactacaaaggtaagctgtcaaatggaaagaagtttgattcctcacacgataggaacgagccctttgttttttctttgggaaagggacaggtgattaaagcatgggatataggggtggccacaatgaagaagggtgagatctgccacctgctgtgtaaaccggagtacgcgtatggaagcgcaggatccctccctaagattccaagcaacgcaacattattctttgaaatcgagcttctggacttcaaaggcgaggacctgtttgaggacggcgggatcatcaggagaacaaagaggaaaggggaaggctatagcaaccccaacgaaggtgcgacggtcgagatacatcttgaggggcgatgcggaggacggatgtttgattgtagggatgttgcattcaccgtgggggagggagaagatcacgatatccccatcgggatcgataaggctctcgagaagatgcaacgggaggagcagtgtatcctgtatctggggccccgccccaaaaacccagggcgctggattcccaagaagaactggtctcgcctcccactgagcaagaggcgggaaccatatacatcaaggtgtgtgtctccatacgcaattctgtccattagcaagaacctcttcaaatgctggtag

SEQ ID NO: 187988 - DNA, 1263 bp, Artificial Sequence
  Description of Artificial Sequence: Synthetic coding sequence
atgaccaccgagcagggcgaggagacccccatgatcggcgacaaggtgtatgtccattataaaggcaagctgagtaacggaaagaaattcgacagttcccacgatagaaatgagccttttgttttttccctggggaagggtcaggtgatcaaggcctgggacatcggagtggccacaatgaagaagggcgaaatctgccacctactctgcaaacctgaatacgcttatggtagtgctggtagcttaccaaagattccatccaatgcaaccctgttctttgaaattgaattgctggatttcaaaggggaagatttgtttgaggatggcgggataatccgacgaactaaaagaaagggcgaaggctattccaaccccaatgagggggcgaccgttgaaattcacttggaggggcgctgcggtggcaggatgtttgactgtcgagacgtagccttcactgtgggagaaggtgaggaccacgacatacccataggcatagacaaagctcttgaaaagatgcagagggaggaacaatgcatcctgtacttgggcccacgctatggtttcggcgaggccggcaagcccaagtttggcatcgagccaaacgccgaattgatttatgaagtcaccctcaagagcttcgaaaaagcaaaggaaagttgggagatggacaccaaggaaaaactggagcaggccgccatcgtcaaggaaaaaggtacagtgtacttcaaaggaggcaagtacatgcaggctgtaatccagtacggcaaaattgtgagttggctcgagatggagtatggcctgtccgagaaagaaagcaaggcatccgaatcatttctgctggcagcttttttgaatctggcaatgtgctacctcaagttgagagaatacaccaaggctgtcgaatgttgtgacaaggccctgggcttggatagtgcaaatgagaaggggctctatagaaggggcgaagctcagcttcttatgaacgagtttgagagcgctaagggtgattttgaaaaggtccttgaggtcaatccccagaacaaagccgccaggttgcagatttcaatgtgccagaaaaaagctaaagagcacaatgagagggatagacgaatctacgcgaatatgtttaaaaaatttgcggaacaagatgctaaggaagaggccaacaaagctatgggaaagaaaaccagcgagggcgtcacaaatgaaaaggggacagacagccaggcaatggaggaagagaagccagaaggccatgtgtag

SEQ ID NO: 187989 - DNA, 984 bp, Artificial Sequence
  Description of Artificial Sequence: Synthetic coding sequence
atgggcggcagcgccctgaaccagggcgtgctggagggcgacgacgcacctggacaatcgctttacgaacggctgagccagagaatgcttgacatcagtggtgatagaggcgtcttaaaggacgtcatcagggagggcgcaggcgatctcgtggctccagacgcttcagttttggtcaagtatagcggatatttggagcatatggatcggccttttgattcaaactacttccgcaaaacaccccggttaatgaagctgggggaagatattaccctgtggggaatggagttaggtttgctgagcatgcgtcgaggcgaactcgctcgctttttattcaagccgaactacgcatacggcaccctgggatgcccccccctgattccccccaacaccactgtcctgtttgaaatagaactgcttgacttcctggattgtgccgagagtgataaattttgcgcccttagcgctgagcagcaggaccaattccctctgcagaaggtgctgaaagtggccgccaccgaacgtgaattcgggaactatctctttaggcagaaccgcttttatgacgccaaagtccgctacaaaagagccctgctactgctacgcaggagatctgccccgccagaggaacagcacctggtagaggccgccaagctgcccgttcttctgaatctgtctttcacgtatctgaaactcgacaggcccactattgcactctgctacggcgaacaggcactgataattgatcaaaaaaatgcaaaagccctcttcagatgtggccaagcatgcctgttacttaccgaatatcagaaagcaagggactttctggtcagggctcagaaagagcagccctttaaccatgatattaataatgaactcaagaagctggcaagttgctaccgtgactatgtagataaggagaaggagatgtggcatcggatgtttgctccctgcggtgatggaagtaccgcgggtgagtcctag

SEQ ID NO: 187990 - DNA, 969 bp, Artificial Sequence
  Description of Artificial Sequence: Synthetic coding sequence
atgagcgccagcagctggccccagaacggcatgccccccagcagcctttatgagcggttatcacagagaatgttggatatttccggagatagaggagttttgaaagacgtgattcgggagggggccggggacctggttgctccagacgcctccgttctggttaaatacagcgggtatttggaacacatggatcgacccttcgacagcaactacttccgcaagacccctagactgatgaagctcggggaagacattacgctctgggggatggagctgggactgctttcaatgagacgaggagaactagctagattcctgttcaagccaaactacgcctacggaaccttgggttgtccaccactgatcccccctaatacgaccgtgttattcgaaatcgagctgctagatttcttagactgcgccgaaagtgataaattctgcgctttgagcgcagaacagcaagaccagtttccgctgcagaaggtgttgaaggtcgcagccacagagcgcgagttcgggaactatctttttagacagaataggttttacgatgctaaagtccgctacaaacgcgcgctgttactactgcggagacggagcgcgccgcctgaagaacaacacctggtggaggcagcgaaactgcccgtgctcctgaatctgtcctttacctacctgaagttggatcggcccactattgcgctttgttacggcgagcaggctttgattattgaccagaaaaacgctaaggcactgtttaggtgtggtcaggcttgcctgcttctgacggagtatcagaaggcaagagattttcttgttcgcgcccaaaaagagcagcctttcaaccacgacatcaataacgagctgaagaaactggcttcatgttaccgagactacgttgacaaagaaaaagagatgtggcatcggatgtttgcaccctgcggcgatggcagcacagcgggcgaatcctag

SEQ ID NO: 187991 - DNA, 531 bp, Artificial Sequence
  Description of Artificial Sequence: Synthetic coding sequence
atggacctgcccgacagcgccagccgggtgttctgcggccggatcctcagtatggtgaacacagacgacgttaatgccatcatcctagcacagaaaaatatgcttgaccgctttgagaagacgaatgagatgctgctcaactttaacaatttatctagcgctcggcttcagcagatgagtgagcgctttctccaccacaccagaactctcgtcgaaatgaagcgcgatctggactccatatttcgaagaattagaactttaaaaggtaagctggctcgccagcacccagaagcgttctcacatatcccggaagcgtcattcttagaggaggaggatgaagatccgatacctccttccacaaccacgacgatcgccacatcagaacagtccacaggctcctgtgacacgtcacctgataccgtgtctccctccctctctccagggtttgaggacctgtctcacgttcagccaggttcgcctgccatcaatggaaggtctcagactgacgatgaagagatgactggggaatag

SEQ ID NO: 187992 - DNA, 1326 bp, Artificial Sequence
  Description of Artificial Sequence: Synthetic coding sequence
atgggcgtgggcgccggccgggtgagccagagcggcgcccccagcccggggggagctgggcgggccaacagttgccccccaagctcaatggcatcatgcgcagaacccagcgagcccagcgccccactgccagccggtgtgccccctctggaggactttgaagtattggacggcgttgaagacgccgaaggcgaagaagaagaagaggaagaagaggaagaagaggatgatctctccgagttgcccccactggaagacatgggccagcccccggccgaagaggccgagcagcccggggctctggccagagagttccttgctgctatggagcccgaacccgctccagccccggctcctgaggaatggctggacattctcggcaacggcctgttgaggaagaaaactctcgtgccaggacctcccgggtcatctagaccagttaaggggcaggtggtaactgttcatctacaaacgtcactggagaacggcacccgggtgcaagaggaaccagagctggtgtttacacttggtgattgcgacgttatccaggctctggatctgtccgttcccctcatggacgtgggagagactgccatggtgaccgcagattccaaatattgctatggcccacaggggagaagtccttacattcccccacatgctgccctgtgtctagaagttaccctgaagaccgccgtcgacgggcccgaccttgagatgctgactgggcaggagcgcgtcgctttggctaatcggaagcgcgaatgcggcaatgcccattaccagcgcgcagatttcgtgctggcagcgaattcgtacgacctcgccataaaggcaattaccagttcagcaaaggttgatatgaccttcgaggaagaagcccagttactgcagctgaaggtgaagtgtcttaataacctcgctgcatcacagctgaagctggatcactacagggctgcactgagatcctgctccttggtgttagaacatcagccagacaatatcaaggctctctttcgcaaggggaaagtgttggcccagcagggtgaatatagcgaagctatcccaatcctccgggccgcactcaaattggagccatcaaacaagacaattcacgccgaactgtccaaattggtgaagaaacacgccgcccagagatctacagagaccgctctgtatcggaagatgctgggcaacccatcacggttgcctgccaagtgtcctggcaaaggggcctggtccattccttggaagtggctgttcggggccactgcggtcgctttaggaggagtcgccctgtctgtggtgatcgctgcacgcaattag

SEQ ID NO: 187993 - DNA, 762 bp, Artificial Sequence
  Description of Artificial Sequence: Synthetic coding sequence
atggccagctgcgccgagcccagcgagcccagcgcccccctgcccgcaggagtgcccccgctcgaggattttgaggtactcgacggtgttgaagatgccgagggcgaagaggaagaagaagaagaggaggaggaagaggacgatttatccgaactccctcccctggaagacatgggccaaccccccgccgaggaagcagagcagccgggtgcgcttgctagggaattcctcgccgccatggagccagagcctgcccctgctccagctccggaggaatggctagatatcctggtcgacatgacctttgaggaagaagctcagttactccagttgaaggtcaagtgtctgaacaatcttgcggctagtcagctaaagctagaccattatagggccgccctccggagttgttcactggtcctggagcaccagcccgataacatcaaggccctctttcgaaaggggaaagtgctggcacagcagggagaatattcagaggcgataccaatacttcgcgctgcccttaagcttgagccttccaacaaaacaatccatgccgagctgtccaaacttgtgaaaaagcacgctgcccagagaagtaccgaaaccgcgctgtaccgaaagatgctggggaacccttcaaggctaccagccaagtgccctgggaaaggagcgtggagcataccctggaaatggctgtttggtgctacagccgttgcactgggcggcgtggctctgtccgtcgtgatagcagccagaaattag

SEQ ID NO: 187994 - DNA, 1599 bp, Artificial Sequence
  Description of Artificial Sequence: Synthetic coding sequence
atggccaagcgggtggccatcgtgggcgccggcgtgagcggcctggcttctatcaaatgctgtttagaagagggcttggagccaacgtgctttgagaggagcgatgacctggggggactgtggcggttcacagagcatgtggaggaaggtcgcgcaagcctgtataaaagcgtcgtatccaattcttgtaaagagatgtcctgttatagtgacttcccattccccgaagactatccgaattacgtgcctaacagccagttcctagaatatttaaaaatgtacgccaatcatttcgacctgcttaaacatatccagtttaaaaccaaagtgtgctccgtgaccaaatgttccgacagcgccgtgagtggccaatgggaggtggtgacaatgcacgaagagaagcaggagagcgcgatttttgatgctgtgatggtctgtacagggttcctgaccaacccctatttgcctctggatagctttcccggcatcaatgccttcaaaggacagtactttcacagtagacagtacaaacatcctgacattttcaaagacaagagagtcctggttattggtatgggcaatagtgggactgatatagccgtagaggctagccatctggccgaaaaagtctttttaagtaccacgggtggagggtgggtcattagccgcattttcgactcaggctatccatgggatatggtgttcatgacgcggttccagaacatgttacgcaattccctgcccacaccaatcgtgacgtggcttatggagagaaaaattaataattggttaaaccatgctaactacggactcatccccgaagataggacgcagcttaaggagttcgtattaaacgatgaacttccggggcgtataatcaccgggaaggtgttcatcagaccttcaataaaggaagttaaggagaattctgtcatctttaacaacacttctaaggaggagcctattgacatcatcgtgtttgctaccggatataccttcgcattcccattcctggacgagtcagtagttaaggtggaagacggccaggcaagtctgtataaatacatctttccggctcaccttcagaaacctaccctggcaatcattggactgattaaacctctcggcagcatgattccgaccggcgagacccaggctcgctgggcggttcgtgtgttgaaaggcgtgaataagttacccccaccatccgtgatgatcgaggagatcaatgctcgcaaggagaacaagccatcatggtttggattgtgttattgcaaggctctgcagtcagactatatcacctacatcgacgaactgcttacttatattaacgccaagcctaatttgtttagcatgttgctgacagatccccacttggcccttacagtgttcttcgggccctgctcaccttaccagttcaggctcaccgggccagggaagtgggagggtgccagaaacgccatcatgacccagtgggatagaacctttaaggtaataaaagcccgggtagtacaagagtcacctagccctttcgagtctttcctaaaagtgttctcatttctggcactactcgttgctattttcctgattttcctgtag

SEQ ID NO: 187995 - DNA, 1599 bp, Artificial Sequence
  Description of Artificial Sequence: Synthetic coding sequence
atggccaagcgggtggccatcgtgggcgccggcgtgagcggcctggccagtatcaagtgttgtcttgaggagggactggaaccgacctgtttcgaaaggtctgatgacctaggcggtttgtggaggtttaccgagcacgttgaggagggcagggcgtccttatacaagtctgtcgtatctaattcatgtaaggagatgagttgttatagcgattttccattccctgaggattatccaaattacgtgcccaattcacaatttctggagtatttaaaaatgtacgcaaaccattttgacctcctcaagcacatacaattcaagacgaaggtgtgttccgttaccaaatgtagcgacagcgccgttagcgggcagtgggaggtggtgaccatgcatgaagaaaagcaagaatctgcgatctttgatgcagtgatggtctgcacagggttccttacgaacccttacctcccgctggattcattccctgggattaatgcattcaagggacagtacttccacagcagacagtataaacaccctgacattttcaaggataagagagtgctggtgattggcatgggtaactccggaactgatatcgctgtcgaagcatctcaccttgcagaaaaagtgttcttatctacgaccggcggaggctgggttatcagtcggatttttgacagcggatatccatgggatatggtgtttatgaccaggtttcaaaacatgcttaggaacagcctgcccaccccaattgtgacttggctgatggagcgcaaaatcaataattggctgaaccacgcaaattacggcctgatcccagaggacaggactcagctgaaggaatttgttctcaatgacgaactaccgggtcggataatcaccggaaaagtcttcattcgaccttccataaaggaggtcaaggaaaacagcgtaattttcaataacacctctaaagaagaacccattgacatcatcgtgtttgctactggctacacttttgcttttcccttcctggatgagtcagtggtcaaggtcgaagacggacaggcctcgctttataagtacatctttccagcacacctgcaaaagcctactttggcaattatcggcttgatcaaacctctggggagtatgatcccaacaggcgaaacacaggcccggtgggctgtgcgcgtgctcaagggagtgaacaagttgcctcctccaagcgtgatgatcgaggagatcaatgcgagaaaagaaaacaaaccgtcttggttcggattgtgctattgcaaggccctgcagtccgattacattacttacattgacgaactgctgacatatataaatgctaagccaaacctgttcagcatgctgctgaccgacccacacctagctctgactgtgttcttcggaccttgttcgccttatcagtttcgcttgacgggcccggggaagtgggaaggcgctagaaatgcaataatgactcagtgggataggacttttaaagtgatcaaggccagggtggtgcaggagtccccatcccccttcgagagctttctcaaagtgttttctttcctggccctgctcgtggcgatattcctgatctttctgtag

SEQ ID NO: 187996 - DNA, 1410 bp, Artificial Sequence
  Description of Artificial Sequence: Synthetic coding sequence
atggccaagcgggtggccatcgtgggcgccggcgtgagcggcctggccagcatcaaatgttgtctggaagaaggactggaacccacgtgctttgaacgaagcgatgatctcggggggctgtggagattcactactaaagtctgctcagtcacaaagtgctccgacagtgccgtgagcggccagtgggaggtggtgaccatgcatgaggagaagcaggagagcgcgatcttcgacgccgtgatggtctgcaccggcttcctcactaatccttacctcccactggacagctttcctgggattaatgctttcaaagggcaatactttcactcccggcagtacaaacacccggatattttcaaagataagagggtgctcgtaattggaatgggcaatagtggtaccgatatcgctgtagaagcttcgcacctcgctgagaaggtcttcctgtccaccacaggcgggggttgggtaattagcagaatcttcgattcagggtacccctgggatatggtatttatgacaagattccagaacatgctgcgcaactccctgccaacaccaattgtaacctggctcatggaacggaaaatcaataactggctgaatcacgctaattatggcctgataccagaagaccgcacccagctcaaggaatttgtactcaacgacgaactgcccgggcggatcatcactggaaaggtcttcatacggccttccattaaggaagtcaaagagaacagtgtgatttttaacaataccagcaaggaagagccaatcgatattatagtttttgccactggatacacttttgcattcccgtttttggacgaatccgtggtcaaggttgaagatggtcaggcctcactctacaaatacatcttccccgcccacctgcagaagcctacacttgctataattggtctgatcaaacccctggggagtatgatcccgactggtgaaacacaggcgagatgggccgtgcgagttctcaagggtgtgaacaagctcccacccccatcagtgatgatcgaagaaatcaacgcccgcaaagagaacaagccttcctggttcggtttgtgttattgtaaggccttgcagtctgattacatcacttatatcgatgaactattaacttacataaatgccaaacctaacctgttctctatgctgctgacagatccgcacttggctctgaccgtgttttttggaccctgctccccgtaccaattccgattgacagggccgggaaagtgggagggcgcccgaaatgccattatgactcaatgggatcgtactttcaaggtgatcaaggctagagtggtgcaagagagcccgtccccattcgagtccttcctgaaagtatttagcttcttggctctcctggtcgctatctttcttatttttctctag

SEQ ID NO: 187997 - DNA, 627 bp, Artificial Sequence
  Description of Artificial Sequence: Synthetic coding sequence
atggccaagcgggtggccatcgtgggcgccggcgtgagcggcctggctagcataaaatgttgcctggaggagggtctggaacctacctgcttcgaacgcagcgacgacctggggggattgtggcgcttcaccgaacatgtcgaggaggggcgtgccagcttgtacaaatctgtcgtatctaactcatgcaaggaaatgtcatgctacagcgacttcccgtttcccgaagactacccaaactacgtgcccaatagtcagtttctggaatacctgaagatgtatgccaaccatttcgacttacttaagcacatccagttcaagaccaaagtgtgtagcgtcaccaaatgctcggactccgccgtcagtggccaatgggaggtggttaccatgcacgaagagaagcaggaatccgccatcttcgatgccgtgatggtgtgcaccgggttcttaaccaacccctacctgccactcgactcctttcctggcattaacgcatttaaaggccaatacttccactccaggcagtataaacatcctgatatatttaaagataagcgtgttctggttatcggaatgggtaacagcggtaccgacattgctgttgaggcctcccacctcgctgagtag

SEQ ID NO: 187998 - DNA, 1830 bp, Artificial Sequence
  Description of Artificial Sequence: Synthetic coding sequence
atggagggcaagcccatgcggcggtgcaccaacatccggcccggcgagacaggaatggacgtgacttctcgttgcaccttgggggaccccaataagcttccagagggtgttcctcagccagcacgcatgccatacatttctgataagcatccacgccagactctggaggtgatcaatttactgaggaaacaccgcgagttgtgcgacgtcgttctggttgtgggagctaaaaagatatatgcccatcgagtcatcttatctgcctgttcaccttactttagggccatgtttacaggtgagctggcagagagcagacagaccgaagtcgtcatcagagacatcgacgagagagccatggaactgctaattgatttcgcctacacctcacagatcaccgtcgaagagggtaacgtgcagacccttctccctgctgcctgcctactgcagctggccgagatccaggaggcatgctgtgagtttcttaagcgtcagttggatccgagcaactgcctaggtattcgggccttcgcagacacccattcttgccgagagctcctaaggattgccgataagttcactcaacacaacttccaggaagtaatggaatcggaggagttcatgcttctcccagcaaaccagctgatcgatattattagctctgacgaattgaacgttaggtctgaggaacaggtcttcaatgctgtcatggcttgggtcaagtattcgattcaggagcgcagaccacagctgccgcaagtactccagcacgtgagactcccccttttaagcccaaaatttctcgtgggcactgtgggatccgaccctctgattaaaagcgatgaagaatgccgcgatcttgtggatgaagcaaagaactaccttctgctgccacaggagcgacctctgatgcagggaccccgtacccgccctagaaaacctatccgatgtggtgaggtgctgttcgctgtaggcggctggtgttctggggacgccatttcatctgttgagcgatatgacccacagaccaacgaatggaggatggtcgcaagcatgtcaaagagacggtgcggggtcggcgtgtcagtgcttgatgacctcctgtacgccgtgggtggtcatgatgggtcgtcttatctcaacagtgttgagagatacgatccgaaaacaaatcagtggtctagcgacgttgctcctacttcaacctgcagaacaagcgtgggcgtggctgtccttggaggcttcttgtacgctgtcgggggccaggatggggtgtcctgcctgaacattgtagagagatacgacccaaaagagaacaaatggaccagggtggcatccatgtcaactcgcagactcggagtcgccgtcgccgtgctgggcgggtttctctatgcggtcggcggctccgacgggacaagcccattgaacacagtagagaggtacaatcctcaagaaaacagatggcatactatcgctcccatgggcacacgccgaaagcacttaggctgcgcagtctatcaggacatgatttatgccgtggggggacgcgatgacacgacagaactctcctcagccgaacggtataaccctaggacgaatcagtggtcaccagtggtggccatgacctcccgtagatctggggtcgggctggcagttgtgaatgggcagttgatggcagtaggcggtttcgacggcacaacatacctgaaaaccatcgaggtgttcgatcccgacgccaacacctggcgtctgtatggtgggatgaattatcgcaggctaggggggggggtaggcgtcataaagatgacccactgcgagagtcacatctggtag

SEQ ID NO: 187999 - DNA, 1416 bp, Artificial Sequence
  Description of Artificial Sequence: Synthetic coding sequence
atggccaagaaggtggccgtgatcggcgccggcgtgagcggcctgattagcctgaagtgttgtgtcgacgagggactagagcccacttgtttcgaaagaaccgaggatatcggaggagtctggaggtttaaggagaatgttgaggatggtagggcctcaatctaccagtccgttgtgactaacacttcaaaggagatgagctgttttagtgattttcccatgccagaagactttcctaacttcctgcataattcaaagctgctcgaatacttcaggatctttgccaaaaaattcgatctgctgaaatacatccagtttcagactaccgtgctgtcggtgcggaaatgtcccgatttctcctcctccggtcagtggaaagttgtgacacagagtaatggtaaggagcagtctgccgtcttcgatgctgtgatggtttgttcaggccaccacatcctgccccacattccactcaaatctttcccaggaatggagagatttaagggacaatactttcactctcgccaatataagcaccccgatggcttcgaaggcaagaggatcctcgttattggaatgggaaattctggctcggacatcgccgtggagttgtccaagaatgcggcacaggtcttcatctcaactcggcatggcacatgggtgatgagccgcatcagcgaagacgggtatccctgggatagcgtatttcacactcggtttcgaagcatgctgcggaacgttctgcctaggacagccgtgaagtggatgatagaacagcaaatgaacagatggttcaaccacgagaattacggcctcgaacctcagaacaagtatattatgaaagagcccgtgctgaatgatgatgtgccttcgaggctactatgtggggcaattaaagtcaaatccactgtgaaagagttgacagagacttctgcgatctttgaggacgggacagtggaggagaatatagacgtgatcatcttcgccacgggttattcattctcatttcctttcttagaggattcattggtcaaggttgaaaacaacatggtgtccctatataagtatatcttcccagctcatttagacaagtcaaccctggcctgcatcggtttgattcaaccactgggctcaatattccctaccgccgagctccaggctaggtgggtgacccgcgtgttcaaaggactctgcagtttgccgtcggaaaggacgatgatgatggacattataaagagaaatgagaaacgtatcgacctcttcggggagagtcaatcccaaaccctccagacaaactacgtcgactacctcgatgagctcgcactggagatcggcgccaaacccgacttctgctcccttctgttcaaagatccaaagctggcagtccggctgtactttggcccctgcaactcctattag

SEQ ID NO: 188000 - DNA, 1599 bp, Artificial Sequence
  Description of Artificial Sequence: Synthetic coding sequence
atgggcaagaaggtggccatcatcggcgccggcgtgagcggcctggccagcattaggagttgccttgaggaaggcctggaaccaacttgcttcgaaaaaagcaacgatatcggaggactttggaagttctctgaccacgccgaggaggggcgagcctccatttataaatctgtgttcagtaactcctctaaggaaatgatgtgtttccctgactttccctttccagacgactttcccaacttcatgcataatagcaaaatccaggaatatatcatcgcattcgccaaggaaaagaacctgcttaagtatatccagttcaaaaccttcgtttcttcggtcaataaacacccggatttcgctaccacaggacagtgggatgtcaccaccgaacgtgacggcaaaaaagagtcggccgtgttcgatgccgtgatggtgtgttcgggccatcacgtttacccaaacttaccaaaggaaagcttccctgggctgaatcacttcaaaggcaagtgcttccattcccgggactataaagagcccggcgttttcaacggaaaaagagtgctggtcgtgggattaggcaacagcgggtgcgatattgccaccgaattatcgcgtacagccgagcaggtgatgatctctagcagatccgggtcatgggtaatgtcaagggtctgggataatggatacccttgggatatgttactagtcacccgcttcgggacctttttgaagaacaacttgccaacggctatctctgactggctgtacgtgaagcagatgaacgcgagattcaaacacgaaaattacggccttatgcccctcaacggcgtgctccgcaaagagcctgtgttcaatgacgagttgcccgcttcaatcctgtgcggaattgttagcgtgaagccgaacgtgaaggagtttaccgagacatctgccatcttcgaagacggaaccatctttgagggcatagattgcgttattttcgctacaggctactcattcgcatatcctttcctggacgagagcataatcaagagccgcaacaacgagatcatattgttcaagggagtgtttccaccactgctggagaagagcaccattgctgtgattggctttgtgcaatctctaggggcagccattcccactgtggatttgcaatcacggtgggcagcacaagtgattaaagggacatgtaccttgccctccatggaggacatgatgaacgacatcaatgaaaagatggaaaagaagagaaaatggtttggtaagtcggaaacaattcagacggattatatagtttatatggacgaattgagcagcttcattggagccaaacctaatataccctggctgtttctgacggaccccaagcttgccatggaggtgtatttcgggccttgttctccctaccagttcagattagtcggccccggtcaatggcctggcgcccggaacgctatcctcacgcagtgggacaggtcactaaagccaatgcagactagggttgtgggccggctgcagaagccttgcttcttcttccattggttgaagctcttcgccataccaattctgttaatagcagtttttctcgttctaacgtag

SEQ ID NO: 188001 - DNA, 1599 bp, Artificial Sequence
  Description of Artificial Sequence: Synthetic coding sequence
atgggcaagaaggtggccatcatcggcgccggcgtgagcggcctggcctctattcgctcctgtctggaggaaggactcgagcccacatgtttcgaaaaatctaacgatattggcgggctgtggaagttcagcgaccacgctgaggaggggcgcgccagcatttacaagagtgtattttccaattcttccaaggagatgatgtgctttccagattttccctttcccgatgacttcccaaacttcatgcacaattccaaaatacaggaatacattatcgccttcgctaaggagaagaacctcctcaagtacatccagttcaagacattcgtctcttctgtcaacaagcatccggacttcgccaccacgggccagtgggacgttacaaccgaacgggacggcaaaaaagagtcggcggtattcgacgccgtgatggtgtgctccggacaccatgtataccccaatctccccaaggagtctttcccaggcctgaatcacttcaaagggaaatgcttccattcaagagactacaaggagcccggtgtgttcaatggaaaacgagtcctggtagtcggccttggtaatagtggttgcgacatcgcaacagagctctctcgaacggctgaacaagtcatgatttcttcaaggagcggctcatgggtgatgagcagggtctgggacaatgggtacccctgggacatgcttctcgttactaggttcggcacctttttgaagaacaatttgcccactgctatctctgattggctatacgtgaaacaaatgaacgcacggttcaagcacgagaattacggactgatgcccctgaatggggttctgagaaaggaaccagtgtttaacgatgaactccccgcctctatcctgtgcgggatcgtttcggtcaaacctaacgtcaaggagtttacggaaacctccgccattttcgaagacggaacgattttcgaaggcattgactgcgtcatctttgcaacggggtactctttcgcatatccatttctggacgagtctattataaagagccgcaacaacgagattatcctgtttaagggggtctttccaccactcttggaaaaaagtacaattgccgtgattggctttgtgcaaagtctgggcgctgccattcctacagttgatcttcagtccaggtgggctgctcaggtgattaaagggacatgcacgctgccttctatggaagatatgatgaacgatataaatgaaaaaatggaaaaaaaaaggaaatggtttggcaaaagcgagaccattcagacggattacattgtgtacatggatgagttaagtagcttcatcggcgccaaacctaatattccctggctgttcttaaccgaccccaagctggccatggaggtttacttcggtccctgcagcccataccagtttcgcctcgttggacccggccagtggcctggagcgaggaatgccatactgacacagtgggacaggtccctcaaaccgatgcagacccgggtggtgggccggcttcagaaaccctgctttttctttcattggctgaagttgttcgccattcccatcctgctcatcgcagtattcttggtactgacttag

SEQ ID NO: 188002 - DNA, 1410 bp, Artificial Sequence
  Description of Artificial Sequence: Synthetic coding sequence
atgggcaagaaggtggccatcatcggcgccggcgtgagcggcctggcctccattagaagttgcctagaggaaggactggagcctacatgtttcgaaaagagtaacgacataggcggcctttggaagttctccacgtttgtaagctctgtgaataaacaccccgatttcgccaccaccggacagtgggacgtgaccactgaaagggatggcaaaaaggaaagcgccgtgttcgacgctgtgatggtgtgttcaggccatcatgtctaccctaatctgcccaaggaatcattccccggactaaatcatttcaagggtaaatgcttccactctcgcgactacaaagaacctggggtgtttaacgggaagcgggtgctcgtagtgggcttagggaattctggatgcgacatcgccacggaactctccaggacagccgaacaggtaatgattagcagccggagcggctcatgggtgatgtcccgagtgtgggacaatggctatccgtgggatatgttattagtgacaagatttggcaccttcctgaagaacaatctacctaccgctatatccgactggctctacgtcaagcagatgaacgctcgcttcaagcatgaaaactatggcctgatgcctctgaacggtgtgctgcgcaaggaacctgtgttcaatgacgagctgcctgctagcatcctgtgtggaatagtttccgtgaagcctaacgtcaaggagtttacagaaacaagtgctatttttgaggacggcaccatcttcgagggaattgactgcgtgatattcgccactggctactcctttgcttaccccttccttgatgagtccattatcaaaagccgcaataacgaaatcattctattcaagggggtcttcccacctttgcttgaaaagtccactattgccgtaatcggcttcgttcaatcactgggtgcagccatccctacggtcgacctgcagtcccgatgggctgcccaggttataaagggcacgtgtacgttaccctctatggaggatatgatgaatgacatcaacgaaaagatggaaaagaagcggaagtggtttggaaagtcagagaccattcaaacagattacattgtgtacatggacgaactgtcctcctttataggtgccaaacctaatattccctggctctttctgactgaccccaagctcgccatggaggtgtactttggaccatgtagcccatatcagtttaggctcgtcggccccggacagtggcccggggcgcgcaatgccatactgacccagtgggatagatcgcttaagcccatgcaaacaagggtagtggggcgtctgcaaaaaccttgttttttttttcactggttaaaactgttcgctatccctatccttttgattgccgtttttctcgtgctgacctag

SEQ ID NO: 188003 - DNA, 1539 bp, Artificial Sequence
  Description of Artificial Sequence: Synthetic coding sequence
atgcccgccagcacccggagccagaagcggcagggcatggacagcctgttagagcctctgaagatgaatatggaccacgccgaagaaggaagagccagcatctataagtccgtcttctccaactctagtaaagagatgatgtgtttccccgatttccctttcccagatgattttcccaatttcatgcataattcaaagattcaggagtatattattgcgttcgctaaagaaaagaaccttctgaagtatattcagttcaaaacctttgtctcctccgtgaataaacatcctgacttcgctaccaccgggcagtgggacgttacaacagaaagggacggtaaaaaagaaagcgccgtatttgatgccgttatggtctgttcagggcaccacgtttaccccaacctgcccaaggagagcttcccaggcctgaatcacttcaaagggaagtgcttccactcccgagactacaaagaacccggagtttttaatgggaagagagtcctggtggttgggcttggtaactctggctgtgacattgcaacagagctctcccgcaccgccgagcaagttatgattagttcacggagtggcagctgggtgatgtcccgcgtgtgggacaacggttacccatgggacatgctgttggttacgaggttcggaacctttctcaagaacaatctgcctactgctatctctgattggctttacgttaagcagatgaatgcacgctttaagcatgaaaactacggactcatgccactgaatggcgtcctcagaaaagagccagtattcaatgatgaactgcctgcctccatcctctgcggcatcgtctctgtcaaaccaaacgtaaaggagtttactgagactagcgcaatctttgaggacggcactatttttgagggtatcgactgtgtgatatttgccaccggttattccttcgcatacccgttcctggatgagtcaattattaagagtaggaacaatgagataatcctctttaagggtgtattccccccgctgctggagaagagtaccatagctgtgatcggctttgtccagagtcttggtgccgctatcccaacagtcgacctccagagccgctgggccgcacaggtaatcaaggggacttgcacactaccatccatggaggacatgatgaacgacattaacgaaaagatggaaaagaaaaggaagtggttcggtaagtccgaaacaatccaaacagattatatcgtttatatggacgagctgtcaagctttatcggcgcaaaacctaacattccatggctgtttctcacagacccgaagctggcaatggaggtgtacttcgggccgtgctccccctaccagttccgattggtcggccctggacagtggcctggggctaggaatgccatacttactcagtgggatcgatcactgaaaccaatgcagaccagggtggtgggcagacttcagaagccttgcttctttttccactggcttaagctctttgccatccccatccttttgatcgccgtgttcttggtactcacttag

SEQ ID NO: 188004 - DNA, 1677 bp, Artificial Sequence
  Description of Artificial Sequence: Synthetic coding sequence
atggccaagaaggtggccgtgatcggcgccggcgtgagcggcctgtcgagtatcaaatgttgcgttgacgaggacttagagcctacctgcttcgaaagaagcgacgacatcggtggactgtggaagttcacggagagtagcaaggatgggatgaccagggtgtataaatcattagtcacaaatgtctgtaaggaaatgagctgctactcagattttccttttcacgaagattaccccaatttcatgaaccatgaaaagttctgggactacttacaggagtttgctgagcatttcgatctgttaaagtacatccaattcaaaactacagtctgcagtatcactaagcgacccgactttagtgaaaccggccagtgggacgtggttactgagactgaagggaagcaaaaccgtgccgtcttcgatgccgtgatggtgtgtacagggcatttcctgaacccccacctccctttggaggcctttcccggcatccacaagttcaagggccagatcttgcacagccaggaatacaagatcccggagggattccagggaaagcgggttctcgttataggcctgggcaacacaggcggcgacatagcagtagaactgagtcgaactgcagcccaggtgctcctctcaaccaggactggcacctgggtgctcggccgctcttccgattggggttatccttacaatatgatggtgacgcgaagatgctgctctttcattgcccaggtgcttcctagcaggttcctgaactggattcaagagagaaaactgaacaagaggttcaaccatgaagactacgggcttagtattacaaagggtaaaaaagccaagtttattgtaaatgatgagcttcctaactgcatcttgtgtggcgccattacgatgaagacaagcgttatagagtttactgaaactagtgcagtctttgaggacggaacggtggaagaaaacatagacgtggtcatttttacgacagggtatacattttctttccccttcttcgaggagcccctcaaaagtctgtgcacaaagaagatcttcctgtacaagcaggttttcccactgaatctcgagcgcgccaccctggctattattggcctgattggtctgaaagggtctattctttcagggacggagcttcaagccagatgggtgacacgtgtctttaagggcctctgtaagatcccgccatcccagaagttgatgatggaagcaacagagaaagagcagttgatcaaaagaggcgtctttaaagatactagcaaagacaagttcgactacattgcttacatggatgatatcgcagcctgcatcggaactaaaccgtcaatcccacttctattcttgaaggatccacgcctcgcttgggaagtcttcttcggcccctgtactccctaccaatatcgcctcatgggccctggtaagtgggatggcgcaagaaacgcaattctgactcaatgggatcgaacgctcaaaccactgaagaccagaatcgttccggattcttctaaaccagcgtccatgtctcactacctcaaggcctggggcgcacccgtgctgctagcgtcccttctgctgatatgcaagagctccctgtttctgaaactggtgcgggacaaattacaggataggatgtctccctacctcgtcagtctgtggcgggggtag

SEQ ID NO: 188005 - DNA, 1602 bp, Artificial Sequence
  Description of Artificial Sequence: Synthetic coding sequence
atgaccaagaagcggatcgccgtgatcggcggcggcgtgagcggcctctcctctattaagtgttgtgtagaagaaggattagagccggtgtgtttcgagcgaacagatgatatcggagggctgtggcgctttcaagaaaatcccgaggaaggtagagccagcatttataagtctgttattatcaacaccagtaaggagatgatgtgcttttcagattacccgattcccgatcactatcccaactttatgcataatgcccaggtactcgaatatttcagaatgtacgctaaggaattcgatctgttgaagtatattagatttaaaacgaccgtgtgctcggtgaagaaacaacccgacttcgccacctccggccagtgggaagtggtgacagaaagcgagggcaagaaagagatgaatgtgttcgatggcgtgatggtgtgcactgggcaccataccaatgcccacttacccttggagtcatttcccggaatcgagaagtttaaagggcaatatttccacagcagagactacaaaaatcctgagggctttactggcaagcgtgttataattattgggattggcaacagcggcggtgatctggcggtcgaaatatcccagaccgctaagcaggtgttcctgagtaccagaaggggagcctggatattgaatcgggtgggggactatggttaccccgcagatgtgttgttttctagtcggctgacccattttatatggaagatatgcggacagtctctggctaacaaataccttgagaagaagattaaccagagattcgatcacgaaatgttcggtttaaagccaaaacatcgggccttatcccaacaccctactctgaacgatgacttgccgaacagaatcatttccggccttgtgaaggtgaaggggaatgtgaaggagtttaccgaaactgctgcgatcttcgaggatggttcgcgtgaggatgacatcgacgccgtgatcttcgctacaggttactctttcgactttccttttctcgaggactcagtgaaagtcgtaaagaacaagatttcactttacaagaaggttttcccccctaatcttgagcggcctaccttagccatcatcggtcttatccagcccctcggtgctatcatgcccatcagcgagctgcaggggcgatgggcaacacaagtttttaaaggacttaaaacccttccttctcaatcagagatgatggcagagatcagcaaggcccaggaggagatagacaagagatatgtagagagtcagcgacatacgatacagggtgattacatcgataccatggaagagctcgccgatctcgttggcgtgaggccaaatcttctgtccctggcttttacagatcctaagctcgccctccacctgcttctgggtccctgtaccccaatccactaccgcgtgcaggggcctgggaagtgggatggtgctcggaaggcaattctgaccactgatgacaggatacgaaaacctctgatgacccgcgtagtggagcggtccagctctatgacttctacaatgacaataggcaagtttatgctagccctcgcttttttcgctatcatcattgcatatttctag

SEQ ID NO: 188006 - DNA, 858 bp, Artificial Sequence
  Description of Artificial Sequence: Synthetic coding sequence
atgaccaagaagcggatcgccgtgatcggcggcggcgtgagcggccttagcagcattaagtgctgtgtggaggagggactagagcctgtttgtttcgagcgcactgacgacatcgggggactatggcgatttcaggaaaatccggaggaagggcgcgcatctatctataaaagcgtgatcattaatacttccaaggaaatgatgtgtttctccgattaccccattccagatcactacccgaatttcatgcataatgcccaggtgctagagtatttcagaatgtatgccaaggagttcgacctcctgaagtacattaggtttaagacaactgtgtgctctgtgaaaaaacagcccgattttgctactagtggacagtgggaagtagttactgagtcagagggaaaaaaagagatgaatgtgttcgatggggtgatggtttgtaccggccatcatacaaatgctcaccttcccctagagagtttccctgggatagagaaattcaaaggacaatactttcacagtagggactataagaacccagagggattcaccggaaaacgggttatcattattggaatcggcaatagcgggggagacctagctgtggaaatcagccagaccgctaagcaggtctttctcagtacacgccggggtgcctggatcttaaatagagtgggggattacgggtaccccgcagacgtactgttttcttctcgactgactcacttcatctggaaaatctgtggacagtcattggccaacaagtacctggaaaaaaagataaatcaacggttcgaccatgaaatgttcggccttaagcctaaacatcgctccaaagatatcgccttgaccgagtag

SEQ ID NO: 188007 - DNA, 1395 bp, Artificial Sequence
  Description of Artificial Sequence: Synthetic coding sequence
atgaccaagaagcggatcgccgtgatcggcggcggcgtgagcggcttgagctctataaagtgctgcgtcgaagagggtctcgagccagtctgtttcgaacgcaccgatgacattggaggtctgtggcgatttcaggaaaatcccgaggaagggcgggcctccatttacaaatctgtgataataaatacatcaaaagaaatgatgtgcttctcagactatccaatacctgaccactacccaaacttcatgcacaacgcccaggtactcgagtatttccggatgtacgccaaggagtttgacctcctcaaatatatcaggtttaagaccacggtctgcagtgtgaagaagcagcccgatttcgcaacctccggacagtgggaagttgtgactgaatctgagggaaagaaagaaatgaacgttttcgatggcgttatggtttgcaccggacaccatactaacgcacatttacctttggagagcttccccggcatagagaaatttaaagggcagtactttcattcaagagattacaagaaccctgagggttttacaggtaaaagagtgattatcatcgggattggcaacagcgggggtgacctggccgtggaaatcagtcagaccgccaagcaagtcttcttgagtactcggcgtggtgcctggatcctgaatagagtgggagattacgggtatcccgcagacgttttgtttagctcccggctgacacactttatctggaagatctgcgggcagtcactcgcgaacaaatatctggaaaaaaaaataaatcagcgctttgaccacgagatgtttggcctgaaacccaagcaccgggcactctcgcagcatccgactcttaacgacgacctgcctaatcgtattataagcggactggtaaaggttaagggaaatgtcaaagagttcaccgaaaccgcggcaatcttcgaagatgggtcgcgggaagatgacattgatgctgtcatctttgcaaccgggtattcattcgattttccatttcttgaagactcggtgaaggttgttaagaataagatttccctttataaaaaagtgttccctcccaatcttgaaagaccgacgctggccattatcggtctaatccagcccctaggagccatcatgcctattagcgagctacagggacgttgggcaacacaggtgttcaaaggtcttaagacccttccatcccagtctgagatgatggctgagataagtaaagcccaggaggagattgataagtcactgaccatgcgcaagacctctgataagcctaagttgaagaacatcctgcagatacctgactatcttaagactgtgaaaatcattaacaaggagtcactgcggaattgtcctggaataaagggtccaaaagagacctag

SEQ ID NO: 188008 - DNA, 579 bp, Artificial Sequence
  Description of Artificial Sequence: Synthetic coding sequence
atgaccaagaagcggatcgccgtgatcggcggcggcgtgagcggcctgagttccatcaagtgttgcgtcgaggagggcttggagcctgtctgcttcgagcgcaccgatgatatagggggtctttggagatttcaagagaatcccgaggaagggagagctagtatctacaaaagtgtgatcattaatacatccaaggagatgatgtgtttctctgactatcctattcctgatcactacccaaattttatgcacaacgcacaggtactcgaatacttcagaatgtacgccaaggagttcgacctgcttaagtacatccgtttcaaaacaaccgtgtgttcagttaagaaacaacccgatttcgctacctcgggtcagtgggaagtggtgacggagtctgaaggtaagaaggaaatgaacgttttcgatggggtaatggtctgcactggccaccacaccaacgcgcacttacctctggagagcttccccggaatagagaaattcaaaggccagtacttccacagccgtgactataagaacccagaaggctttaccggtaaaagggtgattataatcggctag

SEQ ID NO: 188009 - DNA, 438 bp, Artificial Sequence
  Description of Artificial Sequence: Synthetic coding sequence
atgaccaagaagcggatcgccgtgatcggcggcggcgtgagcggcctgagttccataaaatgttgtgttgaggagggactggaacccgtatgtttcgagcgcacagatgatatcggaggtttatggaggtttcaagagaacccggaagaaggacgggcaagtatttacaagagcgtgatcattaacacctccaaggagatgatgtgtttcagtgattacccaatcccagatcactatccgaatttcatgcataatgcacaggtgttggagtactttcgtatgtatgcaaaagagtttgacttgctgaaatacattcgctttaaaacaactgtgtgctccgttaaaaagcaaccagatttcgcgaccagcgggcagtgggaggtagtcaccgaatccgaaggtaaaaaggaaatgaatgtgttcgacggagtgatgtag

SEQ ID NO: 188010 - DNA, 3810 bp, Artificial Sequence
  Description of Artificial Sequence: Synthetic coding sequence
atggaggccaccggcgtgctgcccttcgtgcggggcgtggacctgtcagggaatgatttcaagggaggttattttcccgagaacgtgaaggctatgactagcctccgctggcttaaattgaacagaaccggcctgtgctatcttcctgaggaactggcggccctgcagaagctcgagcacctttctgtctcgcataacaatttaaccaccttgcatggagagctctccagcctgcctagcctgcgcgccatcgtagcaagagctaattcccttaagaacagcggcgtgcccgacgatatcttcaaactggatgacttgagcgttttagacctttctcacaatcagcttaccgaatgtcctcgtgaactcgagaatgccaagaatatgctggtactgaacctgtctcataattctatcgacaccattccaaaccaactttttattaacctgactgacttgctctatctcgacctgtccgagaataggctggagtccctgcccccacagatgaggcgcctggtccatttgcagacactggtgctcaatggaaatcctttgctccatgcccaattaaggcaacttccagctatgacagcattacagaccctccaccttaggtccacacaaagaactcagtctaatctacccacgtctctggagggattgtccaaccttgcagacgttgacctgtcttgcaacgatctgaccagagttccggagtgcctctacactcttccatcactccggcgtctgaacctctctagtaaccagattactgaactttcactgtgtatcgatcaatgggtgcacgtcgagaccttgaatctgtcccggaaccagctcacttccttgccctccgcaatttgcaaactaagcaagttgaaaaagctttacctcaattccaataaactcgacttcgacggcctacccagcggcatcggtaagctgactaatttagaggagtttatggccgcaaacaataatctagagctggtcccggagtccctttgcaggtgtccaaagctccgcaagctggtcttaaacaaaaaccacctcgtgactcttcctgaggccattcatttccttacagaaatagaagttctggatgtgcgcgagaatcctaacttagtgatgccacccaagccagctgatagggcagcggaatggtataatatcgatttctccttgcagaaccagttacgattggctggagcatccccggcaaccgtggccgccgcggccgccgccgggtctggccctaaggacccgatggcccggaaaatgagactccgccgaaggaaagatagcgcccaagacgaccaggctaaacaggtgcttaagggtatgagtgatgtagcgcaagaaaagaataagaaacaggaagaatcggcagatgctcgtgcgccgagcgggaaggtgcgccgatgggatcaggggttggaaaagcctagactggattattctgaattttttactgaggatgtgggtcagctaccagggttaactatttggcagatcgagaacttcgtgccagtgttggtggaagaggccttccatggaaaattctatgaggcagactgctacattgtgttaaaaacatttctcgatgactccggctctcttaactgggagatatattactggattggcggcgaagctaccttggacaagaaggcctgcagcgcaattcacgctgtgaatcttaggaattacctgggggcagagtgccgtaccgttagagaggagatgggcgatgaaagcgaggaattcttgcaggtttttgacaacgacatttcatacattgaaggcggcactgcttccggattttacacagtggaggatacccattacgtgacccgaatgtaccgcgtgtatggtaaaaagaatattaaacttgagcctgtgcctcttaaaggtactagtcttgacccccgcttcgtgttcctgctggaccgcggactggacatttacgtctggagaggagcccaggccaccttgtccagcactacaaaggcccggctattcgctgaaaagatcaacaaaaatgaacggaagggcaaagccgagattacgttgctggtgcaggggcaagagctaccagagttctgggaggcgcttggcggagagccctccgagatcaagaagcatgtcccagaagatttttggcctccccagcctaaactatacaaggttggactgggactaggctatttagagttaccacagattaactacaagctttctgtggagcataagcaacggcctaaagtcgagctcatgccccgtatgcgcctgctgcagtccctgctcgacacccgctgtgtctatatactagattgctggagcgatgtatttatatggcttggaaggaagagccccaggcttgttagagccgccgctctgaaactcggccaggagctctgcggtatgttacaccggcctcgccacgccacggtttccaggtcactggaaggcactgaagcgcaagtatttaaggccaaattcaaaaactgggacgatgtgctgaccgttgactacacgagaaacgccgaagcggtcttgcagtcgccaggcctatccggaaaagtaaagcgggatgcagagaaaaaagatcaaatgaaggcagacctgaccgccttattcctgccacgtcaacctcccatgtccctggcagaggccgagcagctgatggaagaatggaatgaggacctggacggtatggagggattcgttttggaaggaaagaagttcgcacgcttacctgaagaggaatttggacacttctacacacaagattgttacgtgtttctttgccggtactgggtcccagtggaatacgaagaagaagagaagaaagaagataaggaggagaaagcagaggggaaggaaggggaagaggccacagctgaggccgaagaaaaacaaccggaggaggacttccagtgtattgtgtacttttggcagggaagggaagcatctaacatggggtggcttacatttacattctcactgcagaagaaattcgagagcctcttcccgggcaaattggaggtagtccgtatgacccaacagcaagagaacccgaagttcctctcccacttcaagaggaaattcattattcacagaggcaagcgaaaagcagtgcagggggcccagcagccttccctttaccagatcaggacaaatggaagtgcactctgcactcggtgtatccagatcaacaccgatagttctctgctcaactcggaattctgcttcattctcaaagttcccttcgaatcagaagataaccagggtatcgtatacgcatgggttggtcgggcaagcgacccagacgaggccaagctcgccgaagatatccttaatacgatgttcgacacctcctactctaaacaggttatcaacgaaggcgaggaacccgagaacttcttctgggtagggatcggagctcagaaaccctatgatgacgacgcggaatacatgaagcatactcggctgtttcgctgttccaatgagaaaggctattttgccgttactgaaaaatgcagcgatttttgtcaagacgatttggcagacgacgatatcatgcttcttgataacggtcaagaagtttatatgtgggtcggcacacagaccagccaggtcgaaattaaactgagcctcaaggcctgccaggtttacattcagcacatgagatctaaggaacacgaaagacctagacggctaaggttggtgcgcaagggaaatgaacagcatgctttcactaggtgtttccatgcctggtctgccttttgcaaagccctagcttag

SEQ ID NO: 188011 - DNA, 3552 bp, Artificial Sequence
  Description of Artificial Sequence: Synthetic coding sequence
atgaccagcctgcggtggctgaagctgaaccggaccggcctgtgctacctgcccgaggagctcgctgcactgcaaaaactggaacatttaagtgtgtctcataataatctcacaacactgcacggggaattgtcaagtctcccgagccttcgagcgatcgtagccagggctaacagcctaaaaaacagtggagttcctgacgatatttttaagctggacgacctaagtgtgcttgatcttagccacaatcagctgactgagtgcccaagagaactggaaaacgcgaagaacatgctggtgcttaacctgtcacataataggcagctgccggccatgacagcactccaaaccttgcatctccggagtacacagagaacacagtctaacctccccacttcactggaggggctctcaaacctcgcagacgtggatttgtcttgtaacgacctcacacgggtcccagagtgcctgtataccctgcctagtctaaggaggctcaacctgtcaagcaatcagattaccgagctaagcctttgcattgaccagtgggtacacgtggaaacattgaacctatctcggaaccagctgactagcctacccagtgccatttgtaagctctccaagctgaagaaactttacctcaattccaacaagttagactttgatggcctaccctcaggaattggaaagcttactaatctggaggagttcatggcagccaataataatctggagcttgtaccagagagcctttgccgctgccccaaactgaggaagctagttctgaacaagaaccatctcgtcacccttccagaagccattcacttcctgactgaaatcgaggtgctcgacgtgagggaaaatccaaacctggttatgcctcctaagcctgccgaccgagcagccgagtggtacaacatagactttagcctgcagaatcagcttaggcttgctggcgcttcccccgcaacagtggcggccgctgctgccggttccggtcctaaggacccaatggcgcgcaaaatgcgccttagacggaggaaggactctgctcaagacgatcaggccaagcaagtcctgaaaggtatgagcgatgttgcacaggagaaaaataaaaagcaggaagagtccgccgacgcgcgtgcccccagcggaaaggtgagacgctgggatcagggcctcgaaaaaccacgcctcgattactctgagttttttactgaggacgtgggacagttacctgggctcactatctggcaaatcgagaactttgttcctgtacttgtcgaagaggccttccatggcaaattttatgaagccgattgttatattgtcctaaaaacgttccttgacgactctgggtccctgaattgggagatatattactggatcgggggagaagcaactctggacaaaaaagcttgttctgctatccacgcagtgaacctacgtaattacctgggtgccgaatgtagaacggtcagggaggagatgggcgatgagtcggaggaattcctccaggtctttgacaacgacatctcctatattgaggggggcaccgcatctggcttttacaccgtggaggatacgcattacgttactcgaatgtacagagtctatggaaaaaagaatatcaaactggaacctgtgcctctgaagggtacatctctggatccccgctttgtgttcctcctggatcgtggcctggacatatatgtctggcgcggagcacaggcaaccctcagttccactactaaagcacgactgttcgcagagaagatcaacaagaacgagagaaagggtaaagccgaaattaccctgttggtacagggacaagagctacccgaattctgggaggcacttggtggggagccctccgagatcaagaaacacgttcccgaggatttttggcctccccagccaaagctttataaagtgggactcgggctcggctacttagagcttcctcagattaactacaagctctccgtcgaacataagcagaggccgaaggtcgaactaatgccacgcatgcggctgctgcagtccctcttggacaccaggtgtgtttatatcctggactgttggagtgacgttttcatttggctggggcgcaaaagccctcggctcgtgagagcagccgccctgaaactgggccaggagctgtgcggtatgctgcacaggccaagacacgctacagtgagcaggtccctggagggaacggaggcccaagtttttaaggctaaatttaagaactgggatgacgtcttgacagtcgactacacacggaacgctgaggcagtcctgcagtcgccaggcctgagtggtaaggtaaagcgtgacgcggagaagaaagaccaaatgaaggcagacctgaccgccttgttcctgcccaggcagcctcccatgagtctggccgaggccgaacaactgatggaagagtggaacgaggaccttgacggaatggaaggctttgtgctggagggtaaaaaattcgctcgtttacccgaagaggaatttggccacttctacacacaggactgttatgtgtttttgtgtcgctactgggtccctgttgaatacgaagaggaagaaaaaaaggaagataaagaggagaaagccgagggcaaggaaggcgaggaggccaccgcagaagcagaggagaagcaaccagaggaagattttcagtgtatcgtctatttctggcaaggtagggaggctagtaatatgggctggctgaccttcaccttttctctccaaaagaagtttgaatctctctttcccggcaagttagaggttgtgcggatgacccagcagcaagagaacccaaagtttttatcccatttcaaaaggaagttcatcattcatcgcgggaagaggaaggccgtgcaaggcgcccagcaaccttcattgtaccagattcggaccaacggtagcgccctgtgcacccggtgtattcagattaacactgatagctccctgttaaactccgagttctgtttcattttgaaagtcccatttgagagtgaagacaatcagggtatcgtctacgcctgggttggtcgtgcctccgatcccgacgaggccaaactggccgaagatattttaaatacaatgttcgacacatcatatagtaaacaggtgatcaacgaaggcgaagaaccagagaatttcttttgggtcggcatcggtgctcagaagccctacgatgatgatgcagagtacatgaaacacactagactcttccggtgcagcaatgaaaaagggtatttcgctgtgacagaaaagtgttccgacttctgccaggacgaccttgcagacgacgatatcatgctgttggataatggccaggaggtgtacatgtgggtcggaactcagacttcccaggttgaaataaagttgtcactcaaggcctgccaggtctacatccaacacatgaggtccaaggaacatgaacggccaagaaggctgaggctcgttaggaagggaaacgagcagcatgccttcacaagatgcttccacgcttggtctgctttctgtaaggccctggcatag

SEQ ID NO: 188012 - DNA, 3447 bp, Artificial Sequence
  Description of Artificial Sequence: Synthetic coding sequence
atggaggccaccggcgtgctgcccttcgtgcggggcgtggacctgagtggaaatgacttcaaaggcgggtactttccagagaatgtcaaagccatgacctctttacgatggctgaagttgaatagaaccggattatgctatttaccagaggagttagccgcactgcaaaagttggaacatctcagcgtctcacataataatctgaccaccctgcacggtgaactgtcatctttaccttccctgcgagccatcgtggcacgtgccaattctctgaagaattccggagtgcctgatgatatctttaaactggacgatttgagcgtgctcgacctgtcgcacaaccagttgacagagtgtcctcgcgagctggagaacgctaagaatatgttggttttgaatctttcccacaactccatcgataccattcccaatcaactgtttatcaatctgactgatctgctctatctcgacctgagtgaaaaccgccttgaaagcttgccgcctcaaatgcgccgtctcgttcacctgcagaccctggtgttgaatggtaaccctttgttgcacgcacagctgcgacagctgcccgccatgaccgccttgcaaacgcttcaccttcgatccacccagagaacacaatctaaccttccgacatcactggagggcctctcaaatcttgctgacgtggatttaagctgcaatgatctgacacgcgtgcctgagtgtctgtatactctccccagtctgcggcgactcaatctctcgagcaaccaaataactgagctctcgctttgtattgatcagtgggtgcacgttgagaccctgaacctctctcgcaaccaactcacctctctgcccagtgcaatttgtaaacttagcaagctaaaaaaactctacctgaactctaacaagctggacttcgatgggttgccaagtggcatcgggaagttgactaacttggaggagttcatggctgcgaataacaacctggagctagtgcccgaatcactgtgcaggtgcccgaaacttcgtaaactggtgttaaataagaaccatctcgtcaccctccccgaggctatccactttctaaccgagatagaggtcctcgacgtaagggaaaatcctaacctagtcatgcctcccaagccagctgaccgggccgccgaatggtacaacatcgacttcagcttacagaatcagttaagactggctggtgcttcgcccgcaaccgtggcagctgctgctgctgccggtagtggtccaaaagaccccatggcaagaaagatgcgactgcgtcgcagaaaagattccgctcaggatgatcaagctaaacaggtccttaagggcatgagcgatgtcgcacaggagaaaaataagaaacaggaagagagcgcagacgccagagccccaagcggaaaggtgcgaagatgggatcaggggctcgagaagcctcggctggactactctgaattcttcactgaagacgttgggcagttgccaggcttgacaatttggcagattgagaacttcgtgccagttttggttgaagaagcttttcatggcaaattttatgaggccgattgctatattgtcctgaaaacttttctggatgattccggtagtctaaattgggaaatttactattggatcggtggggaagctaccctggataagaaggcttgctcagccatccatgcagttaacctccggaattatttaggggccgaatgcaggactgttagagaggagatgggagacgagtcagaggaatttctgcaggtattcgataatgatatctcatatatcgagggcggaaccgcatcaggcttttataccgtggaagacacccactatgtgaccagaatgtatcgagtctatgggaaaaagaacatcaagctggagcccgtgccactgaaaggcaccagcctggatccaaggtttgtgttccttctcgacaggggactcgacatctacgtgtggaggggggcccaagctaccctgagttcgaccaccaaagctagactcttcgccgaaaaaattaataaaaacgagcggaagggcaaagcagaaattaccctactggtccaggggcaggaactgccagagttctgggaggccttgggaggtgagcccagtgagataaagaaaaattgggacgatgtgctgactgttgactatacaaggaacgccgaggcagttcttcagtcgccgggcctgagcggcaaggtaaaacgagatgccgagaagaaggaccagatgaaggcagacctcaccgcgttatttcttccccggcagccgcctatgtccctggctgaggccgagcagctgatggaggagtggaatgaagacctggatggtatggagggtttcgtcctcgagggaaaaaagtttgctcggctcccggaagaagagttcgggcatttttacacacaggactgctatgtgttcctctgtagatactgggtgcctgtcgaatacgaagaggaagagaagaaggaagacaaagaagagaaagcagaggggaaggaaggagaagaagcaactgcagaggctgaggagaaacagcccgaagaggacttccaatgtattgtgtacttctggcagggtagagaggcaagtaacatgggttggctgacattcacattttccctgcagaagaagttcgagtcgctgtttcccggaaagctggaagtggtgaggatgacacaacagcaggagaacccgaagttcctaagtcatttcaagaggaagtttataattcataggggaaagcggaaggccgtgcaaggtgcacagcaaccatccttgtaccagattagaaccaatggttctgctttgtgtactcggtgtattcagatcaacacagacagttctctgcttaattccgaattctgcttcatcctcaaagtcccttttgagtcagaggataaccagggtatcgtgtacgcctgggtggggcgtgcttcggatccagacgaggctaagctggccgaggacatactgaacacaatgtttgatacatcctactctaagcaggtgatcaacgaaggagaggagccagagaattttttctgggtgggaattggcgctcaaaagccctacgacgacgatgccgagtacatgaagcacactcggctcttcaggtgttcaaacgagaaaggctactttgccgtgactgaaaagtgcagcgacttttgccaagacgacctggccgatgatgacattatgctactcgacaacggccaagaggtttatatgtgggtcggcactcagactagccaagttgaaattaagctttccctgaaagcttgccaggtctatatccagcatatgaggtcaaaggaacacgagcgtccacggcggcttcggctcgttcgaaaggggaatgagcagcacgctttcacccggtgcttccacgcttggtccgcgttctgcaaggcgctcgcctag

SEQ ID NO: 188013 - DNA, 1284 bp, Artificial Sequence
  Description of Artificial Sequence: Synthetic coding sequence
atgttcttcacctgcggccccaacgaggccatggtggtgagcggcttctgccggtctccccccgtgatggtggccggtggacgagtgttcgttctgccatgcatccagcagatacaaaggatctccctgaatacactcaccttgaacgtcaagagcgagaaggtgtacacacgccacggcgtcccgataagtgtcacaggcatcgcccaggtgaaaatacagggtcagaacaaggaaatgttagccgctgcatgccagatgttcctcggcaaaaccgaggccgaaatcgctcacatagccctggaaacactcgaaggccatcaaagagccataatggcccacatgacagtggaagaaatatataaggatcgccaaaaattctctgagcaggtcttcaaggttgcatcctcagacctggtgaacatgggcattagcgtcgtgtcctacacccttaaagatatacatgatgaccaggactatctgcactctttagggaaggccagaaccgcgcaggttcaaaaagatgcgaggattggcgaagctgaggccaagcgcgacgctggtataagggaggcaaaggccaaacaggaaaaagtgtctgctcagtacctttctgaaatagagatggctaaggctcaacgcgattacgagctgaaaaaagctgcatatgacatcgaagtgaataccagaagggcacaggctgacctggcctaccagcttcaggtcgcgaagactaagcagcagatcgaagaacagcgggtgcaggtccaagtcgtagaacgagcccaacaggtggcagtgcaggagcaagagattgccagacgtgagaaagaactggaagcccgtgtgcgaaagcccgccgaagcagaaagatataaactggaacgcttagccgaggccgagaaaagccaattaattatgcaggccgaggcagaggccgcctcggttaggatgcgcggggaggccgaggcattcgccatcggtgcacgggctcgggccgaagcggaacagatggcaaagaaggccgaagcattccaattgtatcaagaagccgcgcagctggacatgttgcttgaaaaactgccacaggtggctgaggagatcagcggacccctcacctccgcaaataagattactctggtctcaagtggctctggtaccatgggagcggccaaggtcacaggtgaagtgctcgatatcctaaccagactacctgaaagcgtcgagagactcaccggtgtgtccatcagtcaagtaaatcataagcctctgcggactgcctag

SEQ ID NO: 188014 - DNA, 1284 bp, Artificial Sequence
  Description of Artificial Sequence: Synthetic coding sequence
atgttcttcacctgcggccccaacgaggccatggtggtgagcggcttctgccgcagccccccagtcatggttgctgggggccgggtttttgtgctaccttgcattcagcagattcagaggatttctctgaacaccctgacattgaacgtcaagtcagagaaagtttatacaagacacggggtgccgatttcagtgacgggcattgctcaagttaaaatccaggggcagaacaaagaaatgttggccgcagcctgccagatgtttctgggcaaaaccgaagccgaaatcgcccacatcgcattggagaccctcgagggacaccagcgagccattatggcccacatgaccgtggaagagatttacaaagaccgccagaagttctcagagcaggtgtttaaggtggcctctagcgacctagtcaacatggggatctcagtagtgtcctataccctgaaagatatccacgatgaccaggactacctgcacagcctagggaaggccagaacggctcaggtgcagaaggacgcccgcatcggtgaagcagaggcgaagagggacgctgggatccgagaagctaaggctaaacaggaaaaagtttccgctcagtacctcagtgaaatcgaaatggccaaggctcagagagattatgagctaaagaaggccgcgtacgatattgaggtgaacaccagacgagcgcaggccgatctcgcctatcagcttcaggtagcaaaaaccaagcaacaaattgaagagcaaagagtgcaagtacaggttgtggaacgtgcccagcaggtcgcagtacaggagcaggaaatagccaggcgggaaaaggagctcgaggctagggtacggaagcccgctgaagccgagcgctataagctggaacgcctggccgaagcggagaaatcgcaactaattatgcaggccgaggctgaggcagcctccgtgcgcatgcgcggtgaggctgaggcgtttgctatcggcgcacgcgccagggctgaagcagagcaaatggccaagaaagcggaagccttccagttgtaccaggaggcagctcagctggacatgctgctggaaaaactgcctcaggtggcggaggagatttcagggcccttaacctctgctaataagattacactcgtgagcagtggtagcgggacaatgggcgccgctaaggtcacaggagaagttctagatatactgactcgtttacccgaatctgtcgagagactgacaggtgtatccatcagtcaggtgaaccataaaccactgcgtaccgcctag

SEQ ID NO: 188015 - DNA, 1284 bp, Artificial Sequence
  Description of Artificial Sequence: Synthetic coding sequence
atgttcttcacctgcggccccaacgaggccatggtggtgagcggcttttgcagatcacccccagtgatggtggcgggcggacgcgtgttcgtgctcccctgcattcagcaaatccaacgcatatctttgaatactctgacactaaacgttaagagtgagaaggtctacacgagacacggtgtccctattagcgtcaccggaattgcacaggtcaaaattcaggggcagaataaagagatgctggccgccgcgtgccagatgtttctgggcaaaacagaggctgaaatcgcccacattgctctggagacactggagggccaccagcgcgccattatggctcatatgactgtcgaagagatctataaagaccgacagaagttttccgagcaggtttttaaggttgcctctagcgatctagtcaacatgggaatctcggtggtgtcttatactctgaaagacatacacgatgaccaagattacttacacagtctgggaaaggcccggacagcccaggtgcagaaagacgcacggatcggagaagcggaagctaagcgggatgctggtatacgagaggctaaggctaaacaggagaaagtatcagcgcagtacctgagcgagattgaaatggctaaggcccagcgcgattacgagctgaaaaaagcagcttacgatattgaggtgaatacccggcgcgcacaggcagatctcgcatatcaactgcaggtggcaaaaaccaagcagcaaatcgaggagcagagagtgcaagtgcaagtggtggagcgcgcccagcaggtcgcggtacaggaacaggagattgcccggcgggagaaagagctggaagccagggtgcgtaagcccgccgaggccgaaaggtataaattggagcgcctcgccgaagctgaaaagtcacagctgataatgcaagctgaagcagaggctgcctcagtccgaatgagaggagaagctgaagcatttgcaattggagcaagagcccgagccgaagctgaacagatggccaagaaggcagaggccttccagctgtaccaagaagctgcccagctagacatgctcctggaaaagctgcctcaggtggcagaggagatttcaggtcctctgacatccgcgaacaaaattactctcgtttcttctggttctgggaccatgggggcagcaaaagtcacaggggaagtcctggacattcttactcggctcccggagtcagttgagaggctgactggagtgagcatctcacaggtcaaccacaaaccattaagaaccgcatag

SEQ ID NO: 188016 - DNA, 438 bp, Artificial Sequence
  Description of Artificial Sequence: Synthetic coding sequence
atgggcgtggagggcaccggccggggcggctgccggctgggcggccctgacggaaaggggaaaggatgggcccccgtggacgctactgcacgcctcccacacccccaaaggctttcgttgccgctactgcaactgcagcccgagccctgtttctcactggtggcccagatgaggccatggtggagcccggattacctgcactctctgggaaaggcccgcacggctcaggttcagaaagatgcccggattggtgaagcggaagcaaagcgggatgcaggtattcgcgaagccaaagctaagcaagaaaaggtgtcagctcagtacctgtcggagatcgagatggctaaggcccagcgagactatgagcttaaaaaagctgcttatgatatcgaggtgaatacccgaagggctcaggccgacttggcttatcagctgtag

SEQ ID NO: 188017 - DNA, 579 bp, Artificial Sequence
  Description of Artificial Sequence: Synthetic coding sequence
atgttcttcacctgcggccccaacgaggccatggtggtgagcggcttctgccgtagccccccagtgatggtggctggaggccgtgtgtttgtcttaccatgtattcagcaaattcagaggatctcgctcaacaccttgactctgaacgtcaagtcagagaaagtgaagatacagggacagaacaaggaaatgctggctgccgcttgtcaaatgttcctggggaagactgaagctgagatcgcccatattgctctggagactctggagggacatcagagggcaataatggctcatatgacagtggaggagatttacaaggatcgccagaagttctctgagcaggtatttaaggttgcttcaagtgatttagtaaacatggggatttccgtggtaagttacacactcaaggacattcatgatgaccaagactacctgcattccttgggcaaggcaagaacggcgcaggtgcagaaggatgcaaggatcggagaagcggaggccaaacgggatgccgggatccgtgaagctaaagcaaaacaagagaaggtatctgctcagtatctatctgaaatcgaatag

SEQ ID NO: 188018 - DNA, 579 bp, Artificial Sequence
  Description of Artificial Sequence: Synthetic coding sequence
atgttcttcacctgcggccccaacgaggccatggtggtgagcggcttttgccgaagcccacctgtaatggttgcagggggccgggtctttgtcctgccgtgtattcagcagatccagaggatctcgctcaacacattaactctgaacgttaagtcagagaaggtcaaaattcagggacagaataaagagatgcttgctgctgcgtgtcagatgttcttaggaaagactgaggcggagatcgctcatatcgcactggaaactctcgagggacaccaacgcgcaattatggcccatatgaccgtggaggagatttacaaagaccggcagaaattcagtgagcaggtcttcaaggtggcaagcagtgaccttgtcaatatgggcatttccgtcgtgtcctatactttgaaggacatccacgacgaccaggattacctccacagcttgggcaaagcccgaacggcccaggttcagaaagatgctcggataggtgaggcggaggcgaaacgggatgctggaatacgcgaggcaaaagctaagcaggagaaggtgtctgctcaatacttatccgagattgagtag

SEQ ID NO: 188019 - DNA, 717 bp, Artificial Sequence
  Description of Artificial Sequence: Synthetic coding sequence
atgcggccctggtggagccccgtgaagatccagggccagaacaaggaaatgcttgccgcagcttgtcagatgttccttgggaaaacggaagcagagatcgcccatatcgcccttgagacactcgaaggtcaccagcgcgctataatggcccatatgacagtcgaggaaatctataaggacaggcagaaattttctgaacaggtgtttaaggtagcttcctctgatcttgtcaatatgggtatcagtgtggttagttacaccttgaaggacatccatgacgatcaagattatttgcacagtttgggaaaggctcggaccgctcaagtccaaaaggatgctaggatcggagaggcagaggccaaacgcgatgccgggatccgcgaagccaaagctaaacaagaaaaggtatccgcgcagtacctgtcagaaattgaaatggccaaggcccaaagggattacgaattgaaaaaagccgcatatgatattgaagtgaataccagacgagctcaggccgatctggcttaccagctgcaggtggcaaagaccaagcagcaaatcgaggagcaaagagtgcaggtgcaggtggtcgagcgagcccaacaggtggccgtacaggaacaggaaatcgcgcgccgggagaaagaactcgaagcgcgggtccgcaaacctgccgaggctgaaagatacaagcttgagcgacttgccgaagcagagtag

SEQ ID NO: 188020 - DNA, 579 bp, Artificial Sequence
  Description of Artificial Sequence: Synthetic coding sequence
atgttcttcacctgcggccccaacgaggccatggtggtgagcggcttttgcagatcacctccagtaatggtcgcagggggtcgtgtgtttgtactgccgtgcattcagcagattcaacggatctcccttaatacccttacccttaacgtaaaaagcgaaaaggtaaaaattcaaggacagaataaggagatgttggcagctgcctgccagatgttcctgggaaagacagaggctgagattgcacatatcgcactcgagaccctagaaggacaccagagagccattatggcacacatgacggtggaagaaatatacaaagaccgccagaaattcagcgagcaagtcttcaaagtcgcctcctccgatctcgtgaatatgggaattagcgttgtgagctacactctcaaggatatacatgatgaccaagattaccttcactccctgggtaaagcgcgcacagctcaggtgcaaaaggacgctcgcattggcgaggccgaagcgaaacgcgatgcagggatcagagaagccaaggcaaaacaagagaaagtgtctgcgcaatatttaagcgaaattgagtag

SEQ ID NO: 188021 - DNA, 579 bp, Artificial Sequence
  Description of Artificial Sequence: Synthetic coding sequence
atgttcttcacctgcggccccaacgaggccatggtggtgagcggcttctgtcgatccccacccgtcatggtcgcagggggaagggtcttcgtgttgccatgcatacagcaaatccagaggattagcctaaacacactcactctcaatgtgaagtctgagaaggtgaagatccagggtcagaacaaagaaatgctggccgccgcttgccagatgttcttgggaaagacagaagctgaaattgcccacatcgccctggaaacgctggaggggcaccaaagagcaatcatggcccacatgactgttgaagaaatttataaggacagacagaaattttctgagcaggtattcaaggtggccagttccgatctggtgaatatgggaataagcgtcgtgagttataccttaaaggacattcacgacgatcaagactatctgcactcactcggtaaggcaagaaccgcacaggtccagaaggacgctagaattggggaggccgaagctaaacgagatgcggggataagggaggctaaggccaaacaagaaaaagtctctgcacagtatctcagtgagatcgaatag

SEQ ID NO: 188022 - DNA, 438 bp, Artificial Sequence
  Description of Artificial Sequence: Synthetic coding sequence
atgggcgtggagggcaccggccggggcggctgccggctgggcggcccagatggcaagggcaagggatgggcccctgtagacgcaacggcacgactgccccacccacagcgcctttctctgccgctcttacagttacaacctgaaccctgcttttcacttgtggcccagatgcggccatggtggtcgcccgattacctgcactctcttggtaaggcccgtactgcacaggtccagaaggatgcccgcataggggaggccgaggcaaaacgagacgcaggcattcgcgaggcaaaggcaaaacaagagaaagtttccgcacagtatctctccgagatcgagatggccaaagcccaacgggattacgagctgaaaaaagctgcctatgacatagaggtaaacacccgaagggcccaggccgacttggcataccagttgtag

SEQ ID NO: 188023 - DNA, 273 bp, Artificial Sequence
  Description of Artificial Sequence: Synthetic coding sequence
tgagccaagaaggccgaggccttccagctgtaccaggaggccgcccagctggatatgctgctggagaagctgccccaagttgcggaggagatctctggacccctcacttctgcgaacaagataacgcttgtgtcctctgggagcggcacaatgggtgcagcaaaggtgacgggtgaggtgctagacatcttgacacggctgcccgagagtgtggagaggctgaccggcgttagcatctctcaagtaaatcacaagcctttgagaaccgcatag

SEQ ID NO: 188024 - DNA, 708 bp, Artificial Sequence
  Description of Artificial Sequence: Synthetic coding sequence
atgttcttcacctgcggccccaacgaggccatggtggtgagcggcttctgccggagcccgcccgtaatggtggcaggaggacgtgttttcgttctgccttgcattcagcagatccagcgcattagtctcaatacattgaccctgaacgtgaagtcggaaaaggtgtacacgagacacggagtcccgatcagcgttaccggaatcgcccaagtgaagatccagggccaaaacaaagagatgctggccgccgcgtgtcaaatgtttctgggtaaaaccgaggctgagatagctcacatcgccttagagacactggaaggccaccaaagagcgattatggctcatatgacagtggaggagatctacaaagaccgtcaaaagtttagcgaacaggtgttcaaggtcgcgagctcagacctggttaacatggggatatcagtcgtcagctacaccctgaaggacatccacgacgaccaggattacttacacagcctgggaaaggcaagaaccgcgcaggtacagaaagacgctcgcatcggtgaggctgaagcaaaaagggacgctggcataagggaggcaaaagcaaaacaagaaaaggttagtgctcagtacctatctgaaatcgagatggcaaaggcgcagagggactatgaactgaaaaaggctgcctacgatattgaagtgaacactcgacgtgcccaggctgactag

SEQ ID NO: 188025 - DNA, 717 bp, Artificial Sequence
  Description of Artificial Sequence: Synthetic coding sequence
atgcggccctggtggagccccgtgaagatccagggccagaacaaggaaatgctagccgcagcctgccagatgttccttggaaagaccgaggctgagattgctcatatagccctggagacactcgagggtcaccagcgagctatcatggcccacatgacagtcgaggagatatataaagatagacaaaagttctccgagcaggtgtttaaggtggcctctagtgacctcgtgaatatgggaatttccgtggtgtcctatacccttaaggatatacacgatgaccaggattacctgcactcattgggcaaggcccgcactgcccaagtgcagaaggatgcccgcatcggagaggcagaagccaagcgagacgcgggcatcagagaggccaaggcgaaacaggaaaaggtgagtgctcaatacctctcagagatcgagatggcgaaagcgcagcgcgactacgagcttaagaaagccgcctacgatatcgaggtaaacactagacgtgctcaggctgacctagcataccagttacaggtggcaaaaaccaaacaacagatcgaagagcaaagagtgcaggtgcaagtggtcgagcgggcccagcaggttgcggtgcaggagcaagagatcgctcgccgggaaaaagagctcgaggcccgggtgcgcaagcccgccgaggcggagagatacaagttggaacgcctggctgaggccgaatag

SEQ ID NO: 188026 - DNA, 417 bp, Artificial Sequence
  Description of Artificial Sequence: Synthetic coding sequence
gtgaagatccagggccagaacaaggagatgctggccgccgcctgccagatgttcttgggtaaaacggaggccgaaatcgcccatatcgctcttgagacccttgagggtcatcagagggccatcatggcgcacatgacggtcgaggaaatatacaaggaccgccaaaaattttccgagcaggttttcaaggtggcaagctccgatctggtaaacatgggcatctccgtggtttcatacaccctaaaagacattcacgatgatcaggactacctgcacagccttggcaaagctaggaccgctcaggtccagaaagatgccaggataggggaagcggaagcgaagagagacgctgggataagagaagcaaaggccaagcaggagaaggtgtccgcacagtatctgagcgagattgagtag

SEQ ID NO: 188027 - DNA, 558 bp, Artificial Sequence
  Description of Artificial Sequence: Synthetic coding sequence
atgttcttcacctgcggccccaacgaggccatggtggtgagcggcttctgcaggagccctccagtaatggtcgctggcggcagggtgtttgtcttgccttgcattcagcagattcagcggatatctctgaacaccttgaccttaaacgtaaaatctgaaaaggtgtacacccggcacggagtacctatctcagtgactggaatcgcccaagtgaagattcaaggccagaacaaggagatgttggcggccgcctgccaaatgttcctgggaaagaccgaagccgagatagcgcatattgccctcgaaacgttagaaggacatcagcgcgccatcatggcacatatgaccgtggaggaaatttacaaagaccggcagaagttttccgaacaagtgtttaaggtggcctcatccgacctggttaatatggggatttccgtagtctcctataccttgaaggacattcatgacgaccaagactacctgcatagcttgggaaaggcacggacagcccaggtgcagaaggatgcgcgaatcggtgaagccgaggctaaacgctag

SEQ ID NO: 188028 - DNA, 348 bp, Artificial Sequence
  Description of Artificial Sequence: Synthetic coding sequence
atgggcgtggagggcaccggccggggcggctgccggctgggcggccctgacggcaagggtaagggttgggctccagtggacgctactgcccggctgcctcatccccagcggctctcgctgccactgctgcaattgcaacctgagccctgcttcagcttggtggctcagatgcgaccatggtggtccccggattaccttcactcactaggaaaagcccgcaccgctcaagtgcagaaagatgctcggatcggcgaggctgaggctaagcgcgatgcaggcattcgggaagcaaaggctaaacaagaaaaggtttctgcacaatacctgtctgaaattgagatggcttag

SEQ ID NO: 188029 - DNA, 561 bp, Artificial Sequence
  Description of Artificial Sequence: Synthetic coding sequence
gtggccaagaccaagcagcagatcgaggagcagcgggtgcaggtgcaggtggttgaaagggcacagcaggtagcggtccaggagcaagaaattgcacggagagaaaaagagctcgaggctagagtaaggaagcctgccgaggcggaacggtataagcttgagagactggctgaggccgagaaaagccaacttatcatgcaggccgaggctgaggcagccagtgtcagaatgcgaggagaggcggaggcgtttgccatcggagcgcgtgcgagggccgaagcagagcagatggctaaaaaggctgaagcatttcaattatatcaagaggcagcgcagttggacatgctgctggaaaaactcccacaggtggcagaagagatatcagggccacttacttctgctaacaagattaccctggtttcttccggctctggcactatgggagcagccaaggtgacaggagaggtcctggacattctcactagactccccgaaagtgtcgaacgcctgaccggagtaagcatttctcaagtaaatcacaagcctctgcggactgcctag

SEQ ID NO: 188030 - DNA, 438 bp, Artificial Sequence
  Description of Artificial Sequence: Synthetic coding sequence
atgggcgtggagggcaccggccggggcggctgccggctgggcggcccagacggcaaagggaagggctgggctccagtcgacgcaaccgccagattacctcatccacagaggctgagcttgcctctgttacaactccagcctgagccgtgcttcagtttggttgcccaaatgcgcccttggtggtcccctgactatttgcatagtttggggaaagcccgtacagcccaagtgcagaaggacgccaggattggcgaggctgaggccaagagagatgccggaatcagggaagccaaagcgaaacaggagaaagtttctgcacaatatctcagcgagattgaaatggctaaagctcaaagagactacgaacttaaaaaggccgcatacgatatcgaagtgaacaccaggcgggcccaggccgatctggcatatcagttgtag

SEQ ID NO: 188031 - DNA, 558 bp, Artificial Sequence
  Description of Artificial Sequence: Synthetic coding sequence
atgttcttcacctgcggccccaacgaggccatggtggtgagcggcttttgccggtcacccccagttatggtagcaggaggcagggtgtttgtgctgccgtgcatccagcaaatccagaggattagtttaaataccctgacactgaacgtgaaatcagagaaagtctacacacggcatggtgtgcctatcagtgtgacaggaatcgcccaggtcaaaattcaggggcagaataaggaaatgcttgccgccgcttgtcagatgttcttgggaaaaaccgaggccgaaatcgcccatatcgcccttgagactctagaagggcatcagcgggccattatggctcacatgaccgtagaagagatctacaaggacaggcagaagttttccgaacaggtcttcaaggtcgcttccagcgatctggtgaacatgggaatcagcgtggtaagctatacactcaaagatattcatgatgatcaggattacttacattccttgggaaaggcccggactgctcaggtgcagaaggatgcccgcatcggtgaggccgaagcgaaacgttag

SEQ ID NO: 188032 - DNA, 633 bp, Artificial Sequence
  Description of Artificial Sequence: Synthetic coding sequence
atgttcttcacctgcggccccaacgaggccatggtggtgagcggcttttgtcggtccccaccagtgatggtggcgggaggacgggtctttgttctgccatgcattcagcagatccaaaggatctcccttaacactctgaccctcaacgttaagtcagaaaaagtgtacacacgccatggcgtgccaatttcggtcaccggaatcgctcaagtgaagatacaggggcagaacaaagagatgcttgctgctgcctgccaaatgttcctgggaaagaccgaagccgagatcgctcatattgcactggagaccctagagggacatcagagagccatcatggcacatatgaccgttgaagagatctataaagaccgtcagaaattttcagagcaggtgttcaaggtcgcttcatctgatctagtcaatatggggatcagcgtggtcagctatacactaaaagacattcacgacgatcaggattacctgcattccctggggaaagcacgcaccgctcaggtgcaaaaggacgcccgtataggagaggcagaggccaagcgcgacgcagggattagagaggcaaaagccaagcaggagaaggtgagcgcacaatacctttcagagatcgagatggcatag

SEQ ID NO: 188033 - DNA, 633 bp, Artificial Sequence
  Description of Artificial Sequence: Synthetic coding sequence
atgttcttcacctgcggccccaacgaggccatggtggtgagcggcttttgtagaagcccaccggtcatggtggccgggggtcgtgtctttgtgctcccatgcattcaacagatacagcggataagcttgaacactctcaccttaaacgtgaaaagcgagaaggtatatacacggcatggcgtccctattagcgtgacaggaatcgcgcaagtaaagattcaggggcagaataaagagatgttggctgctgcctgtcagatgtttcttggtaagacagaggcggagatcgctcacatcgccctcgaaaccctggaaggacatcagagagccatcatggcccatatgaccgtggaggaaatctataaggaccgccagaaattctccgaacaggtgtttaaggtcgcgagtagtgatctggtgaacatggggatttcagtggtgagctacacattgaaagacattcacgatgatcaagattacttacacagcctgggcaaggccaggaccgcacaagtgcagaaagacgcccgcatcggggaggccgaggcgaaacgggatgccggcatacgcgaagccaaggccaagcaagagaaggtttccgctcagtatctgagtgaaattgaaatggcgtag

SEQ ID NO: 188034 - DNA, 759 bp, Artificial Sequence
  Description of Artificial Sequence: Synthetic coding sequence
atgttcttcacctgcggccccaacgaggccatggtggtgagcggcttctgtagatcaccccctgtgatggtggccggtgggcgtgttttcgtgctgccctgtatacagcagatccaacggatatcgctgaatacccttacgctgaacgtgaagtcagaaaaagtttatactcgacacggcgtgcctattagtgtcactggcattgcccaggttaaaatccaggggcagaataaggagatgcttgccgccgcctgtcagatgtttctggggaagactgaagccgaaatagctcacatagccttggagaccctggaaggccatcagcgcgctattatggctcacatgacagtggaagaaatctacaaagatagacagaaattctccgagcaagtgtttaaggtcgccagctccgatcttgttaatatgggcatcagcgtggtgagctatacgctgaaagacatccacgatgaccaagattacctccatagtctgggcaaggccaggacagcacaggtgcaaaaggacgcccgaatcggagaagccgaagcgaagcgggatgccggcatacgcgaggccaaggccaaacaggagaaggtttctgcacagtatctgtccgaaatcgagatggctaaggcccagcgcgactacgaactgaaaaaggccgcatacgacattgaagtcaacacacggcgcgcacaagccgatcttgcttatcagctgcaggtggccaagacaaagcaacaaattgaagagcagtag

SEQ ID NO: 188035 - DNA, 444 bp, Artificial Sequence
  Description of Artificial Sequence: Synthetic coding sequence
atgcggccctggtggagccccgtgaagatccagggccagaacaaggagatgctcgccgctgcctgccagatgttcctcggaaaaactgaggccgaaatcgcccacatcgctctggagaccctggaagggcaccagcgggcaattatggctcatatgactgtggaggaaatatacaaagacagacagaagttctccgaacaagtgttcaaagtggccagctctgacttggttaatatgggaataagcgtggttagctatactctgaaagatatacatgacgatcaggactacttgcattccctagggaaagctaggacagcccaggtgcaaaaggatgcccggataggcgaggctgaggctaagcgggacgccggcattagagaggcgaaagccaaacaggaaaaggtgagcgcccagtatctgtctgaaattgaaatggcgtag

SEQ ID NO: 188036 - DNA, 549 bp, Artificial Sequence
  Description of Artificial Sequence: Synthetic coding sequence
gtgaagatccagggccagaacaaggagatgctggccgccgcctgccagatgtttctgggaaagaccgaggctgaaatcgcacatattgctctggaaaccctggaaggccaccagagggcaatcatggcacacatgactgtggaagaaatatacaaggaccggcagaagttttcagagcaggtttttaaggtggccagttcagacctcgtgaacatggggataagcgtcgtgtcctacaccctgaaggacattcatgatgatcaagactatctgcacagcctgggcaaggcccgcactgcccaggtacagaaggacgctcggatcggagaagcagaggcaaaaagggatgcaggaattagagaagcaaaggccaaacaggaaaaagtcagcgcccaatatctgtccgaaattgagatggccaaagcgcaaagagactatgagctgaagaaggcggcctacgatatcgaggttaacacgaggagggcccaggcagaccttgcttaccagctgcaagtcgccaagacaaaacaacagatcgaagaacagtag

SEQ ID NO: 188037 - DNA, 348 bp, Artificial Sequence
  Description of Artificial Sequence: Synthetic coding sequence
gtgaagatccagggccagaacaaggagatgctggccgccgcctgccagatgtttctggggaagacagaggccgagatcgcccatattgccctcgaaacgctcgagggacatcaacgagctattatggcccatatgaccgtcgaagaaatatacaaagatcgacagaagttttcagaacaggtcttcaaggtggcaagcagcgatctagtgaatatgggcatctccgtagtttcgtacaccctgaaagacattcacgatgaccaggattacctacatagtctgggcaaagcacgcaccgcacaggttcagaaagatgccagaattggggaggctgaagctaagaggtag

SEQ ID NO: 188038 - DNA, 708 bp, Artificial Sequence
  Description of Artificial Sequence: Synthetic coding sequence
atgttcttcacctgcggccccaacgaggccatggtggtgagcggcttttgtcgaagccccccagtgatggtggctggtggacgcgtgttcgtccttccttgtatccagcagattcaacggatctcactgaacactctgaccctgaatgtgaaatctgagaaagtgtacacacgtcacggagtaccgattagcgtgacaggtatcgcccaggtgaagatccagggacaaaataaggaaatgctggccgcggcctgtcaaatgtttttaggcaagaccgaagccgagatcgcacatattgctctggagactctggaaggccatcagcgagctatcatggcccatatgaccgtagaggagatttacaaggataggcagaagttctccgagcaggtgtttaaggtagcgagcagcgaccttgttaacatgggtatatcagtggtgtcttacacgcttaaagacatccatgatgaccaagattatctgcactccttggggaaggcacggacagcgcaggtgcagaaagatgccaggattggagaagccgaggcgaaaagagatgcaggtatcagggaggccaaagcaaaacaagaaaaagtgtccgcgcagtatctgagtgagatcgagatggcaaaggcccagagggactacgagctgaagaaggctgcttacgacatcgaggttaacactcgacgggctcaggcggattag

SEQ ID NO: 188039 - DNA, 1284 bp, Artificial Sequence
  Description of Artificial Sequence: Synthetic coding sequence
atgttcttcacctgcggccccaacgaggccatggtggtgagcggcttttgtaggtcaccacctgtgatggtagctggcggacgggtcttcgttctcccgtgcatacagcagattcagagaatctctctgaacaccttaacgttaaacgtcaagagcgaaaaagtatacacccggcatggcgtgcctatatctgtaactgggatcgcgcaagtcaaaatccaggggcagaataaagagatgcttgccgccgcttgccaaatgttcctcgggaaaaccgaagctgaaatcgcccatattgctcttgagacactcgaaggacatcagcgcgccataatggcgcatatgactgtcgaggaaatttacaaggaccggcagaaatttagcgaacaggtgtttaaggtggccagtagtgacctcgtgaacatgggtataagtgtggtgagctatactctcaaagatatccacgatgatcaagactacctccattccctggggaaagcaagaaccgctcaggtgcagaaggacgcacgcattggcgaggctgaggcgaagcgagacgcaggcatcagagaggcaaaggccaagcaggaaaaagtctctgctcagtatctgagcgagatcgagatggccaaagcacaaagggattacgagcttaaaaaagcagcgtatgacatagaagtcaatacccgccgggcccaggcagaccttgcctaccagttacaggtagctaagacaaagcagcaaattgaagaacaaagggtgcaggttcaggtcgtggagcgggctcaacaggttgcggtgcaggaacaggagattgctagaagggaaaaggagctggaagcacgcgtgcggaagccagccgaggctgagagatataagttggagagactggccgaagctgaaaaatctcagcttatcatgcaggctgaagccgaagccgcctcagtccgcatgcgtggggaggctgaggctttcgcgatcggcgcaagggctcgggccgaagccgaacagatggcaaagaaggctgaggccttccaactgtaccaggaggctgcccagctggatatgctgcttgagaagctcccccaggtggcggaggagatctcaggtcctttaacgagcgccaataagatcaccctcgtgagttccggaagcggcacaatgggggcagcaaaagttactggtgaagtgctggacatcctgactcgactgccagagtctgtagagaggttaaccggggtgtcaatttcccaggtgaaccacaagccactgcgaacggcttag

SEQ ID NO: 188040 - DNA, 498 bp, Artificial Sequence
  Description of Artificial Sequence: Synthetic coding sequence
gtgaagatccagggccagaacaaggagatgctggccgccgcctgccaaatgtttttgggcaagaccgaggcggaaatcgcccatatcgctctagagacgctggaaggccaccagcgagcaatcatggcacacatgaccgtggaggagatttacaaggaccgccaaaaattttcagaacaggtattcaaagttgctagtagcgatctggtgaatatgggcatctccgtcgtctcttacactctgaaagacatccatgacgatcaagattatctgcactccttaggcaaggctaggaccgcacaggtgcagaaagatgcccgaattggcgaggccgaagcaaagcgggacgcaggaattcgggaggccaaagccaagcaagagaaggtgtccgcacaatacctctccgagatagagatggccaaagctcagcgcgactatgagttgaagaaagcggcctatgatatcgaagtgaacaccaggagggctcaagccgactag

SEQ ID NO: 188041 - DNA, 438 bp, Artificial Sequence
  Description of Artificial Sequence: Synthetic coding sequence
atgggcgtggagggcaccggccggggcggctgccggctgggcggccccgacggtaagggcaagggctgggccccagtcgacgccacggcaaggctgccccacccacagcggctcagcctacccctcctgcagctccagcctgaaccgtgtttctctctggtggcccaaatgcgtccttggtggtctccagattacctgcactccctcgggaaagcaaggacagctcaggttcagaaagatgcccggatcggtgaggcagaggccaaaagggatgccggaattcgtgaggccaaagcgaagcaagagaaggtcagcgctcagtatctgtctgagatagaaatggcaaaggcgcagcgtgattacgaactgaagaaagccgcctacgatatcgaggtgaacactcggagggctcaggccgacctggcatatcaattgtag

SEQ ID NO: 188042 - DNA, 759 bp, Artificial Sequence
  Description of Artificial Sequence: Synthetic coding sequence
atgttcttcacctgcggccccaacgaggccatggtggtgagcggcttctgcaggagtccaccagtgatggtggccggagggagagtctttgtcttgccgtgcatacagcaaatccagcgcatcagcctcaacactctgaccctgaacgtcaaatcagagaaagtatacacacgccatggggtgcctataagcgtgacaggcattgcccaggtaaaaatccaaggacagaacaaagaaatgctggctgccgcctgtcagatgtttctgggcaaaaccgaagctgaaatcgcgcacatagccctcgagaccctggagggccaccagcgcgccataatggcgcatatgaccgtagaggagatttataaagaccggcagaagttctctgagcaggtgtttaaagtagccagcagcgatctcgttaatatgggcatatccgtggtcagctatacactcaaggacatacatgacgatcaggattatctacactctttgggtaaggccaggacggcgcaggttcaaaaggatgcgagaataggcgaggccgaagctaagagagatgctggcattagggaggccaaggccaaacaagagaaggtgtccgcgcagtatctcagtgagattgaaatggcgaaggctcagcgagattatgagttgaagaaggccgcttatgacatcgaagtcaatacccgacgcgcacaggcggatctggcttaccagttacaggtcgccaagacaaaacagcagattgaagagcagtag

SEQ ID NO: 188043 - DNA, 759 bp, Artificial Sequence
  Description of Artificial Sequence: Synthetic coding sequence
atgttcttcacctgcggccccaacgaggccatggtggtgagcggcttctgtcgaagtcccccagtgatggtcgcggggggccgcgtgttcgtactgccctgcatccagcagattcaaagaatcagcttgaacacactgacactgaatgtaaaaagcgagaaagtatacacccgacatggcgtaccaatcagcgtgaccgggatcgcacaagtgaaaattcagggccagaacaaggaaatgctcgctgccgcttgtcaaatgttcctaggaaagacagaagctgagatagctcacatcgcgctcgaaactctggaggggcaccaaagagctattatggctcacatgacagtggaggagatttataaggaccgacagaagtttagcgagcaggtcttcaaggtggccagtagtgacttggtgaatatgggcatatccgtggtctcatatactctgaaggacattcacgacgaccaagactacctgcacagtctggggaaagccaggaccgcccaggtccagaaagatgctcgaataggcgaggcagaggctaaaagggacgctgggattcgcgaggctaaggctaagcaagaaaaagtctccgcacagtacctgtccgagatcgagatggccaaggcccagagagactatgaacttaagaaggcagcatacgacattgaagtgaacacccgccgggctcaggctgatctggcctatcagctacaggttgcaaagacaaagcaacagatcgaagaacagtag

SEQ ID NO: 188044 - DNA, 249 bp, Artificial Sequence
  Description of Artificial Sequence: Synthetic coding sequence
gactacctgcacagcctgggcaaggcccggaccgcccaggtgcagaaggatgctcggataggtgaggccgaggcaaaacgtgacgcaggcataagggaagcgaaggcaaaacaggagaaagtctcggctcaatacctctccgaaatcgagatggcaaaagcccaaagagattacgaactcaaaaaggccgcttatgacatcgaggtgaatacaagacgtgcccaggccgatctcgcataccaactgtag

SEQ ID NO: 188045 - DNA, 558 bp, Artificial Sequence
  Description of Artificial Sequence: Synthetic coding sequence
atgttcttcacctgcggccccaacgaggccatggtggtgagcggcttctgtcggagtcccccagtcatggttgcgggaggccgtgttttcgtgctgccttgtatccagcaaattcagcggattagccttaacacgttgacattgaatgtgaaaagcgagaaagtgtatacacgccacggggtgcccattagcgttactggtatcgcccaggtgaagattcaggggcagaacaaggagatgctggcagccgcctgccagatgtttctagggaaaaccgaagctgagatcgcacacatcgctttagaaacactggaaggccaccagcgggcaataatggcccacatgaccgtcgaggagatctataaggatagacagaagttctctgaacaggtcttcaaagtagcctcctcagacttggtgaacatgggtatttccgtcgtttcatacacccttaaggatattcacgatgaccaggattatcttcactccctcggcaaggctcgaacagctcaggtgcagaaggacgccaggatcggcgaagcagaagccaagaggtag

SEQ ID NO: 188046 - DNA, 759 bp, Artificial Sequence
  Description of Artificial Sequence: Synthetic coding sequence
atgttcttcacctgcggccccaacgaggccatggtggtgagcggcttctgccggagtccacctgtaatggtggccggagggcgcgtgtttgtgctgccttgtattcaacagattcagaggatatcactgaacaccctcactcttaacgtcaaatctgagaaggtgtatactaggcatggcgtgccgatctcagtcactgggatagcccaggtgaaaattcaagggcagaacaaggaaatgctggcggctgcttgtcagatgttcctcggcaagaccgaggccgagatcgcacacattgccctggagacactcgaaggccaccagcgggctattatggcacacatgacggtggaggagatatataaagacaggcaaaaattcagcgagcaggtgttcaaggtggcttccagtgacctggttaacatggggatttcagtagtttcctatacattaaaggacattcatgatgatcaagattatttgcactccctgggcaaagcgagaactgcccaagtacagaaggatgcccggattggtgaagccgaggctaaaagagatgcgggcatcagggaggcaaaagcgaagcaagagaaggtgtcagcccaatatctgtctgagattgagatggccaaggcacaacgggattatgagctcaaaaaagcagcgtacgatattgaggtcaatacaagacgggcccaggccgacctcgcctaccagctgcaggtcgccaaaacaaaacagcaaatcgaagaacagtag

SEQ ID NO: 188047 - DNA, 558 bp, Artificial Sequence
  Description of Artificial Sequence: Synthetic coding sequence
atgttcttcacctgcggccccaacgaggccatggtggtgagcggcttctgccgttctccacctgtgatggtcgcgggagggcgcgtatttgttctgccatgcatccaacagattcaacgcatctcgctcaatactctgactctgaatgtcaagagcgaaaaggtgtacacgagacatggcgtaccaatatctgtcacgggcatcgcccaggtgaagatccagggccagaacaaggagatgttggccgccgcgtgtcaaatgtttctgggcaaaaccgaggccgagatcgctcatatcgccctcgaaaccctcgaaggccaccagagagccatcatggcacacatgactgttgaagaaatttacaaagacagacaaaaattctccgaacaggtattcaaagtggcctcatcggatcttgtgaacatgggaatcagcgtggtctcctatacactgaaagatatccatgacgaccaggactatctgcatagtttgggaaaagctaggacagcacaggttcagaaggatgcaagaataggggaggctgaagccaaaagatag

SEQ ID NO: 188048 - DNA, 717 bp, Artificial Sequence
  Description of Artificial Sequence: Synthetic coding sequence
atgcggccctggtggagccccgtgaagatccagggccagaacaaggaaatgctggcagctgcatgtcaaatgtttctggggaagactgaggccgaaatcgcccatatcgccttagagactttggagggacaccagcgcgccattatggcgcacatgacagtagaagagatctacaaagatcgacagaagttttctgagcaggtattcaaggtggcatcgagcgatctggtgaacatgggcattagcgtggtgtcttacactctgaaagatattcatgacgaccaggactatcttcacagccttggcaaagctaggactgctcaagttcagaaagacgccagaataggggaagcggaagccaaacgagatgcaggcattagggaggcgaaggcgaagcaagaaaaggtttctgctcagtacctgtcagaaatcgaaatggccaaagctcagcgcgactatgagctgaagaaagccgcctatgacatcgaagtgaataccagaagagcccaggccgatctggcttaccagcttcaggtggccaaaaccaaacagcagatagaggaacaaagggtgcaagtgcaagtggtggaacgcgcacagcaggtggcggtgcaagagcaggagatcgctcgtagggaaaaagagttagaagctcgcgtccggaagcccgccgaagccgagagatataagctggaaaggttggcggaggctgagtag

SEQ ID NO: 188049 - DNA, 1284 bp, Artificial Sequence
  Description of Artificial Sequence: Synthetic coding sequence
atgttcttcacctgcggccccaacgaggccatggtggtgagcggcttttgccggtctcctcccgtgatggtggctggagggcgagtctttgtcttaccttgcatacaacaaatccagaggatctccctgaacacactgacactgaatgtgaaaagtgaaaaagtctatacccggcatggcgtgcccatctccgttacaggtatcgctcaagtaaagatccagggccagaacaaagaaatgttggcagctgcctgtcagatgtttctgggcaagaccgaagctgagattgcccatatcgctctagagaccttagaaggtcatcaacgcgccattatggctcatatgacggtggaggagatttataaggaccggcagaagtttagcgagcaggtcttcaaggtcgcatcttccgatctagtaaacatggggatatctgtcgtctcgtacaccctgaaggatattcacgatgaccaagattacctgcatagcttgggcaaagctcgcactgcgcaagttcaaaaagatgcaagaataggcgaggctgaagccaagcgggacgccggcataagggaagctaaagccaaacaggaaaaagtatctgcccagtatttatccgagattgagatggccaaggcccagcgcgactacgaattgaaaaaggccgcatacgacatcgaagtgaatacccgtagggcgcaggctgacctggcgtaccagctgcaggtggccaagactaaacaacagattgaagagcaacgggtccaagttcaggtcgttgagagagcccagcaagtggccgtacaggagcaggagatagccaggcgagaaaaggaactggaagcaagggttcggaagcccgctgaagccgagcgatacaaactagagaggttggctgaagcagaaaagagtcagttaatcatgcaggccgaagccgaagcagcatcagtgcgtatgagaggcgaagctgaggcttttgccataggggctagggctcgggctgaagccgaacagatggcaaagaaggccgaggcgtttcagctgtaccaggaggccgcacagctggatatgctgctggaaaaactcccccaggtggcggaggagatttccggtccacttacctccgctaataaaatcactttggtatccagcggcagcggaacaatgggcgccgccaaggtgacaggggaagtactggacattctgaccaggctaccagagtctgttgaacgcctgactggggttagcatctcacaggtaaatcacaagccacttaggacggcctag

SEQ ID NO: 188050 - DNA, 579 bp, Artificial Sequence
  Description of Artificial Sequence: Synthetic coding sequence
atgttcttcacctgcggccccaacgaggccatggtggtgagcggcttctgtaggtcccccccagtcatggtagccgggggtcgggttttcgtgctgccgtgtatccagcagattcaaaggatttctctgaatacccttaccctcaatgtaaaatctgagaaggtcaagatccagggccagaataaagagatgctagctgcagcctgccaaatgtttttgggcaagactgaagctgagattgctcatatcgcattggaaaccctcgagggccatcagcgggccattatggcacacatgaccgtggaagagatctacaaggatcgtcagaaattttctgaacaggtgttcaaggtggcatctagtgacctggtgaatatgggtatctccgttgttagctataccctcaaggatatacatgatgatcaggattatttgcactccttggggaaggccaggactgctcaggtccagaaagacgcccgcataggagaggccgaggctaaaagggatgccggcattagggaggccaaggctaaacaggagaaagtaagtgcccagtacctgtccgagatcgagtag

SEQ ID NO: 188051 - DNA, 708 bp, Artificial Sequence
  Description of Artificial Sequence: Synthetic coding sequence
atgttcttcacctgcggccccaacgaggccatggtggtgagcggcttctgccgcagcccccccgtcatggtggctggcgggagagtcttcgtactgccttgcatccaacagatccagcgcatcagcttgaataccttaaccctaaatgttaaaagcgaaaaagtgtacaccagacacggcgtgccaattagcgtgactggtatcgctcaagtcaaaatccagggtcagaacaaggaaatgttagcggcggcatgtcagatgtttctcgggaagaccgaggctgagatagcccacatagcccttgagaccttggaggggcaccaaagagcaatcatggctcacatgacagtggaggagatctataaagatcgtcagaagttttccgagcaagtgtttaaggtggcgtcctcggatctggtgaatatgggaatatcagttgtgagttacaccttgaaggacatccatgacgaccaagactatttacactccctcggaaaagctcgcaccgctcaggtgcagaaggatgcgcggattggagaggccgaagcgaagagggatgccggcattagagaggctaaggccaaacaagagaaggtgtctgcccagtatctctccgagatcgagatggcaaaagctcaacgggactacgaattgaaaaaagccgcttacgacatcgaggtgaatacaaggcgggctcaggccgattag

SEQ ID NO: 188052 - DNA, 183 bp, Artificial Sequence
  Description of Artificial Sequence: Synthetic coding sequence
gtggccaagaccaagcagcagatcgaggagcagcgggtgcaggtgcaagtagtggagcgcgctcagcaagtggccgtgcaggagcaagaaatcgctagaagggagaaagagctggaagcccgggtaagaaaacccgctgaagccgagcgctacaaactggaacggcttgcagaagcagagtag

SEQ ID NO: 188053 - DNA, 717 bp, Artificial Sequence
  Description of Artificial Sequence: Synthetic coding sequence
atgcggccctggtggagccccgtgaagatccagggccagaacaaggagatgctggccgcagcctgtcagatgttccttgggaagaccgaggctgagatcgcgcacattgccttggagacgctcgagggacaccagcgagccatcatggcccacatgactgtggaagaaatctacaaagaccgacagaaattcagcgaacaggtgttcaaagtggcctccagtgatcttgtgaatatgggcatctccgtagtgtcctacaccctcaaggacattcacgatgaccaggattacctccattctttgggaaaggcccgaacggcacaggtgcaaaaggacgctcggattggcgaggccgaggctaagagggatgccggtatccgtgaggccaaggcaaagcaagagaaagtgtcagcgcaatatctctctgagatcgaaatggcaaaagcccaacgggactatgaactcaagaaagctgcatacgacatcgaggtgaacactagaagagcccaagccgacctggcttatcagctgcaggtggccaagaccaagcagcagattgaagagcagcgggttcaggtgcaggtcgtggaacgtgctcagcaagtcgccgtgcaggagcaagaaattgctagacgcgagaaggagctcgaggcccgcgtccggaaaccagctgaggccgagcgctacaagctcgagagactcgcagaggccgaatag

SEQ ID NO: 188054 - DNA, 708 bp, Artificial Sequence
  Description of Artificial Sequence: Synthetic coding sequence
atgttcttcacctgcggccccaacgaggccatggtggtgagcggcttttgccgtagccctcccgtcatggtggcgggcgggagagtgttcgttcttccttgcatccagcaaatacagcgcatctcccttaacacactgaccctgaacgtgaagtccgaaaaggtgtacacacggcatggtgtgcccatctccgtgactggaatcgcccaggtcaaaatccaaggccagaataaagagatgttggcggccgcctgtcaaatgttcttagggaagactgaggcagagattgctcatatcgccttagagacattagaggggcaccagagagcgattatggcccacatgaccgtcgaggaaatctataaggacaggcagaaattctcagagcaggtgttcaaggtggccagctctgacttggtcaatatggggattagtgtcgtgtcttacactctcaaagatatccacgatgaccaggactatctgcatagcttggggaaagccagaaccgcccaggtgcagaaagacgccagaataggagaggccgaagccaagcgcgacgcgggcataagggaggccaaggccaagcaggaaaaagtgtctgctcaatacctgtctgagatagaaatggctaaggcacaaagagattacgagctgaagaaggccgcctacgatatagaagtgaacacgcgtcgggcgcaggcagattag

SEQ ID NO: 188055 - DNA, 1074 bp, Artificial Sequence
  Description of Artificial Sequence: Synthetic coding sequence
gtgaagatccagggccagaacaaggagatgctggccgccgcctgccaaatgtttctcggaaagacagaggctgagatcgcacacatcgccttggagacgctggaaggccatcagcgagcaataatggcccatatgacggtggaggagatttataaagaccggcagaagttttcggagcaagtattcaaggtggctagttcagacctggttaatatggggattagtgttgtttcctatacattaaaggatatccacgatgaccaggactacttgcacagcttgggcaaagccaggactgctcaggtgcagaaagatgcccggattggagaggcagaagctaaacgggatgcaggcatcagggaggctaaggcaaagcaggaaaaggtgagcgctcagtatcttagtgagatcgagatggccaaggcccaacgagattatgagttgaagaaagctgcatatgatatcgaggtcaatactaggcgagcacaagcagatctcgcctaccaactccaagtggccaaaaccaagcagcagatcgaggaacagagagtgcaggtgcaagttgtcgagcgtgctcagcaggtggccgtgcaggaacaagagatcgcgagacgcgaaaaggagttagaggcccgcgttagaaaacctgccgaagccgagcggtataaactcgaacgcctggcagaggcggaaaaaagtcagctgattatgcaggcagaagccgaggcagcatctgtgaggatgagaggtgaggccgaggcctttgccattggggccagagcccgggccgaagccgaacaaatggccaagaaggccgaggcctttcaattgtaccaggaagctgcccaacttgacatgctgcttgaaaagctgccacaggtggccgaggaaatctcagggccacttacgagtgctaacaaaataaccctggtgagctcgggatccgggaccatgggtgccgcaaaggtgaccggcgaagttctggatatcctcacgcgtctgccagaatctgtcgagaggttaacaggggtcagcatctctcaggtgaaccacaagcccctgcggaccgcttag

SEQ ID NO: 188056 - DNA, 36 bp, Artificial Sequence; identical to SEQ ID NO: 81862
  Description of Artificial Sequence: Synthetic coding sequence

SEQ ID NO: 188057 - DNA, 759 bp, Artificial Sequence
  Description of Artificial Sequence: Synthetic coding sequence
atgttcttcacctgcggccccaacgaggccatggtggtgagcggcttctgccggagtccacctgtgatggtggccggagggcgggtgtttgtgctgccgtgcattcagcagatacagaggatatccctgaacactctgactctgaatgtgaagtctgagaaggtttacaccagacacggagtccccatctccgtcactggcatagcccaggtaaagatacagggccaaaataaggagatgctggccgctgcatgccagatgttcctgggaaagactgaggccgaaatcgcccacattgccctcgagacactggagggacatcagagggctatcatggcccatatgaccgtggaggaaatctacaaggaccgccaaaaattttcggagcaggtcttcaaagtcgcttccagcgacctagtgaacatggggatctccgtggtttcttacactttaaaggatattcacgacgaccaagattaccttcactccctcgggaaggctcgcacggcccaggtgcagaaggacgctcggatcggcgaggcggaggccaagagagatgccggtattcgagaagcaaaggcgaaacaagagaaggtgtccgcgcagtacttgtccgaaatagagatggccaaggcacagagagactacgagttgaaaaaagctgcttacgatatagaagtaaacactcggcgggcacaagccgacttggcataccagctgcaagtcgcaaagactaagcagcagatagaagaacaatag

SEQ ID NO: 188058 - DNA, 708 bp, Artificial Sequence
  Description of Artificial Sequence: Synthetic coding sequence
atgttcttcacctgcggccccaacgaggccatggtggtgagcggcttctgccgcagcccaccagtaatggtcgctggcggcagagtttttgtgctgccttgcattcagcagatacaaagaattagtttgaacacactgacgctgaatgttaagtctgagaaggtgtatacacgccacggcgtgccaatcagcgtcactggaattgcccaggtgaagatccagggccaaaacaaggagatgctggctgcggcctgccagatgtttctcggtaaaacagaagccgagatagctcatattgccctcgaaacgctcgagggccaccaaagggccatcatggcacacatgaccgtggaggagatctacaaagaccgccagaagttttcagagcaggtgtttaaggtggcctctagtgacctggtgaatatgggcatttccgtggtatcgtatacgcttaaggacatccatgacgatcaagactacctccacagtctaggcaaggctcgaactgcccaggtacagaaggacgcacgcatcggtgaggcagaggccaagcgcgacgccggaatccgagaagcaaaagccaagcaggaaaaagtctccgcccaatacctgtccgagatagaaatggccaaagcccagcgcgattacgaactgaaaaaagccgcctacgatattgaagtcaatacccgccgcgcccaagccgattag

SEQ ID NO: 188059 - DNA, 558 bp, Artificial Sequence
  Description of Artificial Sequence: Synthetic coding sequence
atgttcttcacctgcggccccaacgaggccatggtggtgagcggcttctgtcgctcgccccccgtgatggtcgccggaggacgagttttcgtgcttccttgtattcaacaaatccaacgtattagcttaaacacgctcactctgaatgtcaagtctgaaaaggtgtacacaagacatggcgttcccatatccgtgaccgggattgcccaagtcaaaattcagggacagaataaggaaatgttagccgccgcctgccagatgttccttggaaagacggaagctgagatcgctcacatcgctcttgaaaccctggaggggcaccagagagctatcatggctcacatgacagtcgaggaaatctataaggaccgacagaagttctctgaacaagtatttaaggttgcatctagcgatctggttaacatgggtatatccgtggtgagttacaccctcaaggatatacacgacgaccaggattatctgcactcacttgggaaagcaaggacagcccaggtccagaaggatgcccgaatcggtgaagccgaagccaagagatag

SEQ ID NO: 188060 - DNA, 438 bp, Artificial Sequence
  Description of Artificial Sequence: Synthetic coding sequence
atgggcgtggagggcaccggccggggcggctgccggctgggcggccctgacggcaagggcaagggatgggcgccagtggacgccacggcgcgcctgccccatccacagaggttgagcttgcccctcctacagctgcaaccagagccatgcttctcactggtcgctcagatgaggccttggtggtcccccgactatctgcattccctcggcaaggctcggacagctcaagttcaaaaggatgcaaggattggcgaggccgaggcgaagagggatgccggcatccgagaagcgaaagcaaaacaggaaaaagtttctgctcaatatttgagcgagatcgaaatggccaaggcccagcgcgactatgaactgaaaaaggccgcttacgacatcgaagtcaatactcggcgggcccaggcagatttggcatatcagctgtag

SEQ ID NO: 188061 - DNA, 717 bp, Artificial Sequence
  Description of Artificial Sequence: Synthetic coding sequence
atgcggccctggtggagccccgtgaagatccagggccagaacaaggagatgctggctgcagcatgccaaatgttcctgggaaagacagaggctgagattgctcacatcgcattagagacacttgaaggtcatcagagggccatcatggctcacatgaccgtggaggaaatctacaaagaccggcaaaagttttccgaacaggttttcaaagtggcaagtagcgatctggtcaacatgggaataagtgtggtgagttataccctgaaagatatccacgatgatcaggactacctgcattctttggggaaagcaagaacagctcaggtacagaaagacgcccgtataggtgaggccgaagccaagcgggatgccggaatccgggaagccaaggcaaaacaggagaaagttagcgctcagtacctgagtgagatcgagatggctaaagcacagagggactacgaactcaagaaggctgcctacgatatcgaagtgaatacccggagggcccaggcagatcttgcttatcagcttcaggtcgcaaagactaagcagcagatcgaggagcagcgcgtacaggttcaagtcgtggagagagcacagcaggttgccgttcaggaacaggagatagctcgccgcgaaaaggagcttgaggcaagagtcagaaagccagcagaggccgagcggtataaactggaaaggttagccgaggccgagtag

SEQ ID NO: 188062 - DNA, 1140 bp, Artificial Sequence
  Description of Artificial Sequence: Synthetic coding sequence
atgttcttcacctgcggccccaacgaggccatggtggtgagcggcttctgtaggagccctcccgttatggttgcaggcgggcgggttttcgtcttaccctgtatacagcagattcaacgcatctctcttaacacccttacactgaacgtgaaaagtgaaaaggtctacactcggcacggggtgcctatttcggtcaccggaattgcccaggagatttataaagatcgccagaaattcagtgaacaggtgtttaaggtagcctcatccgatctggtgaatatgggcatatcagtcgtcagttacaccctcaaggatattcacgacgatcaggattacctccactccctcggaaaagctcgcacagcacaggtgcagaaggacgcacgaataggtgaggctgaggctaaaagggacgccggcattagggaagctaaggccaagcaagaaaaagtttccgcccaatatttgagtgagatagaaatggccaaggcccagcgggactacgagttgaagaaagccgcttacgacattgaggttaataccagacgggcacaggcagacctggcctatcaactccaagtggcaaagacaaagcagcagattgaggaacagcgcgtgcaggttcaggtggtggaacgcgcccagcaggtagccgtgcaagaacaggaaatagctcgccgggagaaggaattggaggcgcgggttcgtaaacctgccgaagccgaaagatacaagctagagcggttggctgaagccgagaagagccagctgatcatgcaggccgaggcggaagctgcctcggtccgtatgagaggggaagccgaggcctttgctatcggagcaagggcccgcgcggaggcagagcaaatggctaagaaagctgaagcttttcagctgtaccaggaggctgcacagttggacatgctgcttgagaaactcccacaggtggctgaagaaatctccggccctttaaccagtgccaacaagataactctagtgtcgtccgggtcgggaactatgggagctgcaaaggtaaccggagaggtgctggacatcttgacgcgacttcctgaatcggtggagagactgacaggtgtctcaatatctcaggtcaaccataagcctctgaggaccgcctag

SEQ ID NO: 188063 - DNA, 558 bp, Artificial Sequence
  Description of Artificial Sequence: Synthetic coding sequence
atgttcttcacctgcggccccaacgaggccatggtggtgagcggcttttgcaggagccctcctgtcatggtcgccggggggcgagtcttcgtcctgccctgcatccagcagatccagagaatctctctcaacaccttgaccttgaacgtgaagagcgagaaggtctatacacgccacggggtgccaatttctgtcacgggtattgcacaggtcaagattcaggggcagaataaagagatgttagctgcagcctgtcagatgtttctcggcaagaccgaagcagaaattgcccacatcgccttggagaccctggagggtcaccaaagagcgatcatggcccacatgaccgtcgaagaaatctacaaggatagacagaagttttcagagcaggtgttcaaagtagcatcctctgacctcgtaaatatgggcatttccgtcgtctcttacaccttgaaggacatccatgacgatcaggactaccttcacagcttagggaaggccagaacagctcaagtgcagaaagacgcacgcatcggtgaggcagaggcaaaacggtag

SEQ ID NO: 188064 - DNA, 696 bp, Artificial Sequence
  Description of Artificial Sequence: Synthetic coding sequence
gtgaagatccagggccagaacaaggagatgctggccgccgcctgccagatgtttctgggcaaaaccgaagccgagatagcccatattgcactggaaacgcttgagggtcatcagagagcaattatggctcatatgaccgtcgaggaaatctataaagaccgccagaaattctctgaacaggtgtttaaggtggccagttcggatttagtgaacatggggatctccgtcgtgagctacaccctcaaggacatccacgatgaccaggactacctgcacagtctgggcaaggcgaggaccgctcaggtgcagaaggacgctcgtattggtgaggcagaggccaagcgcgatgcagggattagagaagctaaggcaaagcaggagaaagtgtcagcacaatatctgagtgagattgagatggcgaaggcacaacgcgactacgagcttaagaaagctgcatatgacattgaggtgaatactaggcgcgcccaggctgatttagcttatcagttgcaagtggccaaaacgaagcaacagatcgaggaacaacgcgttcaggtgcaggtggtggaacgcgcccaacaagttgcagttcaggagcaggaaatcgcaagaagagagaaagagctggaggctcgcgtccgcaagccagcagaagccgagaggtataagctggagcgcttagccgaggccgagtag

SEQ ID NO: 188065 - DNA, 633 bp, Artificial Sequence
  Description of Artificial Sequence: Synthetic coding sequence
atgttcttcacctgcggccccaacgaggccatggtggtgagcggcttctgcagatctccgccagttatggtggcagggggacgggtcttcgttctgccttgcatccagcaaatacagcggatttccctcaataccctgacactgaacgtcaaaagtgagaaggtctataccagacacggcgtgcccatctcggttactggaatcgcccaggtgaagatccagggccaaaacaaagaaatgttagcggctgcatgtcagatgttcctgggaaagaccgaggcggagattgcccacatcgccctggaaacgcttgaaggccaccaacgtgcaatcatggcacacatgacagtggaggaaatttataaggacaggcagaagttctccgaacaggtttttaaggtagcttccagcgaccttgtgaatatgggcatttcggtagtctcctatacactgaaggacattcacgacgatcaggattacctgcattctctgggaaaggcaaggaccgcccaggtgcagaaagacgctcggatcggcgaagccgaggccaagagggatgcgggcattcgggaggcaaaagccaaacaggagaaagtgagcgctcagtacctctccgagattgagatggcttag

SEQ ID NO: 188066 - DNA, 579 bp, Artificial Sequence
  Description of Artificial Sequence: Synthetic coding sequence
atgttcttcacctgcggccccaacgaggccatggtggtgagcggcttctgtcgcagtccacctgtgatggtggccggcggaagggtattcgttcttccttgcattcagcagattcaacgaattagcctcaatacgctcaccctcaacgtcaaaagcgaaaaggtgaaaatccaggggcaaaacaaagaaatgctcgctgccgcatgtcaaatgtttctcggcaaaacagaagccgagattgctcatatcgcgctcgaaaccttggaggggcaccaacgtgcaattatggcccatatgacagtggaggaaatttacaaggacagacagaagttctcagagcaggtcttcaaagtagcttcctctgatctcgttaatatgggtatttctgtggtatcttatacgcttaaggatatccacgatgatcaagattacctgcatagtctgggcaaagccaggaccgcccaggtacagaaagatgccaggatcggcgaggccgaggccaagcgggacgccggtatccgcgaagccaaagccaaacaggaaaaggtcagtgctcaatacctgtctgagatagaatag

SEQ ID NO: 188067 - DNA, 1140 bp, Artificial Sequence
  Description of Artificial Sequence: Synthetic coding sequence
atgttcttcacctgcggccccaacgaggccatggtggtgagcggcttctgcagatcaccccccgtgatggtagccggaggtcgggtctttgttctcccatgtattcaacagatccaacgcatcagtctgaacacactcacgctgaacgtgaagtcagagaaagtgtacactagacatggcgtgccaatttccgttactggaatcgcccaggaaatatataaggaccgccagaaattctctgagcaagtcttcaaggtggcctcttctgatttagtgaatatggggatcagtgtcgtgtcatacacactcaaggatatccacgatgatcaggactatcttcattcactgggtaaagctcggacagcccaggtacagaaggatgcccgtattggcgaagccgaggccaagagagatgctggtatccgagaggctaaggcaaaacaggagaaggtgagcgcccagtacctatcagaaattgagatggcgaaagcccagcgggactacgagctgaagaaagccgcgtacgatattgaagttaatacacgacgtgctcaagccgatctggcttaccagctccaggttgccaagactaaacagcagattgaagaacagcgcgtccaagtccaggtggtggagcgcgcccagcaggtcgctgtccaggagcaagagattgcacgccgggagaaagagctagaagccagggtacgcaagcccgcagaggctgagcgttacaaactggaaaggctggcggaggccgaaaagtctcagctgatcatgcaggctgaggccgaggccgcttccgtgagaatgcggggcgaggcggaagccttcgccataggagccagagccagagccgaagcagaacagatggctaaaaaggctgaggcatttcagctatatcaggaagctgcccagctcgatatgctactggaaaaattgcctcaggtagccgaggaaatctcaggccctttgacgtccgccaacaagatcaccctcgtgtcctctggaagcgggactatgggcgccgctaaggtaacaggagaagtactcgatatattgaccaggctgcccgagagtgtggagcgtctcactggggtttccatctcccaagtgaatcacaaacctctgcgaacagcatag

SEQ ID NO: 188068 - DNA, 1140 bp, Artificial Sequence
  Description of Artificial Sequence: Synthetic coding sequence
atgttcttcacctgcggccccaacgaggccatggtggtgagcggcttttgtaggagccctcccgtcatggtcgccggtgggagggtatttgtgctgccctgcattcagcagatccagagaatctccctgaatactttgaccctgaatgttaaaagcgagaaagtgtatactcgccacggggtgccgatctccgtcacaggtatcgctcaggaaatttataaggatcgacaaaagttctcagaacaagtgttcaaagttgctagtagcgacctggtcaatatgggcataagcgtggttagttacacgttaaaggacattcatgatgatcaggattacctccactcccttgggaaagccaggaccgcacaggtccagaaggatgcgaggattggcgaagcggaggcaaaaagagatgctggcataagagaggctaaggccaaacaggagaaggtgagcgcacaatacctctcagaaattgagatggcaaaagcacaaagagattatgagttaaagaaggcagcatatgacattgaggttaatacacgccgagcgcaggcggatttagcttaccaacttcaggtggctaagactaagcagcagatagaagagcagagggtgcaagttcaggtggtcgagagggcgcaacaggtggcagtgcaggagcaggaaatcgcacggagagaaaaggaactcgaagcaagggtgagaaagcccgccgaggcagagcgatacaagttggaacgactcgccgaggccgaaaagtcccagctgattatgcaggcggaggccgaagctgcttccgttcggatgcgaggagaagccgaagcattcgccattggggccagagcacgagccgaggctgagcagatggcgaagaaagcagaagcatttcaattgtaccaggaagccgctcaattggacatgctcctagagaagcttccacaggtggccgaagaaatatcaggtcccctgacatctgctaataaaattacgttggtgtcatccggtagtggaaccatgggggctgccaaagtgactggagaggtgctggatatcctgaccagattaccagaaagcgtcgagcgactgaccggcgtttccatcagccaggtgaatcacaagcccctgcgaaccgcctag

SEQ ID NO: 188069 - DNA, 1140 bp, Artificial Sequence
  Description of Artificial Sequence: Synthetic coding sequence
atgttcttcacctgcggccccaacgaggccatggtggtgagcggcttttgcaggtcaccgcctgtcatggtcgctggagggcgagtgttcgtgcttccctgcatccagcagatacaaagaatttcattgaacacactaacactgaatgtgaagtctgaaaaggtgtacacgaggcacggcgtgcccatctctgtgaccgggattgcccaggaaatctacaaggaccggcagaagttctccgagcaggttttcaaggtggctagctctgaccttgttaatatgggaatatctgttgtgtcttataccttgaaggacattcacgatgaccaggattatttacattcgctgggaaaggctcggacagcccaggtacagaaggacgcccgcatcggcgaggctgaggctaaaagggacgccggtattagggaggctaaggcaaagcaggaaaaagtatctgcgcaatacctgtctgaaatagaaatggctaaggctcaacgcgactacgaactgaagaaggccgcttatgatattgaagtgaacacccgaagggcccaggccgatctggcatatcaactgcaggtagcaaaaacgaagcagcagattgaagaacagcgagtgcaggtgcaggtagtggaaagagcccagcaggttgcagttcaagagcaggagatcgcaagaagggagaaagaactggaagctcgtgttcgcaaacctgcggaggctgagagatacaagctcgaaagactagctgaggctgaaaaaagtcaactgatcatgcaggctgaggccgaggctgcaagtgttcgcatgcgcggcgaggccgaggcttttgcaatcggagctagggcgcgcgcagaagctgagcagatggctaaaaaggccgaggcctttcagctctaccaggaggctgcccagctggacatgttattagaaaagcttccacaggtcgcagaggagatatcaggaccactcacttccgccaataagatcaccctggtgagcagtggctccggcaccatgggagcggcaaaggttaccggtgaggtcctggacatattgacccgcctgcccgagtctgtggaacgcctgactggagtcagtatctcacaagtgaaccataagcctcttcgtaccgcctag

SEQ ID NO: 188070 - DNA, 1140 bp, Artificial Sequence
  Description of Artificial Sequence: Synthetic coding sequence
atgttcttcacctgcggccccaacgaggccatggtggtgagcggcttctgccgttcacctccggtcatggtggccggcggccgagtcttcgtgctgccatgtattcagcagattcagaggatcagcctgaacaccttgactctgaacgtgaaatccgaaaaggtgtataccagacacggggttccaatcagcgtgaccggcattgctcaagagatctacaaggatcggcaaaaattctctgagcaggtgtttaaagtggcaagctccgacctcgtgaatatggggatcagcgtcgtgagctacaccctgaaagatatccacgacgaccaggattatcttcacagtctggggaaagccagaaccgcccaggtgcagaaggacgctagaatcggtgaagcagaagcgaagcgggacgcaggcatcagagaggctaaggccaaacaggagaaagtttctgcacagtatctgtctgagatcgagatggctaaagcccagcgcgattacgaactgaagaaagcggcctatgatatcgaagttaatacacgacgtgcccaggccgacctcgcttaccagctccaggtggctaagacgaaacaacaaatcgaggagcagagggtgcaagtgcaggtggtggaaagggcacagcaggttgccgtgcaggagcaggaaatcgcaaggagagaaaaggagctggaagcaagggtgagaaagcccgccgaagcagagcggtacaaactggaacgcctggccgaggccgagaagtcgcagctgattatgcaggctgaagctgaggccgcctctgtgcggatgagaggagaggcagaggccttcgccataggagcacgagcaagagccgaggctgaacagatggccaaaaaagccgaagccttccaactttaccaggaggcggcacaattggacatgttgcttgagaagctgccacaagtggccgaggagatctctgggcctctcactagcgccaacaaaattacactcgtgtccagtgggagcgggacaatgggcgcggctaaggtgaccggggaggtgctagacattctaacacggttgccagagagcgtggaaagactgaccggcgtcagtattagtcaggtgaatcacaaacctctgaggacagcctag

SEQ ID NO: 188071 - DNA, 861 bp, Artificial Sequence
  Description of Artificial Sequence: Synthetic coding sequence
atgggcatcagcgtggtgagctacaccctgaaggacatccacgacgaccaagattatcttcatagtttaggtaaagcccggaccgcccaggtacagaaagacgctcgcatcggtgaggcagaggcaaagagagatgccggcatcagggaggcgaaggctaagcaggaaaaggtgtccgctcagtacctgtctgaaattgagatggctaaagcacagcgcgactacgaattgaaaaaagcggcctatgacatcgaagtcaatacaaggcgggcccaggctgaccttgcatatcagttgcaggtcgctaagactaagcaacagatcgaggagcagagggtacaggtgcaagttgtcgagagagcacagcaggtggctgtgcaggagcaggagattgcaaggcgtgagaaagaattagaggcacgagtgcgaaaaccagcggaggcggaaagatacaaactggagcgcctggccgaggctgagaaaagtcaactgattatgcaggctgaggctgaggctgcatccgtgaggatgcggggggaggccgaggccttcgccatcggagcccgcgccagagccgaggccgaacagatggcaaagaaagcagaagcctttcaactctaccaagaagccgcacaactcgacatgcttcttgagaagttacctcaggtcgctgaggagataagcgggccgctcactagcgctaacaagatcactttagttagttccggatctggaacaatgggtgctgccaaggtgacaggagaggtgttggacatattaactcgtctccccgagagcgtcgaacggttgaccggcgtgtcaatttctcaagtgaatcacaagccactgcgcactgcatag

SEQ ID NO: 188072 - DNA, 1452 bp, Artificial Sequence
  Description of Artificial Sequence: Synthetic coding sequence
atgggcaactgccacaccgtgggccccaacgaggccctggtggtgtctggaggttgttgtggaagcgactataagcagtatgtctttggaggctgggcctgggcttggtggtgcatctccgacacccagcggctgagcctggaggtcatgaccatcctgtgcagatgtgaaaatatcgagacctcggagggtgtccccttgtttgtgacaggtgtggcccaggttccctgtccttgtctgctagactgcaagtggggaaatagcaagggcttttggaagctctgccaagtctgtcagataagcctggagatcatgaccctacagccacgctgtgaggatgtggagactgccgaaggtgttgctctgaccgttactggggtggcacaggttaaaatcatgacagagaaagaactgctggcagtcgcatgtgaacagttcctggggaaaaacgttcaggatatcaagaacgtggtgcttcagaccctggaaggacatcttaggtccatactgggcaccctcacagtggagcagatatatcaggaccgcgatcagttcgctaaacttgttagggaagtggctgctccagatgttggcagaatgggcatcgaaatcctgagcttcaccattaaggacgtgtacgataaagtggactatctgtcgtcactgggaaaaacccagaccgctgtggtgcagcgggacgctgatattggtgttgctgaggcagagcgcgacgctggtattagggaagcggaatgcaaaaaagagatgctcgacgtgaagttcatggcagatactaaaatcgcggattccaaacgcgcatttgaactgcagaagtctgcctttagtgaggaagttaacatcaaaacagcagaagcccagctggcttacgaactccagggcgctagggagcagcagaagattagacaggaggagattgagattgaagttgtacagaggaagaagcagatcgccgtggaggcccaggagattcttcgcactgataaggaactgattgctaccgtccggcggcccgccgaggcagaggcccaccgcattcagcagattgcagagggtgaaaaggtcaagcaggtgctcttggcccaggccgaagccgaaaaaataaggaagatcggggaggcagaggcagccgtgatcgaggcaatgggcaaagcggaggcagagcggatgaagctgaaagcagaggcttaccagaagtacggcgatgcagctaagatggcgctcgtcctggaggctctcccacagatcgctgcaaagattgctgctccactcacaaaagtggacgagattgtggtgttgagcggagacaactcaaaggtgacaagcgaggtgaaccgcctgcttgcagaattgcccgcgtccgtgcacgccctcacaggcgtagatctttctaaaatcccacttattaagaaagcaaccggtgttcaagtgtag

SEQ ID NO: 188073 - DNA, 1287 bp, Artificial Sequence
  Description of Artificial Sequence: Synthetic coding sequence
atgggcaactgccacaccgtgggccccaacgaggccctggtggtgtcagggggatgctgtgggtctgattacaaacagtacgtttttggagggtgggcctgggcctggtggtgtatctccgatacccagaggatcagcctagagattatgacccttcagcctagatgcgaggatgttgaaaccgcggagggggttgcactcaccgttactggagtggctcaggttaaaataatgaccgagaaggaactgctggccgttgcctgcgagcagtttctcggtaaaaacgtgcaggacattaaaaacgtggtgttacagacattagaagggcatctaaggagtatacttgggacccttaccgtggagcagatttatcaggaccgcgaccagtttgccaaactcgtgcgagaagtggccgcgccagacgtcgggagaatgggtattgagattttgagcttcaccattaaagatgtctatgacaaggtcgactatctgtcctccttgggcaaaacccagacggcagtcgtgcagcgtgacgctgatattggagtggcggaagctgaaagggatgccggcattcgagaggccgagtgcaagaaggaaatgttagatgtgaagttcatggccgacacaaaaatcgccgattcaaagagagcattcgagttgcagaaatccgccttttccgaggaggtgaacatcaaaaccgccgaggctcagctggcatatgagctgcagggcgcaagggagcagcagaaaattcgccaggaggaaatagagattgaagtcgtacagagaaaaaaacagatagccgtagaggctcaggaaatcctccgcactgacaaagaactcatcgcaacagtcaggcgccccgcagaagccgaggcacacaggatccagcagatcgccgaaggagagaaagtcaagcaggtgctgctggctcaggctgaagctgagaaaattcggaaaatcggagaagcagaggccgcagtcatcgaggcaatgggaaaggctgaagcagaacgtatgaaactgaaagcagaggcctaccagaagtacggagatgcagctaaaatggcgctcgtgctggaggcattgccacaaattgctgctaagatcgcagcccccctcaccaaggtggatgagattgtagtgctttcaggtgacaactctaaggtgaccagtgaggtgaaccgactgctcgccgagcttccagcttccgttcatgccctgactggagtggacctgtcaaaaataccgctaattaagaaggcgactggggtacaagtctag

SEQ ID NO: 188074 - DNA, 2982 bp, Artificial Sequence
  Description of Artificial Sequence: Synthetic coding sequence
atgcccgccctggcccgggacggcggccagctgcccctgctggtggtgttctcagccatgatctttggcacaattactaatcaggacctgcctgtgatcaagtgtgtcctcatcaaccacaagaacaatgactccagcgtggggaaatcttcctcttatcccatggtgagcgagagcccggaggatctgggctgtgctttaagacctcagagctcgggcactgtatacgaggctgccgccgtcgaggtggatgtaagcgccagcatcactttgcaggtattggtggatgcccccggcaatatctcttgcttatgggtatttaagcatagctctctcaactgtcagccccattttgatctgcagaatcggggtgttgtgtcaatggtgatcttgaagatgacagaaacccaagccggggaatatctgctgttcatccagtctgaggccaccaattacactatcctctttacagtgtcaattagaaatacactgctttacaccctgcggcgaccatatttcaggaagatggagaatcaggatgccttggtatgcatttcagagagtgtgccggagccaattgtggagtgggtgctgtgcgactctcagggcgagagctgtaaggaggagagccctgccgtagttaagaaagaagaaaaggtcctccatgagcttttcgggacagacatccgctgttgcgcccgcaatgagctgggaagagagtgtacgagattgttcaccatcgatctgaatcagacacctcagacaacccttccccagctgtttttaaaggtgggggaacccctctggatcaggtgcaaggccgtgcatgtcaatcacggctttggcctcacgtgggagctggaaaataaagcattggaggaaggcaactactttgagatgagcacctactccaccaatagaacaatgatccggatacttttcgccttcgtgagcagtgtggcaaggaatgatacaggatactacacttgtagttcaagcaagcatcccagccagtctgctctggtgaccatcgtggagaagggatttattaatgcaactaactcttccgaagattatgaaatcgaccagtacgaagagttctgcttttccgtgagattcaaggcgtatccccaaatccggtgcacctggacattcagccgaaagtccttcccttgtgagcagaaaggcctagacaacggatattctatctccaagttttgcaaccacaaacatcagccgggagagtatattttccacgcagagaatgatgacgctcaattcaccaagatgtttaccttgaatattcgtcgaaagccccaagtgctggccgaagcttctgcatcccaagcctcctgttttagcgatgggtatcctttgccatcgtggacctggaagaagtgttcagacaaatctcccaactgtaccgaagagattacagaaggagtgtggaataggaaagctaacagaaaagtgttcggccaatgggtgagttcttccacactgaacatgtctgaggccataaagggcttcctggtcaagtgttgtgcttataatagtctggggactagctgcgaaactatccttctcaactcacctggcccattccctttcattcaggacaatatctctttctatgccacaatcggcgtttgtctgctcttcatcgtggtattaactctgctgatatgccacaaatataagaaacagttcaggtatgaatctcagctgcagatggtacaagtgacggggtcctctgacaacgagtatttttacgtcgacttccgcgaatatgaatacgacctcaagtgggaatttccacgagaaaaccttgaatttggcaaagtgctgggctctggagccttcggtaaggtgatgaacgccactgcctacgggatctccaagactggagtgtccatacaagttgccgtaaagatgttgaaggagaaagcagattccagcgagagggaggcactgatgtcagagctgaaaatgatgacacagctcggttcacacgaaaatattgtgaatctcctgggcgcctgtaccttgtctggccctatctatctaatttttgaatattgttgctatggggaccttcttaactacctgaggagtaagcgggagaagtttcacagaacttggactgaaatctttaaggagcataacttcagtttttatcctacgtttcagtctcatccaaacagctcaatgcctggatccagagaagttcagatccatcctgattcagaccagatctcaggtctgcacggcaatagcttccattccgaggacgagatcgagtacgaaaatcagaagcggctcgaggaagaggaagacctgaacgtactcactttcgaggacctgctctgtttcgcctatcaagtggcgaagggcatggagttcttagagtttaagtcctgcgtgcaccgcgacctcgcagctcgcaacgtcctggtgacgcacggcaaggtggtgaaaatttgcgattttgggctcgctcgcgacatcatgagcgacagcaattacgttgtgcgaggtaatgcccgattgccagtcaagtggatggccccggaatcactcttcgaggggatttacactattaagtcagacgtatggtcatacgggatactgctgtgggaaattttttctttaggtgttaatccctacccaggaattcccgtagatgcgaacttttataaacttattcaaaatggctttaagatggatcagcccttctacgccactgaagaaatttacatcattatgcaatcgtgttgggcttttgacagccggaagagaccctcttttccgaatctgactagctttttgggttgtcaactagcggatgccgaggaagcaatgtaccaaaacgtggacggtagggtgtccgagtgcccacatacctatcagaacaggaggcccttcagtcgagagatggatctggggctgctctcaccccaggctcaagtggaggacagctag

SEQ ID NO: 188075 - DNA, 2991 bp, Artificial Sequence
  Description of Artificial Sequence: Synthetic coding sequence
atgcccgccctggcccgggacggcggccagctgcccctgctggtggttttttctgcaatgatcttcggcaccatcaccaaccaggatctaccagtcattaagtgcgtcctaattaaccacaagaacaatgattcctcagttggaaagtcgtcgtcctatcccatggtaagtgagtctccagaagatctgggatgtgcattaaggccacagagctccggtaccgtgtacgaggccgcagccgtggaggtggatgtgagcgcctcaatcaccctacaggtcctggtggatgcacccgggaatatatcctgcctgtgggtgtttaagcattcgtcactcaattgccagccccattttgacctgcaaaatcgtggcgtggttagcatggtcatccttaagatgacggaaacccaggcgggggagtatcttctgttcattcagtcagaagcgaccaactacaccatattattcactgttagcatccgcaacacactactttacaccctgagacggccgtacttccggaagatggaaaaccaggatgcgcttgtgtgcatctctgagtctgttccggagcctattgtggaatgggtgctttgtgattcacagggggagtcctgtaaagaggaaagccccgcagtggtcaagaaagaagagaaagttcttcatgaattgttcggcacagacatccgctgctgtgcccgcaacgaactcggcagggaatgcacgcgactatttaccatcgatctgaatcagaccccacaaacgaccctaccacagctcttcctcaaggtcggagaaccattatggatccggtgtaaggccgtgcacgttaaccacggcttcggcctgacctgggagctggagaacaaagcattggaagagggcaactactttgagatgtcgacgtactcaaccaaccgtaccatgatccgaattctgttcgccttcgtgagctctgtggcccgtaatgatacaggctactacacatgctcttcgtccaagcacccctctcagagtgctctggttactatcgttgaaaaaggtttcatcaatgcaacgaactcgtccgaggactacgagatcgatcagtatgaagagttttgtttctctgtcagatttaaagcgtacccccagatcaggtgcacctggactttcagccgcaagagttttccatgtgagcaaaagggcctggacaatgggtactccatttcaaagttttgtaaccacaaacaccaacccggcgaatatatatttcatgcagagaatgacgatgcacagtttacaaagatgtttacacttaatattcgccggaagcctcaagtgctcgcagaagcatccgcctcacaggcttcttgctttagtgatggctaccccttgccttcatggacctggaagaaatgcagtgacaaaagtccaaactgtactgaggagattacagagggagtgtggaatcggaaagccaatcgtaaagtctttggccaatgggtctcttcaagcaccctaaatatgagtgaggcaatcaaaggctttttggtgaagtgctgcgcttataattccctgggcacctcatgtgaaaccattctcctcaacagcccaggacctttccctttcatccaggataatatctccttttacgctacaatcggagtatgcttgttgttcatcgtcgtgttgacccttctgatttgccacaagtataaaaagcagtttcgctacgaatcgcagctgcagatggtccaggttactgggtcttccgacaatgaatacttttacgtcgattttcgggagtatgaatatgacctgaagtgggagtttcccagggagaacctcgagttcggtaaagttctgggcagcggcgcttttggtaaagttatgaatgccaccgcgtatggaatctctaagacaggtgtctccatccaggttgccgtgaagatgctcaaggagaaggctgactcgtccgaaagggaagcgctgatgtcagaactgaagatgatgacccaactgggttcccacgaaaatatcgttaacctgttaggtgcatgcactttgtccggcccaatctacctaatattcgaatattgttgctacggcgacctgctgaactacctgagaagcaaacgggaaaagtttcataggacctggaccgaaatattcaaggaacacaactttagtttttaccctacattccagagccatcctaactcttccatgccaggatccagagaagtgcagatccatcctgatagcgatcagattagcggcttgcacgggaattccttccactccgaagacgagatagaatatgagaaccagaagcggctggaagaggaggaagacctgaatgtgctgaccttcgaggatttgctttgtttcgcttaccaggtggctaaagggatggagtttctcgaatttaagtcctgcgtccatcgggacctggccgcacgaaatgtgttagtgacacatggtaaagtagttaaaatttgcgactttgggctggcccgcgatataatgagtgattctaattatgtagtgagaggcaatgtcagattagcacgcctccccgtaaagtggatggccccagagtcgctgttcgagggcatatatactatcaagagtgacgtctggtcatacgggattcttctttgggagatcttcagcctcggagtgaacccttaccccgggatccctgttgacgctaatttttataagctgatccagaatggattcaaaatggaccagcctttttatgcgaccgaagaaatttatatcattatgcagtcgtgctgggcattcgactcaaggaagcgaccttcattccctaatctgacaagtttcctggggtgtcagcttgccgatgctgaggaggcgatgtatcaaaatgtggacggaagagtgtcagaatgtccccatacgtatcagaaccgaagaccattttcacgggaaatggacctgggcctactgtctccccaggcgcaggtcgaggattcctag

SEQ ID NO: 188076 - DNA, 2859 bp, Artificial Sequence
  Description of Artificial Sequence: Synthetic coding sequence
atgcccgccctggcccgggacggcggccagctgcccctgctggtggtcttctctgccatgatttttgggacaatcaccaaccaagatctgccggtgatcaaatgcgtgttgataaaccacaaaaataatgattccagcgtcggaaaaagtagctcttatccaatggtgtctgagagcccagaggatctgggctgtgcgcttcgccctcagtctagtggaaccgtgtacgaagctgcagcagtggaagtagatgtttccgcttccatcactctgcaggtattggtcgatgctcccgggaacatttcttgtctctgggtctttaagcactcttccctgaactgccagcctcactttgatcttcagaacaggggcgtggttagtatggtgatcctgaagatgaccgaaactcaagccggtgagtacctcctttttatccagtctgaggccactaattacaccatcctgtttactgtgtcaattcgaaataccctcctgtatacgctccgccgcccctactttcgcaagatggaaaaccaagacgccttggtgtgtattagcgagtccgtgccggagccgattgttgagtgggtactgtgcgactcacaaggtgagtcctgcaaggaagaaagcccggccgtggttaagaaagaagaaaaggtcctgcatgagctcttcggaaccgatatcaggtgttgcgcacgtaacgaactggggcgcgagtgcacacggcttttcactatcgatttgaatcagaccccgcagaccaccttgccccagctcttcctgaaagtaggcgagccgttgtggatccgatgtaaggccgttcatgtgaaccacggtttcgggctgacctgggaactggagaacaaggccctggaggaaggcaactattttgagatgtccacatacagcacgaataggactatgatcagaatcctcttcgcttttgtgagctccgtggctcgaaacgacaccggatactatacatgctcttcttctaaacatcctagtcaatccgcactcgtcactatcgtcgaaaaaggcttcatcaacgccactaattcttcagaagattacgagattgaccagtatgaggaattctgcttttctgtgcgatttaaagcttacccacaaattaggtgcacctggacgtttagtaggaagagcttcccttgcgaacagaaggggctcgacaacggctactccatttcaaagttctgcaaccacaaacatcagccgggtgagtacatctttcacgccgaaaacgatgatgcccagttcaccaaaatgttcacattgaacatcagaagaaagccacaggttctcgcagaggcttcagcgtcccaggccagctgcttttccgacgggtacccactgccatcttggacatggaagaagtgctcagacaagtcccctaattgtaccgaggagatcaccgaaggggtgtggaacagaaaagctaaccgcaaagtgttcggacagtgggtctccagctctacactgaacatgagcgaagctattaaaggtttcttggttaagtgttgtgcctataattcacttggaactagctgcgaaacaatccttcttaatagccccggtccctttcccttcatccaggacaatatatctttctatgccaccataggcgtctgtctactttttatcgtggtgctcaccctcttaatctgtcataagtacaaaaagcagtttcggtacgagtcccagttgcagatggtccaggttaccggatcgtccgataatgaatacttctatgtcgattttcgtgagtacgaatacgacttgaaatgggaattcccacgggagaatctcgagttcggaaaagttctgggctcaggagcgtttggcaaggtgatgaacgctactgcctacggaataagcaaaactggcgtttctatacaggtcgcagtgaagatgctgaaggaaaaggcagatagttctgaacgggaggcactgatgtcggagctgaaaatgatgacccagctgggatctcacgaaaatatagtcaatcttctgggcgcgtgcacactgtccgggcctatttacctcatctttgagtactgttgttacggagatctgctcaattacctgcgctcaaagcgggagaagtttcaccggacctggaccgagatcttcaaggagcacaacttcagtttttaccccacctttcaaagccatccgaactccagcatgcccggctcccgcgaggttcaaattcacccggatagtgatcaaatctctggtctccatgggaactcttttcatagcgaggacgagatagagtacgagaaccaaaagcgattggaggaagaggaagacctgaacgtcctcactttcgaagacctgctttgtttcgcctatcaagtcgccaaggggatggagtttttggaatttaaatccgccaggctgccagtgaaatggatggcccccgagtccttgtttgagggaatctatacaattaaaagcgacgtatggtcatacggaattctactgtgggaaatcttcagtttgggagtgaacccctaccctggaattcccgttgatgccaatttttataagctaattcagaatggatttaagatggaccaacctttttatgcgactgaggaaatttacattatcatgcagtcctgttgggcgtttgactcgagaaaaaggccctcattccccaatcttacatcctttctcggttgtcaactggccgatgccgaggaggccatgtatcaaaatgtggacggaagagtgagtgaatgccctcacacttatcagaaccggcggccatttagtcgcgagatggacctcggtctccttagtccgcaggctcaagtggaggattcttag

SEQ ID NO: 188077 - DNA, 2253 bp, Artificial Sequence
  Description of Artificial Sequence: Synthetic coding sequence
atgtggaacctgctgcacgagaccgacagcgccgtggccaccgccaggcgtccgcgctggctctgcgccggggcactggtactggccggcggatttttcttgctagggttcttgttcgggtggtttatcaaaagctcgaacgaagccacaaacataaccccgaagcacaacatgaaggccttcctggacgagctaaaagccgagaatataaagaagtttctctataacttcacacaaattccacacctggctggcactgaacagaacttccagctggcgaagcagattcagagccagtggaaggaatttggactcgactccgtggagcttgctcattacgatgtactgctcagttaccccaataagacacaccctaattatatatccattatcaacgaggacggcaacgagatctttaatacatccctttttgagcctcctccacccggttacgagaacgtgtctgatatcgtccctcccttcagtgcattcagtccccagggcatgccagaaggtgacctggtgtatgtgaattacgcacgaaccgaggactttttcaaattagagagagacatgaagatcaactgtagtggcaaaatcgtcatcgcccgctacgggaaagtattccgtgggaacaaagtaaagaacgcacagctggccggcgccaagggggtaattctttattctgatccggcagactattttgcccctggagttaagagctatccagacggatggaatttaccaggtggcggggtgcagcgaggcaacattttaaatttgaatggcgccggtgaccctttgacaccgggctatcctgccaacgaatacgcttaccggagaggaatcgctgaagccgtaggcttgccaagcatacctgtgcaccccattggctactatgacgcccagaagctcctcgaaaagatgggcgggagtgcaccccccgattcaagctggcggggttcgctgaaggtgccttacaacgtgggtccaggatttacagggaacttttcaacacagaaagtgaagatgcacatccacagcactaacgaggtgacccgaatatacaatgtgattggaactttgcgaggcgccgttgagccggatagatacgtgattctgggtggacatcgggattcctgggtgtttgggggcatcgacccccaaagcggagccgccgtcgtgcatgagattgttcgttcttttgggactctgaagaaggaagggtggcgcccccggcgcactatccttttcgcgtcctgggacgctgaagaatttgggctgctcgggagtacagagtgggcggaggagaactctagactgctccaggagcggggggtggcctatattaatgctgacagttccattgagggaaactacactctgcgggtggattgtacgccacttatgtatagccttgtgcacaatcttactaaggaactgaaatcgcccgatgaggggttcgaaggaaagtccctttatgaatcctggactaagaaatcgcccagcccggagttctcagggatgccgcgaataagtaagctcggatctgggaatgattttgaagttttctttcagcgtctcggcatcgcaagtggccgagcacgctatactaagaattgggaaactaacaagttctccggatacccgttataccactcagtctatgagacatacgaattggtggagaagttctatgacccaatgttcaaataccatctgaccgtcgctcaggtgagaggcggaatggtgtttgagcttgccaactctatcgtcctccctttcgactgcagagattatgctgtggtgcttcgaaagtatgccgataaaatttacagcatttctatgaagcacccccaggagatgaagacgtacagcgtcagtttcgattccctgttttccgccgtaaagaactttaccgaaatcgcctcaaagtttagtgagcgcttgcaggactttgataagagtaaccctatcgtgctcagaatgatgaacgaccagctgatgttccttgagagggcctttatagacccactcggactcccagatagaccattctacaggcatgtgatctacgcaccaagctcgcataacaagtatgctggcgagagtttccccggcatctacgatgctctcttcgatattgagtctaaagtcgacccaagtaaagcctggggagaagtgaagcgccaaatctacgtagccgcctttactgttcaagccgccgcagaaacattgtcagaagtagcctag

SEQ ID NO: 188078 - DNA, 2208 bp, Artificial Sequence
  Description of Artificial Sequence: Synthetic coding sequence
atgaccgccggcagcagctaccccctgttcctggccgcctacgcctgcacaggttgcctcgccgagagattgggatggtttatcaaatcctccaatgaagcaaccaacattactccaaagcacaacatgaaagcctttctggatgaactgaaagccgagaacataaagaaatttctgtacaatttcacacaaatccctcacctcgcaggtaccgaacagaatttccagctggcaaagcagatccagtctcagtggaaagaattcgggctggactctgtggaactagcccattatgacgtgctacttagttaccctaataagactcatcccaattacatttcaatcattaatgaggatgggaacgagatcttcaacacatccctattcgaaccaccacctccaggttacgaaaacgtgagcgatatcgtcccacctttttctgccttctcaccccagggaatgccggaaggcgatctggtgtacgtcaattatgcccgaaccgaagacttctttaaactggagcgcgacatgaagattaattgctcaggcaagatcgttatcgcacgatacggaaaagtgttccgtgggaacaaagtgaaaaatgcgcagctggccggggcgaagggagtcatattgtactccgatccagctgactacttcgctcccggcgtgaaaagctatccagatgggtggaatcttcccggtggcggcgtgcaacgaggcaacattcttaacttaaacggagccggtgatccgctgacacctggatacccagcaaacgaatacgcctaccgtcgcgggattgcagaggccgtcgggctcccatcgatccccgtacacccaataggatattacgacgcacagaaactgttagaaaaaatgggaggatctgctcccccagattcttcttggagaggaagtttgaaagtaccatataacgtggggccaggcttcactggcaatttctcaacccagaaagtcaaaatgcacatccattccaccaacgaggtaactaggatttataatgtcatcggtaccctaagaggggcagtggaacctgaccggtacgtcatcctcgggggtcatcgcgactcatgggtcttcggcgggatcgatccacagtcgggggcggccgttgtccacgaaattgtgaggtcattcggcacactcaaaaaggagggctggcggcctcggcgtaccatcctcttcgcctcatgggacgccgaagaatttggcttgctggggtccaccgaatgggctgaggagaatagccggctgctgcaggagcgaggggtggcctacataaacgcggacagcagcattgagggcaactacactcttagggtggattgtacgccactgatgtactcacttgtgcacaacctcaccaaggagctgaagagtccagatgagggatttgagggcaagagtctctacgaatcctggaccaaaaaaagccctagtccagagttttctggaatgcctcgcattagcaagctgggtagcgggaacgacttcgaggtgttcttccaaaggttaggcatcgcatcaggccgagctcgttatactaagaattgggagaccaacaagttctcaggctatccgctctatcactctgtttatgaaacttacgagcttgtcgaaaagttctacgatcccatgtttaagtaccatctgaccgtcgcccaggtgcgaggagggatggtgttcgaactcgcgaactccattgttctcccttttgattgtcgagactacgcggttgtgctcagaaaatatgccgacaagatatacagcatctccatgaagcacccacaggagatgaagacttatagcgtatcctttgatagtcttttcagtgctgttaaaaactttacggaaatcgcttccaaattttccgaaagacttcaggactttgataagagcaacccgatcgtgctacgaatgatgaatgaccaactgatgttcctcgagagggcctttatcgatcctctggggctgcctgacaggcctttttaccgacatgtgatctatgctccctcctcccataataagtatgccggcgaatcattccccgggatttatgatgccctcttcgatatcgagtctaaggtggacccatccaaagcttggggggaggtcaagcgccagatctacgttgctgcttttactgtccaggcggctgcggagaccctgtcagaggtggcctag

SEQ ID NO: 188079 - DNA, 1329 bp, Artificial Sequence
  Description of Artificial Sequence: Synthetic coding sequence
atgggcggcagcgccccccccgacagcagctggcggggcagcctgaaggtgccttacaacgtggggccaggctttacaggaaatttcagtacacagaaagtaaagatgcatattcattctacgaatgaggtgacaagaatttacaacgttatcggcacacttcgcggtgcagtcgagcccgatcgttacgtcatcctgggcggacaccgcgatagttgggtgttcggtggcattgatcctcaaagcggggccgctgtggtgcacgaaattgtgcgaagcttcggcactctcaaaaaggagggatggcgcccccgaagaacgatcctgttcgccagctgggacgcggaggagttcggactgctgggatctaccgagtgggcagaagagaattcccgcttattacaagagcgaggggtggcctatatcaacgcagatagcagcatagaaggcaactacacactgcgtgtggattgtacccctctgatgtacagccttgtccacaatcttaccaaggagctgaaaagtccagatgaaggctttgaagggaagagcctttatgagtcttggacgaaaaagtcccccagcccagaattctcgggtatgcctcgcattagcaaactggggagtggcaatgactttgaggtgttcttccagcggctgggcatcgccagcggcagagctcggtatacaaaaaactgggagactaacaaatttagcggatatcccctgtatcactccgtctacgaaacctacgaactcgttgagaagttttacgatcccatgtttaagtatcatctgaccgtggcccaagtgaggggagggatggtcttcgagttagcaaacagcatcgtgctgccattcgattgtcgggactatgcagttgtgctgcgtaaatacgctgacaaaatttatagtatcagtatgaagcacccccaggagatgaaaacctatagtgtctcctttgattccctgttctcagctgtaaagaacttcacagaaatcgcctccaaatttagtgaacgtctccaggatttcgataaatctaatcccattgtgctacggatgatgaatgaccagctgatgtttctcgagcgggccttcatcgatccactcggcttgccagataggcccttctatcggcacgtgatctatgcaccctcttctcacaacaagtatgcaggggagtcttttcccgggatttacgacgccctttttgacattgagtctaaggtggatccatccaaggcatggggggaggtgaaacggcagatttatgtggcggcttttaccgttcaggcggccgctgaaacgctgtctgaagtagcatag

SEQ ID NO: 188080 - DNA, 2160 bp, Artificial Sequence
  Description of Artificial Sequence: Synthetic coding sequence
atgtggaacctgctgcacgagaccgacagcgccgtggccaccgccaggcgtccacgttggctgtgcgcaggagccctcgtgctggccggtgggttctttttacttggcttcctcttcggttggttcatcaagagtagcaacgaggctactaacatcactccgaaacataatatgaaggcctttttggacgaactaaaggccgagaatatcaagaagtttctctacaactttacacaaatcccgcacctggccgggacagagcagaacttccagctggcaaaacagatccagtcacagtggaaagaattcggtctggactctgtagagctggcccattacgacgtgctgctcagctacccaaacaagacacaccccaactacattagcattatcaatgaagatggtaacgagatctttaataccagcctgtttgagccacctccaccagggtacgagaacgtaagtgacattgtacctcctttctctgcgttctctcctcagggaatgccagagggagacctggtctacgtgaattatgctcgcaccgaagatttctttaaactggaacgcgacatgaagattaactgttcgggcaaaatagtcatcgcaaggtatgggaaagtcttccgcggaaataaggtcaagaacgcccagctcgccggggctaagggtgttatcctctatagtgacccagccgattactttgcacctggggtgaagtcctatcccgacggctggaacttgccggggggtggggtgcaacggggaaacattctgaacttgaacggtgcaggagacccactcacccccgggtacccagccaacgaatacgcctaccggcgagggatcgctgaggctgtgggcctgccatctatcccagtgcaccctataggatattatgatgcacagaagctcctcgagaaaatgggtggcagcgcccctccagattcctcatggcggggaagtttaaaggtcccctataatgtggggcctggatttacgggaaacttctccacacagaaggtgaaaatgcacatccactctaccaatgaggttacccgtatttataatgtgatcggcaccctgcggggtgcggttgagcccgatcgctatgtcatccttggaggacaccgcgactcttgggtgtttggaggaatcgatccacagtcaggagcggccgttgtccacgaaatcgtgcgtagcttcggcaccctgaaaaaggagggctggagaccgcggcgcacaatcctatttgctagctgggatgcagaggaattcggcctgctgggcagcacagaatgggctgaagaaaactcacgcttgctacaagaacggggtgtcgcttatatcaatgcagatagcagtattgaaggtaattatactctcagggtggattgtacaccgctaatgtatagccttgtgcacaatttaactaaagaactcaagagccctgacgaaggatttgaggggaagtctttgtacgagagctggactaagaaatccccctcccctgaattttcaggaatgccccggatcagcaaattaggaagtggcaacgacttcgaggttttctttcagaggctcggtattgcatctgggagagctaggtacaccaaaaactgggagacgaacaaattttcaggctacccactgtatcactctgtctatgagacgtatgagctcgtggagaagttctatgatccaatgtttaagtaccacctgacagtcgcgcaggtgcgcggcggcatggtttttgaactggccaactctattgtactgccgtttgactgtcgtgactacgcagtggtcctcaggaaatatgccgataagatctacagcatctcaatgaaacacccacaagaaatgaagacctactccgtgagtttcgatagtctgttttctgcagtgaagaacttcacggagattgccagtaagttttccgagagactccaggactttgacaaatctaagcacgtgatatacgctccatcctcccacaataaatacgctggggaatcctttccgggcatttacgacgctctgttcgacatcgagtccaaggtagacccgagcaaggcatggggggaagtaaaaagacaaatatatgtggcggcatttacggtgcaggctgcagccgagaccctgagcgaagtagcatag

SEQ ID NO: 188081 - DNA, 1638 bp, Artificial Sequence
  Description of Artificial Sequence: Synthetic coding sequence
atgtggaacctgctgcacgagaccgacagcgccgtggccaccgcccgccgccctcgctggctgtgcgctggcgccctggttctggcaggcggcttttttctgttaggattcctcttcggatggtttattaaaagcagcaatgaggctactaacatcactcccaagcataatatgaaggctttccttgacgagctaaaagccgagaacatcaagaaatttctgtataactttactcaaatacctcatttggcaggaactgagcagaatttccaattggccaaacagatccaatcccaatggaaggaattcggcctggactctgtagaacttgcccactacgatgtgctcctgagctatcctaacaagactcacccaaactacatatccattatcaacgaggatggaaacgaaattttcaatacttcactctttgaacccccgccaccaggttatgagaacgtatccgacattgtacctccatttagcgccttctcgccccagggaatgcctgagggagatctggtatatgtgaactatgcccgcactgaagacttctttaagcttgaacgggatatgaaaatcaattgcagcggaaaaatagtcatcgcccgctacggcaaggttttccgtggtaacaaggtcaaaaacgcccagcttgctggggctaagggcgtcattctctacagtgaccctgctgattatttcgctcccggggtcaagagctatccagacggctggaatctcccggggggtggagtgcagagaggcaacatcctcaatctgaacggcgcaggagatccgcttactccgggctatcctgctaacgagtacgcctataggcgggggattgccgaggccgtaggcttaccaagtatacccgtgcatccaataggctactacgatgcacaaaaactgctggagaaaatgggtggctctgccccacctgactcatcttggagaggtagccttaaggttccttataacgtgggaccaggttttactggcaatttttccacccaaaaggtgaaaatgcatatccattccaccaatgaagtgacgagaatttacaacgtcataggtaccctaaggggcgctgttgagcccgatcggtacgtgatcctggggggccaccgcgattcttgggtgttcggtggtatcgatcctcagagcggggccgccgtagttcatgagatcgtgagatcattcgggaccttaaagaaagaggatattctcgggtggaggccgcggcgcacaattctgttcgcttcctgggatgctgaggagttcggcctccttgggtctacggagtgggctgaagaaaactctagactcctacaggaaagaggggtggcgtacataaacgcggatagtagtatcgagggtaattatacattgcgagtcgattgtacacctctgatgtactcattggtccataacttgaccaaggaactgaagtcaccagatgaggggttcgagggcaagtccctctatgagagctggaccaagaaatcaccaagccctgagttttcaggaatgccccgaatctccaaactgggctccggtaacgacttcgaggtcttttttcagcgtctgggtattgcatccggccgcgccaggtatacaaagaagaaaaaatag

SEQ ID NO: 188082 - DNA, 2115 bp, Artificial Sequence
  Description of Artificial Sequence: Synthetic coding sequence
atgaccgccggcagcagctaccccctgttcctggccgcctacgcctgcacgggctgtcttgcagagcgattaggctggttcattaaatcatccaacgaggctacgaacattactcccaaacacaacatgaaggctttcctggacgaacttaaagctgagaacatcaaaaaattcctttacaacttcacccagattcctcacctcgccggcacagaacagaattttcagctggccaaacagattcaatctcagtggaaagaatttggtctcgactccgtggagcttgctcactatgatgtgctgttgtcctatcctaacaagacacatcctaactacatcagtattattaacgaggacgggaatgagatttttaacacttcactctttgaacccccaccccctggctatgaaaacgtgagtgatattgtgccacccttcagtgccttctcccctcagggcatgccggagggagacttggtctacgtgaactacgcccgtaccgaagattttttcaagctagagcgggacatgaagataaactgctcagggaaaatcgtaattgcgcgctatggtaaagtctttagaggtaacaaagtcaaaaatgctcagttagctggagctaaaggagtcatcctgtactccgaccccgctgactatttcgcccctggcgtcaagtcttatcctgatggctggaaccttccggggggtggagtccagagaggaaatatactgaacctgaacggggccggagaccccctgacacccggctaccccgccaatgagtatgcctataggcgcggtattgctgaggctgtcgggctgccctccattcctgttcacccaattggctattacgacgctcaaaagctcctggagaaaatgggtggctccgctcctcctgatagtagctggcggggctctctaaaggtgccatacaatgtagggccagggttcaccgggaacttcagcacccagaaggttaagatgcatattcactcgacaaacgaggttacaaggatatataacgtgatcggcaccctgcgcggcgcggtggaaccagacagatatgttattctgggtggacaccgggattcatgggtctttggtggaatcgacccgcagtcaggtgctgccgttgtccacgagatcgtccgctcattcggtaccctgaaaaaggaaggatggcgacccaggagaacaatcctcttcgctagttgggacgctgaagagttcgggctgctgggttctaccgagtgggctgaagaaaatagccgtttgttacaagaaagaggagtcgcatacatcaatgctgatagttctatagaaggaaactataccctgcgagttgattgtaccccgctaatgtattcgctcgttcacaacttgaccaaggagctgaagagccccgatgagggatttgaggggaagtccctgtacgagagctggactaaaaagtctccctcaccagagtttagcggaatgccccggatatctaagctggggtccggtaacgacttcgaggtgttctttcaacgtctcgggatcgcctctggccgagctcgctacactaaaaactgggagaccaacaaattttcagggtatcccctctatcactcagtttacgaaacctatgagctcgtggaaaaattctacgatcctatgtttaagtatcatttgactgtggcccaggtccgcggggggatggtgttcgagctggcaaactccatagtgctgcccttcgattgcagggactatgccgtagtgttgcgaaagtatgcggacaagatttacagcatcagtatgaagcacccacaggaaatgaaaacatactcagtttcattcgattcgctgtttagtgcagtgaaaaatttcacagaaattgcatccaagtttagtgaaagactgcaggactttgacaagagtaaacatgtgatctatgcgccctcttcacacaataaatatgccggagagtccttcccaggcatttacgatgccctgttcgatattgagtctaaggttgacccaagcaaggcttggggtgaagtgaagaggcagatctacgtggctgccttcactgtgcaagctgccgcagagactctttcggaggtggcctag

SEQ ID NO: 188083 - DNA, 774 bp, Artificial Sequence
  Description of Artificial Sequence: Synthetic coding sequence
atggcccagcggatgaccacccagctgctgctgctgctggtgtgggtggctgtggtgggcgaggctcagaccagaatagcgtgggcgagaaccgagctcctgaacgtttgcatgaacgcgaaacaccataaggagaaaccaggaccagaagataaattgcacgagcagtgtcgaccatggaggaagaacgcctgttgcagtaccaacacctcccaggaggcccacaaggatgtctcctatctgtacagatttaactggaaccactgtggagaaatggctccggcatgcaaacgacattttatacaagacacttgcctgtacgaatgtagtccgaacctggggccctggattcagcaggtggaccaatcatggcgtaaggagcgggtgctcaatgtaccactgtgtaaggaagactgtgagcagtggtgggaggactgcaggacatcctatacctgtaaatctaattggcacaaggggtggaactggactagtggttttaacaagtgcgccgtgggcgccgcctgccagcctttccacttttactttccgacacctacagtgctctgcaacgagatttggactcactcctacaaagtgtctaactatagccgagggagcggcagatgcatacaaatgtggttcgacccagcccaaggaaatcctaacgaagaagtggcccgtttctatgctgccgcgatgagtggagccgggccatgggccgcttggcctttcctgctcagcttggcgctcatgcttttatggttgcttagttag

SEQ ID NO: 188084 - DNA, 774 bp, Artificial Sequence
  Description of Artificial Sequence: Synthetic coding sequence
atggcccagcggatgaccacccagctgctgctgctgctggtgtgggtagctgtcgttggagaagcccaaacccggatcgcgtgggcccggacggaactgcttaacgtctgcatgaatgctaaacaccacaaagagaagcccggccctgaggacaaactccatgagcaatgtcgaccctggaggaagaacgcgtgctgcagcacaaatacctctcaagaagctcataaggacgtgtcttatctgtatcgattcaattggaaccattgcggagaaatggcgccagcgtgcaaaagacactttatccaggacacctgcttatatgaatgctctccgaatttaggtccctggattcagcaggttgaccaaagttggcgcaaagaaagagtgctgaatgttcctttgtgtaaggaggactgtgaacagtggtgggaagactgtaggacttcatacacatgcaagtccaactggcataagggatggaactggacttcaggtttcaataaatgcgcagtcggcgctgcttgccagcctttccacttttattttcccacccctactgtcctatgtaatgagatctggacgcacagttacaaggtctcaaattactccaggggctcgggacgatgcattcagatgtggtttgatcctgcccagggtaaccctaacgaggaggtggctcggttttacgccgcagctatgagtggtgccggaccttgggccgcctggccattccttctcagtttagctctgatgctgttgtggcttttgtcttag

SEQ ID NO: 188085 - DNA, 774 bp, Artificial Sequence
  Description of Artificial Sequence: Synthetic coding sequence
atggcccagcggatgaccacccagctgctgctgctgctggtgtgggttgcagttgtgggtgaggcacagacaagaatcgcatgggcgcgtactgagctcttgaacgtttgtatgaatgccaaacaccacaaggaaaagcccggaccggaggacaagctccacgaacagtgtagaccctggcggaagaacgcctgttgttccaccaatacaagtcaggaggcacacaaggacgtctcgtacctgtatcgattcaattggaaccattgtggggaaatggcacctgcttgtaagcggcatttcatacaagacacctgcctatatgaatgcagcccgaacttggggccgtggattcaacaggtcgatcagagctggcggaaagaaagggtgctgaacgttcccctgtgtaaagaggattgcgaacagtggtgggaagattgtcgtacatcgtatacttgtaagtcaaattggcataagggctggaactggacaagtggttttaacaaatgcgctgtgggcgccgcttgccagcctttccacttttactttccgacgcccaccgtgctctgtaacgagatatggacacattcttacaaagtgtccaattactccagagggtccggcaggtgtattcaaatgtggtttgatcccgctcagggaaaccccaatgaggaggtggcacggttctatgcagcagctatgtctggggccggcccgtgggccgcttggccgttcctactctcccttgcgcttatgctcctgtggctgttgagctag

SEQ ID NO: 188086 - DNA, 774 bp, Artificial Sequence
  Description of Artificial Sequence: Synthetic coding sequence
atggcccagcggatgaccacccagctgctgctgctgctggtgtgggtggccgttgttggtgaagcccaaaccaggattgcctgggcacggactgaattgttaaacgtctgcatgaatgccaagcatcacaaggaaaagccagggcccgaggacaagctgcacgagcagtgcagaccatggaggaagaacgcctgctgctctaccaatacgagccaggaggcacacaaggacgtctcttatctataccggttcaactggaatcactgtggcgaaatggctcccgcctgtaagcgccatttcatacaggatacctgcctgtatgagtgctctcccaacctcgggccgtggatccagcaggtggaccagtcttggaggaaagagagagttctgaatgtgcctttgtgcaaggaggattgcgaacagtggtgggaggattgtaggacctcctacacttgtaagtcaaattggcacaagggttggaactggaccagcggctttaacaaatgtgcagttggagcggcctgtcagcccttccacttctactttcccacccccaccgtcctgtgtaatgagatatggactcactcttataaggtgtccaactattctcgggggtctggaaggtgcatccaaatgtggttcgaccccgcccagggcaatccaaatgaagaggttgcccggttctatgcagcagccatgtccggcgctggcccatgggccgcctggccctttttattgtcgctggcactgatgctgctttggttactgagctag

SEQ ID NO: 188087 - DNA, 768 bp, Artificial Sequence
  Description of Artificial Sequence: Synthetic coding sequence
atggtgtggaagtggatgcccctgctgctgctgctggtgtgcgtggctaccatgtgctccgcacaagacagaactgacttactcaatgtttgtatggacgccaagcaccacaagaccaagcccgggccagaagataagctccacgatcagtgcagcccatggaaaaagaatgcttgctgcaccgccagcacatcgcaggagctgcacaaagacacctccagactgtacaattttaattgggaccattgtggcaaaatggagcctgcttgcaagagacacttcatccaggatacgtgcttatatgaatgttcccctaatctgggcccatggatacagcaagtcaaccagtcctggcgcaaggaacgcttcttggacgttcccctgtgtaaggaagattgccaacgctggtgggaggactgccataccagccatacatgtaagtcaaattggcaccgcggctgggactggacttccggagtaaataagtgccctgctggcgctttgtgtagaacatttgagtcttatttccctactcccgccgccctgtgcgaggggctctggagtcattcatataaggtgtccaattattctagaggctcaggcagatgtatccaaatgtggtttgacagtgcgcagggcaatccaaatgaggaagtcgcaaggttttatgccgccgctatgcacgttaatgccggggagatgctgcatggcaccggtgggctgttactgagtttggccctcatgcttcagttgtggctgcttggatag

SEQ ID NO: 188088 - DNA, 729 bp, Artificial Sequence
  Description of Artificial Sequence: Synthetic coding sequence
atgctgcccgccgccaccgaggtgcagctgcggctgcagggccagaaagatatggtctggaagtggatgcccctgctcctgttgcttgtttgtgtcgccaccatgtgttctgcccaggatcggacagatctcctgaacgtttgtatggacgcaaaacaccataagaccaagccaggacctgaagacaaacttcacgatcagtgtagcccgtggaaaaagaatgcttgttgcaccgccagtacctcccaggaactgcacaaggatacttcccgactctataatttcaattgggatcattgtgggaaaatggaaccagcgtgtgctacatcatcgagaacgccggtttccatgtctgcacatcccggcgctctagaccctgctggtgagtccgaactggctaaaaatgccagctggatgtgcccatatgccaaaaggactgtgtctgcaggtggcaggatagttacacctccgacacgggctcgcgccactggcacagaggatgggacagggcctcaggaactcacatccgcgcagctcggtttgagcgccgctcccttgtccccgacatcaccgctacagctgccgttcgtcaaggcgtcaggcgttacccacaccagatctgctaccacggctgaaggagccgccgccgctagtcggtgcggcttaatccagccccgggcaaccccgacccggaagtggagaggctcaatgcttcaaccctgcatgtag

SEQ ID NO: 188089 - DNA, 516 bp, Artificial Sequence
  Description of Artificial Sequence: Synthetic coding sequence
atggtgtggaagtggatgcccctgctgctgctgctggtgtgcgtggcaactatgtgcagcgctcaggacagaacagacctgttaaacgtctgtatggacgctaagcatcataaaactaagcccgggcctgaagacaaattacatgaccagtgctcaccatggaaaaagaacgcatgctgtacggccagcacttcccaggaactccataaggacacgagccggctctataacttcaactgggatcattgtggcaaaatggagccagcctgcaaacgccatttcatccaagacacatgtctgtatgagtgctcacccaacctgggaccctggatccaacaggtgaatcagtcatggagaaaggagcgcttcctcgatgttcctctgtgcaaagaagactgccagcgctggtgggaagactgccacacttctcacacatgcaaaagcaattggcatagaggctgggactggacatccggcgtgaacaaatgccccgcaggcgctctctgtcgcacctag

SEQ ID NO: 188090 - DNA, 2010 bp, Artificial Sequence
  Description of Artificial Sequence: Synthetic coding sequence
atggccctgctgctggtgagcctgctggccttcctgagcctgggctctgggtgtcatcatcgtatttgtcactgttccaaccgggttttcctgtgccaggaatcaaaggtgaccgaaattcccagcgatctaccacggaacgctatcgagctacgctttgttcttacaaagctgcgtgtcattcagaaaggagccttcagcggtttcggtgacctggagaaaattgaaatcagtcaaaacgatgtattagaggtgatagaagcagatgtgtttagcaatctgcctaaattgcacgagattagaatcgagaaagctaacaacctcctatacatcaaccccgaagcttttcagaatttacccaatttgcagtacctcctcatcagcaacaccggcatcaagcatctgcccgatgtgcacaagatccattctctccaaaaagtgcttctctggctcaacaagaacgggatccaggagatccataactgtgcctttaacgggacccagctggatgaactgaacctctcagacaataacaacctcgaagaactccctaatgacgtatttcatggtgcctcagggccggttatactcgacatctcaagaactcgcattcactccctcccaagctacggcttggagaaccttaaaaaactcagagcgcggagcacctataatttaaaaaagctcccaacattagagaaattggtcgccctgatggaggcctcactgacatatccctctcactgctgcgcctttgccaattggcggaggcagatctcagagcttcatcccatctgcaacaaatcaatcctgaggcaggaagtggactatatgacccaggcccggggccagcgatcctctttggcagaggacaacgaatcatcttattcccgcgggttcgatatgacatacacggagttcgactatgacctttgtaatgaggtggtcgacgtgacatgttctccgaagccggatgctttcaatccatgtgaggatatcatggggtacaatattttacgcgtcctgatatggtttatatctatactcgcaataacaggtaatatcattgtgctagttatacttaccacatcccagtacaaacttaccgttccacgatttctaatgtgtaatctcgcattcgcggacctatgcatcggaatttacctgctgctgatcgcgtctgtggatattcacaccaagtcccaatatcacaactatgcaatagactggcagacaggcgccggctgtgacgcagcaggcttcttcacagtattcgcctcagaactgtccgtgtacaccctgaccgctattacgctcgaacgttggcacaccattactcacgccatgcagctcgattgcaaagtccagctgcgtcacgctgcttccgtgatggtcatggggtggatcttcgcatttgccgcagctctcttcccgatcttcggaattagttcctatatgaaggtgtccatatgcctgcccatggatatagatagccccctgtctcagctctatgtgatgagcctgctggtgctgaatgtccttgccttcgtcgttatctgcggatgttacatccacatttatctaaccgttagaaaccctaacattgtatcttcatcatccgatacaagaatcgccaagagaatggcaatgttgatcttcacagacttcctatgcatggcccctatatctttctttgccatatccgcttctcttaaggtgcccctcatcactgtgagcaaggccaaaattctcctcgtgttatttcaccccattaatagttgtgccaacccctttttgtacgccatctttacaaagaattttaggcgggactttttcatcctgctcagcaaatgtggctgttatgagatgcaagctcaaatctacagaacagagacaagctctactgtccataatacccacccacgtaacggccactgcagttcggcgccaagggtaacttcaggctctacgtatatcctcgtgccactgtcccatctcgcacagaactag

SEQ ID NO: 188091 - DNA, 1902 bp, Artificial Sequence
  Description of Artificial Sequence: Synthetic coding sequence
atggccctgctgctggtgagcctgctggccttcctgagcctgggcagcggctgccatcatagaatatgtcattgctctaatcgtgtgttcctgtgccaggagtccaaggtcaccgagattccttcggatctccccagaaacgctattgaattgcggttcgtactcactaagttgagggtaatccagaagggggcattttctggattcggggatcttgagaagattgagatatcacagaatgatgtgctggaggtgattgaagcagatgtgttctccaacctaccaaagctccacgaaattcgcatcgagaaggctaacaatctgctgtatatcaaccctgaagcgtttcaaaacttgcctaatctgcagtatctgctgatttcaaataccggtatcaagcatctcccagatgtccacaagattcactctctgcagaaagttctgcttgacatccaggacaacatcaacattcacactatcgagcgtaattcctttgtaggtctctcctttgaatcagtcattttgtggttgaacaagaacggaattcaggagatccataattgtgcattcaatggcacccaattggatgaattgaatttgtctgataacaacaaccttgaagaactgccgaatgatgtgtttcatggggcctctggtcctgtaatactgagcgagttgcaccccatctgcaataagtcaatactgagacaggaggtggactatatgacccaggctcgggggcagagaagcagcctggctgaagacaatgaatcgtcatatagccgggggtttgacatgacgtacactgaattcgattatgatctgtgtaacgaggtagtggacgtaacgtgtagccccaaaccagatgcgttcaacccttgtgaagatataatggggtataatatcttgcgggttttaatttggttcatttcaatcctcgctataaccgggaatataattgtccttgttatcttgactacttcccagtacaaactgactgtgcctcggttcctgatgtgtaacttggcctttgcggatctgtgcatcgggatatacctgctgctgatcgcgtcagtggatatacatactaaaagccagtaccacaactatgcgattgactggcagactggtgcaggatgtgacgcagctggatttttcacagtattcgcctccgagttatctgtgtatactttaacggcaatcacactggagcggtggcatacaatcacacacgcaatgcagttagactgtaaagtgcagctccgacacgctgcttccgtcatggttatgggctggatcttcgcctttgcagctgccctatttccaatcttcgggatcagcagctacatgaaggtatccatctgtcttccaatggacattgattcgcctctgagtcagctgtatgtgatgagcttactggttctgaacgttctggcttttgtggtgatatgcggatgctacattcacatctacctgaccgtgcgcaatccaaacatcgtgtcatccagttccgatacaaggattgctaagcgcatggcaatgctgatctttactgattttctttgcatggcgcctatctcattttttgcaatcagcgcaagtctgaaggtgcctttaattaccgtcagcaaggcaaagattctgctggtactgtttcaccccatcaattcgtgtgccaacccttttctttacgctatttttaccaaaaatttccgtcgcgatttctttattctgctcagcaaatgcggctgttacgagatgcaggcacagatctaccggacggaaacctcttcgacagtacataacactcatccccggaatgggcattgttcatcagccccgagagtgacttcaggttctacatacatactggtgcccctctcacatctcgcgcaaaactag

SEQ ID NO: 188092 - DNA, 2088 bp, Artificial Sequence
  Description of Artificial Sequence: Synthetic coding sequence
atggccctgctgctggtgagcctgctggccttcctgagcctgggcagtggttgccaccatcgcatctgtcactgttcgaacagggtctttctttgccaggaatcgaaggtgactgagatcccttcagacctgccaagaaacgctattgaacttaggttcgtactgactaaactgcgagttatccagaaaggtgccttctcaggatttggtgacctagagaaaattgaaatctcgcaaaatgacgttttggaggtgatagaggcagatgtgtttagcaatcttcccaaacttcacgagatccgtatagagaaagcaaacaatctgctctacattaacccagaggcatttcagaacctgcctaatttgcagtatctcctgatcagtaatacgggtattaagcacctgccagatgtgcacaaaatccactccctgcagaaggtcctgctggacattcaagacaacattaatatccacaccatcgaaagaaactcatttgtaggcttgtccttcgagagtgtgatcttatggctcaacaaaaacggaatccaggagatacacaactgcgctttcaacggaacacagctggacgaattgaacctgtccgataataataacctggaggaattgcccaacgatgtgttccatggcgccagcgggcccgttatcctcgatattagtagaacgcggatccattccctgcctagttatggactggagaacctgaagaagttgagggcacgaagcacctacaacttgaagaagctgcctactttagagaaactagttgcgctgatggaagcaagcttgacttatccgtctcattgttgtgcttttgctaattggagacggcaaatcagtgagctgcatccaatttgtaacaagagtatcttgagacaagaagttgactacatgacccaggctagggggcagcgttcgtcactggctgaggataacgagagctcatatagtcgcggctttgacatgacatatacggaatttgactacgatctctgtaacgaggtggtagacgtaacttgcagcccaaagccggacgcctttaatccctgtgaagatatcatgggctataacattctccgagtgctgatttggtttattagcattctcgcaatcacaggtaacattattgtcctggtaatcctgactacctctcaatacaaactgaccgtgcctcgcttcctaatgtgcaacttggcttttgccgacctctgtataggtatttacttactccttattgctagtgtagacattcatactaaatcgcaatatcataactacgccatagactggcagaccggggctggctgtgatgctgcaggtttttttacggtctttgcttctgagctctccgtatacacacttactgcgatcactcttgagcggtggcacaccataacacatgcaatgcaactagactgcaaagttcagcttaggcatgccgcttccgtcatggtgatgggctggatcttcgctttcgccgccgcgttattcccaatcttcggcatctctagctatatgaaggtgagcatttgtttgcccatggacatcgactctccactttcacaactttatgtgatgtctcttctagttctgaatgtgctggcgtttgtggttatctgcgggtgttacatccacatttacttgacagtacggaatccaaacatcgtgagctcttcttctgataccaggatcgctaaacgtatggcgatgctcattttcacagacttcctgtgtatggcacctatcagtttttttgccatcagtgcgagcttgaaagtaccactcattacagtgtccaaggcgaagattctgctggtgctgttccaccccatcaattcgtgtgccaatccattcctgtatgccatcttcacgaaaaattttcgaagagacttctttatactgcttagcaagtgtggatgctatgagatgcaggcccagatatataggactgagacatcgtctacagtacacaacacccaccctcggaacggccactgttcctccgctcctcgggttacttctggctctacatacattctcgtccctctgagccatctggcccagaattag

SEQ ID NO: 188093 - DNA, 1296 bp, Artificial Sequence
  Description of Artificial Sequence: Synthetic coding sequence
atggaggccagcctgacctaccccagccactgctgcgccttcgccaattggcggcgacagattagtgagttgcatcctatctgtaacaaaagcatccttcggcaagaggtcgattatatgacccaagccagaggtcagaggagcagcttggcggaagacaacgaaagttcctacagccgcggcttcgacatgacatatacagaatttgattatgatctgtgtaacgaagttgtggatgtgacctgctctccaaagcccgacgcattcaacccatgtgaggatatcatgggctacaatattttgagggtcttgatctggttcatttcaatacttgctattactggaaacatcatcgtgctggtgattttgactacctctcaatacaagctgacggtgccgcggtttctgatgtgtaacttggccttcgcggacctatgcataggcatataccttcttctgattgcctctgtggacatccatactaagtcacagtatcacaactatgcgattgactggcagactggggcaggctgtgatgccgctgggttctttaccgtgttcgcttccgagttgtcagtctatacattaacagcgattacactggaacgatggcacacaatcactcatgcgatgcaacttgactgcaaagtgcaactcagacatgccgccagcgtgatggtgatgggatggatcttcgcgtttgccgctgccctctttccgatttttggtatttctagctacatgaaagttagcatttgcctaccgatggatattgactctccactgtcgcagctctatgttatgagtctgctagtcctcaacgtgttagccttcgtggtaatttgcgggtgctatatccacatctatttgactgtgagaaacccgaacatcgtgtcaagctcatcagatactagaatcgccaaacgtatggccatgctgatctttaccgacttcctctgcatggcccccatttctttcttcgccatttcagcgtcgctgaaggtgcccctcataacagtaagcaaagccaagatccttctggtgctgtttcatcccattaacagctgcgccaacccttttctgtatgcaatctttacgaaaaacttcagaagggattttttcattctgctgagtaagtgcgggtgctacgagatgcaggcgcagatttataggactgaaacctcaagcaccgtgcataatacccacccccgcaatgggcactgttcatccgctccccgggtcacaagtggctccacctatatcctcgtgccactgagccacctagctcagaactag

SEQ ID NO: 188094 - DNA, 3417 bp, Artificial Sequence
  Description of Artificial Sequence: Synthetic coding sequence
atggcccccaccctgttccagaagctgttcagcaagcggaccggcttgggggctcccggccgggatgcgcgggaccccgattgcggtttctcatggcctttacccgaattcgatcctagccaaatccgccttatcgtgtatcaggattgtgaaaggcgcgggaggaacgttctgttcgattcatcagttaaacgacgaaatgaagatattagtgtcagtaagcttggtagcgacgcccaggttaaggtgtttgggaagtgttgtcaactaaagcccggaggcgattcctcctcaagcctcgattcaagcgtcacctcctcctccgatataaaggatcagtgcttgaaatatcaaggatcccgttgttcctctgatgctaacatgctgggcgagatgatgttcggatccgtagccatgagttacaagggcagcacccttaaaatccatcaaatcagaagtcctccccagctaatgctcagcaaagtgtttacagcacgcaccggcagtagtatctgcggaagtctcaacacactgcaggactccctagagtttatcaaccaggataacaacactctcaaagccgacaataacaccgtgataaacggtcttttaggtaacattgtgcacagcaaccccatggacatgccaggccgggagctgaacgaagaccgcgacagcggcatcgcccgaagtgcctcactgtcttccctgttgatcaccccctttccttcgcccaactcatccctcacccgctcttgcgctagctcatatcagcggcgctggcgtcgctctcagacgacctcactcgaaaatggtgtgtttcctcgatggtcaattgaagagtcctttaacctctcggatgagagctgcggccccaatcccggcatcgtgaggaaaaagaaaatcgctattggcgtgatttttagtctgagtaaggacgaggatgaaaataacaaatttaacgagttcttcttctcacatttccctctttttgagagtcacatgaataaactaaagtcagcaattgagcaggccatgaagatgtctcgcagatctgccgatgcctcacagcggagtctggcatacaataggatagtcgatgcactgaatgagtttagaacgacaatttgtaacctttacactatgccccgcattggggagccggtgtggctcaccatgatgagtggcactcctgaaaagaaccacctttgttatcggttcatgaaagaattcacctttctaatggaaaacgcatccaaaaaccagtttctccccgccctgatcaccgcagtgcttactaatcatctggcatgggtgcctaccgtgatgccgaatgggcagccccctattaagatttttttagaaaaacactcaagccagtcggtggatatgctagcaaaaacacacccctacaaccccctctgggcccaactgggcgatctctatggagctatcggcagtccagttagattggctagaaccgttgtggtgggcaaacggcaggacatggttcagcggttactgtattttttgacttacttcatacgttgctccgaattacaggagacacatctcctagaaaacggcgaggatgaggcaatcgtaatgccgggtactgtgatcacaacaacccttgagaagggcgaaatcgaagagtcagaatatgtgttggtgaccatgcacaggaacaagtcttctttgctgtttaaggaaagtgaagagatacgcacacctaactgcaattgtaaatattgctcgcaccccctgctcggacagaacgtagagaatatatctcaacaggagcgcgaggacatacagaattcatctaaagaactgcttgggatttcagatgaatgccagatgattagcccctcagattgtcaggaggaaaatgctgtagacgtgaagcagtacagagacaaattgaggacatgcttcgatgccaaattagagaccgtagtatgcacggggtctgtgcctgtcgacaaatgtgctctatctgagtcaggcctggagagcactgaggaaacctggcagtccgagaagcttctggactcagacagccataccggcaaggcaatgcgaagtactggaatggtggttgaaaagaaacccccagataaaatcgtgcccgcgtcattttcatgtgaggctgctcagactaaggtaacctttttgattggcgattctatgtctcccgactccgacacagaactccgctctcaggccgtggtggaccagatcacacggcatcacacaaaaccgcttaaagaggagagaggcgccatcgaccagcatcaggagacaaaacaaacaaccaaggaccagtccggtgaatcagatactcaaaacatggtctctgaggagccgtgtgagctgccttgttggaatcactctgatcccgaatccatgtcactgttcgacgaatacttcaacgacgactccatcgaaacaaggaccattgatgatgttcctttcaagacctcaaccgactcgaaagatcattgttgcatgttggaattctccaaaatcctctgcaccaagaataataagcagaacaacgagttttgtaaatgtatcgaaaccgtcccacaagactcttgtaaaacatgtttcccacagcaggatcagcgagatacactgtctatcctcgtgccccatggagataaagagagctctgataaaaaaatcgcagtggggaccgaatgggatattccgagaaacgaatcttctgactccgccctgggagactccgaaagcgaggatacagggcatgatatgacccgacaggtgtccagctattatggcggggagcaggaggactgggctgaggaggacgagatccctttccccggcagtaagctcattgaggtgagcgcagtccagcccaacatcgcaaatttcggaagaagtctcctggggggatattgttcaagctacgtccctgattttgtgctccaaggaattggcagcgatgaacgctttcggcagtgtttgatgtcagatctcagccacgccgtgcagcacccagttctggatgaaccgatcgcggaagccgtttgcattatagcagatatggacaagtggacagtccaggtggcatcctcccaaaggagagtgacagataacaaattgggtaaggaagtgttggtgtcgtccctggtgtctaacctcctccactccacacttcaactttataaacacaacctttcacccaacttctgtgtcatgcacctggaggacagactgcaggaactgtactttaagagcaaaatgctgagcgagtaccttaggggccagatgcgggttcacgttaaagagctgggcgtggtgcttggaattgaaagctctgatttgccactgttggcagccgtcgcctctactcacagcccgtatgttgcccagatcctactctag

SEQ ID NO: 188095 - DNA, 3501 bp, Artificial Sequence
  Description of Artificial Sequence: Synthetic coding sequence
atggcccccaccctgttccagaagctgttcagcaagcggaccggcctgggtgcacctgggagggatgctcgagacccagattgcggtttcagttggccgctgcctgagtttgatcccagtcagatccgattgatcgtctaccaagactgcgaacggcgaggtcgtaatgtgctgtttgactcctctgtcaaacgaagaaatgaggatatttctgtttcgaagctcggctcagacgcacaagtgaaagtcttcggaaaatgctgccagttgaaaccaggcggtgacagttcctcgtctttagacagctccgtgacttcctcctctgacatcaaagaccaatgcctcaaatatcaggggtcgagatgctccagtgacgccaatatgctgggcgaaatgatgttcggaagcgtggccatgtcctacaagggctccacgttgaagattcaccaaattcgatctccaccccagctgatgttgagcaaagtcttcacagcgcgcactggatcctctatttgtggaagcctcaatacactccaggactcactggagtttatcaatcaggataataacactctgaaggcggacaacaataccgtgatcaacgggctactcggtaacattgggctgtctcagttttgctcgccaaggagagcttttagcgaacagggacctctgaggctgatacgtagtgcaagctttttcgccgtccactctaaccctatggatatgcctggaagagaattgaacgaggaccgtgactccgggatcgcccgatccgcaagtctctcctcgctcctgatcactccttttcctagccctaattcctccctgacccggtcctgtgcctccagttaccagcgccgctggcgaagatcgcagaccacctctcttgagaatggggtcttccctagatggtccatcgaggagtcctttaatctgagtgacgaatcctgcggaccgaacccaggaatcgtgcggaaaaagaagatcgccataggagtcattttcagcctgtctaaagacgaggatgaaaacaacaagtttaacgagttcttttttagccatttccccctgtttgagagtcatatgaataagttaaagtctgccatcgagcaggctatgaaaatgtctaggcggagcgcagacgcaagccagcgttctctggcatacaatagaattgtggatgctctgaacgagttccgcaccacaatatgtaacttatacactatgcctcgtatcggggagccagtatggctcactatgatgtcaggtactcctgagaaaaatcatctatgctaccgctttatgaaggagtttacctttctaatggaaaatgcttctaaaaatcagtttcttcccgccttgattactgcagttctgacaaatcatctcgcatgggtgcctacagtcatgccaaacggacagcctcctattaagatcttccttgagaagcattcctcccagagcgtggatatgcttgccaagacacacccttacaacccactgtgggcacagctcggggacctctacggcgcaatcgggtctcccgtgcggctggctcgcactgtcgtggtgggaaagagacaggatatggtccaaagactgctctatttcctcacttattttatacgttgtagtgagctccaggagacacacttgctggagaatggcgaggatgaagctattgttatgccaggcactgtgatcacaacaactcttgaaaaaggggaaatcgaggagtccgaatacgttctggtgactatgcacagaaataagagttccctgctgttcaaagaaagtgaagagatccgcacacccaattgcaactgcaagtattgctctcatcctttgctcgggcagaacgtggaaaacataagccagcaagagcgagaggacatccaaaatagctcaaaggaactgctgggtataagcgatgagtgccaaatgatctcccctagcgactgccaagaggagaatgccgtggacgtaaaacaataccgcgacaagctgcgaacttgcttcgacgctaagctcgagacagtcgtctgtacaggaagtgtaccagtggataaatgcgccctgtccgagagcggcctcgagagcacagaggagacctggcagagtgagaaactacttgacagcgacagtcacacgggtaaggctatgagatcgacggggatggtcgtcgagaaaaagccaccagacaaaatcgtcccagcatcattcagctgtgaggccgcccagacaaaagtgaccttcctcatcggagactccatgagtccagatagcgacacggaactgagaagccaggccgtggtagaccagattacccgtcaccatacaaagcctcttaaggaggagagaggtgccattgatcaacaccaggagactaaacagaccactaaggaccagagtggcgagagcgacactcagaatatggtgtctgaggaaccgtgcgaactgccctgctggaaccacagtgaccccgaaagcatgagcctgtttgacgagtacttcaacgatgattctattgaaacaagaaccatagatgatgtgcctttcaagacttctacggatagcaaggaccactgctgcatgctggaattttccaagatcttatgtactaaaaataacaagcagaataatgaattttgcaaatgcatcgagaccgtgccccaggattcctgcaagacttgtttcccgcagcaggatcaacgggacaccttatctatcctggttccccatggtgacaaggaatcttcagataagaagatcgccgtgggtactgagtgggacatccctcgcaacgagtcttccgacagcgcattaggtgatagtgaatcggaagacactggccacgacatgactcgtcaggtctcttcctattatggcggagagcaagaagattgggctgaggaagacgaaattcctttccctggtagcaagttgatcgaagtgtctgccgtgcagcccaacatcgccaacttcgggcgaagtcttctggggggttattgtagctcttacgttcctgactttgtccttcagggtattggcagcgatgagcggtttcggcaatgtttgatgagtgacctgagtcacgcggtccaacaccctgtgcttgatgaacccattgcggaggctgtatgcattatcgctgacatggataaatggacagtgcaagtcgcatcaagccagcgccgcgtcacagacaacaaattgggcaaggaagtgttagtgtcatccctggtttccaatctgctgcattctaccctgcagttgtataaacacaacctgagtccaaatttctgtgtgatgcatctcgaagataggcttcaggagctgtacttcaagagcaagatgctcagcgagtatttaaggggccagatgagagtgcacgtgaaagagctgggggtggtcctcgggatcgaaagcagtgatcttccactgctggctgcagtggccagcacacattcaccttacgtggcccagatccttctgtag

SEQ ID NO: 188096 - DNA, 1527 bp, Artificial Sequence
  Description of Artificial Sequence: Synthetic coding sequence
atggcccccaccctgttccagaagctgttcagcaagcggaccggcctgggcgcacccggacgggacgcaagagatcctgactgcggattcagctggccactgcctgaattcgatccttcccagatcaggcttattgtttatcaggattgcgagaggcgaggccgcaatgtcctatttgattcctctgttaaacggcgaaatgaggatatatcggtgtctaaactcggtagcgacgcccaagtcaaggtttttggtaaatgctgtcaattaaaaccagggggcgacagctcatcctccctcgactccagcgtgacttcctcttctgacattaaggatcagtgtctaaagtatcagggcagtagatgctcctcagatgcgaacatgctgggagagatgatgtttgggagcgtcgctatgtcttacaagggaagcactctgaagattcaccagattcgctcgcccccacagctgatgttgtctaaagtgttcacagcccggacaggctcttccatttgtggttccctgaatacattgcaggattctctggaattcatcaatcaagacaataatacactaaaggctgacaacaacactgttatcaatggccttctgggcaacatcgggcttagccagttttgcagcccgcgacgtgccttcagcgaacagggtccattaagactaatacggagtgcatcattttttgccgtccactccaaccctatggacatgcctggccgcgagttaaacgaagatagggactcaggcatcgcacgatccgcctctctgagttcactgctgatcactcccttcccttctccgaattcctccctgacaaggagctgtgcctcctcttaccagcgtcgctggcgcaggagccagaccacttccttagagaacggggtgtttccaaggtggtccatcgaagaaagctttaatctgtccgacgagtcctgtgggccaaaccctgggatcgtgcgcaagaaaaagatcgcgatcggcgtgatttttagcttgtccaaggatgaagatgagaacaacaagttcaacgagtttttcttttcccactttcccctcttcgaatcccacatgaacaagttaaaatctgccatagagcaggcgatgaagatgtcaaggcggtcagcagacgcatcccaacgatcccttgcttataaccggatcgtggacgccttgaacgagttccgcaccacaatatgcaacctgtacacaatgcctagaatcggcgagcctgtctggctgactatgatgagcggcacacccgaaaaaaaccacttgtgttatcgctttatgaaggaatttacttttctgatggagaacgcctctaaaaaccaattcctgcccgcactaatcacagctgtccttaccaaccatttggcttgggtgcctaccgtgatgcccaatggacagcctccaatcaaaattttcttagagaagcactcatcccagtcggtggacatgttggctaaaacacacccgtacaaccccctctgggcccagctgggaatgtag

SEQ ID NO: 188097 - DNA, 2757 bp, Artificial Sequence
  Description of Artificial Sequence: Synthetic coding sequence
atggacatgcccggccgggagctgaacgaggaccgggacagcggcatcgcgcggtcagcgtccctgtcctctctgctgatcactccatttcctagtccaaatagctcactgacaagaagttgcgcctctagctaccaacgtcggtggcgccggtcacaaaccacatcactcgaaaacggagtgttcccacgctggtctatcgaggaatcattcaacttaagcgatgaaagttgcgggcctaaccctggcatcgtaagaaagaaaaaaatcgccattggcgtcattttttctttgtctaaagatgaagacgagaataataagttcaatgagttctttttctcccactttcccctctttgagtcacacatgaacaaattgaagagcgccatcgaacaggccatgaagatgtcacggcgcagcgccgatgccagtcagcggtcccttgcgtataataggatcgtagacgctctcaacgagttccggacaaccatttgtaatttatacactatgccgcgcataggggagcccgtgtggttaactatgatgtctgggacccctgagaaaaatcatctttgctatcgtttcatgaaggagtttaccttcttgatggagaatgccagcaagaatcagtttctgcccgcgttgattaccgccgttttgacaaaccatctcgcctgggtgcccaccgtgatgcccaacgggcagcccccaattaaaatattccttgaaaagcactcaagccagagtgtcgatatgctagcgaaaactcatccgtataaccctctctgggctcaactgggcgacctatatggggccattgggtctcccgttcgtctggccagaacagtggtcgtaggaaaaaggcaggatatggtccagagattgctgtacttcctaacatacttcattaggtgttctgagctgcaagaaacccacctgctcgagaacggggaggacgaagccattgtgatgccagggactgtgataaccaccaccctggagaagggcgagatagaagagtcagaatatgtcttagtgcttctgttcaaggaaagcgaagaaattaggacccctaactgtaactgcaaatactgttcacatcctctccttgggcagaatgtcgagaatatatcccagcaggagagggaggatattcagaattcatccaaagagctgttgggcatctccgatgagtgtcagatgatcagcccctcggattgtcaggaagagaatgcagttgacgtgaagcagtacagggacaagctgaggacctgtttcgatgcgaagctggaaacagtcgtgtgtaccggatctgtccccgtggacaaatgtgcactaagcgagtcaggacttgagtccacagaagaaacgtggcagtctgagaaactgctagatagtgattctcacactgggaaggcaatgagatctactggtatggtggtggaaaagaagcctcccgacaaaatagttcccgcctccttctcgtgcgaggcggcacaaacaaaggtcactttcctgatcggagatagtatgtcacccgactctgacacggagttgcgatcgcaagctgtggtcgatcagataaccagacatcataccaagccacttaaagaggaaaggggagccatcgaccaacatcaagagaccaaacaaacaacaaaagaccaatcaggcgaaagcgatacgcagaatatggtgagcgaagaaccctgcgagctcccatgttggaatcatagtgatccagagtctatgtcccttttcgacgaatatttcaacgacgattccatcgagacgcgtactatcgatgacgtgccatttaaaacctccacagattctaaggatcattgctgcatgctcgaattcagcaagatcctatgtactaagaacaataaacagaacaacgagttctgcaagtgtatagagacagttccgcaggattcctgcaaaacgtgttttccccaacaggatcagcgggatactctgtccattctggtgcctcacggagataaagagtctagtgataagaagatagcggtgggcacagaatgggatatacctcgtaacgagagttccgacagtgccctgggcgatagtgagagtgaggatacaggacacgatatgacccgtcaggtctcaagctactacgggggagagcaagaggactgggccgaggaggatgagataccgttccccggctcgaagctgatcgaggtcagcgctgtacagccgaacattgcgaattttggacgcagcctccttggaggctattgtagtagctatgtgccagatttcgtgttacagggaatcggatcagatgagagatttcgtcagtgcttgatgagtgacctcagccacgctgtgcaacaccccgtactcgacgaacctatcgctgaggccgtgtgcataatcgcagatatggataagtggacagtgcaggttgcttctagccagcgcagggtcaccgacaacaaactaggaaaggaggtgcttgttagtagtcttgtgtccaatctgttacactctaccctccagttatacaaacacaacctgtcccccaacttctgcgtgatgcacctcgaagaccgcctccaggaattatatttcaaatccaagatgttgagcgaataccttcggggtcagatgcgtgtgcatgtgaaggaacttggagtggtgcttggaatcgaatcctcggacctacccctgttagccgctgtggcttctacccattctccctacgtggctcagatcctcctgtag

SEQ ID NO: 188098 - DNA, 3345 bp, Artificial Sequence
  Description of Artificial Sequence: Synthetic coding sequence
atggcccccaccctgctgcagaagctgttcaacaagcggggcagctcaggttcttccgcggcagccagtgctcaaggacgggcccccaaagaagggcccgcattctcttggagttgttccgagttcgacttgaacgagatcagactgattgtatatcaagactgcgataggcgggggcggcaggtgctttttgattctaaggccgtgcagaaaattgaagaggtcactgcccagaaaacagaggacgtccctatcaagattagcgcaaaatgctgtcaaggcagctcttcggtgagctcatctagttcatcctctataagctcacacagtagctctggaggctcatcacatcacgccaaggagcaactgcctaagtatcagtacacacgtcccgctagtgatgtcaatatgctcggcgaaatgatgtttggctcagtagctatgtcttataagggaagtacacttaagatccactatatcagatcgccccctcaattaatgatcagcaaggtgttttccgctcgcatgggtagcttttgtggatccactaacaatctccaggactcctttgagtacataaaccaggatcccaatttgggtaaactgaataccaaccagaactcgcttgggccttgcagaaccggaagcaacttggctcacagcactcccgtggacatgccctccaggggccagaacgaagaccgggattccggcatagcacgaagcgcctctctctcttcattattgatcacacccttcccttcacccagctcttccactagctcctcctcatcctatcagcgacgctggctccgttctcaaacaacaagtttagaaaacggcattatccctcggaggagtacagatgagaccttctctctggcagaggagacgtgctcttccaaccccgctatggttcggagaaaaaagatcgcaataagcattatattttccttgtgcgagaaagaggaggctcagcgaaacttccaggatttcttcttctctcacttccctctgttcgagtcccatatgaacaggctgaagtccgctatagagaaagctatgatctcatgtcggaagattgctgagagtagtctgagagtccagttttatgtgagtaggctcatggaagctctgggtgaattccgtggtaccatctggaacctctatagcgttccaaggattgctgagcccgtgtggctcaccatgatgtctgggactctggaaaagaatcagctgtgtcagagattcttaaaggaatttacactgctgattgaacagatcaataagaaccaattcttcgcagccttactcacagctgtactgacataccacttggcatgggtgcccactgtaatgccagtggaccatccgcccattaaagccttttctgagaagaggacttcacaaagcgtgaatatgcttgccaaaacacatccctacaacccgctgtgggcccaactgggagatttatacggggcaatcggatcccctgtgaggctgactaggaccgtggttgtgggcaagcagaaggacttagtgcaacggattctgtacgtcctgacgtatttcctgcgctgttctgaactgcaggagaatcagctcacttggtccggcaatcacggtgagggcgatcaggtcttgaacggttccaaaataattaccgcgctagaaaagggcgaagttgaggagagcgaatacgttgtgattaccgttagaaatgaaccagctttagtacctccaatactcccgcccacagcggccgaaagacacaatccctggccgaccgggtttcctgagtgcccagaaggcacagattcccgtgacctcggactcaagcctgataaagaagctaatagacgaccagagcaagggagtgaggcctgttctgctggttgcctgggccctgcttccgatgcaagctggaagccacagaacgcgttttgcggagatgaaaagaataaggaggcaccccaggatgggtcctctcgactgccctcttgcgaggtgctgggagcagggatgaaaatggaccagcaggcagtctgtgagctgttgaaggtggaaatgcctacccgcctgcccgatcgatccgtcgcatggccctgtccagaccgacacctgcgagagaaaccaagccttgaaaaagtcacatttcaaattgggagttttgcgtcccctgaatctgatttcgagagccgaatgaagaagatggaggagcgcgtcaaggcctgcggcccatccctggaggcgtctgaggccgccgacgtagcccaggaccctcaggtctctcggtccccctttaaacctggattccaggagaacgtatgctgtccacaaaaccgattatctgagggcgatgagggggaaagcgataaggggtttgctgaagacaggggaagtaggaatgatatggcggccgatatcgctggacagctgtcccatgcggctgacctcggtaccgcctcgcacggagccggcggcactggcggccgccggctcgaagctactcgcggattgtatgtaaaggcggcagaaggccctgtcctggagccagtggcccccagatgcgtccagagaggtccgggcttggtggcaggcgctaatatcccatgcggcgacgacaataaaaaggcgaattttcggacggaaggcgacatccccaggaacgagtcctctgattcagcgttgggagactccgatgacgaagcttgtgcatccgccatgcttgatctgggacatggcggagatcgcactggcggttcactcgaggtggagctgccactgccccggagccagtcaatttcaacacagaatgttaggaattttgggcgaagtctccttgccgggtattgccctacatatatgcccgacctggtcctgcatggaacagggtctgacgagaagctgaaacagtgtctcgtcgcagatttggtacacaccgttcatcacccagtactagacgagcccattgccgaggccgtgtgcatcatcgctgacacagataagtggtccgtgcaggtggctacgtcccagcgcaaggtgaccgacaacatgaagttggggcaggatgtgttagtaagcagtcaagtatcttcactgttgcaatctatcctccagctgtacaaacttcaccttcctgccgatttctgtataatgcatttagaggataggttgcaagagatgtatctgaaatctaagatgctatctgagtatcttcggggtcacaccagggtacatgtcaaggaactcggcgtggtgctgggtattgagagcaacgacctcccactcctgaccgctatcgcctctacccactccccatacgtagcacaaatactgctctag

SEQ ID NO: 188099 - DNA, 3414 bp, Artificial Sequence
  Description of Artificial Sequence: Synthetic coding sequence
atgtgcggcggcaccgccaacaccaccaaccagcccgagagctggcaggattcggcccgatgcgtgagcgatgctgtgcccggggcaggaagaatatatcgcgccctgttatgcaccaagataaagaagcacacaggtgttgataggagtactgaccacaccgagctagacaattcctggtcatgcagcgaatttgacctgaacgagataagacttatcgtctaccaggactgcgaccgccgaggccgccaggttctgttcgattctaaggccgtgcaaaagatcgaggaggtgacagcccaaaagaccgaagacgttcccattaagatttccgcaaagtgttgtcagggctcttcaagcgtcagcagttcctcgtcttcctctatctcctctcattccagtagtggaggctcctcccatcatgcaaaggaacagcttcctaaatatcagtacacaaggcccgcctcagatgttaatatgcttggtgagatgatgttcggttcagtggccatgtcatacaaggggtctacactgaagattcactatatccggtcccccccacaactcatgatcagcaaagtgttcagcgctcggatgggtagcttctgcggctcaaccaataatctgcaggattcttttgagtacataaatcaggatccaaacttgggcaagttaaacaccaaccaaaactcactcgggccttgcaggactggcagcaatctcgcacactctactcctgtggacatgccctctcgaggccagaacgaggacagggactcaggtatcgcccggagtgcctccctctcaagtctgttgattactcctttcccaagcccctcttcttcaaccagttcgtctagcagctaccagcgcagatggctgaggagccagactactagtcttgagaatggtatcatcccacggaggtctaccgatgagacgttctctctcgcagaggagacctgctcgtccaatcccgcaatggtgcgacggaaaaaaatcgcgattagcatcatcttttctctctgtgagaaagaagaggctcagcgaaattttcaggattttttttttagccacttcccgctgttcgaatctcatatgaatcggctgaagagcgccatcgaaaaggcgatgatcagctgtcgcaaaatagctgagtcttcgttgagagttcagttttatgttagccgactgatggaggcactgggagaatttcgtggcacaatctggaatctctattccgtgccccgaatagccgagcccgtctggctgaccatgatgtccggaactctcgagaaaaaccaactgtgccagcgattccttaaggaattcaccctcttgattgaacaaattaacaagaaccagttcttcgcggctctactgactgcagtattaacataccacctggcctgggttcccacagtgatgcctgtagatcatccccccatcaaagcattctctgagaagcgaaccagccagtccgtgaacatgctagccaagactcatccttacaaccctctgtgggcgcagcttggtgacttgtacggtgccatcggcagtccagttagactaacaagaactgtcgtggtcggcaaacaaaaagacctggtgcagcggatcttatacgtcttgacttacttcttgcggtgtagcgagcttcaagagaaccaacttacttggtccgggaatcacggcgagggggatcaagttttaaacggatctaaaataatcacagcactggagaagggcgaagtggaagagtccgagtacgtagtgatcacagtccggaacgagcccgcattggttccgcctatcctacccccaacagctgctgagcgccacaatccatggccaaccggatttccagagtgcccagaggggacagattccagagatctgggcttgaaacccgataaggaagcaaaccgacgcccagagcaagggagtgaggcttgcagcgccggctgtctcgggccagccagtgacgcctcatggaaaccccaaaatgcattttgcggagatgagaagaacaaagaggctcctcaggatggaagtagccgtctgccctcctgcgaagtcttgggagctggcatgaaaatggaccagcaagctgtttgtgagttgcttaaggtcgaaatgcccactaggcttcccgaccgcagcgtcgcttggccttgtccagaccgacacctgagagagaagccatccctggaaaaagtgacattccagatcgggtccttcgcctcccccgaaagtgactttgaatcacgtatgaaaaaaatggaggagagggtgaaggcctgcgggcccagcctggaagcctcggaagcagcagacgttgcccaggatcctcaggtctcaagaagtcctttcaaacccggctttcaagagaatgtgtgctgccctcagaatcgactctccgaaggagatgagggcgagtccgataaaggctttgctgaagataggggcagccggaacgacatggcagcagatattgccgggcagctctcccatgcagccgacctgggaactgcgtctcacggcgcaggcgggacaggcggacggcggttggaagctactcgcgggctgtacgtgaaggcggctgaaggccccgtgcttgaaccagtggcgccacggtgtgtgcaacgaggtcctggacttgtggccggagcaaatattccttgcggagacgataacaaaaaagccaactttcgcactgagggggatattcctagaaacgaaagttctgacagtgctctgggcgattcagatgacgaagcgtgcgcctctgccatgttggacctcggccatgggggggatcgcactggcggcagtttagaagtggaactgccattgcccagaagtcaatccatctccacgcagaacgtgcgaaacttcggcagatctttgcttgccggctactgcccgacgtatatgccagacctggtgttgcatgggaccggcagcgatgagaaactcaagcaatgtctagtggccgatctggtgcatacagtgcaccatccggtcctcgacgagcctattgcggaagcagtctgtattattgcggataccgacaagtggagcgtccaggtcgccacctctcagcggaaggtgacggacaacatgaaactgggtcaagatgttcttgtgtcatcacaggtttcctcactgctgcagtctatcctacagctgtacaagctgcatctgccggcagacttttgcatcatgcatttggaagaccggctccaggagatgtatcttaagtccaaaatgctgtctgagtatctccgggggcacacgagagtacatgtcaaggaacttggagtggtgctgggcatagaatctaatgacctgccactactgacagccattgcgtcgacccactctccctacgtcgcccaaatactgttatag

SEQ ID NO: 188100 - DNA, 2022 bp, Artificial Sequence
  Description of Artificial Sequence: Synthetic coding sequence
atgtgcggcggcaccgccaacaccaccaaccagcccgagagctggcaggatagtgcgcggtgcgtgtctgatgcagtcccaggagccggccggatttatagggccctcctgtgcaccaagatcaaaaaacacaccggcgtggaccggtccaccgaccacaccgagctggataactcctggtcatgctctgagttcgatctcaacgagatacggctaattgtttaccaggattgtgatcggcggggccgtcaggttctattcgactctaaagcagtgcagaaaatcgaagaagtgacagcacagaaaaccgaggacgtgcctataaaaatttccgcgaaatgttgtcagggatcctcctccgtcagcagttctagctcctcgagtatctcgagccactcaagtagcgggggttcctcccatcacgctaaagaacagttgcctaaataccagtacaccagacctgcctctgacgttaacatgcttggcgagatgatgtttgggagtgttgcaatgtcctataagggatctacgctcaagattcactatattcgcagcccaccacaattaatgatatcgaaagtcttctccgcgcggatgggtagcttttgtggctcaactaacaacctacaagattctttcgagtacatcaatcaggatcccaatttgggcaaactgaacactaatcaaaatagcttagggccctgccgaaccggctcaaacctggcgcatagtacccctgtcgacatgccatcgcggggacagaatgaggatagggactccgggatcgcaaggtctgccagcctgagctctttgttgatcaccccattccccagtccgagcagttccacctcatccagctcttcataccagcgcaggtggctgagaagtcagaccacctcccttgagaatgggattatacctaggaggtctaccgacgaaacgttctccttggcagaggagacttgctcttccaaccccgccatggtccgccggaaaaagattgctatctcaatcattttcagcctatgcgaaaaggaagaagcccaacgcaatttccaggacttctttttcagccacttccctctgtttgaatctcacatgaaccgcttaaagtctgcgatcgagaaagccatgatcagctgtcgcaaaattgcagaatctagtctgagggtgcagttttatgtgagcaggctcatggaggccctgggtgagttccgggggactatctggaatctgtactccgtccctcgcatcgccgagcccgtgtggttgaccatgatgtccggcacactggaaaagaatcaactgtgtcagcgatttctgaaggagttcacattgctgatcgagcagataaacaaaaaccaattcttcgctgcgctcctaacagcagttcttacgtatcacttggcttgggttccaaccgtcatgcctgtcgaccatccgcccattaaggcctttagcgaaaagcggacgtcccaaagcgtaaatatgcttgctaaaacccatccatacaacccactgtgggcccagctgggagatctttatggcgctattgggtcccctgtgagactgaccagaacagtggttgttggcaagcagaaggacctggttcagcggatactgtatgtgctgacttacttcttgaggtgctccgagctgcaagagaaccagctgacctggtcaggaaatcacggggaaggcgaccaggtcctgaacggctctaagattattactgcactggagaagggggaggtggaagaaagcgagtatgtggtgattacagtccggaacgagcctgccttggtacctcctattctccctcccacagctgctgagcgacataacccatggcctacaggctttcctgaatgcccagaaggaacggactcccgggatctgggcctgaaaccagataaagaggccaaccgccgcccagagcaggggtccgaggcctgttctgccggctgtcttggccccgcatcagatgcgtcctggaaaccccagaatgccttttgtgggtag

SEQ ID NO: 188101 - DNA, 660 bp, Artificial Sequence
  Description of Artificial Sequence: Synthetic coding sequence
atggaccccgcccccggcgtgctggacccccgggccgccccccccgccctgttaggaaccccgcaagcagaggtgttagaagatgtgctcagggagcaatttggaccccttccacaacttgctgctgtctgcaggttaaagaggcttccgtcaggtggttattcttctactgagaacctgcagttagtccttgaacggagacgggtggctaacgcaaaggaaagggaacgcattaagaaccttaacaggggcttcgccaggctaaaagcccttgtgcctttcctcccccaaagccgtaaaccgtctaaggttgacatcttgaagggcgccaccgagtatatccaggtgctgagcgatctgctcgagggagcaaaagactccaaaaagcaggacccagatgaacagtcctacagcaataattcctcagaatcccatacgtccagtgcccggcagctcagtcgtaacatcacacaacacattagttgcgccttcggcttaaagaacgaggaggagggcccatgggccgatggtgggagcggcgaacccgctcacgcctgcaggcatagcgtgatgtctactaccgaaatcattagcccgaccaggtccttagatcggttccccgaggtggagctcctcagccaccgccttccacaagtctag

SEQ ID NO: 188102 - DNA, 1035 bp, Artificial Sequence
  Description of Artificial Sequence: Synthetic coding sequence
atggtgcgggcccggcaccagcccggcggcctgtgcctgctgctgctcctgctgtgccaattcatggaagaccggagtgctcaggccgggaattgttggctgcgccaagcaaaaaacggccgatgtcaagttctctataaaaccgaactttctaaggaggagtgctgttctacaggccgactgtcaaccagctggaccgaggaagatgtcaatgacaataccctcttcaaatggatgatcttcaatggcggcgcaccaaactgtatcccgtgtaaggagacctgtgaaaatgtagattgcggcccagggaagaagtgtaggatgaacaaaaagaataaaccccggtgcgtctgcgcccccgattgttccaatattacctggaaaggccctgtttgtggcttggacggcaaaacttataggaatgaatgcgctttgttgaaggcccgatgcaaggaacagcctgagctggaagtccagtatcaaggacggtgtaagaaaacatgtcgggatgtgttctgccccggttcctctacatgtgtcgtcgaccagaccaacaatgcttactgcgttacttgcaaccgcatctgccctgagcctgcaagcagtgaacaatacctatgcggtaatgacggtgtaacatactcctccgcttgccatctcagaaaagctacttgtcttctaggccgcagcattgggttagcatacgagggaaaatgtataaaagccaaatcatgcgaagatatacagtgcacgggcggcaagaaatgtttgtgggatttcaaggtgggccgcggacgatgctcactctgcgacgaactgtgccctgactcaaaatccgacgagcctgtctgtgcatctgacaatgctacatacgcgagtgaatgcgccatgaaagaagctgcctgtagttccggagtgctcctggaggttaagcactcaggatcttgtaatagtatctctgaagacacggaagaggaagaggaagacgaggaccaggactatagctttcctatatcttctatactggaatggtag

SEQ ID NO: 188103 - DNA, 954 bp, Artificial Sequence
  Description of Artificial Sequence: Synthetic coding sequence
atggtgcgggcccggcaccagcccggcggcctgtgcctgctgctgctcctgttgtgccaattcatggaggatcgctctgcccaggcggggaactgttggctgcgacaggccaagaatggcagatgtcaagtgctctacaaaactgaactgtccaaggaggaatgctgctccacgggccgactctccacaagttggaccgaggaagacgttaatgataacactctttttaagtggatgattttcaacggtggcgccccgaattgcatcccttgcaaggagacctgtgagaacgtcgattgcggccccggcaaaaaatgtcggatgaataaaaagaacaagccccgctgtgtgtgtgccccagattgctctaacataacttggaagggtcccgtgtgcggccttgacggaaaaacatatcgtaatgagtgcgcactgttaaaggctcgatgcaaggagcagcctgagctggaggtgcagtaccaaggaaggtgtaagaaaacttgcagagacgtcttttgccctgggtcaagcacctgcgtggtagaccagaccaacaatgcttattgcgtcacgtgtaacaggatctgtcctgaaccagcttccagcgaacaatacctctgcggcaatgacggggtcacttactcttctgcatgtcacttaaggaaagcaacttgcttgctcgggcggtccataggtctagcctatgaagggaagtgcattaaagccaagtcttgcgaagatattcaatgtacagggggaaaaaaatgcttgtgggattttaaagttggacgagggagatgtagtctatgtgacgagttatgtcctgattccaaatctgacgagcccgtgtgcgccagtgataatgccacttatgcttctgagtgcgcaatgaaagaggctgcttgctcttcgggtgtactgctggaggtaaaacacagtgggagctgcaattag

SEQ ID NO: 188104 - DNA, 1023 bp, Artificial Sequence
  Description of Artificial Sequence: Synthetic coding sequence
atggtgcgggcccggcaccagcccggcggcctgtgcctgctgctgttgctgctgtgtcagtttatggaagatcgctcagcccaggccggcaactgctggctcagacaggctaagaacggtcgatgccaggtcctctacaaaaccgaattgtccaaggaagaatgctgtagcacgggccggctgagcacaagctggacagaggaggatgtcaatgacaacacactgtttaagtggatgatcttcaatggcggtgctcctaactgcatcccgtgtaaagaaacttgtgagaatgtcgattgtggccccggtaagaaatgtcgtatgaacaaaaagaacaaaccacggtgcgtgtgcgctcccgattgttctaatattacctggaaagggcccgtctgtggccttgacgggaagacttaccgcaatgagtgcgctctgcttaaggcaagatgcaaggaacagccagagcttgaagtccaataccagggtcggtgcaagaagacatgcagagacgtgttctgtccaggttcttctacctgtgtggtggaccagactaataatgcttactgcgttacctgtaaccgcatttgccctgaacctgcctcctccgagcagtacctctgcgggaatgacggtgtgacctacagctccgcctgccacctcaggaaggcgacctgcctcctcgggcgtagcattggactcgcttatgaggggaagtgcatcaaggctaaatcttgtgaagacattcagtgtaccggcggcaaaaaatgcttgtgggatttcaaggtcgggagaggccgatgtagtctctgcgatgaattatgccctgactcaaagtctgacgagcccgtgtgcgcaagtgataacgcaacctacgcgtccgaatgtgctatgaaagaggctgcctgttcctcaggggtacttctggaggtcaagcacagcggatcttgcaactacacagaggaagaagaggaggacgaggatcaagattattcctttccgatcagttcaatactggagtggtag

SEQ ID NO: 188105 - DNA, 927 bp, Artificial Sequence
  Description of Artificial Sequence: Synthetic coding sequence
atgtggaagcggtggctggccctggccctggccctggtggccgtggcctgggtgcgagccgaggaagaactcaggtcgaaatcaaaaatctgtgccaatgtgttttgtggggcggggcgagagtgtgccgtcacggagaagggcgagcctacgtgtctgtgcattgaacagtgtaagccccacaaaagacccgtatgcggcagtaatggcaagacatacctaaatcactgcgagctgcatagagacgcatgcttgactggctcaaaaattcaggtagactatgacggacattgcaaagagaagaaaagcgtctcaccaagcgccagcccagtggtgtgctaccagagcaaccgggatgagctgaggcgcaggattatccaatggctggaagccgagattatccctgatgggtggttttccaaagggtccaactactcagagattctcgacaagtatttcaagaatttcgacaacggggatagtcgcctggactcctctgaattcctcaagtttgtggagcaaaacgagacagccatcaatatcactacctaccccgaccaggaaaataacaagcttttgcgtggcctctgcgtcgacgcgctgatcgaactctctgacgaaaacgcggactggaagttgtcattccaggaattcctcaagtgtctcaatccctcttttaaccccccagaaaaaaagtgtgcactggaagatgaaacctacgctgatggcgccgaaaccgaggtggactgcaatagatgcgtgtgcgcttgcgggaactgggtatgcacagcgatgacatgtgacggtaaaaaccaaaagggggctcagactcagaccgaggaggaaatgactagatacgtgcaggagctacagaagcaccaggaaactgccgaaaaaactaagagggtgagtactaaggaaatctag

SEQ ID NO: 188106 - DNA, 423 bp, Artificial Sequence
  Description of Artificial Sequence: Synthetic coding sequence
atgtggaagcggtggctggccctggccctggccctggtggccgtggcatgggtgagggccgaagaggaactccgttccaagtccaaaatttgtgcaaatgtgttctgcggggctggccgggagtgtgccgtgactgagaaaggcgagccgacttgcttatgtatcgagcagtgtaaacctcataagcgccctgtgtgtggatccaatggtaagacatatcttaaccactgtgagctacatcgtgacgcctgtctgaccgggtccaagattcaggtggattatgatggacattgtaaggagaagaagtcagtcagccctagcgccagtcctgtcgtgtgctatcagtccaaccgggacgagctgcggaggcgtataatccagtggctcgaagccgagatcatccccgacgggtggttctcatag

SEQ ID NO: 188107 - DNA, 756 bp, Artificial Sequence
  Description of Artificial Sequence: Synthetic coding sequence
atgtgcttcgtggagcccgccggcaacgtgcagagccagcggaagggaaacccaccagtgtccgcgttgtctaacgccaatctgacggggtcaaagatccaagtagactatgacggccattgtaaagaaaagaagtccgttagcccgagcgcctctccagtggtgtgttaccagtccaatcgagacgaactgagacgaagaataattcagtggctcgaggcggagataattcccgatgggtggttctccaagggcagtaactattcggaaattttagataaatactttaagaacttcgataacggggactccaggttggattctagcgagttcctgaaattcgtggagcaaaatgagacagctatcaatatcactacctatcctgatcaggagaacaataaattgctcaggggactgtgcgtcgacgcccttatagagttgtcagacgagaacgctgactggaaattaagctttcaggagttcctgaagtgcctgaacccatcatttaatccaccagagaagaagtgcgcgctggaggacgagacatatgccgatggcgccgaaaccgaggtggattgcaaccgctgtgtttgcgcctgtggaaactgggtgtgcaccgccatgacgtgcgacggaaaaaatcagaaaggtgctcagacacagactgaggaagagatgaccaggtatgttcaggaacttcagaagcaccaggagaccgcagagaagactaagcgcgtttccacgaaggagatctag

SEQ ID NO: 188108 - DNA, 792 bp, Artificial Sequence
  Description of Artificial Sequence: Synthetic coding sequence
atgcggcccggcgcccccggccccctgtggcccctgccctggggcgctctggcgtgggcggttggttttgtgtcaagcatggggagtggaaaccctgctccaggcggagtgtgttggcttcaacaaggtcaggaagccacctgcagcttggtattgcaaacagacgtgactcgcgcagaatgctgtgcgtcaggaaatatcgatactgcttggtcaaacctgacccatcctggcaacaaaatcaatttactgggctttcttgggctagtgcactgtctcccatgtaaggatagctgcgatggtgtcgaatgtggtcctggaaaggcatgccgcatgttaggcggtagacccagatgtgagtgcgctccagattgttcaggccttccggcacggctccaggtgtgcggctcagacggtgccacgtatcgggacgaatgcgaacttcgggctgccagatgtcggggccatcccgatttgagcgtgatgtaccgcggaaggtgtcggaagagttgcgagcacgtcgtgtgccctcggccccagtcttgcgtggtcgaccaaaccggtagcgctcattgtgtggtatgccgggctgcaccttgtcctgtcccttcgagcccagggcaggagctgtgtggtaataataacgtgacttacatcagttcttgccacatgcgccaggccacctgctttctcggcagaagtattggtgtgcgccacgccggctcttgcgcaggaacaccagaggaaccaccaggtggcgaaagcgccgaagaggaagagaactttgtgtag

SEQ ID NO: 188109 - DNA, 1614 bp, Artificial Sequence
  Description of Artificial Sequence: Synthetic coding sequence
atgctgaacaccctgcagaccaacgccggctacctggagcaggtgaagcggcagaggggagacccccaaactcagctcgaggctatggaactgtacctcgcccgatctggactccaggttgaagatctggatcgactgaatatcattcacgtcacagggacaaaaggtaagggctcgacctgcgcctttaccgagtgcatcttaagaagctatggattgaaaactggctttttttcaagtccacacctggttcaggttagggaaagaattcgaatcaacggccaacccatcagtcctgagttgttcaccaaatacttctggagactttaccacaggctcgaggagaccaaagacggatcgtgtgtgagcatgcctccctattttcgctttctcactctgatggcattccacgttttcctccaggaaaaagtggatctcgcagtcgtcgaagtaggaatcggaggcgcctatgactgtactaacataatccgaaaacccgtggtctgtggcgtatctagccttggtatcgaccataccagtctgctcggagacaccgtggagaagatagcctggcagaaaggcggcattttcaaacagggtgtgcccgcattcaccgtgttgcaaccagaagggccccttgccgttcttcgggatcgggcccagcagattagctgtccactgtatttgtgtccaatgctagaggcattggaagaaggaggaccaccgctgacactcggactggaaggcgagcaccagcgcagcaacgctgcactagccctccagctggcgcactgctggttgcaaagacaggatcgacacggagccggcgagccgaaagcctcccgccccggcctcttgtggcaacttcccctagccccagtatttcaacccacgagtcatatgagactgggattaagaaacaccgaatggcctggcaggactcaggtgctaaggcgcggacctctgacctggtatctggatggagcccacacggcgagctcagctcaggcttgtgtgcggtggtttcgtcaggcccttcagggcagagaaagaccttcagggggccccgaggtgcgagtgctcctcttcaacgccacaggcgatcgtgaccccgctgcattgctgaagctgttgcaaccctgccaatttgattacgccgtcttctgtccgaacctcaccgaagtgagttctacgggcaacgctgatcaacagaattttaccgtcacacttgaccaggtcctgttgagatgcctggaacatcaacagcactggaatcacctggacgaggagcaggcatccccagacttgtggtccgccccatcaccggagcccggaggaagcgccagccttctactggcaccacatccacctcacacttgttccgcatctagcctcgtgttctcctgtatctcccatgccttgcaatggatcagccaagggcgggaccctatcttccaacctccctccccccctaagggacttcttacgcaccctgtggcccacagcggggcttcgatcttgcgagaagccgctgccatccacgtacttgttactggatctctacatctggtagggggagtattgaaacttctggagccagccttgtcgcaatag

SEQ ID NO: 188110 - DNA, 1128 bp, Artificial Sequence
  Description of Artificial Sequence: Synthetic coding sequence
atgagccgggcccggagccacctgcgggccgccctgttcctggccgctgctagcgcgcgcggcattactacacaggtcgctgccaggagaggcctatccgcctggccagtaccccaggagcccagcatggagtaccaggacgccgtgagaatgctcaatacactgcagactaatgccggatatctggaacaggtgaaacgtcagcgaggcgacccacagacacagctggaggctatggaactctaccttgctagatccggtttacaggtcgaggatctcgatagactgaatattatccacgtgacaggcaccaaaggaaagggcagcacttgcgcgttcactgagtgcatcctacgttcctacggattaaagacggggtttttctcttccccgcacctggtgcaagtgcgggagagaatccggatcaatggccagccaatatctccagagctgttcacaaagtacttttggagactgtatcatcggctagaggaaaccaaggatggaagttgtgtgtccatgcccccctacttcaggtttcttacgctgatggcattccatgtgttcctccaggaaaaagtggacctggccgtggtcgaagttggcatcgggggagcttacgattgcacaaatataataagaaaacctgtagtgtgcggggtcagctcccttggaatcgaccacacttctctgctcggggacacggtggaaaagatagcctggcagaagggcggcatctttaagcagggggtccctgcctttacggttctgcagcctgaagggcccctggcggttctgcgggatcgggcccagcagatttcggtgctcggctctcagcgacatcctggacagggctcctgcggtagctgtccttggcacctttgcagcagtccccacccgacttgcggctcgggtttcggtacacgtagcggaagggccggtaggcgctgctgcggcgctgggccctccccaggcacctggaccgtgcggacgccacccgcagcaaggcgacccgcttgcgcaggttccgcaagacggtgcagagccgctcggggacgggcagtggcaccaagattcgaatcctgctcaagcatgctcccaggaacgggcaccagacgcccctgttag

SEQ ID NO: 188111 - DNA, 1128 bp, Artificial Sequence
  Description of Artificial Sequence: Synthetic coding sequence
atgagccgggcccggagccacctgcgggccgccctgttcctggccgccgcctcggcccgaggcattaccacacaggtggccgctcgcaggggactgtcagcctggccggtgccccaagagccttcaatggaatatcaggacgccgttcgaatgttaaataccctgcagaccaatgctggctatctcgaacaagtcaaaagacagagaggcgatccgcagacacagctggaggccatggagctatacctggcccggtcaggcctgcaggtcgaagacctggataggcttaacattattcacgtcaccggcaccaaaggaaagggttcaacttgcgctttcactgaatgcatcctccgatcatatggcctcaagacgggatttttctcttcaccccatctggtgcaggttagggaacgcataaggatcaatggccagcccattagccccgaactgtttacaaaatacttttggcggctgtaccaccgcctggaagaaacaaaagatggaagctgtgtcagtatgccaccttacttccgctttttgacacttatggcctttcatgtcttcctgcaggaaaaagtcgacctcgcagtagtggaagtggggatcgggggtgcctacgactgcaccaacataataaggaagccggtcgtttgcggcgtttcctccttggggatcgatcatacaagtctactgggcgatacagtggagaaaatagcctggcagaaaggcggcatctttaagcagggcgtgcctgcattcacagttctacagcctgagggacctctcgctgtgttaagagacagagcacagcagataagcgtacttggttctcagaggcaccctgggcagggtagttgcgggtcttgcccttggcatctgtgtagctcaccacatccgacttgtggatcaggctttggcactaggtcgggtcgtgcaggacggagatgctgtggagcgggcccgtcgccgggtacttggacagtgcgcaccccccccgccgcccgtcgccccgcatgtgccgggtcagcccgtcggtgtcgggcagctcgtgggagagctgtggctccacgctttgagagctgttcctctatgcttcctggcaccggcactcgtagaccatgttag

SEQ ID NO: 188112 - DNA, 1764 bp, Artificial Sequence
  Description of Artificial Sequence: Synthetic coding sequence
atgagccgggcccggagccacctgcgggccgccctgttcctggccgctgcgtccgctagggggatcaccactcaggtggccgcccgacgaggcctgtctgcctggcccgtgccccaggagcccagtatggaataccaagatgccgtgagaatgctcaataccttacagacgaatgcggggtaccttgagcaggtcaagaggcagcgaggagacccacaaactcagttggaagcaatggaactctatctggcccgcagcggtctccaggtagaagatctcgatagactgaatattattcacgtgaccggtacaaaagggaaggggtctacctgtgccttcacggaatgtatcctgcgcagctacgggctgaaaacgggattcttttcttccccccatctggtccaggtgcgggagaggattcgcatcaatgggcagccaatcagtcctgagctcttcactaaatacttctggcgattgtaccataggctggaggagaccaaggacggctcgtgcgtatctatgccgccctacttccgcttcctgacactcatggcattccacgtgtttttgcaagagaaggtcgatctagccgtggtggaagttggtattggaggagcatatgattgcactaacatcattcggaagccggtggtgtgtggagtgtccagtctgggcatagaccatacttcgcttctgggcgataccgtggaaaaaatcgcttggcagaaaggtgggatattcaagcaaggggtgccagcttttaccgtgctacaaccagaaggcccactcgccgttcttcgcgatcgagcgcagcaaattagctgtcccctctatctgtgccccatgttggaagccctggaggagggcgggccaccattgacattaggcttggagggcgagcatcagcgctccaacgccgccctggcactccagttagcacactgttggctgcagagacaggaccgccatggagctggggagcccaaagcatctagacctggattgctctggcagttgccactggctccagtgtttcagcccaccagtcatatgcgcctgggattgagaaataccgagtggcccggcaggactcaggtgttgagacgcggcccactcacttggtacctcgacggcgcccacaccgcgtctagtgcccaagcttgtgtgcgctggttccggcaggctttacagggcagagagaggccttctggagggcccgaagtgcgggtgctcctgttcaacgctacaggggacagggacccagctgccctacttaaactcttacaaccctgtcagtttgactacgcagtcttttgcccaaatttgaccgaggtatcatcaactggcaatgcagatcaacagaattttacggtgaccctggatcaagttcttctgcggtgccttgagcaccagcagcactggaatcatctggatgaagaacaggctagcccagatttatggtcagctccaagccctgagccaggtgggagcgcctcactgctgctggcgcctcaccccccccatacttgcagcgcttcctcccttgtgttttcttgcatttcccacgcgttgcagtggatcagtcaaggccgagatccaattttccagccgccctcaccccccaaaggactcttgacacacccagtggctcactctggtgcctcgatcctgcgggaggcagctgctatacatgtgctagtgaccggtagcctgcatctggtggggggggttctgaagctcctcgagccagctctcagtcaatag

SEQ ID NO: 188113 - DNA, 1686 bp, Artificial Sequence
  Description of Artificial Sequence: Synthetic coding sequence
atgagccgggcccggagccacctgcgggccgccctgttcctggccgctgcctccgctagagggattaccacccaggtggcagcgcgtcgaggactgtctgcttggcccgttccccaggaaccctccatggagtatcaggacgcggtaagaatgctcaacactttgcagaccaatgccggttacctggaacaggtgaagcggcagaggggcgatccacaaacacagcttgaggcgatggaattatacctggcgcgatccgggttgcaggtggaggacctcgatagactgaacatcattcacgtgacgggaacaaagggaaaaggttctacttgcgctttcactgagtgtatactgcgatcctacggtcttaagaccggcttttttagctctccgcacctggttcaggtgcgggaacgtattagaattaatggacaaccaatctctccagagcttttcacaaagtacttctggcggctgtatcatcggctcgaagagaccaaagtggatctggcagtggtggaagtaggcattggaggcgcttatgactgtactaatatcatcagaaagcccgttgtgtgtggggtgagcagcctcggaatcgatcacacgtcgttgctgggcgataccgtggaaaagattgcatggcagaaaggaggcattttcaaacagggagtccccgccttcaccgtgctacagcctgaaggcccacttgccgtgctgcgggaccgggctcagcagatttcatgtccgctttacctgtgtccaatgttagaggcactggaagaggggggtccaccactgacccttggcctggaaggcgaacaccagcggtccaatgcggccctcgccctgcaactggcccactgctggttgcagagacaggaccgccacggggccggtgaacctaaagccagccgtcccggcttgttgtggcagctcccgcttgcaccggtatttcagcccacgtcccacatgagacttggtttgcggaacacggaatggccaggccggacacaggtcctgcgccgtggacccctgacatggtatctggacggagcccacactgcttcaagcgcccaagcttgtgtacgatggttcaggcaggcactgcagggaagagagagaccaagcggcggccccgaggtgagggttctgttgtttaacgctacaggtgatcgagaccccgccgcgctgctgaagttattgcagccctgtcagttcgactacgcagttttttgcccgaatttgacggaagtgtctagcaccgggaacgcagaccagcagaacttcactgtgactttggaccaagtccttctgagatgtttagagcaccagcagcactggaatcacctggacgaggaacaggcctccccagacctgtggtccgctcccagtccagaacctggtggatccgctagccttctgctggcccctcaccctccccatacctgtagtgctagcagcctcgtgttcagttgtatctctcacgctttgcagtggattagccagggacgggatcccatcttccaacctccttcacccccaaagggcctactgactcatccagtggcacacagtggtgcttctattctgcgagaggctgcagctatacatgtcctcgtcactggctccctacatctggtgggcggagttcttaagctcttagagcccgccctttctcagtag

SEQ ID NO: 188114 - DNA, 585 bp, Artificial Sequence
  Description of Artificial Sequence: Synthetic coding sequence
atgctgaacaccctgcagaccaacgccggctacctggagcaggtgaagcgtcagcgaggtgaccctcagacacaacttgaagctatggagctgtatctggctcgctcagggctccaggttgaagatttggatcgtttgaacattattcatgtgaccggtacgaaaggcaagggtagtacatgcgcttttactgagtgcatcctcaggagctacggactgaagactgggttctttagctcacctcatctggtacaagtgcgcgagaggatccgtatcaatggtcaacctatttctccggagttgtttacaaagtacttttggcggttataccataggctggaagagacgaaggttgatctggcagtggtagaggtcgggattgggggtgcatacgactgtactaatatcataaggaaaccagtagtttgcggtgtaagctctttaggaatcgaccatacctctctgttgggagacaccgtggaaaagattgcctggcagaaagggggcatctttaaacaaggggtgccggcgtttaccgttctgcagccagaggggccactggctgtccttagggatagggcttag

SEQ ID NO: 188115 - DNA, 798 bp, Artificial Sequence
  Description of Artificial Sequence: Synthetic coding sequence
atgctgaacaccctgcagaccaacgccggctacctggagcaggtgaagaggcagcggggcgatcctcagactcaacttgaagccatggagttatacctggctaggagcggactgcaagtagaagatctagaccgactgaatatcatccacgtcaccggcacgaaggggaaaggttccacctgtgcctttaccgagtgtatcctccggtcctacggccttaaaacaggatttttctctagcccacacttggtccaggtgcgcgaacgaattcggatcaatggtcaacctatcagtcctgagcttttcacaaaatacttttggcgactctaccaccgactagaggaaacaaaggatggctcatgtgtgtcaatgcccccatacttcagattcctgaccctgatggctttccatgtgttcctgcaggagaaggtcgacctggctgtggtggaagtcgggataggcggagcatatgattgtacaaacatcattagaaagcccgttgtatgcggggtgtcttcactgggaatcgatcacacatcactgctcggcgacacagtagagaaaatcgcctggcaaaaaggcggaatcttcaaacagggggttccggctttcaccgtgcttcagcccgaaggacccctggcagttctacgtgaccgcgcacagcagatctccgtccttggcagccagaggcatcctggtcaaggatcttgcggttcctgcccttggcacctctgctcttctccccaccctacctgtggatccggtttcggtacaaggagcggacgtgccggaaggtag

SEQ ID NO: 188116 - DNA, 1392 bp, Artificial Sequence
  Description of Artificial Sequence: Synthetic coding sequence
atgcacagcgccagcagcatgctgggcgccgtgaagatggagggccacgaacccagcgactggagttcctattatgccgaaccagaagggtatagcagcgtgagcaacatgaacgcaggcttgggcatgaatgggatgaacacttacatgagtatgagtgcggcggccatgggcagcggatctggaaatatgtccgccgggtccatgaacatgagcagctatgtaggcgccggaatgtctcccagtttggcgggaatgtccccgggagccggagcaatggcagggatgggagggtccgctggcgccgcaggcgtggcagggatgggaccacacctttctccgagtctgtctcccttgggcggtcaggccgccggagctatgggaggactagccccttatgcaaacatgaattctatgagcccaatgtatggccaggcgggactgagcagggccagggatcccaaaacatatcgccgaagttatacacatgcgaagcccccttactcgtatatttccctcattaccatggccatccagcagtcacctaacaagatgctgactctctcagagatataccagtggataatggacctgtttcccttttaccggcaaaaccagcagaggtggcagaactctatccgccacagtctttccttcaatgactgctttttgaaggtgcctcggtcaccggacaagccaggaaaaggctcattctggactctccacccagattctgggaatatgtttgagaacgggtgctatctgagacggcaaaagcggtttaagtgtgagaagcagctggctctaaaagaggccgctggtgcagcaggatcaggaaagaaggcagccgccggggcgcaggcctcccaggcccaactgggcgaagcagcaggccccgcaagcgagactcccgcagggacagagagtccacactcaagtgcctcgccatgccaggaacacaagagaggtggcttaggtgaactcaaaggaacacccgctgccgccttgtcacctccagagccagctccttcaccagggcaacaacaacaggccgccgcacatctgctgggcccgccacatcacccaggcctgcctccggaggctcacctcaagcccgaacaccattacgccttcaatcatccctttagtattaataatctaatgtcttcagaacagcagcatcatcatagtcatcaccaccaccagccgcacaagatggacctgaaggcgtacgaacaagtgatgcattatccaggatacggatccccgatgccaggttccctggcgatgggcccagtgaccaataaaactgggcttgacgcctcgccgctggctgcagataccagttactatcagggggtgtattcccgccccataatgaacagttcatag

SEQ ID NO: 188117 - DNA, 1374 bp, Artificial Sequence
  Description of Artificial Sequence: Synthetic coding sequence
atgctgggcgccgtgaagatggagggccacgagcccagcgactggtcttcttattacgccgagccagaagggtacagcagtgtgagtaatatgaacgccggcctcggtatgaacggcatgaatacgtatatgtctatgtccgctgctgcaatggggagtggttccggcaatatgagcgcagggtcgatgaatatgtcctcctatgtcggggctgggatgagcccttctttagccggaatgtccccaggtgctggcgctatggccggcatggggggcagtgctggtgctgctggggtggccggaatgggcccccatctgtctccgagtctgtccccactcggggggcaggctgccggggctatgggtggtttggccccctatgcaaatatgaacagcatgagccccatgtacggacaggccggtctgtcccgggcaagggatccaaagacctatcgccgaagctatactcatgcaaaacctccctactcttacatcagcctgatcacaatggcaatccaacagtcccctaataagatgttgactttgagtgagatctatcaatggatcatggatctgttcccgttttaccgacagaatcagcagcgctggcagaacagcattcgccacagcttgtcatttaatgactgtttcctcaaggtgccccgcagccccgacaaaccaggcaaggggtctttttggacacttcacccagattcaggaaacatgtttgagaacgggtgctatctcagacgacaaaagcgatttaagtgcgaaaagcagctcgccctcaaagaggctgctggtgccgcaggctctggcaaaaaagcagcagcgggtgcacaggctagtcaggctcagcttggcgaggccgccggaccagcatccgagacccctgccggcactgagagcccgcacagcagcgcctctccatgtcaagagcataagagaggcgggcttggagaacttaagggcacgcccgcagcggcacttagccctcctgagcccgccccctctcctgggcagcagcagcaggccgccgcccatctgctgggcccacctcatcaccccggcctgcctcccgaggctcaccttaagcccgagcatcattatgcattcaatcatccatttagcatcaacaatcttatgtcttccgagcagcagcaccaccattctcatcaccatcatcaaccacataagatggacttaaaggcgtacgaacaggtgatgcactatcccgggtatgggagccctatgccagggtccctggcaatgggcccagtcactaataaaactgggctggacgcgtccccactggccgccgatacaagttactaccagggagtctacagccgaccaattatgaattcttcatag

SEQ ID NO: 188118 - DNA, 1374 bp, Artificial Sequence
  Description of Artificial Sequence: Synthetic coding sequence
atgctgggcgccgtgaagatggagggccacgagcccagcgactggagttcgtattacgccgagccagagggatactcatcagtttcaaacatgaatgcagggttaggtatgaacggcatgaacacttacatgagcatgtcagctgccgccatgggttcaggcagcggcaacatgtccgccgggtctatgaatatgtcgtcctacgtgggagcgggaatgtcgccatctcttgctggaatgtccccaggcgcaggagctatggccggcatgggtggctccgccggggcggcaggggtggcaggaatggggccacacttatcgcccagcctgtctcctctgggagggcaggctgcgggggctatgggaggccttgcaccatatgccaacatgaattcaatgtctccaatgtatggccaggctggcctcagtcgggcacgagatcctaagacttacagacggtcctatacccacgcaaagcccccgtattcttacatctctctgataaccatggccatccaacaaagtccgaataagatgcttacgctcagtgaaatttatcagtggatcatggacttgtttcccttttacaggcagaaccaacagcggtggcagaacagcattcggcattcactatcttttaacgactgcttcttgaaagtgccccgcagcccagacaaacctgggaagggctccttctggaccctgcaccctgactcaggcaacatgtttgagaatggatgctaccttcggcgccagaagaggtttaagtgcgagaaacagttagccctgaaggaagccgcgggagccgctggcagcggaaagaaagccgcggctggggcccaggcctcgcaggcgcaactgggtgaggctgctggaccagcctcagagacccccgccgggacagaaagtccacactcctcagcatccccttgccaggaacataaaaggggaggcctaggggaactaaaagggacgcccgccgccgcactgagtccgcccgaacccgctccctctccaggacagcagcagcaggcggccgctcacctcctcggaccacctcaccaccctggattaccaccggaggcccaccttaaacctgaacaccactatgcctttaatcaccctttctccattaacaacctgatgtctagtgaacagcagcaccaccactctcaccatcatcaccaacctcacaagatggatctgaaggcttatgaacaggtaatgcattaccccgggtatggcagccccatgccgggaagcctggctatgggtccagtgactaataaaacaggactggacgcgtcaccactggcagcagacacatcatactaccagggcgtgtacagccggcccattatgaattcttcatag

SEQ ID NO: 188119 - DNA, 1032 bp, Artificial Sequence
  Description of Artificial Sequence: Synthetic coding sequence
atgctgggcgccgtgaagatggagggccacgagcccagcgactggagtagttattatgccgaacccgaaggctattcaagcgtgtccagagctagagacccaaaaacctatcgcagatcatatacccacgcgaagcctccttacagctacatcagcctgattacgatggcgatccagcagtcgccgaacaagatgctaaccctctctgagatttaccagtggatcatggacctgttcccattctatagacaaaatcagcaacgctggcaaaactcaatcagacactcccttagcttcaacgattgtttcctaaaggtgccaagaagtccagacaagccaggaaaaggatccttctggacactgcaccccgactccggtaatatgtttgaaaatgggtgttatctcagaagacagaagcgttttaagtgtgaaaaacagctcgccctgaaagaggcagctggggcagcaggctctgggaaaaaggcggccgcaggtgcccaggcctcccaggcgcaactgggtgaagcagccggacctgcgtcggagacgcctgccggaactgaatcaccccacagttccgcttcaccgtgccaggagcacaagcgcggagggcttggtgaactgaaaggtactccagccgctgccctgagcccgccggagccagctcccagtcccggccagcagcaacaagccgccgcccacctgttgggcccgccgcaccaccccgggctgccaccagaggcacatcttaagcctgagcaccattacgcatttaaccaccccttctccatcaacaacctgatgagtagcgagcagcagcatcaccactcacaccatcaccaccagcctcacaagatggatttgaaggcttatgaacaagtcatgcattaccctggatacggttcccctatgccgggcagcctggctatgggccctgtgacaaataaaactgggctggacgccagtcctcttgccgcagacacctcatattaccaaggtgtctacagcaggcctattatgaacagctcttag

SEQ ID NO: 188120 - DNA, 1053 bp, Artificial Sequence
  Description of Artificial Sequence: Synthetic coding sequence
atgctgggcagcgtgaagatggaggcccacgacctggccgagtggtcctactaccccgaagcaggcgaggtctatagtccggtgactcccgtgcccaccatggcccccctgaattcttacatgacattgaatccactttcatcaccgtaccctcccgggggattacccgcctcccctctgccatccggaccactagcgcccccagcaccggcagcccccttgggcccaaccttccctgggcttggagtgtcgggcgggagtagtagttcagggtacggcgccccagggccaggactggttcacggcaaggagatgcctaagggctacagacgccccctagcacatgcgaagcctccttattcatatatcagcctcataacgatggccattcaacaggcccccggtaagatgcttaccctgagtgagatctatcagtggatcatggatctgtttccttactatagagaaaatcagcagcggtggcagaacagtattcgccacagtctctcctttaatgactgcttcgttaaagttgcacgatctccggacaaacccggtaaggggagctactgggcactccacccatcttcgggcaacatgtttgaaaacgggtgctacctgaggagacagaagaggtttaaactggaggaaaaagtcaaaaaagggggatccggcgcagcaactaccactcgaaatggcactggcagcgccgcgtccacaacgacccccgccgcaaccgtgacctcccctccccagccaccacctcccgctccagagcctgaagctcaaggcggtgaggatgtgggggctctggactgtggaagccctgccagctccactccttacttcacgggactggaactccctggtgaactaaagctggacgcaccatacaactttaaccatccgttcagtatcaacaatctcatgtctgaacaaactcccgccccccctaaactggacgtaggatttgggggatacggggcggaaggaggtgagccaggggtgtactatcaaggcctgtacagcaggtcccttcttaacgcttcatag

SEQ ID NO: 188121 - DNA, 1662 bp, Artificial Sequence
  Description of Artificial Sequence: Synthetic coding sequence
atgcaggcccggtacagcgtgagcagccccaacagcctgggcgtggtgccctatctgggtggtgagcagtcctactatcgggctgccgccgccgcagccgggggtggctacaccgctatgcctgcgcccatgtccgtgtacagccatcctgcccatgctgagcagtaccctggaggcatggctcgtgcctatggcccctacactccacagccccaaccgaaggatatggtcaaacccccgtactcctatattgctctgatcactatggcgatccagaacgcccccgacaagaagatcacactcaacggaatctatcaattcatcatggacagatttccattctaccgtgacaacaagcaggggtggcagaatagcattcgccataatctgagccttaacgagtgcttcgtcaaagtccctagagacgataaaaagcccggcaaggggtcctactggaccctcgaccctgactcctacaacatgtttgaaaatgggagcttcctacgtagacgcagaaggtttaagaaaaaggatgccgtgaaggataaggaggagaaggacaggctgcaccttaaggagccaccaccccctggcagacagccaccacccgccccccccgagcaggcagatggaaacgccccgggcccccaacccccccccgtcagaattcaggatatcaaaaccgaaaatggcacctgtccgtctcctccacagccactttcccccgctgcagcgctgggatccggaagcgcagccgcagtaccaaagatcgaaagccctgacagctcgtcctctagcctatcttcaggcagtagccctcctggctccctgccaagcgcccgcccattgagtctggacggggcagattccgcaccacctcctcctgctcctagcgcgcctcctccgcaccactctcagggattcagcgtcgataatatcatgacaagtctccggggctctcctcaaagcgccgcggctgagctgagctccgggctactcgcttcggccgctgcgtcctctcgagccgggatagccccaccacttgctttgggcgcctactcccctggccaaagttcgctgtactcttctccttgttcccagacctcaagtgctgggagtagcggtgggggaggcggcggcgcaggcgccgctggaggtgctggaggagccgggacctatcactgcaatctccaggccatgtctttgtacgccgccggggagcgggggggccacctgcagggggcacctggcggggccggcggtagcgccgtcgatgacccgttgcctgactattccctgcccccagtgacaagcagtagctcctcttcccttagtcatggggggggtggtgggggaggcggaggcggtcaagaggcaggacaccacccagcagcccaccagggtcgtcttacttcctggtatctgaaccaggccggaggtgatctggggcatcttgctagtgctgcggctgcagcggccgctgctggttacccaggacagcaacagaatttccatagcgtgcgggagatgttcgagtcccagcgcattggcctcaataatagtcccgttaatggaaactctagctgccaaatggcattcccatcctctcagtccttgtaccggacttcaggagcgttcgtgtacgattgcagtaaattctag

SEQ ID NO: 188122 - DNA, 639 bp, Artificial Sequence
  Description of Artificial Sequence: Synthetic coding sequence
atgcaggcccggtacagcgtgagcagccccaacagcctgggcgtggtgccatacctggggggagaacagagttactatcgcgccgcagccgccgccgcaggtgggggctatacagccatgccagcccctatgagcgtatacagccatcctgcacatgcggaacagtatccgggcggcatggccagggcttacgggccatataccccacaaccccagccgaaagacatggtgaagcccccatatagttatatcgccctgattactatggcaatacagaacgctccagacaagaagatcaccctcaatggcatctaccagtttatcatggacaggttcccattctacagggacaataagcaggggtggcagaatagcatccgacacaacctgtctttgaatgagtgcttcgttaaagttcccagagatgacaagaagcctgggaagggctcctactggacgcttgatccggacagctacaacatgttcgagaacggtagttttcttagacgaaggagacggttcaaaaagaaggacgctgtgaaggataaagaggagaaagatcgccctcaggccacacgcgcttcaagcaggacttccaccaggtgtggaaggtgttcctcgcacagaggatccgcctag

SEQ ID NO: 188123 - DNA, 1488 bp, Artificial Sequence
  Description of Artificial Sequence: Synthetic coding sequence
atgaccctgggcagctgctgctgcgagatcatgagcagcgagagctctcccgctgctctttccgaagccgacgcggatatcgacgtcgtggggggaggctctggcggcggggaactcccagcccggtctgggccccgcgccccacgcgatgtgttacctcatgggcatgagccaccagcagaggaggccgaagctgatctggcggaagacgaagaagagagcggcggatgctcagacggcgagccgcgggccctcgcatcccggggagccgcagctgctgctgggtcacccgggccgggcgcagccgctgccaggggagcagccggtcccggaccggggccaccaagtggaggagccgccacccgtagtccgctggttaagccaccttatagttacatcgccttgattaccatggccattctccagagtcccaagaagagactgaccctttctgagatctgcgaatttatcagcggaaggttcccatattacagggagaagtttcccgcctggcaaaactccattcgccacaacctctccctgaacgactgcttcgtcaagattccacgggagcccggaaaccccgggaagggaaactattggacgttagatcccgaaagcgccgatatgtttgataacggctccttcctgcgtcggagaaaaaggttcaagcggcaacccttaccccctcctcacccccaccctcatccacacccagagctgcttttacggggcggagccgctgcagccggggatccaggtgctttcctacccggttttgccgcctacggcgcatatggctacggttacggtctcgcacttcctgcatacggagcccccccaccaggtccggccccacatccgcacccacatccccatgcgtttgcgtttgcagccgctgctgcggctgccccatgtcagctgagtgtgcctcccggcagagctgctgccccccctcctggtcctccaacagcttcggtgtttgctggggctggctctgcgcctgcacccgcccccgcgtccgggagtgggcccggaccaggtcccgctggactacctgcattcctaggcgctgagctgggctgtgccaaggctttttatgctgccagcctttcaccacctgccgccgggacagccgctgggctgcccaccgccctcctgagacaggggctgaaaaccgacgcaggcgggggagccggagggggcggcgccggcgccgggcaacgcccaagtttctcaattgaccacattatgggacatggcgggggaggggccgctccacccggcgccggagagggctccccaggcccccccttcgccgccgccgccggacccggtggacaggcccaggtgttggccatgctcaccgcccccgccttggctccggtagctgggcatatccggctctcacatcccggagacgcactgctttcttctggctctaggtttgcgagtaaggtagctggtctgtccgggtgtcacttctag

SEQ ID NO: 188124 - DNA, 1437 bp, Artificial Sequence
  Description of Artificial Sequence: Synthetic coding sequence
atgaccctgagcggcggcggcagcgccagcgacatgagcggccagacagtccttacggccgaagacgtggacattgatgtggtgggagagggagatgatggcctcgaagaaaaagattctgatgctggctgcgattcccctgctggccctccagagctgcgcctggacgaggcagacgaggtcccgccagccgcacctcatcatggtcagcctcagcccccgcaccaacaaccgctcacattaccgaaagaggcagccggagccggtgctggaccaggcggggatgtgggagcccctgaggccgatggatgcaagggaggggtggggggtgaagaaggcggcgccagtgggggcggccccggggccggctccggatcagctggaggacttgcgccatccaagcctaagaatagcctcgttaagccaccatattcctacatcgccttgatcaccatggccattctgcagagcccgcagaaaaaattaactctgtctggcatttgtgagttcatttcaaaccggttcccgtactaccgggaaaagtttcccgcatggcagaattcgatacggcataatctcagccttaatgactgctttgtgaaaatcccgagggaacctggaaaccctggcaagggcaattattggacccttgatccccagagtgaggacatgttcgacaacggctcctttctgcggcgtcgaaagcgatttaaacgtcatcaacaagagcacctaagagagcagactgccctgatgatgcagagctttggcgcctacagcctggcggctgctgccggggccgcaggcccgtatggcagaccttatgggctccaccccgcggccgctgcaggggcgtattcacatccggccgctgccgccgccgcagccgccgcagcggcccttcagtacccatacgccctcccaccggttgcgccagtcctccccccagccgtgccactgctgccaagtggagagctgggaagaaaggcggcagcttttgggtcacaactggggcctgggttgcaactgcaattgaattctctgggggcagccgccgcggctgcgggcacagcgggagctgccgggaccaccgctagccttatcaagagtgagccatccgctaggccaagcttctcaatcgagaacatcattgggggagggcctgctgctccaggcgggtcagcagtgggagcgggcgtcgctggcggaactggcggtagtggtggtggctcgacggctcagagtttcctgcggccgccagggaccgtgcagagtgctgctctaatggctacccaccagcctttgtcgctgtcccgcacaaccgccaccatcgctccgatcctcagtgtgcccctatccggtcagttcctccagccagccgccagtgctgcagccgctgctgccgccgctgctcaggctaaatggcccgcccaatag

SEQ ID NO: 188125 - DNA, 1320 bp, Artificial Sequence
  Description of Artificial Sequence: Synthetic coding sequence
atgaacctgccccgggccgagcggctgcggagcaccccccagcggagcctaagagactcagatggagaagacggaaaaatcgatgttctgggtgaggaagaggatgaagatgaagaagaagctgcaagtcaacagtttctcgaacagagcctccagcccgggctgcaggtggcacgctgggggggagtggccctcccccgtgagcatatcgaaggaggtggcggtccgtccgacccaagcgaatttggcacagagtttagggctcccccacggtctgcggccgcatccgaggatgctaggcagcctgctaaacctccaagcagttacatcgcgttgatcaccatggctatattgcaatctccccacaagcggctcacactctctgggatctgcgctttcatttccgatcgcttcccctactaccgcaggaagttccctgcatggcagaacagcattcggcacaatctctcccttaatgactgtttcgttaagatcccacgcgaaccaggacggcctggaaaggggaactattggtctctggacccggcaagccaagacatgttcgacaatggctccttcctccggcgtcggaaacgcttccaacgtcatcagccgactcctggtgcacacctgcctcatccattcccacttccagcagcacatgctgcgctccataatccaaggcccggacctttgctcggcgcgcccgcccccccccagccagtgcctggagcgtacccaaacactggccccggacggaggccctacgccctgctgcaccctcatccgcctcgctatcttctgctatcagcccctgcctatgcaggggcccccaaaaaagcggaaggcgctgatctggctaccccagcaccattcccatgctgtagtcctcaccttgtgctgtccctggggagacgagcgcgcgtgtggcgcaggcacagggaggccgatgcctccttgtctgcactgagagtgagctgcaagggctcaggggaacgcgtgcaggggcttcgaagagtgtgtccacgaccgcgcggcgcaacagccccttgctcttctgacaggcaagcatgccgcactatcttgcagcagcagcagcgccatcaggaagaggattgcgctaatgggtgcgccccaacaaagggagctgtgctcggaggccatctttctgctgccagcgcccttctgagataccaggccgttgcggaaggatcagggctaactagcctagccgcacctctcggaggggagggaaccagtccggtgtttctagtgtcacctactccgagctcactggccgaatcagccggcccatcctag

SEQ ID NO: 188126 - DNA, 1227 bp, Artificial Sequence
  Description of Artificial Sequence: Synthetic coding sequence
atgaacctgccccgggccgagcggccccggagcaccccccagcggtccctccgcgactcggacggggaggacgggaagattgacgtgctcggagaggaagaagacgaagacgaagtggaagatgaggaggaggaggcaagccagaagttcctggagcagagtcttcagccaggcttgcaagttgctcgctggggtggcgtggctctacctcgcgagcatatcgagggaggcggaccatctgatccctccgagttcgggacggagttccgtgctcccccccgcagcgcagcagcctctgaggatgctaggcagccagcgaagcccccctactcttatatagctctgatcactatggccattctacagtccccgcataagcggctgacactctccggtatttgtgcctttatttcaggaaggttcccttactacaggaggaaattcccagcctggcagaacagcatacggcacaacctatcattaaatgactgttttgtgaaaattccaagagagccaggccacccaggcaagggcacatattggagcctagacccagcgtctcaagacatgtttgataacggctctttcttgcgccgcagaaagcgcttcaagcggcatcagctgacgcctggtgcccatctaccacaccccttccccctacccgcggcccacgctgcactgcacaatccacggccgggtcccctgctgggcgctcctgcactccctcaaccagtgccaggagcctaccccaacaccgctcctggtagaaggccatatgctctgcttcatccacacccccccagatacctgttattaagcgccccagcgtacgcgggcgcacccaagaaagccgaaggggcagatctggcaaccccaggaaccttgccggtgctgcagccttccctagggccacaaccctgggaggaggggaaaggcctcgccagtccccccggaggcggctgtatttccttcagtatcgagagcatcatgcaaggtgtaaggggagccggcacaggggccgctcagagcttgagcccaactgcttggagctattgtcctctgctacagcggcccagttcactgagcgacaactttgcagctacagccgctgcctcagggggcggtctgcgccaacggctccggtctcaccaaggtcggggtgccgggcgggctcccgtgggccgggtcggggccgctgctgttagcggcgggggccgcggactatag

SEQ ID NO: 188127 - DNA, 1251 bp, Artificial Sequence
  Description of Artificial Sequence: Synthetic coding sequence
atgaacctgccccgggccgagcggccccggagcaccccccagcggtctctgcgcgattccgacggcgaggatggaaagatcgacgttctgggtgaagaagaagacgaggacgaggtggaggacgaagaagaggaggcgcgtcaacagtttctcgaacagtcccttcaacctgggcttcaggtcgctagatgggggggggtggcattgccaagagaacacattgagggcggaggaggcccgtccgacccttcggagtttgggacaaaatttagagctccgcccagatccgccgctgccagtgaagacgcgcgccagcctgctaaacctccatattcctatatcgcactgatcacgatggctatactgcagaacccgcacaagagacttaccctgagtggcatttgtgccttcatcagtggacggtttccatactacagacgcaagtttcctgcttggcaaaactctatccgccacaatttatctctgaacgattgttttgttaaaatcccaagagaacccggccatcctggaaaggggaattactggagccttgaccccgcgagtcaggatatgtttgacaacggctcttttctccgccgcagaaaaagatttaagcgtcaccagttgaccccaggagcccacctcccgcatccattcccccttcctgccgcccacgcagcactgcacaatccacaccctggccccctccttggagcacccgctccccctcaacccgtacctggcgcctatcctaatacggcccccgggcggcgtccctacgccctgttgcatccacatcccctcaggtatctcttgctgagcgcccgggtctatgcaggtgctcctaaaaaagctgagggcgccgacctggccacaccggcgcccttcccctgctgctcaccacacctagttctcagccttggcagaagggccagggtgtggcgccggcaccgtgaggccgatgccagtctgagcgcgctcagggtgctgtgcaaaggaagcggcgagagagtccagggactcagacgggtgtgcccacgtcctagaggagcaacagctacctgtagctcagatcaccaggcctgctgtattcctaagcccctgccactttgttgtaaatgtccccctccactgttgctgggacagttttgttctaactcgtccagcattaggaggaccgcccctacggcagcgctcccaccccgagctcgatgttgggctggaacatgcagaccaaggcgccgctgctag

SEQ ID NO: 188128 - DNA, 1254 bp, Artificial Sequence
  Description of Artificial Sequence: Synthetic coding sequence
atgaacctgccccgggccgagcggctgcggagcaccccccagcggagccttcgggactctgatggcgaggacgggaagatcgatgtgctcggggaggaggaggacgaggatgaggtggaagatgaggaagaggctgcatctcagcagttcttggagcagagccttcagcctgggttacaagtagccagatggggaggcgtcgctctccctcgggaacacatcgagggaggcgggggccctagtgacccaagtgagttcggaacgaagttccgcgcgccacctcgaagcgccgccgcctctgaggatgcgaggcagcctgctaagccaccatattcatatattgcgctcatcactatggccatcctccagaatccgcacaaaaggctgacattgagcggcatatgtgcttttatttctgggcgattcccatattaccgtcggaaatttccggcttggcagaattccatcagacacaacctgagcctaaacgactgctttgtgaagattccaagagagccaggccatccaggtaagggtaactactggagcttagaccccgcctctcaagatatgtttgacaatgggagcttccttcggagacgcaaaaggtttaagcgccaccagctgacccccggtgcacatttgccacatccctttcctcttccagcagcacacgccgcactacacaatccccggcctggtcctctcctgggagctcctgccccacctcaaccagtgcccggggcatatcctaacacagcccccggcagacgaccatacgccttgctgcacccgcacccactgcgttacctactgttatctgcgccggtgtacgcaggcgccccaaagaaggccgaaggtgccgcactggccacccccgctcctttcccctgttgctctccacatctggtgttatccctgggtaggcgggccagagtgtggaggcgtcaccgtgaggccgatgcaagcctgtccgctctaagggtgctgtgtaaagggtccggggagcgcgtgcaggggctgagacggatatgtcctcgccccaggggggccactgccacgtgtagctcagaccaccaggcttgttgtatacctcgacctctgcccctttgttgcaagtgtcctccacctccgcttcttggccaattttgttccaactcctcatcgatccgccggcggaccgctcctaccgctgccctcccgccccgcgcccggtgctgggctggtacttgtaggccgaggaggccatgctag

SEQ ID NO: 188129 - DNA, 1122 bp, Artificial Sequence
  Description of Artificial Sequence: Synthetic coding sequence
atgaccgccgagagcggccccccccccccccagcccgaggtgctggccacagtgaaagaggaacggggagagacagccgctggtgcaggcgtgcccggggaagctaccggcaggggcgccggtggtagaaggaggaagcgtcctctccagcgagggaagcccccgtattcttatattgctcttatagcaatggccatcgctcacgcccccgaacgaaggctcaccctggggggcatatacaaattcataactgagcgctttccattttaccgtgacaaccccaaaaaatggcagaacagtattcggcataatcttactctgaacgattgctttctgaaaatccctcgggaggccggaaggccgggtaaaggaaactactgggccctcgacccaaacgcagaggacatgtttgagagcgggagctttctgcgcaggcgcaaaagattcaaacgctccgacctaagcacttaccccgcatacatgcatgatgctgccgccgctgcagccgctgcggcagcggcagccgcagccgcagcaattttccctggcgcagttcccgctgctagacctccatatccaggcgcagtctacgcaggatatgctcccccttctctagccgctcccccccccgtttactaccctgctgcctctccaggtccttgcagagtgttcggcctggtacccgagcgacctctaagccccgaacttggtcctgctccatctggcccaggcgggtcctgtgctttcgcaagtgctggggcccccgctactactacggggtatcagccggctgggtgcacaggcgcgaggcccgccaacccctcggcctatgctgccgcatatgctggccccgatggagcatacccacagggtgctggttcggcaatttttgcagcggctggaagattggctggcccagcaagccccccagccggtggaagctcaggcggcgtagagacaacagttgacttctacgggcgcaccagtccagggcagttcggagctcttggcgcatgctataatcccggtggacaactgggaggggcatccgcaggtgcatatcatgctaggcacgccgccgcatatccgggcggaatcgatcggttcgtgagcgccatgtag

SEQ ID NO: 188130 - DNA, 960 bp, Artificial Sequence
  Description of Artificial Sequence: Synthetic coding sequence
atggccggccggagcgacatggacccccccgccgccttcagcggctttcccgccctccccgcagtcgccccttccgggcctcctccatctcccctggcaggcgcggaacctggccgcgagcctgaagaggcagcagcaggccggggcgaggccgctcccaccccggcacccggccctggtcgtcgaagacgacgccctctgcaacgaggcaagcccccatactcatacattgcattaattgctatggcgctcgcccacgcccccggccgtagactgacactggccgccatttatcgattcatcaccgagcgattcgccttctacagggacagccccagaaagtggcagaactcaatccgccacaacttgacattgaacgattgctttgtcaaagtcccaagagagcctgggaatcccggaaaaggcaactactggaccctcgacccagcagcagctgatatgttcgacaacggctcttttctacggcggcgcaaaagattcaaacgcgccgaattgcctgcccacgccgctgcagcccctgggccacctctgcctttcccttacgccccatacgcccctgcccctggaccggctttgctggtcccaccaccatcagctggtccgggcccctcacctcctgcccggctgttttcagtggactctctcgtcaatctccagcctgaactggcaggcctgggtgccccggaacctccgtgctgtgcggcaccggacgccgcagcagccgcatttcccccctgcgcagccgccgctagcccgcctctctacagccaagtgccggatcggttagtgctgcccgctactagacctggccccggcccgctgcccgctgagccactgctggctctggccggacccgcggccgccctgggtcctttgtctccgggagaagcatacctcaggcagccaggatttgccagcgggcttgaaaggtacttgtag

SEQ ID NO: 188131 - DNA, 1335 bp, Artificial Sequence
  Description of Artificial Sequence: Synthetic coding sequence
atgaccaccgagggcggccccccccccgcccccctgcggcgggcctgttcacctgttcccggggcacttcaagccgcactgatgtcccctccccctgctgccgccgctgcagccgcagccgcacccgaaacaacaagctcctcttcctcatcctcgtccgcctcttgtgcaagttctagttcatcaagcaactctgctagtgccccttctgccgcttgtaagtccgcaggaggagggggggccggagcaggctccggaggcgccaagaaagcctcttctgggctgcggcgtcccgagaagcctccgtactcctatatcgcactaatagtcatggctattcagtcctccccctctaaaagactgaccttatcagagatataccaatttctccaagccagatttcccttcttccggggtgcctatcagggatggaaaaattccgttaggcataacctgtcccttaatgagtgcttcatcaaactgccaaagggcttggggcggccgggaaaagggcattactggactattgacccagcttccgagttcatgttcgaggagggatcctttcggaggaggcctagggggtttcggcgtaagtgccaggctctaaagcctatgtatcacagggtcgtgagcggactgggattcggagccagccttctaccacagggctttgactttcaggctcctccctctgcgcctctgggctgtcactcccaaggggggtacgggggtctggacatgatgccagccggttatgatgccggagccggtgctccgagccacgctcatccacatcatcatcaccaccatcacgtgccacacatgtctcctaatcccggctccacgtatatggcctcctgtcccgtaccagccgggcctgggggagtcggcgctgccggaggggggggcggaggcgactatgggccagactctagcagctcaccagtacctagtagtcccgcaatggcctccgcaatcgaatgtcattcaccttacacttctcctgcggctcattggtccagccccggcgcatcaccctatctgaaacaacctccagcattaactccgtcctccaaccctgccgcttccgccgggctgcatagtagtatgagctcctacagtctggagcagtcatacttgcatcagaatgcccgggaagacctctccgtgggactccctcgctaccagcaccacagtaccccggtctgcgatcgtaaggatttcgtattgaactttaacggcatttcctcatttcatccatccgcttctggaagttattaccatcaccaccaccagtccgtgtgtcaagatataaaaccatgcgtgatgtag

SEQ ID NO: 188132 - DNA, 1470 bp, Artificial Sequence
  Description of Artificial Sequence: Synthetic coding sequence
atgctggacatgggcgaccggaaggaggtgaagatgatccccaagagttctttttccatcaacagtctggtgcctgaggccgtccagaatgataaccaccacgctagccatggccatcataatagtcaccacccccaacaccaccaccaccatcaccaccaccatcaccacccccctcccccagcaccacagcctccacctccaccacaacagcagcagccccccccacctccgccccccgccccccagcccccgcaaacccgcggggctcccgccgccgacgatgataagggtccacagcagctgctgctccccccaccaccccctcccccgcccgcagctgccctggacggagcaaaagcagacggactgggaggcaagggggagccagggggcggtcctggggaactggcgcctgtcggaccggatgagaaggagaaaggcgccggcgctggtggggaggagaaaaagggcgcaggagagggtggaaaagacggcgaaggtggtaaggaaggggaaaagaagaacggtaagtatgagaaaccaccgttttcttacaacgccctcatcatgatggcgatccgacaatcccctgagaaacgccttaccctgaacggcatttacgaatttatcatgaagaatttcccgtactacagagagaacaaacagggatggcagaattccatcagacacaatctgagtttgaacaagtgctttgtcaaagtcccccggcactacgacgaccctgggaagggtaactactggatgttggacccatctagcgacgatgtgttcatcggcgggacaactggaaagctgcgcaggcgctcaacaacctctcgggcgaaactcgctttcaagagaggcgcaagattgacgtcaaccggccttacctttatggatcgagccgggtccctatattggcctatgagcccattcctcagcctacatcaccctcgtgcatccagcacattgtcatataatggtactacaagcgcttacccaagccaccctatgccgtattcttcagtgctcacacagaactctctaggaaataatcattccttttctacagccaacggattatccgtcgatcggcttgtgaatggcgagattccctatgcaacccatcacctgacggcggctgccttggcggcgtcagtcccttgcggcctctctgtgccttgcagtggtacctactcgctgaatccatgttccgttaatctccttgcagggcagacctcttatttcttcccacacgtaccccatccttccatgacctctcagtcaagtacctcaatgtcagctcgcgccgcatcatcctctacaagcccccaggccccatcaactttgccatgtgaatcactgaggccgagtctgccgagttttactactggactttccggaggattgagtgattactttacacatcagaatcagggctctagttcgaaccccttgatacattag

SEQ ID NO: 188133 - DNA, 1470 bp, Artificial Sequence
  Description of Artificial Sequence: Synthetic coding sequence
atgctggacatgggcgaccggaaggaggtgaagatgatccccaagtcctctttttcaatcaactccctcgtgccagaagctgttcagaacgacaaccaccatgcgtcccacgggcatcacaactcccaccatccccagcaccaccaccaccaccatcaccatcaccaccacccccctccgcctgccccgcagcccccgcctcccccccagcagcagcagccacccccaccccctcctcctgcgccacagccaccccagacaaggggcgcacctgcagccgacgacgataaaggaccccagcagctgttgctgccccccccccctccacccccccccgccgcagccctcgacggagcgaaggcagacgggctggggggtaagggcgagcccggtggaggccctggtgaactcgcccctgtcggccccgatgagaaagagaaaggagctggagctggaggtgaggaaaaaaagggggcaggagagggaggcaaagatggggagggaggaaaggaaggagagaaaaagaacgggaagtacgagaaaccaccattcagttacaatgcgctcatcatgatggcaatccggcaaagtcctgaaaaacggcttacccttaacggcatttatgaatttatcatgaaaaattttccttactaccgggaaaataaacaggggtggcagaatagcattaggcacaacttgagcctgaacaaatgcttcgtcaaggtccctaggcattacgacgatcccggcaagggaaactactggatgttagaccccagttctgacgacgtgtttatcggtgggactacggggaagctgcgtcggaggtcaactacctcaagagcaaaactggccttcaaacgaggggcgcggctcacctcaactggtctgacgtttatggacagggctggttccctctattggccaatgtcacctttcctgtcactgcatcatcctagagcttccagcacgctgagttacaacggcacgacttccgcctatccctctcaccctatgccctactcgagcgtgctgacacagaactccctgggcaataaccatagcttttccacagccaatggtctatctgtggaccgactggtgaatggcgagatcccctatgctactcatcacctcaccgctgcagccctggccgcctccgtcccttgcggcctcagcgtaccgtgctctgggacttatagcctaaatccatgctcggtcaacctgttggcagggcaaacttcctacttctttcctcatgtgcctcaccccagtatgacgtcccagagtagcacaagtatgtcagcccgcgccgctagctcttctacaagcccccaggccccttccactttaccttgcgagtccctgagaccaagtctgccatcattcaccacaggactctccggagggctaagcgattattttactcatcagaatcagggctcgagctctaacccactgattcactag

SEQ ID NO: 188134 - DNA, 1137 bp, Artificial Sequence
  Description of Artificial Sequence: Synthetic coding sequence
atgagcagcttcgacctgcccgcccccagccccccccggtgcagccctcagttcccttctattggccaagagccccccgagatgaatctgtattatgaaaacttctttcacccacagggtgtacctagcccgcaacgcccaagttttgaaggcggaggcgagtacggggcaaccccaaatccctacttgtggtttaacggaccgacaatgaccccacctccatacctgccaggaccaaacgcttctcccttcttaccacaggcgtacggcgtgcagcgcccactcttacctagcgtgtccggcctgggggggagcgacttgggatggctcccaatacctagccaggaagagctgatgaagctggtcaggcctccatattcttacagcgcactcatcgcaatggcaatccacggagctccagataaacggttgacccttagccaaatatatcagtacgtggccgataacttcccgttttataacaagagtaaggccggctggcagaatagtattcgacacaaccttagccttaatgattgcttcaaaaaggtgcccagagacgaggatgatccaggcaaggggaactattggactctggatccaaactgcgaaaagatgtttgacaacggtaacttcaggcggaagcggaagcgcaagtccgatgtgagctcttccaccgcatcccttgctttagagaagacagagagctctctgccagtggactccccaaaaacgacagaacctcaggatattctcgatggcgcctcccctggaggaactacatctagccctgagaaacggccctcgccgcccccttccggggccccatgcctgaattcattcctgtcgagcatgaccgcctacgtgagcggcggatctccaacgtcccaccctcttgttactccaggactgagcccggagccgtctgacaaaacaggacagaactccctgacatttaactcattctccccactcaccaatcttagtaatcattcagggggcggcgactgggccaatcctatgcccaccaacatgctatcgtatggaggcagtgtgctctctcaattttccccacatttctacaatagcgtgaacacctcaggagtcctataccctcgagagggcacggaagtgtag

SEQ ID NO: 188135 - DNA, 852 bp, Artificial Sequence
  Description of Artificial Sequence: Synthetic coding sequence
atgagcagcttcgacctgcccgcccccagccccccccggtgcagccctcagttccccagcattggacaggaacctcctgaaatgaatttgtattatgaaaatttttttcacccccagggcgtgccttccccccaacggccatctttcgaaggaggcggagagtacggcgctactccgaatccttacctgtggttcaacggtcctacgatgacgcctccaccttatctgccaggcccaaatgctagccccttccttccgcaggcctacggcgttcagaggcctttactccccagcgtgtcaggtcttgggggaagtgacctaggatggctccctatcccttcccaagaggaacttatgaagctggtcagaccgccctactcctactccgccctcatagcaatggccatccacggagcccctgacaagcgcttaaccctctcacagatctaccagtatgtggccgataatttcccgttctataataaaagtaaagcagggtggcagaatagtattcggcacaacctgtcgcttaatgattgcttcaagaaggtgccccgcgacgaggacgaccccgcctacgtctctggcggttcacccacctcacacccactagtgactcctggcctgtccccggagccaagtgacaagaccgggcagaatagtctcacctttaatagtttctcgcccctcaccaacttgtccaaccattccggggggggggattgggcaaatccaatgcctaccaatatgctgagctacggcgggagcgtgttgtctcaatttagtcctcatttctacaacagtgtgaacactagcggagtgttgtacccacgcgaggggacagaagtttag

SEQ ID NO: 188136 - DNA, 1266 bp, Artificial Sequence
  Description of Artificial Sequence: Synthetic coding sequence
atggccgagagctggctgcggctgagcggcgccggccccgccgaggaagctggtcctgagggcgggctggaggaaccagacgcactggatgattcactgacaagccttcagtggctccaggagttctctattcttaacgccaaagccccagcactgccacctgggggtactgacccacacggataccaccaagtaccaggttccgccgcccccggaagcccgctggctgccgaccctgcttgcctcggtcagcctcacacacctggaaagccaaccagctcatgtacctctcgctccgccccccccggcctgcaggcaccacctcctgacgacgtggactatgcaactaatccccatgttaagccaccgtacagttacgcgacactgatttgtatggctatgcaagccagcaaggcgacgaagattacattaagtgctatttataaatggattactgacaacttctgctactttcggcatgcagacccaacctggcagaacagcatccgccataatctttccctgaataagtgcttcattaaagtacctcgcgagaaggacgagccagggaaaggcgggttctggaggattgatccccagtatgccgaacgactgctgagcggagcgtttaaaaaaagaaggctccccccagtccacatccaccccgctttcgctagacaggcagcccaggagccaagcgcggtgccacgtgcagggccgctgaccgtgaatacagaagcccagcagctcttgagggagttcgaggaggccaccggggaagctggctggggcgccggcgaggggcggctgggacacaaaaggaaacagcctctgccgaagagagttgccaaagtgccccggcctcccagcaccctcctacccacaccagaggagcagggcgagctcgagcctttgaagggcaactttgattgggaagccatcttcgatgccggaactttgggaggggagctcggtgcacttgaagccctcgaacttagtcctccactcagtccggcatctcacgtagacgtcgatttgacaattcacgggcggcatatcgattgtccagcaacgtggggtccctcggtcgaacaggcagccgacagtctcgacttcgatgagacattcctggccactagcttcctacaacacccatgggacgagtcaggctcgggctgtctacctcccgagcctctttttgaagcaggcgacgcaactcttgccagcgacttgcaagactgggcttcagtcggcgctttcttgtag

SEQ ID NO: 188137 - DNA, 987 bp, Artificial Sequence
  Description of Artificial Sequence: Synthetic coding sequence
atggccgccgccgccgccgccctgagcggcgccggcaccccccccgcgggaggcggggcggggggtggtggcgcaggcggtggcggttccccgcctggggggtgggcagttgctcggctcgaggggagggagtttgagtacttaatgaagaaacgcagcgtgaccataggccggaacagctcccaaggaagcgtcgacgtgagcatgggccattcttctttcatctcaagacgccatctggagatattcacccctcctggcggtggagggcatgggggtgccgccccggaacttcctccagcccagcctaggccagatgccggtggcgatttttacctgcgatgtctggggaaaaacggagtattcgtggacggggtgttccagcgacggggcgctccccctttgcagctccccagggtttgtaccttccgtttcccttctaccaacattaagatcaccttcaccgccctgtcctctgaaaagagggagaaacaggaggcctcggagtcgccagtcaaagcagtgcagcctcacatttcgccccttaccattaacattcctgatactatggcccaccttattagcccattgccatcccccactggtacaattagcgcagctaatagttgtcctagctccccacgtggtgcgggatctagcggatacaaggtgggtcgtgtcatgccctctgacttaaatttgatggctgacaactcccagcccgagaatgagaaggaagcttccgggggtgactctccgaaggacgattcaaagcctccctatagttatgcgcagttgatcgttcaggctattacgatggctcctgataaacagcttacacttaatgggatctatactcatattacaaagaactatccttactaccgtactgcggacaagggttggcaaaggggagaatcattcgcccacgttggcaatacccggatcaggatcggtttgcccgcacacaaggccccgcaacgttag

SEQ ID NO: 188138 - DNA, 1983 bp, Artificial Sequence
  Description of Artificial Sequence: Synthetic coding sequence
atggccgccgccgccgccgccctgagcggcgccggcaccccccccgccggcggtggagcaggaggagggggtgccgggggcggcggttcgcctcctggaggctgggcagttgcgaggctggaaggcagagaattcgaatacctgatgaaaaaacggagtgtgactataggcagaaattcttcccagggaagcgtggatgtgtccatgggtcactcctctttcatcagcagaaggcatcttgagatctttaccccccctggtggagggggacatgggggtgctgccccagaactgccacccgcgcagcctcgtccagatgctgggggagacttttatctcaggtgcttaggaaaaaatggcgttttcgtcgatggcgtgtttcagagaaggggcgcccccccccttcagttgccacgggtatgtaccttcagattccccagcacgaatattaagatcaccttcactgccctgtcatcagaaaagagagagaagcaggaggcatcggagagccctgttaaggccgtgcagccgcatattagccctctcacaatcaacatccccgacacaatggcgcacctgattagcccccttccctctcctactggtaccatcagcgcagccaacagctgcccatcatcgcctaggggtgccggcagcagcggatacaaagtaggccgggtgatgccctctgaccttaacctcatggcagataacagccagcctgaaaacgagaaagaggcttccgggggcgactcccccaaagatgactccaagccaccgtactcttatgctcagctcattgtgcaagccattacaatggcacctgacaagcaattgaccttaaatggaatctatacccacatcacgaaaaactatccatactataggacagccgacaagggctggcagaacagtatcaggcacaatctgtctctgaatcggtattttatcaaggtcccccgaagtcaggaggagccaggcaaaggcagtttttggcggatcgacccagcatctgagtccaaactgattgagcaggcatttcgtaagcggaggccccggggtgtgccttgttttagaacccccctgggccctctcagttctaggtcagcccccgcatcacccaatcatgcgggcgttctctcagcccatagttccggggcccagacaccagagtctctgagccgggaggggtcgccagcccctcttgagcccgagcctggagctgctcagcctaagttggcagtaattcaggaagcacgcttcgcccagagcgctcctggcagcccactgtctagccaacccgtgcttatcactgtacagaggcaactgccacaagccattaaacctgtcacctacaccgtggccactcctgttaccacttccacatctcagcctcctgtggtccagaccgttcacgtggtccatcagatccccgcggttagtgtaacatccgtagccggactcgcgcctgcaaacacctacaccgtcagcggccaggctgttgttacacccgccgcagtccttgcccctcctaaagccgaagctcaggagaacggtgatcacagggaggtgaaagtgaaagtagagcccatccctgccatcgggcacgcaactctcggtactgcttcccggattatacagaccgcccagactacccctgtccagactgtgactattgtccagcaagccccactcgggcagcaccagttacccattaagacagtgactcaaaatggaactcacgtggctagcgtccctacagctgtgcacggacaggtcaacaacgccgccgcctcccctctgcacatgctggcgacacacgccagtgcaagtgcctccctacctaccaagcgccacaatggggaccagcctgaacaacctgaactgaagcggattaaaaccgaggatggcgaaggcattgtgatcgcactgtctgttgacactcccccagcagccgtgcgagagaagggcgtgcagaactag

SEQ ID NO: 188139 - DNA, 1833 bp, Artificial Sequence
  Description of Artificial Sequence: Synthetic coding sequence
atggccgccgcccggcgggccctgggcgccggcaccccccgggccagaggccgcggcagaggggcaggcggtggaggttctcgcagagccctgggtaggggggccccaggtggaccccgggtgagggtgagcgatgaggaggccctgggagaccaccgtccgcaattagtggctgggctggggggaagagagcatggtcccctggagctccacctgcctgcccctcctcgggatctgcatgcaccaggccgtaggggacacggcggagccgctcccgagctgcctccggcccaaccccggcctgacgctggtggcgatttctacctaaggtgcctcggcaagaatggggtgttcgtggacggcgttttccagagaagaggtgccccaccattacagctgccacgcgtatgcaccttcaggttccccagtaccaacattaagattacatttacggcattgtccagcgagaagcgcgaaaagcaggaggcgtccgagagtcctgtcaaagccgtccagccacacataagtccactcactatcaatattccggatactatggcacacctcatatcaccacttccaagcccaactgggaccatttcagctgctaatagctgcccaagttcccctcgcggagctggctcctcaggctacaaagtgggccgagtcatgcctagcgacctgaatctgatggcagataactcacagcctgagaacgagaaagaggcgagtggcggcgactctcctaaagatgattctaagcctccatatagctacgctcagcttattgtccaggctatcaccatggctcccgacaagcaacttacacttaatgggatctatacacatatcaccaagaactatccctattacaggaccgcagacaaggggtggcagaatagcatcaggcataatctgagcctgaacagatatttcattaaagttccaagatctcaggaggagccaggcaaagggagcttctggcggattgatccggcctctgagtcgaagctgatcgaacaagctttcagaaagaggcggcctcggggcgtgccttgcttcaggacacccctgggcccgctgagctcccgtagtgcacctgcttcacctaatcatgcgggcgtgctcagtgcgcatagttccggcgctcagactcccgaaagtctttctagagaaggaagccccgcacctcttgagccagaaccgggcgcagcccagcctaaactcgccgtgattcaggaggccagattcgctcagagcgcacctggttcaccattgtcctcccaacccgttcttatcactgtgcagaggcagttaccacaggccatcaaacctgtgacctataccgtggccactccagtcacaacatccacttcccagcccccggtcgttcaaacagttcacgtggtacaccagattccagctgtatccgtgacctctgtggccgggctcgcacctgccaacacttacacagtttcaggccaggccgtggtcacacccgccgccgtgctcgcacctccgaaggctgaggctcaggagaacggggaccaccgagaggtcaaagttaaagtggaacccataccggcaattggacacgcaaccctgggaaccgcatcgagaatcatccagactgcgcaaaccacgcccgtgcaaacggtcaccatcgtccagcaagctccactggggcaacatcaactccccataaagacagtgacacagaatggcacacatgtcgcttcagtcccaactgccgtgcacggtcaggtgaacaatgggcctctagggctccgcagacccccctgcgccagctcagattggtcttgtctcagctag

SEQ ID NO: 188140 - DNA, 1038 bp, Artificial Sequence
  Description of Artificial Sequence: Synthetic coding sequence
atgagccacctgttcgacccccggctgcccgccctggccgccagccccatgctctacttgtacggtcccgagagacctgggctgcctctggcattcgccccagcagctgcacttgctgccagcggacgggctgagacaccgcaaaaacctccatactcttacatcgccctcattgctatggctattcaggatgctcctgagcaaagggttacccttaatggcatttaccagttcataatggaccgcttccccttttatcatgacaaccgacagggctggcagaatagcataagacacaacctttccctgaacgactgctttgtcaaagtgcccagagagaaaggccgacccgggaaaggcagctattggactctggacccaagatgcctggatatgtttgagaacggcaattatagaaggagaaagagaaagcctaaaccagggccgggtgccccggaagcaaagcgccctcgggccgaaacacaccagaggagtgcagaggctcagccagaggccggatcgggcgccgggggatctggtccagcgatctcacggctacaggccgcgcctgcaggacccagcccactcctggacgggcccagtccacccgccccgctgcattggcccggtacagcatcacctaacgaagacgcgggagacgcagctcagggcgccgccgctgtcgcagttggacaggctgccaggaccggcgacggtccaggttctccactaagacctgcttccaggagctctccaaagtcaagtgataagagtaaaagctttagtatcgacagcattctcgccggcaagcaaggacaaaagcctcctagtggagacgagcttctgggtggagctaagccagggcccggaggccgcctgggggcctcactattggctgcttcaagctccctgagaccaccattcaacgcatccttgatgctcgatcctcatgtgcaggggggattttaccagctgggcattcccttcctgagctactttccactgcaggtaccagacactgtactgcacttccagtag

SEQ ID NO: 188141 - DNA, 1131 bp, Artificial Sequence
  Description of Artificial Sequence: Synthetic coding sequence
atgatggccagctaccccgagcccgaggacgccgccggcgccctgctggcccctgaaaccgggaggaccgtgaaggagcccgaaggcccacctcccagccctggcaagggcggtgggggcggaggaggtactgcacccgaaaagccggaccccgcccagaaacccccgtactcatatgtcgctctaattgccatggccattagggaatcagcagagaagcggctgacacttagcggtatctatcagtacatcattgcgaaattcccattttacgagaagaacaagaaggggtggcagaatagcatacgccataatcttagtcttaacgaatgctttattaaagtccctcgagagggcggtggcgaacgcaaaggcaattattggaccttagatccagcctgtgaagatatgttcgagaaagggaattataggcgccgaagaaggatgaaacggcctttccggccacctccagctcattttcagccagggaagggcctctttggggccggtggagccgctggaggatgcggcgtagccggtgcaggagcagatgggtacggctacctagctccacctaagtacttgcagtcaggcttccttaataattcttggccacttccccagccacccagcccaatgccctatgcctcatgccaaatggccgctgccgcagcggccgccgctgcagctgctgcggctgcaggtcccggctcacctggcgccgccgctgtggtaaagggcctcgcaggacccgccgcatcatacggaccatacacaagggtgcaatccatggccctcccccccggagtagtaaattcatataacggactgggaggtccacctgctgctcccccaccacctcctcacccacatcctcacccacacgctcatcatctgcacgcagctgctgctccaccccctgcccctccccatcatggagcagcggctcccccacccggccagctgagccctgcctctcccgcgacagccgccccccctgcccctgcgcctacgagcgcccctgggctccagtttgcctgtgctcgccagccagaactagctatgatgcactgttcctattgggatcacgactctaagaccggcgccctccatagccggctggatctgtag

SEQ ID NO: 188142 - DNA, 810 bp, Artificial Sequence
  Description of Artificial Sequence: Synthetic coding sequence
atgatggccagctaccccgagcccgaggacgccgccggcgccctgctggcccccgagactggcagaacagtaaaggagcctgagggcccacctcctagcccaggtaagggtgggggcgggggcggggggacagccccagaaaagcccgaccccgcccagaagcctccatatagttatgtggcgctgatcgctatggccatccgcgagagtgccgagaagagactcacactatctggtatctatcagtatattatcgctaaattccctttttatgagaaaaataaaaagggatggcagaactctattagacacaatctgtcacttaatgagtgcttcattaaagtgccaagggaggggggtggagaaaggaagggtaattactggactttagatccagcgtgcgaagatatgtttgagaagggaaattacagaaggcgccgcagaatgaagaggccatttcgacctccgccagcacacttccagccaggcaagggcctgttcggagctggtggcgccgcgggcgggtgcggcgtcgctggcgccggagccgacggctacggttacttagcccccccaaagtatcttcagagtggattcctcaataactcctggcctctgccccagccccccagccctatgccatatgcttcgtgccagatggctgccgcagcagcagcggccgctgctgcagccgctgcggccggtcccggttctctggcccgacccctgtggtccaggggatggagagctcggccccctagaactggccggactcatgcctgcagggcctggaggtgccccccagcttag

SEQ ID NO: 188143 - DNA, 2406 bp, Artificial Sequence
  Description of Artificial Sequence: Synthetic coding sequence
atgaagaccagcccccggcggcccctgatcctgaagcggcggcggctcccactccccgttcagaatgcaccatcggagaccagcgaggaggagcccaagcgcagtccggctcagcaggagtcaaatcaggccgaggcctcaaaggaggttgcagaaagcaatagctgcaagttcccggccgggataaagatcatcaaccatcccactatgccgaacacccaggttgttgcgattcctaacaatgcaaacattcactctattattaccgcactcaccgccaaaggaaaggagagcgggagctccggccccaacaaatttattctgatctcatgcggcggagctcctactcagccacctggactcaggccccagactcagacatcatacgatgccaaaaggactgaggttacactcgagaccctaggccctaaacccgctgctcgcgatgttaacctacctagaccgccgggcgctttgtgcgagcagaaaagggagacttgcgccgacggagaggccgcgggatgtactatcaataattctctgtcaaacatccaatggctccggaaaatgagcagtgatggcttggggtcaagaagtatcaagcaggagatggaggaaaaggagaattgccacctggaacaaagacaagttaaggttgaagagcccagcaggcccagtgcaagctggcagaactccgtgtcagagcgcccaccctatagctacatggccatgatacagttcgcaattaattcaaccgaacggaagcggatgacccttaaagatatctacacatggatcgaagaccatttcccctatttcaagcatatagctaagccagggtggaagaactctattcggcataacctgagcctgcacgatatgttcgtcagagagactagtgcaaacggtaaggtctccttttggaccattcatccaagtgctaatcggtaccttacactggaccaggtctttaaacctctggatccgggcagcccacaattacctgaacacttagaatcccagcaaaaacgccctaacccggaactgcggcggaatatgacaatcaagactgagctcccactgggcgccagaagaaagatgaagccgctgctgcctcgggtgagctcttacctcgtccccatccagttccccgtcaaccagtcactggtgctgcagccctccgtaaaggtgcctctgcctctagccgcctccctcatgtcatccgaactcgcgcggcattctaaacgggttaggatcgcaccaaaggtgtttggtgaacaggttgtcttcggatatatgtccaagttcttcagtggcgatcttcgggacttcggaactccaatcaccagtctatttaatttcatttttctctgcctgagcgtgttattggcggaggagggcattgctccactgagttccgccggtcccggcaaagaagagaaacttctatttggcgaaggcttctcacctcttctccctgtgcagaccatcaaagaggaagagattcaacctggagaggagatgccacatctggccaggcccattaaagtggagagccctcccctggaagaatggccgagccccgccccatcttttaaggaagaatctagtcacagctgggaggactcgtctcaatctccaacaccacgacccaaaaaatcttacagcgggctacggtcccctactagatgcgtctcggagatgctggtaatccaacacagagagcgtcgcgaacggtccaggtctcgaaggaagcaacatctcttgcccccttgtgtggatgagcctgagctgctgtttagcgaaggtcccagtacctctcgttgggccgcggagcttcctttccctgccgactcctccgacccggcatctcagcttagctactcgcaggaagtgggtggtccattcaaaacccctatcaaagagactcttcccatctcatccacccctagcaagtccgtactgcctcggacaccggaatcgtggcgcctaacaccgcccgcaaaagttggcggccttgatttctccccagttcaaacgagtcagggggcctccgatccccttcccgacccactgggattaatggatttgtctacaacacccctgcaatctgctccacccctggagagcccacaacggctgctcagcagtgaacccctggatctgatctcagtaccgttcgggaacagtagtccatcggacatagacgtccctaagccaggtagcccggaaccacaggttagcgggctggccgccaatagatcgctaaccgagggcctggttctggataccatgaatgacagcttgtctaaaattcttctcgatatatctttccccggattggatgaagacccactgggacctgacaatatcaactggtcccagtttatccctgagctgcagtag

SEQ ID NO: 188144 - DNA, 2292 bp, Artificial Sequence
  Description of Artificial Sequence: Synthetic coding sequence
atgaagaccagcccccggcggcccctgatcctgaagcggcggcggctcccattaccggtgcagaatgctccttccgagacctctgaagaggaaccaaagcggtcacctgctcaacaagagtccaatcaggccgaagcaagtaaggaggtggccgaaagcaactcatgtaaattcccagcaggcatcaagattatcaaccaccctaccatgcctaacactcaggttgttgcgatccctaacaatgcgaacatccatagtattattacagcactgaccgccaagggaaaggagtcaggcagctctggtcctaacaagtttatcctgatctcatgcggcggcgcgcccactcagcctcccgggttgagaccccagacccagacgtcttatgacgccaagcgtactgaggtcacattagaaacgttagggccgaagcccgctgctcgcgacgttaaccttcctaggcctcccggcgcgttatgcgaacagaagagggaaacctgtgcagatggagaggcagccggctgcacaattaacaacagcctcagtaatatccagtggctgcggaaaatgtcttccgatggcctgggctccaggtccatcaagcaggaaatggaagagaaagaaaattgccatttggaacaacggcaggttaaagtggaagagccttctcgcccttctgcgtcctggcaaaattctgtgtcggaacgacctccctacagttacatggctatgatacagttcgcaattaactccaccgaaaggaagcgaatgaccctgaaagacatctacacctggatagaagaccactttccgtattttaagcacattgcgaaacctggatggaagaactccattcgccacaatctttccctgcacgacatgttcgtcagagaaacaagcgccaacggcaaagtttccttttggaccattcacccttccgccaaccgatacctgacgctggatcaggtgtttaagccacttgatcccggatctcctcaattgcctgagcatcttgagtcccagcagaagcggcctaatcccgagttaaggcgcaacatgaccatcaaaacggaattacctttgggagccaggagaaagatgaagccactccttccccgcgtgagctcatatctcgtgcctattcagtttccagtaaaccaatccttggtgctacagccctctgtgaaggtacccttgcctttggctgctagcctcatgtcttccgaattggctaggcacagcaaacgcgtccgtatcgcccctaaggtgctgctggccgaggaaggaatcgcccctttatcatctgcaggaccgggaaaagaagaaaaactgctgttcggggagggattttcccctctcctccccgttcagacaatcaaggaagaagaaattcagcctggtgaagagatgcctcacttggcacgacccatcaaggtggagagtccacctttggaggaatggccttcacccgccccttcgttcaaggaagagagctctcactcttgggaagatagttcccagtctccgactccgcgccccaaaaaatcttatagtggcctgagatctcccacaaggtgtgtatctgagatgctggtgatacagcatcgagaaagaagagagcgcagcagatcacggaggaaacagcatttgcttcccccttgtgtggatgaacctgaactgctgttctccgaaggaccaagcacttcccgctgggcagcagaacttccctttccggccgatagcagcgatccggctagccagctttcatactcacaggaagtggggggtcccttcaagaccccaatcaaagagacactcccaatcagtagcaccccctcaaagagtgtcttaccccggaccccggagtcttggcggctgacccccccagccaaggtgggtggccttgacttctcccccgtgcagacgagccagggtgctagtgacccactgcctgatccactcggcctcatggacctgtccacgactcccctccagtcagcacctccactcgagagtccacaaaggctgctgtcgtctgaacccctggatctgatcagcgtgccattcgggaattctagtccaagcgacatcgatgtaccaaaacccggctcaccagaaccgcaggtttccggactggcagcaaacagatccctgaccgaaggcctcgttctggatacgatgaatgactccttgtccaagatcttgctggatatcagctttccgggcctggatgaggacccgctcgggccagataacatcaattggtcacagttcattccagaactgcagtag

SEQ ID NO: 188145 - DNA, 2247 bp, Artificial Sequence
  Description of Artificial Sequence: Synthetic coding sequence
atgaagaccagcccccggcggcccctgatcctgaagcggcggcggctgccccttccagtacagaatgccccaagcgaaacaagcgaagaggagcctaagagaagccctgcccagcaggagtcaaaccaagccgaggcttctaaggaggtggcagaatccaactcctgcaagttcccagccgggatcaaaatcatcaatcaccccactatgcccaacacacaggtggtggcaatccctaacaatgctaacatccactctatcattacagctttgactgccaagggcaaggagagcggcagcagcggccccaataagttcatactgatcagctgtgggggtgctccgacccagcccccagggctacgtccacagacacaaacatcttatgacgccaagcgtactgaagtgacactggaaaccctgggacccaaacccgcagctcgggacgtaaacctcccacggcccccaggagccctctgtgaacagaaaagagagacatgcgccgatggggaagctgccggctgcactattaacaattcgctctcaaacatccagtggctgaggaagatgtcttcggatgggttaggctcacgatccattaagcaagagatggaggaaaaggagaactgccacttagagcaacgccaggttaaggtggaagaaccaagccgcccgagcgccagctggcagaattcagtcagtgagcgccctccatactcgtacatggcaatgatacagttcgcaataaacagtacagagcgtaaacgcatgactctgaaggacatttacacatggattgaggaccacttcccttactttaaacatatcgccaaacccggctggaagaattcgatccgccacaacctctcactacatgacatgtttgtgagggaaacatcagccaacgggaaagttagcttttggacaattcacccaagtgccaatcgctatctaactttggaccaggtgttcaaacagcagaagcgcccgaacccagaactccgcagaaatatgaccattaaaacagaactgcctctgggggcacgaagaaaaatgaaacctcttcttccacgcgtgagctcctacctggtgcctattcagttccccgttaaccaaagtctggtattgcaaccttccgtaaaggttccactccctctcgctgcctccctcatgtcctccgaactggcgcgccattctaaaagggtgagaatcgccccgaaagtgttgctggcggaagaaggcatcgcccccttgagcagcgccggcccagggaaggaggagaagctgctgtttggagagggcttctcccctctgctgcccgttcagacaatcaaggaggaggagatccagcctggtgaagagatgcctcatctcgcacgcccgataaaggtagaaagcccaccgcttgaggagtggccatcccctgcaccttctttcaaggaagagagcagtcactcatgggaggatagctcccaaagccctactccccggcccaagaaatcctatagcggcctccggtcccccacccgatgcgttagtgaaatgctggttattcagcatcgcgagagacgggagcgctcccgttcccgaagaaaacagcatttgctaccaccatgcgtcgacgagccagaactgctgttctctgaaggaccctccaccagccggtgggcagcagaattaccttttcctgccgattccagtgaccccgcctcccagctgtcgtatagccaggaagttgggggaccatttaagaccccaattaaggaaacacttcctatctcctccacccctagtaagagcgtcctgccccgaacccccgaaagttggagactcacccccccagcaaaagtgggagggctggacttttctccagtgcaaacctctcaaggtgccagtgaccctctccccgatcctctgggattaatggacctgagtaccactccactgcagagtgccccgcccctggagagcccacagcggctactgagctcagagccgctggaccttattagcgttccatttggcaatagtagccccagcgatatcgatgtgccaaagccagggtcccccgagccccaggtgtctggactagccgcaaatcgctccctaaccgagggcctggttctagacactatgaacgatagcctgtcaaagatcttgcttgatataagttttccaggactggacgaggaccctctgggtcccgacaatattaattggtctcagttcattcctgaactgcaatag

SEQ ID NO: 188146 - DNA, 531 bp, Artificial Sequence
  Description of Artificial Sequence: Synthetic coding sequence
atgggcgcccccgccacccggcggtgcgtggagtggctgctgggcctgtacttcctgagtcacatccccataactctgttcatggacctgcaggccgtgctgcccagggagctttaccctgtggagtttcgtaacctgctaaaatggtatgcgaaagagttcaaggacccactcttgcaggagcctcccgcctggttcaagtcattcctgttttgcgagttagttttccagctgccttttttcccgatcgccacgtatgcctttcttaagggttcctgtaaatggatccgcacccccgctataatatactccgttcataccatgacaacacttatcccaatccttagcaccttccttttcgaggatttttcaaaagccagcggatttaaaggtcaaaggcccgaaaccctccacgaacggttgactctcgtgtctgtgtacgctccgtacttgttaatcccctttattttactgatatttatgcttcgctcaccctactacaaatatgaagaaaagaggaagaagaaatag

SEQ ID NO: 188147 - DNA, 1473 bp, Artificial Sequence
  Description of Artificial Sequence: Synthetic coding sequence
atgggccccgtgatgccccccagcaagaagcccgagagcagcggcatcagtgtgtcctccgggctttcacagtgctacggtgggtccggattctccaaggcgctacaggaagacgacgatctggacttctccctcccagacatccgcctcgaagagggcgccatggaagacgaggaacttacaaatttgaattggttgcacgagtctaagaacctactaaagtctttcggagagagtgtgctcagaagtgtctcccccgtgcaagacctggatgacgacacccccccttcacccgcccacagtgacatgccgtacgatgctaggcaaaatcctaactgtaagcctccctacagttttagctgcctcatcttcatggctattgaggactccccaaccaaaagactgcctgtgaaagatatttacaattggatcctggagcacttcccctactttgccaatgctccgaccggatggaagaattccgtccgtcataacctgtcactaaataaatgtttcaagaaggtggacaaggaacggagtcagagcatcggaaaggggagtctgtggtgtatagacccagagtatcgccagaatctcatccaggcactcaagaagacaccttatcaccctcatcctcacgtgtttaatacaccaccaacatgccctcaggcttaccagagcaccagcggaccccctatatggccaggatctacgttcttcaaacggaatggcgccctcctccaagaccctgacatagacgccgcaagcgccatgatgttgttgaatacccctcccgaaatacaagccggatttccaccaggcgtcatccagaatggtgcacgggtcctgtcccgggggttgtttcctggagtgagaccactacctattacccctatcggggtcaccgccgccatgcggaacggcataacttcctgtcgaatgaggacagaaagtgagccaagctgcggctctcctgtggtgtctggcgatcccaaggaagaccataactattcctcagcaaagtcctcgaatgcaaggtccacatcccccacttctgactccatctcttcctcaagcagctcagccgacgatcactatgagtttgccaccaaaggttcccaggagggatccgagggcagcgaaggctcctttcgatcgcacgaatcgccgagcgacaccgaagaggatgataggaaacattctcaaaaagaacccaaagactctttaggagattctggctatgccagccagcacaagaagaggcagcattttgcaaaggctcgaaaggtgcctagcgacacattacccctcaaaaagagaagaaccgagaagccccccgagtccgacgatgaggagatgaaggaggccgcggggtcactgctccatttggctggcatacggtcttgtctgaataacatcacaaaccggactgcgaagggacagaaagagcaaaaagagacgaccaagaattag

SEQ ID NO: 188148 - DNA, 1473 bp, Artificial Sequence
  Description of Artificial Sequence: Synthetic coding sequence
atgggccccgtgatgccccccagcaagaagcccgagagcagcggcattagtgtgtcaagcgggctgtcacagtgttacggaggaagtggcttctcaaaggctttgcaggaggatgatgacctggacttcagtctgccggacataagattggaagagggggctatggaggatgaggaattgaccaacctcaattggctgcacgaatcaaagaacttattaaagtcatttggcgagagcgttctgagatccgtgtctccagttcaagatttagacgacgatacacctccttctccagcgcactctgacatgccctacgacgccagacaaaaccctaattgcaaacctccttatagtttttcgtgtctgatctttatggccatagaggatagtcccactaaaaggctcccagtgaaagatatctacaattggattctggagcacttcccctactttgcgaacgcccccactggctggaaaaacagcgtgcgtcataacctcagccttaacaagtgtttcaagaaggtcgacaaagaacgctcacagtccatcgggaaaggctctctctggtgtatcgaccctgaataccgtcagaatctcatacaggctctcaaaaaaactccatatcacccgcatccccatgtgttcaatacccctcctacgtgccctcaggcctaccagagcacttccggccctcccatctggcccggtagcactttttttaaacgcaatggtgctctattgcaggatccagatattgatgccgcctcagccatgatgctgttgaataccccccccgagattcaggcaggattccccccaggggtcatacaaaatggagctcgcgtgctgtcccgagggctttttcccggagtgcgtccactgcctatcactccaatcggagttactgccgccatgaggaatggcatcacttcttgccgcatgcggactgagtcagaaccctcctgcggcagtccggtggtaagcggcgaccctaaagaggaccacaattattccagcgccaagtcctcaaatgctcggtctacttccccaacttcggactcaatctctagtagtagcagctccgccgatgatcactacgagtttgccaccaaggggtctcaggaaggaagcgagggatccgagggctcctttagatctcatgagtccccaagcgacactgaagaggacgaccgcaagcattcacagaaggagccaaaagattcacttggagactctggatacgcttcacagcacaaaaagcgacagcatttcgctaaggcccgtaaggttccttcggacactttaccccttaagaagcggagaacagaaaaaccacctgaaagcgacgacgaggagatgaaagaggccgccgggtctttgctgcacctggcaggcattaggagttgtctgaataatatcacgaatcgcaccgccaagggccagaaagagcagaaggagaccacaaaaaactag

SEQ ID NO: 188149 - DNA, 165 bp, Artificial Sequence
  Description of Artificial Sequence: Synthetic coding sequence
atgggccccgtgatgccccccagcaagaagcccgagagcagcggcatctcagttagctccggtctgtcccagtgttacggagggtctggtttctccaaggctttgcaggaggacgacgacctggacttcagtctgccagacatccgtctcgaggagggagcatag

SEQ ID NO: 188150 - DNA, 282 bp, Artificial Sequence
  Description of Artificial Sequence: Synthetic coding sequence
atgggccccgtgatgccccccagcaagaagcccgagagcagcggcatatcggtctcatctggcttgagccagtgctacggcgggagtggcttttccaaggccctccaggaagatgacgatctcgactttagcctgccagacatccgtctcgaggagggtgcgatggaggatgaagagctgaccaatctcaattggctgcacgagtccaagaatctgctgaaatctttcggagagagtgtgttgcggtctgtgagtcccgtgcaggacctcgatgatgattag

SEQ ID NO: 188151 - DNA, 1407 bp, Artificial Sequence
  Description of Artificial Sequence: Synthetic coding sequence
atgggccccgtgatgccccccagcaagaagcccgagagcagcggcatcagtgtatcgagcggactgtctcagtgctatggcggcagcgggttcagcaaagcacttcaagaagacgatgacctggacttcagtttgcccgacatccgactcgaggagggggctatggaggatgaagaattaaccaaccttaactggctacacgaatccaagaacttgctcaagagctttggcgaatcagttctgcgatcggtctcccccgtccaggatcttgatgacgatactccaccctccccagcacacagcgacatgccttatgacgccagacagaatccaaattgtaaacccccatacagcttttcctgcctgatcttcatggcgatcgaggacagcccgactaagcgcctccccgtgaaagacatctataactggatactcgaacacttcccctacttcgcaaatgcacccaccggctggaagaattccgtgcggcataatctgagcttaaataaatgtttcaagaaggtcgataaggagcggtctcagagcataggaaaaggcagtctgtggtgcatcgatccagaatacagacagaacctcatccaagctctgaagaagaccccctatcacccacacccacatgtgtttaacactccacccacctgtcctcaggcctatcagtccacctctggcccccctatttggcccggatctaccttttttaagcggaacggagccctgcttcaggtgcccccgggggttatacaaaatggtgcccgagttctgagtcgcgggctgttcccaggcgttcggccactgcctattacacctatcggtgtgaccgctgccatgcggaacggcataactagttgcagaatgaggacggagagcgaaccgagctgcggcagtcctgttgtgagtggagaccccaaagaagatcataattatagtagtgccaagtccagtaatgctaggtctacctccccgacttctgacagcataagctcctcaagcagttccgcggacgaccactacgagtttgccacaaagggctcccaagagggaagcgaagggtctgaaggcagcttcagaagtcacgaatcgcctagcgatacagaggaagatgacagaaaacactctcagaaagaacccaaagattccctgggggacagcgggtacgccagccagcataaaaaaagacagcatttcgctaaagcacgaaaagtcccttccgacaccctccctctgaagaaaagacgtacagagaaacctcctgagtctgatgatgaggagatgaaagaggccgcgggatcccttctgcacctcgccgggatccgatcctgcctcaacaatatcacgaatcgaacagctaaaggacagaaagagcagaaagagactaccaaaaattag

SEQ ID NO: 188152 - DNA, 627 bp, Artificial Sequence
  Description of Artificial Sequence: Synthetic coding sequence
atgggccccgtgatgccccccagcaagaagcccgagagcagcggcattagtgtcagctctggtctctctcagtgctacggtggcagcggcttttcaaaagccctccaggaggacgatgacttagacttcagcctccccgacatcaggctggaggaaggagctatggaggacgaagagctgacaaatctgaattggctccacgaaagtaagaatctcttgaaatcttttggcgaatctgtcctcaggtccgtgagccctgtgcaggaccttgatgacgacacccccccctccccggcacatagcgatatgccttacgacgcaaggcagaaccctaattgtaagccaccttacagctttagttgtctgatattcatggcgatcgaggatagccccaccaagagattaccggttaaggatatctacaattggatccttgaacatttcccatacttcgctaacgccccaaccggctggaagaactcggtgcgccacaatctttctctgaataagtgcttcaagaaggtggacaaagagcgtagccagtcaatagggaagggaagcttgtggtgcatcgatccggagtaccgacaaaatttaatccaggcccttaagaagacaccatactag

SEQ ID NO: 188153 - DNA, 1407 bp, Artificial Sequence
  Description of Artificial Sequence: Synthetic coding sequence
atgggccccgtgatgccccccagcaagaagcccgagagcagcggcattagtgtctctagcgggctctcacaatgctacggaggatcagggttttctaaagctctgcaggaagatgatgacctggacttcagcctgccagacattagactcgaggagggagccatggaagacgaagaactcaccaacctgaactggcttcacgagagcaagaatttactgaaaagctttggcgagtcagtgctgaggtctgtgtcacccgtgcaggatcttgatgacgatacccctcccagccccgctcattctgatatgccttacgacgctagacagaatcctaactgtaaacctccctatagtttcagctgccttatttttatggcaatagaagactcgcctacaaaaaggttgcctgtaaaagacatctataattggatactggaacacttcccgtatttcgcgaacgctccaacaggatggaagaactctgtgaggcacaatttgtcactgaataagtgtttcaagaaggtggacaaggagcgtagccagtctatcggaaaaggcagcctgtggtgcattgatcccgagtaccggcagaacctgatccaggcccttaaaaaaacaccttaccacccccacccacatgtgttcaacaccccaccaacttgtccccaggcctatcagtctacatccggtccacccatttggccaggttccacttttttcaaacggaatggcgcccttctgcaagtgcccccgggagtaatccagaatggtgcccgggtgctatcaagggggctttttcccggagttagaccactgccgatcacaccaatcggggttacagccgccatgagaaatggaatcaccagttgccgcatgcgcacggaaagcgaaccctcctgcggatcgcctgtggtgtcgggcgacccgaaagaggatcacaattatagtagcgcaaaaagctccaatgcaagaagcacatctcctaccagtgactccatttctagtagctccagttccgctgacgatcactatgagttcgctaccaaaggaagccaagaaggcagtgaaggaagcgagggaagcttccggagccatgaatcccccagcgacacagaagaggacgaccggaaacactctcagaaggagcctaaagattctctgggcgattcaggatacgcttcacagcataagaagcgccagcacttcgccaaagcgcgaaaagtgcccagcgacacattgcctctaaagaaacggcggactgagaaacccccggagtctgatgacgaggaaatgaaggaagccgccgggtcactccttcacctcgcaggtatccgtagctgtctgaataacatcactaataggaccgccaagggacagaaggaacagaaggagactaccaagaactag

SEQ ID NO: 188154 - DNA, 777 bp, Artificial Sequence
  Description of Artificial Sequence: Synthetic coding sequence
atgatcgagagcgacaccagcagcatcatgagcggcatcatccggaacagtggccagaatcaccacccatcccctcaggagtatcgactgctggccacaaccagtgatgatgacctgcctggcgacctccagagtttaagttggctgactgccgttgatgtccccaggctccaacagatggcaagcggcagagtggaccttgggggcccatgtgttccacatccacaccctggagctctagcaggtgtggcggaccttcacgtcggtgccacccccagccccctgctccatgggccggccgggatggcccctaggggcatgccaggcttaggcccaatcactggccaccgagacagtcagatgagccagttcccagtgggcgggcagcccagcagtggtctgcaagatccccctcacctctattctccagctacccaaccccagtttcctctgcctcccggggcccaacagctgtctgatcgtcacggtccagaggaacaacaggacagacaacccgcgtgcgagcgagacctccaactgcacgagggagccctgcccctactgcaggacgggccacgtagagtggaggaactgggcgccgctcaaccagtctcagaacaggtgttgcgggaagggggggaacaggacgagaggctgttaccccaaggactgccagttggatctgaacccggaccacacaggcaggacggcggaggtgatgcacaggtggaagaagagggccccggatgccaccctcctgagtacggacagccttag

SEQ ID NO: 188155 - DNA, 1554 bp, Artificial Sequence
  Description of Artificial Sequence: Synthetic coding sequence
atgatcgagagcgacaccagcagcatcatgagcggcatcatccggaactctggccagaaccatcaccctagcccacaagaatatcgccttttagctactactagtgatgacgatctccccggagacctgcagtctctaagttggctcaccgcagtcgatgtcccaaggctgcagcagatggccagtggcagggtggatctcggagggccatgtgtcccacacccccaccctggagcactcgctggcgtggcagacctgcatgtaggagcgacccctagtcctctgttgcacggccctgccggaatggcaccgagaggaatgccaggcctcgggcctatcacggggcatcgcgatagtatgagtcagtttccagtgggtggacagcccagtagtgggctgcaggaccccccacacctctattcaccagccactcagcctcagtttccactccctcccggcgctcagcagtgtcctccagtggggctgtacggcccgccctttggtgttcgtcctccctacccccaaccacacgtcgccgtacactcttctcaagaactgcacccaaagcattatcccaaacctatctattcctattcttgtcttatcgctatggcgctgaaaaactccaagaccggatccctgcccgtctctgagatttacagcttcatgaaggaacatttcccctattttaagacggcccctgatgggtggaagaattctgtgagacacaacctttccttgaacaaatgcttcgaaaaggttgaaaataaaatgagcggctccagtcggaaagggtgtctttgggcactgaatctggcgcggattgataagatggaggaggaaatgcacaaatggaaaagaaaggacctggcagcaatccaccggtccatggcaaaccccgaggagctcgataagcttatcagtgatcggccagaatcttgtcgaagacccggcaagcctggtgagcctgaagcgccagtgctgacgcacgcgaccacagtggcagtagcccatggatgcctggcagtgtcacagctgcctccccagcctctgatgactttgtcactacagtccgtgcctctgcaccaccaagtgcaaccgcaggcacatttagcacccgattcgcctgccccagctcagaccccaccgctgcacgcacttcccgacctgtcgccctcacctttgcctcacccagccatgggaagggctcccgtggactttataaacattagcactgatatgaacactgaggtcgacgcgctggatccttccataatggacttcgctttacaaggaaatttgtgggaagaaatgaaggatgaggggttcagcctcgatacgttaggggcgttcgccgatagcccactcgggtgtgacctgggagccagcggcctgacccctgcaagcggaggcagcgaccagagctttcccgatttgcaggtgaccgggttgtacacggcctactccactcccgactcggtggccgcatccggtacttcatcttccagtcagtacctgggcgcacagggtaataagcctattgcactcctgtag

SEQ ID NO: 188156 - DNA, 1014 bp, Artificial Sequence
  Description of Artificial Sequence: Synthetic coding sequence
atgcccggcctgccctgccccgccctgccctgccccgcccccccccccgctcctagttgtttgatcgccatggctctcaagaacagtaaaacaggctctctgcctgtctctgaaatctattcctttatgaaggaacacttcccctactttaagacagctccagacgggtggaagaacagcgttagacataacttatctctcaataaatgcttcgaaaaagtcgagaataaaatgtccggctcttctagaaaaggctgcctgtgggctctcaacctcgcacggattgacaaaatggaagaagagatgcacaagtggaaaaggaaggatctggccgctatccaccgaagcatggcgaatcctgaagaactcgataagctgataagtgatagaccagaatcctgccgtcgccccggaaaacctggagaaccggaggcccctgtcttgacacacgccactaccgtggccgtggctcacggttgtctggcggtgtctcaactgcccccacagccattgatgaccctgtcccttcaatcggttcccttgcatcaccaggtccagccccaggcccatctggccccggattcccccgcccccgctcaaacccctccactccatgctctgcccgacctgagcccctctcccctgccccacccagctatgggtcgggcacccgtggatttcattaacatttctaccgacatgaatacagaggtggacgccttggatccttccatcatggattttgctcttcagggtaacctctgggaagaaatgaaggatgagggctttagcctcgatacactaggagcattcgcagacagcccattaggttgcgacctcggcgcttcaggcctgacacctgcttcagggggctccgatcagtcttttcctgacctgcaggttacagggctttataccgcttatagcactccagactccgttgcagcctccgggacatcctcatcttctcaatatctcggcgcacagggaaacaagccaatcgccctgctctag

SEQ ID NO: 188157 - DNA, 1680 bp, Artificial Sequence
  Description of Artificial Sequence: Synthetic coding sequence
atggccgccaagctgcgggcccaccaggtggacgtggaccccgacttcgcacctcaatccagaccaaggtcctgcacgtggccccttccgcagcctgacctggccggtgacgaggatggggcacttggcgccggagtggccgagggggcggaagactgcggtcccgaaaggcgcgcaacagccccagcaatggccccggcaccaccccttggggctgaggtgggccccctcagaaaagctaaatcttctaggcgaaatgcctggggcaatctatcatatgccgacttaatcactaaggcaattgagtctgcccccgataaacggttgaccctgtcgcaaatttatgactggatggtgagatacgtgccatacttcaaagacaaaggggattcaaacagttctgcaggatggaagaactctattagacacaacctgagccttcacacaaggttcatccgcgtccagaatgaaggtaccggtaagtcaagctggtggatgcttaaccccgaggggggcaaaactgggaagaccccacgaaggcgggccgtatctatggacaatggcgcaaagttcttgcgtataaaaggaaaagccagcaaaaagaagcagcttcaagcccccgaacggagcccagacgactcatctccctccgctcccgctcccggccccgtgccagccgcagccaaatgggccgcctctcccgcctcgcacgccagtgatgactacgaggcctgggcagatttccgggggggggggcggcccctcttgggggaggccgctgagcttgaagatgacgaagcccttgaagccctggcccctagcagtccattgatgtacccatctccagcatccgcactgtcccccgcattgggctcaaggtgtcctggcgagcttccacgactcgcagagctggggggccctctgggactccacggcggcggcggcgctggcctgccagaaggtctgctcgacggtgctcaggacgcttatggaccccgcgctcgagcacaggctcggccaggcgcaggatgtgcggggggcgcaggcgccgggggccgcagtcgacgtctcccccggcagagaggcgggcccgttcgggctgcacgagcgctggcccaatgcctatctccgccccatcagccttacgatgccgcaagaaggggcggtaggagggggcccgggacagcagggcctcgcaggaggctccgcggcccagcaagacgacctccagctggtagatcagcaggcgccctacggtgccgcagaaggagagccgctggacggcgagcaaggccactgcccggaaggcctggaccccgacatgtgcagagagagccacgcgtgcgcaggggcgtgcatcacccacaacgactgcatggccagcggcggaatgggttgcaattacgctttggccctgcatctgccgcggccggccccggaaggggtcctgcccctcagccagagctgggcgccggactccgagctgcctcacggctgagggcgccacgccctgttcctagaggccctttgtctagccatcccgattccagggtccccgcccccgactctagctcccctggcggaggcccctccccagctcgtgaccctagccgcaggccagccgccggcgaaggagagggcggggccggtgctcctcactgttcttgtcctcacagctag

SEQ ID NO: 188158 - DNA, 2034 bp, Artificial Sequence
  Description of Artificial Sequence: Synthetic coding sequence
atgatgcaggagagcggcaccgagaccaagagcaacggcagcgccatacaaaacgggagcgggggctccaaccacctgctcgaatgtggcggtttacgagagggtaggtcgaatggcgagacaccagcggtcgacattggggcagctgaccttgcgcacgcgcagcagcagcagcagcaggccctgcaggtcgctcggcaactgttgctccaacagcagcagcagcagcaagtcagtggactgaaatcgccgaaaaggaatgataagcaacccgcccttcaggtgcctgttagtgtggctatgatgacccctcaagtaatcactccacagcagatgcagcagattcttcagcaacaggtcttgtctccacagcagctgcaagtcctgctccaacaacaacaagccctgatgctccaacagcagcagcttcaggagttttacaagaagcaacaggaacaactacaactccagctgctacagcaacagcacgctggaaaacagccgaaagagcaacagcaggtggctacacagcagctggcatttcagcagcagctgctgcagatgcagcaattgcagcagcagcacctgcttagcttgcagcgacagggtctgctgactattcagcccgggcagccggcattgcccttgcaacccctggctcaagggatgatccccacagaactccaacagctgtggaaggaggtgacgagcgcacacactgcagaggagacgactggaaacaaccatagcagcctggacctaaccaccacttgcgtctccagctctgcccctagtaaaactagcctcatcatgaaccctcacgcctcaactaatggccagctgtcagtacatacaccaaaacgagagagtctttcccatgaggaacacccccatagccacccgctgtatggacacggcgtctgtaaatggccaggatgtgaagctgtctgtgaggactttcaatccttcctaaaacacttaaacagcgagcatgcgctggacgacagatctactgctcaatgccgggtgcagatgcaagtggtacagcagcttgagctgcagctcgccaaagacaaagaacgcctacaggctatgatgacgcaccttcacgttaaaagcacagaaccgaaagctgccccccaacccctgaacctggtcagtagcgtgaccctgtccaagtctgccagcgaggcctctccacaatctctgccacacaccccaaccacccctaccgcacctctaaccccagtgactcagggaccaagtgtgatcacaaccacgtccatgcacactgtggggccaatccggcgtcgttatagcgataaatacaacgtccctatctcttcagccgacatagcccagaaccaggagttttataagaacgcagaggtcaggcccccattcacatatgcatctctgattaggcaggcgattctggagtcaccggagaagcagctgacactgaatgaaatttacaactggtttacaaggatgtttgcttactttcgccgcaacgccgcgacctggaagaacgctgtacggcacaatttgagtctccataaatgttttgtgcgcgtggaaaatgtgaaaggggcagtctggaccgtcgacgaggttgagttccagaaacgcaggccacagaagatttcggggaacccgtctctaatcaaaaatatgcagtcgtctcacgcctattgtacccctctcaacgcagccctgcaggcatctatggccgagaattccatcccgttgtacacaacagcaagcatgggaaatccaacccttgggaatttggctagtgctatcagagaagagctcaacggggccatggagcacacaaattctaacgagagcgattctagccccggacgttcacctatgcaagccgtgcacccagttcacgtgaaagaggagcccctggacccggaagaggccgaagggccccttagtctggtgaccaccgccaatcactccccagattttgaccacgaccgggattacgaagatgaacccgtgaacgaggacatggaatag

SEQ ID NO: 188159 - DNA, 1077 bp, Artificial Sequence
  Description of Artificial Sequence: Synthetic coding sequence
atgatgaccccccaggtgatcaccccccagcagatgcagcagatcctccagcagcaggtgctcagccctcagcagcttcaggtgcttcttcagcagcagcaggccctgatgctgcagcagcagcaactccaagagttctataaaaaacagcaggagcagcttcaactgcagcttttgcagcagcagcacgcaggcaagcaaccgaaagagcagcagcaagtggccactcagcagctggcctttcagcagcaactgctccaaatgcagcagctccaacagcagcaccttctgtcactgcaacgccagggcctgctgactattcagccgggccaacccgctctgccgttgcagccccttgcacaaggaatgatccctacagagctgcagcagctgtggaaagaagtcacctccgcacacaccgccgaggagaccacaggtaataatcactcatctctggacctgaccactacgtgtgtctcttcctctgccccgagcaaaacttccctaatcatgaatccccatgccagcactaatggccagctgtcagtacacacccctaagcgggaatctttgagtcacgaagagcatccacattctcacccattgtacggccatggagtgtgcaagtggcccggatgcgaggctgtttgcgaagactttcagtctttcctcaagcatctgaattccgagcacgcattggacgaccggagcaccgctcaatgtcgagtgcagatgcaggttgtccaacaattagagctgcaacttgccaaggacaaagagagattacaggcgatgatgacacacctccacgtcaaaagcacagagcccaaggccgcaccacagcccctcaatttagtgagttcagtaacacttagcaaatcggcttccgaagcctcccctcagagtttacctcatactcctactactcctacccctcctgactcacgccatcctcgtccactgtgtcaccataatcaccagcatgctcacggggggacacatcctcaggcggtattgaggcagatccagagagctcactttgtctctcgttactgcgctgagcccaggatcctgtag

SEQ ID NO: 188160 - DNA, 1509 bp, Artificial Sequence
  Description of Artificial Sequence: Synthetic coding sequence
atgatgcaggagagcggcaccgagaccaagagcaacggcagcgccatccaaaacggctcaggcgggtccaatcacttgctagaatgcggcggactgcgggagggcaggtcaaacggggagactcccgccgtggatattggggctgccgacctcgcacacgcacaacaacagcagcagcaagccctgcaggttgcgaggcagcttctgctgcaacaacagcagcaacagcaggtgtccggtctaaagtcccccaagagaaacgacaagcaacctgctctgcaggtacccgtcagtgtagcaatgatgacaccccaggtcatcactccacagcagatgcagcagatcctccagcagcaagttctttcccctcagcagctgcaagttctgctgcagcagcaacaggcccttatgcttcagcagcaacaactccaggagttttacaaaaaacaacaggaacagttgcagttgcagctgctgcagcagcaacacgccggcaagcagccgaaggaacagcagcaggtggccactcagcagttggctttccagcagcagcttctccagatgcagcaactgcagcagcagcacttgctaagtttgcagcgccagggactcctgactatccaaccaggccagccagccctccccttacagcctctggcccagggaatgatccctacggagcttcagcagctgtggaaggaggtcactagtgcccataccgctgaagaaacaacaggaaacaaccactcctctcttgacctgaccacaacttgtgtcagctctagcgcgccttcaaagacaagtctaattatgaatccacacgcttccacaaacgggcaactaagtgtgcatacacctaagagggagagcttgagccacgaagagcacccacactctcatcctctgtatgggcatggtgtgtgtaaatggcctggctgcgaagccgtttgcgaagactttcagagtttcctaaagcacctgaacagcgagcatgccctggatgaccggagcaccgcccaatgcagggtgcagatgcaggtcgtgcagcagctcgagctacagctggcgaaggataaggagcgactgcaggctatgatgactcatttgcacgtgaagtccaccgagccaaaagcagctccacagcccctcaatctggttagtagcgtcaccctttccaaatccgcctccgaggcgagccctcagagcctgcctcatactcctaccactccaacggctcctctcacacccgtcacgcaggggcccagtgtgataaccaccacatccatgcatactgtagggcctattcgcagacgatactcagacaaatataatgtcccaatatccagcgcagatattgcccagaaccaagaattttataagaatgcggaggtgaggccaccctttacttacgccagtctcatcaggcaggccatactggaatcccccgagaagaaaaagaaagagcgccagacactgggaaccatgcccattcactcaacacagcaatag

SEQ ID NO: 188161 - DNA, 1470 bp, Artificial Sequence
  Description of Artificial Sequence: Synthetic coding sequence
atgatgaccccccaggtgatcaccccccagcagatgcagcagatcttgcaacagcaggtcctgagtccccagcagctgcaggttctgctccagcagcagcaggccctgatgcttcaactgcagcagttgtggaaggaagtgacatctgcccacaccgctgaggagacaacagggaacaatcatagttcactggatctgacaacaacctgcgtttcatctagcgctcccagcaaaacatctctgatcatgaatccacacgccagcacaaacggccagttatctgttcacacaccaaagagagagtccctctcacatgaagaacaccctcactcccaccctctgtatggtcacggcgtatgcaagtggcctggatgcgaagctgtctgcgaggacttccagtcgttcctgaagcatctgaacagtgagcatgccttggatgaccgcagcaccgcgcagtgccgcgttcaaatgcaggtggtccagcagctggagttacaactggctaaagataaggagagactccaggctatgatgacgcacctccacgtgaaatcaacagagcccaaagccgccccccagccactcaacctggtgtcttcagtgaccctctccaagagtgcatccgaggcctccccccaaagtctccctcatacccccacaaccccaacagcaccccttacccccgtcacacagggcccaagtgtgattaccaccactagcatgcatactgtcggcccgatccgcagacgatactcagacaaatacaatgttcctatctcttccgctgacattgctcagaaccaggagttctataagaacgcggaggtgcgccccccattcacatacgcgagcctgatcagacaggctattcttgaatccccggagaaacaactgacactgaacgaaatctataattggtttacgcgtatgttcgcctattttcgacgaaatgctgctacttggaaaaacgccgtaaggcacaatctgtcgctgcataagtgcttcgtgagagtcgaaaacgtcaaaggggccgtgtggacagtggacgaggtagaattccagaagagaagaccacagaaaattagcggcaatcctagccttattaaaaacatgcagagttctcacgcatactgcacgccgttaaatgctgcgctgcaggccagtatggccgaaaatagcatccctttgtacaccaccgcgtcaatgggtaatcctaccctgggcaacctcgccagtgccatccgagaggagctgaacggcgcgatggaacacactaattctaatgagtcagacagttccccgggcaggagtccaatgcaggccgtgcaccctgtgcatgtgaaggaggagccacttgacccggaggaggccgaagggcctctttcactcgtaacaaccgctaatcatagccccgattttgaccacgacagggattatgaagatgaacctgtgaacgaggatatggaatag

SEQ ID NO: 188162 - DNA, 2034 bp, Artificial Sequence
  Description of Artificial Sequence: Synthetic coding sequence
atgatgcaggagagcggcaccgagaccaagagcaacggcagcgccattcagaatgggtccggaggcagtaatcacctacttgagtgtggaggcctaagagagggtcggtccaatggagaaacacctgcagttgacatcggagctgccgacctcgcccacgcacagcagcagcagcagcaggcacttcaggtcgcaagacagttacttctgcaacagcagcagcagcaacaagtgtccggcctcaagagtcctaaacggaacgataagcagcccgccctccaggtccctgtgagtgtagcgatgatgacaccacaggttatcactccgcagcagatgcagcagattctgcaacagcaggttctaagcccgcaacagttgcaggtgttgctgcaacagcaacaggcactgatgctgcagcagcagcagttgcaagagttttacaaaaagcaacaggaacagttgcagctccagctgctacagcaacaacacgccggcaagcagcccaaagagcagcagcaggtggctacacaacagttggcatttcaacagcagttactacagatgcagcaattgcagcagcagcaccttctttctctacaacggcaagggctcctaaccatacagcctggacagccagcactacctctgcagcccctggcacaagggatgattcccacagagctgcagcaactgtggaaggaagtgacttctgcccacactgcggaggagacaactggtaacaaccattcctccctggacctcaccacgacctgtgtcagttcctccgctccaagcaagacatccctgatcatgaacccacatgcaagcaccaatggccagctctcggtccacaccccgaagagagagtccttatcccatgaagaacacccacacagccaccccctgtacggccacggcgtttgtaagtggcccgggtgcgaggctgtctgtgaagattttcaatcttttctgaaacatctaaactccgagcatgctctggatgacagaagcaccgctcagtgcagggtccagatgcaagttgtacagcagctggagctgcagctcgccaaagataaggagagactccaagctatgatgacccacctacacgttaagagcactgagcccaaggctgcccctcagccactaaatctggtgtcatccgtaacgttgtctaagtcagctagtgaggcatccccccagagcttaccccatactcctaccacccctaccgcccccttaacaccagtgacccagggcccaagcgtgatcaccaccacctcaatgcacacagttggccctatccggcggcggtacagcgataaatataacgtaccaattagctcagccgatattgcccaaaatcaggagttctacaagaacgccgaggttcggcctcctttcacttatgccagtctaattcgccaagcaatcttagagtccccagaaaaacaactcacgctgaatgagatttacaactggttcaccagaatgttcgcttacttccggaggaacgccgctacctggaagaacgcggtgcggcacaatctgtccctccacaaatgttttgtgagagtggagaacgttaagggggccgtgtggacagtcgacgaagtcgaattccaaaagagaaggcctcagaaaataagtggaaacccaagcctgatcaaaaacatgcagtctagtcacgcttactgcacacctctgaacgcagcactccaggcatccatggctgagaatagcatcccactctacacaaccgcttccatgggaaatcccacgctgggcaatttggccagcgccattcgggaggagcttaatggtgccatggagcacaccaatagcaatgaatctgactcatccccaggtcgaagcccgatgcaggcggtgcaccccgttcacgttaaagaggagccgctcgacccggaagaggcggaagggccattatctcttgttactaccgctaatcactcacccgattttgaccacgacagggattatgaggacgagcctgtgaatgaggacatggaatag

SEQ ID NO: 188163 - DNA, 1806 bp, Artificial Sequence
  Description of Artificial Sequence: Synthetic coding sequence
atgatgcaggagagcggcaccgagaccaagagcaacggcagcgccatacaaaacggctccggcggctccaaccaccttctcgagtgcggtggcctgcgcgaaggcagatcgaacggagagacaccagcagtcgatatcggcgctgcggacctggcacacgcgcagcagcaacagcagcaggccttacaagtggcacggcagctcctgttacagcaacaacagcagcagcaggtgagcggtttgaagtccccgaaacggaacgacaaacagcccgctttgcagcagcaacaggttgctacacagcagctggcattccaacagcagctgctccagatgcagcagctgcagcaacagcatcttctctctctgcagcgccagggcctcttgaccatccaacccggtcaacccgcgcttccgctgcagcccctcgcccaaggaatgattccgaccgaactgcagcaactgtggaaagaagtcacatcagcacataccgccgaggaaactacaggcaataatcatagttcccttgacctgaccactacctgcgtgtctagctcagcacccagcaagacatctttgatcatgaaccctcatgccagcacaaatgggcagctgtccgttcacacaccaaaaagagagtccttatcccatgaggagcacccccactctcacccactgtacgggcatggagtgtgcaagtggccaggatgcgaggctgtttgtgaggacttccagagcttcctgaaacatctgaacagcgaacatgctctggacgatcgcagtactgcacagtgccgggtacagatgcaggtcgttcaacagctagagctgcagctggctaaagacaaggaacgcctgcaagcgatgatgacccacctacatgtgaaatccacagaaccaaaggcggctccccaaccactcaatctggtatcttccgtgacactgtcgaagtcagcatctgaagcctcacctcagtcccttccacacacccctacgacccccaccgccccactgacacctgtgacccaggggcctagtgtgataaccaccaccagcatgcacaccgtcggcccaattagaaggaggtattcagataaatataacgtgccaatctcctcggctgacatcgcacagaaccaggaattctacaaaaatgccgaggtcaggcctccctttacctacgctagcttgattcgccaggctatacttgaaagtccagagaagcagttaaccttaaacgagatctacaactggttcacaagaatgttcgcctacttccgtcgtaacgccgctacttggaaaaacgcagtgaggcacaacctgagcctgcataaatgtttcgtccgggtcgaaaacgtgaagggcgctgtgtggaccgtcgatgaagtggagtttcagaaacgtagaccccagaagatcagcggcaatccatctttaatcaaaaatatgcaatcctcccatgcctattgcactccgctgaacgctgcgttgcaggcttcaatggcagaaaattccattcctctctataccacggcttctatgggcaaccctacactcggaaacctggcttcagcaatacgggaagaactaaacggagcgatggaacacaccaatagtaatgagagcgattcgtcgcctggtcgatccccgatgcaggcggtccaccctgtccatgtgaaagaggagccccttgacccggaggaggcagagggtcccctgtctctggtaacaacagcaaaccattcacccgactttgaccacgatagggattacgaagatgagcccgttaatgaggacatggaatag

SEQ ID NO: 188164 - DNA, 675 bp, Artificial Sequence
  Description of Artificial Sequence: Synthetic coding sequence
atgatgaccccccaggtgatcaccccccagcagatgcagcagatcctacaacaacaagtgctctctccccagcagcttcaggttctcctgcaacagcaacaagctctgatgctgcagcaacagcaactacaggaattctataagaagcagcaggagcagcttcaactgcagctgctgcaacagcaacatgccggaaaacagccaaaggagcaacagcaggttgccacccaacaactagccttccagcaacagcttctgcaaatgcagcaactacagcagcaacacctgttgtcattgcagcggcaaggcctcctcacaatacagcccggccagcccgcgttgccgctgcagccactagctcagggtatgattcccactgaactccagcaactctggaaagaggtcacgagtgcacatacagctgaagaaaccaccgggaacaaccattcctcgctggacctgaccaccacttgcgtgtccagctccgctccatccaaaacaagtctgatcatgaatccccacgcctctactaatgggcagttatcggtgcatacccctaagagggagtcactctcgcacgaagagcacccacacagccatcctctttatgggcatggggtctgtaagtggcccgggtgcgaagcagtttgtgaggatttccagagtttcctgtag

SEQ ID NO: 188165 - DNA, 2040 bp, Artificial Sequence
  Description of Artificial Sequence: Synthetic coding sequence
atgttccagtgcgtgttcagcagcagcgtgctgcagccccacagcacaagctgtctgtttaagcaccttttttaccattccgcgaccccggccagccagaaacagcccgaacctatctattctaagaagacggagattcagaggcaaaccgttcgggccccattcgctaaacttttcatcttcagtgccctgcaggtggccagacaacttcttcttcagcaacagcagcagcaacaagtgtcgggcctgaaatcacctaaaagaaacgataaacagccagcgctacaggtcccggtctctgtagccatgatgactccacaggttatcacaccacagcagatgcagcagatactgcagcagcaagtccttagccctcagcagctgcaggtgctgctccagcagcaacaggctctcatgttacagcaacagcaactccaggagttttataagaaacagcaggagcagctacaattacagctcctgcagcagcagcatgccggtaaacagcctaaggagcagcagcaagtggctacgcaacagctggccttccagcagcagctgctccagatgcagcagcttcagcaacagcacctgctgtccctgcaaaggcagggactgcttaccatccagccaggacaacccgccctgccacttcagccattggcccagggcatgatccctactgaactgcagcaactgtggaaagaagtaacctcagcccacacggcagaagagacaacgggcaacaaccactccagtctggatcttacgacaacctgcgtttcttccagtgccccctctaagacttctctcattatgaacccacacgcgagtaccaatgggcagctgtctgtgcacacgcctaaacgggaaagcttgagccacgaggagcatcctcactcacatccactttacggtcacggcgtatgcaaatggccaggatgtgaggcagtctgcgaagattttcaaagttttctcaaacacctgaactcggagcatgcccttgacgaccggtctacagctcagtgccgcgttcagatgcaggtggtccaacaacttgaacttcaactggcgaaagacaaggagcgcttgcaggccatgatgactcatttacatgtcaagtctaccgagcctaaggctgctccacaacccctgaatctagtctcaagcgtgactctgagtaaaagtgcttctgaggcgagccctcaaagcctcccccatacccccactactcccaccgccccactgacacccgtgacgcagggcccgtctgttatcaccaccacatccatgcacacagtaggcccaatcagacgacgatattcagataagtataatgttcccatctccagtgctgatatcgctcaaaatcaagaattttacaagaacgctgaagtccgacccccttttacatatgcctcactgatcaggcaggctatactagagtcaccagagaaacagttaacgttaaacgagatctacaattggttcactcgtatgttcgcctatttccgaagaaacgccgccacttggaaaaacgctgtccgccataacctgtccctgcacaagtgctttgtcagggtggaaaacgtgaaaggggccgtttggacagtggatgaagtggaatttcaaaaacggcgaccacagaaaatcagtgggaacccctcactcattaagaatatgcagtcatcccacgcctattgcactcctctgaatgccgcccttcaggctagcatggctgaaaatagcatacccctttacaccacagcttctatgggaaatcccacactaggcaacttagcaagcgcaataagagaggaactcaatggggcgatggagcacactaattctaacgagagcgatagctcccccgggcgatccccgatgcaggccgtgcatcctgtgcatgtgaaggaagaaccattagatcctgaggaggccgaaggccccctgagcttagtgacaaccgccaaccattctccggatttcgatcacgatagggactatgaggacgagcctgtgaacgaggatatggaatag

SEQ ID NO: 188166 - DNA, 372 bp, Artificial Sequence
  Description of Artificial Sequence: Synthetic coding sequence
atgatgaccccccaggtgatcaccccccagcagatgcagcagatccttcaacagcaggttctcagcccacaacaattgcaggtcctgctgcagcagcaacaggcactgatgctccagcagcaacagctgcaagagttctacaagaaacagcaagagcagctccaattacagctactacagcagcagcacgccggcaagcaacccaaagagcagcagcaggtggctactcagcagcttgccttccagcaacaactactccaaatgcagcagctacagcagcaacatctgttgagtctgcagagacagggtctgctcaccatacagccaggccaacccgcactgcccttacagcccctggctcaaggtatgtag

SEQ ID NO: 188167 - DNA, 2034 bp, Artificial Sequence
  Description of Artificial Sequence: Synthetic coding sequence
atgatgcaggagagcggcaccgagaccaagagcaacggcagcgccatccagaatgggtctggcggtagcaatcacctcctggaatgtggaggattgcgagaaggtcgcagcaacggggagacaccagccgtggacattggggccgcagacctggctcatgctcagcagcagcaacagcaggcccttcaagttgccaggcaactcctgctgcaacagcagcaacagcagcaggtgtcagggttaaagtcccctaagaggaatgataagcagcccgctctgcaggtgccagtctctgtcgcaatgatgaccccacaggtgatcacgcctcagcagatgcagcagatccttcaacagcaagtcctgtcgcctcaacagctccaggtcctgctgcagcagcaacaggctttgatgctgcagcagcaacagctacaggagttttataaaaagcagcaggaacaacttcagttgcagctgctccaacagcagcatgcaggaaaacagcctaaggaacagcaacaagtggcaactcagcaactggcgttccagcagcagcttctacagatgcagcaattgcagcagcagcatctgcttagtctgcagaggcaagggctgttgaccattcagcctggccagcccgctctgcccctgcagcctctcgcgcagggaatgatacccacggagctgcagcagctgtggaaggaagtcacatctgctcacaccgctgaggaaactactgggaataatcactcttctctcgatttgaccaccacttgtgtgtcttctagcgccccctccaaaaccagcctgatcatgaacccgcatgcgtcaacaaacgggcaacttagtgttcatacgccaaagcgggaaagcttgtcacatgaggagcatccgcacagccatccgctgtacggacatggagtgtgcaagtggccaggttgtgaggccgtgtgcgaggatttccagtctttcctgaaacatctaaactcagagcacgcccttgacgaccgctccactgcccagtgcagagttcagatgcaggttgttcagcagctcgagcttcagctggccaaggataaagaacgtctacaggcaatgatgacccatctacatgttaaatccaccgagcctaaggctgcacctcagccactgaatctcgtttcttctgtgaccctctcaaaatcagcatccgaggcctctccccagagtctaccccacacgccaactactccaaccgcacccctgacacccgtgactcaggggcctagcgtgattaccaccacttccatgcataccgtgggccctatccggaggcgctactccgataagtataatgtgcccatcagcagtgccgatatcgctcagaatcaagagttttacaagaacgctgaggtgcgacctccattcacctacgcctctctgatacggcaggcgattttagagagccctgaaaaacagctgacgctgaacgagatttataattggtttaccaggatgtttgcatattttcgacgtaatgctgccacttggaaaaacgccgttcgccacaatctatccctgcacaagtgtttcgtgcgggtggaaaacgtcaaaggcgcggtgtggaccgtagacgaggtcgaattccagaaaagacgtccgcagaaaatatccgggaacccttccctgatcaagaacatgcaatcttcccacgcatactgtactcctctcaatgccgccctgcaagcatcgatggctgagaacagcatccctctgtatacaactgcctctatgggtaaccctaccctgggaaatctcgcaagcgccattcgggaagaactgaacggagccatggagcacaccaacagcaacgaaagcgatagtagccctggccgctcacccatgcaagcggttcatcctgtgcatgtgaaggaagagcccttagatcccgaggaagcggaaggtccccttagcttagtcaccacagcaaaccactccccagacttcgatcatgacagagattatgaagacgagcccgttaatgaggacatggagtag

SEQ ID NO: 188168 - DNA, 345 bp, Artificial Sequence
  Description of Artificial Sequence: Synthetic coding sequence
atgatgcaggagagcggcaccgagaccaagagcaacggcagcgccatccagaacggttccggcggcagcaatcatctgctggaatgcggcggcctgagagaaggccgatcgaacggcgagactcccgctgtagacattggcgccgccgatctcgcccacgcacagcagcagcagcaacagtggcacctgatcaaccatcagcctagtcggtcgcccagcagctggttaaagcgcttgatcagcagcccatgggagctggaagtgctgcaagtacccctttggggagccgtggccgagactaagatgagcggccccgtctgtcaaccaaacccttcacccttttag

SEQ ID NO: 188169 - DNA, 669 bp, Artificial Sequence
  Description of Artificial Sequence: Synthetic coding sequence
atgatgcaggagagcgccaccgagaccatcagcaacagcagcatgaatcagaatgggatgagtacactgtcttctcaactggatgccggcagtagagacggacgatcctcaggtgacacctcgtctgaggtgagcaccgtggaacttctccaccttcagcaacagcaggcgcttcaggccgctcggcaacttctcttacagcagcagaccagtggtctaaaaagcccaaagtcttctgacaagcagcgccccttacaggtgcccgtctcagttgcaatgatgacccctcaggtgatcacaccgcagcagatgcagcagatcctgcagcaacaggtgttatctccccaacagctgcaagcactgctgcagcaacagcaagctgtgatgctgcagcagcagcaactacaggagttctataaaaaacaacaggagcagctgcatctgcagctcctacagcagcagcagcagcaacagcagcagcagcagcaacagcaacagcagcaacagcaacagcagcaacagcaacagcagcagcaacagcaacagcaacagcaacagcagcaacagcaacagcaccccggcaaacaggccaaggaacagcagcagcagcagcagcagcagcagcaacttgctgcgcagcagctggtgttccagcagcagctgctctag

SEQ ID NO: 188170 - DNA, 2148 bp, Artificial Sequence
  Description of Artificial Sequence: Synthetic coding sequence
atgatgcaggagagcgccaccgagaccatcagcaacagcagcatgaaccagaatggaatgtcgacattgagcagtcagctcgatgcaggctctagggatggacgtagctcaggcgatacgagttcggaagtgagcacagtcgaactactacacttgcaacagcagcaggccttgcaagctgcccgacagctcctcctgcaacagcaaacctccggcctcaagtcccccaagtcctcagacaagcagaggcccctgcaggtccctgtctcagtggccatgatgaccccccaggtgattactcctcagcaaatgcaacagatcctgcagcagcaagtactaagcccccagcagcttcaggccctgctgcaacaacagcaggcggtgatgcttcagcaacagcagctccaggagttctacaaaaaacagcaagaacaactccacctgcagctcttgcaacagcagcagcagcagcagcaacagcagcagcagcaacaacaacagcaacagcagcaacagcaacagcagcagcagcagcaacagcaacagcaacagcagcagcagcagcagcagcagcacccaggtaagcaggccaaggaacagcaacagcaacaacagcagcagcaacaattggcagcccaacagctcgttttccagcaacagctgcttcagatgcagcagcttcagcagcagcaacacctcctgtcactccagagacagggtctcattagtatccctccaggtcaggccgccctgcctgtgcagagccttccccaggccggtttatctccagccgaaattcagcagctctggaaagaggtgacaggagtgcatagcatggaggataacggaattaagcacgggggcctggacctcaccactaacaatagctcgtctacgacctcatctaatacctctaaggcctcacctcctatcacccaccatagtatcgttaacggccaaagtagcgtgcttagcgcccgccgggattcttctagccatgaagagacaggagcctcacacacgttatacgggcacggagtgtgcaagtggccggggtgcgaatccatctgcgaggacttcgggcaattcctgaagcacttgaacaacgaacatgcactcgatgaccggtcaaccgctcagtgtcgggtgcagatgcaagtggtgcagcagctcgaaatccaactttccaaggagagggaaagactccaggccatgatgacacacctgcacatgaggccctcagagcccaaaccttccccaaagcccctgaacctggtctcttcggtgaccatgtccaagaacatgttggagactagcccccagagcctgccacagacccccaccacgcccaccgccccggtcacccctataacgcaaggcccgagcgtcatcactccagcttccgtcccaaatgtgggtgccattagaaggagacacagcgacaaatataacatccctatgtcttctgagattgctccaaactacgagttttataagaacgccgacgtacgcccaccttttacttacgccaccttgattagacaggctatcatggaaagctcggacagacagttaacactgaatgagatctacagctggttcactaggacatttgcctacttccgaaggaatgcagctacatggaagaacgcagtgcgccacaacctttccctgcataagtgcttcgttcgggtcgagaacgtgaagggagccgtgtggacagtggacgaggtagaatatcaaaagcggcgctcccagaaaattaccggctcccccactctggtgaagaatatccccacctccctcggttacggtgcggcactgaatgcgagtttgcaggccgctttggccgaaagctcactcccgctgcttagcaatccaggcctgatcaacaacgccagtagcggtctgttgcaggcggtccatgaagacttgaacggtagcctggatcatatagacagcaacgggaactcttcccccggttgctcccctcagccgcacattcactcaatccatgttaaagaagagcccgtcatcgctgaggatgaggattgccccatgtctttggtgaccacggccaaccattcaccggaactcgaagatgaccgcgaaattgaagaggaaccactgagtgaagacttggagtag

SEQ ID NO: 188171 - DNA, 1299 bp, Artificial Sequence
  Description of Artificial Sequence: Synthetic coding sequence
atgatgcaggagagcgccaccgagaccatcagcaacagcagcatgaaccaaaatgggatgtctaccctcagcagtcagctggacgcaggctccagagatggccggagttctggagacacttcaagcgaggtgagcacagtcgaactcctgcatcttcagcagcagcaggctctgcaggccgctagacagctgctgctacagcagcagacctccggacttaaaagtcccaaatcttccgacaaacagcggcccttgcaagtcccagtgtctgtggcaatgatgacaccccaggttatcacgccacagcagatgcagcaaattctccagcagcaggtcctgtcaccccagcaactgcaggctctcctacagcaacagcaagctgtgatgctgcagcagcagcagttacaagagttctacaaaaagcagcaggaacagcttcatcttcaattactacagcagcagcagcagcagcagcaacagcaacagcagcaacaacaacagcaacagcaacagcagcagcagcagcagcagcaacaacagcagcaacagcagcagcagcaacagcagcagcagcacccaggcaagcaggcaaaggagcagcagcaacaacaacagcagcagcagcaactcgccgcgcagcagctcgttttccagcaacaattgttgcagatgcagcagttgcagcaacaacaacatcttctaagcctgcaacgccaaggactaatctccattccacctggccaggccgcactacccgtgcagagcctgccccaggcaggtctgtcccctgccgagatccaacagttgtggaaggaagtgaccggcgtgcatagcatggaggataacggaatcaagcacggtggactcgacttaaccacaaataacagtagcagtaccactagctcaaacaccagcaaggctagtcccccaatcacacatcactccatcgttaacggccaatcttctgtgctatcagcacggcgcgattcctccagccacgaggagacgggggcctcacacacactgtacggtcatggcgtttgcaagtggccgggctgcgagtccatctgtgaagattttggtcaatttctgaagcatctaaacaatgaacacgctctcgatgatcggtctacagcacagtgtagggtacagatgcaggtagtgcagcaactggaaatacaactgagcaaggaaagggagaggcttcaggccatgatgacacatctgcacatgcgcccatccgagccaaaaccttctcccaaacccgtgagcgcttactgcttcatcaattctaagtag

SEQ ID NO: 188172 - DNA, 1371 bp, Artificial Sequence
  Description of Artificial Sequence: Synthetic coding sequence
atgcaggagagcgccaccgagaccatcagcaacagcagcatgaaccagaatggaatgtctaccctttcgagccagttagatgcagggtctagagatggccgcagctcgggggatacgagcagcgaggtcagcaccgttgagttgttacacctgcaacagcaacaggccctgcaagctgcccgccaattgctgctgcagcagcaaacatctggacttaagtcaccgaagagtagcgacaaacagcgccccttgcaggaactactccctgagactaaattgtgcatctgcggccattcaagtggagacggtcacccacacaataccttcgccgtgcccgtgtctgtggctatgatgacaccacaagtgattactccgcagcagatgcagcagatcctgcagcagcaggtgctctcacctcagcagctgcaggccctgctccagcagcagcaggctgttatgctccaacagcagcagctgcaggagttttacaaaaagcaacaagaacaattgcacctccagctactgcagcagcagcagcagcaacagcagcaacagcaacagcagcaacaacagcagcaacaacagcagcaacagcagcagcagcaacaacagcagcagcagcaacagcagcagcagcagcagcagcatccaggaaagcaggcgaaagaacagcagcagcagcagcagcaacagcagcagctggccgcccaacaactggtgttccaacaacagctgctgcagatgcagcaactccagcagcagcaacacctgctttccctccaacgccaggggctcatatccataccccccgggcaagctgccctccccgtccagagcttaccacaggccggcctttctccagcggaaattcagcaactttggaaagaggtaacaggtgttcactcaatggaagataacggtattaagcacggtgggcttgacctgacaacaaacaattcctcctcaactacgtcttccaacaccagcaaagccagccctccaatcactcaccattctatcgtgaacgggcaatcctccgtgctatccgccaggcgggattctagttctcatgaagagacaggggcctctcacactctatatggtcatggggtatgtaagtggccaggttgtgagtctatttgcgaggacttcgggcagttcctgaaacacctcaataatgagcacgctcttgacgaccgcagcaccgctcaatgtcgcgtccagatgcaggtcgttcagcagctagaaatccagctcagcaaggagcgcgagaggcttcaagcaatgatgacacacctccacatgagaccctcagaacccaaaccttcgccaaaaccagtttcggcttattgcttcattaattcgaagtag

SEQ ID NO: 188173 - DNA, 1872 bp, Artificial Sequence
  Description of Artificial Sequence: Synthetic coding sequence
atgatgaccccccaggtgatcaccccccagcagatgcagcagatcctgcagcagcaggtgctctcccctcagcagcttcaggctttattgcagcaacagcaggcggtgatgctgcagcagcagcaactgcaggagttctacaagaagcagcaggagcaacttcacttacagttactgcaacagcagcaacagcagcagcaacagcagcagcagcaacagcagcagcaacagcaacagcagcagcagcagcagcaacaacaacagcagcagcagcagcaacagcagcagcagcagcagcacccgggaaaacaggccaaggaacagcagcagcagcagcagcagcagcagcagctggccgcacagcagttggtgttccagcagcagctgctacagatgcaacagttgcagcaacagcaacatttgctgtctctacaacgtcagggtctcatatccataccaccaggccaggcagccctgccagtgcaaagtttgcctcaggcaggcctgtctcctgcggagatacagcagctctggaaggaagttaccggagtgcactctatggaagacaacggtattaagcacggaggactggatcttacaacaaacaatagttcctccacaacttccagtaacacatccaaggcatctcctccgatcacccaccacagtatcgtgaatggacagagttcagtactcagcgcccgcagagactcatcttcccacgaggagacaggcgcatctcatacattgtacggtcatggggtctgtaagtggccgggctgcgaatctatttgcgaggacttcggccagtttctcaaacacttgaataacgagcatgccctggacgatagatcgacagcacagtgccgggtgcagatgcaggtcgtgcagcagctcgagatccaactgtctaaggagcgggagagactgcaagcaatgatgacccatctgcatatgaggccttctgaaccaaaaccttcccccaagccactcaacttggtgagtagtgtgacgatgtcgaaaaacatgctggaaacctccccgcagtcactcccccagacaccaactacccccaccgccccagtaactcctataactcagggtccgtctgtgattacccccgcctccgttcctaacgtgggtgcaattcgtaggagacacagcgataagtataacatacccatgagttccgagattgcgcctaactatgagttttacaagaatgccgacgttaggcccccctttacttacgcgaccttgattcggcaggctatcatggagagctcagataggcaactgaccctgaacgagatttattcatggtttactaggactttcgcctatttcaggcgcaacgcggctacgtggaagaatgctgttcgccataatctgagcttgcacaagtgctttgtgcgcgtcgagaacgttaaaggcgcagtctggaccgtcgacgaagtggagtaccagaagagacgctcacaaaagattactggttctcccacacttgtgaaaaacattcctacaagtctgggctatggagccgccctgaacgccagcctgcaggctgcactcgccgaatccagccttccactgctgtctaatccgggcttgataaacaatgcaagtagcggactcctccaagccgttcatgaggatttaaatgggagccttgatcacattgattctaatggcaactcaagtcctgggtgttcgccacagccccatattcattccatccatgtgaaagaggagccagtcattgctgaggacgaagactgcccaatgagtctcgtgaccaccgccaaccatagcccagaactcgaggatgatagagaaatagaggaagaacccctcagcgaggatctggaatag

SEQ ID NO: 188174 - DNA, 1593 bp, Artificial Sequence
  Description of Artificial Sequence: Synthetic coding sequence
atgatgaccccccaggtgatcaccccccagcagatgcagcagatccttcaacagcaagtgttgagccctcaacagctgcaggcacttttacaacagcagcaagctgtgatgctacagcagcagcaactgcaggagttctacaaaaagcagcaggagcagctgcatcttcagctgctgcagcagcagcaacagcagcagcagcagcagcagcagcaacaacaacagcaacagcaacagcagcaacaacagcagcagcagcagcaacaacagcagcagcagcagcagcaacagcagcagcatcccggcaaacaggctaaagagcaacaacaacagcagcagcaacagcagcagctcgctgctcagcaacttgtgtttcaacagcagctgctgcagatgcaacagcttcagcagcagcagcacctcctgtccttacaaaggcagggcctcattagcatccctcccggtcaggcagcgctgccggttcagtccctcccccaggcgggactatcccccgccgagatccagcagctgtggaaggaagttacaggcgttcattctatggaagataatggcatcaaacatgggggcttggaccttactaccaacaattcctcaagtacgacaagcagtaacacctctaaggcatccccccccataacccatcacagtattgtgaatggacagagctcagtgttgagcgcaagacgagattctagctcacatgaagaaacaggagcgagccatactctgtacggacacggtgtgtgcaagtggcccggctgtgagtctatctgtgaggactttgggcagttcctgaagcaccttaataacgagcatgcgttagacgaccgatcgacagctcaatgtcgcgtgcagatgcaagttgtacagcaactggagatacagctttctaaagaaagagagcgtctccaggctatgatgacacaccttcatatgagaccttccgagccgaagccgtccccaaagcccgcaataatggagagtagtgaccggcagttgacgttaaatgaaatctactcttggtttactcgcacgtttgcttactttcgcaggaacgccgccacatggaaaaacgccgttcgtcataacctctcactgcataagtgctttgtgcgtgttgagaatgtgaagggcgcggtttggacagtcgacgaggtggagtatcagaagcggaggagtcagaaaattactgggtctcccaccctcgtgaagaacatacccaccagtctgggatatggggccgctctaaatgcttctttgcaggcggccctggctgagtcctctcttcccttgctcagcaatcccggacttatcaacaatgcgtcatccggcctgctccaggccgtccatgaagacctcaatggttccctcgatcatatcgattcaaatggcaacagctcccctggctgtagcccacagccacacattcactctattcacgtgaaggaggagcccgtgattgctgaggacgaggactgcccaatgagtttagtaaccactgcaaaccacagtcccgagcttgaggacgaccgtgagatagaggaagagcccctgagcgaggacctggagtag

SEQ ID NO: 188175 - DNA, 2148 bp, Artificial Sequence
  Description of Artificial Sequence: Synthetic coding sequence
atgatgcaggagagcgccaccgagaccatcagcaacagcagcatgaatcaaaatgggatgtctacactgagctcccagcttgacgcgggcagtcgggacggcaggtcgtccggagacaccagcagcgaggtcagcaccgtcgagctgctacatctgcagcagcagcaggctctgcaagccgccaggcaactcttactgcaacaacagacctccggtctgaagtcccctaagtcaagcgacaagcagagacccctgcaggtccccgtttcagtcgccatgatgacccctcaggtgataacaccacagcagatgcagcagatcctgcagcaacaggtactgtcgcctcaacagctacaagctctgctccagcagcagcaggccgttatgctgcagcaacagcagctgcaggagttttacaagaaacaacaagagcagctgcatctacagctgctgcaacaacagcagcaacagcaacagcagcaacaacagcaacagcagcaacagcagcagcagcaacagcagcaacagcaacagcagcagcagcagcagcaacaacaacagcagcagcagcagcaccccggaaaacaggctaaggagcaacagcagcagcaacagcagcagcagcagcttgccgcacaacaactcgtgttccagcagcaactgcttcagatgcaacagctgcagcagcagcagcacctccttagcctccagcgccagggccttatcagcatccctcccggacaggctgctttaccggtccagagtcttccgcaggctggcttaagccccgcagaaatacagcagctgtggaaggaggtgaccggagtacacagcatggaagataacggaatcaagcatggcggactggaccttaccacaaacaattcctccagcaccaccagcagtaatacttccaaagcgagccccccaattacacaccactccatagtgaatggacagtccagcgtcttatccgctcggagggattccagctctcatgaagagacaggcgcctctcacacattgtacggtcacggggtgtgcaagtggccaggatgcgagtcaatttgcgaggattttggacagttcctgaaacatctgaataacgaacacgctcttgacgatcgctcgacagcccagtgccgtgtgcagatgcaggtcgtgcaacaacttgagatccaactgtcaaaagaacgcgaacggcttcaagcgatgatgacgcaccttcatatgagaccatcagagccaaagccttcccctaagcccctgaatctggtatctagcgtcacaatgtccaagaacatgctggagacctcgccacaatcactaccgcaaactcccactacccccaccgcaccagtcacacctattacgcaggggccttctgtaataaccccagcctctgtgccaaatgtgggagcaatccgccgtcgtcattctgacaaatacaacattcccatgtcctcggagatagccccgaattacgagttttacaagaacgcggatgttcggcccccctttacatacgctaccctgatcagacaggcgattatggaatcgagcgaccgccagctaactctaaacgagatctatagttggtttaccaggacatttgcctattttagacgcaacgccgcaacctggaaaaacgcagtgaggcacaatctgtcactgcataaatgtttcgtgcgagtggagaatgttaagggcgctgtctggactgttgacgaagtcgagtaccagaaaagaagaagccagaagattacagggtctcctaccttggtgaagaacattcccacatcactcggatacggtgcagcactaaacgccagcctccaggccgctctggccgagtcatccttgcctctgctgtccaatccaggtctgatcaataacgcttctagtggtctgttgcaggccgtgcacgaggatcttaatgggagccttgatcatatcgattccaatggcaattctagcccaggttgctcaccccaacctcatattcattccatccatgttaaagaggagccggttatcgcagaggacgaggactgccccatgtcactcgtgaccaccgcaaaccactcacccgagttggaagacgatagagagatcgaagaggagcccctgtccgaagatctggaatag

SEQ ID NO: 188176 - DNA, 1149 bp, Artificial Sequence
  Description of Artificial Sequence: Synthetic coding sequence
atgatgaccccccaggtgatcaccccccagcagatgcagcagatcctccagcaacaggttttgagcccacagcagttacaagccctgctgcaacagcagcaggcagtgatgctacagcaagactttctagactccgggcttgaaaatttcagggctgccttggaaaagaaccaacaattgcaggaattctacaagaagcagcaggaacagttacacctgcagctgttgcagcagcagcaacagcagcaacagcaacagcaacagcagcagcagcagcaacagcaacagcaacagcagcagcaacagcaacagcaacaacagcaacagcagcaacagcaacagcagcagcatcctggcaaacaggcaaaagaacagcagcaacagcaacagcaacagcagcagctcgcagctcaacagttggtctttcagcaacaacttcttcaaatgcagcaattacagcagcaacaacacctgctcagcctccagcggcagggtctgattagcattcctcccggccaggcagccctgcctgtgcagtctctcccacaggccggactatcccccgccgaaattcaacagctctggaaggaggtgacaggtgtccattcaatggaggacaatggcataaagcacgggggacttgacttgactacgaacaattcttccagcaccacgtcttcaaatacctccaaagcttcacctcctataactcaccacagcatcgtgaatggtcagagttccgtgcttagtgcccgaagagactcatccagccatgaagagacgggcgcgagtcacaccctgtatggccatggagtctgcaagtggcctggctgtgagtctatatgtgaggactttggtcagttcctcaaacatctgaataacgaacatgccctggacgataggtccaccgcccagtgtagagtgcagatgcaggttgtacagcagctcgagattcagctctcaaaggagcgcgagcgactgcaggctatgatgactcacctgcacatgcggccctcggagccgaagccatcccccaaacccaacatttgtaaagtgacttaccgctgcatctggatgttccttaggttttccaattacgccgaagtcctgctgtacattccagagaagctcaccccagtcgccctgtag

SEQ ID NO: 188177 - DNA, 2199 bp, Artificial Sequence
  Description of Artificial Sequence: Synthetic coding sequence
atgatgcaggagagcgccaccgagaccatcagcaacagcagcatgaaccagaacgggatgagcaccctgtcttctcaacttgatgccggcagccgcgacgggagatctagtggagacacttcctccgaggtctctactgtggaactcctgcacttgcagcagcagcaagccctccaggccgccaggcaacttctattacaacagcagacctctggactgaaaagtcctaagagctcggacaagcagcgcccgcttcaggtgccggtgtcagtcgccatgatgacaccccaggtgattacaccccagcagatgcagcaaattctccagcaacaggtgctcagcccacagcaactgcaagcactgctacagcagcagcaggctgttatgctgcaacaggactttcttgacagcggcctagaaaacttccgcgcagctttggaaaaaaaccagcagttacaggagttctacaagaaacagcaggaacagctgcatctgcagcttctgcagcagcaacaacagcaacaacagcagcagcagcaacagcagcaacagcagcaacagcagcaacagcagcagcagcagcagcagcaacagcagcagcaacagcaacagcaacagcagcagcacccaggtaagcaggccaaggaacagcagcagcagcaacagcagcagcagcagctcgctgctcagcagcttgtcttccagcagcagttacttcagatgcaacagctgcaacagcagcaacacctgctgagcctgcagaggcagggattaattagcattcctccaggccaagcagctttaccagtgcagtccttgcctcaggccggtctcagtcccgcggagattcaacaactgtggaaagaggtgaccggcgtgcactctatggaggataacggcataaaacatggcgggctggacctgaccactaacaattctagctcaaccacaagcagtaacacatcaaaagcaagtccaccgataacacatcacagtatcgttaacggacagagttctgttctgtccgcccgccgggatagctcttcccacgaggaaaccggcgcaagtcatactctttatgggcacggcgtgtgtaagtggccaggatgtgaatccatttgtgaagatttcggccagtttctgaagcacctcaacaacgaacatgctcttgacgaccgctcaaccgcacagtgtcgcgttcaaatgcaggtggtgcaacagttagaaatccaattaagcaaagagcgcgagaggctgcaggcaatgatgacacacctgcacatgagacccagtgaacctaaaccatcgcccaagcctctgaacttggtgagctccgttactatgtcaaagaatatgctggagacctccccacaatcactgccccagaccccaactaccccaaccgcacccgtaactcccattacgcaagggccgagtgttatcacacctgcaagcgtacccaatgtcggagctatccgtcggcgacacagcgacaagtataacatccccatgagctctgaaatcgccccaaactatgagttttacaaaaacgccgacgtgagaccgcccttcacctacgctactctgatcagacaggccatcatggagtcctcagatagacagctgaccttgaatgagatctactcctggttcacccggaccttcgcatatttccgcagaaatgccgctacatggaagaacgccgttcgccataacctgtcccttcacaaatgctttgtgcgcgtggaaaatgtgaagggcgcagtctggactgtcgacgaggtggagtaccagaagcgccgttcccaaaagatcacagggagccccactttggtgaaaaacatcccaacctccctggggtacggcgctgctctcaatgcctctctccaggccgcacttgccgaatctagcctgccattgctgtctaacccgggtttgatcaacaacgccagtagcggacttcttcaagccgtgcacgaggacctgaacggcagtttggatcacatcgattccaacggaaattctagcccagggtgcagccctcagccccacatccatagtatccacgttaaagaggagcccgttattgcggaggacgaagactgccctatgagtctagtcacaaccgcaaaccattcacccgagctcgaggatgatcgtgagatcgaggaggagcctctgtccgaggacttagagtag

SEQ ID NO: 188178 - DNA, 2223 bp, Artificial Sequence
  Description of Artificial Sequence: Synthetic coding sequence
atgatgcaggagagcgccaccgagaccatcagcaacagcagcatgaatcagaacgggatgagtaccctctctagccaactcgacgctggctcaagggatggacgctcctccggcgacacatcaagtgaggtgtccacagttgagttactccaccttcagcaacaacaggcactgcaggccgccagacagctcctcctgcagcagcagacaagcggactgaagtcacctaagagtagcgacaaacagcgaccactgcaggagctgctacctgagaccaagctgtgtatctgtgggcattccagtggggacggacatcctcataatacctttgccgtccctgtcagcgtggcaatgatgacaccccaagtcatcacgccacagcagatgcaacagattttgcagcagcaggtgctgagtcctcagcaactccaggcccttctgcagcagcaacaagctgtgatgctgcagcagcaacaactgcaggagttttataaaaagcagcaagagcagctgcacttgcagttgctacagcagcagcaacagcagcagcagcaacaacagcagcagcagcaacagcaacagcaacagcaacaacaacagcagcaacaacagcagcagcaacaacagcagcagcaacaacagcaacagcacccaggtaagcaagcgaaggaacaacagcagcagcaacaacaacagcagcagctggccgcccaacaactcgtgtttcagcaacagctcctacagatgcagcagttacaacagcagcagcatctgctgagcttgcagcgacagggcctaattagcatcccaccaggtcaagcagcccttcccgttcagtcactccctcaagccggattgtcccctgccgagatccaacagctttggaaggaggttactggcgtgcacagcatggaagataatggaatcaagcatggtggacttgatctcaccactaacaactcctcttctaccacatcttctaacacctccaaagcgtccccaccaataacccaccattcaatcgtgaacggtcagtcgagtgtgctgtccgctagacgcgattcatcaagccatgaagaaacaggtgctagccataccctttacggacatggcgtgtgcaagtggcctggatgcgaaagtatctgcgaggacttcggccagttccttaagcatctcaacaatgaacatgccttggacgaccgatcaactgcacagtgcagggtccaaatgcaggtggtgcaacagctggaaatccagctgtcaaaggaaagagagaggctgcaggcaatgatgacacatctccatatgaggccctctgagcctaagccaagccctaaacctctgaaccttgtttctagcgtcacaatgagtaaaaatatgttggagaccagcccacagtccttaccccagacccccactactccaacggcccctgttactcctatcacccaagggccgtcagttatcacccctgccagcgtccccaatgtgggcgccatccggaggaggcattctgacaaatacaacatccctatgagttccgagatcgcacccaattatgagttttacaagaacgcggatgtacgccctccttttacatacgcgaccctgatcagacaggcgattatggaaagctctgacaggcagcttaccctcaatgaaatctatagctggttcacaagaaccttcgcttacttcaggcgcaatgcggccacttggaaaaatgctgttcgccataatctgagcctgcataagtgctttgtccgggttgagaacgtgaagggagctgtctggaccgttgatgaggtggagtaccaaaaaaggagatctcaaaagataacaggctctcctaccctggtaaagaatatccctacatcgctcgggtatggcgccgcgctgaacgcatccttgcaagcagccctcgcggaatcttccctgccactcctgtcaaaccccggactaattaataatgcgagcagcggtctgctgcaagcagttcatgaagatctgaacggctctctagaccacatcgattccaatgggaatagttcacccggttgtagcccacagccacacattcactccattcatgtgaaagaagaacctgtcatcgccgaggacgaagactgcccaatgagtctggtcacaactgcaaaccatagtccggagttggaagacgaccgggagatagaagaagagcctctttccgaggatcttgagtag

SEQ ID NO: 188179 - DNA, 1191 bp, Artificial Sequence
  Description of Artificial Sequence: Synthetic coding sequence
atgcccaacccccggcccggcaagcccagcgcccccagcctggccctgggtccaagccccggagcatcacccagctggcgcgccgctccaaaagctagtgatctgttgggggcccgtggtccagggggaaccttccaggggcgtgatctccggggaggcgcgcatgctagctcgagcagcttaaatcccatgccaccctctcagctgcagctgtcaacggtcgatgctcatgccagaacaccggtcttgcaggttcacccactggaaagccctgcaatgatcagtctgactccccctaccacagctacaggggtgtttagcttgaaagctagacccgggttaccacctggaattaatgtcgcctctcttgagtgggtatcgagggagcctgcactgttatgcacattccctaacccctccgctccacggaaggactccacactgtccgcagtgccccagtcctcttaccccctgctcgcgaatggagtttgcaaatggcccggttgcgagaaagtgttcgaagaacccgaggacttccttaagcattgccaagcagatcacttgcttgatgagaagggcagggcccagtgcctgctccaacgtgagatggtccaatccctagaacagcagctcgtgctggaaaaggagaagctcagcgccatgcaggcgcatttagctgggaaaatggctctcaccaaagcgtcatccgtggctagttctgataagggcagttgctgtatcgtggccgcaggaagccaaggccctgtggtgccagcatggtctggtcctcgggaagctccagacagccttttcgccgtgcgaagacatctgtgggggagtcatgggaactcgacgtttccggagttcctgcataatatggactacttcaagttccacaacatgcgcccgccattcacatatgccacactcatccgttgggccatcctggaggcccccgaaaagcagcggacccttaacgagatctatcactggtttacgaggatgttcgcgttcttccggaaccacccggcaacctggaaaaatgctatccgccacaatctgtctctccataagtgctttgtccgggtagagtctgagaagggggcggtgtggactgtggatgagctggagttccgcaaaaagcgctctcaaaggccctctcgctgtagcaaccccactccaggtccctag

SEQ ID NO: 188180 - DNA, 1296 bp, Artificial Sequence
  Description of Artificial Sequence: Synthetic coding sequence
atgcccaacccccggcccggcaagcccagcgcccccagcctggccctcggcccatccccaggcgcgtccccaagctggagagcggctcccaaggcatccgatctgctgggtgcgcgtggccccggcggcacctttcaggggagggacttgcggggaggggctcacgcatcttcttcctccttaaatcccatgccccctagccaactgcagcttcctacccttcctctagtgatggtagctccctccggagccaggcttggtcccctccctcatctgcaggcccttctccaagaccggcctcacttcatgcaccaactgagcaccgtggacgcgcatgcgcgtactccagtgctccaggtacaccctttggaaagccccgccatgatttccctgacccctcccactaccgcaaccggtgtgttctccctgaaggctcgtccagggcttccacccggcattaacgttgcgtcgctcgagtgggtatcgcgcgaaccggccctgttatgcacctttccgaacccaagcgccccccggaaggactcgaccttgtctgctgtgcctcagtcctcttacccgctgctggccaacggagtatgcaagtggcccggatgtgagaaagttttcgaggagccagaagacttcctgaagcattgccaggcagaccatttgctggacgaaaagggacgggcccagtgcttgttgcaaagagaaatggtgcaatccctagagcagcagttagtgctcgagaaagagaagttgtccgccatgcaggcccacttggccggaaaaatggcattaacaaaggctagtagtgtggcaagttctgataaggggagctgttgcatagtagccgcggggagtcaggggccagtagtccctgcctggtctggcccacgagaagccccagacagtctgttcgcagtcagacgacacttgtgggggtctcacggcaactcaacctttccagagtttctacacaacatggattactttaagtttcataacatgaggccgccctttacgtatgccacactcattcgttgggcgatcctcgaggccccagagaaacagaggacactaaacgaaatctaccactggtttacacggatgtttgcgttctttcggaatcaccccgctacttggaagaatgccattcggcacaacttaagccttcacaagtgcttcgtccgggtggaatccgagaagggtgctgtgtggacagtagatgaactagaatttcgaaaaaaaagaagccaacgcccttctcgctgttccaaccccactcctggtccttag

SEQ ID NO: 188181 - DNA, 1215 bp, Artificial Sequence
  Description of Artificial Sequence: Synthetic coding sequence
atgcccaacccccggcccggcaagcccagcgcccccagcctggccctggggcctagccctggggctagcccgtcctggagggccgcacccaaggccagtgatctgcttggcgcgagagggcccgggggtacattccagggaagagacctcagggggggagctcacgcttcttcttctagtctcaatccaatgcctccctcccagctgcagcttcccaccctgccattagtaatggtggcaccatcaggagcccgattggggccactgcctcatctgcaagcgcttctgcaggatcgacctcatttcatgcatcagctgagcacagttgatgcacacgcaagaacgcctgtgctgcaagtgcatcccctcgagagccctgctatgattagcttgacacccccaaccaccgccactggagtgttttcactgaaggctcggcccggcctgccacccggaataaacgttgcatctctggagtgggtctcgagagagcctgcattgctttgtactttccctaacccctcagcccctagaaaggactctaccctgagtgcagttcctcaatcatcttatccccttcttgcaaacggcgtctgtaagtggcccgggtgtgagaaagttttcgaagagcctgaagactttctaaagcattgccaggccgaccatcttctagacgagaaaggcagagcccaatgcctgctccagagagagatggtacagagccttgaacagcaggcaagtagcgacaaagggtcatgttgtattgttgcagctggctctcaggggcctgtggtgcctgcttggtctggcccgcgcgaggcccctgattcactgttcgccgttcgacgacacctgtgggggagccatgggaatagcacattccctgagttcctgcacaacatggattattttaagttccacaatatgagacctccctttacctacgccactttgatccggtgggcaattcttgaggctcctgagaaacagcggactctgaacgaaatctatcactggtttactcgcatgttcgccttctttcgaaaccatccagcgacttggaaaaacgcaatcaggcataacctctctctccataagtgctttgtgcgggttgaatctgagaagggagccgtgtggactgttgacgagctcgaattccggaagaaacggagccagcgcccgtcccgttgctcaaaccccactcctggcccatag

SEQ ID NO: 188182 - DNA, 1191 bp, Artificial Sequence
  Description of Artificial Sequence: Synthetic coding sequence
atgcccaacccccggcccggcaagcccagcgcccccagcctggccctgggcccttctccaggcgccagcccatcatggagggcggctcctaaggcatctgatctgctcggcgccaggggaccaggaggaactttccaggggagggacctgcgggggggggcccatgcctcctctagcagtctgaatcccatgcccccttcacagttgcagctgagcaccgttgatgcccatgcccgaacaccagttcttcaggtgcacccgctggagtcccctgccatgatctctttaaccccacccacaactgctactggagtattttccctaaaagctagacctggtttgcccccaggaataaacgtcgcctccctggaatgggtgtccagagagcctgccttgctgtgcacttttcctaacccatctgcccctcggaaggattcaacattaagtgccgtgcctcagtcctcataccccctgctggctaatggtgtttgcaagtggcctggatgtgaaaaggttttcgaagaaccagaagacttcctgaagcactgccaggcagatcatctgcttgatgagaagggccgcgctcagtgtctgctccaacgggagatggtgcagagtctagaacagcaactggtactggagaaggagaaactgagcgctatgcaagcacacctggctggcaaaatggccctgacaaaggcgagctccgttgcatcctcggacaaagggagctgctgtattgtcgccgctgggtctcaaggacccgtcgtgccagcctggtcgggaccacgggaagccccggactctctgtttgcggtcaggaggcacctctggggcagtcacggcaacagcactttccccgagtttttgcataatatggactatttcaaattccataacatgcgacccccattcacctacgccacactcatcaggtgggctattctggaagcgccagaaaaacagcgaaccctgaatgaaatttatcactggttcacccggatgttcgctttcttccggaaccatcctgcgacctggaagaacgctattagacataacctgtccctgcataaatgcttcgtgagggtggagagtgagaagggcgccgtttggaccgtggacgaactcgagtttcggaaaaagcgatcccagcggccttcccgatgctccaatcccacacctggcccttag

SEQ ID NO: 188183 - DNA, 2043 bp, Artificial Sequence
  Description of Artificial Sequence: Synthetic coding sequence
atgatggtggagagcgccagcgagaccatccggagcgcccccagcggtcagaacggtgtcggctcactgtcaggccaggcggacggcagctcaggaggggcaacaggtaccacagcctcaggaaccgggagggaggtgacaacaggagcagattctaatggagagatgagtcctgctgagctcttgcattttcagcagcagcaggctctgcaagtggctagacagttcctgctgcagcaagctagtgggctgtcgagtcctggtaacaacgactctaaacagtctgcgtctgccgtccaagtgcctgtcagtgtggcgatgatgagtcctcagatgcttaccccccagcaaatgcaacagatcctcagccccccacagctgcaggccctgctgcaacaacagcaggccctgatgctgcagcagttacaggagtactataagaagcagcaggagcagctgcatctgcagcttctgacgcagcagcaggcaggaaaaccccagccgaaagaggcgctgggtaataagcagctggctttccaacagcagctgctgcagatgcaacagctacagcagcagcacctactcaatctccaacggcagggactggtttctttgcagccaaatcaggcatctggaccgctccagaccctcccccaagctgctgtctgccccaccgatctcccgcagctttggaaaggcgagggcgcacctggtcagccggccgaagatagcgttaaacaggaagggctggacctgacagggaccgctgctaccgctacatcatttgcggctccccctaaagtgtctcctcccttatcccatcatacgctgcccaacggacagcctacagtattgacaagtaggagggatagttcttcacatgaggaaacccccggcagccacccgctctacggccatggcgagtgcaagtggccaggctgtgagacattatgtgaagacctgggccagttcattaaacacctaaacaccgaacatgcccttgacgatcggagcaccgcacagtgtcgagttcagatgcaggtggtgcaacagttggagattcagctggcgaaagaatctgagcggttgcaggcaatgatggcccatctgcatatgcggccaagcgaacccaagccgttttctcagcctctgaatccagtgcctgggtcttcgtctttttcaaaggttactgtatccgcagcagattctttcccagacggcttggttcacccacctacctctgctgccgcaccggtgacacctctgaggccacccgggctggggtccgcgagtctgcatggtgggggcccagccagaagacgtagtagtgacaagttctgttccccaattagctccgagttggctcagaatcatgaattctataagaatgctgacgtccggccaccgttcacgtacgcctcactgattagacaggccatcttagaaacgcctgaccgacagctgaccctcaatgaaatttacaactggttcactaggatgttcgcttacttcaggcgaaatacggccacttggaaaaacgcagtacggcacaatctgagtctacataagtgtttcgtgcgcgtggagaacgttaagggagcagtatggacggtggacgagcgggagtaccaaaagaggcggcctccaaagatgaccggcagtcccacactcgtcaagaacatgatctccggcctgagctacggtgccctgaacgcttcttaccaggccgctttggctgaaagcagcttccccctactgaattcccccggtatgcttaatccaggtagtgccagttctctgcttcccctcagtcacgatgatgttggagcgccagtcgagccactgccaagcaacgggtcatcttctccgccccggcttagcccccctcagtacagccatcaagtacaggtgaaggaggagcctgccgaagctgaagaagacaggcaaccaggacctccattaggggccccaaatccttccgctagtgggcctccggaagatcgagatctggaggaagagctgcctggagaggagctctcttag

SEQ ID NO: 188184 - DNA, 2037 bp, Artificial Sequence
  Description of Artificial Sequence: Synthetic coding sequence
atgatggtggagagcgccagcgagaccatccggagcgcccccagcggtcagaatggagtcgggagtctaagcggacaagccgacggatcatccggcggcgcgacgggaaccactgcctccggtaccggccgcgaagtgacaaccggtgccgactctaatggggagatgagtccagcagagcttttgcacttccagcagcagcaggcgctgcaggttgcacggcagttcctgcttcagcaggccagcgggttgtcatcacctgggaataacgactccaaacagtctgcatctgccgtgcaggtccctgtgagtgttgccatgatgtcgccacaaatgctaacccctcagcaaatgcagcagattttgtcccccccccagcttcaagcacttctccaacagcaacaggccttgatgctccagcaagagtactataaaaagcagcaggagcagttacatctgcagctactcacccagcaacaagccggtaagccgcagcccaaggaagcgctaggcaacaaacagcttgccttccagcaacagctgttgcagatgcagcagttgcagcagcagcacctccttaatctgcagagacaaggactggtttccttgcagcccaaccaggctagtggtcccttgcagacactccctcaagccgccgtgtgcccgactgatctgcctcagttgtggaaaggtgagggcgctcccggccagccagccgaagattcggttaaacaggaaggcctagacctgactggtacagcggctacagcaacatcttttgcggcgcctcccaaggtgtccccccctctctcacaccacactctgcccaatggacagcccaccgtgctcacttctcgcagggactcttcttcccacgaggagaccccagggagccatccattatatggccatggtgagtgtaagtggccaggatgcgagactctgtgcgaggacctgggacagtttattaagcatctgaacacggagcacgccctcgatgacagatccaccgctcagtgtagagtgcagatgcaggtggtccagcagctggaaatacagttggcgaaggagtcagaacgcctgcaggcaatgatggcccatctgcatatgcggccttctgagcctaaaccattttctcagcccctcaatccagtacccggtagcagcagcttttctaaagtaacagtaagcgcggctgattcctttcccgatggcctcgtgcatccacccacttccgcagctgcaccagtgactcccttgaggccccccggcctcggttctgccagtttgcacggaggagggcccgccagaaggcgctcctcagataaattttgttcacctatatccagcgaactggctcagaaccatgaattctacaaaaacgcagacgtgcggccacctttcacgtatgcatccctcataaggcaggcaattctcgagacaccggacaggcagctcaccttaaatgaaatctataattggtttacccgcatgttcgcctactttaggcgcaacactgccacatggaagaatgccgtgcgtcataacctgagcctgcacaagtgcttcgtcagggtggaaaacgttaaaggagccgtgtggactgttgacgagagagagtatcagaaacgccgtcccccaaagatgactggatcaccaacacttgtcaagaatatgataagcggacttagttacggtgccctgaacgcaagctaccaagccgccctggctgagtcatcatttcctcttctgaacagccctggtatgctgaatcctggctccgcaagcagcctgctacccctcagtcatgatgacgtaggggcacctgtggagccactaccctcaaatgggagttccagccctccacgtttatccccacctcagtactcccaccaggttcaggttaaggaggagcctgcagaggcagaggaggatcgccagccaggcccacctctgggcgctccaaatccttcagcatccggccctcctgaggaccgggacctcgaggaggaactaccgggagaagagctatcatag

SEQ ID NO: 188185 - DNA, 2043 bp, Artificial Sequence
  Description of Artificial Sequence: Synthetic coding sequence
atgatggtggagagcgccagcgagaccatccggagcgcccccagcgggcagaacggcgtcggaagtctgtccggccaggctgatgggtccagcggcggtgctacggggacgaccgcgtctgggaccggaagagaagtaactactggcgccgatagtaacggtgaaatgtcccccgctgagctgctgcattttcagcagcaacaggccctgcaagtcgcgaggcagttcttgctacagcaggcatcggggctgtcctcacctggaaataacgatagtaagcaaagcgctagcgccgtccaggttcccgtcagcgtcgcaatgatgagcccacaaatgctgacaccgcagcaaatgcagcagatcctgtcacctccccagctgcaggccctgctgcaacagcaacaggctcttatgctccagcagctccaggagtactacaaaaaacagcaggaacagctccatctgcaactcctgacacagcagcaggccggcaaaccccagcccaaagaggccttgggcaacaaacaactggcttttcagcagcagttgcttcaaatgcagcaactgcaacagcaacacctcctcaacctccagcgccaaggacttgtcagccttcagcccaatcaggcttcgggacctctccagactctcccacaagccgccgtgtgccccaccgacctgccccaactgtggaaaggggagggagctccgggccagcctgcagaggatagtgtcaagcaggaaggcctggacttgaccggtaccgccgccacagctacctcattcgcggcaccaccgaaggtgagtcctcctctttcccatcataccctgccaaatggccaacccacagtgctgacttcaaggagggacagcagttcacacgaggagaccccgggcagccatcctctctacggccacggggagtgtaaatggcctggatgtgagaccctttgtgaggacctcgggcaattcattaagcatctgaacaccgaacacgccctcgatgacagatccaccgcccagtgccgtgttcaaatgcaggtggtgcagcagctggagatccagctggccaaggagagcgagaggcttcaggccatgatggctcacctacatatgagacctagtgagccaaagccgttcagccagccgctaaaccctgttcctggcagctcatctttttcaaaggttacagtgtcagcggccgattccttccctgacgggctggttcatcccccgacttcggcagctgccccggtgactccactcaggccccccggcctgggatctgcaagccttcatggtgggggccctgcgcggcggcggtcgagtgacaagttttgcagcccgattagctccgaattggctcaaaaccatgaattttacaagaatgcggatgtgcgcccccctttcacctatgccagcctaatccgccaggctatactcgagacccctgacagacagcttactttgaacgagatctacaactggtttaccaggatgtttgcatacttcaggcggaatacagcaacctggaaaaacgctgtgaggcacaacctgagcctgcacaagtgctttgtaagagtggagaacgttaagggcgctgtctggacagtggacgagcgtgagtaccaaaagcgtcggcctccgaaaatgactggatcccccaccctagtgaaaaatatgatctcaggcctgagctacggggcactgaacgcatcttaccaggccgcacttgccgaatcctcattcccgctattgaacagcccgggaatgctcaacccgggcagtgcctccagcttactaccactgtcacacgatgacgtaggcgcgcctgtagagcccttgcctagcaatgggagttcatcacctccaagactcagcccacctcagtacagtcatcaagtccaagtgaaggaagagcccgctgaagccgaagaagacagacagcccggtccaccacttggcgcaccaaatccatccgcatctggtcctcctgaggacagggatctggaggaggagctgcctggagaggaattaagctag

SEQ ID NO: 188186 - DNA, 2004 bp, Artificial Sequence
  Description of Artificial Sequence: Synthetic coding sequence
atgatggtggagagcgccagcgagaccatccggagcgcccccagcggccagaacggagtagggtccctcagtggacaggcagacggatcaagcggaggcgctactggcaccaccgccagtggaaccggcagagaagtaacaactggcgctgactcgaacggcgaaatgtcccctgccgagctgctgcacttccagcagcagcaggcgctgcaggttgcccgccaatttctgctccagcaagccagcggtttatcgtcccccggcaacaatgattccaagcagagcgctagcgccgttcaggtgcctgtgtcagtcgcgatgatgtctccccaaatgcttacaccacagcagatgcagcagattctctcgccccctcagttgcaggcactgttgcagcagcagcaagctctgatgcttcaacagcttcaggagtattacaaaaagcagcaggaacaattacatcttcaacttctgacgcagcagcaggcaggcaagccgcagcccaaagaggcgctcggcaataagcagcttgcgtttcagcagcaactcctccaaatgcagcaactacagcagcagcatctgctgaatctgcagaggcaggggctggtgagcctgcagccaaaccaagcttctggaccactgcagacgctgccccaggctgtgtgcccaacggatctcccacagttgtggaaaggggaaggcgctcctggacagcccgctgaggacagcgtaaaacaagagggactggacctgactggtaccgctgcgaccgccacgagctttgccgccccaccgaaggtgtctcctcctttgagccaccatacactgcctaacggacagcctaccgttttgacctcccggcgtgactcttctagccacgaagagaccccgggaagccaccctctctatgggcatggcgaatgcaaatggcccgggtgtgaaactctctgcgaagacttgggccagttcatcaaacatctgaacactgagcacgccctagacgatagaagtacggcccagtgtcgggtgcagatgcaggttgtacagcaactagaaatccaactcgcaaaggaaagcgagcggttgcaggcaatgatggcacacctccacatgcgcccgagcgaaccaaagccgttttcacagccagttacagtgtcagctgccgattcattcccggacgggctggtgcacccaccaacgtccgctgccgcccctgtgactcccctgcgcccaccaggactaggcagcgcctcattgcatggcggtggacccgcgaggaggaggtcaagcgacaagttttgcagccccatcagtagcgagctagcacaaaaccacgagttttataagaacgccgatgttagaccaccatttacatacgcgagtctgataagacaggctatactcgaaacacccgatcgacagttaaccctgaatgagatctataactggtttacacggatgttcgcctacttccgtcggaataccgccacatggaagaacgccgttcggcacaacttgagtctgcacaagtgttttgtccgggttgagaatgtcaaaggcgccgtgtggacagtggacgagcgtgaatatcagaagaggcgccctccgaagatgactggctccccgaccctcgtgaagaacatgatcagcggactgagttacggtgcgttaaatgcaagttatcaggcagctctggcggagagctcctttccgctgctgaactccccaggcatgctgaatcctgggagcgcatctagcctattgcctcttagtcacgacgatgtaggtgctcccgtggagcctctcccttcaaatgggagcagttcccctcccagactcagcccgcctcaatacagccaccaagtgcaggttaaggaagagccagcagaggccgaggaggatagacagccaggcccccccttaggagcacccaacccatctgccagcgggccaccagaagatagggaccttgaggaggaacttccaggggaggaactgtcctag

SEQ ID NO: 188187 - DNA, 2007 bp, Artificial Sequence
  Description of Artificial Sequence: Synthetic coding sequence
atgatggtggagagcgccagcgagaccatccggagcgcccccagcggccagaatggggtgggcagtctctcagggcaggctgatggaagcagcggcggcgccactggcactactgcttctggaactggccgggaggtgaccaccggagccgattcaaatggcgaaatgagccctgcagaacttttgcactttcaacagcagcaggccctacaggtggcacgccagtttctgctgcagcaggctagtggcctgagtagccccggcaacaacgactctaaacagtctgccagtgcggtgcaggtcccagtcagcgtggccatgatgtcacctcagatgctgaccccacaacagatgcagcagattctgtcccctccccagctgcaggctctgctacagcagcaacaggcactgatgcttcagcagctccaggagtactacaaaaaacagcaagagcagctgcacttacaattgctcacccagcaacaggccggtaaacctcagccaaaagaggctctagggaacaaacagcttgctttccagcagcagctattacaaatgcaacagttgcagcaacagcacttactcaatctgcagcgacagggcctcgtgagtctacagccaaaccaggcttctggccccttacagaccctccctcaagcagcagtatgccccactgacctgccccagctttggaaaggcgaaggtgcccctggtcagccagcggaggattccgtgaagcaggagggtttagatctgaccgggaccgctgctaccgctacaagttttgcagcccctcctaaagtgtctcctcccctgtcccatcacacactgccaaacggacagccaaccgtgcttacatctcgaagagatagctcctctcatgaagaaactcctgggagccacccactctatggacatggcgaatgtaaatggccaggatgcgagacactttgtgaagacctgggccagtttatcaagcacctgaacacagaacatgccctagatgaccgctctaccgcccagtgcagggttcagatgcaggtggtgcagcagctcgaaatacagctggctaaagagtctgaaaggctgcaggcaatgatggcacatctgcatatgcgcccatccgaaccaaagccctttagccagcctgtgacagtctctgccgcagactccttccctgacggactggtgcaccccccaacctctgccgccgccccggttactcccctgcggcctcctggacttgggtccgcgagcttgcatggtgggggcccagcccggaggcggtctagtgacaagttttgtagccctatatcaagcgagctggcccagaatcacgaattttacaagaacgccgatgtccgccctccctttacatacgcctctcttattcgtcaggcgatccttgagactcctgatagacaactcacactgaatgaaatctataattggttcactcggatgtttgcctactttcgtcggaatacagcaacctggaaaaacgcagtccggcataatttatccttgcacaaatgttttgtgcgcgtggaaaacgttaagggggcggtgtggaccgtggatgagcgtgaataccaaaaacggcgtcccccaaagatgaccggaagccccacactggttaagaacatgatcagcggacttagctacggggctttgaacgcctcttatcaggcagcactggctgagtcttcattcccactcttgaactcccccggtatgctcaaccccggcagcgcgagctctctgctgccattgagccatgacgacgtcggagctccagtggaacctctcccctccaacggctcctcatctcctccacggctgtccccccctcagtatagccatcaggttcaggtcaaggaagagcccgctgaggcagaggaggatcgacagccaggacctccgttaggggcgcccaatccctccgctagcggtccaccggaggatcgggacctcgaggaggagttgcccggagaggaactgtcctag

SEQ ID NO: 188188 - DNA, 1212 bp, Artificial Sequence
  Description of Artificial Sequence: Synthetic coding sequence
atgaagctggaggtgttcgtgccccgggccgcccacggcgacaagcagggctctgatctcgaaggagcagggggaagcgacgcgccaagtcccttaagcgctgctggggacgattctctgggctctgatggcgattgcgcggccaactctcccgccgcggggggaggcgcccgtgatacacagggggacggtgagcagtcagcgggtggcgggccgggggcagaggaagccataccagccgctgcagctgctgctgtggtagccgagggggcagaggcgggagccgccggccccggcgctggaggagccggaagcggggagggcgcccggtctaagccctacactcgccggccaaaacctccgtacagctatatcgccctgatagctatggccatcagggatagcgcaggaggtagattgactctcgctgaaattaatgagtacctgatgggaaagtttcctttctttcggggcagttacacaggctggagaaatagcgtacgacataatttgagtcttaatgactgtttcgtgaaggtgttgcgggacccatcccggccatggggcaaagacaactactggatgctgaatcctaattccgaatacactttcgccgatggtgtcttccgccggagacgcaagcgcctgtcccatcgggcacccgtgcctgcgcctggtctccgacccgaagaggcaccaggcctgccagcggccccccccccagcaccagccgcgccggcctctccaagaatgcgctcacctgcccgacaggaagagagagcctctcccgccggaaagttctctagttcctttgctattgacagtatccttagaaagccctttcgatccagacggttgagagacaccgcgcctggcacgaccctccagtggggagctgcaccttgcccccccctccccgcatttccagctctcctgcctgcggcaccctgtcgcgcactgttacctttgtgtgcgtatggtgcgggggagcccgcccggctgggcgcccgggaggcagaagtgccccccactgcacccccattactgttagcccctctgcctgcagcggctcctgccaagccgctaagggggcccgccgccggcggcgcgcacctttactgcccacttcgtcttccagccgctttgcaggcagccagtgtgaggcgacccggcccccatctcccttatcctgtggagactctactggcctag

SEQ ID NO: 188189 - DNA, 1626 bp, Artificial Sequence
  Description of Artificial Sequence: Synthetic coding sequence
atgagccagctggtggagtgcgtgcccaacttcagcgagggcaagaaccaggaagtgatcgacgccataagtggtgctatcactcagacccctggttgcgtgctgctcgacgtggacgcaggccctagcactaaccggactgtctacaccttcgtgggcccacccgaatgcgtggtggagggcgcgttaaatgccgctcgcgtagcttccaggctgatcgacatgtccagacaccagggagaacatcctcgaatgggcgcactcgacgtgtgccctttcattccagtgaggggcgtaagcgtggacgaatgcgttttatgcgcacaggccttcggccagcgtcttgccgaagagttggatgtgccagtgtacctgtacggggaggctgccagaatggactccaggcggactctaccagctatccgtgccggagagtacgaggcactcccaaaaaaactgcaacaagcggactgggcccccgattttggcccctccagcttcgtaccgtcttggggtgcgaccgctacaggagcaaggaaattcctgatagcgttcaatatcaacttattaggcaccaaagagcaggcccacaggatcgccctgaacctacgtgagcagggacggggtaaagatcaacccggcaggcttaagaaggtgcaggggatcggttggtatcttgacgagaagaatcttgcccaggtgtccacaaaccttctggattttgaggtcactgccctccatactgtttacgaagaaacctgtagggaggcacaggagctgtcactccctgtcgtagggtcccagttggtcggtctggtccctctgaaagccttgttggacgcagctgctttctactgcgagaaagaaaatttatttatccttgaagaagaacagagaattcgcctggtggtaagcagactcggactcgactcattgtgcccctttagccctaaggaacgcatcatagagtatctcgtgcctgagagaggaccagagagagggctgggctccaagtccctgagggccttcgtgggcgaagtcggggctcgctccgccgcaccgggaggcggctctgttgctgccgcagccgctgccatgggcgccgcattggggtcgatggtcggcctcatgacatacgggaggaggcaatttcagtcattggacacgactatgaggaggctgattccacccttcagagaggcctcggccaaactcaccaccctagtagatgcagacgcagaggcattcacagcatacctcgaagccatgcggctacctaagaacacaccagaagagaaagaccgaagaacagcagccctgcaggaaggactccgcagggccgtctctgtgccgttaaccttagccgagaccgtggcaagtttatggccggcactgcaggaactcgcacggtgtggaaatcttgcctgtcgtagcgacctgcaagtggccgccaaggcactggagatgggggtgttcggagcatactttaacgtgttaatcaacctccgggatatcactgacgaggcgtttaaggatcagatccatcatagagtatcctcattactgcaggaagcaaagactcaggcagccttggtcctggattgcttggagacacgacaggaatag

SEQ ID NO: 188190 - DNA, 1488 bp, Artificial Sequence
  Description of Artificial Sequence: Synthetic coding sequence
atgagccagctggtggagtgcgtgcccaacttcagcgagggcaagaaccaggaggtcattgatgccatctcgggtgccatcactcagactcccgggtgtgttctgctggatgttgatgcaggcccatccactaaccgtacggtgtacacattcgtagggccccccgagtgcgtcgtagagggcgctttgaacgctgcgagggttgcctcccgcctaattgacatgtcgagacatcagggtgagcaccctcggatgggagcgctagacgtgtgcccatttattcctgtgcggggcgtaagcgtagatgaatgtgtgctgtgtgctcaggcattcggacaacgtttggccgaggaacttgatgtccccgtgtacctctatggtgaggctgcccgaatggattctcgtaggactctgccagctattagagcaggcgagtatgaggccttgcccaagaaactgcagcaagctgattgggcccccgatttcgggccctcttcgtttgtcccctcttggggggcaaccgctaccggggctagaaaattcttgatagcttttaatatcaacctgttaggtaccaaggagcaggcacaccggatagccctcaacctgagggaacagggcaggggcaaggaccagccaggccgtctcaaaaaagtccaggggatcggatggtacttagatgaaaagaatctggcacaggtgtcaacgaaccttcttgatttcgaggttactgcgctgcatacagtgtacgaggagacatgtcgtgaggcgcaggagctttcactgccagtggttgggtcccagctggtcggactcgtgcccttaaaagcgctgctcgatgccgcagccttctactgcgagaaggaaaacctgtttatacttgaggaagagcaacgcattcgacttgttgtgtcccgcctaggcctcgacagcctgtgtcctttttcgcccaaggagaggatcatcgaatacctggtcccggagagagggccagagagaggactgggaagtaagtcgctacgggcattcgtgggggaagtcggagcacgatcagcggcgcctgggggcgggtccgtggcagctgcagccgccgctatgggagccgctcttggttctatggtgggcctgatgacttatggccgccggcagtttcagagtttggacacgacgatgcgtcgtttgatcccaccattcagggaggcctcagccaagttaactacattggtggatgccgatgctgaagccttcactgcttatctggcccatggtggtcctaccggtggaagtgaagccggctccctgtgcgctgcagacgccggaggtgatgggggcctcgctgttgcgggcccggcaggaacaggaccggtctgggagccagggctgccagtgaggccacccggtggtggccagtctcctggggacggaagagtgtggagaatctttcaacgagcacaccaacccgaaggacatcaccgccgtggcatttag

SEQ ID NO: 188191 - DNA, 1719 bp, Artificial Sequence
  Description of Artificial Sequence: Synthetic coding sequence
atgagccagctggtggagtgcgtgcccaacttcagcgagggcaagaatcaagaagtgatcgatgcaatctcgggtgccattacacagacccctggctgtgtcctgctcgacgtggacgcagggccatcgactaatagaacagtctatacattcgtgggtcctccggagtgcgtggtggaaggcgcacttaacgctgcccgggtcgcgtcccgactaatcgacatgtcgcggcatcaaggggaacacccgcggatgggcgcccttgatgtctgcccttttattcctgttaggggcgtgtctgttgacgagtgcgtgttgtgcgcccaggcctttgggcaacgtctggccgaggaattagacgtgccggtgtatttgtatggagaggccgctcgcatggacagccggagaactctgcctgctattagagccggagaatatgaagcactgcccaaaaaactgcagcaggctgattgggcacctgactttgggccgtcttcatttgtcccttcatggggggccacagcaactggcgctcgaaagtttctgatcgccttcaacatcaacctgctaggtaccaaggagcaggcgcatcgcatagccctcaatttgcgtgaacaaggcaggggtaaagaccagcccgggcggttgaagaaggtgcaagggatcggttggtacctggacgagaaaaatttagcacaggtgagtacgaatctgctagatttcgaggtaaccgcactgcataccgtttatgaggaaacttgtcgagaggcacaggaactctctcttcccgtagtgggtagccaattagtgggcctggttcccctgaaggccctgctcgacgctgccgccttctattgtgaaaaggagaacctcttcattttggaggaggagcaaaggatccgtctggttgtgtcccgtctgggattggattctctatgtcctttttcccctaaggaacgcatcatcgaatatctggtgcctgagagaggccccgaacggggtctgggtagcaaaagtctcagggccttcgttggcgaagtgggcgcccggagcgccgcacccgggggaggcagcgtggccgcggccgccgctgccatgggcgcagccctgggctctatggtaggcctgatgacgtatggccgacgccagtttcagtctctggatacaactatgcgccggctaatacctccctttagggaagcttccgcgaagctcaccacactggtagacgctgatgctgaggcctttacagcatatctagaggccatgcgattacctaaaaacacccctgaggaaaaggatcggcgcacggctgctttacaggaaggcctgagacgggcggtgtccgtgcctctgactttagctgaaaccgtcgcttccctctggccagccctacaggagctggctcgttgcggaaacctggcatgtcgctcagacctgcaggttgcagccaaagctctcgagatgggcgtctttggcgcctactttaacgtcctaataaaccttagggatattactgacgaggccttcaaggatcagccccccgccggctcccaggacccagggtgcaccggggctggcctgctgggcgaccctgcaggcgtcaccgtgcgagaggcctcacctggctcagtggcccctccaagccccattccaaggggccaatcctgtgatctggagacaccagggactgccggaccaagtaccctagaagggtag

SEQ ID NO: 188192 - DNA, 1488 bp, Artificial Sequence
  Description of Artificial Sequence: Synthetic coding sequence
atgagccagctggtggagtgcgtgcccaacttcagcgagggcaagaaccaggaagtcatcgatgcaatcagcggcgccatcacacagacccccggctgtgtcctcctggatgtggacgcaggaccttcaaccaacaggacggtgtacaccttcgtgggcccgccagaatgtgtcgtggaaggtgcgctcaacgccgcccgggtggcatctcggctgattgatatgtcccgccaccagggcgagcaccctcggatgggcgccctcgacgtatgccccttcattcccgtgaggggcgtgtccgtggacgagtgcgtcctgtgtgcgcaagcattcggacagcgcctggctgaggaattagatgtgcctgtctacctgtacggggaggccgcccgcatggacagtaggcggacactcccagcaatccgcgctggcgagtatgaagcactaccaaaaaaattgcaacaggcagactgggctccagacttcggaccctcctcctttgtcccatcttggggggccaccgctactggagcccgcaagtttctaatcgcattcaatatcaatctactaggaacaaaagaacaggcccaccgaattgctctgaatcttagagaacaggggcgaggaaaggatcaaccagggcgactgaagaaggtccaaggcattggatggtatctggacgagaagaatctagctcaggtgtcaacaaatctcctggatttcgaggtgactgcgctgcacaccgtctatgaagagacgtgtcgggaggcccaagaactctcactcccagtggtaggctctcagctcgtcggcctcgtgcctctgaaggcattactcgatgctgccgctttctactgcgagaaggaaaacttgtttattctggaggaagagcagaggatcagactggtggtgagccgtttggggctagactctctctgtccgtttagcccaaaggagcggatcattgagtaccttgttccagagagggggccagagcgagggctaggaagcaagtccctccgggctttcgtgggcgaggtgggggctcgaagcgccgccccagggggaggttccgtggccgctgcagctgctgcgatgggtgcggcgcttggttccatggtcggtcttatgacctacggccggaggcagttccagagtttggataccaccatgcgccgccttataccccctttcagggaagcctccgcaaaactcacgacactggtggatgccgatgcagaagcatttacggcctatctggcacacggggggcctacagggggttctgaggcggggtccttgtgtgctgccgacgccggtggcgacggaggactggctgtggccggtccagcgggaaccgggcctgtctgggaacctggattgcctgtgagaccacctggggggggtcagagccccggagatggccgcgtgtggcggatttttcagagagcacaccagccggaggggcatcaccgtagagggatttag

SEQ ID NO: 188193 - DNA, 1626 bp, Artificial Sequence
  Description of Artificial Sequence: Synthetic coding sequence
atgagccagctggtggagtgcgtgcccaacttcagcgagggcaagaaccaggaagtgatcgacgccatctccggagctattacgcaaacgcctggctgtgtcctgttggacgtagacgcagggcctagcactaacaggactgtgtacacttttgttggccctccagagtgtgtagtggagggggccctgaacgcagcacgcgtcgccagccgtctcatagatatgagccggcaccagggtgagcacccgcggatgggagccctggacgtttgtcctttcatccctgtgaggggcgtgtccgtggacgaatgtgtcctctgcgcgcaggcatttggacaaagactagcagaggagctggacgtgcccgtctacctctacggagaagctgctcgaatggattcccgcagaacgctgcccgctatccgagctggtgagtacgaagccttacccaaaaaactgcagcaggccgattgggcaccggactttggcccgagctcattcgtgccatcgtggggagcaacggccacaggggctcgaaaattcctcattgcattcaatattaatttgttgggaacaaaggagcaggcccatcggattgccctcaatcttagggagcagggccgtggcaaagatcagccgggcaggcttaaaaaggtgcagggcattgggtggtatctggatgagaaaaacctcgcacaggtgagcaccaaccttctggatttcgaagtgacagcgctgcacacagtatatgaagaaacatgccgagaagcccaagagctctccctgcccgtcgtcggatcccagctggtgggactcgttcccctgaaggcgctccttgatgcagccgcattctactgcgaaaaagaaaacctgtttattttggaggaggagcagagaatccgtcttgtggtatcccgcttggggctggattcactttgtccatttagtccaaaagagagaatcatcgagtatctggtccctgagcgggggccagaacgcggcctgggctctaaaagtttgagggcctttgtcggtgaggtcggagcacgcagtgctgcgccgggtggcggttccgtggcggccgctgctgctgccatgggcgcagcattaggttccatggtcgggctgatgacatatggcagaaggcaatttcaatcactcgataccacaatgcggaggcttattcccccctttagggaagcttccgctaagctcactacgttggtggatgccgacgctgaagcatttactgcttatctggaggctatgcggcttcctaaaaacaccccagaagagaaggaccggcgaactgcagcgttgcaagaagggcttcgccgcgcagtcagtgtccctttaaccctggcggagacagtcgcttcgctgtggccagctctacaggaattagcaaggtgcggcaatttagcttgcaggtcagatcttcaagtagccgctaaagccctggagatgggtgtgttcggagcgtatttcaacgtgctgattaaccttcgtgacatcacggacgaggccttcaaagatcagatccaccatcgggtttcatccctcctacaggaggctaaaacccaggctgcactcgtccttgactgtctggaaacacgccaggaatag

SEQ ID NO: 188194 - DNA, 1719 bp, Artificial Sequence
  Description of Artificial Sequence: Synthetic coding sequence
atgagccagctggtggagtgcgtgcccaacttcagcgagggcaagaaccaagaggttattgacgcaatcagcggtgcaattacccaaacgcccggatgtgtcctcttagacgtggatgctggcccgagcacaaatcgcactgtttacacctttgttgggcctccagaatgtgttgtggagggtgctctgaatgctgctcgtgtggcgagccggctgatcgacatgtctcgacaccagggagagcacccacggatgggcgcactggatgtctgtcccttcatcccggttcgcggcgtgtctgttgatgagtgcgtgttgtgtgctcaggcttttgggcaaagactggctgaagaactcgatgtgcccgtgtacttgtatggtgaggctgcccggatggactctcggagaactttacccgctatccgggccggggagtatgaggctctgcccaaaaagttgcaacaggctgattgggcacccgattttgggccatctagtttcgtaccttcttggggagctaccgcgaccggcgctcggaaattcttgatcgctttcaacatcaaccttctggggaccaaggagcaggcccaccgcatcgccctcaatctgagggagcagggccgcggaaaggaccagcccggtcgccttaagaaagtacagggcattggctggtaccttgatgagaagaatcttgctcaggtgtctaccaatctgttggacttcgaagtaaccgccctgcacaccgtatacgaggaaacctgtagagaagcccaggagctctcgttgcccgtggttggttcccagctcgtggggctcgtccctctcaaagcgttgctcgacgcagcggctttttactgcgaaaaagagaacctgttcattctcgaggaggagcaacgcattaggcttgtggtctctcgcctggggcttgatagtctttgccctttctcgccaaaagaaagaattatcgagtatctggtgcccgagcggggcccagagcgcggcctgggtagtaaaagtctccgtgcatttgtgggtgaggtcggcgctagaagcgctgcccctgggggagggagtgtggccgccgccgcagctgccatgggggccgctttgggatccatggtcggcctgatgacatatggacgaagacagttccaatctctggatactactatgcgaaggctcattccaccgtttagggaggcttctgctaagcttactactctggtggatgctgacgccgaagcattcaccgcgtacttggaggccatgcggctccctaaaaatactcccgaagaaaaggacaggcgaacggcagcccttcaggaggggctacggcgggccgtgagcgtgccactcaccctcgcagagactgtggcttccctgtggcctgctctgcaagaactggccagatgtggcaatctggcatgcagaagtgatctccaggttgccgctaaggccctcgaaatgggagtcttcggtgcatactttaatgtcttgattaacctcagagatatcacagatgaggcatttaaggatcagccgcctgctgggtctcaggatcctggctgtacaggagcaggcctcctgggagatccggcgggggttactgtgcgagaagccagtcccggatctgtcgctcccccctcccctatccctcgggggcaaagctgcgatctggagactcctggtactgctggaccctctactttagagggatag

SEQ ID NO: 188195 - DNA, 1779 bp, Artificial Sequence
  Description of Artificial Sequence: Synthetic coding sequence
atgagctggggcaccgagctgtgggaccagttcgacaacctggagaagcacacacagtggggaatcgatatcctcgaaaagtatatcaagtttgtgaaggagcgcactgagattgagttgagctacgctaagcagctccgtaacctatcgaaaaaatatcagccaaaaaagaactccaaagaagaggaagagtataaatatacttcctgtaaagcctttatctctaatctgaatgagatgaatgactacgctggccagcatgaagtgatttcagaaaacatggcttcacagatcatcgttgatctagctagatatgtgcaggagctcaaacaggaacgcaagagcaattttcacgacggacgcaaggcacagcagcacattgagacttgctggaaacaactcgagtccagtaaaaggaggttcgagagagattgtaaagaagctgatcgagctcagcaatactttgagaagatggatgctgatatcaatgtcacgaaagcagatgtcgagaaggcccggcagcaggcccagatccgacaccaaatggctgaagactcaaaagccgactactcctcaattctccagaaattcaatcatgaacagcatgaatactatcacacgcacattcctaacatctttcagaagatccaagagatggaagagcggcgaatcgtgcgcatgggcgagtctatgaaaacatatgccgaggtggatcggcaggtgattccaatcatcgggaaatgtctggacgggatcgtcaaggcagcagaatctatcgatcagaagaatgattcccagctcgtcattgaggcttataagtctggctttgaaccacccggcgacatagagtttgaggattacacacagccgatgaaacggacagtttccgataactccctgtctaatagcagaggagaggggaaaccagacctgaagtttgggggaaaaagcaaagggaagctgtggccatttatcaagaagaataagagtcccaaacaacagaaggagccgttatctcatcgatttaatgaatttatgacctctaaacctaagattcactgttttcggtcccttaagcgtggccattcacttttgaagggcgccactcccgaggatttttccaatttgccacctgagcagcgccggaagaagctgcagcagaaagtagacgagctcaataaagaaattcaaaaggagatggatcagcgcgacgccattaccaagatgaaggacgtttatttaaagaatccccagatgggcgatcccgcttcattagatcataagctcgccgaggtctctcagaacatcgagaaactgagagtggagacccagaaatttgaggcttggctggcagaggtggaggggaggctcccagctcggtctgaacaagcccgaagacaatcggggctctatgactcacagaaccctcccacagtgaacaattgtgcccaggaccgggaaagtcctgatgggtcatacacagaggagcaatcccaggagagtgaaatgaaggtgctcgctaccgactttgacgacgaatttgacgacgaagaaccactgcccgccatcggcacctgcaaggccctctatacctttgagggtcagaatgaagggactatttccgtggtggagggagagaccctgtatgtaattgaggaggataaaggagatggctggactcgaatcaggagaaatgaggatgaagagggatacgtgccaacttcttatgtcgaagtgtgcctcgacaagaatgccaagggcgcgaaaacctacatctag

SEQ ID NO: 188196 - DNA, 1854 bp, Artificial Sequence
  Description of Artificial Sequence: Synthetic coding sequence
atccggtggaccgacgagctgtgggaccagttcgacaacctggagaagcatacccagtggggaatcgacatattagaaaagtacatcaagttcgtgaaagagagaacggagatagagctaagttatgcaaagcaactgcggaacctcagcaagaagtatcaaccaaaaaaaaattcgaaagaagaggaagaatacaagtatacatcctgtaaagctttcatcagcaatctgaatgagatgaatgactatgcaggccaacacgaggtcatcagcgagaacatggccagccaaatcatagtagacctggctaggtacgtgcaggaactgaaacaggaacgcaaaagtaactttcacgacggtcggaaagcccagcaacacatagagacatgctggaagcaactagagagctctaagcgaagattcgaacgcgactgtaaagaggcagaccgcgctcagcagtatttcgagaaaatggacgccgatatcaatgtgactaaagctgacgtcgaaaaggctcggcaacaggcacaaattcggcatcagatggccgaagactctaaagctgattactcctccattctccagaagtttaaccacgagcagcacgaatattatcacacacacatcccaaatattttccagaaaatccaggaaatggaagaaagaagaatcgtgcgcatgggcgaatccatgaagacctacgcggaagttgacagacaagtgattcccatcattggaaagtgcctggacggtatcgtaaaagctgccgagtctatagaccagaagaatgattctcagcttgtcattgaggcctataagagtggatttgaaccccctggtgatatagagtttgaggattatacgcagccaatgaaacgcacagtcagcgacaactctttaagcaacagcaggggtgaaggtaaacccgacctaaagttcggaggaaaatctaaggggaagctgtggccgtttataaagaaaaataagctcatgtcgctccttacgtccccacatcagccccccccccccccacccgcttccgcctccccaagtgccgtgcctaatgggccgcagtctccgaagcagcagaaagagcccctgagccaccggtttaacgaattcatgacttcgaagcccaagattcattgcttccgttctttaaaaagaggaccttcattcaaacagggtgccacaccagaggacttctccaacttgccacctgaacagcgccgaaaaaagcttcagcagaaagtggatgaattaaataaagagatacagaaggagatggaccaacgggatgccattaccaaaatgaaggatgtctaccttaagaacccccagatgggtgacccagctagccttgaccacaaacttgctgaggtgagccagaatattgagaaactcagagtcgagactcagaaattcgaggcatggctggcagaggttgaaggaaggcttcccgcacgttctgagcaggctcgtcggcaatcggggctgtacgattcccagaatcctccgacagtcaacaactgcgcccaagaccgcgaaagccctgacgggagctacacagaggaacagtctcaggagtctgagatgaaggttctggccaccgatttcgatgacgaattcgatgatgaagaaccgttgccggcaataggaacatgcaaggcactgtacacctttgagggtcagaatgagggcaccatcagcgtggtggaaggagaaacactgtatgttatcgaagaggataaaggcgatgggtggacacggataagacgaaatgaagatgaggagggatacgtaccaacatcttacgtcgaagtctgcctcgataagaatgcgaaagattcgtag

SEQ ID NO: 188197 - DNA, 1854 bp, Artificial Sequence
  Description of Artificial Sequence: Synthetic coding sequence
atgagctggggcaccgagctgtgggaccagttcgacaacctggagaaacacacacaatggggcatcgacatactggagaagtacattaaatttgtgaaagaacgcactgaaatagagctctcctatgctaaacagcttaggaatctatcaaagaagtaccagcccaaaaaaaatagcaaggaagaggaagaatacaaatacacttcttgcaaagccttcatctccaatctcaatgagatgaacgattacgctggacagcatgaagtcatcagcgagaatatggcttctcagatcatcgtggatctggctaggtacgtgcaggagctcaaacaggaacgaaaatctaatttccatgatggaaggaaggcccaacaacacatcgaaacttgctggaagcagttagagtcaagcaaacgtcgcttcgagcgcgattgtaaagaagctgacagggcccagcagtactttgagaagatggatgcggacattaatgtcactaaggctgatgtggaaaaagccagacagcaggcacagattcgtcatcaaatggccgaagatagcaaggccgactattcttccatcctgcagaaatttaaccacgagcaacacgaatattaccatacacacatccccaacatctttcaaaaaatccaagagatggaagagaggcgcatagtgcgtatgggcgaatcaatgaaaacttatgctgaggttgatagacaagttattcctatcattggtaaatgtcttgacggcattgtcaaagctgcagagagtatagatcagaaaaacgacagtcaactcgtaattgaagcgtacaagtccgggttcgagccccctggtgacatcgagtttgaggactacacacaaccgatgaagcggacagtttctgacaattcactgtcgaactcaagaggcgaggggaaaccggacctcaagtttggtgggaaaagtaagggcaagctgtggccgtttataaagaaaaataagttgatgtccctactaacaagtcctcatcaaccgccaccaccccctcctgccagcgctagcccctctgccgtcccaaacggcccgcaatcacctaaacaacaaaaggaaccattgagtcacaggttcaatgaattcatgacaagtaagcccaagatccattgcttccggtccttaaaaagagggcattctcttttaaaaggcgctactccagaagactttagtaacttgccacctgaacagcggcgaaaaaaactgcagcagaaagtggacgaactcaacaaagaaatccagaaggagatggatcaaagagacgctatcacaaagatgaaagacgtgtatttaaaaaacccacaaatgggagaccctgcgtcattggatcataagctggccgaggtctcccaaaacatcgaaaaattgcgtgtcgagactcaaaagtttgaggcctggttagcagaggtggagggccgcttaccggctaggagcgaacaagcgaggagacaaagcgggctgtacgactctcagaaccccccaaccgtaaacaattgcgcacaggatcgagagtctccagacggaagctacactgaagaacagtcccaggagtcggagatgaaggtgttagctaccgattttgatgatgaattcgacgacgaggagccactgccagccataggaacatgcaaggctctgtataccttcgaagggcagaacgagggcactatttctgtcgtggagggcgagaccctgtacgtgattgaggaggacaagggcgacggatggacacgaatccggaggaatgaagatgaagagggctatgtacccactagctacgtggaagtgtgtttagataaaaacgccaaagactcctag

SEQ ID NO: 188198 - DNA, 1827 bp, Artificial Sequence
  Description of Artificial Sequence: Synthetic coding sequence
atgagctggggcaccgagctgtgggaccagttcgacaacctggagaagcatacccagtgggggattgacattcttgagaaatatatcaagttcgttaaagagaggactgaaattgagttgagctacgccaaacaactccgaaacctctctaaaaagtaccagcctaaaaaaaattctaaggaagaagaggagtacaaatatacctcttgcaaagcgttcatctcgaatttgaacgaaatgaacgattacgcaggacagcacgaggtgatatcggagaatatggctagccagattatcgttgaccttgcccgatacgttcaggaactgaagcaggagcgcaaaagtaacttccacgacgggcggaaagcacagcaacacatcgagacttgttggaaacagctggaaagtagcaagcggaggttcgagagggattgtaaggaggcggacagggcccagcagtacttcgagaaaatggatgctgatatcaacgtgacaaaggcagacgtcgagaaggcacgccagcaagctcagatccgacaccaaatggctgaggactccaaagcagactatagttccatccttcagaagttcaaccacgaacaacacgaatactaccatacacacatccctaatatttttcagaagatacaggaaatggaggaaagaagaattgtgcggatgggagaatctatgaagacctacgctgaggtagacaggcaggtcatacccataatcggcaaatgcttggacgggatagtaaaagccgcagagtcaatagaccagaagaatgattcccaattagtgatcgaggcatataagagtggcttcgagccccccggagacattgagtttgaagactacacccagcctatgaagagaacggtctcagataactctctgtccaattcccgcggtgaagggaaacccgatttaaagttcggaggtaaaagcaagggtaaactgtggccctttatcaaaaagaacaaacctcccccaccaccgccagcttcagcttcaccgtctgctgtgcccaacggccctcagagcccaaagcagcagaaggagccactgagccacagatttaacgaattcatgacatcaaagccaaaaattcattgtttcagaagcctgaagcgcggtcactctctgactctccagggcgccacccctgaagactttagcaatttgccacccgagcagaggaggaagaagctccagcaaaaagtcgatgaactgaacaaggagattcagaaagaaatggaccagcgggatgctatcaccaaaatgaaggacgtctatctcaagaatccacaaatgggtgaccccgcctccttagatcataaattagccgaagtctcacagaatatagaaaaacttcgagtggagacccagaagttcgaagcatggttggcggaggttgagggaagactgcctgccagatccgagcaggctcgccggcagagcgggttgtacgactcacaaaatccccctaccgtcaataattgtgcccaggaccgtgaaagtcctgacgggagttataccgaggaacagtcccaggagagcgaaatgaaagtgttggctaccgactttgatgacgaattcgacgatgaggagccactcccagctataggcacatgtaaggctctatatactttcgagggacagaacgagggtaccatctccgtggtggagggagaaaccctgtacgtcattgaggaggacaagggggatgggtggaccagaatcagacggaatgaagacgaagagggatatgtgcctacgtcctacgttgaggtgtgcctggacaagaatgcaaaagattcatag

SEQ ID NO: 188199 - DNA, 738 bp, Artificial Sequence
  Description of Artificial Sequence: Synthetic coding sequence
atgaagcggaccatcggcaagcccacctacgccttcgaggcccgggactatgtgctgtcattgaaactcggagcaacccctgaggatttctccaacctgcctcccgaacagcgccgcaaaaagctccagcagaaggtcgatgagcttaataaggaaatccagaaggaaatggaccagcgtgacgccatcacgaagatgaaggacgtgtacctgaaaaaccctcagatgggggaccctgccagcctggaccataagctagccgaggtttctcagaatattgaaaaattgcgagtcgaaactcagaaattcgaagcctggctggcagaggtggaggggcggctgccagcgaggagcgagcaagcgcgacgtcagtctggcctgtacgactctcaaaacccccccacagtaaacaactgtgctcaggaccgagagtcacccgacggctcttatacagaggagcaatcccaggagagcgagatgaaggtgttggctacagatttcgatgatgagttcgacgacgaggaacctctgcctgccatcggaacatgcaaagccttatatactttcgagggtcagaacgaagggacaatttccgtggtggaaggggagaccctgtatgtgattgaagaagataagggagatggctggactcggattcggcggaatgaagacgaagagggttacgtccccacaagttatgtagaggtctgtctggataaaaatgctaaggactcgtag

SEQ ID NO: 188200 - DNA, 1854 bp, Artificial Sequence
  Description of Artificial Sequence: Synthetic coding sequence
atgagctggggcaccgagctgtgggaccagttcgacaacctggagaagcacactcaatggggcatcgacatcctggagaagtatattaagtttgtaaaagagagaactgagatcgaactcagctacgctaagcagttacgcaatctgagcaaaaagtatcaacccaagaaaaattctaaggaagaggaggagtacaaatatacatcctgtaaggcttttattagtaatcttaatgagatgaatgattatgcaggccagcatgaagtgataagcgagaacatggcttcccagattattgtagatctggcacggtacgtgcaggaactgaagcaggagcgcaagtctaacttccacgacggcagaaaagcccaacagcatatcgagacttgttggaaacagcttgagagctcaaagaggcgctttgagagggactgcaaggaagcagaccgggcccagcagtacttcgagaaaatggatgccgatatcaacgtgactaaagctgatgtggagaaggcccgacagcaagctcaaatcagacaccagatggctgaagactctaaagcagattactcttctatcctgcaaaaattcaatcatgaacagcacgaatattatcacactcacattcccaatatcttccagaagattcaggagatggaagagcgcagaattgttcgaatgggagagagtatgaaaacctacgctgaggtcgatcgacaggtcatacctattatcggtaaatgccttgacggaattgtgaaggctgctgagtcgatcgaccagaagaatgactctcaactagtgatcgaggcgtacaagagcggattcgaacctcctggagatattgagttcgaggactacactcaacctatgaagcggacagtgagtgacaatagtctgtcaaacagtcgcggcgagggaaagccagacttgaaatttgggggtaagagtaagggcaaactgtggccctttattaaaaagaataagctcatgtcccttctgacttcgcctcaccaacccccgccccccccccctgcctccgcgagcccaagtgcagtgcctaatggcccgcagagtcctaaacagcagaaggaacctctgtcacatcggtttaatgagttcatgacctccaagcctaaaatccattgttttaggtctttgaagaggggactgtcacttaaattaggggccacgcctgaggatttcagcaacctaccacccgagcagagaagaaagaagctccaacaaaaggttgacgagctgaataaggaaatccaaaaagagatggatcagagggacgccattaccaagatgaaggacgtttacctcaaaaacccccagatgggcgatcctgcgagcctagatcataagctggccgaggtttcccagaatatcgaaaagctcagggttgagacacagaaattcgaggcctggctggccgaggtggaggggcgcttacctgcacgctctgagcaagctcggcgccaatccggcctctatgattcccaaaaccctccaacagtcaacaattgcgcacaggaccgtgaatccccagatgggtcttacactgaggaacaatcccaggaatcagagatgaaagttttagctaccgacttcgacgacgagttcgacgacgaggaacccttgcccgccattggcacttgtaaagctctgtacactttcgaaggacagaatgagggtaccatctcagtggtggagggcgaaacgctctacgttatagaggaggataagggggacggatggactcggattcgcaggaacgaggacgaggaagggtatgtcccaactagctacgtggaggtgtgcctggacaagaacgctaaagattcgtag

SEQ ID NO: 188201 - DNA, 1722 bp, Artificial Sequence
  Description of Artificial Sequence: Synthetic coding sequence
tgactgagctacgccaagcagctgcggaacctgagcaagaagtaccaacccaagaagaactccaaagaagaggaagaatacaagtacacttcatgcaaggcattcatctccaatctgaacgagatgaacgactacgcagggcagcacgaggtgatcagcgaaaatatggcctcacagattattgtggacctggcccgatatgtgcaggaattgaaacaagagagaaagagcaattttcacgacggacgtaaagcacaacagcacatcgaaacctgttggaagcagctcgaatcctcgaagcgtcgtttcgagagagattgtaaagaggccgaccgggctcaacagtatttcgaaaaaatggacgcagatataaatgttacaaaggccgatgtagaaaaggccagacagcaggcccagatcaggcaccaaatggccgaagacagcaaggccgattacagcagtatactgcagaagttcaaccacgagcagcacgagtattatcacacacacatacccaacatatttcagaagattcaagagatggaggagaggcgtattgttcgaatgggggagtccatgaaaacctatgccgaggtagatcggcaggttatccctattattggtaaatgtctcgatggcattgtaaaggctgcagaatcaatcgaccagaagaacgacagccagctagtaatcgaggcatataagtccggttttgagccacccggcgacattgaattcgaggactacacccagcccatgaaaagaaccgtgtccgacaattctctgtccaactcccgaggcgaggggaaacccgaccttaagttcggcggcaagagcaaaggcaaactctggccctttattaagaaaaataaaccaccaccccctccccccgcgtccgccagtccttctgcagtcccgaacgggccgcagagccccaaacagcagaaggaacccctttcacacaggttcaatgagtttatgacaagcaagcctaagatccattgttttcgtagtctcaagagggggcactcgttgctgaagggagccacccctgaggacttctccaacctcccaccagagcaacgaagaaaaaaactgcagcagaaagtggacgagctcaataaagaaattcaaaaagaaatggatcaacgcgatgccataaccaaaatgaaagacgtctatctgaaaaatccgcaaatgggagaccctgcaagcctcgatcataaactcgccgaagtttctcagaacatcgagaagctccgtgtggagacccagaagttcgaagcatggctagctgaggtggagggcagactgccggcccgttcagaacaggctagacgccaaagcggactctatgactcacagaatcctccaacagttaacaattgcgcacaagatcgtgaatctcctgatggctcgtacacagaagaacaatcacaggaatcggagatgaaggtgcttgctactgactttgatgatgagttcgatgatgaagagcccctgccagcaattggaacttgcaaggccttatataccttcgagggccagaacgaggggacaatctcagtggtagagggggaaaccctgtatgtgattgaagaggataagggtgatggttggacccgcatcagacgtaacgaagatgaggaagggtatgtgccaacctcatatgtggaagtctgcctcgacaagaatgctaagggggctaaaacgtatatttag

SEQ ID NO: 188202 - DNA, 3495 bp, Artificial Sequence
  Description of Artificial Sequence: Synthetic coding sequence
atggccggcggcgaggaccggggcgacggcgagcccgtgagcgtggttaccgtgcgggtgcagtacctcgaggatactgacccctttgcctgcgcaaatttcccggaacctaggcgggcccccacatgtagcctcgatggagccctccctcttggcgcgcagattcccgcagtgcaccgcctcttgggcgccccactaaagttggaagattgtgcactgcaagtgtctccatccggctattacctggatactgagctgtcacttgaagagcaacgagagatgctggaggggttctatgaggagatatccaagggtcggaaacctacgctgatcctacgcacccaactgagtgttagggtgaatgctattttagaaaagctgtatagctcttccggcccggaattgcgcaggagcttattttcactgaaacagattttccaggaggataaagatctggtgcccgagtttgttcattcagagggtttgagctgtctcattagagtcggtgccgccgccgaccacaattaccagtcttacatactgcgtgctctgggtcagctcatgctctttgtggacggaatgctgggggtggtcgcgcactcggacacaatccaatggttatacaccttatgcgcatctctatcgcgcctggtggtgaagaccgccttaaaactgttgctcgtgttcgttgagtacagcgaaaataatgcccctctgtttatcagagctgtcaactcagtcgcatctactaccggagcgcctccctgggctaacctggtctccattctcgaggagaaaaacggtgccgaccccgagctgctggtctacacagttaccctcataaacaagaccctagccgccctacccgaccaggacagcttttacgatgtaacagacgccctggaacagcagggcatggaagctttagtccagaggcacctcggcacggccggtacagacgtggatctcaggacgcaacttgtgctgtacgagaacgccctgaaacttgaagacggtgacatagaagaggctcccggcgcgggcggaaggcgggaacgacgcaaaccgagttccgaagagggcaaaaggagcagacgctcactggaaggcggcgggtgcccagcgcgagcacctgagccagggcctacgggccctgcaagtccagtgggaccaacgagcagcactggccccgcattactgaccggccccgcatcttcgccagtgggacctccaagcgggctccaggcatcagtaaacctgttccctaccatttccgtcgctccatctgccgacacttccagcgagcggtctatctataaagctaggttcttagaaaacgtcgcagctgccgaaacagagaagcaggtggcactggctcaaggccgcgccgagactctggctggtgcaatgccaaacgaggccggcggacatcctgatgcaagacaactgtgggatagcccagaaaccgccccggccgctcgaaccccgcaatcccccgccccttgcgtcctattgcgcgctcagagaagtctggcaccagagccaaaagagccactgatccctgccagtcccaaggctgaacctatttgggagctgccaacaagagctcctaggctctcaatcggagatttagacttttccgacttgggcgaggacgaagaccaggacatgctgaatgtagagtctgttgaggctggcaaggatattccagccccctcccctcctctccctctcctctccggtgtcccaccacctccaccccttcctccaccacctcccatcaagggcccatttcctcccccaccaccgcttcctctggccgccccactgccgcactccgtaccagactccagcgccctccccacaaagcggaaaacagtaaaactgttttggagggaacttaagcttgcaggtggtcatggggtgtccgcatctcggttcggtccttgcgctactctctgggcctctttagaccctgtttccgtcgataccgccaggctcgaacacctgtttgaaagccgcgccaaagaggtcctccctagcaaaaaggcaggggagggtcggagaacgatgaccacagtgctcgatccaaaacgttcaaatgctattaatattggcctaaccactctgccaccggtccatgtgattaaggccgctcttctgaacttcgatgagttcgcagtgtccaaagacggaatcgaaaaactccttacaatgatgccaactgaggaggagcgtcagaagatagaggaggctcagctcgctaacccagatattccccttggaccagcagagaatttcctgatgacgctggcttcaatcgggggcctggcggctcgccttcagctgtgggcctttaagcttgattacgactcaatggagcgtgaaatcgctgagccgctttttgacctgaaggtaggtatggagcagcttgtgcaaaacgccacatttcgttgtatactagctacactcctcgcagtgggaaacttcttgaacggatcacagtcaagcgggtttgagctcagctacctagaaaaggtttctgaggtgaaggacacggtgcggagacagagtcttctgcaccacctttgctccttggtccttcagacacgacccgagtccagcgatctgtatagcgaaattccggctctgacaagatgtgccaaagtcgacttcgagcagctcacggagaatctcggacaattagagcgtagatctcgagctgcagaggagtccttgcggagcttggctaaacatgagttggcgcccgctctgcgcgccaggttaacgcactttttggaccaatgcgccaggcgcgttgccatgctccgcatcgttcaccgtcgcgtgtgtaataggttccacgcttttctgctgtacctagggtacacaccccaagccgcgagggaggtacggatcatgcagttctgtcacactctccgcgaatttgctttggagtatcggacatgtcgagagcgcgtccttcaacaacagcaaaagcaggccacctaccgcgagcgcaacaaaacccggggaagaatgattacagaaaccgagaagttctccggagttgcgggagaggcaccctcaaatccgtccgtgcctgtcgcagtatcctcaggccctggcaggggcgatgcagactcccacgcttctatgaaatcactcctgactagtaggccagaggataccacgcacaaccgcagaagccgaggaatggtgcagtcttcctccccgattatgcctacagtcggaccctcgaccgcttcgccagaggagccacctggatcttccttgccgtctgacaccagcgatgaaataatggatttgctagtccagtccgtaaccaagagttctcccagagccctggcagcaagagaacggaaacggagcaggggcaaccgcaagtcgctccgacgcacgctgaagtctgggctcggagacgacctggtgcaagcccttgggctgagcaaggggcccggattagaggtctag

SEQ ID NO: 188203 - DNA, 4320 bp, Artificial Sequence
  Description of Artificial Sequence: Synthetic coding sequence
atggccaccctggcctgccgggtgcagttcctggacgacaccgacccttttaacagtactaactttcctgagcctagtaggccccctctctttacatttcgtgaagacttggccttggggacgcagctcgctggagtacaccgcttgctccaggctccccataagttggatgattgtacacttcagctgagccacaacggcgcttatctggacttggaggccactctggcagaacagcgcgacgagctggaggggtttcaggacgatgccggtagagggaagaagcactctatcatactgaggacccagctgtctgtgcgagtacatgcttgtatcgagaagctgtacaattcttccggcagagatcttcggagggccctgttctctctgaagcaaatcttccaggatgataaagatctggttcatgagttcgtggtggccgagggcttgacctgccttatcaaagtgggcgctgaagctgaccagaattaccagaattacatcctccgggcactcgggcagatcatgttatatgtcgacgggatgaacggggtgatcaacaggaacgagacaatccagtggctgtataccctcatcggatcgaaatttcgcctggtcgtcaagaccgctttgaagttactcttggtcttcgtggaatacagtgaatccaatgctccacttttaattcaagccgtaaccgccgtggacaccaaacgtggggtgaaaccctggtctaatatcatggagatcttggaagagaaagatggtgtggacaccgagttactcgtctacgcgatgaccctggtcaataaaaccctgtctggtttgccagatcaggacactttctatgacgtggtcgactgtcttgaagagctgggcatcgccgccgttagccagcgccatctgaataagaaagggaccgacctcgacctggtggagcagctcaacatatacgaggtcgcgctcagacacgaggacggagatgagactacagagccaccaccaagtggctgtcgcgatcgacggcgcgcatccgtctgctcaagcggtggaggcgagcacagagggctggaccgtagaaggtcacggcgacactctgtgcagagtatcaaaagtacgttaagcgctcctactagcccttgcagtcaaagtgcaccaagttttaaacccaaccaagttagagatcttagagaaaagtatagcaacttcggtaacaattcttaccacagcagtcggccatcaagcgggtcgagcgtacccaccacacccacctcttccgtgtcgccaccccaagaggcccgattggagcgctcaagcccatctggcctgcttacatcgtcctttagacaacaccaagagagtctggccgctgagagagaaaggcgcagacaggagcgagaagagcgtctacaacgcattgagcgggaggagaggaacaagttctctcgggactatctggacaagcgggaggaacaaaggcaggccagagaagagcgatacaagtatctcgagcagctggcggccgaagagcacgagaaggaacttcggagtcggtctgttagcagggggagggctgatctgtctcttgacctaaccagtccagctgctccagcctgcctagcccctctgagtcactccccctctagtagcgattcccaagaggcgttgacggtgtcagcgagcagtccaggaaccccccaccatcctcaggcctcggccggagaccctgagcccgagtccgaagctgaacctgaagccgaagccggcgcgggacaagtagctgatgaagccgggcaggacatagccagtgcccatgaaggggcggaaacagaggttgagcaggccttggaacaggagcctgaggaaagggcttctttgagcgagaaggagcggcaaaacgagggggtcaacgagagggataattgtagtgcctcaagtgtctcatccagttcctcaactctggaacgggaagagaaagaggataaactcagccgtgaccgcaccacaggactctggcctgctggcgttcaggacgctggcgtgaatggacagtgtggtgacatcctgaccaacaagaggttcatgttggacatgctgtacgcgcacaaccgcaagtcgccagatgatgaggagaaaggtgacggagaggctggcagaactcaacaagaagctgaagccgttgcatccctcgccaccagaataagcacgctgcaggcaaattcccagactcaggacgagtccgtgcgccgcgtggatgtgggatgtctagacaacagggggagtgttaaagcgttcgccgaaaagttcaactctggggacctaggcagaggcagcattagcccggacgctgagcccaacgacaaggtgcctgagaccgcaccagtacagccaaagactgaatccgactacatctgggatcagctgatggcaaacccaagagaacttaggatccaggacatggatttcacagacctaggtgaggaagacgatattgatgtgctcgacgtcgacctcgggcatagggaggctcccgggccgcctcccccccctccacctacttttcttggacttccaccaccgcctcctcccccgctgctcgacagcatcccgccacctcccgtgcccggcaacctcctggtgccacctccaccagtcttcaacgctccgcaaggcttgggatggtcgcaggttcctcgtgggcagcccacttttactaagaagaagaagaccatacgcctgttttggaacgaggttagaccatttgactggccttgtaagaacaatagaagatgccgggaattcttgtggtccaagctggaacccatcaaagtcgacacctctaggctggaacatctgtttgaatctaagtccaaagaactgtccgtctccaaaaaaactgctgccgatgggaagaggcaggagataatcgtcctcgatagtaagcgctccaacgcaatcaatattgggcttacagtgttgccccccccaagaactatcaagatcgcaatcttgaacttcgatgaatacgctttaaataaagagggaatcgagaagattttgacgatgattcccactgatgaggaaaagcagaagatccaggaagctcagttggctaaccctgagattcccttaggctcagccgaacagtttctgttaacactgagcagtatcagcgaactctccgcccggctccatctttgggcgttcaagatggattacgagacgaccgaaaaagaggtcgcagaaccgctgctggatttaaaggagggcattgatcagctggagaacaataagactctcgggtttatcctgtctaccctgctggcaatagggaattttctgaatggcaccaacgctaaggcatttgaattgtcgtatctggaaaaggttcctgaggtgaaagacactgtccacaagcagtccctgcttcatcatgtgtgcacgatggtcgtggagaatttcccagatagctctgacctgtattcagagatcggggccatcacaagatccgcaaaggtcgactttgatcagcttcaagacaatctgtgccagatggagaggagatgtaaagcaagctgggatcatctgaaggcaatcgccaaacatgagatgaaaccggtgctaaagcagcgcatgtccgagtttctgaaggactgtgctgagaggatcatcattttgaaaattgtacaccgcagaatcattaatcggtttcatagcttcctcctgttcatgggacaccccccttacgccatccgtgaggtgaatattaataaattctgccgcatcattagtgaattcgctctggagtataggactacccgggagcgggtgctgcaacagaaacagaaaagagcaaatcatcgagaacgcaataaaactcgcgggaagatgatcaccgactccgggaagttcagcggcagctctcctgcaccaccctctcagccgcagggcctgtcttacgccgaggatgcggctgaacacgagaatatgaaggccgtgctaaaaacgtcttcacctagcgttgaagatgccacccccgccctgggggtacggaccaggtcgcgagcgtcccgcggaagtaccagttcttggactatgggcacagacgattccccaaatgtgacagacgatgccgccgacgagatcatggacaggattgtgaagtcggctacccaagtaccctctcagcgggtagtgcctcgcgaacgaaaacgctcacgcgccaacaggaaatcactgagacgcaccttgaaaagcgggttgacccctgaagaagctagagccctgggattggtaggcacctcagagctgcagctgtag

SEQ ID NO: 188204 - DNA, 4269 bp, Artificial Sequence
  Description of Artificial Sequence: Synthetic coding sequence
atggccaccctggcctgccgggtgcagttcctggacgacaccgacccattcaattctaccaattttccagaaccgagccgaccacctctgtttacctttcgagaggatcttgctcttgggacccagctggccggggtccacagacttttgcaggcaccgcacaaacttgatgactgtactctgcagctgtctcataacggcgcttacctagacttggaagctaccctggccgagcagagggatgaactggaaggattccaggacgacgctggccgcgggaagaaacattctatcatcctgaggacccaactgtcagtgagagtccacgcctgcatcgagaagctctacaacagctcaggcagggacctgcgccgtgccctcttttcacttaagcagatttttcaagatgataaggatctggtgcatgagttcgtggttgcagagggactaacttgtcttataaaggtcggagccgaagcagatcagaactaccagaactatatcctccgtgctcttgggcagatcatgctgtacgttgatgggatgaacggtgttattaatcgaaatgagacgatccaatggctatatactctgataggcagtaagtttcgactagtagtcaaaaccgctctgaagctcttgctggtctttgtggagtatagcgagagcaacgccccccttcttatccaggcagtaaccgcagttgatacaaaacggggtgtgaaaccatggagcaatatcatggaaattctggaggaaaaggatggagtggataccgaactactcgtgtacgctatgacgctggtgaataagactctgtcaggactgcctgaccaggatacattctacgacgtcgttgattgccttgaagagttgggcattgccgccgtaagccaacggcatctgaacaaaaaggggactgatctggacctggtagagcagctgaacatctacgaggtggcgctgaggcatgaggacggcgacgagaccacagagccccctccttcaggctgccgagacagaaggcgagccagtgtctgcagtagtggaggaggagagcatagagggctggatagacgcagaagccggcgccatagtgtgcagtcaatcaagtctacactaagtgccccaacctccccatgctctcagagcgcccctagctttaaacctaaccaggtgcgggatctacgcgaaaagtacagcaactttgggaataattcttaccactccagccgcccaagctctgggtcaagcgttcccaccactcctacatctagtgtgagcccccctcaagaagcccgcttggagcgcagctccccttcgggcttgctcactagttcattccggcagcatcaggaaagtctggctgctgagcgcgaacgtaggcgtcaggagcgggaggaacggcttcaacgcatcgagcgtgaagagagaaataagttccggtacaagtacctggaacagctggcagctgaggaacatgagaaagagcttagatcccgaagtgtgtcaaggggcagagcagacctgtccttggacctaaccagccccgccgctccagcttgtttagctcccctgagccactctccttctagttccgactctcaggaggccctcactgtgtccgcgtcttcacccggaacaccccaccatcctcaggccagcgcgggtgatcccgaacctgaatcagaggctgagccagaggcagaggcgggcgccggccaagtcgctgacgaggcaggtcaggatatcgcatccgctcatgaaggtgctgagacggaagtggagcaagcattagaacaggaacccgaggaacgagcaagtctaagcgagaaagaaaggcagaatgaaggggtgaacgagagggacaactgctccgcctccagcgtctccagctcctctagcacgttagaacgcgaagagaaggaggataaactgtctagagatcgaacaacgggcctgtggcccgctggagtgcaggacgccggcgtgaacggtcagtgtggagacatcctgaccaataaaagatttatgctggatatgctctacgcgcacaatcgaaaaagtccagacgacgaggaaaagggtgatggcgaagctggcaggacacaacaagaggctgaggctgttgctagtttagctacgcgtattagtaccctgcaggcgaatagccaaacccaggatgagtctgttagaagggtcgacgttggctgcctagacaaccgtggctcggtaaaagctttcgcggagaaattcaacagcggagatctgggccggggtagcatttctcccgatgcagaaccaaacgataaagtgcccgaaacagcacccgtgcagcccaagaccgagtccgactacatttgggatcaactgatggcaaaccctcgggagttgcgcattcaagatatggactttacagatctcggcgaggaagacgacatcgacgtgctggacgttgatctaggacatcgtgaagcaccgggtcctccccctccccctccccccaccttcctaggcctgccaccacctcctccccctccacttcttgattctatcccgccaccccctgtcccaggcaatttgctcgtcccccccccccccgtgttcaatgccccccagggactgggctggtctcaagtgccacggggccagccaaccttcaccaaaaagaagaagactataagactgttctggaacgaagtgcgaccattcgattggccctgtaagaataacaggcgctgccgggaatttttatggagcaaactagagccaattaaagtcgataccagccgactggagcacctgttcgaaagcaagtcaaaagagctgtccgtgtccaagaaaacagctgctgacggtaaaagacaggaaattatcgttcttgattcaaagcgcagcaacgcgatcaacatcggactgaccgtcctacccccacctcgcacaattaaaatcgccatccttaatttcgacgaatacgcactcaataaagaaggcatcgagaagatcctcaccatgattcccactgacgaagaaaagcaaaagattcaggaggcccagctagcgaatcccgagatacccttaggatcagcggagcagttcctcctgaccctcagcagcatttccgagttgtccgcacggttacatctctgggccttcaagatggattatgaaacaactgagaaggaggtggctgagccattgctcgatctcaaggaggggatcgaccagctggaaaataacaagacactgggcttcatacttagtacgctcctggccatcggcaactttctaaatgggactaatgccaaagcttttgagctgtcataccttgaaaaagtgccagaagtgaaggatacagtgcataagcagtctctcttgcatcacgtttgtaccatggtagtggaaaattttccagactcaagcgacctttactccgaaatcggcgccattacccggtctgccaaggttgattttgatcaactccaggataacctgtgccagatggagcgcagatgcaaagcatcctgggatcaccttaaagctatcgcaaagcatgaaatgaaacctgtgttgaaacagagaatgagtgagttcctgaaggactgcgccgaacggattattattttaaagattgttcaccgtaggattattaatagatttcactcctttctgttgttcatgggacaccccccttatgcgatcagggaggtgaacattaacaaattttgtagaatcattagcgagttcgccctggaatatagaacaactagagaacgtgtgctccagcagaagcagaagcgtgctaaccatagagagaggaataaaacgaggggcaaaatgattacagactccggaaagttctctggcagttccccagcgccaccaagccagccacagggcctctcttacgctgaagacgccgcagaacacgagaatatgaaggctgttctaaaaacatcctccccatccgtggaggacgcaacccctgccctcggagtacgcacgaggagccgggcgagcagaggaagtaccagctcatggacgatggggaccgacgactcacccaatgtgactgatgacgccgcagacgagattatggatagaatcgtgaagtctgctactcaagttccctctcaacgggtggttccaagagagcgaaaacgcagtcgggctaaccgcaagagtctacgaagaacactcaaatctggtctaacgcccgaggaagcccgcgccttgggactggtgggtacaagcgagttgcagctttag

SEQ ID NO: 188205 - DNA, 4206 bp, Artificial Sequence
  Description of Artificial Sequence: Synthetic coding sequence
atggccaccctggcctgccgggtgcagttcctggacgacaccgacccgttcaatagcacaaacttcccggaaccgtctcggcctcccttgttcacgttccgagaggacctggcactcgggacccagctcgctggggtccaccgactcctacaggccccacataaactggatgattgcaccttgcagttgagtcacaacggtgcatacctggacctggaagcgactttggctgaacagagggatgagctcgaaggattccaggacgacgccggtagggggaaaaaacactcaataatattacggacacaactaagcgtgcgggtacacgcctgcattgagaagctctacaacagtagtggacgcgacctccgacgtgctctcttttcgttgaagcagattttccaggatgacaaagatctcgtccatgaattcgtggtggccgaaggcctgacttgtctgatcaaagtgggtgctgaggccgaccagaattatcagaactacatcctgagggctctcggccagattatgctttatgtggatggcatgaacggagtgatcaaccggaatgaaacaatccagtggctgtatacattgatcggtagcaagttccggttggtagtcaagaccgctctcaagttactcctagtgtttgtcgaatattccgagtccaacgcccctctgttaatccaggccgtcactgcagttgacaccaaacgcggcgttaaaccgtggtcaaacataatggagattttagaggaaaaagacggcgtggatacagagctgctcgtctacgccatgaccctcgtaaataagaccctctcaggcctgcccgaccaggatacattctacgatgttgttgactgcctggaggagttaggaattgccgcggtgtcgcagcgccacctaaacaagaagggcacagaccttgacctggttgaacagctcaacatctacgaagtggccctccgtcacgaagatggggatgagaccacagagcccccccctagcgggtgcagggatcggcgacgggcctctgtatgtagttcaggtggcggcgagcaccggggccttgaccgcagacgatccagaaggcattccgtgcagagcattaaatctaccttgtccgctccaactagcccatgctcacaatccgccccctcctttaaaccgaaccaagtgcgcgatctccgcgagaaatcttcccccagcggcttactgacctcctcctttcgccaacatcaagagtcgctggccgccgagagagaaaggcgccggcaggaacgagaagagaggctacagcgtatcgaaagggaggaacggaataaattctcccgcgactacctggacaagcgggaggaacagcggcaggctcgcgaggagcgctacaaatacctcgagcagctggccgcagaggagcacgagaaagagctgcgctctagaagcgttagtagagggcgggctgaccttagtctcgacttgacctcccctgccgcccccgcctgcttagctccgttaagccacagcccctccagctccgacagccaggaggcgttgaccgtcagcgcgtccagtcccggcacacctcatcacccccaggcatcagcaggcgacccagagcccgaaagtgaagccgaacctgaggccgaggcaggggcggggcaagtggccgacgaggccggccaggatatcgcttccgcacacgagggagccgagactgaagtggaacaagcactggagcaggaacccgaggaacgtgcctcacttagcgagaaagaaagacagaacgaaggggttaacgaaagagacaactgcagcgcatcgtctgtgtcaagcagtagttctactctggaacgggaggagaaggaggacaagctgagtcgcgacagaactaccggcttatggccagccggggtacaggatgcgggggtcaatggacagtgtggagatatccttaccaataagagatttatgcttgacatgctgtatgcacacaacaggaagtctcccgatgatgaggaaaaaggtgacggcgaggctggacgaactcagcaggaggctgaagcagttgccagtctggcaacccgcatctcaactctccaggccaactcccagactcaggatgagtccgtcagacgagtggacgtggggtgtcttgacaatcggggtagcgttaaggctttcgctgaaaaatttaattctggcgaccttgggaggggaagcattagtcctgatgcagagccaaatgataaggttcccgagacagccccagtgcagcccaaaacagagtcagactacatttgggaccagcttatggctaacccccgtgaactgcgcatccaagatatggatttcaccgatttgggcgaagaagacgatattgatgtgttggacgtggatttgggccaccgcgaggcacccggtcctccccccccccctccacccacatttctgggtctgccaccccctccgccaccaccgctgctggactctattccgccccctcctgtacctggcaatctcctagtgccaccccccccagtgtttaacgccccccaggggcttggctggagccaggttcccagaggccagcccaccttcacaaagaagaagaagaccattaggctgttttggaacgaggtaaggcccttcgactggccatgtaagaataatagaaggtgccgcgagtttctgtggtcaaagctcgagccaatcaaggtggatacgtcccggctagaacacctgttcgaatctaaatctaaagagctttcggtcagcaagaaaacggctgctgatgggaagcgtcaagaaataatcgtgcttgatagcaaacggtctaatgcaatcaacatcggccttaccgttttgccacctccaagaaccataaaaattgccattctcaactttgacgagtacgcactgaacaaagaaggtatcgagaaaatccttacaatgattcctactgacgaagagaagcaaaaaattcaggaggcccagctggctaatcctgaaattcccctgggcagtgccgaacagttcctcctgaccttgtcgagtatttccgaacttagcgccagacttcacctgtgggcttttaaaatggactatgaaacaaccgaaaaggaggtggcagagccgctcctcgacctgaaggagggtatcgatcagctggaaaacaataagactttaggcttcatattgtccacactgctggcgatcggaaactttctgaatggtacgaatgccaaagccttcgaactgtcttacctggagaaggtgccagaggtgaaggacactgtccacaaacagtccttgctacaccatgtgtgcactatggtcgtcgagaatttccctgactcctctgatttatatagtgagattggggctattacacgttctgcaaaagtggactttgatcagcttcaggataacctctgccaaatggagaggcggtgtaaggcttcttgggaccaccttaaggccatagcaaagcacgagatgaagccagtgctcaagcagcgcatgagtgagtttctcaaagattgcgccgagagaatcatcatcttgaaaattgtgcatcggcgaattatcaaccggttccatagtttcctgctgtttatggggcacccaccttacgctattcgggaggtgaatataaataagttctgtcgcatcatcagtgaatttgctctggagtataggacaactagagaacgggtactacagcaaaaacagaagagagctaatcaccgcgaacgcaacaaaactcgcggcaaaatgattactgactctggtaagttctcaggcagcagccccgcccccccgtcccagccgcagggcttgtcatatgccgaggacgcagcagagcatgagaatatgaaggcagtgttaaagacaagcagtccgagcgtcgaggacgcaacgcctgctctgggggtcagaaccaggtcacgagcatctcggggcagtacatcctcttggacaatgggcaccgacgactctcccaatgtcacagatgatgcggccgatgagattatggaccgaatcgtgaagagcgccacacaggttcccagtcagagagtggtacctagagagaggaaaaggagcagggctaaccgcaagtccctccgccggacactgaagagtggcctgacccctgaagaggcccgtgcactgggccttgtgggcacaagcgaacttcagctatag

SEQ ID NO: 188206 - DNA, 1053 bp, Artificial Sequence
  Description of Artificial Sequence: Synthetic coding sequence
atggagaccaacagcagcctgcccaccaacatcagcggcggcacccctgccgtgagtgcgggctacttgtttctcgacattattacctatctcgtatttgccgtcacattcgtgcttggggttttggggaacggtttggttatatgggtcgctgggtttagaatgactcacaccgttactaccatctcttatctcaatctggcagttgctgatttctgctttacatcaaccctgccgtttttcatggtgcgcaaggctatgggcggccactggccttttggctggtttctgtgtaagttcgtctttacaatcgttgatataaatcttttcggttccgtgtttctaatcgctctaatagcattggacagatgcgtgtgcgtgctccatcctgtgtggacacagaaccacagaaccgtgtcactggccaaaaaggtgatcatcgggccttgggtaatggctctgctcctcaccctgcccgtcattatcagggtcacaacagtgcccgggaagacgggcacagtggcgtgcacgtttaattttagcccgtggacaaatgaccccaaggagcggattaatgtcgccgtagccatgctgacagtgaggggtatcattaggttcatcatcgggttttccgcccccatgagcatcgttgccgtgagctacgggctgatagccacaaaaatacacaaacagggcctgataaagtcgagtcggccacttcgtgttctctctttcgtcgccgcagcgttcttcctgtgctggtccccgtaccaggtcgtggctctgattgccactgttcgcattagggagctgctgcaaggcatgtacaaggaaattgggattgccgtcgacgtgacctcggccctagccttctttaacagttgtttaaaccctatgttgtacgtatttatgggccaggacttccgcgagcgtttgatccacgctctcccagcctccctggaacgggccctcactgaagactctacacaaacctcagatacagccacaaactccacactaccgagcgctgaagtggagttgcaggcaaagtag

SEQ ID NO: 188207 - DNA, 1053 bp, Artificial Sequence
  Description of Artificial Sequence: Synthetic coding sequence
atggagaccaacagcagcctgcccaccaacatcagcggcggcacccccgctgtttctgctggatacctgtttttggacattatcacctacctggtcttcgctgtgacattcgtgctgggggtgcttgggaatggactggtcatttgggttgcaggctttaggatgactcataccgttactaccatatcctacctcaacctagccgtcgccgatttctgcttcacttctactctgcctttttttatggtccgcaaggccatggggggacactggcctttcgggtggttcttgtgtaaatttgtttttacgatagtggatatcaacctgtttggttcagtgttcttgatagcactgatcgctctagatcggtgcgtgtgcgtgctgcaccccgtctggacacaaaatcaccgcacagtcagcttggcaaaaaaagtcatcatcgggccttgggtgatggctctcttactgactttacctgtgataattcgagttaccaccgtccccggaaaaactggcaccgtggcctgcacatttaacttcagcccctggaccaacgatccgaaggaacggatcaatgtagctgtcgctatgctaaccgtgagaggcatcatccgatttattatcggcttttctgccccaatgtcgatcgtggctgtatcctacggcttgattgcaaccaaaatacacaagcagggcctaatcaaaagcagcagaccactacgggttctgtctttcgtcgccgctgcatttttcctttgttggtccccgtatcaggtggtcgcactgattgctaccgtccgaattcgcgagttgctccaaggcatgtacaaggagatcggcattgctgtggatgtgacgtctgctctcgccttcttcaactcttgcctcaatcccatgctgtacgtgttcatgggccaggacttccgcgagaggttaatccatgcactgcctgcgtcacttgaacgggctctgacggaagactccacacagacatccgataccgccactaattcgacccttccatccgccgaggtcgagctgcaggctaagtag

SEQ ID NO: 188208 - DNA, 1056 bp, Artificial Sequence
  Description of Artificial Sequence: Synthetic coding sequence
atggagaccaacttcagcacccccctgaacgagtacgaggaggtgagctacgagtccgcagggtacactgttctccgtatcctaccgttggttgtgttgggcgtgacttttgtgttgggtgtccttgggaatgggttagtgatttgggtcgctggctttcgaatgacaagaacagtcaccaccatctgctatctcaacctggccttagcagacttttcgtttaccgccactctgcctttcctcattgtgtccatggctatgggagaaaagtggccatttgggtggttcctttgtaagctgatccacattgtggtagacataaacttattcggtagtgtttttttaataggctttattgcactggacagatgcatttgcgtactgcaccccgtgtgggcccaaaatcaccggacagtgagcctggctatgaaggtaattgtgggcccctggatcttggccttggtccttacacttccagtgttcctgtttctcaccaccgtgaccatccctaacggagatacctactgcacttttaacttcgcctcatgggggggaacccccgaggaaagattaaaggtggcgattacgatgctgactgccagagggattattagattcgtgatagggtttagcttgcctatgtcaatagtggccatttgctatggattgattgcagctaagattcataagaaggggatgattaagtcaagccggcctttacgggtcctaactgccgtcgtagcctcttttttcatatgttggttcccattccaacttgtcgccctgttaggtaccgtttggctgaaggaaatgctgttctatgggaagtacaaaattatcgatatcttagttaatcctacgtcgagtttagcttttttcaattcttgcctcaaccctatgctgtatgttttcgtcggtcaggactttcgcgaacgtctcattcatagtctgcctacatctttggaacgggccttgtccgaggattctgccccaactaatgacactgcggccaatagcgccagcccacctgccgaaaccgaactgcaagctatgtag

SEQ ID NO: 188209 - DNA, 1056 bp, Artificial Sequence
  Description of Artificial Sequence: Synthetic coding sequence
atggagaccaacttcagcacccccctgaacgagtacgaggaggtgtcctatgaatctgccggatataccgtgttgcgaatcttgcctctggtggtgctgggagtcactttcgtcctgggcgtgctcggaaacggtttggtcatttgggtcgccgggttccgaatgactcgcactgtcacgacaatttgctatctcaacttggcactggcggacttcagcttcacagccacccttccctttttgatcgtgtccatggcgatgggcgaaaagtggcctttcggctggtttctttgtaaactaatacacatagtggtggatatcaacctgttcggatctgttttcctgattggatttatcgccctcgacagatgcatttgtgtgctgcacccagtgtgggcacagaatcacaggacagtgagtctggctatgaaggtcattgtgggaccatggattctggcactcgttctgaccctgcctgtgtttctctttcttactacagtgaccattccgaacggtgatacttactgcactttcaacttcgctagctggggcggaactccggaagagcggctgaaggttgctataaccatgcttactgccagggggataattaggttcgttattggattttctctgccaatgtctatcgttgcaatttgttacggcctgatcgccgctaagatccacaagaagggaatgattaaaagctcacgacctcttcgcgtactgaccgcagtagtggctagcttctttatttgttggttcccattccagctggtcgctctgctagggactgtgtggttgaaagagatgctgttctatgggaagtacaagattatcgatatcctggtcaatcccacatcaagtctggcattttttaactcatgtttaaaccccatgctgtatgtgttcgttggccaagatttccgcgagcgcttaattcattcccttcctacctcactggagagagcgctgagcgaggactctgcaccgaccaatgacaccgccgctaattctgcttctcccccggcagaaactgaacttcaggcaatgtag

SEQ ID NO: 188210 - DNA, 1062 bp, Artificial Sequence
  Description of Artificial Sequence: Synthetic coding sequence
atggagaccaacttcagcatccccctgaacgagaccgaggaggtgctcccagagcccgcaggccacactgttttgtggatatttagcctgctggtgcacggggtcacattcgtgtttggggtgttaggaaatgggttggtgatctgggtggctggatttaggatgacacggacagtgaataccatctgctacctgaacctagccctcgcagatttctctttttctgccatactgcctttccggatggtgtctgtcgcaatgcgcgagaagtggcccttcggaagcttcctatgtaaactggtgcacgtgatgatcgatattaatctgttcgtgtctgtctatctgatcaccattatcgccctggatagatgcatttgcgtgctgcacccagcatgggcccagaaccaccggaccatgagtttagcaaaaagggttatgactggcttatggatattcacaatagtcctcaccctgcccaatttcatcttttggacaacgatttcaaccaccaacggggatacatattgtatattcaatttcgccttctggggtgacaccgctgtggagcgcctgaatgttttcattactatggcaaaagtgtttcttattctgcacttcatcatagggtttagtgtgcctatgtccataatcacggtgtgttacggcattatcgccgctaaaatacatcgtaatcacatgattaaatcttcccggccactgcgcgtgttcgccgctgtggtggcttcctttttcatttgctggtttccttatgagttgatcggaattctcatggctgtctggttaaaggagatgctcctcaatggtaaatataaaattattcttgtgttgattaatccaactagtagtcttgccttttttaattcttgcctcaatcccatcctctatgtgttcatggggaggaacttccaggagagacttataaggagtctgcctacgagcttagagagagcactcaccgaagttcccgatagtgcacagacatcaaacactgatacaacttccgcctcccccccagaggaaactgaactccaggcaatgtag

SEQ ID NO: 188211 - DNA, 816 bp, Artificial Sequence
  Description of Artificial Sequence: Synthetic coding sequence
atgttccgggacttcggcgagcccggccccagcagcggcaacggcggaggatacggaggccctgcacaaccaccggctgcagctcaggcagcccagcagaagtttcacctcgttccttccatcaacacgatgtcaggtagccaagaactgcagtggatggttcagccccatttcctggggccgagttcctatcccaggcctttaacctacccacagtatagcccccctcagcctcgacctggagtgatacgtgctctgggccccccccctggcgtcaggcgacgtccgtgtgagcagattagcccggaagaagaagagcgacgccgggtacgccgggaaagaaacaaattagccgctgcaaaatgcagaaatagacgcaaggagctcacggacttcctccaggctgaaaccgataagctcgaggacgaaaagtcaggcttacagcgtgagatagaggaactgcaaaagcagaaagagcggctggaattagtcctggaggcacatagacccatctgcaaaattcctgagggagccaaggagggtgatacgggttcaacatcgggaacctcctctccacccgctccatgccgccctgtcccatgcatctcactgtccccaggaccagtactcgaaccagaggcccttcatacccccactctgatgaccacaccgtcactaactccattcaccccctctttggtgtttacatacccatcaactcccgagccctgtgcgagcgcccaccgtaaatcctcctcttcctctggagaccccagcagtgatcctttgggctctccgacactgctggctctttag

SEQ ID NO: 188212 - DNA, 510 bp, Artificial Sequence
  Description of Artificial Sequence: Synthetic coding sequence
atgttccgggacttcggcgagcccggccccagcagcggcaacggcgggggctacggggggcccgcccagccccctgcagccgctcaggccgcccagcaggagactgacaagttggaagacgaaaagagtggacttcaacgcgagatcgaagaactacagaaacagaaggagagactggagttagtcctggaggcacataggcctatttgcaagataccagagggtgccaaagagggagatacagggagcacttctgggacttccagcccacctgccccctgccggcccgtgccctgcatttctctctccccaggccccgttcttgagcccgaggcactccacacccctactctgatgactactccctccctcaccccttttacgcccagcctggtgtttacttatcccagcacccccgaaccctgcgctagcgcccatcgaaaatccagctcttccagcggcgacccctcctcagaccccctgggctcccccactttgctggctctgtag

SEQ ID NO: 188213 - DNA, 351 bp, Artificial Sequence
  Description of Artificial Sequence: Synthetic coding sequence
atgttccgggacttcggcgagcccggccccagcagcggcaacggcggtggctatgggggacccgcccagccacccgccgctgcccaggcggcgcaacagaaattccacttggttccctctattaataccatgagcggtagccaggagctgcagtggatggtgcagccccacttcctgggcccctccagctacccaagacccttgacttatccccaatactctcccccgcagccaaggcctggtgtgatcagagcattaggtcctccaccaggagttcgtcgccggccttgtgagcagatcagccctgaagaagaggagagttggcagccgagggattttgtggatccatag

SEQ ID NO: 188214 - DNA, 981 bp, Artificial Sequence
  Description of Artificial Sequence: Synthetic coding sequence
atgtaccaggactaccccggcaacttcgacaccagcagccggggcagttctggctctcccgcccatgctgaatcttatagtagcgggggcggcggccagcaaaagttcagagtggacatgcccgggtcaggaagcgccttcattcccaccatcaatgccataaccaccagccaagacctacaatggatggtccagcctacggtcatcacatcgatgagcaatccttacccacggagccatccctacagcccactccccggccttgcttctgtcccggggcatatggccctgccccgcccaggtgtgatcaagaccatcggcactacagtgggacgtcgcaggagggacgaacagctttctcctgaagaagaagagaagagacgaatacgaagggagaggaacaagctcgccgctgctaaatgcaggaatcggcggcgagagctaaccgagaagcttcaagctgaaacagaggagctggaggaggagaagtcgggactgcagaaagaaatcgccgagctgcaaaaagagaaagaaaagctggagttcatgctggtcgcgcatggcccagtctgtaagattagtccagaggagcggagaagcccaccagctcctggtctgcagcccatgcgttcaggtggaggctcggttggtgcagtggtggtaaaacaggagcccctggaagaggacagccccagttcatcctccgctggcctcgataaagcccaaagatccgtgataaaaccgatctctattgccggcgggttttatggagaagaacctctacacacacctatagtggtgacttccacacctgcagtaacccccggaacttccaatcttgtctttacataccccagcgtgctggaacaggaatcaccagctagcccttccgaatcttgctctaaagcacatagacgctcatccagcagcggcgaccagtcgtcagattccctgaacagcccaactctgttggccttatag

SEQ ID NO: 188215 - DNA, 864 bp, Artificial Sequence
  Description of Artificial Sequence: Synthetic coding sequence
atgcccggcagcggcagcgccttcatccccaccatcaacgccatcaccactagccaagatttgcagtggatggtgcagcccacggtcattaccagtatgagcaacccttatcctcgcagtcatccctactctcctctgccaggtctcgcaagtgttccaggccacatggctctcccacgaccgggagtgatcaaaactattggcaccactgtgggacgtcgccgacgtgatgagcaactttctccagaggaggaggagaaacggcggattcgacgggaacggaataagctcgccgccgccaagtgcagaaatcgtagacgagagctgaccgaaaagttgcaagccgagacagaagagctggaagaggaaaaaagcggactgcagaaggaaatcgcagaattacaaaaggagaaagaaaagctggaattcatgttggttgctcacggccccgtatgtaagatctcccctgaggagcgccgaagtcccccagctcccggactgcagcctatgcgctctggggggggttctgtcggcgcggtggtcgtgaaacaggagcccctggaagaagacagtcctagctcttcctcggcgggtctcgacaaagctcagaggtctgttatcaaaccaatctctattgccggaggcttctacggagaagagcccctgcacaccccgattgtagtgacctctacacccgctgtgacaccaggcaccagtaacttagtttttacgtatccatcagtcctggagcaagagtcccccgctagccccagtgagtcttgcagcaaggcccaccgccgatccagctcttctggtgaccagagctcggattctctgaacagcccgaccttgttggccctttag

SEQ ID NO: 188216 - DNA, 972 bp, Artificial Sequence
  Description of Artificial Sequence: Synthetic coding sequence
atggccgagaagttcgactgccactactgccgggaccccctgcaggggaaaaagtacgtgcagaaggacggacatcattgttgcttgaaatgctttgataagttctgcgccaacacgtgtgtggagtgtagaaaaccaatcggcgcagattctaaggaagttcattacaaaaaccgcttctggcacgatacatgcttcagatgtgccaagtgcctgcatcctcttgccaatgagactttcgtggccaaggacaacaagattttgtgtaacaagtgcactaccagggaagattcacccaaatgtaagggttgttttaaggccatcgtagctggcgatcaaaacgtggagtataagggcactgtgtggcacaaagactgtttcacttgttccaattgtaaacaggttattggtactggttcatttttcccaaaaggggaagatttctattgtgtgacgtgtcacgaaaccaagtttgccaaacactgcgtgaagtgcaataaagccatcacaagtggcggaatcacctaccaggatcagccctggcacgcagattgtttcgtgtgcgtaacttgctcaaagaagctcgcggggcagcgctttacagccgtggaggaccagtattattgcgtcgactgttataaaaacttcgtggcaaagaagtgcgcggggtgcaaaaatcccattacaggcaagcggactgtatctagggtttcacatcctgtctccaaggctagaaaaccacctgtatgtcacgggaaacgactgcccctaaccttgtttccatcagccaacctgcgtggcaggcacccaggcggtgaacgtacctgtcctagctgggtcgtagtcctctatcgcaagaaccgatctcttgcagctccaaggggcccaggactggtgaaagcccccgtgtggtggcccatgaaggacaatcccggaaccaccacagccagcaccgctaagaatgctccctag

SEQ ID NO: 188217 - DNA, 774 bp, Artificial Sequence
  Description of Artificial Sequence: Synthetic coding sequence
atggccgagaagttcgactgccactactgccgggaccccctgcagggcaaaaagtacgtgcaaaaggacggacaccactgttgcctcaagtgctttgataagttctgcgctaacacatgcgtggaatgcagaaaaccgatcggtgctgattcgaaggaggtccattacaagaacaggttttggcatgatacctgcttccgctgcgccaagtgcctccaccccttagctaatgagacgtttgttgcaaaggataataagattctttgtaacaagtgtaccacccgagaagattcacccaagtgtaaggggtgcttcaaagctatcgtggcaggggatcagaacgtggagtacaagggcaccgtgtggcataaagattgctttacctgtagtaactgtaaacaggtgattggtacaggcagcttttttccaaaaggggaggacttttattgtgtaacctgccatgaaacaaagtttgccaaacattgtgtgaaatgcaacaaagcaataacttcggggggcataacctatcaggaccagccgtggcacgcagactgttttgtgtgtgtgacatgtagcaaaaagctcgctggacagcgatttactgctgtcgaggatcagtattactgtgtagactgctataaaaattttgttgccaaaaaatgtgctggctgtaaaaatccgattacggggtttggaaaaggtagctctgtagtcgcgtacgagggacagtcatggcatgactactgctttcattgcaagaaatgcagcgtgtag

SEQ ID NO: 188218 - DNA, 633 bp, Artificial Sequence
  Description of Artificial Sequence: Synthetic coding sequence
atggccagccaccggcacagcggccccagcagctacaaggtgggcacaatggccgaaaagttcgactgtcattattgccgagatcccctccagggtaagaaatatgtacagaaggacggccatcattgctgcttgaagtgctttgacaaattttgtgcaaacacctgtgtagagtgtcgaaaacccattggggctgactcaaaagaagtgcattacaaaaaccggttctggcacgatacttgttttcggtgtgccaagtgcctgcaccccctggccaatgaaacattcgtcgccaaagacaataagattctgtgcaataagtgcacaactcgggaagactctcctaagtgcaaagggtgcttcaaagcaatcgttgcgggggaccagaatgtagagtacaaaggcacggtatggcacaaggactgctttacctgctctaactgtaagcaggttatcggcactgggagcttctttcccaagggggaggatttctattgcgtgacatgccacgagaccaagtttgctaaacattgtgtgaaatgcaataagggcctggtgaaggcccccgtgtggtggccaatgaaagacaatccggggaccactactgcttcaacagcaaaaaacgcaccgtag

SEQ ID NO: 188219 - DNA, 891 bp, Artificial Sequence
  Description of Artificial Sequence: Synthetic coding sequence
atggccagccaccggcacagcggccccagcagctacaaggtgggcaccatggcagagaaattcgattgtcactactgccgcgacccactgcaaggaaaaaaatatgtccagaaggacggccatcactgctgcctcaagtgttttgataagttctgtgcaaatacctgcgtcgagtgccggaagccaatcggggctgatagcaaagaggtgcactacaagaaccgattctggcacgacacatgtttccgctgcgcaaagtgtttacaccccttagcaaatgagaccttcgtcgctaaggacaacaagatcctatgcaacaagtgtactacaagggaggactcacccaagtgtaaagggtgttttaaggcgattgtggcgggggaccaaaacgtggaatacaaaggcaccgtatggcacaaggattgctttacatgttctaattgtaagcaggttataggcacaggctcgttcttcccaaaaggagaagacttctattgcgtcacttgtcacgagaccaaattcgccaaacactgcgtgaagtgtaataaagccataacctcaggcggcattacttaccaagatcagccttggcacgcagactgtttcgtgtgtgtgacctgctctaaaaaattagccggtcaaagatttacggcagttgaagaccagtactattgcgtcgattgctataagaattttgtggctaagaaatgtgcaggctgcaaaaaccctataaccgggttcggcaagggaagttcagtggtggcatacgaagggcagagttggcatgattattgtttccactgcaagaagtgttccgtgaatcttgccaataaacggttcgtgtttcaccaagaacaggtgtattgccctgactgcgccaaaaagctgtag

SEQ ID NO: 188220 - DNA, 843 bp, Artificial Sequence
  Description of Artificial Sequence: Synthetic coding sequence
atggccgagaagttcgactgccactactgccgggaccccctgcaggggaagaaatatgtccagaaggatgggcaccactgttgcctcaagtgctttgacaagttctgcgctaacacgtgtgtcgagtgcaggaagcctattggcgctgacagcaaggaagtccactacaagaataggttctggcatgatacttgcttcagatgcgccaaatgcttgcatccccttgctaatgaaacattcgtggccaaggataataaaatcctctgcaataagtgtacaaccagagaagactcaccgaagtgtaagggctgcttcaaggctatcgttgcaggtgatcagaacgttgagtacaaaggcacagtctggcataaggactgctttacttgttctaattgtaaacaggtgattggaactggcagttttttcccgaagggggaggacttttactgcgtcacctgccatgagaccaaatttgccaagcactgcgtgaaatgcaataaggcaattacctctggcggaattacataccaagatcaaccctggcacgccgactgtttcgtctgcgtaacctgttcaaagaaattggctggccaacggttcacggcagttgaggaccagtactactgcgtcgactgctacaagaacttcgtagccaagaagtgcgccggttgcaagaaccccattacagggtttggcaaagggagctcagttgtcgcttatgagggacagtcttggcacgactactgcttccattgcaaaaagtgcagtgtcaacttagcgaacaagagatttgtcttccatcaggagcaggtgtactgtcctgactgcgcaaagaaactgtag

SEQ ID NO: 188221 - DNA, 843 bp, Artificial Sequence
  Description of Artificial Sequence: Synthetic coding sequence
atggccgagaagttcgactgccactactgccgggaccccctgcagggaaagaagtatgtgcagaaagacggccatcattgctgcctcaagtgctttgataagttttgcgccaacacctgcgtggaatgtcgcaaaccgatcggcgctgatagcaaagaggtgcattacaaaaacaggttttggcacgacacctgcttccgctgcgcgaagtgtctgcaccctttggccaatgagactttcgtggctaaagacaataagattctctgcaacaaatgcaccactcgggaagactcccctaagtgtaagggctgcttcaaggccattgtagcaggcgatcaaaacgtggagtataaaggtacagtgtggcataaagattgcttcacatgtagtaactgtaagcaagtcatcggtaccggctcattcttcccaaagggggaagacttttattgtgtgacatgccatgagacgaagttcgccaagcattgcgtgaaatgcaacaaagcgattacctccggcggcataacctaccaagaccagccttggcacgcagattgctttgtgtgtgtaacatgcagcaaaaaattggccgggcaacgtttcactgcggtcgaggaccagtattactgtgtcgattgttacaaaaatttcgtggccaaaaaatgcgcgggctgtaagaacccaatcacgggcttcggcaaaggttcctccgtggttgcttatgaaggacagtcctggcacgactactgctttcattgtaaaaaatgttcagtcaacctggcaaacaagcgatttgtgttccaccaggagcaagtgtactgtccagactgtgcgaagaagctgtag

SEQ ID NO: 188222 - DNA, 972 bp, Artificial Sequence
  Description of Artificial Sequence: Synthetic coding sequence
atggccgagaagttcgactgccactactgccgggaccccctgcaggggaagaaatatgtgcagaaagacggacaccactgttgcctcaaatgttttgataaattttgcgcaaacacatgcgttgaatgcagaaagcctatcggtgccgactcgaaagaagtccactacaagaataggttttggcatgacacttgttttcggtgcgccaagtgtttacacccactggcaaacgagacatttgtggccaaagataataagatcttatgcaataagtgcaccacccgtgaggactccccaaaatgcaagggctgctttaaggcaattgtagccggcgaccagaatgtcgaatacaaagggacagtctggcacaaggattgttttacttgtagtaactgtaaacaggtgatcggaactgggagcttcttccctaagggagaagatttctactgcgttacttgtcacgagacaaagtttgcaaaacactgtgtgaagtgcaacaaagctatcacctcagggggaatcacttaccaagaccaaccatggcatgctgactgcttcgtatgcgtcacgtgtagcaagaagctggccggccagcggtttacagcagtggaggatcagtattattgcgtagattgctacaaaaacttcgtcgccaagaagtgtgcgggatgtaaaaaccccatcacgggcaagcgcacggtgagcagggtgagccatcccgttagcaaagcccggaaacccccagtgtgccatgggaagagactgcccctcaccctgtttcctagtgcaaaccttcgcggcagacacccagggggagagcgcacctgcccatcctgggttgttgtcctttaccgtaagaacaggtctcttgcggctcctcgcgggccaggactagtgaaggcacccgtatggtggcccatgaaggataaccccggcactaccaccgcctccacagcgaaaaatgctccatag

SEQ ID NO: 188223 - DNA, 615 bp, Artificial Sequence
  Description of Artificial Sequence: Synthetic coding sequence
atggccgagaagttcgactgccactactgccgggaccccctgcagggtaagaagtacgtgcagaaggacggacatcactgttgtctgaagtgtttcgacaaattttgcgctaacacctgtgtggaatgccggaagccaatcggcgcagactccaaggaagtccattacaagaatcgattctggcacgatacctgtttccgttgcgcaaaatgtctgcatcccctggccaatgagaccttcgtggctaaagacaataagattttgtgcaataaatgtaccacccgtgaggattccccaaagtgcaagggctgctttaaagcaatcgtggccggcgaccagaacgtcgagtacaagggcactgtttggcacaaggactgctttacatgctctaattgcaagcaggtgatcggcacaggcagttttttccccaaaggcgaggacttctattgcgttacctgtcatgagaccaaattcgccaaacattgtgtaaaatgcaacaaagcaattacatccggcggtatcacataccaggaccagccctggcacgctgattgtttcgtctgtgtgacttgcagcaagaaactagctggccagagattcacagctgtggagtag

SEQ ID NO: 188224 - DNA, 624 bp, Artificial Sequence
  Description of Artificial Sequence: Synthetic coding sequence
atggccgagaagttcgactgccactactgccgggaccccctgcagggcaagaagtacgttcagaaggatggccaccactgctgcctgaaatgtttcgacaaattttgcgccaatacctgcgtcgaatgtcggaagcctatcggcgcagattcaaaagaggtccactacaagaatcggttttggcacgatacctgtttccggtgcgctaagtgcctgcatcccctggcaaacgagactttcgtggctaaagacaacaaaattctgtgcaataagtgtaccacaagagaggattcgcctaagtgtaaaggctgttttaaggctattgtggcaggagaccaaaacgtggagtacaagggtaccgtgtggcacaaagattgtttcacatgtagcaattgtaagcaggtgatcggcacgggatccttctttcctaagggggaagatttctattgtgtgacctgtcacgaaactaagtttgcaaagcattgcgtgaagtgtaataaagcaatcaccagcgggggaattacctaccaagaccagccttggcatgcagattgcttcgtttgtgtcacctgctccaagaagttggccggccaaaggttcaccgctgttgaggaccagtactag

SEQ ID NO: 188225 - DNA, 426 bp, Artificial Sequence
  Description of Artificial Sequence: Synthetic coding sequence
atggccgagaagttcgactgccactactgccgggaccccctgcagggaaagaaatatgtccagaaagacggccatcactgttgcctcaaatgtttcgacaaattctgtgctaacacttgcgtcgaatgcagaaaaccgataggagccgacagtaaggaggtccattacaaaaacaggttctggcatgacacttgttttagatgcgcaaaatgcctccatccgttagcaaatgagacatttgtggctaaggataataagatcctctgtaacaagtgtaccacccgcgaagacagtccaaaatgtaaaggttgctttaaagctatcgttgcaggtgaccagaatgtggagtataaaggaaccgtgtggcacaaagactgctttacgtgttcaaactgtaagcaagttattggcacaggatctttctag

SEQ ID NO: 188226 - DNA, 624 bp, Artificial Sequence
  Description of Artificial Sequence: Synthetic coding sequence
atggccgagaagttcgactgccactactgccgggaccccctgcaggggaagaaatacgtgcaaaaggatggccaccactgctgccttaagtgttttgataaattttgcgcaaacacatgcgtggagtgcagaaaacctattggcgctgatagcaaggaagtgcattacaagaaccgattttggcatgatacttgcttcaggtgcgctaagtgcctgcaccccctcgccaacgaaactttcgtagcaaaagataataaaatcctttgtaataagtgcaccacccgcgaggattctccgaagtgcaaaggctgttttaaagccattgtggccggggatcagaacgtcgagtacaagggaacggtgtggcataaggactgtttcacatgttccaattgcaaacaggtaatcggcactgggtcatttttccccaagggtgaagatttctattgtgtcacatgtcacgagacaaagttcgcaaagcattgtgtcaaatgcaataaggcaattacaagcggtggtataacctatcaggatcaaccctggcacgcagattgttttgtgtgcgtgacctgttcaaagaaactagctggccagcggttcaccgctgtggaggaccagtattag

SEQ ID NO: 188227 - DNA, 963 bp, Artificial Sequence
  Description of Artificial Sequence: Synthetic coding sequence
atgagccacttcatcctgcggcacctgggcagctgcttccagccctatccagcctttgcggaatacatattgtccgctacacacccagcatcgggtcctagttcttacaaggtcggaacaatggccgaaaagttcgactgccattattgtcgggaccctctgcaaggcaaaaagtatgtccagaaggatggccaccactgctgcttgaagtgctttgacaaattttgtgcaaacacgtgtgttgagtgccgtaaacccattggcgctgacagcaaggaagtgcactacaagaaccgattctggcacgatacatgctttaggtgtgctaagtgtttgcatcccctggcaaacgaaacattcgtagcaaaggataacaagattctgtgcaacaagtgcacaactcgagaggattcccctaaatgcaaggggtgcttcaaggccatcgttgcgggtgaccagaacgtggaatacaaggggacggtgtggcacaaggattgcttcacctgctccaattgtaaacaggtgataggtacaggatcattctttccaaaaggagaagatttctactgcgtgacgtgccatgagaccaaatttgctaaacattgcgtgaagtgtaataaggccataacttctgggggaatcacataccaggatcaaccatggcatgcggattgctttgtgtgcgtgacgtgcagtaagaagctggccggccaacggtttacagctgtggaggatcagtattattgcgtggattgctacaagaatttcgtggccaagaaatgtgccgggtgcaagaacccaattaccggatttggaaaaggctccagcgtagtggcgtacgaaggacagtcttggcacgactattgctttcactgcaagaagtgctctgtgaacctcgcgaataaaagattcgtgtttcaccaggaacaggtgtactgtcccgattgcgccaaaaagctatag

SEQ ID NO: 188228 - DNA, 618 bp, Artificial Sequence
  Description of Artificial Sequence: Synthetic coding sequence
atggccgagaagttcgactgccactactgccgggaccccctgcagggaaaaaagtacgttcagaaggatgggcatcactgctgcctgaagtgtttcgacaagttttgtgccaacacctgcgtggaatgcagaaaacctatcggggcagattctaaggaggtgcattacaaaaacagattctggcatgacacatgcttccgttgcgccaagtgtctgcatccattggcgaacgaaacttttgtcgcaaaagacaacaaaattctctgtaacaagtgcactacgagggaggattcaccaaagtgcaagggatgctttaaagctattgtggcgggcgatcaaaacgttgaatacaaaggcacggtttggcacaaagactgttttacatgctcaaactgcaagcaggtgattgggacaggaagttttttcccgaagggtgaggacttctactgtgtgacctgccatgaaacaaagtttgccaaacactgtgttaagtgtaataaggcgattacatccggaggaattacatatcaagaccagccgtggcatgccgattgctttgtgtgcgtcacgtgcagtaagaaactcgccggccagagattcacagctgtggaagattag

SEQ ID NO: 188229 - DNA, 468 bp, Artificial Sequence
  Description of Artificial Sequence: Synthetic coding sequence
atggccgagaagttcgactgccactactgccgggaccccctgcagggaaaaaagtacgtgcaaaaggacgggcaccactgttgtctcaaatgtttcgacaaattttgtgctaatacttgtgtggagtgccggaaaccaattggggcagattctaaagaggtgcactacaaaaaccggttctggcacgatacttgtttccgctgtgctaaatgcctgcaccctctcgccaatgaaactttcgttgccaaagataacaagatcctctgtaacaaatgtacaacccgggaagattccccaaagtgcaaggggtgtttcaaagctattgtcgccggagaccagaatgtcgaatataaaggcactgtctggcataaagattgtttcacatgcagcaattgcaaacaagtgatcgggacgggctcattcttccccaaaggtgaggacttttactgcgtcacctgccacgagtag

SEQ ID NO: 188230 - DNA, 843 bp, Artificial Sequence
  Description of Artificial Sequence: Synthetic coding sequence
atggccgagaagttcgactgccactactgccgggaccccctgcagggcaaaaagtacgtccagaaggatggtcaccactgttgtcttaagtgctttgacaaattctgtgccaatacctgcgtcgagtgcaggaaacccatcggagccgacagtaaggaggttcactataaaaacaggttctggcacgacacatgtttcaggtgcgccaagtgtctgcacccccttgctaacgaaactttcgtggcaaaggataacaagattttgtgcaacaagtgtaccactcgcgaagactctcctaaatgcaagggctgtttcaaggctatcgtggcaggggatcagaacgtggagtataagggaaccgtgtggcacaaagactgtttcacctgttcaaactgcaagcaagtcattgggactggctcttttttccctaagggcgaagatttttattgtgtcacctgccacgaaacaaagttcgcaaagcactgtgttaagtgtaacaaggccatcaccagtggtggcatcacctaccaggaccagccttggcatgctgattgcttcgtctgtgtgacatgctccaagaaactggctggacagagatttacagccgtggaggaccaatattactgtgtggactgctataagaattttgtcgccaaaaagtgcgccgggtgcaaaaatcccatcactgggtttggcaagggaagctcagtcgtggcctacgaggggcaaagctggcatgactattgcttccattgcaagaaatgttcagtgaatctggccaacaagagatttgtgtttcatcaggagcaggtttattgtcctgattgcgctaagaagctctag

SEQ ID NO: 188231 - DNA, 783 bp, Artificial Sequence
  Description of Artificial Sequence: Synthetic coding sequence
atggccgagaagttcgactgctgcctgaagtgcttcgacaagttctgcgcaaacacctgcgtcgaatgtcggaagcctataggcgctgattctaaagaagtacactacaagaaccgcttctggcatgacacttgcttccggtgtgctaaatgtctacaccccctggctaatgagacattcgttgcaaaagataacaaaatactgtgcaacaagtgcaccacaagggaagactcaccaaaatgcaagggctgtttcaaggccattgtagcaggggatcagaacgttgagtataaaggcacggtgtggcacaaagactgctttacctgtagcaactgcaaacaggttatcgggactgggtcattcttcccgaagggtgaggatttctattgcgtcacgtgtcatgaaaccaaatttgcaaagcactgcgtcaaatgtaataaagctattacttctggaggaataacctaccaagatcagccctggcacgccgactgtttcgtctgcgtgacatgctccaagaagctggctggacagcgcttcacagctgtagaagaccagtattattgcgtggactgttataagaactttgtggctaaaaaatgcgccggctgcaagaatcctatcaccggcttcggcaagggcagttcagtggtcgcatacgaaggccaatcctggcacgattactgcttccattgtaagaagtgcagcgtcaatctcgctaacaagagatttgttttccaccaggagcaggtgtactgccctgactgtgccaaaaagctgtag

SEQ ID NO: 188232 - DNA, 930 bp, Artificial Sequence
  Description of Artificial Sequence: Synthetic coding sequence
atgaccttctacgtggccagcctggccctggagctgatctggatgctgtcctcccctgccggtccaagttcctacaaggtgggaacaatggccgagaaatttgactgtcactattgcagggacccattgcagggtaagaagtacgtacaaaaggacggacaccactgctgcctaaaatgctttgacaaattctgcgcaaatacctgtgttgaatgccgcaagccaattggcgctgattccaaggaggtgcattacaaaaataggttttggcatgatacttgcttcaggtgtgctaaatgcctgcatcctctggcaaacgagacctttgtggccaaagataacaaaatcttgtgtaacaagtgtacaactcgggaggattctcctaaatgcaaggggtgttttaaagctatcgttgcaggagaccagaacgttgaatacaagggaacagtttggcacaaggattgctttacatgctctaattgtaaacaggtgatcggaacgggatccttcttcccaaaaggagaggacttttactgcgtgacatgtcacgagaccaaattcgccaagcactgtgtcaagtgtaacaaggccatcacctccggaggaatcacataccaggatcagccttggcatgcagactgttttgtctgcgtaacttgtagtaagaaactggccggtcagagatttacagcagtggaagaccaatactactgcgtggattgttacaagaattttgtggccaagaagtgtgccggctgcaaaaatccaatcacagggttcggaaaggggagctctgtcgtggcttacgagggacagtcgtggcatgattattgcttccactgtaagaagtgttccgtgaacctggcaaataagcgattcgtctttcatcaggaacaggtgtactgtccagattgcgccaaaaaactctag

SEQ ID NO: 188233 - DNA, 828 bp, Artificial Sequence
  Description of Artificial Sequence: Synthetic coding sequence
atggccagccaccggcacagcggccccagcagctacaaggtgggcacaatggctgaaaagttcgactgtcattattgccgcgatccgttgcaaggcaagaagtacgttcagaaagatggacatcactgttgcctgaaatgcttcgacaagttttgtgctaacacatgcgttgaatgtagaaagcccatcggcgcggattcgaaagaggtgcactacaagaatagattctggcacgacacctgctttagatgcgccaaatgcacaacgcgcgaagatagtcctaaatgtaaaggctgtttcaaagcaatcgtcgctggagaccagaacgttgagtataagggaaccgtgtggcacaaagactgcttcacatgttccaactgtaagcaagtgattggcaccggatctttctttcccaagggcgaggacttctattgcgtcacctgccatgagactaaattcgctaaacactgtgtgaagtgtaacaaggcgatcaccagtggcgggataacttatcaagaccagccctggcacgcagattgcttcgtttgtgtaacgtgctccaagaaactcgcaggtcaacgctttacagctgttgaagatcagtactattgcgtcgactgctacaagaattttgtcgcaaaaaagtgcgcagggtgcaagaacccgattaccggattcggaaaaggctctagcgtcgtggcttacgaagggcagtcatggcacgactactgcttccactgtaaaaaatgctccgtaaacctagctaacaagaggtttgtgtttcatcaggagcaagtatactgtccggactgcgctaaaaagctatag

SEQ ID NO: 188234 - DNA, 843 bp, Artificial Sequence
  Description of Artificial Sequence: Synthetic coding sequence
atggccgagaagttcgactgccactactgccgggaccccctgcagggcaagaaatatgtccagaaagacgggcaccattgctgtctgaagtgttttgataaattttgcgcgaacacatgcgttgagtgcaggaaaccaatcggcgcagactctaaggaggtccactataaaaatagattttggcatgacacttgcttcaggtgtgcaaagtgtcttcatcctctggcgaatgaaacattcgtagccaaggacaataaaatcttatgcaacaaatgcaccacccgagaggatagtccaaaatgtaagggctgcttcaaggctatagtggccggcgatcagaatgtcgaatacaaggggaccgtatggcacaaagactgctttacctgtagcaattgtaaacaggtgatcggcactggaagctttttccccaagggagaagacttctattgcgttacttgccatgagactaaattcgcgaagcactgcgtgaaatgtaacaaggctattacttccggaggtattacttatcaggatcagccatggcacgccgattgcttcgtgtgtgtgacctgttctaagaaacttgcggggcagcggtttacagcagtggaggaccaatactattgcgtcgactgctataaaaattttgtggcgaagaaatgtgccggttgtaaaaatcccattacgggattcggaaagggctcttctgttgtcgcttatgagggccaaagctggcatgattactgtttccactgtaaaaagtgtagcgtgaacctggctaataaaagatttgtttttcatcaagagcaggtgtattgtccagattgtgcgaagaaattatag

SEQ ID NO: 188235 - DNA, 840 bp, Artificial Sequence
  Description of Artificial Sequence: Synthetic coding sequence
atgaccgagcggttcgactgccaccactgcaacgagagcctgttcggaaaaaagtacattttgagggaggaaagtccctattgcgtggtgtgctttgagactcttttcgccaacacctgtgaggaatgtggcaaaccaattgggtgcgattgcaaagatttgagctacaaagacaggcactggcacgaggcctgtttccattgctctcagtgtaggaacagtcttgtcgataaacctttcgctgctaaagaagatcagctattatgtacagattgttacagcaacgaatatagcagcaaatgccaggaatgcaagaagacaatcatgcccgggacacggaaaatggagtataaaggttcttcctggcatgagacatgctttatttgtcatcgctgccagcagccgattggaaccaagtctttcataccgaaggataaccagaacttttgcgtgccctgttatgagaaacagcacgctatgcagtgcgttcagtgcaagaagcccattaccactgggggcgtgacctatcgggaacagccatggcacaaagagtgctttgtgtgtacagcttgcagaaaacagctctccggccagcgatttaccgccagggatgattttgcctactgcctcaactgtttttgcgacctgtacgccaaaaagtgtgccggctgtactaacccaatctcaggtctcgggggcacaaagtacatatcatttgaagaaaggcagtggcacaacgactgctttaattgcaaaaagtgtagcttatctttggtcggccggggattccttacagaaagggacgacatcctatgtccagattgcgggaaggacatttag

SEQ ID NO: 188236 - DNA, 456 bp, Artificial Sequence
  Description of Artificial Sequence: Synthetic coding sequence
atgaccgagcggttcgactgccaccactgcaacgagagcctgttcggcaagaaatacatcctccgcgaggagtccccttattgcgttgtgtgcttcgagacattgttcgcaaacacgtgtgaggaatgcggcaagcctatcggttgtgactgcaaggtgcctgcccgctggtccactagagcagccgcggggatgaggccagcaagtagcgccaccgcagcttcttctcaactggagccgcgagtgagcagccctaagactattcggatcagtgtgtgcccagctatgcggaataacatgccttgttccgccttttctgcgaaatcaccctctcccagagagggaagcctgaccggctccagccctggaacgcgctcagccagctgcgccccacccgcagggtccagctgtctgggatcagctagccaattggccatgacactcccaacagcctag

SEQ ID NO: 188237 - DNA, 1170 bp, Artificial Sequence
  Description of Artificial Sequence: Synthetic coding sequence
atgacccggcggggcttcagccgggccggcgccgcccagcggagcaccagacctgccgccgaacctcagcctccggcggctcgcgccctccagccaagaccaggcgtccccggacccctgcgttgtcgggagtaccttcagccgcccgcaccccgccgagaagcagagggcctatcccaccagggctccgaagttggcgcggagtcaggcgctagaccaaaggagcgcggggccgagccagagctcggtcggctgtggctgcgcacggtaagcagttggcgcttggggtggcattttgatttcggcgtcgccgagaaacccggagtcaaaatgaccgagcgcttcgactgccatcactgcaacgaaagcctcttcgggaagaaatatatactgcgggaggaatccccttactgcgtggtatgtttcgaaacattgtttgctaacacatgtgaggaatgcgggaagcccatcggctgcgattgtaaagatctttcttacaaagaccgccactggcacgaagcatgtttccattgctcacagtgccgtaactccctggtcgacaagcccttcgcagccaaggaagaccagctgctatgcacggactgctactctaacgagtattcaagtaagtgtcaggagtgcaagaagacaatcatgcccggcacccgcaaaatggagtataagggatcttcatggcacgagacatgttttatatgccaccgctgtcagcagccgatagggactaaaagtttcatcccgaaggacaaccagaatttctgtgtaccctgctacgaaaagcagcacgccatgcagtgtgtccagtgcaagaaaccgatcacaacagggggcgtcacttaccgggagcaaccatggcataaagagtgtttcgtgtgtaccgcatgcagaaaacagttaagtggccagagattcaccgcaagagatgattttgcttactgcctgaactgtttctgcgacttatacgccaagaaatgcgcggggtgcaccaatcctatttcaggactgggcggcacaaaatatatcagctttgaggaaagacagtggcacaatgactgcttcaattgtaaaaagtgctcactctctctggtgggccgcggctttctgacggagagggacgacattttgtgtccagactgtggaaaggacatttag

SEQ ID NO: 188238 - DNA, 840 bp, Artificial Sequence
  Description of Artificial Sequence: Synthetic coding sequence
atgaccgagcggttcgactgccaccactgcaacgagagcctgttcggtaagaaatacatcttgcgggaagaatcgccttattgcgtcgtatgtttcgaaactctatttgcgaatacctgcgaagagtgcgggaagccaatcggttgcgactgcaaggatttgtcctataaagaccgacactggcacgaggcctgctttcattgtagtcaatgccgtaactcgttggtcgataaaccctttgcagccaaggaggatcaattgctgtgcacggattgttacagtaacgaatacagcagcaagtgccaggaatgtaagaagaccataatgccagggacccgaaagatggagtacaaagggtctagctggcatgaaacatgctttatctgtcacagatgtcagcaacctataggcaccaagtccttcatccccaaggataaccagaacttttgtgtgccttgttacgagaagcagcacgcgatgcaatgcgtgcagtgcaagaagcctatcaccacaggcggggtcacttacagagagcagccgtggcataaagagtgctttgtgtgtactgcttgtaggaagcaactgagtggacagcgttttaccgcccgtgatgattttgcatattgtctcaactgcttttgtgacctgtacgccaaaaagtgcgccggatgcaccaaccctatcagcggtctagggggcaccaaatatatcagttttgaggagaggcagtggcacaatgattgctttaattgcaagaagtgtagtctgagcctggtgggcagaggattcctcactgaaagggacgacatcttatgtccggactgcgggaaggacatttag

SEQ ID NO: 188239 - DNA, 840 bp, Artificial Sequence
  Description of Artificial Sequence: Synthetic coding sequence
atgaccgagcggttcgactgccaccactgcaacgagagcctgttcggtaagaagtatatcctacgggaagaatctccatactgtgtggtttgctttgaaacactgttcgctaatacgtgtgaggaatgcggaaaaccaatcggctgcgattgtaaggacttgtcctataaagatcgccactggcatgaagcgtgtttccattgctcccagtgtcggaactccttagtcgacaagccattcgccgccaaagaggaccaacttctctgcaccgattgctattccaatgaatattcgagcaaatgtcaagaatgcaaaaagaccattatgccaggcactcgcaaaatggagtataagggttcatcatggcacgagacttgctttatctgccatcgatgccagcagcccatcggcacgaaatcctttatcccaaaggataaccagaacttttgcgtcccgtgttatgaaaagcagcacgccatgcagtgcgtgcaatgcaagaagcctattactacaggcggagtgacataccgggagcagccttggcataaggagtgttttgtgtgtactgcctgccgcaaacaactgtcaggacaaagatttacggcaagggatgatttcgcatactgccttaattgtttctgtgacctgtacgccaagaaatgtgcaggctgcactaatcctatctctggccttggaggaaccaagtatatcagcttcgaagagcggcagtggcataacgattgttttaactgcaaaaagtgttcgctttctctagtgggccgcggcttcttgactgagcgcgacgatattctctgtccagattgtggcaaagatatatag

SEQ ID NO: 188240 - DNA, 840 bp, Artificial Sequence
  Description of Artificial Sequence: Synthetic coding sequence
atgaccgagcggttcgactgccaccactgcaacgagagcctgttcgggaagaagtatattttgcgcgaggaatcaccctattgcgttgtgtgcttcgaaaccctgttcgctaacacctgtgaggagtgcggaaaaccgattggctgcgactgcaaagatttaagctataaagacagacattggcatgaagcatgtttccattgttcccagtgccggaattccctcgtcgataagccatttgcggctaaggaagatcaactgctgtgcacagactgttattcaaacgaatattcatccaagtgtcaagagtgtaagaagacgattatgcctggaacccggaaaatggaatacaagggctcttcatggcacgagacatgttttatctgccaccggtgtcaacagcccataggaacaaagtcctttatccctaaagataatcaaaatttttgcgtgccttgctacgagaagcaacacgcgatgcagtgtgtgcagtgcaaaaagccgatcacaacggggggcgtgacctaccgcgaacagccctggcacaaagagtgctttgtctgcactgcatgccgaaagcagctgagcggacagcgctttacagcccgtgatgattttgcatactgtctgaactgtttttgcgacctgtatgctaagaagtgcgcaggttgtacgaatcctattagcggtctgggtgggactaaatatatctctttcgaggagagacagtggcacaacgactgtttcaattgcaagaagtgctccctatcactggtgggccgcgggttcctcacagagagagacgacatactctgccctgattgcggcaaggacatttag

SEQ ID NO: 188241 - DNA, 840 bp, Artificial Sequence
  Description of Artificial Sequence: Synthetic coding sequence
atgaccgagcggttcgactgccaccactgcaacgagagcctgttcggtaaaaagtacattctgagagaggaaagcccatattgtgtggtctgctttgagacactgttcgccaatacttgcgaagagtgcggaaagcccatagggtgcgattgcaaagacctcagctataaagatcgacattggcacgaggcatgtttccattgtagccaatgtcggaactcccttgtggataagccatttgcagctaaagaggatcagctgttgtgtacagactgttacagcaacgaatactcaagcaaatgccaggagtgtaagaagaccattatgccaggcaccagaaagatggaatataagggatcatcatggcacgagacttgtttcatctgtcatcggtgtcaacagcccattggcaccaagtcttttatacctaaagataatcagaacttctgtgtgccgtgctacgaaaaacagcacgcaatgcagtgtgtacagtgcaagaagccaattaccacaggaggcgtgacatatcgggaacagccttggcacaaagagtgcttcgtttgtacagcttgccgcaaacagctgtctgggcaacgatttacagccagggacgatttcgcctattgcctcaactgcttctgtgacctctatgctaaaaaatgcgccggctgtactaatccaattagtggtttgggtggcacaaagtatatctcttttgaggagaggcaatggcacaatgattgcttcaactgcaaaaagtgcagcctgtccttagtgggaagagggttccttaccgaacgcgatgacatcctctgtccagattgcggaaaggatatctag

SEQ ID NO: 188242 - DNA, 840 bp, Artificial Sequence
  Description of Artificial Sequence: Synthetic coding sequence
atgaccgagcggttcgactgccaccactgcaacgagagcctgttcggcaaaaaatatatcctgagggaagagtctccctattgcgtcgtctgcttcgaaacactgttcgcaaacacctgcgaagaatgtgggaagccaatagggtgcgactgcaaagatctcagttacaaggaccgtcattggcatgaagcatgctttcattgttctcagtgcaggaactcactagttgacaagccgtttgccgcaaaagaagaccaattgctttgcaccgactgttactcaaacgagtactcaagtaaatgccaggaatgtaagaagacaataatgcccggtacccggaaaatggaatacaagggcagcagttggcacgagacctgctttatttgccatagatgccagcagcccattggaacaaaatctttcatccccaaagataatcagaacttttgcgtcccttgttacgaaaagcagcacgctatgcagtgtgtgcagtgcaaaaagcctatcacaacagggggcgtgacttaccgagagcaaccctggcataaggagtgctttgtgtgtactgcctgtcggaaacaactttctggccagcgttttactgcaagagacgactttgcatattgtctcaattgtttttgtgacctctacgctaagaaatgtgcagggtgtaccaatcctatttcggggcttggtggtacgaagtacattagtttcgaggagaggcagtggcacaacgactgtttcaattgtaagaagtgcagcctgagccttgtggggcgcggctttctgactgagcgcgatgatatactgtgtccggactgcggaaaggacatctag

SEQ ID NO: 188243 - DNA, 840 bp, Artificial Sequence
  Description of Artificial Sequence: Synthetic coding sequence
atgaccgagcggttcgactgccaccactgcaacgagagcctgttcgggaagaaatacatcctgcgggaggagtccccatattgtgtggtgtgtttcgaaacactgtttgcgaatacatgtgaggaatgtggaaagccgatcggttgtgactgtaaggacttgtcatataaagatcggcactggcatgaggcctgcttccactgtagccagtgccggaatagccttgtggacaaacccttcgccgcaaaagaggaccagctgttgtgtacagactgttatagcaatgagtactcaagcaagtgccaagagtgtaaaaagacaatcatgccagggacccgcaaaatggagtacaagggctccagctggcacgaaacttgttttatctgtcaccgatgccagcagcccatcggcactaagtctttcatccccaaggataaccagaacttctgcgtcccatgctacgagaagcagcacgcgatgcagtgcgtccaatgtaaaaagccaattacgacaggcggagtgacctaccgcgagcaaccttggcataaagagtgctttgtgtgtacagcatgcaggaaacagctgagtggacagcggttcactgccagggatgatttcgcttactgtttgaactgtttttgtgacctctatgctaaaaagtgcgccggctgtacaaaccccataagcggtttgggaggtacaaagtacatctcatttgaggagcgacagtggcacaatgactgttttaactgtaaaaagtgttcactgtctctggtgggaaggggttttcttaccgagcgggacgacattctctgtccagactgcgggaaagacatttag

SEQ ID NO: 188244 - DNA, 60 bp, Artificial Sequence
  Description of Artificial Sequence: Synthetic coding sequence
atgaccgagcggttcgactgccaccactgcaacgagagcctgttcgggaagaaatactag

SEQ ID NO: 188245 - DNA, 435 bp, Artificial Sequence
  Description of Artificial Sequence: Synthetic coding sequence
atgacccggcggggcttcagccgggccggcgccgcccagcggagcacgcgtcccgccgcggaaccacagcctccagccgcgcgtgctctacagccaagaccaggcgttcccggcccactgcgctgccgagagtacttgcaacctcctgcgccccgccgcgaagctgagggactgtcacatcagggaagtgaagtgggcgcagaaagtggagctaggccaaaagagaggggagcagagcccgagctgggcaggctgtggcttagaaccgtttcgtcatggcgactgggctggcacttcgattttggtacggaatcacgtttcgtcgctcaggccggcgtgcagtggcacgatctctcgtcacttcaggccctacccttagggtctaggcactctcctgcccccgcgagtcaggtcgctggaaccaccggatgttag

SEQ ID NO: 188246 - DNA, 843 bp, Artificial Sequence
  Description of Artificial Sequence: Synthetic coding sequence
atgagcgagagcttcgactgcgccaagtgcaacgagagcctgtacggacgaaaatatatccaaactgactccggaccctactgtgtgccgtgctacgataacacctttgcaaatacatgtgctgaatgccagcagctgatcggccatgactcacgcgaactgttctacgaggacagacatttccacgaaggctgttttagatgctgcaggtgccagaggtcattagcagacgagcccttcacatgccaggattctgagctcctatgcaacgattgttactgtagcgcttttagcagccagtgctccgcatgcggcgagacggtcatgcccgggagtaggaagctcgaatacggtggtcaaacatggcatgaacattgcttcttgtgctctggttgcgagcagcccttaggcagtaggagctttgtaccggataaaggcgctcactactgtgtgccatgttacgaaaataaattcgcgccaaggtgtgccagatgtagcaagacactgacccaagggggagtgacatatcgtgaccagccatggcacagagagtgcctggtatgtaccggatgccagacgcccttagcgggccagcagtttacctctcgcgacgaggacccttactgtgtggcatgcttcggagagctgtttgcacctaaatgcagctcttgcaagagacccatcgtgggacttggaggcggaaagtatgtctctttcgaggaccgccattggcatcataactgcttttcttgcgcgaggtgtagtacctctctggttgggcaaggtttcgttccggacggtgatcaggtattgtgccaaggatgttcgcaggccggaccatag

SEQ ID NO: 188247 - DNA, 855 bp, Artificial Sequence
  Description of Artificial Sequence: Synthetic coding sequence
atgaccaccgcccacttctactgccagtactgcaccgccagcctgctgggtaagaagtacgttctgaaggatgactccccatactgtgtgacctgctacgatagggtgttttctaactattgtgaagaatgcaagaagccaattgaatctgactctaaagacttgtgttacaaagacagacactggcatgagggttgttttaaatgtacaaagtgcaaccatagtcttgtagagaagcctttcgcggcgaaagatgaaagattgctgtgcactgaatgctacagcaatgaatgctcctccaaatgttttcattgcaaaagaacaatcatgccaggcagccggaaaatggaattcaagggcaattattggcatgaaacatgttttgtgtgtgaaaattgccgacagcccataggtactaaaccgctgatttccaaagaatccggaaactactgtgtcccttgctttgaaaaagagttcgcccattattgcaatttctgtaaaaaagtgattaccagcggcggtataacgttttgcgaccaactgtggcataaagagtgttttttatgtagcggctgcaggaaggatctgtgtgaagaacagtttatgagccgcgacgattatccattctgcgtggactgttataaccacctgtatgcaaataaatgtgttgcctgcagcaagcctatctccgggcttacaggcgccaaattcatttgttttcaggattcccagtggcacagcgagtgttttaattgtgggaagtgttctgtgtctcttgtggggaaaggatttctgactcaaaacaaggaaattttttgccagaaatgcggtagcgggatggataccgatatttag

SEQ ID NO: 188248 - DNA, 633 bp, Artificial Sequence
  Description of Artificial Sequence: Synthetic coding sequence
atgaccaccgcccacttctactgccagtactgcaccgccagcctgctcggaaagaagtacgtattgaaggatgacagtccatactgtgtgacgtgctacgacagagtattttctaattattgcgaagaatgtaaaaaacccattgaaagcgactctaaagacctgtgctataaggacagacattggcacgaggggtgtttcaaatgcactaaatgcaaccattccctcgttgagaagcccttcgcagccaaagacgagaggctgctgtgcacagagtgttattctaatgagtgctcatcgaagtgtttccattgtaagcgcacaatcatgcccggttcgagaaagatggaatttaaaggcaattattggcacgagacttgttttgtctgcgaaaactgccggcagccaatcggcacaaagcccttaattagtaaagagtcagggaattattgtgtgccatgtttcgagaaggagtttgctcattactgtaacttctgtaagaaagtgataactagtggcggcatcacattctgcgaccagctttggcacaaagagtgttttctgtgcagtgggtgtagaaaggatctctgcgaggagcaattcatgtctcgagatgattaccccttttgttag

SEQ ID NO: 188249 - DNA, 855 bp, Artificial Sequence
  Description of Artificial Sequence: Synthetic coding sequence
atgaccaccgcccacttctactgccagtactgcaccgccagcctgttagggaagaaatacgttttaaaggacgattctccatactgtgtgacttgctatgaccgggtattctccaactactgtgaggagtgcaagaagccgatagaatcagattccaaagatctgtgctataaggatcgccactggcacgaaggctgttttaaatgtacgaaatgcaatcattctctggtagagaaaccttttgccgccaaggacgaacgcctgctctgtacagaatgctacagcaatgagtgtagcagtaaatgtttccactgcaagcggacaatcatgcccggcagtcgcaagatggaatttaagggaaattactggcacgagacctgctttgtttgtgagaattgccgacagccaattggtacaaagcccttaatctctaaggagtcagggaattactgcgtcccatgcttcgagaaggagttcgcccattactgcaatttctgtaagaaagtaataacaagtggcggtattactttttgcgaccagctgtggcacaaggagtgttttctgtgctccgggtgccgaaaagatttgtgcgaggagcagttcatgtcccgggatgattatcctttctgcgttgattgctacaatcacctttatgcgaacaaatgcgttgcatgcagcaagcctatttctggattaaccggagctaagttcatttgttttcaggacagccagtggcactctgaatgtttcaattgcggaaaatgtagcgtctccttggtcggcaaaggttttttgacacagaacaaggaaatcttttgtcagaaatgcggctccgggatggacacagatatatag

SEQ ID NO: 188250 - DNA, 1314 bp, Artificial Sequence
  Description of Artificial Sequence: Synthetic coding sequence
atgggccggcggatgcggggcgccgccgccaccgccggcctgtggctgctcgcactggggagtctgttagctctgtggggtggcctgctgcccccgaggaccgagctaccggcatctcggccaccagaggacagactgcctagacgaccagcccggtccggtggacccgcacccgcacccaggtttcctttacctcctccactggcctgggacgctagggggggatctctgaaaacctttagggcactcctaacactggccgccggggcagacggaccccccagacagagtcgctcagaacccagatggcacgtcagcgcccggcagccacgcccagaagagtccgccgctgtacatggcggagtgttctggtcacggggccttgaagagcaagttcctcctggattctcagaggcccaggcagccgcgtggttagaagctgcaaggggggctcggatggtggccctcgagcgagggggatgtggacgctcctcaaatcgcctggcacgcttcgcagatggtactcgcgcttgtgtgcgatacggtattaaccctgagcagattcagggcgaagctttatcttactacctggcacgtctcctgggcctccagcgacacgttcccccattagccttggcacgtgtagaagcaaggggtgcccaatgggctcaggtgcaggaagagctgagagcagcgcactggacagagggatccgttgtgagccttacaagatggttacccaacttgacagatgttgtggtgcccgcaccctggcgcagcgaagatggcagactgcgccccctcagggacgcaggaggagagcttgcgaatttaagccaagctgaactcgtggacctcgtacaatggacggatctgattctctttgactatctgacagctaactttgaccggttggtctcgaatctgttctctcttcagtgggatcccagggtcatgcagagagccactagcaatctgcacagaggtcctggaggggcactggtttttttggataatgaagccggacttgttcatggctacagggtggccgggatgtgggataaatataacgaacctctcttgcaatccgtatgtgtgtttcgcgagcgcacagcgcgcagagtcttagagttgcacaggggccaagatgccgcagcccggctccttcggctgtacagacggcatgagccccgctttcctgaattggctgcgctggccgaccctcacgcacagctgctccagcgaaggctggatttccttgcaaaacatatactgcattgcaaggcaaaatacggtcggcgttcaggaacctag

SEQ ID NO: 188251 - DNA, 312 bp, Artificial Sequence
  Description of Artificial Sequence: Synthetic coding sequence
atggagcggcagcagcagcagcagcagcagctgcggaacctgcgggacttcctgctcgtatataatagaatgaccgagctttgctttcagaggtgtgtcccatccctacatcaccgcgctctggacgccgaagaggaggcctgtcttcacagctgcgcgggtaagctgatacattctaatcatagactgatggctgcctatgtgcaattgatgcctgccctggttcagcggaggatagccgactacgaagccgccagcgcagtccctggcgtggctgccgagcagccaggcgtgagccccagtggcagttag

SEQ ID NO: 188252 - DNA, 312 bp, Artificial Sequence
  Description of Artificial Sequence: Synthetic coding sequence
atggagcggcagcagcagcagcagcagcagctgcggaacctgcgggacttcttgctggtgtataacagaatgacagagctgtgttttcaaaggtgtgtgcctagcctgcaccaccgcgccttggacgccgaagaggaagcctgtctccacagttgcgcaggtaaactgatccactccaaccaccgcctcatggctgcatacgttcaacttatgcctgcactggtgcagcgcagaatcgccgattacgaagcagcatccgcggtgcctggagtagccgccgagcagccaggggtgtcaccttctggtagttag

SEQ ID NO: 188253 - DNA, 312 bp, Artificial Sequence
  Description of Artificial Sequence: Synthetic coding sequence
atggagcggcagcagcagcagcagcagcagctgcggaacctgcgggatttcctcctggtctataataggatgactgagctttgtttccagcggtgtgtgccctcgcttcatcaccgcgcattagatgctgaggaagaagcttgcctgcactcgtgtgccggcaagctgattcattcaaatcaccgactcatggccgcttacgttcagttgatgccagcactggtgcaacggcgcattgccgactacgaagctgccagcgccgtgcctggtgtggccgcagagcagcccggggtatccccctccggctcgtag

SEQ ID NO: 188254 - DNA, 948 bp, Artificial Sequence
  Description of Artificial Sequence: Synthetic coding sequence
atgcacggccacggcggctacgacagcgacttcagcgacgacgagcgctgcggagagagctcaaaaagaaagaaaaggacagtcgaggacgacctgctgctgcagaaaccatttcagaaggagaagcacggtaaggtggcccataagcaagtagcagccgaacttttggatcgtgaggaagcgcggaaccgcaggtttcaccttattgcgatggatgcataccagcgtcacacaaaattcgtgaacgactatattctttattatggtggcaagaaggaggactttaaacgcctgggggaaaacgataaaaccgacctggacgtcatcagagaaaatcaccgtttcttgtggaatgaagaggacgagatggacatgacctgggagaagcgtctggccaagaagtactacgataagttatttaaagaatattgcatcgccgacttatctaagtacaaggaaaacaagtttggctttagatggagagttgagaaggaggttatctccggcaagggccaattcttctgtgggaataaatactgcgataaaaaggaggggctaaaatcatgggaagtgaacttcggatacatagagcacggcgaaaagcgtaacgcactggtcaagctcagactatgtcaggaatgcagcatcaagttgaactttcaccaccgtcggaaggagatcaaatctaaaaagcgcaaggacaagaccaagaaagactgcgaggagtcttcacacaagaagagtagactgtcatccgctgaggaggcctctaaaaagaaagataaggggcatagcagctcaaaaaaatcagaagattcactgctgcggaactctgatgaagaagaaagcgcttcggaatccgagctgtggaaagggcccttacctgaaacagatgaaaaatcacaggaggaggagtttgatgagtatttccaagacctgttcttgtag

SEQ ID NO: 188255 - DNA, 948 bp, Artificial Sequence
  Description of Artificial Sequence: Synthetic coding sequence
atgcacggccacggcggctacgacagcgacttcagcgacgacgagcgctgtggagaatctagcaaacgcaagaaacgcaccgtggaggacgacctcttactgcaaaaaccctttcagaaagagaagcatggaaaggttgcccataagcaggttgccgccgagctcctcgaccgtgaagaagctagaaaccgcaggtttcatttgatcgctatggatgcatatcaacgccatacaaagttcgttaacgactatatcctttattatggaggcaagaaggaggattttaaaagactgggggaaaacgataaaacagatctcgatgtgatccgtgagaatcataggttcctgtggaacgaggaagacgagatggatatgacctgggaaaagcgcttggctaaaaaatattatgataaattgtttaaggaatactgcatcgcagatctctctaaatataaagaaaacaaatttggattccggtggcgcgtcgaaaaagaggtcatctcaggcaaaggacaattcttttgtggcaataagtactgtgacaagaaggaaggactgaagtcctgggaggtcaactttggatacatcgaacacggggagaaaagaaatgccctcgtgaaactgcgcctgtgtcaggaatgctctattaaactcaactttcaccacagaaggaaggagattaagagcaaaaagcgtaaagacaaaactaagaaagattgcgaagaaagctcccacaagaagagcagactcagttccgcagaagaagccagtaagaagaaggacaagggacacagctcctcaaagaagtctgaggactctctcttacgacggatgctggaggaactgcagatgttcacctgggaaaaatctgaacgaatggggggcaaaaggctgattatcatcataggagaggagctgagtgctaatgtgaccacttttaagatgtag

SEQ ID NO: 188256 - DNA, 942 bp, Artificial Sequence
  Description of Artificial Sequence: Synthetic coding sequence
atgcacggccacggcggctacgacagcgacttcagcgacgacgagaggtgtggcgagtcttcaaagcgtaaaaagaggaccgtcgaggacgacctcctgttgcagaagcctttccaaaaggagaaacacgggaaagtcgcccataagcaggtcgcagccgaacttctggaccgggaggaagctagaaatcggcgatttcatctgatagctatggatgcgtatcagagacatacaaagtttgtcaatgactatatactgtactatggaggaaaaaaggaggactttaagaggctgggcgagaacgacaagacagacttggatgttatcagggaaaaccaccgcttcctgtggaacgaagaggacgaaatggatatgacttgggagaagaggctcgccaaaaagtattacgataagttgttcaaggaatattgtattgcagatctatctaagtacaaggagaacaagtttggatttcggtggcgagtggagaaggaagttatttccgggaaggggcagtttttctgtggcaataaatactgcgataagaaagaagggctgaaatcctgggaagttaatttcgggtatatcgagcacggagaaaagcgcaatgcactcgtgaagctaagactgtgccaggaatgttcaatcaagctcaactttcaccacagaagaaaagaaatcaaatcaaaaaagcggaaggacaagaccaaaaaagactgtgaagagagttcgcacaaaaagtcacggctgagcagcgccgaagaggcgagcaagaagaaggacaaaggacattctagtagcaagaaatccgaagattccctgttgaacggtgttatgctcttccatcccggttggagcgctgtggcccggtctcaactgacagcagccccggctagccaggtgcaaacaaacaaccactactggagaggggtcgtctgctag

SEQ ID NO: 188257 - DNA, 879 bp, Artificial Sequence
  Description of Artificial Sequence: Synthetic coding sequence
atgcacggccacggcggctacgacagcgacttcagcgacgacgagaggtgcggtgagagctctaagcggaagaaaagaaccgtggaggacgatttgctgctgcagaagccgtttcagaaagagaaacatgggaaagtggcccacaagcaagtggccgcggagctgttggatagagaggaggcaagaaaccgccgatttcatttaattgccatggatgcctaccagagacacaccaaattcgtaaacgactacattttgtactacgggggcaagaaggaagattttaagcgcctaggagagaacgacaaaacagacttggacgtcatacgcgagaatcacagatttttgtggaatgaggaagatgagatggatatgacttgggagaagcgcctcgctaagaagtactacgacaagctctttaaagagtattgcatcgctgacctgtctaaatacaaggagaataaattcggattccgttggcgcgtggaaaaagaggtgatctcagggaaggggcagttcttttgtggcaacaaatattgcgataagaaagagggcctaaaatcttgggaggtgaatttcggttacatcgagcacggtgagaaaaggaatgccctggtgaagctccgactgtgtcaggagtgcagtattaaactcaatttccaccatcgccggaaagagattaagtccaagaaacgcaaggataagaccaaaaaagactgtgaagagtcatcccacaaaaagtccaggctttcctccgcggaggaagcctcaaaaaagaaggacaagggccacagttcatccaagaagtccgaggactccctgctaaagacctacttcgtgggcctactctctgaatcaaatgaaaagacctatatgtag

SEQ ID NO: 188258 - DNA, 831 bp, Artificial Sequence
  Description of Artificial Sequence: Synthetic coding sequence
atgcacggccacggcggctacgacagcgacttcagcgacgacgagcggtgcggggagtctagcaagcggaagaaaagaaccgtggaggatgacttgctgctacagaagcccttccaaaaggaaaagcacgggaaagttgctcataaacaggtggctgcagaactcttagacagggaggaggcaagaaatcggcgctttcacctgattgctatggacgcatatcagcgacatacgaaatttgtcaacgactacatcctctactacggcggcaagaaagaagactttaagcgcctgggcgagaacgataagaccgaccttgatgtgatccgggagaaccataggttcctatggaacgaggaagacgagatggacatgacctgggagaagcgcttggccaagaagtattatgacaagctctttaaggagtattgcatcgctgacctctccaagtataaagaaaataagtttggatttcggtggcgagtggagaaggaggtgatttccggcaaagggcagttcttttgtggtaataaatactgtgacaaaaaggaaggcctcaagtcctgggaggttaattttgggtatatcgagcacggagaaaagagaaacgcactggtaaagctgaggttatgtcaggaatgttccatcaaactgaatttccatcataggcgcaaagagatcaagtccaaaaagcgtaaggataaaaccaaaaaagactgcgaagagagcagccacaagaaaagtcgcctgagctccgcggaggaagcctcaaaaaaaaaggacaagggccacagcagttccaaaaaaagtgaggatagtctgttaaactag

SEQ ID NO: 188259 - DNA, 978 bp, Artificial Sequence
  Description of Artificial Sequence: Synthetic coding sequence
atgggcatcttccccggcatcatcctgatcttcctgcgggtgaagttcgccacagcagcagttattgtttccggccaccaaaaaagcactaccgtatcacacgagatgtcaggcctcaattggaagccatttgtttacggtgggttggcttcaattgtggctgagtttggcacatttcctgtcgacttaacgaaaaccagactccaggtgcaggggcaaagtatcgacgccaggttcaaggaaataaagtatcgcggaatgtttcatgcactgttccggatatgcaaggaagagggagtgctggcgctctactctgggatcgcaccagccttactgagacaagcgtcatacggcaccatcaaaatcggaatttatcagagcctgaagaggctgtttgttgaacgtttagaggacgaaacactgcttatcaatatgatctgcggggttgtgtccggggttattagcagtactatcgctaatcccacggatgtgttaaagatcagaatgcaggcccagggttcattgtttcaaggttcaatgatcggctcgttcatcgatatctatcaacaggagggtactcggggcctctggcggggagtggtgcccaccgcccagcgcgctgccatagtggtgggggtcgagttgcctgtatatgatattaccaaaaaacacctaatcctaagtggaatgatgggcgataccattttaacgcactttgtttccagttttacctgtgggttagccggagctttggcatctaaccccgtagacgtggtgaggactcgcatgatgaaccagcgggccatcgttggacatgtggacctgtacaagggcacagtggatggaattctgaagatgtggaaacatgaggggttctttgccctctataagggtttctggccgaattggcttcggttaggcccatggaatatcattttctttattacctacgaacaactgaagcgactgcagatctag

SEQ ID NO: 188260 - DNA, 894 bp, Artificial Sequence
  Description of Artificial Sequence: Synthetic coding sequence
atggaggagctggtggtggaggtgcggggcagcaacggcgccttctataaggcgttcgtgaaagacgtgcatgaggatagcattacagtggccttcgaaaataactggcagcctgataggcaaatcccgttccacgacgtccgcttccccccgccagtggggtacaacaaggacatcaacgaatccgacgaggtggaggtctattcccgagcaaatgaaaaggagccctgctgttggtggttagctaaggttcggatgattaaaggagaattttacgtcatagagtatgctgcatgcgatgccacatacaatgagattgtcaccatcgagagactgagatcagtgaatcctaacaagcccgctactaaggataccttccacaagatcaaactggatgtgcccgaggatcttcggcagatgtgtgctaaggaggccgcccacaaagactttaaaaaagctgttggcgcgttttcagtaacttatgatccggagaactatcagctggtcatattaagcataaatgaagtgacatcgaagagggctcatatgcttatcgacatgcacttcagatctctgaggactaagctctctttgataatgcgaaatgaagaagcttcaaaacagctcgagtcctcacgacaactagctagtcgctttcacgaacagttcatcgtcagggaggacctgatgggacttgccatcggaactcatggagctaatatccagcaagcacgcaaggtaccaggcgttacagcgattgatctggacgaagatacctgcacctttcatatttatggggaggatcaggacgcagttaaaaaggctaggtcctttctggaattcgctgaggatgtgatccaggttcccagaaatctggtaggcttaaagatatag

SEQ ID NO: 188261 - DNA, 1773 bp, Artificial Sequence
  Description of Artificial Sequence: Synthetic coding sequence
atggaggagctggtggtggaggtgcggggcagcaacggcgccttctacaaggcattcgtcaaagatgtgcacgaagatagcatcactgtggccttcgagaataactggcagcctgacaggcagataccttttcacgacgtacggtttcctcctccagtaggttacaataaggacatcaacgagagcgatgaggtggaagtctacagtagagccaacgaaaaggagccttgttgctggtggcttgcaaaggtgcgaatgatcaagggggaattttatgtaattgagtatgcggcctgtgacgcgacttacaacgagatcgttaccatcgagagactaaggtcagtcaacccgaataagcctgccaccaaagacaccttccacaaaataaagctcgacgttccagaggatctccggcagatgtgtgccaaggaggccgcccacaaggatttcaagaaggctgtgggagcttttagcgttacctacgatccggaaaactaccagttggtgatcctctctattaatgaagtcacttctaagagagcacacatgcttatcgacatgcactttcggtccctccgcacaaaactgagtctgataatgaggaatgaggaggccagcaagcagctggagagctccagacagttagcatcgcgatttcatgaacagtttatcgtacgagaggacctcatgggtttggctatcggcacacacggagctaatattcaacaggccaggaaggtgccaggggtgaccgctattgatctcgacgaggatacatgtacgttccatatctatggcgaggatcaagacgccgtaaaaaaggccagaagtttcttggagttcgcagaagacgtcatccaggttccgcgcaacctcgtcgggaaagtgatcggaaaaaatggtaagctaatccaagaaatcgtggataagtccggggtggttcgtgtacggattgaggccgaaaatgagaaaaacgtcccacaagaggaagagattatgccacccaatagcctgcctagtaataactcacgggttggccctaacgcacctgaggagaaaaaacatctcgacatcaaggagaatagcacccatttttcgcagcccaactcaacaaaagtacagcgggttctggtggcatcctcagtggtcgctggcgaaagccagaaacccgagttgaaagcttggcagggcatggtgcctttcgtgtttgtggggaccaaggattctattgccaacgctacagtcctcttggattaccacctaaactaccttaaggaagtggaccagctgagacttgaacgcctgcaaatagacgagcagctccgacagatcggggcatcaagtcgacctccccccaacagaacagacaaggagaagtcctacgtaactgacgacggccaaggcatgggacggggctcgagaccctatcgtaatagaggtcatggaagacgtggacctgggtatacaagcgccccaaccgaagaggaaagagaaagtttcctgagaaggggagatggccggcggagaggagggggaggacgaggccaggggggtcggggacgcggcggaggctttaaggggaatgacgaccacagcaggactgacaatcgacccagaaaccctagggaggccaaaggcagaacgacagatggctccttgcaaaatactagctccgagggatccagacttcggacaggaaaagacagaaatcagaagaaggagaaacctgactccgtcgatggacaacagcccttggtgaatggagtcccctag

SEQ ID NO: 188262 - DNA, 1614 bp, Artificial Sequence
  Description of Artificial Sequence: Synthetic coding sequence
atggaggagctggtggtggaggtgcggggcagcaacggcgccttctacaaggctttcgttaaggatgtgcacgaagactctataacagtagccttcgaaaacaattggcaacccgacaggcagattccatttcatgatgtccgctttcctccccctgtcggttataacaaggatattaatgagagtgatgaggtggaagtgtattcccgtgcaaatgagaaagaaccatgttgctggtggctcgctaaggtccgcatgattaaaggcgaattctatgtgatcgaatatgcagcctgcgatgctacatacaatgaaatcgttaccatcgagcggctgcggagtgtcaatcctaataagcctgccaccaaggataccttccataagattaagctagatgttccagaagatttgagacagatgtgcgctaaggaagcagctcacaaggatttcaagaaagcagtgggcgcatttagcgtcacatacgatccagaaaattaccagcttgttattttaagtataaatgaagtcacctcaaaaagagcacacatgttgattgatatgcacttccgctcactgaggaccaagttaagtcttattatgagaaacgaagaggcaagcaagcagctggagagctctagacaattggcatctcggtttcacgagcagtttatcgtgcgggaagatctgatgggtcttgcaatcggcacccacggggccaatattcaacaggcccgcaaagtgcccggagtgaccgcaatagatttggacgaagatacatgtacattccatatctatggggaggatcaggacgctgtgaagaaagcacgtagtttcctcgaattcgctgaagatgtaatccaggttccaagaaatctcgttggtaaggtgatcggcaaaaatggcaagctcattcaagagatcgtggacaaaagtggtgtggttagggtgagaatcgaggcagagaatgaaaagaacgttccacaggaggaggagatcatgcctccaaattcccttcccagcaataattccagagttggtcctaacgcccctgaggagaaaaaacatcttgacattaaggaaaattctactcacttctcccagccaaattctacaaaggtccaaagggtgctggtagcctcaagcgtggtagccggtgagtcccaaaaaccggaactcaaagcctggcaagggatggtacctttcgtgtttgttggaactaaagactcaatcgcaaacgcgactgtcctactggattaccatctgaattacctgaagctgcagcagagaaagcgaggtagagcatcctgtgccgaggaaacagacggcggagtggaaggggaagaagaggataaggaggaggaggatgtggaggaagccagcaaagagactacgatcacaccagaacagattattgtacatgtcatccaagagcgccttaaagaggaacaacaaatggaccccttccgcagcgagttaaccgcgattatgaaaggggtgagcactttgaagcactatcggatcccgcctgtgaaagtggtcggttgcgcgcgggttaaaatcgtcactagacggaagcgatcccagactgcttggatggtgagtaaccattcttag

SEQ ID NO: 188263 - DNA, 1899 bp, Artificial Sequence
  Description of Artificial Sequence: Synthetic coding sequence
atggaggagctggtggtggaggtgcggggcagcaacggcgccttctacaaggctttcgtcaaggatgtgcatgaggattctatcacagtggccttcgagaataactggcagccagatagacaaatccctttccatgacgtgagattccctccccctgtgggatacaataaggatataaacgagtcagatgaggtggaggtctacagccgtgccaacgaaaaagaaccatgttgttggtggctggccaaggtccgcatgatcaagggagagttctatgtcatcgaatatgcagcttgcgatgcaacctataacgagattgtgacaatcgagaggttacgatctgtcaaccctaataaaccagcaactaaagacacctttcacaagatcaagctggatgtccctgaagatctaaggcagatgtgtgcaaaggaagccgcacacaaagactttaaaaaggctgtgggcgcatttagtgtgacctatgatcctgagaattaccagctagtgatactttccataaacgaagtcacgagcaagcgcgcccatatgctgatcgacatgcactttcgatccttgcgtaccaaattgagtcttattatgcgcaacgaggaggccagcaagcagctggagtcttctaggcagctggcctcgagattccatgagcaatttatcgtgcgcgaggatcttatgggcctggcaattggaactcatggggcaaacatacaacaggcgcggaaggtgcccggcgttaccgccatagatctggatgaggacacgtgtaccttccatatctatggggaggatcaggatgccgttaagaaggctcggtctttcttagagttcgcagaggacgttatccaggtcccaaggaacctcgtcggcaaggttattggtaaaaacggtaaactgatacaggaaatcgtggataagtcaggggtggtgcgtgtaaggatcgaagctgagaacgaaaaaaatgttcctcaggaagaggaaatcatgcccccaaacagtcttccctctaacaacagtcgcgtgggccccaatgctccagaggagaagaaacatctggatatcaaagaaaacagcacacacttctcccagcctaatagcacgaaagtgcaacgagtgctggtggctagctctgtggtggccggtgaatctcagaagcccgagttaaaggcctggcaggggatggttccatttgtgttcgtgggtaccaaggactccatagcaaatgccacagtgttattggactaccatcttaattaccttaaggaggtcgatcagctccgactggagcggctgcagatcgatgagcagctgcgccagattggtgcatcgagccggcccccacccaacagaaccgacaaggaaaaatcatatgtgacagacgatggccagggcatgggaaggggaagccgcccataccgaaacagggggcatggacgtcggggtcccgggtacacatccggtacaaatagcgaggcatctaatgcctctgaaacagaatcagatcaccgtgacgaattgtcggactggagtctcgcaccaactgaggaagagagggaaagtttcctgcggcggggggatggaaggcgtcgcgggggtggaggtaggggccagggaggacgtggaagaggaggggggttcaaaggcaacgacgatcacagtcggactgacaacaggcctcggaacccacgcgaagcgaaaggcaggacaaccgacggttctctgcagataagggtcgactgcaacaacgagcggagcgtgcacaccaagaccctgcagaatacctcaagcgagggctctagactacgtactggcaaagatagaaaccagaagaaagagaagcctgactctgtggacgggcagcagccactagtgaacggagtgccatag

SEQ ID NO: 188264 - DNA, 1749 bp, Artificial Sequence
  Description of Artificial Sequence: Synthetic coding sequence
atggaggagctggtggtggaggtgcggggcagcaacggcgccttctacaaagcatttgtaaaggatgtccacgaagacagtatcacagttgccttcgagaacaactggcagcccgacagacagattccatttcacgacgttcggttccccccacccgtcgggtacaacaaagacattaacgagtctgacgaggtcgaagtatacagtagggccaatgagaaagagccgtgttgttggtggctggccaaggttaggatgattaaaggcgagttctacgtcattgaatatgctgcatgcgacgctacctataacgaaatcgtgactatcgagcgactccgatccgtcaatcctaataaacccgcaacgaaggacacattccataagatcaagctagacgtccctgaagaccttaggcaaatgtgcgcaaaagaagcagcccataaagactttaagaaagctgtgggcgccttttcagtcacatacgatccggagaattaccagttggttattttatctataaacgaggtgacatcaaagcgcgctcacatgcttatcgatatgcattttagatcgctcagaacaaagctaagtctcatcatgagaaacgaggaggccagtaagcagctcgagtctagcagacagctggcctcgagatttcacgagcagttcatcgtgcgcgaagacctgatgggattagcgatcggcacacacggcgcaaatatccaacaagcccgcaaagtgcccggagttactgccatagacttagatgaagatacctgtactttccacatctatggtgaggaccaggacgccgtgaaaaaggctcggtcatttttagagtttgctgaggatgtgattcaagtgccgagaaatctggtcgggaaggtgattggaaaaaatggtaagctcattcaggaaatcgttgacaaatctggagttgtccgtgtgcgcatagaggccgagaacgaaaagaacgtcccccaggaagaggagattatgcctcctaattcactgccctctaacaattctcgggtggggcctaatgcgcctgaggaaaagaaacatctcgatatcaaggagaatagcacacatttttctcaaccgaactccactaaagttcagcgtggtatggtaccatttgttttcgtgggtacaaaggattccatcgcgaacgccaccgtgcttctggattaccatttgaactacctgaaagaggtggatcaactgcgtctggagcgcttgcagatagacgagcagctcagacagatcggagcttctagcagaccaccaccgaacaggaccgacaaggagaagtcctatgtgacagatgacgggcaaggaatgggcaggggaagcaggccttatagaaaccgcgggcatggtaggagaggtcctggttacacatctgagtccgatcacagggatgagctctctgattggagtttagctccaacagaggaagagcgggagagctttctgagacggggggacggtcggagaagaggaggtggagggagaggccaaggcggacgaggtcgggggggtggatttaagggcaacgacgatcattctcgcaccgacaatcgtccaagaaatcctcgagaagcaaagggtagaaccacagatggttcgctgcaaaatacgtcatcagaaggtagtcggctacgcacaggcaaagaccgcaaccagaaaaaggaaaagcctgacagcgtcgatgggcaacagccattagtgaatggcgtaccttag

SEQ ID NO: 188265 - DNA, 1779 bp, Artificial Sequence
  Description of Artificial Sequence: Synthetic coding sequence
atggaggagctggtggtggaggtgcggggcagcaacggcgccttctataaggcctttgttaaagacgtccacgaagactcgattacagtagccttcgaaaataactggcagccagaccgccagatccccttccatgacgttcgctttccacccccggtggggtacaacaaagacatcaacgaaagcgacgaggtggaagtctacagtagggccaatgagaaagagccctgttgttggtggctggccaaagtcagaatgattaagggcgagttttacgttatagagtatgccgcttgcgacgctacctacaatgagatcgtgaccatcgaacgacttcgttctgtaaacccgaataagcctgccaccaaggacacctttcataagatcaaacttgatgtgcctgaggacctacggcagatgtgcgccaaggaagcagcccacaaagacttcaaaaaggctgtgggcgctttctcggtgacttacgacccggagaactaccagttagtaattctctcaatcaacgaagtgacaagcaaacgcgcgcacatgctcatcgatatgcactttcgatcgctgagaacaaaactgagccttataatgcgcaacgaggaggccagtaagcagttggagagcagccggcagttagccagcaggttccatgaacagttcatcgtacgcgaagacctgatgggtctggcaattggtacgcatggcgctaacattcagcaggccagaaaggtaccaggggtcactgctatagacctggatgaggatacatgtacctttcacatttacggagaagaccaggacgcagttaagaaggccaggtcctttcttgaatttgccgaagacgtgatccaggtgcccagaaatttagtggtgatcggtaagaatggcaagctgatccaggagattgtggacaagtccggggttgtgagagtcaggattgaagcagaaaacgaaaagaacgtgccacaggaggaggagattatgccccctaactcactgccctcaaacaactcacgggtaggcccgaacgcacccgaggagaaaaaacatttggatatcaaagagaacagcacccatttcagtcagcctaactccacaaaagttcaaaggggaatggttccctttgtgtttgtcggtacgaaagactccatcgcaaatgcaactgtgctgctggattaccatcttaattatctcaaggaggttgaccagctcaggctagagcgcctgcagatcgacgagcaactgcgccagattggcgccagcagtagacccccccccaatcgtacggataaagaaaagtcttatgtgaccgatgatggtcaggggatgggtcggggctcgcgaccgtatcgcaaccgcggccacggccgtaggggtcccggatatacctccgggaccaacagcgaagccagtaacgcctctgagaccgagtcagatcaccgtgatgaactttctgattggagcctcgctccaactgaagaagagcgtgagtcatttctccgaaggggggacggacggagacgagggggcgggggcaggggccagggcggcaggggaagagggggtggattcaaggggaatgacgaccatagcaggaccgacaatagaccgcgaaaccctcgggaggcaaaggggcgcacgactgatggatccttgcagaacacttctagtgagggctcaaggcttagaactggcaaggacaggaaccagaaaaaggagaagccagactccgtggacgggcagcagccacttgttaacggggtgccatag

SEQ ID NO: 188266 - DNA, 789 bp, Artificial Sequence
  Description of Artificial Sequence: Synthetic coding sequence
atgccccccaacagcctgcccagcaacaacagccgggtgggccccaacgccccagaggaaaagaagcacctggatatcaaagaaaatagtacccacttctctcagccgaatagcacgaaagtgcaaagaggaatggtaccttttgtgttcgtcggcaccaaggattcgattgccaacgcgaccgtcttgctagactaccatttgaattatttgaaggaggtggatcaactcagattggagagattgcagatcgatgaacagttgcgacagattggggcgtccagtaggccacccccaaacagaaccgataaagaaaagtcttacgtgaccgacgatggccagggtatgggcagagggtcacgaccataccgtaaccgtggccatggaaggagaggccctgggtacacctctggaactaatagcgaagcctctaacgcaagcgagaccgagagtgaccaccgtgacgaactgtccgactggtctctggcgcccacagaggaagaaagagagagcttcctgcgccgaggcgacggcagacgacgcgggggcggaggcagaggacagggcggccgtggccgaggaggggggtttaaaggcaatgatgatcactcgagaacggacaatcgcccaagaaacccaagggaggccaaaggccgcaccaccgatgggagtctgcaaaacacatccagtgaaggttcaagactgcgtaccggaaaggaccgcaaccagaagaaggaaaagccggacagcgtcgacggacagcagccgctggtgaacggagtaccctag

SEQ ID NO: 188267 - DNA, 1611 bp, Artificial Sequence
  Description of Artificial Sequence: Synthetic coding sequence
atgatgaagggcgagttctacgtgatcgagtacgccgcctgcgacgccacttacaatgagattgtaaccttcgagcgcctgcgccccgtgaaccaaaataagacagtcaagaaaaatacatttttcaagtgtaccgtggacgtgccggaagatctgcgggaagcctgtgctaatgagaacgcgcacaaggattttaagaaggcagtgggggcctgtagaatcttttaccaccccgagacaacccagctgatgattttatccgcttccgaggcaaccgtgaagcgtgtcaacatcctgagtgacatgcacctgcgctctattcggacgaaactcatgctcatgtcacgaaacgaggaggctacaaagcacctggagtgcactaagcagctggccgcggcttttcacgaagagtttgtagtgagggaggacttgatgggtctggctataggaacccacgggagcaacattcaacaggcccgcaaggtgcctggcgtaacagccattgagctggatgaagatacgggtactttcaggatctatggtgagagcgcagatgccgtaaaaaaagcccgcggcttcctggagttcgtggaggactttattcaggtgcccagaaacctcgttggaaaggtgatcggcaaaaacgggaaggtaattcaggaaattgtcgataaatccggagtggtgagggtgcgaattgaaggagacaacgagaacaagcttcccagagaggatggaatggtcccttttgtcttcgtaggcacaaaagaatctatcggcaatgttcaggttctgctagaatatcacatcgcttacctgaaagaggtggagcagctgcgtatggagaggctgcagatcgatgagcagctgcggcagattggctctaggtcctacagtggccggggacgtggcaggcgcggacccaactatacatcggggtacggaactaatagcgagttatcaaatcccagcgagacagaaagcgagagaaaggacgaactctctgattggtccttagccggtgaggatgatagagactcacgacatcagcgagactccaggcgaaggccaggggggagggggagatctgtgtctggcggacgaggccggggcggtccacgcggtggtaaaagttccattagctccgtgctgaaggaccctgactccaatccttactccctgctggataacacggaaagtgaccagacagcggacacagacgcttccgagagccaccatagtaccaataggcgccggcggtccagacggagacgtactgatgaggatgccgtcctaatggacggaatgacagaaagcgacactgcttccgtcaacgagaacggcctggtgacagtggcggactacatctcccgcgctgagtctcaatctcgtcagaggaacctgccaagagagactctggccaagaataagaaagagatggccaaggatgtcattgaagagcacgggccgtcagagaaagccatcaatggaccgacgagcgcatccggtgacgatatatccaaactgcagcgcacgccaggggaagaaaagataaacaccctgaaagaggaaaatacccaagaggcggccgttttgaacggtgttagttag

SEQ ID NO: 188268 - DNA, 1866 bp, Artificial Sequence
  Description of Artificial Sequence: Synthetic coding sequence
atggccgagctgaccgtggaggtgcggggcagcaacggcgccttctataaaggatttatcaaggacgtccatgaggactccctaaccgttgtgttcgagaataattggcaacctgagcgacaggtgccttttaatgaggtcaggcttcctcctcctcctgacattaagaaggagatttctgagggcgacgaagtagaagtgtattctagagcgaacgaccaggagccatgtggttggtggttggcaaaggtgcggatgatgaagggtgaattctacgtcatagagtatgcggcctgtgatgcgacctacaacgagattgtcacatttgagcgactacgtcccgtcaatcagaataagacagtgaagaagaatacttttttcaagtgtactgttgatgtccccgaggacctgcgcgaggcctgcgccaacgaaaatgcccataaggactttaaaaaggccgtaggagcctgcaggatcttctatcaccccgagactacccagctgatgatactgtctgcctcagaagctactgtgaagagagtcaacatattatccgatatgcacctgagatccatccggaccaaactgatgctgatgtcccgaaacgaagaagcaacaaaacacctagagtgcactaaacaactcgctgccgcattccacgaggaatttgtggtcagagaagatctgatggggctggcaatcgggacccacggttctaatatccagcaggctcgaaaggtcccaggcgtgacggcaatcgaactggatgaagataccggtacctttagaatttatggcgagagtgctgatgcagtgaaaaaggcccgaggattccttgagttcgtggaggacttcatccaggtgccacgtaacctggtaggcaaggttatcgggaaaaacggcaaggtcatccaggaaattgttgataaatctggcgtcgtgcgggtgcggattgagggcgataacgagaacaaactcccacgggaggatggaatggtgccctttgtgtttgtggggactaaggagtctattgggaatgtacaggtcctactggaataccacatcgcgtacttaaaggaggtcgagcagcttagaatggagcggctgcagattgatgagcagttaaggcagatcggctcccggtcttattccgggcgtggcagaggaaggcgcggcccgaattacaccagcgggtatggcactaactccgagctgtctaacccttcagaaacagagagtgagaggaaagatgaactgagcgattggtcactcgcgggggaagatgatagagacagcagacaccaacgagacagtaggcgccggccaggcggacgcgggaggtcagtatccggaggacgtggacggggcggaccccgaggcggcaagtcaagcatatcctcagtgcttaaagaccccgattcgaatccctactctttactcgacaacacagagagcgatcagaccgctgacacagatgcatctgagagccaccactcgactaacagaaggcggcggtcgcgccgtcgaagaacagacgaagatgccgtgctgatggacggaatgacggagtccgacactgcttccgtgaacgagaatggtctagtgaccgttgccgactatatcagccgagcagagtcccagagcaggcagcgaaacctgccacgcgagactttggcgaaaaataagaaagaaatggctaaggacgtgattgaggagcatggtccgagtgaaaaggcgattaacggtccaacctcagcttcaggcgatgacatatccaaacttcaaagaaccccgggcgaagagaagattaacaccctcaaagaggagaacacacaggaggcggcagtgcttaacggagtgagctag

SEQ ID NO: 188269 - DNA, 1620 bp, Artificial Sequence
  Description of Artificial Sequence: Synthetic coding sequence
atggccgagctgaccgtggaggtgcggggcagcaacggcgccttctataaaggcttcatcaaggatgtgcatgaggattcactaaccgtggtattcgagaataattggcagccagagcggcaggtcccattcaacgaagtcagactgcctccgccccctgacatcaagaaggaaattagtgagggcgatgaagttgaggtgtattcacgcgccaatgatcaagagccatgcggctggtggttggctaaggttaggatgatgaaaggcgagttttacgtgattgaatatgcggcctgtgatgcaacctataacgaaatcgtgacattcgagcggctaaggccagtcaaccagaacaaaactgttaagaagaacacattcttcaaatgcaccgtggacgtccccgaggacctgagggaggcttgtgcaaatgagaatgctcataaggacttcaagaaggctgtgggtgcatgcaggatcttttaccaccctgaaactactcaactgatgatcctgagtgcctcggaagccaccgttaaaagggtcaacatcttgagcgacatgcatttgcgctctattcgtaccaagcttatgctgatgtctagaaatgaagaggcaacgaaacacttggaatgtaccaaacagctcgcggccgcttttcatgaagaatttgtggttcgtgaggacctgatgggcctagcaattggcactcatggttccaatattcagcaagcgagaaaggttcctggcgtaaccgccatcgagttagacgaagacaccgggaccttcaggatttacggtgaatcagctgacgcagtaaaaaaggcgcgcggtttcctggagttcgttgaagacttcattcaagtgcctcgcaacctggtcgggaaagtgataggtaaaaatggtaaagttattcaggagatcgtggataaaagtggcgtggtgagggtgagaattgagggggacaatgaaaataaactgccaagagaagatggcatggtcccttttgtgtttgtaggcactaaagaatcaatcggtaatgtgcaagtgctcttggaataccacattgcctaccttaaagaggtggaacaactaaggatggagagattgcagatcgatgaacaactgcggcagatcggatcaagatcatatagcgggagaggcagaggacgtagaggaccgaattacacctccggctatggcactaatagtgagttgagtaaccccagcgaaaccgagtcagagagaaaagatgagttatccgactggtcccttgcgggagaggatgacagagacagcagacatcaaagggactcgagacgacgaccgggagggaggggtcgtagtgtatctggcggacgaggaagggggggtcctcgcggcggaaaatcttctatttcttctgttttaaaagaccccgattctaacccctactcactcctagataacacagaatctgatcaaactgccgacactgacgcttcggagtctcatcattccactaacaggcggcgccgctcccgacgtcgtcgaacagatgaggatgctgtgctgatggacgggatgaccgagagtgatacggcatccgtgaatgagaacggcctgggcaagagatgcgactag

SEQ ID NO: 188270 - DNA, 1827 bp, Artificial Sequence
  Description of Artificial Sequence: Synthetic coding sequence
atggtgaccgagggcttcatcaaggacgtgcacgaggacagcctgaccgtggtgtttgagaacaattggcagcccgagcgccaggttcctttcaatgaggtcagactcccccctccacccgatataaaaaaggagatctctgaaggcgacgaagtggaggtatattctcgggccaacgaccaggagccctgtggatggtggctggccaaggtacgcatgatgaaaggcgagttctatgttatcgaatacgcagcctgcgatgctacctacaacgaaatcgtgaccttcgaaagactcaggccggtgaaccagaacaaaaccgttaaaaagaatacattcttcaagtgcacggtggacgtccccgaggatctcagagaggcctgtgctaatgaaaacgcccacaaggatttcaagaaagctgtcggcgcttgccgaatcttctatcaccctgagactacacagttgatgatcttgtcagcttccgaggccaccgtgaagcgcgtgaatatcttatccgacatgcatctgcggagtatccggactaaactgatgctaatgtcacgaaatgaagaagcaactaagcacctagaatgtacaaagcaactggctgccgccttccacgaggagtttgtggttcgggaagatctcatgggtcttgcgataggaacccacgggagcaacatacagcaagcccggaaagtgccgggggtgacggccatcgagctggacgaggacactgggactttcaggatctatggggagtccgctgacgcggtgaagaaggctcgcggcttcctggaattcgtggaggattttatccaggtgccccgtaatctggtgggcaaggtaatcggaaagaatggaaaggttatccaagagatcgtggataaatccggagttgtgagggtgagaatcgaaggcgataacgagaacaagctgccacgggaagacgggatggtgccattcgtctttgtggggaccaaggaatccatcggtaatgtgcaggtactgctcgagtaccatattgcatacctgaaagaggttgagcaattacgcatggaaagattacagattgatgagcagttacgacagattggcagtcgtagttattccgggcgcggacgggggcggcgcgggcctaactacacgtccggctatggaacaaacagcgaactgtctaatcctagcgagaccgagagcgagagaaaagatgaattatccgactggagtttggctggggaggatgatcgggactctcggcaccaacgtgactccaggcggcgccctgggggtcggggccggagtgtgtcaggtggcaggggtagaggcggcccccgtggggggaagagttcaatctcgagtgtcttaaaggatccggatagcaatccttactccttgcttgataataccgaaagcgaccaaacagccgatacagacgcttcagagtctcatcactcaaccaatagaaggagacgctccaggaggaggcgcaccgacgaagacgcagtgttaatggatggtatgaccgagtctgacacagcgagcgtgaacgagaacggtctggtgacagtggctgattacatctccagagcagagagccagtcaagacaaagaaatctcccacgcgagacactagccaagaacaagaaagaaatggcaaaagacgtgatcgaagaacatggcccatccgagaaggccatcaacggcccaactagcgcttccggggacgatattagcaagctgcagaggacaccaggcgaagagaagatcaacacactgaaagaagagaacacccaggaggcagccgtcctgaacggggttagctag

SEQ ID NO: 188271 - DNA, 2022 bp, Artificial Sequence
  Description of Artificial Sequence: Synthetic coding sequence
atgggcggcctggccagcggcggcgacgtggagcccggcctgcccgtggaagtaaggggcagtaacggcgctttctataaaggctttgtgaaagatgtccatgaggactctgtgaccatattctttgaaaacaactggcagtctgaacgccagattccctttggagatgtgagactgccaccccccgctgactataacaaagaaataaccgaaggggacgaagtggaggtgtacagccgagccaacgagcaggaaccatgcggctggtggctggcgcgagtacgcatgatgaaaggcgacttttacgtcattgagtacgccgcttgcgatgccacttataatgagatcgtgacgctcgaaaggctgagacctgtgaatcccaatcccctcgccacaaagggtagcttctttaaggtcactatggccgtcccagaagacctgcgtgaggcttgctcaaatgaaaacgtacataaggagttcaagaaagccctcggcgctaattgcatctttctgaatataaccaacagcgagcttttcatcttatctacaacggaagcgcctgtgaaaagagcctctctgctgggagacatgcacttccgcagcctgaggaccaagcttttactcatgtcaaggaacgaggaggccactaagcatcttgagaccagcaaacagctggccgccgcattccaggaagaattcacggtgagggaggatttgatgggcctggcgatcgggacccatggagctaacatacaacaagcccgcaaggtgcccggcgtcaccgctatagagctgggagaagaaacctgcacatttcggatctatggcgagacgccagaagcatgtaggcaggccaggtcctaccttgaattctccgaggattccgtccaggttccacgtaatctggtgggcaaggtgataggcaagaatggtaaggttatccaagaaatagtggataaaagcggggttgttagggtacgagtggagggggataacgacaagaaaaaccctagggaggaggggatggtgccttttatcttcgtggggacaagagagaacataagcaacgcacaggctcttctcgaatatcatttaagttacctgcaggaagtggagcaactacgactagaacggctccagattgacgagcagctgcgacaaataggactggggtttaggccccccggatccggacgaggctcaggcggaagcgataaagcaggatactcaaccgatgagtcatctagttcttctctgcatgccacacggacgtatggcggtagctatgggggacggggccgagggaggagaaccggcggtcccgcctacgggccctcatcggacgtttccacagctagtgaaaccgaaagcgaaaaaagagaagaaccaaaccgcgctggcccaggggatagggacccaccaacacgaggagaggagtcgcgccggcggccgactggcgggcgggggcgcggtcccccgccagcacccagacctacatccagatacaactcctcaagcataagtagtgtcttaaaggatccagattccaatccgtacagcctgctggacacctctgaaccggagccgccggtggactccgagcccggggagcctccaccagcgtccgcccggcgtcggcggagcaggaggaggcggaccgacgaggaccgcacggtaatggacggcggactggaatctgacggcccaaatatgacagagaatggattggaagacgagagtaggccccagaggagaaataggtctcggcggaggaggaatagaggcaaccgaacagacggatcaataagcggcgaccggcagcccgtaaccgtcgcagattatatatctcgggccgaaagccagtcgcgccaaagacctcccttggagagaacaaaaccgtctgaagatagcttgtccgggcagaagggggatagcgttagtaaactgcctaaaggaccctcagagaatggtgagttgtccgcccctttggagctgggctctatggttaacggtgtttcctag

SEQ ID NO: 188272 - DNA, 6540 bp, Artificial Sequence
  Description of Artificial Sequence: Synthetic coding sequence
atgaacagcctgagctggggcgccgccaacgccgtgctgctgctgttgctgctggcttgggcctctcctaccttcattagtattaacagaggcgtgagggtgatgaaagggcacagcgctttccttagtggagatgatctgaaatttgccattcctaaagaaaaggatgcgtgtaaggttgaagtcgtgatgaacgaacctattacccagagagttggcaaactcaccccgcaggtatttgactgccacttcctcccaaacgaagtgaagtacgtacacaacgggtgcccaattcttgacgaggatacagtcaagcttcgattataccgctttacagagcgcgataccttcattgaaacctttatcctgtgggtatacctgctggaacccgactgcaacatcatccacatgagcaacaacgtcctggaagtgccggaatttaatggtctcagtcaggccattgataagaacctgctaagattcgactacgatcgtatggcgtctctcgaatgtaccgtaagcctcgacacagctaggacaaggcttccggcacatgggcaaatggtgctgggagagcctcgaccagaggaaccacgaggagaccagccccacagtttctttccggaaagccagctacgggctaaattgaagtgtcctggaggaagctgcacaccaggattgaagaaaataggctctctgaaagttagctgtgaggagttcctcctcatgggtctccggtaccagcatcttgatccgccctcgcccaacattgattatattagtatccaactggatctgactgacacaagatccaaaatagtctacaagagcgagtcagcctggcttcctgtgtacatacgtgctggaatccctaaccaaattcccaaggccgcctttatggcagtgtttatcctggaggtcgaccagtttattctcacatccctcacgacgagcgtcttggactgcgaggaggacgagacacccaagccactgcttgtctttaacatcaccaaagcacccctacaaggctatgtgacccatctgctggatcatacgagacctatttcttccttcacatggaaggatttgtccgacatgcagatcgcataccagccacccaacagttctcactccgagagaaggcatgacgaggtagagctcgaggtgtatgattttttttttgaacgctcagctccgatgaccgtgcatatcagtatcagaaccgcagatacaaatgctccccgggtctcctggaatacaggtctgagcctcctcgaggggcagagccgggcaatcacatgggagcagttccaggtcgtggacaacgacgacattggcgccgtgcgcctagtcacagtaggcgggctgcagcacggctggctgaccctgaggggtgggaagggcttcctgttcactgttgctgatctacaggcgggcgtggtgaggtaccaccatgacgattctgacagtaccaaggacttcgtcgtttttagaatctttgatgggcatcacagcattcgtcacaaatttccaataaacgtgctgccaaaagacgatagtccaccattccttatcacaaacgttgtcatcgaactggaggaaggtcagaccattctaattcagggctctatgctacgtgcatctgatgtggatgcatccgatgattacatattctttaatataaccaaaccacctcaagcaggagagatcatgaaaaagcccgggcctggcctaattggctatccagtgcacggattcctccaacgagatctatttaatggtataatctattacaggcacttcggcggagagatcttcgaggatagtttccagtttgtactgtgggacagccatgaaccgcctaatctgtcagtgccgcaagtagcaaccattcatatcacccctgtcgatgaccaacttcctaaagaagcccctggagtgagtaggcatcttgttgtaaaagaaacagaggtggcttacataaccaaaaagcagctccatttcatagattctgagagttatgaccgggaactcgtatacacaatcaccactccgccattcttctcatttagccaccggcatctggatgctgggaagttgtttatggtggatagtatccccaaggtcgtcaagaatccaacggccctggaactgcgtagcttcacacagcatgccgtgaattatatgaaggtcgcgtacatgcccccaatgcaagatattggtccgcactgcagggacgtgcaatttaccttcagtgtgtcaaatcagcatggcggcacactccatggcatctgtttcaacataactattcttcctgtcgacaatcaggtgcctgaggcctttactaatcctttgaaggtgaccgagggagggcagtcaatcatcagtaccgaacatatcttaatctccgatgccgatactaaattagataatattgacttgtcgctgcgggagttaccgcttcatggtcgtgttgaactgaacggttttccgctgaatagtggcggcacattctcctggggagacctgcatacactgaaagtgcgataccaacatgacggaacagaagtgctgcaagatgatttattgctcgaagtgaccgacggcaccaacagcgcagagtttgtgctccatgtcgaggttttccccgtaaatgatgagcccccggtcctgaaagcggacctgatgcctgtaatgaattgctctgaaggcggagaggtcgtcatcacttcagagtacatcttcgcgactgacgtggacagcgacaacctcaagctaatgttcgtcatcgcccgggaacctcagcatggcgtggtgaggagagctggtgttaccgtggaccagttttcacaaagagatgttatttcagaggccgtgacctacaaacacaccggcggagagattggcctcatgccatgctttgacaccatcacgctagttgtgagtgacggggaagcagggccatttgtgaacggttgttgttataatggaccaaaccccagcgttccactgcacgcctcatttcctgtgtatgacctcaatatcactgtatatcctgtagacaatcaaccaccaagcattgcaattgggcctgtttttgttgttgacgagggctgctcaaccgcccttacggtcaatcatctgtcggctacggatccagataccgccgcagatgacttggaattcgtgcttgtatcgccaccacagtttggataccttgagaacatccttccgagtgtcggcttcgaaaagtccaatatagggatctcgatagactcctttcagtggaaagatatgaacgcctttcacattaattacgtgcagtcccggcacctcagaatcgaaccgacagccgatcagttcacggtgtatgtgacggacggtaaacaccactcactggaaataccgttcagtatcattattaaccctaccaacgacgaggcccccgatttcgtggtgcagaacatcaccgtctgcgaggggcagatgaaagagctggactcctctatcatcagtgccgtggatcttgacattccacaggatgcactgcttttcagcattactcagaagcctaggcatggcttgctcattgatagaggcttctccaaggacttcagcgagaataaacagcccgcaaatccacatcaaaaacatgctcctgtgcattccttttcgatggagctgttaaaaacgggcatgcgcctgacctacatgcacgatgattctgagtccctggctgacgacttcactatccaattgagcgacgggaaacacaagattctgaagactatctccgtggaagtaatccccgtcaacgatgagaagcctatgttatctaagaaggccgaaatcgcaatgaacatgggagagacaagaattatttcctctgcgatcctgtcagcgatagacgaagatagtcccagggagaagatttactacgtgttcgaaaggctacctcagaacggccaacttcagttgaagattggcagggattgggtacctttatcccccgggatgaagtgtactcaagaggaggtggatctcaatctgctccggtacacccacacgggcgcgatggactctcaaaatcaagacagcttcacgttttacctgtgggacggtaataaccgtagccccgctctcgactgtcaaattacaatcaaggatatggaaaagggggatatcgtgattctcaccaagccattggtggtaagcaaaggggaccgaggcttcctgacgacgactacattactcgccgtcgacggaacggacaagcccgaagaattgctgtacgtcattaccagcccccctaggtacggacaaatcgagtacgtgcattaccccggcgtgcctataactaatttttcccagatggacgttgtcgggcagacggtttgctatgtgcataagtccaaagttactgtgagtagtgacagattcagatttataataagtaacggcctgagaaccgaacacggtgtgtttgagattactctcgaaaccgtagatcgtgcgctgcctgtggttactaggaacaaaggtctgaggctggcacagggggccgtcgggttactaagtccagatctgctccagttaactgatccggatacacccgctgagaatctaacctttctgctggtgcagctgccgcagcatgggcagctctacttgtggggaactggcctcctgcagcataacttcactcaacaggatgttgacagcaaaaatgtcgcctaccgccattctggtggggatagtcagaccgattgcttcaccttcatggcgacagacggtacaaaccaggggtttattgttaatgggcgcgtttgggaggagcccgtgctgtttaccatccaggttgatcagctcgacaagaccgccccaagaattacccttctccatagcccatctcaggttggactgttgaagaacggctgctacggaatctatatcacatcacgagttttgaaggcatctgacccagatactgaggacgaccagatcatttttaagattctgcagggaccaaaacatgggcaccttgaaaacacaacaacaggagagttcatacacgagaagttttcacagaaggacttgaactccaaaaccatcctctacatcattaatccaagtctcgaggtgaactctgatacagttgaattccagattatggacccgactggcaatagcgctacgccacaaattctcgaactgaagtggagtcatatcgagtggtcacagacagaatacgaggtctgtgagaatgtcggtttgcttcccttggaaatcattcgccgaggctattccatggatagtgcctttgtggggattaaagtcaaccaagtctcggctgcggtcggcaaggatttcaccgtgatcccttccaaactgattcagtttgacccaggtatgagtacaaaaatgtggaacattgctatcacttacgatgggctcgaggaagatgacgaggtttttgaagttattctgaatagtccagttaacgctgtgttgggcacaaagaccaaggcagcagtgaaaatccttgacagtaaaggcggacagtgccatccctcttatagctcaaaccagtctaagcatagtacatgggagaagggtatctggcatttgttgccaccgggatccagtagcagtaccacgagtgggtccttccacctggagaggagacctcttccaagtagtatgcagctcgctgtcattcggggggacactctcaggggctttgacagcacggacctctctcagcgaaagttaagaacaaggggtaacggtaagacagttagaccctcatctgtgtataggaatgggaccgacatcatttataactaccacggcattgtgtcccttaaattggaagatgactccttccctacccataaaagaaaagccaaggtgtccatcatttctcagcctcagaaaacaatcaaagtcgcggagctgccccaggccgataaggtagagtccacgacggattcccactttccaaggcaggaccagctgccatccttccccaagaactgcacccttgaactcaagggtctgtttcacttcgaggagggtatccagaagctgtaccagtgcaatggtatcgcctggaaggcctggtccccacagacaaaggacgtcgaggacaaatcatgccctgccggctggcaccagcactctggctactgtcacatcttgattacggaacagaagggtacatggaatgccgccgcgcaggcctgccgggaacagtatcttgggaacctcgtgacagtgttctcacgccagcacatgcggtggctttgggacattggcggaagaaagagtttctggatcggtctgaatgatcaggttcacgcagggcattgggaatggattggcggggaacctgtagcgttcaccaacgggcggagggggcccagtcagaggagtaaactggggaaaagctgcgtccttgttcaaaggcaaggcaagtggcagaccaaggactgtcgcagggccaagcctcacaactacgtgtgctcccgaaagctctag

SEQ ID NO: 188273 - DNA, 6543 bp, Artificial Sequence
  Description of Artificial Sequence: Synthetic coding sequence
atgaacagcctgagctggggcgccgccaacgccgtgctgctgctgctcctgttggcatgggcctctccaaccttcattagtatcaatcggggtgtgagggtcatgaaaggacactccgccttcctgagcggcgacgacttaaaattcgcgataccaaaagaaaaagatgcatgcaaggtcgaggtcgtgatgaacgagcctataacccaaagagtgggcaagttgacaccccaggtgtttgattgtcacttcctccccaacgaggtgaaatacgttcacaatggctgccccatcctcgatgaagatactgtgaaactgaggctgtaccgctttacggagagggacaccttcattgagaccttcatcctgtgggtctatttactggaaccggactgcaatattatccacatgtctaataacgtcctagaagttccagagttcaacggcctgagtcaggccatcgacaagaacctgctgagattcgactatgataggatggcgtcgctagaatgcacagtgtcattagacactgctcggacaagactgcctgcccatgggcagatggtactcggcgagccaaggccggaggaaccaagaggtgaccagccccattcttttttcccagaaagccagttgagagctaagctgaaatgtccagggggatcctgtacgccgggccttaagaagattgggagcttaaaggttagttgtgaagagttcctactaatgggcctccgttatcagcacctggaccctccttcgcccaacatagattacatttctatccagttagacctcacagacaccaggtctaaaattgtatataagaaaagcgaatctgcctggcttcccgtttatatccgcgccggaattcctaaccagattccaaaagccgcctttatggcagttttcattctggaagtggaccaattcatcctgacaagtcttacgactagtgtgcttgattgtgaagaagatgaaacccctaaaccgcttctcgtatttaatattaccaaggcaccgctacaaggctacgtgacacaccttctagatcacacccggccgatttcctcttttacttggaaggatctttccgatatgcagattgcctatcagcctcctaacagctcacacagtgaacgccgtcatgatgaggttgaactcgaggtttatgacttcttttttgagaggtctgccccaatgactgtccatatttctatccggactgcagacacaaatgccccacgcgttagctggaacactggccttagcttattggaaggccagtctcgtgcaattacgtgggaacagtttcaggtcgtcgataacgatgatatcggtgccgtcagactagtcaccgtcgggggactgcagcacggctggcttaccctgagaggcgggaaaggcttcctgttcaccgttgcagacctccaggctggagtcgtgcggtaccaccatgacgatagtgacagcacaaaagactttgtagtgttccgtatatttgatggccaccattcaatccggcacaaattccctataaacgttctgccaaaagacgactcgccacccttcttaataacaaatgtcgtcatcgaactggaggagggtcagacaatcttgatccaggggtccatgctgcgcgcctcggatgttgatgccagtgatgattacatctttttcaatatcactaaaccccctcaggcgggtgagatcatgaagaaacctggacccggacttatcggctaccctgtccacggattccttcagagagacttgttcaacgggatcatctactaccggcattttggcggggagatatttgaggactcttttcagttcgtgttgtgggatagccacgaacccccaaatttgtccgtccctcaggtggcaacgattcacatcacaccggtggacgatcagctgcccaaagaggcccctggcgtcagtaggcatctggttgtgaaggaaacagaggtcgcctatatcacgaagaaacagcttcactttatcgattccgaaagctacgacagagaactcgtgtataccatcacgactcctccctttttcagcttttcccatcgccacctagacgccggcaaactgtttatggtcgacagtattcccaaggtggttaagaatccgacggcactggagctgcgatcgttcactcagcacgccgtcaactatatgaaagtagcttatatgcctccaatgcaggatattggacctcactgcagggatgtgcagttcacatttagtgtctcaaatcaacacgggggcactctgcatgggatatgctttaacataacaatactacccgtcgacaatcaggtacctgaagctttcacaaaccccctcaaggtgactgagggcggccagagtattatcagcaccgagcatatcttgatctctgatgctgacacaaagctggacaatattgatttgagcctcagagaactgccactgcacggtagagtggagctgaacgggtttccactcaattctggcggcactttttcctggggggacctacatactctcaaagtcagataccagcatgatggcactgaagtcctccaagatgatttgctgctggaagttacagatggaactaactccgccgagttcgtcttgcacgtagaagtctttccagtcaatgatgagcccccggtcctgaaagccgacttgatgccagttatgaattgcagtgaagggggagaggtggtgatcacctcagaatacatatttgccaccgatgtggatagtgataatcttaaactgatgttcgttattgcccgtgagccccagcacggcgtcgtgcgtagggccggcgtgacagtggatcaattctctcagagggacgtaatttccgaggccgttacatacaaacatactggcggcgagatcgggctcatgccctgtttcgacacaataacgttggttgtttcagacggtgaggccggccctttcgtgaatggttgctgctacaacggaccgaatccctccgtgccactccacgctagtttccccgtgtatgacctgaacatcacggtgtatcctgtagacaaccagcctccttctattgcgataggccccgtcttcgtcgttgacgaaggatgttcgactgccctgactgtgaaccacctgagcgccacagatccagatacggctgcagatgacttagagttcgtgttggtcagcccaccccagtttggctacctggagaacatactgccaagcgtgggtttcgagaaaagcaacattggcatctccatcgatagcttccagtggaaagatatgaacgcattccacataaattacgtgcagagccgtcacctcaggattgagcccacagcggaccaatttactgtctacgtgacagatggcaagcatcactctctagaaattccgtttagtattatcattaatccaacaaacgacgaggctcccgattttgtggtacagaatattaccgtttgtgaaggacagatgaaagagctggacagtagtatcattagcgccgtcgatttggacattccacaagatgccctactgttcagcatcacacaaaagccaagacatggacttttaatcgacaggggctttagcaaagacttttcagaaaacaagcaaccagcgaaccctcatcaaaaacacgcccccgtccactctttctcgatggaactcctgaaaactggtatgcggctgacgtacatgcacgacgacagcgaatctctagccgatgactttacgatccaattgtccgatgggaagcacaaaatactgaagactatctccgtggaagtcattcccgtgaacgatgagaaaccaatgctcagtaaaaaggcagaaattgcgatgaatatgggtgagacccgaataatatcctcagcaatcctcagtgctattgacgaagactcaccaagggagaagatctattatgtctttgagaggcttccacagaacggacagctgcagctaaagatcgggagggattgggttcccctatcaccagggatgaagtgtacacaggaagaagtagatttaaatttgttgagatacacccatactggggccatggactcccagaatcaggatagcttcaccttctatctgtgggacgggaacaaccgcagcccagcactggactgtcagattacaatcaaggacatggagaagggggatatcgttattctgacgaaacctctagttgttagcaagggtgatcgcggattccttacaacgactacattgctcgctgtggacggcactgacaaacccgaagagctcctatacgttattacgagcccaccaaggtatggccaaatcgaatacgtccattaccctggtgtcccaatcaccaatttttcacagatggatgttgtgggacaaactgtatgctatgtgcacaagagcaaagttacagtgagctccgataggtttcggtttatcataagtaatggacttcgaaccgagcacggagtgttcgaaattactctcgaaacagttgacagagctctgcctgtcgttacacgtaataagggccttcgcctcgctcaaggcgcagtgggcctgctgagcccggatctcctccagctgaccgacccggacacacctgctgaaaatttaacttttctgctggtccagcttccacaacatggtcaactctacctgtggggcaccgggctgctgcagcataacttcacgcagcaggatgtggactcaaaaaacgtagcttacagacatagcggcggggattcgcagacagactgcttcacgttcatggctaccgacgggactaaccaaggttttatcgtgaacggcagagtctgggaggaacctgtgctgtttactattcaggtcgatcagctggataagactgcccctcgcatcaccttgttgcacagtccaagtcaagtagggctcctcaagaatggctgctacggaatctacattacctcgcgggttctcaaggcctctgatcccgacacagaggatgatcaaatcatctttaaaattttgcaagggcctaagcacggacacctggagaacacaacaaccggggagtttattcatgaaaagtttagccagaaggatttaaactcaaagacgattctctacattatcaatcccagcctggaagtgaattcagacaccgtagagttccagatcatggaccccaccggtaatagcgcgacccctcagatcctcgagctgaagtggtcacatattgagtggagtcaaacagagtacgaagtctgtgaaaatgtgggcctgcttcccctggagatcatccgtcgaggctacagcatggacagcgccttcgtggggattaaagttaatcaggtctcagcagctgtggggaaggattttacggttattcccagcaagctaatccaatttgaccccggaatgagtacaaagatgtggaatatagctatcacttatgatgggctcgaggaggacgacgaagtttttgaagttattcttaattcaccagtcaatgccgtgttgggcactaagaccaaggcagctgtaaagatcctggacagtaaaggcggccagtgccacccatcttattcctcgaatcaaagtaagcacagtacatgggagaagggaatctggcatctcctgcctcccggctcgagtagcagtaccacctcgggatcatttcacctggagcgtaggcctttgccaagttctatgcaactggcagtgattcggggcgacactctccgcggatttgattcgacagacctgagtcagcgtaaacttcgaaccaggggcaacggaaaaacggttcgacccagtagtgtgtaccgaaacggtacagatattatctacaactatcacgggatcgtctccttaaagctcgaggacgatagcttcccaactcacaagagaaaggcaaaggtgtccattataagtcagccacagaaaaccattaaggtggcagagctgccacaggctgataaagtggaatctaccaccgatagtcactttccacgacaggaccaactccctagctttcctaagaactgcactcttgagctgaaggggttgttccatttcgaggagggcattcagaagctgtaccagtgcaacggaattgcctggaaagcctggagtccacagactaaagacgtcgaggataagtcttgccctgcgggttggcaccagcattccggatattgtcatattctcatcactgagcagaagggcacttggaatgctgcagctcaagcctgccgtgagcagtacttgggtaatctcgtgaccgttttctccaggcagcacatgcggtggctctgggacatcggtgggcgaaaaagcttctggatcggcctgaacgaccaggttcatgccggccactgggagtggatcgggggagaacctgtggcctttacaaacggccgccggggaccctcacagagatccaaactcgggaaatcctgcgtactggtacagcgccaaggcaagtggcagaccaaagactgtcggagagctaagcctcacaattacgtgtgctctagaaaactctag

SEQ ID NO: 188274 - DNA, 648 bp, Artificial Sequence
  Description of Artificial Sequence: Synthetic coding sequence
atgctggacgagagcctggccgtgcggcggagcaagaagtgcaaggagatgatcatgcactgggagaaaaaggaagacatagatatcgtgaacacggtagaccagctggataaaactgcgcctaggattactctgctgcactctccatcgcaggtagggcttttgaaaaacggctgctatgggatctatatcacttctcgcgtactgaaggcctctgacccggacaccgaagatgaccaaataatattcaagatcctccaggggccgaaacacggacacctggagaacacgacaacaggcgaatttatccatgagaaattttcccaaaaagacttgaattcgaagaccatactgtacatcataaatccgagcctggaagtgaactctgataccgtggagttccagataatggatcctactggaaactctgcaaccccccaaatattggaacttaaatggtcgcacatcgagtggagtcaaaccgagtatgaggtttgtgagaacgtcggcctcctgcccctggagattatccggcgaggatacagtatggatagtgcattcgtgggaatcaaggtcaaccaggtgtctgccgctgtcggtaaagacttcacagtcatcccatcaaaactcatacagttcgatccatag

SEQ ID NO: 188275 - DNA, 2148 bp, Artificial Sequence
  Description of Artificial Sequence: Synthetic coding sequence
atggtgacccaggagagcatgctgaaggccgccctgcccctgttcactaggtttattatttctaatgggctgaggaccgagcatggggtcttcgagattaccctggagacggtggatagagcccttcctgttgtgaccaggaacaagggcctacgcctggcccaaggcgccgtgggcctgctgagcccggaccttctgcagctcacagatccagacactcctgcagaaaatcttacatttttacttgtgcagttgccacagcatggacagctctatctgtggggaacggggctgttgcaacacaacttcacgcagcaagacgttgactccaagaatgtcgcttataggcacagtgggggcgatagccagaccgactgcttcaccttcatggccaccgatggcaccaatcaggggtttatcgtaaacgggcgcgtttgggaagagccggtgctatttacaattcaagtggatcagctcgacaaaaccgctccccggatcacactcctgcactcccctagccaggtgggtttactgaagaacgggtgctatgggatatatattacatctagggttctcaaggcttccgatccagatacagaggatgaccaaatcatcttcaaaatactgcagggaccaaagcacggacaccttgaaaacacaactacaggagagtttatccatgagaagtttagccagaaggatctcaattcaaaaaccatcctgtatattataaatcccagcttggaggtcaattctgatactgtcgaattccaaattatggaccctacaggaaacagcgccactccccagatactggagctgaaatggtctcacatcgaatggagccagacagagtatgaggtgtgcgagaacgtcggcctgttgccattggaaattattcggagggggtactctatggactccgctttcgttgggatcaaagttaatcaagtctcagcagccgtaggaaaggactttactgtaatccccagcaagttgatccagtttgatcctggcatgtccacgaagatgtggaacatcgccatcacatacgatggtcttgaagaagatgatgaggtttttgaagtgatcctgaatagccctgtgaatgccgttctcggaaccaagacaaaggccgcggtgaaaatcctggactccaagggagggcagtgccatccctcctatagttcgaaccagtcgaagcacagcacatgggaaaagggaatctggcatctgctgccaccaggcagcagttcctccacaacgagcgggagctttcatctcgagagaaggcctcttcctagtagtatgcagctggctgtgatccgaggcgatacactgagggggttcgattccaccgaccttagccagaggaaactcaggacgcgtggaaatggcaagacagtacgacccagctctgtgtatagaaatggtacggatattatttacaattatcatgggatagtgtcactcaagctggaggacgattcgttcccaacccacaagagaaaggcaaaagtttccattatatcccagccgcagaagacgatcaaggtcgcggagctgccccaggccgataaagtagagtccaccactgattcccatttcccccgccaggaccagttaccttcgtttccaaagaactgcaccttggagctgaaggggttgtttcactttgaggaaggaatccagaagctctatcagtgcaatggaatagcctggaaggcatggagcccacagacaaaggatgtagaggataagtcttgtcctgcagggtggcatcagcacagcgggtactgtcacattctcattaccgaacagaagggcacttggaacgctgctgcccaagcttgccgtgagcagtacctgggtaacctggtcaccgtgttttccaggcaacatatgaggtggctgtgggatatcggtggcagaaagtccttttggatcggacttaacgaccaggtccacgccggacattgggagtggattggaggggaacctgtcgcttttactaatggccgacgaggcccctctcagagatcaaagctggggaaatcctgtgtgctggtgcagcggcaaggaaagtggcagacaaaagactgccgcagggccaagccacacaactatgtctgctctcgtaagctgtag

SEQ ID NO: 188276 - DNA, 6540 bp, Artificial Sequence
  Description of Artificial Sequence: Synthetic coding sequence
atgaacagcctgagctggggcgccgccaacgccgtgctgctgctgctcctgcttgcgtgggccagtcccacattcattagcattaatcgcggcgtgagggtcatgaaaggacattccgccttcctgagcggcgatgatctgaaatttgccataccgaaagaaaaagacgcatgtaaagtggaggtggtgatgaatgaaccaataacacagagggtcggaaagctgaccccccaagtgtttgattgccactttctgccaaatgaagtcaaatacgttcataatggctgtcccattctggatgaggacacagtgaagttacggctgtaccgctttaccgagagggatacctttattgagacattcatcctttgggtttacctgctggaacccgattgcaatatcatccatatgtctaacaacgtgctggaggttcctgagttcaacgggcttagtcaagccatcgataaaaatttgctgcgcttcgactacgaccgaatggccagcctggaatgtaccgtgtcgttggatacagctcgcacaaggctgccagcccacggacagatggtattgggcgagccccggcccgaggagccaaggggagaccagccacatagcttttttccggagtcacaacttcgggctaagctaaaatgtcctggaggcagctgcacgccaggccttaagaagataggaagcctcaaggtctcatgcgaggaattcctgctgatgggactgagataccagcatttagacccaccctcccctaatattgattatatttcaatccagctggatctgactgacacccgttcaaagatcgtgtacaaaagtgaatccgcgtggctgccagtctacatcagagctggaatccctaatcagatacccaaggcagcatttatggcagtgttcatccttgaagtggatcagtttattctcacctctctgaccacgagtgtactggactgcgaggaagacgagactcctaagcccctcttagtcttcaatatcaccaaagctcctcttcaggggtacgtgactcatcttctggatcacacgaggcctatctcaagtttcacttggaaagatcttagtgatatgcaaatcgcatatcagcctcccaattcatcacatagcgagagaaggcacgacgaggtcgagctggaagtgtacgatttctttttcgagaggtcagcgccgatgacggttcatatctctataagaaccgcggacaccaacgccccacgtgtgtcctggaataccggtctcagcctgctggaaggccaaagccgcgccatcacttgggaacaattccaggtcgtggataatgatgacatcggagccgtacgcctggtcactgtggggggccttcaacatggctggctcaccctccggggggggaagggcttcctgttcaccgtggctgacctccaggctggggttgtccgctaccaccatgacgattctgacagcaccaaggactttgtcgtctttaggatctttgacggacaccacagcatcaggcataagtttcccatcaacgtgttacccaaagacgattccccccctttcctgataaccaacgtagtgatcgaactcgaggaagggcagaccatactgatccaaggaagcatgttgagagcatctgatgtcgatgccagcgacgattacatctttttcaatattaccaagccgccccaagctggtgaaattatgaaaaagcccggaccgggcttgatcgggtaccccgtccacgggttcctgcagcgagacctgttcaacggcatcatttactacagacacttcggtggggaaatcttcgaagattcgtttcaattcgttctatgggacagccacgagccacctaatttgtcagttccgcaagtggccactattcatatcacgcccgtggacgaccaactcccaaaggaggccccgggggtgtcccggcacctcgtggtcaaggaaacggaagtcgcttacatcaccaagaagcaactgcactttattgactctgaaagctacgatagagagcttgtgtacaccattaccaccccgccattcttttcgttcagccataggcacctcgatgcgggcaaattatttatggtagatagcataccaaaggtggtgaagaacccaactgccttggagttgagatctttcacacagcatgccgtcaactatatgaaggtggcgtatatgcccccgatgcaagacatcggcccacattgcagagatgtgcagttcactttcagcgtgagtaaccagcatggcgggaccttgcatggcatttgtttcaacatcaccattcttcctgtggataaccaggtcccagaagcttttacgaatccacttaaggtgactgagggcggacagtccataatcagcaccgagcatatacttatcagcgatgcggatactaaactcgacaacatagacctgagccttcgcgaactccccctacatggacgggtagaactcaatgggtttcccctgaactccggcggcacgttctcctggggcgaccttcataccctcaaggttcgataccaacacgatggtacagaggtgctgcaggatgacctcctgttggaggtcactgatgggacaaactctgcagaatttgttctgcatgtcgaagtttttcctgttaacgatgaacctcccgtgctgaaggctgatcttatgcctgtaatgaattgcagcgagggtggcgaggtcgttataaccagcgaatacatcttcgccaccgatgtggactccgacaacctgaagcttatgtttgtgatcgccagagagccacagcacggagtagtgcgccgagccggcgtgacagtcgaccagtttagccagcgggacgttatctccgaagccgtgacatataaacataccgggggggaaataggccttatgccctgctttgacaccataactcttgtggtctctgatggagaagcgggcccatttgtcaatggctgttgttacaacggccctaacccatccgtgcctcttcacgcaagctttcctgtatacgatctgaatattactgtttatccagtggacaatcagccaccttctatcgcaatcgggccggtcttcgtggtggacgaaggctgttccaccgcgctgaccgtgaaccacctttccgcaacagatcccgacaccgctgctgacgacctcgagtttgtgttagttagcccccctcagttcggttacttggagaatatccttccgtctgtgggctttgaaaaaagtaacattgggattagtatcgattcctttcaatggaaggacatgaacgcttttcacatcaattacgtccagtctagacacttgcggatcgaacccaccgcggatcagttcacagtgtatgtgacagacggaaaacaccattccttggagatcccattcagtatcatcattaaccctacgaacgatgaagcgcccgacttcgttgtgcagaacattaccgtgtgcgaaggacaaatgaaggaactcgactcaagcattattagtgctgtcgaccttgatataccacaagatgcattacttttctctattactcaaaaaccacgacacggattactcattgacagagggttcagcaaggacttctcagagaataagcagccggcaaatccccatcaaaagcatgcccctgtgcactctttctccatggaattgttgaagacggggatgcgcctaacttacatgcacgatgatagcgaaagtttagccgatgacttcacaatccaactgagtgatgggaaacacaaaatcttgaagacgatatctgtggaagtgattccggtgaacgacgagaaacccatgctctcaaagaaggctgaaattgcaatgaatatgggtgaaactaggataatttcttcggccatcttgtccgctattgatgaggattctccacgggagaagatctactacgtatttgagaggcttccccagaatggacagttacagctgaaaatcggtcgggactgggtcccactctctcccggcatgaaatgcacacaagaggaagtggatcttaacctgttacggtacacccataccggtgctatggactcacagaatcaggattcatttactttttacctgtgggacgggaataaccgttcgccggccttggattgtcagattaccattaaagacatggagaaaggcgacattgtaatcctgaccaagccacttgtcgtgtctaaaggggaccgggggttcctgaccaccactactcttctggccgtggacgggacagataaaccggaagaactgctgtacgtcattaccagccctccacgctatggccagattgagtacgtgcattacccaggggtccccatcacaaacttcagtcaaatggacgtcgtgggtcaaactgtgtgttacgttcacaaaagcaaggttacagtatcctccgacaggtttcgctttatcatctctaacggtctacggacagagcacggcgtgtttgagattaccctggaaactgtcgaccgggctctcccggtggtgactaggaataaagggttgcgattagcccagggagcagtagggttgctgtcccccgatctattacagctcacagaccctgacacccccgctgagaatctgacattcttgctggtccagctgcctcagcacggacagctgtacctttggggcaccggtctccttcagcacaatttcacacaacaagacgtcgattctaaaaacgtggcatatcggcattcagggggggacagtcagacagattgtttcacatttatggctacggatggtaccaaccagggcttcattgtgaacggcagagtatgggaggagcctgtattatttactatccaggtcgaccaacttgacaagaccgctccccgaattactttactgcattccccttcccaggtgggactgctgaagaatgggtgctacggcatttacataacaagccgtgtgctgaaggcttccgatcccgacacggaagatgaccagattattttcaagatcttacaaggccccaagcacggacatttagagaacaccaccacaggcgagttcattcacgagaaattcagtcagaaggatttgaactcaaaaaccatcctgtacatcattaacccttcgctggaggtgaacagcgacacggtggagtttcagataatggatcctacaggaaactcagcgacgccccagattcttgagctgaaatggagccacattgagtggtcccagaccgagtatgaggtgtgcgaaaacgtagggctgctcccactagagataatcagacgcggctatagtatggacagcgcttttgtggggattaaggtgaatcaggtctccgccgcagtgggaaaggacttcactgtgattcccagtaagttaatccaattcgatcctggtatgagcacaaagatgtggaacatcgcaattacctacgacgggctggaggaagacgatgaggttttcgaagtgatcctgaacagcccagtgaatgctgtgttgggtacaaagactaaagctgcagtgaaaatactcgactctaagggtggacagtgccatccatcctattcatcaaaccaatccaaacattccacttgggagaagggtatttggcacctgctccccccaggatctagcagcagtaccacttcgggttcatttcacctcgaaagacggcctctcccttcctccatgcagctcgcagtgattagaggagacacgcttcgaggattcgatagcactgacctttcgcagcgaaaattgagaacacgagggaatgggaagactgtgaggccatcttccgtgtaccggaatggaacagacatcatttacaactaccatgggattgtgtctctgaagctggaggatgattcctttcccactcacaagaggaaggccaaggtcagtatcatcagtcagccccagaagaccattaaggttgctgaactgccgcaggcagataaagttgagtctactaccgattcccatttccctcgacaggaccagcttcccagctttcctaaaaattgcacccttgagttgaagggcttgttccactttgaggagggaatccagaaactgtatcaatgcaatggtattgcctggaaagcctggtcaccgcagactaaggacgtagaggacaaatcatgcccggccgggtggcatcagcattcgggatattgccacatcctgataacagagcaaaagggtacatggaacgccgccgcacaggcatgccgggagcaatatctgggcaacctggtgaccgtgtttagtcggcaacacatgcgctggctctgggacattggtggtaggaaatccttttggattggcctgaatgatcaagtgcacgcaggccactgggagtggattgggggtgagccagtggctttcacaaatggccgacgcggcccctctcagaggagcaagcttggcaaatcttgcgtgcttgtgcagagacaggggaagtggcagaccaaggattgcagaagggccaaaccacacaactatgtgtgctcacgaaagctctag

SEQ ID NO: 188277 - DNA, 9510 bp, Artificial Sequence
  Description of Artificial Sequence: Synthetic coding sequence
atgcacagcgccggcacccccggcctgagcagccggcggaccggcaatagcacttctttccagcccgggcctccgcccccccccaggttgcttctgctcctcttactcctgctgtccctggtgagccgtgttcccgctcagccagccgcattcggccgggcactcctcagcccaggccttgcaggggctgctggggtacctgcggaggaagccattgtgcttgccaaccgcggcctgcgggtgccatttggacgggaagtgtggctagacccgcttcacgatctggtactgcaagttcaacccggagatcgctgcgccgtgtccgtgctcgataatgatgcccttgcccagagaccggggagactctcaccgaagcgcttcccctgtgactttggaccaggtgaggtgcggtacagccatctcggcgctcggagcccgagtcgtgatcgggtgcgacttcagcttcgatacgatgcccccggaggagccgttgtcctgccgctggtcctcgaggtagaggtggtctttacgcagctagaggtagtcactcgcaacctgcctctggtggtggaggagctactgggcacctccaacgccctagatgctaggtccctggagttcgcttttcagccagaaactgaggaatgtagggtggggattctatcagggctcggagcattaccgagatacggggagctcctccactacccacaggtacctggaggggcccgggaaggtggggcgcctgaaaccctgctaatggattgcaaggccttccaggagcttggcgttcgctatcgccacacagctgcatcacgctctccgaacagggactggattcctatggtggtggaattgaggtcacggggagcaccggtcggaagtcccgccctgaaacgggaacactttcaggtacttgttaggatacggggaggggcagagaacaccgccccaaaaccttcattcgtggcaatgatgatgatggaggttgatcaatttgtgttaaccgcactaactcccgatatgctggccgcagaggatgctgagagtccttctgacctgctgattttcaaccttacgtccccgttccagccaggtcagggatatctggtctcgacagacgatcgctctttacctctttcctccttcacccagagagatctccgattactcaagatcgcttaccaaccaccctccgaagatagtgaccaggaacggcttttcgagctggaattggaggtggtcgaccttgagggggctgcctccgacccctttgcctttatggtcgtagtcaagcctatgaatacaatggccccagtggtaacccggaacacgggccttatattatatgagggccagtcacggccactgactggcccagctgggagcgggccccagaatctggtcatttccgatgaagacgatctggaggctgtgcggctcgaggtggtggccggcttacggcacgggcatcttgtcattctgggagcatccagcggcagctcggcaccgaaaagttttactgtggccgaactcgccgccgggcaagtggtgtatcaacatgatgatcgcgacggatccttgtcagataacctagttctacggatggttgatggaggagggagacatcaagttcagttcctgtttcctatcacgttggtgccggtggacgaccaaccacctgtactgaatgccaatactggactcaccctggcagaaggggagacagtgccgatcctgcccctgtccctctctgccacagacatggactccgatgacagcctgcttctctttgtgctcgagtctccattccttaccacgggccacctactgctccggcagacacaccccccgcacgaaaagcaagaactgttgcgtggcctctggaggaaagagggggcgttttatgaaagaacggtgactgaatggcagcagcaggatattactgagggcagattattctaccgccattcgggcccacacagcccaggccctgtaacagaccaattcacctttcgcgtgcaagacaatcacgatcccccgaatcagagcggattacagaggtttgtgattcgcatacaccctgtcgatagactgcctcccgaattgggttccgggtgcccactccggatggtggtgcaggagtcacagctcacgccactgcggaaaaagtggctgcgctataccgacctggatactgacgacagggagctcagatatacagtgacacaaagcccgactgacaccgatgaaaatcacctcccagcgcccctcggaacattagttctcacagataatcctagcgtcgttgttacccactttacgcaggcccagattaaccaccacaagatcgcatatagaccccccgggcaggaactcggcgtcgccaccagagtagcccagttccaattccaggttgaagatagagcgggtaacgtagcgcccggcacctttaccctatacctgcatcccgttgacaatcaacctccagaaatcctgaacaccgggtttactatccaggaaaagggccaccatatattatcagaaacagaactgcacgttaacgacgtggacacagatgtcgcccacatcagctttaccctgacacaggccccaaaacacggacatatgagagtgtctgggcagatcctacatgtgggcggtcttttccatctggaagatatcaagcaaggacgagtgagttacgctcataacggggataaaagcctgactgactcctgctccctcgaggtttccgatcggcaccatgtcgtccccataacactccgcgtgaacgtccgtcccgtcgatgacgaagtgccaatactttcccatccgaccggcaccctagaaagctacctggacgtgttagagaatggagctactgagatcaccgcaaacgtcatcaaaggtacgaacgaggaaaccgacgacctgatgcttaccttcctcctggaggatcccccgctgtatggggaaattctggtcaacgggattcccgcagaacagtttacgcaacgagacatcttggagggctccgtcgtctacacacacaccagtggggagatcggtctcttgcccaaggcggatagctttaatctaagtctctcagacatgagccaggagtggcgtataggaggaaatacaattcagggagtaacgatttgggtgactattctgccagtagacagccaagccccagagatttttgtgggcgagcagctgatcgtgatggagggggacaaaagtgtcatcacaagcgtgcacatttccgcagaagacgtggattctctgaatgacgacattctgtgtaccattgtgatccagcctacatctggctatgtcgaaaacatctctccagcccccggatccgagaagtcccgggctggtattgccatcagtgcctttaacctgaaggatctgaggcagggccatattaactacgttcagagtgtgcataaaggcgtggagccggtggaggacaggtttgtattcagatgttcagacggcattaattttagcgaaagacagtttttccctatagtgatcattcccacgaacgacgagcagcccgaaatgttcatgcgcgaattcatggtgatggagggcatgagtctcgtcatcgacactcctatcctgaacgcagccgatgctgacgtgccgttagacgacctgactttcacaataactcaatttcctacccatggacacattatgaaccagcttatcaacggaaccgtcctagtggagtcattcacattggaccagatcatcgaaagcagcagtatcatctatgaacacgacgactcagagacacaggaggactctttcgttatcaaactaacagatggcaagcactccgtcgagaaaacagtattgatcatcgtcatacctgtggacgatgaaactcctagaatgactataaacaacggactcgagatcgagatcggtgataccaagataattaataacaagatactgatggcaacggacctagactctgaggataagtctttagtctatatcataagatacggccccggacacggacttctccaaaggcggaaacctactggagcgtttgaaaatataaccttaggaatgaactttactcaggacgaagtggatcgtaatctgatacagtatgtgcatctggggcaggagggaatacgcgacttgattaagtttgacgttacggatggaatcaacccgctgattgacagatacttttacgtgagcataggatctattgacattgttttccctgatgtgatctctaaaggcgtgagccttaaggagggcggaaaagtcaccctgacaaccgatttgctgtccacttcggatctgaatagtccagacgagaacctcgtgttcaccatcacacgggctcccatgcgggggcacttggagtgtactgaccagcctggtgtgagcatcacaagcttcactcagctgcaactcgccgggaataagatctactacatccatacagccgacgatgaggtgaagatggactcatttgaatttcaggtcacggatggtaggaatcctgtcttccggactttcagaatctcaatcagcgacgtcgataacaaaaagccggtggtgaccatacacaagctcgtggtgtcagagtccgagaacaagttgattaccccatttgagcttaccgttgaagaccgcgacaccccagataaactgctgaaattcacaataactcaggtgcccatacatggccatctgctttttaataatactagacctgttatggtgttcaccaagcaggatctgaatgagaatctcatatcgtacaagcatgatggaacagagtccagcgaggacagcttcagtttcaccgtcactgatggaactcataccgatttttacgtcttcccggatactgtgtttgaaacccggcggcctcaagttatgaagattcaggtgttggccgttgacaattctgtgccccagattgctgtgaacaaaggcgcctccacgcttcggacactcgctaccggccacctgggcttcatgataactagtaagattctcaaggtggaagacagggattctctgcacattagtcttcgcttcatcgtgaccgaggccccgcagcatgggtacctgctgaatcttgataagggtaaccactcgattacacaatttacccaggccgacattgacgatatgaaaatttgctacgtcttgagggagggtgcaaatgctacatccgatatgttctactttgctgtcgaggatggggggggcaacaaacttacctaccaaaattttcgcctgaactgggcttggatttcttttgagaaggagtattatcttgtgaacgaggactcaaaattcctcgacgtcgtcttaaagcgacgtggctacctcggcgagaccagctttattagtattggcactagagatagaacagcggaaaaggataaggattttaaagggaaagcccagaagcaagtccaattcaacccggggcaaactagggcaacatggagggttcgaatcctgtctgacggtgagcatgaacaaagcgaaacctttcaggtggttctgtccgagcccgttctcgccgctttggagttcccaactgtcgctacagtagagatagtcgatccaggtgacgagccgacagtgttcattcctcagtccaaatactctgtggaagaggacgtgggggaacttttcattccaatacggcgctcaggcgacgtgagccaagagctgatggtcgtgtgttatacgcagcagggcaccgccaccgggacagtgccaacgtctgttctcagctattctgactatatttcccggccagaggaccatactagcgtagtgcgcttcgacaaggacgaacgggagaagctgtgccgcatcgtcatcattgacgactcgctgtatgaagaggaagaaacgtttcacgtgttgctgtcgatgcccatggggggccgaataggcagcgagttccctggcgcccaagtgacaatagtgccggacaaagacgacgagccaatcttttacttcggtgacgtggaatatagcgtcgatgagagcgctggttatgtggaggtccaggtgtggcgcactgggactgatctctcaaagtcaagttcggtgactgttagaagccgcaaaacagatcccccgagcgctgacgcaggtaccgactatgtcgggatcagtcggaacctggacttcgctcccggcgttaacatgcagcctgtacgggtggtgattctggacgacttggggcaacctgccctggaaggcatagaaaagttcgaactggtgctcagaatgccaatgaacgccgccctgggcgaaccatccaaggccacagtgtcgattaatgattccgtctccgacctcccaaagatgcagttcaaggaaagaatctataccggtagtgagagtgacggacagatcgtgaccatgattcacaggactggggacgtgcagtacagatcttccgtgagatgctacactagacagggatctgctcaggtaatgatggacttcgaagagcgcccaaacactgatacaagcataatcaccttcttgcccggagaaacagagaagccatgcatcctggagctgatggatgacgtgctatacgaagaggtcgaagaacttcgcctggtgctagggaccccacagtctaactctccttttggggccgccgtgggcgagcagaatgagacactgataagaatccgcgacgacgctgacaagaccgttataaagtttggagagactaaattcagtgtgactgagcccaaggaacccggcgagagtgtggttattcgaattccggtgattaggcagggcgatacatccaaagtcagtatcgtgcgggtgcataccaaggacggctctgccacctctggagaagattatcatcccgtctctgaagagatcgagtttaaagagggcgagactcaacacgtggtggagattgaagtgactttcgatggggtgagggaaatgcgggaggcatttactgtgcatctgaaaccagacgagaatatgattgcagagatgcagctcactaaggctatcgtatacatcgaggagatgagttccatggcagacgtcacatttccttcagtgccccagatagtctcactgctgatgtacgacgataccagtaaggccaaagagtccgctgaacccatgtccggctacccagtcatttgcatcaccgcatgtaatcctaagtatagcgattatgacaagacgggttcaatttgcgcatctgagaatatcaacgataccctgaccaggtatagatggctgatctccgcgccggcaggccctgacggggtgacttcaccgatgcgcgaggtggattttgatacattctttaccagctctaagatggtgacactggactccatatactttcagcccgggagtcgcgtacaatgtgccgcacgtgcggtgaatacaaatggagatgaaggcctggagttgatgtcacccatagtgacaatcagccgcgaggagggcctgtgtcaaccaagagtgcctggagtggttggagccgagcctttttctgcaaagctgagatataccggccccgaggacgcggattatactaatcttatcaagctcaccgtcacgatgccccacattgatggcatgctccccgtgatctctactcgtgagttgtcaaatttcgagctgactctcagtcccgatgggacgagagtcgggaatcataagtgctccaacctgctggactacactgaggtgaaaactcactatggcttcctcacggacgctacaaagaaccctgagattatcggggaaacttacccataccagtattccctcagcataagagggagcaccacgctgcgattttatcggaacctcaacctagaagcttgcctgtgggaattcgtaagctactatgacatgagcgaacttctggccgactgcggtggaaccatagggacggacgggcaagtcctgaacttggttcagagttacgttaccctgcgagtcccgctttacgtaagttacgtattccattcccctgttggggtagggggctggcaacatttcgatctcaaatcggagctgagactgactttcgtttatgacacagcgatcctttggaacgatgggattggatcacccccagaggctgaactccagggcagcttgtacccaactagcatgagaatcggcgatgaaggccgcctggccgtccactttaagactgaggctcagttccacggactgttcgtactgagccaccccgcttcctttacgtcaagtgtgatcatgtcagcggatcatcccggcttaaccttttctctgaggctcatcaggtcagaacccacatacaatcagcctgtacaacaatggtccttcgtaagcgacttcgcggtacgggactatagcggtacatacacagtcaaactcgtgccatgtacagcgccatctcaccaggaatacaggttacccgtgacgtgtaatcctagggaacccgtcacatttgacctggacataagattccagcaggtctctgatcctgttgccgcagaatttagcttaaacacccagatgtacctgctgagcaagaagtccctctggctatccgacggctcaatgggcttcggccaagagtcagacgtagcgttcgccgaaggggatatcatctatggacgcgtcatggtagacccagtacagaatctgggagattctttctactgctcaatcgagaaagtcttcctgtgtacaggggcggatggatacgtaccgaagtattctcccatgaacgctgagtatggctgcctggccgactcaccctcgttactctatagattcaaaattgtcgataaagcacaacccgaaacccaggccaccagctttggaaacgtgctgtttaatgctaaactagctgtcgacgaccccgaggctatcctattagtaaatcaacctggcagcgatgggtttaaggtcgattccactcctcttttccaggttgctctgggccgagaatggtatatccatacaatttacacagttcgcagcaaggataatgccaaccggggcataggtaagcggtccgtcgagtatcattccctggtgtcccagggaaaacctcagagcaccactaaaagccgcaaaaagcgcgagatacgcagtacgccatcactggcttgggagatcggcgcagagaattcaagggggaccaacattcagcatatcgctcttgatagaaccaaaaggcagatccctcatggtcgcgcaccacctgatggtatccttccttgggagcttaactctccttctagcgctgtatccctggtcaccgtcgttggcggcacgactgtcgggctgcttacaatctgcctcaccgtcatcgcagtgctcatgtgccgcggcaaggaatccttccgcgggaaggacgcccccaagggatcctcgtcaagcgagccaatggtgcccccacagagccaccataatgacagttctgaagtgtag

SEQ ID NO: 188278 - DNA, 12039 bp, Artificial Sequence
  Description of Artificial Sequence: Synthetic coding sequence
atgggcgtgctgaaggtgtggctgggcctggccctggccctggccgagttcgccgtcctgccgcatcattccgagggcgcctgtgtatatcaggattctctgctggccgatgctacaatatggaagccagattcctgccaatcttgcaggtgtcacggggacattgtgatttgcaagccagcagtttgccggaatccacaatgcgcgttcgaaaagggcgaagtgctgcagattgcagcaaaccaatgctgccccgaatgcgtattgcggacccccggttcatgtcatcatgagaaaaaaatccacgaacacggtaccgagtgggctagctctccttgcagcgtatgctcatgtaaccacggcgaagtgcggtgtacccctcaaccatgcccacccctcagttgtgggcatcaggagctggcctttatccctgaaggctcttgctgtccagtgtgcgtgggactggggaaaccatgtagttacgagggccatgtgtttcaagacggagaagattggagattgtctcgctgcgccaagtgcctatgtagaaatggcgtggcacagtgtttcaccgcacagtgccaacctctcttttgtaatcaggacgagacagtggttcgcgttcctggaaaatgctgtccccaatgtagcgctcggagctgttcagcagctggccaggtttacgagcacggagaacagtggtccgagaacgcttgtactacatgtatctgcgatcggggcgaggtgaggtgtcataagcaagcgtgcctgccgctgcgctgcgggaaaggtcagtctagagctcgaagacacggccagtgttgtgaggagtgtgtttccccagcaggaagctgtagttatgacggggtggtgcgttatcaggacgagatgtggaagggcagtgcttgcgagttttgcatgtgcgaccatgggcaggtcacatgtcagacaggagagtgcgccaaagtagagtgcgccagggacgaagagttgatccaccttgacggcaaatgctgtcctgagtgcattagtcggaacggatactgcgtgtacgaagagaccggggagtttatgtcttcgaacgcaagcgaagtcaagcggatcccagagggcgaaaagtgggaagatgggccttgtaaagtctgcgagtgccgcggagcccaggtcacatgttatgaaccctcgtgccccccttgtcctgtcgggactttagcattggaggtgaagggccaatgctgccctgactgtaccagtgttcactgtcaccctgactgcctgacctgctctcaatctccggaccactgcgatctgtgccaggacccaaccaagctgttgcagaatggctggtgtgtgcatagttgtggtctgggcttctaccaagctggcagcttatgcctcgcctgccagcctcagtgctctacgtgtaccagtggcctggaatgttcgtcgtgccagccccctctgttgatgaggcatggacagtgcgtacctacatgtggagatggtttctatcaggaccggcatagctgtgctgtttgccatgagtcttgcgccgggtgctggggacctacagagaagcactgcctcgcatgtagagatccactccacgtcctaagagacggcggatgcgagtcttcgtgcgggaaaggcttctataaccggcagggcacctgcagcgcttgtgaccaatcgtgtgactcttgtggcccatccagtcccaggtgccttacgtgcactgagaagaccgttctgcacgacggaaagtgcatgtcagagtgtccgggaggctattatgctgatgctacggggcggtgcaaggtctgtcacaatagctgtgcgtcctgcagtggacctacaccctctcactgtactgcttgctcaccacctaaagccctccggcaaggacattgcctccctaggtgcggcgaaggcttttacagtgatcatggtgtgtgcaaagcttgccactcttcatgtctcgcttgcatgggacctgccccaagccactgcaccggctgcaaaaaacctgaggagggactccaggttgagcaactgagcgatgtgggcatcccatcgggtgagtgcttggcccagtgcagagctcacttttatctggagtccacagggatctgcgaggcatgtcatcagtcttgttttcgctgcgcaggcaagtcgccccacaattgcacagattgcgggccgagccacgtactcctagatggccagtgtctgtcccaatgtcccgatggatattttcatcaggagggcagctgtacggagtgccacccaacctgccggcaatgtcacggccctctagagtcggattgcatttcttgttaccctcacataagtctgactaacggaaactgccgcacctcctgccgcgaagaacagtttctgaacctcgttgggtactgcgcagattgccaccacctatgtcagcattgtgctgctgacttgcacaacaccgggagcatttgcttacggtgccagaacgctcactacctgctgctgggagaccactgcgtgccagactgtccgtctgggtattatgccgagaggggcgcttgcaagaagtgccactccagctgccgtacctgtcaaggccgtggtccttttagctgcagctcatgtgatactaacctcgtgttgtcccacactggaacctgctcgactacttgctttccaggccactatctagacgacaaccacgtttgccagccctgtaacacccactgcgggtcctgcgactctcaggcctcttgcacatcttgccgcgatcccaacaaggtgctcctgtttggcgagtgccagtatgaatcttgcgcgccacagtattatttggatttttcaactaatacctgtaaggagtgtgactggagttgtagcgcttgtagcggtcccctgaagacggattgtctgcagtgcatggatggttacgtgctccaggacggtgcctgcgtggagcagtgcttatcaagcttttaccaggatagtggcctgtgtaagaattgtgacagctactgcctccagtgccaggggccccacgagtgtactcgctgcaaggggccatttctcctgttggaggctcagtgtgtccaagagtgcggcaaaggatacttcgcagatcatgccaagcacaagtgcacggcttgtccacagggatgtttacaatgctcacacagagatcggtgtcatctctgtgatcatggattcttcctgaaatccggcttgtgtgtttataactgcgtaccagggttttccgtgcatacttctaacgagacctgcagcggtaagattcacacacctagtttgcatgtgaatggctctctcatattgcccattggcagtatcaagcccctggattttagcttactgaacgtgcaggaccaagagggcagggttgaggacttactctttcatgtggttagtactcccactaatggtcagctggtcctgagccgaaacggaaaagaggtgcagctggacaaggcagggcggtttagctggaaggatgtgaacgagaagaaagtccgattcgtgcactccaaggagaaactcaggaaaggttatttgtttctgaaaatcagcgaccagcagttcttcagcgagccgcagctgatcaatatccaggccttctccacccaagccccttacgtgttacgtaacgaggtcttacacatcagtcgcggtgagcgcgcaactattaccacacagatgttggatatccgagatgacgacaatccgcaggatgtagtgattgaaatcatcgacccccctctgcatggccagcttttgcagaccctccagtcaccagccacgcccatttatcagtttcaattagacgaactctctagaggtcttctgcactacgctcatgacggaagtgactctacaagcgacgttgcagtgcttcaggccaacgacggccatagtttccacaacatcctctttcaggtcaaaacggttcctcagaacgacaggggtctgcagctcgtggccaactcgatggtttgggttcccgagggtgggatgctccagattactaatcggatcctgcaggccgaagcaccgggagcctctgcggaagagattatttacaaaatcacacaggattacccccagttcggagaggttgtcttgctggttaatatgcctgctgatagccccgccgacgaaggacagcatttgccagatggaagaactgccacgcccactagtacgttcacccagcaggacattaacgagggaatcgtatggtaccggcactctggcgcacccgcacagagtgattcctttcgattcgaagtgtcctcagccagcaatgctcaaactcgattggagagccacatgttcaatatagcgatcctgccgcagaccccggaggctcccaaggtgtcactagaggcctcgctccatatgaccgcaagggaagacggccttacagttatccagccacactctctctcttttatcaactctgaaaagccctccggcaagatcgtgtacaatatcaccctgcctcttcacccaaaccaaggtatcatagagcatagagaccacccacacagtccaatcaggtactttacccaggaggacatcaatcagggcaaggtcatgtatcgcccgccgcctgctgctcctcatctgcaggagttgatggccttttctttcgcaggtctgcccgaatcggtgaagttccactttacagtgtctgatggggaacacactagtcctgagatggttttgaccatccatttattaccgagcgaccagcagttgcctgtgtttcaagttacagccccacgcctcgcagtttcgccaggcgggtccacgtctgtagggttgcaggtcgttgtgcgtgatgccgaaaccgctcccaaggaactgtttttcgaattaagaaggcctccccagcatggagttcttctaaagcacaccgccgagtttaggcgccccatggctactggagatacctttacctacgaagacgtggaaaagaatgctctgcagtacatccatgacggaagctctactagggaggacagcatggaaatttccgtcactgacgggttgacggtcacaatgctcgaggtccgggtggaggtgtctctcagcgaggatcggggacctcggctcgctgctggtagctccctgagcatcacggtcgcgtctaagagcacggccattattacacgctctcatttggcctacgttgacgactcttcacccgatcccgagatttggatacaactgaattatctgccatcatatggtacactgctccgcatctctggttccgaggtggaggagctctcagaagtgtctaacttcactatggaagatattaacaacaagaagatccgttatagcgctgtcttcgagacagatgggcatctggtcaccgacagcttttattttagcgttagtgatatggaccataaccatttagataatcagatattcactattatgatcacacccgccgaaaatcctcccccagtaatcgcctttgctgatctgatcactgtggatgagggggggagggcccctctgtcctttcaccacttttttgcgactgacgacgatgataacttacaacgggacgccatcattaaattatctgcactccctaagtatggttgtattgagaataccgggaccggtgatcggtttggaccggagaccgcatccgatctggaggcaagtttccccatccaggacgtgcttgaaaactacatatactacttccagtcagttcacgagtcaatcgaaccaacccatgatattttctcattttatgtgtcagatggcacatcccgctctgagattcattccattaacatcactatcgaacgcaaaaatgacgaaccacccagaatgactcttcagcccctacgggtacagctcagcagtggcgtcgttatcagcaactctagtctctctttgcaggacctagatacccccgataatgaattgatctttgttctcacaaagaaacccgaccatgggcatgttctgtggaggcagactgcctctgaacccctggaaaacggtcgtgtgttggtccaaggatcaaccttcacctatcaagatatcctggccggacttgtgggctatgtgccaagtgtccccgggatggttgtcgatgagtttcagttttccctgacagatggacttcatgtggacacaggccgcatgaagatctataccgaactaccagcaagcgatacccctcacctcgctattaaccagggtctgcaactgagcgccgggtccgtcgccagaattaccgagcaacacctcaaggtcactgacattgacagcgacgatcatcaagtgatgtatattatgaaggaggaccccggcgccggtcggctgcagatgatgaagcacggcaacctggaacagatcagtatcaaaggccctattcgcagcttcacccaggcagacatctcacagggccacgtggagtattcacatggaactggagagcctggtggcagttttgcttttaaattcgacgtggtcgatggagagggaaacaggttgatcgataaatcctttagcatctccattctggaagacaaatcccccccagtcatcactactaataagggcctggtgctggacgagaattcagtaaaaaaaataactactttgcagctgtcggccactgatcaggacagcggtccaaccgaactgatctacagaatcactcggcaaccacagctcggacacttggagcacgcggcttcccctggcatccagatttcctctttcacccaagccgaccttacctcgaggaacgtgcagtacgttcactcttctgaagctgagaaacatagtgatgctttttcattcaccctgagcgacggcgttagcgaggtgacacagacattccacattacacttcacccagtggacgacagtctcccagtagtccaaaacctggggatgcgcgtgcaggaaggcatgagaaaaactatcacagaattcgagctaaaggctgtggacgccgataccgaagctgaatccgtaacttttacaatagtgcaaccgccccgacatggaacaattgagcgaacgtctaatgggcagcactttcacctgacttccactttcaccatgaaagacatttaccagaacagggtttcatattcacacgacgggtcaaatagcctgaaagacaggttcacattcactgtaagcgatggcactaaccccttcttcattatcgaggaaggcggtaaggaaatcatgaccgcagccccccaacccttccgcgtagacattctccctgtcgatgacggcacgcctagaatcgtgactaatctgggactgcagtggctggagtacatggatggcaaggctacaaatctaattacaaagaaggaactgctgaccatggatccagatacagaagatgctcagttagtgtacgagatcaccacaggacctaaacatggctttgtggagaataaactccaaccagggagagccgctgcaacattcacgcaggaagacgttaatttagggctgatccgatacgtgctgcataaagagaagattagagagatgatggacagcttccagtttctcgttaaagattccaaaccaaacgtggtttcggacaacgtgtttcacatccagtggtccctcatttccttcaagtacacatcttacaatgtctccgaaaaggccggatcagtttccgtgaccgttcagcgaaccggcaacctgaaccagtatgccatcgttttgtgtcgcaccgaacaagggacggcatcttcttcgagtcgggtgagcagccaacccggccagcaggactacgtggaatatgccggtcaagtacaattcgacgaaagggaggatacaaaaagctgcacaatcgttatcaacgatgacgatgtgtttgagaatgtggagtcgttcacagtggagttgtcgatgccagcgtacgccctgctgggcgagttcacacaagccaaggtgattatcaacgatacggaggatgagccgacccttgagttcgacaagaagatctattgggttaatgagagcgctgggttcttgttcgctcccattgaacgcaaaggcgacgcatcctccatagttagcgccatatgctacacagtccccaagtccgccatgggcagctcgctgtatgccttagaatcaggtagcgactttaaatcacgcggcatgtccgcggcgtccagagtgatcttcggacctggcgtcaccatgtccacctgcgacgtgatgcttatagacgacagcgagtatgaagaagaggaggagttcgaaatcgctctcgccgacgcgtccgataacgcgcgcatcggcagggtggcgactgcaaaagtgcttattagtgggccgaatgacgctagcactgtcagtctggggaacactgccttcaccgtgagcgaggacgccggcactgtcaagataccagtaattaggcatggcactgacttgtctaccttcgccagcgtttggtgcgccacacgtccgagcgatccggcatccgccacccctggggtggactacgtcccgtctagtcggaaagtggagttcgggcctggtgtgattgagcaatattgcactttgacgattcttgacgacactcaataccccgtgatcgaaggcctggagaccttcgttgtgttcctgtcatcagcacagggagccgaattgacaaagcccttccaagccgttatcgcaatcaacgacacatttcaagatgttccttcaatgcagttcgcaaaagatttgctcctggttaaggagaaagagggtgtgcttcatgtcccgattacaagaagcggagatttgagttatgagtcatccgttcgctgctacacccagagtcatagcgcccaagttatggaagactttgaagagcggcagaatgctgacagctctcgcattacattcctgaagggagacaaagtgaaaaattgtacagtgtatattcacgatgactctatgttcgagccagaagaacaattccgcgtatatttgggtttgccgctcggaaatcactggagcggcgccaggattggcaaaaataacatggcaaccatcaccatctctaacgatgaagacgcccccacgatcgaattcgaggaggcagcgtaccaggtgcgtgagcctgcaggccctgacgctatcgctatcctgaacattaaggttattaggcgaggcgaccagaataggacatcaaaggtcagatgttcaactagggatgggagcgcccaatctggtgtggattactacccaaaatcccgggtactgaaattctctcccggagtcgatcacattttctttaaggtggagattctgagtaacgaggatagggagtggcacgaatcattctctttggttttaggccctgacgaccccgtagaggcagtattgggtgatgtgacaaccgccaccgtgacaatactggaccaggaggccgcgggttccctgattttaccagcacctccaatcgtggttacgctggccgattatgaccatgtggaagaggtgactaaggagggcgtcaaaaagagtccctctcccggctatccgctggtatgcgttaccccctgtgatccccacttccctcggtatgccgtcatgaaggaacgctgctctgaggcaggcattaatcagacctcggtgcagttctcttgggaagtggcagcccccacagatggcaacggcgcgcgcagcccctttgagacaattactgataacacccctttcacatccgttaaccacatggtcctggatagtatttattttagccgaagatttcacgtgaggtgcgtcgctaaagcggtagataaggttggccacgtcgggactccattgcgttctaatatcgtcacgatcggcaccgacagcgcaatttgtcacaccccagtggtggcgggcacttcacgcgggtttcaggcccagagctttatcgccactctgaaatatcttgacgtgaaacataaagaacaccctaatcgcattcatatatccgtgcagatcccacaccaagatggaatgcttcccctgatttctaccatgcctcttcataaccttcacttcttgctgtccgaatctatatacaggcaccagcatgtgtgttccaatctggtgacaacttacgatctcaggggtattagcgaggccgggtttctcgatgacgtggtctacgactccaccgccttaggacccggttatgacaggccttttcagttcgatccctcagtccgcgaacccaaaacaattcagttgtataaacatctaaatctaaagtcttgtgtttggacctttgacgcctattacgatatgaccgagctcattgatgtttgcggtgggtctgtgacggctgattttcaagtcagagactctgcccagtcttttctgacagtgcacgtgcctctatacgtttcctacatctatgtaactgctccacgcggttgggcaagcttggagcaccacacggagatggaattctccttcttttacgacacagtgttatggaggacagggatccaaactgacagcgttctttcggcgagactccaaatcatcagaatttacattcgcgaagacggtcgtctggtcattgaattcaaaacacacgctaaattcagggggcagttcgtgatggagcaccatacattaccagaggtgaagtcttttgttctgacccctgatcatttgggagggatcgaatttgaccttcagttattgtggtcagcccaaacctttgatagcccccatcagctatggcgagccactagttcttacaaccgaaaagattattctggcgagtacactatatacctcattccatgtacagttcagcctactcagccttgggtggaccctggcgagaaaccactagcctgcaccgcgcacgcccccgagcggttccttattcccattgcctttcagcagactaatagacctgtcccggtcgtgtactcacttaatacggaatttcagctgtgcaataatgaaaaagtctttctcatggatccaaatacatccgacatgtctctggcggaaatggactacaagggagccttcagtaaaggccagatcttatacgggagagtgttatggaaccccgaacagaacctgaattcagcctacaagctgcagctcgagaaggtttacctgtgcactggtaaagacgggtatgtgccgttcttcgatccgacaggcacaatttataacgaaggccctcagtatggatgcatccagcccaacaaacacttgaagcatagattcctcctactcgaccgtaatcagcccgaggttacagataaatacttccatgatgtgccatttgaagcgcactttgcctcggagctcccagatttccacgtcgttagcaatatgcccggcgtggatgggttcacccttaaggtggatgctctgtataaagtagaggccggtcatcagtggtacttacaagtaatctacatcattgggcccgatactatcagcgggcctagggttcaaagatctcttacggctcctctgcgccggaaccggcgggatctggtcgagccggacgggcagttgattctggatgattctctcatctatgataacgaaggagaccaggtcaagaatgggaccaatatgaagtctctgaacctagaaatgcaggagcttgcggtggcggcctccctctcacaaaccggagcttctattgggtctgccctggccgcgatcatgttactgcttctggtgttcctggtggcctgctttatcaatcgcaagtgccaaaaacagcggaaaaaaaagcctgcagaagacatccttgaagagtacccactgaacacaaaggtcgaagtgcctaaacggcaccctgacagagtggagaagaacgttaacaggcactactgcactgtgcggaacgtgaacatcctttcagagcctgaggccgcgtacacattcaagggcgccaaagtgaagaggcttaatctcgaggtgcgggtgcataataacctccaggatggcactgaggtgtag

SEQ ID NO: 188279 - DNA, 2214 bp, Artificial Sequence
  Description of Artificial Sequence: Synthetic coding sequence
atgggcgtgctgaaggtgtggctgggcctggccctggccctggccgagttcgcagtgttaccccaccactcggaaggtgcctgcgtttatcaggatagtctcctggccgatgcaactatatggaaacctgacagttgtcaaagctgtaggtgtcatggggacatcgtgatatgtaaacccgcagtatgccggaatccacaatgtgcattcgaaaaaggtgaagtcctgcaaatcgccgccaatcagtgctgtccagagtgtgtccttcggacaccgggctcgtgtcaccacgaaaagaaaatccacgaacatggcaccgagtgggcttcctccccttgctcagtgtgttcctgcaatcacggagaggtgaggtgtaccccccagccttgcccgccactctcctgcgggcatcaggaattggcttttatccccgagggctcctgctgccccgtctgtgtaggattaggcaaaccgtgcagctacgaagggcacgtctttcaggacggcgaggactggcggctgtcacgctgtgccaaatgcctgtgcaggaatggagtcgctcaatgctttactgctcaatgccaacccttgttttgcaatcaggatgagacagtggtgcgtgtgcctggcaagtgctgtccacagtgctctgcccgctcttgcagtgctgcaggccaggtctatgagcacggcgaacagtggagcgagaatgcgtgcactacttgcatatgtgatcgaggagaggtgcgctgccacaaacaggcctgtcttccgctcagatgcggcaaggggcagagtagggccagacgtcacgggcagtgctgcgaggagtgcgttagcccagcgggctcctgcagctacgatggggtggtcagataccaggatgagatgtggaaaggaagcgcctgcgaattttgtatgtgtgatcacggccaggtgacctgccagacaggagagtgtgcaaaagttgagtgcgctagagatgaagaactgatacacctcgacggcaaatgctgcccagaatgtatatcccgaaatgggtactgtgtctatgaggagactggtgagtttatgagttccaatgccagcgaagttaagcgtatccccgaaggcgaaaaatgggaagacgggccttgtaaagtttgtgaatgccgtggagcacaagtaacctgttacgaaccttcctgccccccatgtcccgtgggtactcttgccctagaagtgaagggtcaatgttgtcccgactgtacgtcagtccattgtcatcccgattgtcttacttgcagtcagagcccagatcattgtgacctatgtcaggatcctacaaaactgctccagaatggctggtgcgtccattcgtgtggacttggcttttatcaggccggctcactttgtttagcatgccagccgcaatgttccacttgcacctcaggactggaatgtagcagctgtcagccaccactgttaatgagacatggacaatgtgttccaacctgtggcgatggcttttatcaggatcgccactcctgtgccgtctgccacgaaagctgcgcgggatgctggggacccacggagaagcattgcctggcctgtagagaccctttgcatgtgctccgcgatggggggtgcgaaagcagttgtggaaagggattttacaatagacaaggcacctgctcggcgtgcgatcagagctgtgactcatgtggaccctcttcgcctaggtgtctgacatgcactgagaaaacggtgctccacgatggaaaatgcatgtccgagtgccctggcggttactacgcggatgcaacggggcgctgtaaagtgtgccacaactcttgtgcctcttgcagcgggccaacccctagtcactgtaccgcttgcagcccgccaaaagctctgaggcagggacattgtcttcccaggtgcggagaaggtttctacagtgatcatggagtttgtaaggcctgtcattctagctgcctcgcctgcatgggtccagctcccagtcactgcaccgggtgcaaaaagcctgaagaaggattgcaagtcgagcagctcagcgacgtcgggattccatcaggggagtgtctcgcgcagtgtagggcccacttctatctggagagcaccggaatttgtgagggccaaaacctggatttctgccagaatcttgaggttatcagtgctgtctgtctgggaataagtagcacggaaaactag

SEQ ID NO: 188280 - DNA, 954 bp, Artificial Sequence
  Description of Artificial Sequence: Synthetic coding sequence
atgggcgtgctgaaggtgtggctgggcctggccctggccctggccgagtttgccgtccttccacaccactccgagggcgcctgcgtttatcaggactccttactcgctgacgcaactatttggaagccggatagctgccagagttgccgatgtcacggagatattgtcatttgtaagcccgctgtttgtagaaatcctcaatgcgcatttgagaagggcgaagtgctacagatagccgctaatcagtgttgtcccgaatgtgtgctgcgcacccccggaagttgccaccatgagaaaaaaattcatgagcacggcacagaatgggcaagtagtccgtgtagcgtgtgcagctgcaaccacggcgaagtgagatgcaccccgcaaccctgtccaccactatcttgtggacaccaagagcttgccttcatcccagagggttcatgctgcccggtgtgcgtggggctggggaagccttgttcctatgaggggcacgtttttcaggacggagaggactggagactctcacgctgtgccaagtgcttgtgtcggaatggcgtggcacagtgctttactgctcagtgccagccgttattctgcaaccaggatgaaaccgttgtacgcgtcccgggtaagtgctgcccccaatgcagtgctcgttcttgctccgccgcagggcaggtgtatgagcacggggagcagtggagcgagaatgcttgcacaacttgtatctgtgaccgcggagaggttcggtgccataaacaggcatgtctgcccttgagatgcgggaaagggcagagtcgggcccgcagacacgggcagtgctgcgaggagtgtgtaagtcctgccttggcctcgcagagcgttgggataacaggcatgtcccaccacgcccagagccttctggggccttttctgacccagatcaagaagccgcacttctcttgccttgagtag

SEQ ID NO: 188281 - DNA, 6726 bp, Artificial Sequence
  Description of Artificial Sequence: Synthetic coding sequence
tgaagcgaggtgagcaacttcaccatggaggacatcaacaacaagaaaatccgctacagtgctgtcttcgagactgatgggcatctggtgactgacagcttctacttctccgtgtctgacatggaccataaccacctcgacaatcaaatctttacaattatgataacgccagctgaaaacccacctcctgtcatcgccttcgccgatttgatcactgtggatgagggtggcagggcacccttgagtttccatcacttctttgcaactgatgatgacgataacctccaacgggacgcaattataaaacttagtgctttgccgaaatacggctgcatagagaacacaggcacaggggatcgcttcggccccgaaacggcctctgacctggaagcatcattccctatacaggatgtgttagagaattatatctactatttccagagcgttcacgaatccatcgaacctacacacgacatcttctctttttatgttagcgatgggacctccagatcagagatccacagtattaatatcactatcgagcggaaaaatgatgagccaccgcgcatgactcttcagccactcagagtgcaactgtcatccggagtagtgatcagtaactcatccctttccctgcaggatctggatacccccgacaacgagctgatattcgtactgactaagaaacccgatcacggacatgtcctctggcgccagactgcatccgagccactcgagaacggcagagttttagtacaagggtcaaccttcacatatcaggatatccttgctggattagtgggatatgttcccagcgtacctggaatggtcgtcgacgaatttcaattcagtttgactgacggcctccatgtcgataccggccggatgaaaatatataccgagctgcctgcaagtgacacgccccacttggcgatcaaccaggggttgcagttatccgccgggtctgtggcccgcataactgagcaacacttaaaagtaactgatatcgacagtgacgaccaccaggttatgtacataatgaaggaggacccaggcgctggccgactccagatgatgaagcacggtaacctggaacagatcagcattaaaggcccaattcggagctttacccaggccgatattagtcaaggccacgtcgaatactcgcatggtacaggcgagccaggagggagtttcgcttttaaattcgatgtggttgatggcgaaggcaaccgtctgatcgacaaatccttttcaatttcaattctggaggacaagagccctcctgtgattacaacaaacaagggcttggtgctggacgagaactcagtaaagaaaatcacaactctacagttaagtgcaaccgaccaggatagcgggcccaccgagctgatttaccgtattacgaggcagccccagctgggccatctggagcatgcggcctcgcccggcattcagattagctcatttacacaagctgaccttaccagtcgcaacgtccagtacgtacattcttcggaagctgagaagcattctgatgccttctcattcaccctgtcagacggcgtctccgaagtgacccagaccttccacatcacgctgcaccccgtggatgattctttaccggtggtgcagaatctaggcatgcgtgtacaagaagggatgcgaaagacaatcacagagtttgagctgaaggccgtggacgcagacaccgaggctgagtctgtcacatttacaatcgtccagccaccccgtcacggtaccatcgaaaggacctctaacggacagcattttcatctaacgtcaacctttactatgaaggacatctaccagaatcgggtcagctacagtcatgacggatccaacagcttaaaggaccgattcacattcacagtttcggatgggacgaaccccttttttataatcgaagagggcggtaaggagattatgaccgccgctccgcagccctttcgggtcgacatcttacctgtggacgatggtacgccaagaatcgtaacaaacctggggcttcagtggttagagtatatggatggcaaggctacaaatctgatcacaaagaaggagctgctgaccatggaccctgatacagaagatgcacagctggtgtatgagattaccaccggccctaagcatggattcgttgagaataaattgcaacccggtcgcgccgctgccaccttcacccaggaggacgtgaatctgggcttaattcgctacgtgcttcataaggagaagatccgtgagatgatggatagtttccaattcctcgtaaaggatagtaaaccaaacgttgtctccgataatgtgtttcacattcagtggtctctgattagtttcaaatacacttcttataatgtttctgaaaaagctggatcagtgagtgtcaccgtgcaacggactggaaatctgaaccagtatgcaattgtactgtgtagaaccgaacagggcactgctagtagcagcagccgcgtctccagccagccaggtcagcaagactacgtggaatacgcagggcaagtccagttcgacgagagagaagacaccaaaagctgtaccatcgtcatcaatgacgatgatgtatttgaaaacgtagaaagtttcacagtcgaacttagcatgcctgcctatgctcttctcggcgagtttacacaggctaaggtaatcatcaacgatacagaagacgaacctacgttggagttcgataaaaagatctactgggtgaacgaaagcgccggctttctctttgctcccatcgaacgaaaaggggatgcaagctccatagtgtccgccatctgttatactgtgcctaagagcgcaatgggaagctctctgtacgccctggagtcgggcagcgactttaagagcaggggcatgtcagctgcatcccgagttattttcgggcccggggtaactatgtcaacatgcgatgtcatgctgatcgatgattccgagtacgaagaggaggaagagtttgagatcgccctggctgacgctagcgacaatgcccgtatcggccgtgtggccactgccaaggtcttgatttccgggcccaacgatgcctctacggtaagccttggcaacaccgcgttcacagtgtctgaggatgctggtaccgtgaagattcccgtgattcgacatggaactgacctgtcaacttttgcttccgtctggtgtgctacgagaccctcagatccagcatccgccacgccaggggtcgactatgtcccttctagccgcaaagtggaatttggacccggcgtgattgaacagtattgcacacttacaatattggacgatacccaatacccagtaatcgagggcttggaaacattcgtcgtttttctctcatccgcacagggtgccgagcttaccaaaccctttcaggccgtgatagctatcaacgacacattccaggatgtaccttccatgcagtttgcaaaggacttattgttggttaaggagaaggaaggagttcttcatgtgcctatcactaggagcggcgatctgagctatgaatctagcgtccgatgctacacacaaagtcatagcgctcaggtgatggaagattttgaagaaaggcaaaatgccgacagctctaggatcacttttcttaaaggggataaggtcaagaactgtaccgtgtatatccacgacgacagcatgttcgaaccagaggaacaatttcgtgtgtacttaggtctgccactgggcaatcattggtcaggcgcccggataggaaagaacaacatggctaccattacgatttccaatgatgaagatgcacccaccatcgagttcgaggaggcggcttaccaagtaagggagcctgccggtcccgacgccattgccatcctaaacattaaggttatcagacggggagatcaaaataggacctctaaggtgaggtgctcaacacgcgatggtagcgcacagtcaggtgtcgactactacccaaaatcaagagttctgaaattcagtcctggagtggatcacattttcttcaaggtggagatattgagtaatgaagaccgtgaatggcacgaaagttttagtcttgtgcttggtcctgacgatccggtggaagccgtgcttggcgatgtgaccacggcaaccgtcaccatcctggatcaggaggctgccggaagtctgattctccccgctcctcccatcgtagtaaccctagctgactacgatcatgtggaggaagtgactaaggagggcgttaagaagtctccaagcccagggtatccactcgtctgcgtaacaccatgcgacccacactttccccggtacgctgtgatgaaggagcgttgtagcgaagcgggaatcaaccagacatctgtgcagttctcctgggaggttgctgcccctactgacggtaacggcgcccggagtcctttcgagactatcacggacaatacgccctttacttctgtgaatcatatggtcctggacagtatctacttctcacggcgctttcacgtcaggtgcgtggcaaaggccgtggataaggtggggcatgtgggcacccctctgaggtcaaatatcgtgaccatcggaactgactccgcgatctgccacaccccagtggtggccggaacctcccgtggattccaggctcagtctttcatcgctacactcaagtacctggacgttaagcacaaggagcacccaaatcgcatccatatcagcgttcaaattccccatcaagatggcatgctaccactgataagtacaatgcctctgcataacctgcattttctactgtccgagtcaatatatcggcaccagcacgtctgtagcaacctcgtgaccacatatgacctcagggggattagcgaagccgggttcctggatgatgtggtttatgacagcactgcactgggccccggatacgacaggccgttccaatttgatccatcggtgagggagccaaagaccatccagctttataaacatctcaatcttaagagctgcgtttggaccttcgacgcctattacgatatgaccgaattaatcgatgtgtgcggaggctcagtcacagccgattttcaggtccgcgacagtgcccagagttttcttactgtccacgttccactctacgtgtcttacatctacgtgactgctcctcgaggctgggccagcttagaacaccatacagagatggagttctccttcttttatgataccgtgctgtggcgcactggcatccagaccgactcagtgctctcggccaggcttcagataatcagaatctatattcgcgaggatgggcggctcgtgatcgagttcaaaacacacgcgaagttcaggggacaatttgtgatggaacaccataccctgcccgaggtgaaaagctttgttctgactcccgaccacctgggaggaattgaattcgatctgcagctcttgtggtccgctcagacctttgattctccgcaccaattatggcgcgctacatcatcgtacaataggaaagactatagcggcgaatacacgatctacttgattccatgcactgtgcaacctactcagccttgggtcgacccaggcgaaaaacctcttgcttgtactgcacacgctcccgagcgattcctgatccctatcgcgtttcagcagaccaaccggccagtccctgttgtatatagcctaaacactgagtttcagttgtgcaacaacgaaaaagtgtttttaatggaccccaatacatcggatatgtccctcgcggagatggactacaagggggcctttagtaaaggacaaattctgtacggaagggtgctttggaaccccgaacagaatcttaatagtgcgtacaagctccagctggaaaaggtctacttatgtacagggaaggacgggtacgtgccctttttcgatcccacggggaccatttacaacgagggaccccaatatggctgtatccagccaaacaaacacctgaagcatcggttccttctgttagaccggaatcagccagaggtgactgacaaatattttcacgatgttccatttgaagcccacttcgcatccgaattgcctgactttcatgttgtgagcaacatgcccggtgttgatggtttcacactgaaggtagatgccctctataaggtggaagccgggcaccaatggtacctccaggttatttatattattgggcccgacaccatctcagggcctagggtgcagcgctctctgactgcacccttgcggcggaatagacgcgatctggttgagcccgatggccagctgatcttagacgactccttgatttatgataatgaaggggatcaggtgaagaatggcacaaatatgaagtccttgaacttggagatgcaggaactcgctgtagcggcgtccctgagccagacaggcgcgtctatcggttccgcgctggctgcgattatgctgctgttgcttgtgttcctggtagcttgttttattaaccggaaatgccagaaacagagaaagaagaaacccgcggaggatatcctggaagagtatcctttaaataccaaagtggaggtccccaaacgtcatcccgaccgggtcgagaaaaacgttaataggcattactgtactgtgcggaacgtcaatattctgagtgagccggaagccgcttacacctttaagggggcaaaggtaaagcgtctaaacctcgaagtgcgtgtgcacaataatctccaggacggcactgaggtctag

SEQ ID NO: 188282 - DNA, 768 bp, Artificial Sequence
  Description of Artificial Sequence: Synthetic coding sequence
gagcggcagggccagagccgggcccggcggcacggccagtgctgcgaagaatgtgtatcgccggccgggtcatgtagctatgacggcgtggtccgctatcaagatgagatgtggaaaggttctgcttgtgagttttgtatgtgcgaccatgggcaagtcacctgccaaacgggggaatgcgcgaaggtggagtgcgctagggacgaggaactcattcaccttgacggcaagtgctgtcccgagtgcatttctcgcaatgggtattgtgtgtacgaggaaaccggcgaattcatgagctctaacgcttcagaagtcaaacggattcctgaaggcgagaaatgggaggacggcccgtgcaaagtctgcgaatgcagaggagcgcaagtcacctgctatgagccctcttgccccccatgtccagtcgggacactggccctggaagttaagggtcaatgttgccctgattgcactagcgtgcattgtcatcccgactgcctgacctgcagccagtcccctgaccactgcgatctgtgccaggaccccacaaagttgctgcagaacgggtggtgtgtgcattcttgtgggctggggttttaccaggccggcagcttgtgcctcgatgacggattcagccttccagctccggtcttgcacgtctaccagtgggccggtgtgcttatcctccccgcgtccccagcagacgccgctagggctgtgtgtgcgtatctttggggacgcttactgccacgatctccatttctgtgctag

SEQ ID NO: 188283 - DNA, 840 bp, Artificial Sequence
  Description of Artificial Sequence: Synthetic coding sequence
atggtgctgaccatccacctgctgcccagcgaccagcagctgcccgtttttcaagtgactgcccctcggcttgccgtgtcgccaggcggatcaacctcggtcgggttgcaggttgtcgtgagggacgccgaaactgcacctaaggaactattcttcgaactcaggcgtcctccgcagcacggcgtgcttctgaagcacaccgcggagttcagacgcccgatggctacaggagatacttttacctatgaggacgttgaaaagaacgcgctgcagtatatccacgacggcagctccacacgcgaggatagtatggagatttcagtgacggacggtctgactgtgaccatgctggaggtgcgtgtggaagtctccttgtccgaggacaggggacctaggctggccgccggtagttctctctctataacggtggcgagcaagtccacagcaatcattacaagatctcatctggcctacgtggacgactccagtccagaccctgagatctggattcagcttaactacctgccatcttacggcacactgcttcggatctccggttccgaggttgaggagttgtccgaggtctctaacttcacgatggaggacattaacaacaagaagataaggtatagcgccgtgttcgagactgacgggcatctcgtcacagatagcttctacttttccgtctcagatatggatcataaccatctcgataatcagatattcacaatcatgattaccccggctgaaaatcccccaccagtaatcgcatttgccgacctcataacagtagacgaaggggggagggcacccctgtcttttcaccacttctgctattag

SEQ ID NO: 188284 - DNA, 5931 bp, Artificial Sequence
  Description of Artificial Sequence: Synthetic coding sequence
atgggcgtgctgaaggtgtggctgggcctggccctggccctggccgagtttgccgttctgcctcaccatagcgagggggcctgtgtgtatcaggattcacttctggctgacgctaccatttggaaacctgatagctgtcaaagttgtcggtgtcacggcgatatagtaatttgcaaaccggctgtgtgcaggaacccccagtgtgctttcgaaaaaggagaagtgctccagattgccgctaaccagtgctgtccagaatgtgtgctccggacgccaggaagctgtcaccatgaaaagaaaatccatgagcatggcactgagtgggctagctctccatgcagcgtgtgctcctgtaaccacggggaggtgcgatgcactccgcagccatgccccccactctcttgtggtcatcaggagctagccttcatacccgaggggagctgttgtcccgtctgtgtgggactcgggaaaccctgtagctacgaaggccatgtcttccaagacggggaggattggcgcctaagtagatgcgcaaagtgcttatgtcgcaatggagtggcccagtgtttcacagcacaatgccagccattattctgtaaccaggacgagacagtggtgagggtgcccggaaaatgttgtccccagtgttctgccaggagctgtagcgcggcgggacaggtgtatgagcacggggaacagtggtcagagaacgcttgcacaacatgcatttgtgataggggcgaggtcagatgccataagcaggcttgtctaccactccgttgtggcaaaggtcagtccagggcacggcggcatggccaatgctgtgaagagtgcgtgagtcctgccggctcctgttcttatgatggtgttgtgaggtatcaggatgaaatgtggaagggatccgcatgtgagttctgtatgtgcgaccacggccaagtgacttgccagactggtgaatgcgctaaagtcgagtgtgcgcgtgacgaggaattgatacacctggacggaaaatgctgtcccgagtgtatttctcgcaatggctactgcgtgtacgaagaaaccggagagttcatgagttctaatgcctccgaggtgaaaaggattcctgaaggtgagaagtgggaggatggaccgtgcaaggtttgcgaatgtaggggagcccaggtaacatgctacgaaccaagctgtcccccttgccctgtgggtacactcgccctcgaggtcaaggggcagtgctgtcccgactgcacctcggtgcactgccacccagattgcttgacctgtagccagtctcccgatcactgcgatctctgccaggacccaacaaaactcctccagaacggatggtgcgtgcacagctgtgggttagggttctaccaggcgggaagcttgtgcctggcatgccagcctcaatgcagcacttgtacctcaggcctggaatgtagcagctgtcaaccccccctcctcatgcggcacggtcagtgcgtgccaacttgcggcgacggcttctatcaggaccggcatagctgcgctgtgtgtcacgaatcctgtgcaggatgctggggcccgacagaaaaacactgcctcgcctgtcgcgacccactgcacgtgctgcgggacggaggctgtgaaagctcatgtggcaaggggttctataaccggcagggcacctgctcagcttgcgaccagtcgtgtgacagctgcggaccttccagtccgaggtgtttgacctgcactgaaaaaaccgtgttgcatgacggcaagtgtatgtctgaatgtccaggcggatactacgctgatgcaacgggaagatgtaaggtgtgccataactcttgcgcgagctgtagcggacccacaccttcacattgtacggcgtgctcaccccccaaggctctgcgccaagggcactgcctgcccagatgtggagaaggattttattccgaccatggagtctgtaaggcttgccactcctcatgcctagcatgtatgggcccggcaccttcccactgtactggctgtaagaagcctgaggaaggcctgcaagttgaacagttgagcgacgtcggcattccctcaggcgaatgtcttgctcagtgtcgagctcatttttatttggagagcacagggatatgtgaggcttgccatcaatcctgcttcagatgtgcaggaaaaagccctcataattgcacagactgtggccctagccacgttcttctagacgggcagtgtctctcccagtgtccagatggatacttccaccaggaagggagctgcacggagtgccatccaacctgccggcagtgtcacggtcctcttgagagtgattgcataagctgttatccacatatttccctgaccaacggcaattgtcgaacatcttgtagggaggaacagttcctcaatctcgttgggtactgtgccgactgccatcatctgtgtcagcactgcgcggccgatttacacaacaccggatccatctgtttgcgctgccaaaacgcacactacctccttctcggcgaccattgcgtacccgactgccccagtgggtactacgcggagcgcggagcttgtaaaaaatgtcacagctcttgcagaacttgtcaaggccgaggcccgttttcgtgctcatcttgtgacactaatctggtgctgtctcatacaggcacttgctccacaacctgcttccctggtcactacctggatgataaccatgtgtgtcaaccttgtaacactcactgcgggtcgtgtgacagccaggcaagctgcaccagttgtagggaccctaacaaggtgctgctctttggggaatgccagtacgagtcctgtgcgccccaatattacttagactttagcaccaacacgtgcaaggaatgcgactggtcttgctctgcttgtagcgggcctcttaagacggactgtctgcagtgcatggatggctatgtactgcaagatggcgcgtgtgttgagcagtgtctgtcatcattttatcaggatagtggcctgtgtaaaaactgtgattcatactgcttgcagtgtcagggacctcatgagtgtacccgttgcaaaggacctttccttttgctggaggctcaatgcgtgcaggagtgcgggaagggatactttgctgaccatgccaaacataaatgcaccgcctgtccccaggggtgtctgcaatgctctcaccgcgaccgctgtcacttgtgtgaccacggatttttcctgaaatccggcctctgcgtttacaattgcgtccccggcttctcagtgcacactagtaatgagacctgcagcggtaaaattcatacgccttccttgcacgtgaacgggagtctgatcctgcccataggatctatcaaaccgcttgatttttccctgctgaatgtccaggaccaggaaggacgtgtggaggatcttctgtttcacgtggtgagcactcctaccaatggtcagctcgtgctctctcgtaatgggaaggaagtgcagcttgacaaggctgggcgcttctcttggaaggacgttaacgagaagaaggtcagattcgtccactccaaagaaaaactaaggaagggctacctatttctcaagatttctgatcaacagttttttagtgaaccccagttaatcaacattcaggcattctcgactcaggctccctatgtgttaagaaatgaggttctgcatatcagtcgtggcgaacgcgccaccatcacgacacaaatgctggatattagagatgacgacaatccacaggacgtggttatcgagattatagatccccccctgcacggtcagttactccagaccttacaaagtcccgccacgcccatctatcagtttcagctcgacgaactgagccgcgggctgttacattatgctcatgacggatccgacagcaccagcgatgtggccgtcttgcaggccaatgacggtcatagcttccacaacattctttttcaggtcaaaacagtgccgcagaacgaccggggcctacagttagttgcaaattctatggtgtgggtgcctgaggggggtatgctccagatcacaaatcggattctccaggcagaagccccaggagcctctgcggaagagattatttacaagatcacacaggactaccctcagtttggtgaagttgtcctcttagttaatatgcccgccgactcgcctgctgacgagggccagcacctccccgacggccgtactgccaccccaacctcaacctttactcaacaggatattaacgaggggatcgtttggtacagacactctggagcccccgcccagagcgattccttccgcttcgaagtaagtagcgcaagcaacgcccagaccagactggagagtcatatgtttaatatcgccattctaccacagacgcctgaagcaccaaaagtgtcgttagaggcatctctacatatgacagcgcgcgaagatgggctgactgtgattcagccccattccctgtcttttatcaactctgaaaagccttccggaaagattgtgtacaatatcacacttcccctccatcctaaccaggggattatcgagcaccgagaccatcctcattcaccaatcaggtattttactcaggaggatatcaaccaggggaaagtcatgtacagacctccacctgcagctccgcatctgcaggaattaatggccttctccttcgcgggcctccctgaaagcgtaaagttccattttacagttagcgacggagaacatacctccccagagatggtgttgacaatccacctcctccctagtgatcagcagcttcccgtctttcaggtaactgctcccagactagcggtgagccccggtggaagtacgtcggttgggctgcaagttgtggtgagagatgccgagactgcacctaaggaactgttctttgagcttcgcagaccacctcagcacggtgtgttgctgaagcataccgccgagttccggcgcccgatggcgactggggacacattcacatacgaagatgtggagaagaacgcccttcagtatattcatgacgggtcaagcactcgcgaagattctatggaaatttccgtgacagacggtctaacggtaacgatgttggaagtgcgggtggaggtctccttgtccgaagaccgcggtccacgcctcgcggcaggcagtagcctttctatcactgtggcaagcaaatccaccgcaattataactcgatcacatttggcctatgtagacgattcatctcccgatcccgagatctggatccagctaaattatctgccgtcatacggcaccttactgcgaatttctggatcggaagtggaggagctgtcggaggtgtcgaattttacaatggaagatattaacaataagaaaattcgatatagcgcagtgttcgaaaccgacggacatctcgtgacggacagcttttactttagcgtctccgatatggaccataatcacctcgataaccagatattcacaataatgatcacgcctgccgaaaaccccccgccagtaatagcattcgcggacctgatcaccgtcgacgagggggggagagctccgttaagcttccatcatttctttgctaccgatgacgacgacaatctccagcgcgacgccattatcaagctatctgcgcttccgaaatatgggtgcattgaaaacaccggaaccggggaccgctttggcccggagaccgctagcgatcttgaagcttcattcccaattcaggacgtgctcgagaattacatttactacttccaatctgtacacgagagcattgagcccacacacgacatcttttccttctacgtgtcagatggaacctcacgcagtgaaattcattctatcaacatcaccattgaagtcaagaccctggaggtcggtaaggtagagcccctaaccaccatcttccacacgattagagaactttcgctgtag

SEQ ID NO: 188285 - DNA, 633 bp, Artificial Sequence
  Description of Artificial Sequence: Synthetic coding sequence
atgtggaccctgggccggcgggccgtggccggcctgctggccagccctagccccgcacaagcacaaaccctgactcgggtgcctaggccggccgaacttgcgccattgtgcggcagacgagggctgagaaccgacatagatgccacctgtacaccacgccgagcttccagcaatcagagagggctcaatcagatctggaatgtcaagaagcagagtgtgtacctcatgaatctccgtaaaagcgggacactgggacatcctgggtcactcgatgagacgacctacgagagattagcagaagagaccctggatagcctggccgaattctttgaggatctcgcagataaaccttatacgttcgaggattacgatgtgtcattcggctctggggttctaacagtgaagctaggaggtgacctgggcacctacgtaatcaataaacagacacccaacaaacagatttggctgtcctctccttctagcggacctaagcgatatgattggaccggcaagaattgggtttactctcatgatggcgtgtctctgcatgaactactggctgccgaattaaccaaggcattaaaaactaaactcgatctgtcgtccttagcatacagcgggaaagatgcttag

SEQ ID NO: 188286 - DNA, 516 bp, Artificial Sequence
  Description of Artificial Sequence: Synthetic coding sequence
atgtggaccctgggccggcgggccgtggccggcctgctggccagcccttctcccgcccaagcccagaccctcacccgagtgcctcgccctgcggagcttgcacccctctgtggcaggcggggactgagaacagacatagacgccacatgtaccccgagaagagccagctccaatcagcgggggcttaaccagatttggaatgtgaagaagcagtccgtctatctgatgaatctgaggaaatccgggacactgggacatccaggctctttagatgaaactacatatgaacgactggctgaggagacactggatagcctggccgagttttttgaggacctggctgacaagccatacacctttgaggactatgacgtttcctttggttccggagtgcttacagtgaaactgggcggcgaccttggaacttatgtaataaacaagcagacgcccaacaagcagatctggctgagttctccatccagactcacctggttactctggctctttcacccatag

SEQ ID NO: 188287 - DNA, 591 bp, Artificial Sequence
  Description of Artificial Sequence: Synthetic coding sequence
atgtggaccctgggccggcgggccgtggccggcctgctggccagcccttccccagctcaagcacagactctgaccagggtgcctagacccgctgaacttgccccactatgtggtcggcggggacttaggactgacatcgacgctacctgcactccacgccgcgcttcttctaaccagcgcggactgaatcaaatctggaacgtgaagaaacagagcgtgtatctgatgaatctgagaaaaagcggcaccctgggtcacccgggaagcctggatgaaaccacttatgagagactggctgaagagacgctggattccctcgctgagtttttcgaagacctggccgacaagccttatacatttgaagattacgacgtcagtttcggctctggtgtgctcacagtgaaactcggaggcgaccttggaacctacgtcatcaataagcagacaccaaacaagcaaatatggctatccagccctagccggtacgtagtagatcttagtgtcatgactgggctgggcaaaaccggttgtaccccaacaaccgcgtgcccaagtatgtcttgctggccacagtctagcctgaaaccctag

SEQ ID NO: 188288 - DNA, 702 bp, Artificial Sequence
  Description of Artificial Sequence: Synthetic coding sequence
atgccctgccggcgggaggaggaggaggaggccggcgaggaggccgagggggaggaggaggaggatgactcgttcctgttactgcagcagtcggttacactaggttcaagtggtgaagtggaccgactggtcgcacagatcggggaaactttgcagctcgacgcggcccaagattcacccgctagtccctgcgcgccaccaggtgtgcctttacgagctcctggacctctggctgctgcagtgcctgcggacaaggctaggccaccggccgtgcctctgctcctgcctcctgcctccgccgagacagtcggcccagccccatctggagcccttcgttgcgccctaggagatcgtggtcgtgtacggggccgcgccgccccctactgcgtggccgaggtcgccgccggcccatctgcactgccaggaccttgccggaggggatggctacgagatgctgtgaccagcaggagactgcagcagcgaagatggactcaggccggggcaagggctggagatgacgacccccaccgactactgcaacaactggtgcttagcggcaatctgataaaggaggccgtccggcgcctccaacgcgccgtggccgctgtagctgccaccgggccagctagtgcgcctggtcccggcggaggtagaagtgggcccgatcgaatagccttacagccctccggctccttgctgtag

SEQ ID NO: 188289 - DNA, 1161 bp, Artificial Sequence
  Description of Artificial Sequence: Synthetic coding sequence
atggagggcggcctggccggcgagcgggcccgggagagccccgtggattgctcagtgtctaaatgttcaaagctcgtggggggcggcgagagtaacccgatgaactacaattcttatatggatgagaaaaacgggcctccacccccaaatatgacaaccaatgagagacgcgtgattgtgcccgccgaccccaccctgtggacacaggagcatgtaaggcagtggttagagtgggctatcaaggaatacagtttaatggagattgacacaagcttctttcagaatatggatggcaaggaactttgtaagatgaacaaggaggactttctacgggccaccactctttacaatactgaggtgttgctgtctcatctgtcctaccttagagaatcatcattgctcgcatataatactaccagccacactgaccagagctccagactctcggtcaaagaggaccccagctatgattccgtgagacgaggggcatggggcaataacatgaattcaggactgaataaatctccccccttaggtggggctcagacgataagcaagaatactgagcaacggccgcagccagatccatatcagatactcggccctaccagctcacgactagctaaccctggcagtggccagatccagctgtggcaatttctgcttgaactgctatccgacagcgcaaatgccagttgcatcacctgggaggggacaaatggcgagttcaagatgacagatcctgatgaagttgcacgtaggtggggggagaggaagtctaaaccaaatatgaactatgataaacttagcagggcactaagatactattatgataaaaacattatgaccaaagtgcacggaaagaggtacgcatacaaattcgactttcatggcattgctcaggcactccagccacaccccacagagtccagtatgtataagtacccttcagacatttcctatatgccttcttatcacgcacaccagcagaaggtcaattttgtgcctccccacccctccagtatgcccgtgactagttcttccttcttcggcgctgcctctcagtattggacgagtccaacagggggtatttaccctaatcccaacgtgccacgccatcccaacactcatgtgccttcccatttgggctcttactattag

SEQ ID NO: 188290 - DNA, 1260 bp, Artificial Sequence
  Description of Artificial Sequence: Synthetic coding sequence
atgaccgccagcggcagccccgactacggccagccccacaagatcaatcctctccctcctcaacaggaatggatcaaccagcccgttagagttaatgtgaagcgcgagtacgaccacatgaatggctcgcgcgagtcgccggttgattgttctgttagtaagtgtagcaagttagtgggaggcggcgaatctaatccaatgaactataatagctacatggacgaaaaaaacggacctcccccacctaatatgaccactaacgagcgacgggtaatagttccagccgacccaacactgtggacacaggaacacgtgagacagtggctcgaatgggcgatcaaagaatattcattgatggagattgatacttctttcttccaaaatatggatggtaaagaactgtgcaaaatgaacaaagaggatttcctaagagccacaaccctctataacacagaggtcctcctctcacatctcagttacctgcgagagtcgagcctgctggcctataatactacttcccatactgaccagagttctagactgtctgtgaaagaagatccatcttatgattctgtccgccgaggggcatggggtaataacatgaattcaggactcaacaaatcacctccattgggtggcgcccaaacaataagcaagaacacggaacagcggccccagcctgatccctatcagatccttggtcccactagttctcgactcgctaatcctgggagcggacagattcagctgtggcagtttttactcgaactgctaagcgatagcgccaatgcttcgtgtatcacatgggagggtacaaacggcgagttcaagatgactgaccccgacgaggtcgcccgccgttggggggagcgaaagtcaaaacctaacatgaattacgataagctgtccagggcgctacgttactattacgacaagaatataatgacaaaggtgcatggcaaacgctacgcctacaagttcgacttccatggcatcgcccaggcattacagccccatccaacggagagtagcatgtataaatatccttcagatattagttacatgcccagttaccatgcacaccaacagaaggtcaacttcgtgcccccccacccctcttctatgccggtgaccagtagctcattcttcggggctgcttcccaatattggacgagccctacaggagggatttaccccaaccctaacgtgccacgtcaccctaatactcatgtacctagccatcttggaagctactactag

SEQ ID NO: 188291 - DNA, 1359 bp, Artificial Sequence
  Description of Artificial Sequence: Synthetic coding sequence
atggacggcaccatcaaggaggccctgagcgtggtgagcgacgaccagagcctgtttgacagcgcctacggtgccgcggcgcacttgccaaaagctgatatgacggcaagcggcagtcctgactacggccaacctcataagataaacccgctgcccccccagcaagagtggataaatcagccggtcagggtgaacgtgaagagggagtatgatcacatgaatggatctcgcgagagccctgtcgattgttcggtgagtaagtgcagtaagcttgtagggggcggagaatccaacccaatgaattacaacagctatatggatgagaaaaacgggcctccccccccaaacatgaccaccaacgagaggagggtgattgtgcccgccgacccaaccctttggactcaagaacatgtgcgtcagtggcttgagtgggccataaaggagtactcacttatggaaatagatacaagtttcttccagaacatggacggaaaagagctgtgcaagatgaataaagaagactttcttagagcaaccacgctgtataacacagaagtgttgctttctcacttgagctacttgagggaaagctccttgctagcctacaacacaacttcccataccgaccaatcttctcgactgtcggttaaagaggaccctagctacgactctgttcgaaggggcgcttgggggaacaacatgaactctgggttgaataaatcccctcccctgggtggagcacagacaatcagcaaaaacaccgagcagcggccccaaccagacccttaccaaatcctgggccctaccagtagtaggctggcgaaccccgggtctgggcaaattcaactttggcagtttttactcgagctactcagcgacagtgccaatgcgagttgtattacgtgggaagggacgaacggagagttcaagatgaccgaccccgacgaggtcgctcgcaggtggggcgagagaaaatcgaagcccaacatgaactacgacaagctctctagggccttaaggtactactatgacaaaaatatcatgactaaggtgcacgggaaacggtatgcttacaaattcgatttccacgggattgctcaagcgctgcaaccgcaccccacggaatccagcatgtacaagtatccgtccgatatctcttacatgccatcataccatgcgcatcagcaaaaggtcaacttcgtgcctcctcatccatcttcaatgcccgttaccagtagctcttttttcggagctgcctcacaatattggacaagccccactggcggaatatatcctaatcctaacgtgccacgccaccccaatactcacgtaccttcacacttaggcagttactactag

SEQ ID NO: 188292 - DNA, 780 bp, Artificial Sequence
  Description of Artificial Sequence: Synthetic coding sequence
atggaccccggcagcctgctggcctacaacaccaccagccacaccgaccagtcatcgagactatccgtgaaggaggacccatcatacgactctgtgcgtaggggcgcctggggaaataacatgaactctgggctgaacaagagccctcctctagggggtgcacagaccatctccaagaacactgagcagcggccacagcccgatccataccagatcctgggcccaacctcaagtaggttagccaatccaggctccggtcagattcagctgtggcagtttctcctcgagctactgtctgattcagcgaacgctagctgcattacatgggaaggcactaacggggagttcaaaatgacagatccagatgaggtcgctaggaggtggggggaacggaaatctaaaccaaatatgaactatgacaaattgtccagagccctgcggtactattatgacaagaacattatgactaaggtgcatgggaaacgatacgcttataagtttgatttccatgggatcgcccaagctctgcagccacatccaaccgagtcgagcatgtataagtacccctcagacatatcatacatgccatcttaccacgctcaccaacagaaagtaaattttgttcccccacacccctccagtatgcccgttacctcatcttccttcttcggcgctgcctcacagtattggacgagccctaccggcggcatttatcccaatcctaatgtgcctagacaccccaatactcacgttccatctcaccttggctcatactactag

SEQ ID NO: 188293 - DNA, 1944 bp, Artificial Sequence
  Description of Artificial Sequence: Synthetic coding sequence
atggccgaggaggaggcccccaagaagagccgggccgccggcggcggggcctcctgggaactgtgtgcaggtgctctatctgctcggctcgcggaagagggatctggagacgctggcggccgtcggagacccccggtcgatcctcgacggctggcgagacagctgctcctgctgctgtggcttcttgaggcacctctcctgcttggcgttcgcgcacaggctgccgggcaggggccaggccagggcccaggaccaggccagcaaccacctcccccccctcagcagcaacagtccgggcagcagtacaatggggagagggggatctcggtgccagatcatggttactgtcaaccaatcagtatcccactgtgcactgatattgcatataaccagaccattatgcctaatctattaggccatacgaaccaggaggatgccggcctggaggttcaccagttctatccattggttaaagtacagtgctccgcggagctgaaattcttcttatgtagcatgtacgcaccagtgtgcaccgtgttagagcaggcacttcccccttgcaggtccctgtgcgagagagctcgacaggggtgcgaggcccttatgaacaagtttgggtttcagtggccggataccctcaaatgcgagaagttccccgtgcacggtgccggagagctgtgtgtgggacagaatacttcggataaaggcactcctacccctagtctcttaccggagttttggacatcaaatccccaacatggcgggggaggccataggggcggatttcccggcggcgctggtgctagcgagagaggaaaattcagttgccccagggccctgaaagtaccctcatatctcaattaccacttcctgggggaaaaagattgtggggccccttgtgagcccaccaaagtttacggtcttatgtattttggccctgaagagctgcgcttctcacgcacttggattggcatatggtctgtgctatgctgtgccagtaccctctttacagtgctgacctacttggtcgatatgagaagattttcttacccagaacggcctatcatattcctctctggctgttacacagctgttgccgtcgcatatatcgccggattcctcctggaagaccgcgtggtatgcaacgataaattcgcagaggacggagcccggacagtggcccaagggactaaaaaagaaggctgcaccattcttttcatgatgctgtacttcttctcaatggcctccagcatttggtgggtgattctgagcctgacttggttcctggctgccgggatgaaatgggggcatgaagcaatcgaggctaactcacagtactttcatctggccgcttgggccgttccagcaattaaaaccattaccatactagctcttggtcaggtagacggggatgtcttaagtggtgtctgcttcgttggactaaacaatgtggacgctcttcgaggttttgttctggctcccctctttgtttacctcttcatcgggacttctttcctcctagccggcttcgtgagcctgtttcggattcggaccataatgaagcatgacggcaccaagacggaaaagcttgaaaagctgatggtgagaatcggagtcttttcagttctttatacagtaccagctacgatcgtgatcgcctgctacttctatgagcaggcctttcgggatcagtgggagcgatcgtgggtggctcaatcctgtaagagctacgcaatcccatgccctcatcttcaggcgggagggggcgcaccaccccacccgccaatgtccccggattttacggttttcatgatcaaatatctgatgaccctcatcgttggaattacctcaggcttctggatctggtcaggcaaaaccctcaatagttggcgaaaattttatacacgcctgacaaattccaagcagggagaaacgacggtttag

SEQ ID NO: 188294 - DNA, 1284 bp, Artificial Sequence
  Description of Artificial Sequence: Synthetic coding sequence
atggaggccatggccgccagcaccagcctgcccgaccccggcgactttgataggaacgtgccgaggatctgcggggtatgtggagatcgcgctactggattccatttcaacgccatgacctgcgaagggtgtaaaggcttctttaggaggtctatgaaaaggaaagccttattcacatgcccttttaacggggactgtaggatcaccaaggataatcggagacattgccaggcctgcaggctgaaaaggtgcgtagacatcggcatgatgaaggagttcatactcacggacgaagaagtccagcgaaaaagagagatgatcttgaagcggaaggaggaggaagcactgaaggattctctgcgacccaagctgtccgaagagcagcaaagaatcatcgccattctgctagatgcacaccataagacttatgaccctacctatagtgatttctgtcaatttaggccacctgtgagagtgaatgatggcgggggatcgcacccttcccgccccaatagtcgccatactccatccttttctggcgactcctcatcctcatgtagcgatcactgcattacctcttcagacatgatggattcaagcagtttcagcaaccttgacctgtccgaggaagattcagatgacccctccgtgacactggaactcagtcagctgagtatgcttccccacctggcagatttagtgtcatattctattcagaaggtgatcgggttcgccaaaatgatccctgggtttagggaccttacatctgaggaccagattgtgcttctcaagagtagcgcgattgaggtcatcatgctacgtagcaatgagagtttcacaatggatgacatgagttggacatgcggtaaccaggactataaataccgggtgtccgatgttaccaaggccggccactcattagaattaattgagcctctgattaaatttcaagtgggtctgaagaagctcaatctgcatgaggaggaacatgttttgctgatggctatttgtatcgtgagcccagatcggccgggtgttcaggatgctgcactgatagaggctatccaggatcgtctgagtaatactctccagacgtatattcggtgccggcatcccccccccggcagtcacttactgtacgccaagatgattcagaagctcgcagatttgaggtcactcaacgaggagcattcaaagcaatatagatgtctgagcttccagccagagtgctctatgaaattgacccccttggtgctggaggtgttcggaaatgaaatcagttag

SEQ ID NO: 188295 - DNA, 1365 bp, Artificial Sequence
  Description of Artificial Sequence: Synthetic coding sequence
atgcccgcccaccgggaccccgacgtgcagggccaccggctgcagcatgactcttacgcccaaccggatggacccagggagcctgcccgcgggagccatccagtggccagagtcagggcagctggcggagtacgtctgcctaggccaccgccgttgctgcccgtcctggctgtgcgcgcagacgtgcaccgcgcaggactgtatcctcatcctcgcctgccgggccacgtcagagctggacctgcccaggtgctgcccgactatggagctgtccagcttcaggtggccaggctgcccggcctgccggaaacccctcaacaggagcgaccgcagctgcccgtgcacgggggcgcccagcagcgcctcgggagggcacatccggggctcgggccagtgcccgcagcggttcccgccgctgctgcaccccagagggcaggggcccctgccgaggggagaggccctcgtgcgcggcggcttcgtcaaccgggccaggttccccctcggggcgaagagagggtcgtacgcgcagcactgcacgctagacgcgggagggtgctcgagccaaggggccaggctctgcgctctgggctggctggccacctgggtggcgccgtcctgcttttacagcggcttcatcgggcccacctcccacacagacctggccctctaccccttcccagagccccacatcacttgccactgcacgtgctgcttagacttctgcgaggccttccacatccgcctctccggcggaggagagaacataggcttcgccccggccagcgtcccgccctgtgccaccctggtgggacaggcgagcacagactgcacgccggtctcccaggcccactcttgctgcgccacggccagctcgccgtggttgggggcccacatgctcacttagttccaggtcggcggcaggaagtgggccctcgcgggcatcggtcacaacagcagcttttacccccgggatcccttggtcaccctggaggggaggatcacccagaccccgggcatgcccagggtggcggcgggcgtgctcaccggggcttgttaagggggcagcatggcaggcagcgtgcacatcgtctccgagcacacagtcctggccttctgcccgggcacagacatgtattgcacccgttagggttacgcggacccgtccctcacccagaaggcgacgaggatggacgacgcgagcacggacaggctggcgaggcgcatggagcatatcgagctctgttatgcgcggtgcaccgcgcagggcatctgtgtgacaggctcctactgcttaggaccccccagcatggtctcctggaggatcccggaggggccgcacaagtccagaatgaacagccagactag

SEQ ID NO: 188296 - DNA, 1698 bp, Artificial Sequence
  Description of Artificial Sequence: Synthetic coding sequence
atgcggccccggagcgccctgccccggctgctgctgcccctgctgctgcttccagctgccggtcctgcccagttccatggcgagaaggggattagtatacctgatcatgggttttgtcagcccatctccattcccctgtgtacagacatcgcttataatcagacaataatgcctaatttgctaggacacaccaaccaagaagacgccggcctcgaggtccaccagttttaccccctggtgaaggtgcagtgtagccctgaactgcggtttttcctgtgtagcatgtacgcaccagtctgtaccgtgctggagcaggcaatacctccctgtagaagtatttgcgaacgggccagacaaggatgtgaagccctgatgaacaagttcggctttcagtggccagagcggttgcggtgtgaacatttcccgagacacggggccgagcagatctgcgtgggtcaaaatcacagtgaggacggtgccccagcgcttcttacgacagcccctcctcccggtcttcagcctggggcagggggaacccccggcggaccaggcggcggaggcgcccctcctagatatgcaacgctggaacatcctttccactgtccacgagtactaaaagtcccaagttatctgagctacaagtttctgggcgagcgggactgtgctgcgccttgcgagcctgccagaccagatggatctatgtttttttcgcaggaggaaactaggtttgcccggctgtggattctgacgtggtcagtgctgtgctgcgcttctacctttttcacagtaactacatatctggttgatatgcagagatttagatatcccgagcgaccgatcatcttcctctccggctgctataccatggtgtcagtagcctatatagcagggtttgtcctgcaggaacgggtcgtctgtaacgaacgatttagtgaagatggctatcgcactgtagtccaaggtacaaagaaagaagggtgcaccattttgtttatgatgctgtattttttcagtatggcgtctagtatttggtgggtgatcttatcgctgacctggtttctcgctgccggcatgaagtggggccacgaggcgatcgaggccaatagtcagtatttccaccttgccgcctgggcagttcccgctgtgaagacaatcacaattctggccatgggccagatcgacggagacttactgtccggagtgtgcttcgtgggactcaatagtctggaccctttacggggctttgtgttagcgccactgttcgtttacctgttcataggtactagcttcctactggccgggtttgtaagtctgttcagaattagaacaattatgaagcatgatggaaccaaaacagagaagctggagcgactgatggtccgcatcggagtgttctccgtcctatatactgttcccgctaccattgtcattgcatgttacttctacgaacaagccttccgcgagcattgggagaggtcatgggttagtcagcactgcaagtcactggctataccctgcccggcccactacacaccccggatgagccccgacttcacagtatacatgatcaaatatcttatgacgctgatcgttggtataacttccggcttttggatttggtcgggaaagacattgcatagttggaggaagttctatacgcgtttgacaaattccagacacggagagaccactgtttag

SEQ ID NO: 188297 - DNA, 1926 bp, Artificial Sequence
  Description of Artificial Sequence: Synthetic coding sequence
gcccggggcgtgagcggctgcagcgtgcggccccggcaggccagcgggcaagcacaccggcctctcccacgtccagccagtccaactctgcgcccccgggtgaagtttgcaaaaaggagaggaagaaggcaaccgcagagaggaggcggaggagaagaagcccaaagccctggctggggacggggacgtggaggtcgacaaggcgctggctggggtgcggcggcctctatgcgacctcggtctgcactgcctcgcctgctgctgccccttctgctgttacccgcggctgggcctgcccagttccacggggaaaagggcatatcaatccctgaccacggtttttgccagccaatttcaattccactgtgtaccgatatcgcatacaaccaaacgataatgcccaatctgctgggtcacacaaatcaggaagatgccgggctggaggtacaccagttctaccccctcgtcaaggtgcagtgcagccccgaactccggtttttcttgtgcagtatgtatgccccggtgtgcacggtgttagagcaggcgatccctccttgtaggtctatctgtgagcgggctcggcaggggtgtgaggctctgatgaataagttcggctttcagtggcctgagcgactcagatgtgaacactttcccagacacggagctgaacaaatctgcgtcggccagaatcatagtgaggatggggcacccgccctgctaaccaccgcacctccacctgggctgcagcctggggccgggggaacccccggcggccccggagggggcggtgctcctcccaggtacgctacactggagcacccctttcactgccccagagtcctcaaagtgccctcctatctgagttataagtttttgggcgagcgcgattgtgctgccccgtgcgagcccgctaggccagatggaagtatgttcttctctcaagaggagactagatttgccaggctgtggattctgacctggagtgttctgtgctgtgcatcgactttttttactgtcaccacctatctggtagacatgcagcgattcaggtatccagagcgacctattatcttcctgtcgggttgctatactatggtgagtgttgcctacattgcaggatttgttctgcaggaaagagtggtgtgtaacgaacgatttagtgaggatggctacagaacagtggtgcagggtactaagaaggaaggatgtaccatcctgttcatgatgttatacttcttttcaatggcgtctagcatatggtgggttatcttgtcccttacctggttccttgccgccggcatgaagtggggtcatgaagccatcgaagctaactctcagtattttcatctggctgcttgggccgtcccagccgtgaagactatcacaattctggccatggggcagatagacggcgatctgttgtcgggggtctgcttcgttgggttgaattcactggatccacttaggggcttcgtgctggctccactcttcgtctatttgtttattggcacgagcttcttgcttgccgggtttgtaagcctcttccgcatccggacaattatgaaacatgacggcaccaagacagagaagcttgaacgcttaatggttagaatcggggtgtttagcgtcctctacacagtcccagccacaatagttatagcttgctatttctatgagcaggcctttagagaacattgggaaaggagttgggtgtcccagcattgcaaatctctggcaattccttgccccgctcattatacaccgcgaatgtcccccgacttcaccgtctatatgatcaagtacctaatgaccttgattgtggggattacctctgggttttggatatggtccggcaagacattgcacagctggaggaagttttatactaggctgacaaactccagacacggtgagactaccgtatag

SEQ ID NO: 188298 - DNA, 2001 bp, Artificial Sequence
  Description of Artificial Sequence: Synthetic coding sequence
atggccatgacctggatcgtgttcagcctgtggcccctgaccgtgttcatgggacacattggaggtcattccttattttcatgcgagccaataacactgcgaatgtgccaggaccttccatataatacaaccttcatgccaaacttgctgaaccactacgatcagcaaaccgctgcacttgcgatggagccctttcaccccatggtgaatctcgactgttctcgggatttccggcccttcctgtgcgctctatatgcaccaatttgcatggaatacgggcgggtaaccttgccttgtcggagactgtgccagagggcatactccgaatgttccaaacttatggagatgtttggagtgccttggcctgaggatatggagtgctctcgattcccagactgtgatgagccctatcccagactggtcgatctgaatctggctggagaacccactgagggggctcctgtggccgtgcaaagagactatgggttttggtgtccacgggaactgaaaattgatcccgatctgggttacagctttctgcatgttagggattgttccccaccttgtccaaatatgtatttcaggcgcgaggagctgtcgttcgcccgttattttatcggcttgattagcattatctgcttatcagctaccctgtttacgtttttaacattccttattgatgtcacacgttttcgctatcccgagcggcctataatcttctatgccgtgtgctatatgatggtgagtctcatttttttcattggatttctcctcgaagatagagtagcctgcaacgcttcaatccccgcccagtataaggcatcgacagtcacccaaggcagccacaacaaggcctgcacgatgctgtttatgatcctgtactttttcactatggccgggtcagtttggtgggtcatcctcaccattacatggtttttggctgccgtccccaagtggggtagtgaagcaattgagaaaaaagccctgctcttccacgctagtgcctggggaatccccggtactctgaccatcatactcctggctatgaataagatagaaggtgacaacatttctggagtatgctttgtgggtctgtatgacgttgacgctctccgctactttgtattggccccactctgtctctacgtggtggtaggcgtaagcctgctgctggctggaatcatttcccttaatcgggtgcggatcgaaatccctctggaaaaagaaaaccaggacaaactcgtgaagtttatgataaggataggggttttttccattctctatctggtcccccttttggtagtcattggctgctacttttacgagcaggcctatcgcgggatttgggaaacaacttggattcaggagcggtgccgcgagtaccacatcccttgtccataccaggtgactcaaatgtcccggccggatcttattctttttctaatgaagtatctgatggcacttatcgtgggcatcccatccgtgttttgggtggggtccaagaagacgtgcttcgaatgggcgagcttctttcatgggaggcgtaagaaagagattgtgaatgaatcccgccaggttctgcaagagcctgacttcgctcagtcgctactgcgggatcctaacacaccaattatacgaaaaagtcgggggacctccacccaggggacttcaacccacgcatcttctacgcaattggccatggtggacgaccaaaggagcaaggccggaagcattcatagtaaggtctcctcttatcatggcagcctccatcgctcccgtgacgggagatacaccccctgcagttatcggggcatggaggagaggcttcctcacggatccatgtctcggcttactgatcactctagacacagctcctcacacagactgaacgaacagagtcggcactccagtatcagggacttatcgaacaatccaatgacgcacatcactcatgggacctctatgaatcgcgtcattgaagaagacggcaccagcgcttag

SEQ ID NO: 188299 - DNA, 108 bp, Artificial Sequence
  Description of Artificial Sequence: Synthetic coding sequence
atggccatgacctggatcgtgttcagcctgtggcccctgaccgtgttcatgggtcatataggaggccattcacttttctcatgcgagcctatcacactccgcatgtag

SEQ ID NO: 188300 - DNA, 2001 bp, Artificial Sequence
  Description of Artificial Sequence: Synthetic coding sequence
atggccatgacctggatcgtgttcagcctgtggcccctgaccgtgttcatgggccacattggcggccatagtcttttttcgtgtgagcccataactctgcggatgtgccaagacctgccctataataccacttttatgccaaacctcttgaaccattatgatcagcagactgcagctctggctatggaacccttccatccaatggtgaacctcgactgttctagggattttcgtccctttctgtgcgctctctacgcgcctatttgcatggagtatggaagggtgactctgccctgcaggcgcctgtgtcagcgagcctacagcgaatgcagcaaattgatggaaatgtttggcgttccatggccagaagatatggagtgcagcagattcccagactgcgacgaaccgtaccctcggctggtggatctgaacctcgccggagagcccactgaaggcgctcccgtcgctgttcagagagactatggcttctggtgtccgagagagctgaaaattgatccagatctgggctactctttcctacatgtgagagattgctctcccccatgtcctaatatgtattttaggcgcgaagaactcagttttgctcggtattttattggtctgatatctatcatttgtctcagcgcaaccttattcacattcctcacttttctgatagatgtcacaagattcagatacccagagagacctatcattttctatgcagtttgttatatgatggtatccctgatcttttttatcggattcttgttagaagaccgcgtggcctgtaatgcatcaatccctgcgcagtacaaggccagcactgtgacacagggaagccataataaagcctgcacgatgctgttcatgatactttatttttttaccatggccggaagtgtgtggtgggttattctgactattacctggtttctagcagccgtgcccaagtggggatctgaagccattgaaaagaaagcactgctgttccacgcatccgcttgggggatcccaggtacactgacaattatactgctggctatgaacaagattgagggggataacatatcgggcgtttgttttgtcggcctctatgatgtggatgctctgcggtatttcgtgctggcccctctgtgcctgtacgtcgtggtcggcgtatctctgctactggccggaattattagtctgaacagagtcagaatcgaaatcccgttggagaaagagaaccaagacaagttggtaaagttcatgatccgcatcggagtatttagcatcctttaccttgtgcccttgctggtggtaattggatgttacttttatgaacaggcgtatcggggcatttgggagacaacatggattcaggagcgctgtagggaataccacataccctgtccttatcaggtgacccaaatgtctaggccagatctcatcttgttcctcatgaaatatttgatggcactgatcgtgggaatacccagcgtattttgggtggggtccaagaagacctgtttcgagtgggcatcctttttccatggcagacgaaaaaaggagattgtgaatgagtctcggcaagtgcttcaggagccagacttcgcccagtctttgctacgggaccctaacacaccaattattcgcaaaagccgcggcactagcacacagggaacctctacccacgcttcttctacccaactggccatggtagacgaccagcgctccaaggcaggctctatccactctaaggtctccagctaccatggcagtctacatagaagccgggacgggaggtacacgccttgcagttataggggcatggaagagcgcctgcctcatggatccatgtcccgactgactgaccattcacggcattcctcttcccatcgactgaacgagcagagccggcattccagtatcagggatctgtccaataaccctatgacacacattacccacggtaccagtatgaatcgcgtaatagaggaagacggcacctctgcctag

SEQ ID NO: 188301 - DNA, 1614 bp, Artificial Sequence
  Description of Artificial Sequence: Synthetic coding sequence
atggcctggcggggcgccggccccagcgtgcccggcgcccccggcggggtcggcctctccttaggccttctgctgcaattactgctgctgctagggccagcaagaggttttggagacgaagaggaacgtcgctgcgacccaattagaatatcaatgtgtcagaacctgggctataatgtcactaagatgcctaaccttgtaggccatgaacttcaaaccgacgcagaactgcaactgacgacatttactcctttgattcagtatgggtgctcttcccaactgcagtttttcctgtgttccgtgtacgtgccaatgtgcaccgagaaaatcaatattcccatcggcccttgcggtgggatgtgcttatctgtgaagcgccgatgcgagccggtgctcaaggaattcgggttcgcttggccagagagcctgaactgtagtaaattccccccacagaatgatcataatcatatgtgcatggagggaccaggggacgaggaggttccgttaccgcacaaaacacccattcaaccaggcgaagagtgccattccgtggggacaaactcagaccagtacatctgggtgaaacgctccctcaactgcgtcctgaagtgcgggtacgacgccgggctgtacagcagaagtgctaaagaatttaccgacatttggatggcagtgtgggcgtcactgtgcttcatcagcacagccttcacagtgcttacctttctgattgactcttcccgattctcctaccctgagcgacctatcattttcctcagcatgtgttataacatatacagcatcgcttacattgtgcgattgacagtcggtcgcgaacgtattagttgtgattttgaagaggcagcggagccagtgttaatccaggaggggctcaagaacaccggctgtgcgattatttttctcctaatgtatttcttcggtatggcaagctcaatttggtgggtgatcctgacactgacgtggttcttagccgccggtttaaagtgggggcatgaagccatcgagatgcactcttcttacttccatatagcggcttgggccattcccgcagtgaagacaatagtcatcctaatcatgcggcttgtggacgctgacgaactgacgggactttgctacgtggggaaccagaacttagatgccctcacagggttcgtggttgcgccactgtttacttatctggtcattgggactctgttcatcgcagctggcctggtggcccttttcaaaattaggtccaacttacagaaagacggaaccaagacggataaacttgagcgtttgatggtgaagataggtgtgttcagcgtgctctacactgtccctgcaacatgtgtgattgcttgttatttctatgagatctccaactgggcccttttcaggtattcggctgatgactctaacatggcggtggagatgctaaagatcttcatgtccctgttggttgggatcaccagcggcatgtggatttggtctgctaaaacactccatacttggcagaaatgctcaaataggctcgtgaatagcggcaaagtgaagcgcgaaaaacgtgggaatgggtgggtgaagcccggcaaaggttccgaaactgtcgtgtag

SEQ ID NO: 188302 - DNA, 2121 bp, Artificial Sequence
  Description of Artificial Sequence: Synthetic coding sequence
atggagatgttcaccttcctgctgacctgcatcttcctgcccctgctccgtgggcatagtctgtttacttgtgagcctattaccgtgccccgttgcatgaaaatggcatacaatatgacattctttcccaacttgatggggcactacgaccagagcattgccgccgtcgaaatggaacattttctacccctggcgaacctggaatgcagcccgaacatcgagacctttctctgcaaggcttttgtccccacctgtattgagcagattcatgtggtgccaccttgcagaaagctatgtgaaaaagtttattctgattgcaagaagctgatagataccttcggaattcgttggcctgaggagctggaatgtgaccgactgcaatattgcgatgagacagttcccgtgaccttcgatcctcacactgaattcctgggaccgcaaaagaaaacagaacaggtgcagcgagatattggattctggtgccccagacacctaaagacatctggagggcagggttacaagtttttgggtatcgaccaatgcgctcccccgtgccccaatatgtacttcaaatccgacgaattagaatttgccaaatccttcataggaaccgtgagtatcttttgcctatgtgcaacgttgttcaccttccttaccttcctgattgatgtacgacggtttcgatatcccgaacggccaattatctactactctgtgtgttattcgatcgtgtccctgatgtattttattggatttctactaggggacagtaccgcttgcaataaagccgatgaaaaactggagctaggggatacagtcgtgctaggaagccagaacaaggcttgtacagtgttgttcatgctgctgtatttcttcacaatggcaggcaccgtttggtgggttatactcacaatcacctggtttctggctgcagggaggaaatggagctgcgaggcgatagaacaaaaggcagtttggttccatgccgtggcatggggaacgcccggcttcttgacagtaatgctcttggccatgaataaggtggagggcgataacatttccggcgtctgcttcgtcggactgtatgacctggacgcctctcgctatttcgtgttactgcccctgtgtctctgcgtgtttgtcggcttgtccctcttgttggctggcatcatctctctaaaccatgtacgccaagtgatccagcatgatggccgcaaccaggaaaaactcaaaaaatttatgatccgaatcggggtcttcagcgggttgtatctggttccgctagtaaccctgttgggctgttatgtgtacgaacaggtcaatcgtatcacatgggagatcacctgggtgagtgaccattgccggcagtaccatattccctgtccataccaggccaaggctaaggctagaccagaattggccctgttcatgatcaagtatcttatgacgctgatagtgggcattagcgccgtgttctgggtgggcagcaagaagacttgtacagaatgggcaggattctttaagaggaaccggaaaagggaccccatatctgagagcagaagagtcctgcaggaaagctgcgagttctttctaaagcacaattccaaagtgaaacacaaaaaaaaacactacaaaccttcttcccacaaactcaaggtcatttctaaatccatgggcacgagcactggagccacagctaatcatgggactagcgccgtagcgattacaagtcatgattatctgggacaggaaacactgaccgaaatccagacttctccagagacgagcatgcgggaagtgaaggccgacggagcttcaacaccaagattacgggagcaggactgcggcgaaccagctagtccagccgcatccattagcaggctgagtggggagcaagtggacggaaagggccaggccgggagcgtctcagagagcgcgcgttcagaagggaggatcagccccaaaagtgacatcaccgataccggacttgcacagagcaataacctgcaagtcccaagcagctctgaaccttccagcctgaagggaagtaccagcctactggtgcatccggtaagtggcgtgcgcaaggaacaggggggcgggtgccattctgatacatag

SEQ ID NO: 188303 - DNA, 2121 bp, Artificial Sequence
  Description of Artificial Sequence: Synthetic coding sequence
atggagatgttcaccttcctgctgacctgcatcttcctgcccctgcttcgaggacacagtctttttacttgcgagccaataacagtgcctcggtgtatgaagatggcctacaacatgacatttttccccaatctgatgggccattatgatcaatccatagcagcagtagagatggagcacttccttccattggcaaatctagaatgttcaccgaacatagaaaccttcctgtgcaaagcatttgtaccaacatgtattgaacaaattcatgtagttcctccttgtcggaagttatgtgaaaaggtgtattccgactgtaagaagcttattgatacattcggaatccggtggcccgaggagttagaatgtgatcggttacagtattgcgatgaaaccgtgcccgtaacctttgatccccacactgaattcttgggcccacagaagaagactgagcaggtacagcgagatatcggcttttggtgcccacgacatttgaagacctccggaggacaaggctataagtttttgggaattgaccagtgcgcaccaccttgtccgaacatgtatttcaaatcagacgaactggagtttgcaaagtcttttataggaacagtgtctattttctgcttatgtgccaccctattcaccttcctgacctttcttatagatgttcggaggtttcgctatcctgaacggcctatcatctattacagcgtttgctattcgattgtgtcactgatgtattttatcggatttctattgggagatagtacagcctgcaataaagccgacgagaagcttgagttgggtgatactgtggtcttaggatcccagaacaaggcttgcactgttttgttcatgctgctgtacttctttaccatggccggcaccgtgtggtgggtgattctgactatcacctggttcctggcggccggcaggaagtggtcatgcgaggctatcgaacagaaagcagtctggttccacgcggtggcgtggggcacccccggctttttgacagttatgctcctggctatgaacaaagtcgagggtgacaatatttcaggcgtatgcttcgtggggctttatgatctcgatgcatcccgctatttcgttctgcttccactgtgtctctgcgtcttcgtagggctcagcttgctgttggctggaattatcagcctgaatcatgtgcgccaggtcatacagcacgatggccggaatcaggagaagctgaaaaaatttatgatcaggattggtgtgttttccggcctctacctggtgcctctcgtgacactgttaggttgttacgtttatgaacaagtgaaccgcatcacttgggaaattacctgggttagcgaccactgccggcaatatcatatcccatgcccctaccaggctaaggctaaagctcgcccagagttagcacttttcatgatcaaatatttgatgaccctgatcgtgggaataagcgctgtgttctgggtggggtctaaaaagacctgcacagagtgggcagggttttttaaacggaacaggaaacgggaccctataagcgagagccggagggtattacaggaatcatgtgagttcttcctgaaacacaacagtaaggttaagcacaagaagaaacactataaaccctcttcacacaagctgaaggtaatttccaagtccatgggtaccagcactggggctacagcgaatcatggtacctccgccgtcgcgataacctcacacgattatctcggccaggagacacttaccgagatccagacatctcccgagaccagcatgagggaagtcaaggcggatggtgcttctactccccgattgagggaacaggattgtggggaaccggcgtcccctgcagcaagtatctctaggttgagcggtgaacaggtggacggtaagggccaggcaggaagcgtgtctgagagcgctcgaagcgagggcagaatctcccccaaaagcgatataacggacaccggactggctcagagcaataacctccaagtacctagctcatctgagccttcgagtttgaagggttcgacgtcgctccttgtgcacccggtgtctggcgtacgcaaagaacagggaggcggatgtcatagcgacacctag

SEQ ID NO: 188304 - DNA, 2025 bp, Artificial Sequence
  Description of Artificial Sequence: Synthetic coding sequence
atgaagatggcctacaacatgaccttcttccccaacctgatgggccactatgatcagagcattgccgcagtcgagatggaacacttcttaccgctggcaaacctggaatgcagccccaacatagagacgttcctttgcaaagccttcgtacctacttgtatagagcagattcacgtggtccctccatgccggaagctctgtgaaaaggtgtattcagattgtaagaaactgatcgacacctttggcattcggtggcctgaggagttagagtgtgacaggctgcagtattgcgatgagaccgtgcccgtgactttcgaccctcacacagagtttctgggtcctcaaaagaagaccgagcaggtccaaagagatattgggttctggtgtcctagacacttaaaaacttcagggggccaagggtataagttcctgggaattgatcagtgcgcaccaccgtgtccaaacatgtactttaaatccgacgaactggagttcgcaaagagctttatcggaacagtatccattttttgtctctgtgccaccctgtttaccttcctcactttcctgattgatgtgcggcggttccgctatcccgagaggccgatcatctactactccgtgtgttattctattgtctccctcatgtacttcattggctttctcctgggcgattccactgcctgtaataaggcagacgagaaactggagctgggggataccgtggtcttgggctcgcagaataaagcttgcacagtgctgttcatgctgttatatttttttactatggctggaacagtgtggtgggtgatcctgactatcacctggttcctggccgccggcaggaaatggtcctgcgaggccatagagcagaaagcagtctggttccacgcagtggcctggggtaccccagggttccttaccgtgatgttgcttgccatgaacaaagtggagggtgataacatttccggagtgtgtttcgtgggactgtatgatctggatgctagcaggtactttgtgctgctgcctctgtgcctctgcgtctttgtcggtctgtctctcctactggccggaatcatctccctgaatcacgtgaggcaggtcatccagcatgatggtcgcaatcaggagaaacttaagaaatttatgatcagaatcggcgttttttctggcttgtatctggtgcccctcgtcaccttactcgggtgttatgtgtacgaacaggtaaataggattacctgggagattacatgggtgagtgaccattgccgtcagtaccatatcccatgcccctatcaggcaaaagctaaagcccgcccagaattggccctttttatgatcaaataccttatgacactgattgtggggataagcgctgtgttttgggtcggatcaaagaagacatgtaccgagtgggcaggattttttaaacgcaaccggaagcgggacccaatttcggagagccggcgcgtgctgcaggagtcctgcgagtttttcctgaaacataatagtaaggtaaagcacaagaagaaacactataagccctcctcacataagctgaaagttataagcaaatcaatggggacctcaaccggcgcaactgccaatcatggcacgagcgctgtggctattacctcacatgactaccttgggcaggagacactgactgaaatccaaactagccccgagactagtatgcgggaagtgaaggctgacggcgctagtactcctcgcctgcgcgaacaggattgcggagagccagcgagtccagccgcttcgatttcacgcctgtctggcgagcaggtggatggtaaaggccaggctggttccgtgtccgaatccgcccggtccgagggccgcatctcaccaaaaagcgacatcaccgatacaggacttgctcagagcaacaatctgcaagtgccgtccagctccgaaccctcctccctgaaaggaagtaccagccttctagtccaccccgtctcaggggttcgcaaagagcaggggggcggttgccacagcgacacttag

SEQ ID NO: 188305 - DNA, 1956 bp, Artificial Sequence
  Description of Artificial Sequence: Synthetic coding sequence
atgctggcccagcacttcctgcccctggccaacctggagtgcagcccaaacatcgaaaccttcctctgtaaagcattcgtgccaacatgtatagaacaaatccatgttgtgcctccctgccgaaagctttgcgaaaaggtatatagcgactgtaagaagctcatcgatacattcggaattagatggccggaagagctcgagtgcgataggctgcagtattgcgacgagactgtgcccgtgacattcgacccgcacactgagtttctcggtccacagaagaaaactgaacaagtgcagcgggatattggcttctggtgtccccgccatctgaaaacaagcgggggccagggctacaagttcttaggtatcgatcagtgtgcaccaccctgccctaatatgtattttaagagtgacgagctggagttcgccaagtcattcattggtacagtatctatcttctgcctatgcgcgactctgtttacctttcttacttttttgatcgacgtgaggcgctttcgatatccagagcgacccattatctattattctgtgtgctactccatcgtctctttaatgtatttcatagggtttctcctcggtgactcaacggcctgtaataaggctgacgagaaattggagctcggtgatactgtggttctgggatcccagaataaggcctgtacagtcctcttcatgctcctctacttcttcaccatggcaggaacagtatggtgggtgatcttgacaatcacttggttcctcgctgccgggaggaagtggtcctgtgaggccattgaacagaaggctgtgtggtttcatgccgtggcctggggaaccccaggttttctaactgtcatgctcctggccatgaacaaggtggagggcgacaacatatcgggagtgtgtttcgttggactgtacgatcttgacgcttctagatattttgtacttctacctctgtgtttatgcgttttcgttggactcagcctcctactagccggtattatcagtttaaatcacgtcaggcaggtgatccagcacgacgggcggaaccaagagaagctgaagaagttcatgatccgaataggggtttttagcggcctataccttgtccctctcgtgacactcttggggtgttacgtatacgagcaggtgaatcgaatcacctgggagattacttgggtttcagaccactgccgacaatatcacatcccttgtccctatcaggccaaagccaaggcaaggccggagttggcgctttttatgatcaagtatttgatgaccttaattgtggggatctccgctgtgttttgggtgggctcaaagaagacatgcacagagtgggctggctttttcaagcgaaaccggaagcgagacccaataagtgaatcgagacgcgtcctgcaggaaagctgcgaattttttttaaagcacaattctaaggtgaagcataagaagaagcattacaagcctagttctcacaagctaaaagtgatcagcaagagcatggggacttccacaggtgcaaccgcaaaccatggtaccagcgccgtggcaatcacctcccatgactatcttggccaggagaccctgaccgaaattcagacgtctcctgagaccagcatgcgggaagtgaaggcggacggtgctagtactccacgcctgagggaacaggattgcggcgaaccagccagtcctgctgcaagcatttctcggctctccggagagcaggtagacggtaaaggccaagctggatccgttagcgagagcgccaggtccgaaggccgcattagtccaaagagcgacatcaccgataccgggctcgcacagagtaacaacctgcaggtaccaagcagtagcgagccatcgagcctgaaaggttcgacgtccctgctcgtacaccccgtatccggcgtgcgaaaggaacagggcggcggctgccacagcgacacttag

SEQ ID NO: 188306 - DNA, 1206 bp, Artificial Sequence
  Description of Artificial Sequence: Synthetic coding sequence
atgacccgggtgctgccccggtggaagtggagctgcgaggccatcgaacagaaggcggtatggttccacgcagtcgcctggggcacacctggattcctgactgtaatgctgctggctatgaacaaggtggagggagacaatatttccggggtgtgcttcgtgggtctttacgacctggacgcgtctaggtatttcgtcttattaccactctgcctctgcgttttcgtggggctctctttactgctggctggtatcatttcactgaatcatgtgaggcaggtgattcaacatgacgggcgaaatcaagagaagctgaaaaaattcatgatcagaattggcgttttttctggtctctatctggtgccattagtgactctgctgggctgctacgtgtacgagcaagtaaatagaatcacatgggaaattacgtgggtgtctgatcactgtagacagtaccacataccctgcccctatcaggctaaagcgaaggctcgccctgagcttgctctgtttatgattaagtaccttatgaccctgatcgtaggcatcagcgctgtgttctgggtggggtcaaagaagacctgcacggaatgggccggatttttcaagagaaatcggaaacgagaccctatctctgagagcagacgagtcctacaggagagctgcgagttcttcttgaagcacaatagcaaggttaagcacaaaaaaaaacactacaagcctagctcccataaattgaaagtcatctcaaagtcaatgggcacaagcactggtgcaacagctaaccatggaacaagcgcagtggctataacatcacatgattacctgggccaggaaacccttaccgaaatccagacatcaccagaaacttccatgcgtgaggtcaaagccgatggtgccagcaccccccgccttcgtgaacaggactgcggagagccggccagtcctgcggccagtataagccgtctgagtggtgagcaggttgatggaaaaggacaggccggatcggtttccgaatcggcacggagtgagggccggatcagccctaagtccgacatcacggatactggcctggcacagagcaacaatcttcaggtgccatcgagctccgaaccatctagcctaaagggttcaacatcattgctggtccaccccgtgagtggggtcagaaaagagcaaggcggcgggtgccacagcgatacttag

SEQ ID NO: 188307 - DNA, 2085 bp, Artificial Sequence
  Description of Artificial Sequence: Synthetic coding sequence
atggagtggggctacctgctggaggtgaccagcctgctggccgccttggcactactccaacgaagcagcggagctgccgcagcatctgcgaaggagctggcttgtcaagagatcaccgtgcctttgtgtaaagggatcggatataattacacatacatgcctaatcagttcaatcacgacacgcaagatgaggctgggctggaagttcatcagttctggcctctggtcgaaattcagtgcagtcccgatctgaagttttttctctgtagcatgtatactcctatatgcctcgaggattacaagaagccactgcccccctgtaggtccgtctgcgaacgggctaaagctggctgcgctccgttgatgcgacagtacggatttgcttggcctgatcgaatgcgctgcgatcgcctcccagaacaggggaaccccgacaccttgtgcatggattacaaccggactgatctgaccactgcggctcctagtccaccacggcgcctgcctcctcctcctccaggcgagcaaccgccatcagggagcggacacggccggccacctggcgctaggcccccgcatcgtggcggagggcgcgggggggggggaggggacgcggcagccccccctgccaggggtggtggcgggggggggaaggcgcgcccacctggtgggggcgctgccccctgcgaacccggctgccagtgtcgtgccccaatggtgtccgtgtcctccgaaagacaccctctgtacaatcgcgtgaaaaccggccagattgccaattgcgcactcccttgccacaatccgttcttctctcaggacgagcgtgctttcacggtcttttggattgggctctggagtgtattatgctttgttagtacctttgccaccgttagcacttttctgatcgatatggaaaggtttaaataccctgagagacctataatttttctgagcgcttgctacctgtttgtcagtgttggttacctggtgagactggtggctggccacgaaaaagtagcctgttccggaggtgcgcctggcgccggaggagccggcggcgccggtggagcggccgccggggcaggggcggctggagccggagcaggtgggcccggtgggcggggcgagtatgaggaactgggggcggtcgagcagcacgtgaggtacgagactacgggtccagctctctgtacagttgtgttcctgctggtatacttctttgggatggctagttctatctggtgggtgattctttcactgacctggttcctggccgccggcatgaaatggggcaacgaagccattgccggatactcgcagtactttcatctggccgcatggctggtccccagtgtgaaaagtattgctgtgcttgccctgagctcagtagacggagatcccgttgccgggatttgctatgttggaaatcagtccttagataatttaaggggattcgtgctagctcccctcgtcatttacttgtttatcgggaccatgttccttcttgccggcttcgtgtccctctttcggattcgctctgtaattaaacaacaggacggacccaccaagacccacaagctggaaaagttaatgatccgactcggcctcttcaccgtattatacacggttccagccgccgttgtcgtggcatgtcttttttacgagcaacacaacagaccaagatgggaagcgacccacaattgcccatgcctgcgggatctgcaacccgaccaggctaggcgcccagactatgccgtgtttatgctcaaatacttcatgtgtttagtcgtcgggataaccagcggcgtttgggtttggtccgggaagactcttgagtcctggcgctccttatgcacaagatgttgttgggcctcaaaaggagctgctgtgggtgggggcgcaggggctacagctgccggcgggggcggaggccctggcgggggaggcggaggagggccaggaggcggcggaggaccagggggcggtggcggaagcctgtatagtgacgtgagcacaggactgacctggcgaagtggcacggcctccagcgtgagctatcccaagcagatgccattgtcccaggtttag

SEQ ID NO: 188308 - DNA, 1776 bp, Artificial Sequence
  Description of Artificial Sequence: Synthetic coding sequence
atggccgtggcccccctgcggggcgccctgctgctgtggcagctgctcgctgcaggaggggccgcccttgaaattggtaggtttgaccctgaaaggggaagaggagcagcaccatgccaagccgttgaaatccctatgtgccggggaattggttacaatctcacgcggatgcctaatttgctcgggcatacttcccagggggaagctgcagccgagctcgcagagttcgcccctctggtacagtacggatgccactcgcaccttcgctttttcctttgctcactgtatgcccccatgtgtactgaccaggtgtctacaccgatccctgcatgtcgtccaatgtgcgagcaggcacggctgcgctgcgctcctataatggaacaatttaactttgggtggccagatagcttggactgtgcaaggcttcctacaagaaatgacccacacgcactgtgtatggaagcgccagagaacgccacggccgggcctgccgagccccataagggcctcggcatgctgcccgttgctcctagacctgctagaccccctggcgacctgggcccaggagcaggaggttctggaacatgcgagaatcccgaaaagtttcaatatgtggagaaatctcggagctgcgctccgcgctgtggtccgggagtggaggtcttctggagtaggagggataaggattttgccctggtgtggatggccgtgtggtctgctttgtgcttttttagcaccgcgtttactgtactcactttcctgctcgaaccccaccgtttccaatatccagaaaggccgattatattcctgagcatgtgctacaacgtatatagcctggcattcctgatcagagccgtcgcaggggcccagagcgtggcgtgtgatcaagaagcaggggctctttacgtaatccaagaagggttggaaaacacgggatgcacgctggtctttttgctcctgtattacttcggcatggccagcagcctgtggtgggtcgtgctgactctgacgtggtttttggcggctggtaagaagtgggggcatgaagcgatagaagcgcacggtagctactttcatatggctgcctggggactgcccgcccttaaaaccatagtgattctaacgctcagaaaagtggctggggatgagctgaccggtctgtgctatgtagcctctactgacgcagctgcattgacgggctttgttctggttcccctgagcgggtacttggtgctaggttcttcatttctgttaacaggattcgtggccttgtttcatattaggaagattatgaagaccggaggtaccaacacggagaagctggaaaagttgatggtgaagattggtgtcttcagcatactgtacacagtacccgctacctgtgtcatcgtgtgctatgtgtacgaaaggctcaatatggacttctggcgcctgcgcgccacagaacagccttgtgccgccgccgccgggcccggtgggcgacgggattgcagcctgcctggcggatctgttccgacagttgccgtcttcatgttaaagatattcatgtccctggtcgtggggattacctccggggtatgggtatggtcatccaagacgtttcagacttggcagtcgctgtgctataggaagatcgcagctggccgagcccgtgctaaagcatgcagggcccccgggagttacggtcgcggaacacattgccactataaggcccctactgtcgtgcttcacatgaccaagacagaccctagcttggagaaccccacccatctctag

SEQ ID NO: 188309 - DNA, 978 bp, Artificial Sequence
  Description of Artificial Sequence: Synthetic coding sequence
atggtgtgcggcagccccggcggcatgctgctgctgcgggccggcttattggccctggcagcgctgtgtctgctccgagttcctggcgcacgagcagctgcctgcgagcctgtgagaattccattgtgcaagagccttccttggaacatgacaaagatgcctaaccatctgcaccactctacccaagccaatgcaattctggctattgaacaatttgaaggccttctgggaacacactgctctccagacctcctcttcttcctgtgcgcgatgtacgccccaatctgcacaatcgatttccagcacgaacctataaaaccttgtaaatccgtgtgcgagagagcccgccaagggtgtgaaccaatcctcatcaagtaccggcactcatggccggaaaaccttgcttgtgaggaacttccagtgtacgaccgcggcgtgtgcatctcacccgaggcgatagttaccgccgatggtgctgactttccaatggacagcagcaacggcaattgcagaggggccagctcagagaggtgcaagtgtaagcctattcgcgcaacacaaaaaacctactttcgcaacaattataactacgtgattcgtgctaaagtcaaggagataaagaccaaatgccacgacgtgacagctgtcgtggaggttaaggaaatcctgaaaagtagcctggttaatataccccgcgacacagtgaacctgtacacgtcatccggatgcctgtgccctcccttgaacgtgaacgaagaatacattataatggggtatgaggacgaggaacggtctcggctgttgttagtggaagggagtatcgcagaaaagtggaaggacagacttgggaagaaggtaaagaggtgggatatgaaactgcgccaccttggactctcgaaaagtgacagtagcaactctgacagcacccagtctcaaaagagcggccggaattctaatcctaggcaggcccgcaactag

SEQ ID NO: 188310 - DNA, 930 bp, Artificial Sequence
  Description of Artificial Sequence: Synthetic coding sequence
atggaggagctgctgcggcgggagctgggctgcagcagcgtgcgggccactggccactccggcggaggctgcatttcacagggcagatcctacgacactgaccaaggtcgcgtatttgtaaaggttaaccctaaagctgaggctagacgcatgtttgagggggagatggcaagccttacagcaattcttaagacaaacacggtgaaagtgccaaagcctataaaagtcctagatgctcccggcggcggatctgtgcttgtcatggaacacatggacatgagacatctgtccagtcatgccgccaaactcggtgctcagctggccgacttacatctggacaataagaagctgggggagatgagactcaaggaggctggcacagtaggaagagggggcggccaagaagaacgaccatttgtcgccagattcggattcgacgtggtcacctgctgtggttatctcccgcaggttaacgactggcaggaagactgggtggtgttctacgcccggcagcggattcagcctcagatggatatggtcgaaaaggaatcaggtgacagggaagccctacaattgtggagtgcacttcagttaaagattcctgatctgttccgagacttggaaataatccctgccttattacacggggatctctggggtggcaatgtggccgaggatagcagtggacctgtaatattcgatcctgcatccttctacgggcatagtgagtacgagttagcaatagctgggatgttcggaggtttctcttccagcttttactccgcgtatcacggaaaaatccccaaggcccccggctttgagaaaagactgcagctgtaccagctgttccattacttgaatcactggaatcactttggtagtggctaccgcggatcctcgcttaacataatgaggaatttggtgaagtag

SEQ ID NO: 188311 - DNA, 780 bp, Artificial Sequence
  Description of Artificial Sequence: Synthetic coding sequence
atgttcgagggcgagatggccagcctgaccgccatcctgaagaccaacaccgtgaaggtccccaagcccattaaagtccttgatgctcctggaggaggttccgtgctggtgatggagcacatggatatgcgccacctgtcgtcgcatgcagcgaaactcggggcccaactggcggacctgcatctagacaataagaaactcggagaaatgagactgaaagaagcaggtaccgtaggaaggggaggcggacaggaggagcggccctttgttgcacgttttgggttcgatgtggtgacatgttgtggctaccttcctcaggtgaatgattggcaggaagactgggtcgttttttacgcacgccagaggattcagccccagatggacatggtggagaaggagtccggagatcgcgaggccctacagctctggagcgctctgcaactgaagattcccgacctatttcgcgatctcgagattattccggccttactccatggagatttatggggaggcaatgtggctgaggactcctctggccccgtaatattcgatcctgcttctttctacgggcattccgaatacgaactcgctattgccggtatgttcggaggattctcaagcagcttttatagtgcctatcatggaaagatccctaaagcaccgggcttcgagaagcgcctccagctctatcagctgttccattacctgaaccactggaatcatttcggctcaggctacagagggtcttccctaaacatcatgagaaacctggtgaagtag

SEQ ID NO: 188312 - DNA, 1017 bp, Artificial Sequence
  Description of Artificial Sequence: Synthetic coding sequence
atggccgaccaggcccccttcgacaccgacgtgaacaccctgaccaggtttgtcatggaggagggccgcaaggccaggggcaccggggaacttacccagctcttgaactccttatgcaccgccgtgaaggctatctcttcggctgtcaggaaggccgggattgcacacttgtatggcattgccggaagtacaaacgtgaccggcgatcaggtcaaaaagctggacgtcctgtcaaacgatctagtaatgaatatgctcaaatccagcttcgccacctgtgttcttgtgagtgaagaggacaaacacgcaataatcgtggagcccgaaaagcggggcaagtatgtcgtgtgctttgaccctttagatggtagctccaacattgattgtctcgtttcggtgggcacaattttcggtatatatagaaagaagtcaacagatgaaccatccgagaaagatgcactgcaacccggcaggaatttggtagccgcgggctacgccttgtacgggagcgctactatgttggtgctagccatggattgtggtgtcaactgttttatgctggatccagctatcggcgagtttattctcgtcgataaagatgtcaaaatcaagaaaaaggggaagatctacagcctcaatgagggatacgcgagggactttgaccccgcggtgacagaatatatccagcggaagaagttccctcccgacaatagtgcgccatatggagcccggtatgtggggagcatggtagctgatgtgcacagaacgctcgtttatggggggattttcttatacccggctaataagaagtcacctaacggaaagttgcggctactttatgagtgcaatcccatggcctacgtgatggagaaggctggtggtatggcaacaactggcaaggaggccgtgcttgatgtcatccctactgatatccaccagcgcgcccccgtcatcctcggatcccccgatgatgttctggagttcctcaaggtatacgagaagcatagcgctcagtag

SEQ ID NO: 188313 - DNA, 456 bp, Artificial Sequence
  Description of Artificial Sequence: Synthetic coding sequence
atgctgaagagcagcttcgccacctgcgtgctggtgagcgaggaggacaaacacgccatcatagttgaacccgaaaaaagaggcaaatacgtagtctgctttgaccctctcgacggatcttccaacatcgactgtcttgtttcggtggggacaatcttcggaatttataggaaaaagagcacagatgaaccctccgagaaggatgctctgcaaccaggccgaaaccttgtggccgcgggatatgctctctatggatccgcgacaatgctggttttggccatggactgtggggtcaactgtttcatgcttgacccagcaattggcgagttcatcctggttgataaagatgtaaaaataaaaaagaagggcaagatctattctctgaacgaaggctacgccagagatttcgacccggctgttaccgagtacatacagcgcaagaagtttcccccttag

SEQ ID NO: 188314 - DNA, 1017 bp, Artificial Sequence
  Description of Artificial Sequence: Synthetic coding sequence
atggccgaccaggcccccttcgacaccgacgtgaacaccctgaccaggtttgtgatggaggaaggccgaaaagccaggggcacgggagagttgacccaacttctcaattccctatgcaccgctgtgaaggccataagctcagccgtgcgcaaggccggcatcgcgcacctgtacggaatagcagggtctacaaacgtgaccggcgatcaggtgaaaaagctggacgtgctctctaatgacctcgtaatgaatatgttgaaaagctcattcgctacctgcgttctggtgagtgaggaggacaagcatgccatcatcgttgagccagaaaaaagagggaaatacgtggtgtgttttgacccacttgatggtagcagcaatatcgattgcctggtgtcagtgggcacaatattcggaatttatcgcaaaaaatccacagatgaaccctccgagaaggatgctctgcagccaggcagaaacctcgtggctgccgggtatgcactatatgggagcgctacaatgctcgtccttgccatggactgtggagttaattgttttatgctggacccagccatcggcgagttcattctcgttgacaaggatgtgaagatcaaaaagaagggaaaaatttacagtttgaacgaagggtatgctcgcgacttcgacccagctgttacagagtatatccagagaaagaaatttcccccagataactcagcaccatatggtgccaggtacgtcggcagcatggtagccgatgtgcatcgaacactagtctacggtgggatatttctgtaccctgctaataagaaatcgccaaacggtaagctgagactcctgtatgagtgtaacccgatggcctatgttatggagaaagccggcgggatggccacaacaggcaaggaggcagtgctcgatgtgatacccaccgatatccatcagcgcgccccagtgatattaggttcacctgacgatgttctcgaattcctgaaggtatatgaaaaacacagcgctcagtag

SEQ ID NO: 188315 - DNA, 1020 bp, Artificial Sequence
  Description of Artificial Sequence: Synthetic coding sequence
atgaccgaccggagccccttcgagaccgacatgctgaccctgaccaggtacgtgatggaaaaaggtcggcaggctaagggcaccggcgagctgacccagctgcttaattccatgttaaccgccattaaggctatctctagtgccgtgaggaaagccggattggcccacttatacgggattgcaggctccgttaacgttaccggcgacgaagtgaaaaaactggatgtcctgagcaatagtctggtgatcaacatggtgcagagcagttatagcacctgcgtcctagtgtcagaggaaaataaagatgctattatcaccgcaaaggaaaagaggggcaagtatgtggtgtgcttcgacccactcgatgggagctcaaatattgattgcctggcatctatcggcaccatatttgcaatttatagaaaaactagcgaggacgagcctagcgagaaggatgccctgcagtgtgggcgcaacattgtcgcagctgggtacgccctatatggatcagccacactggtcgccctctccactggacaaggggtggatttattcatgctggaccccgcccttggcgagttcgtgctggtggaaaaggacgtaaagattaagaagaaaggcaagatctactctctgaacgaggggtatgctaagtatttcgacgccgcaaccacagagtatgtgcaaaaaaagaagttccctgaagatggctccgcaccttatggcgcgaggtatgttggctcaatggtggccgatgtgcacagaaccttagtctacggaggcatcttcctttatccagcaaaccagaagtcaccgaagggaaagctcagattactgtacgaatgtaatcccgtggcgtatattatcgaacaggccgggggcctggctacaaccggaacgcagcccgttctggacgttaaacctgaggccattcatcagcgcgttcctctcattctcgggtcccctgaggacgtgcaagaatacctgacgtgcgtccagaaaaatcaggctgggtcatag

SEQ ID NO: 188316 - DNA, 837 bp, Artificial Sequence
  Description of Artificial Sequence: Synthetic coding sequence
atgggcaagggcaacgaggacagcgacctgcactgcagcagcatccagtgcagtaccgaccaacctccttttcagcaaatctcctttacagaaaagggcagcgacgaaaagaagccctttaaggagaagggaaagaccgccttttctcactcctctgaaaaacacattcagcggcagggaagtgagccaaaccctaacaaagaaaatagcgaggagactaagcttaaagccgggaattcgaccgctggatcagaacctgaatcaagctcctaccgagaaaattgtaggaaaaggaaaatgtcaagtaaggactcatgtcaggataccgcaggaaactgtccggagaaggaatgctcactgtccctaaataaaaaatctcgttccagcaccgctgttcacaattcagagatccaggagacttgcgatgcgcaccaccgggggcactccagggcctgtaccggccacagcaaaagacaccgaagcagggctctgggggttcaaacgccttcaataagaaaaagtctcgttacatctgtccgggccatgtccgaagccgtgtatcaggacctggcacaggtgtgggcccagcagatccacagcccacttacttgtgagcagttaacgctgttgactcgactgaggggtccactgtgcgcacaggttcaaacactttacagcatggctacacaggctgcgtacgtgttccctgccgagagttggctagtaccagctaccctaccgggtcctggcgaatccgccctcgacagagaagcccacccattccccggccaggaaattaccgagactgtttcaggttccgacgaagctaagctttag

SEQ ID NO: 188317 - DNA, 984 bp, Artificial Sequence
  Description of Artificial Sequence: Synthetic coding sequence
atgggccggaccagcaaggacaagcgggacgtgtactaccggctggcaaaggagaatggatggcgtgcaaggtccgctttcaagttactgcagctggataaggagtttcagctgtttcaaggcgttactcgggctgtggacttgtgcgcagcaccaggctcttggtcccaggtattaagccagaaaatcggcggacaaggatccggccacgtggtcgccgttgatctgcaggctatggcacctttgccaggtgtggtgcagatccagggtgatattacccagctgtctaccgccaaggagataatccaacatttcaagggctgtccggcggatctggtggtttgcgatggagctccggacgtaactggcctgcatgacgtagacgagtatatgcaggcacagctgttattggcagccctaaatattgccacccacgtgctgaagccgggaggttgcttcgtggcaaagatctttcggggaagagatgtgaccctgctttattcccagcttcaggtgttcttttcatccgttttatgcgcgaaaccgcgatccagccgaaattcttctatcgaagcctttgctgtttgtcagggctacgatcccccggaaggctttattcccgacctctcgaagcctctgctggaccattcctatgattttaatcaactagacggcccaaccagaataatcgtcccttttgtgacatgcggtgacctcagtagttacgactccgatagatcgtatcctttggatttagaaggtgggtcagaatataagtacaccccccctacacaaccacctatcagtccaccctatcaggaagcctgtactttgaagcgcaagggacagcttgccaaagagattcggccacaggattgtcctatcagccgcgtcgatacattcccccagcccctagcggcccctcaatgtcacacacttctagcaccagagatggaggataacgaaatgtcctgttctccttag

SEQ ID NO: 188318 - DNA, 990 bp, Artificial Sequence
  Description of Artificial Sequence: Synthetic coding sequence
atgggccggaccagcaaggacaagcgggacgtgtactaccggctggctaaggagaacggttggcgggctcgttcggctttcaaactgttacaactggacaaagaatttcagctgtttcagggggtgacaagggccgttgacctttgcgcagccccggggtcgtggtcgcaggtcctgagccaaaagatcggtggccagggttccggccacgtggttgctgtggacctgcaggcaatggcccctctacccggtgtcgttcagattcaaggggatattacccagttaagcacagccaaggaaattattcaacattttaagggatgccccgcggaccttgtggtgtgtgatggtgctccggacgtaaccggcttgcacgatgttgacgaatatatgcaggcccagcttctgcttgccgccctgaatatagccacccacgtactgaaacccggaggatgcttcgttgcaaaaatatttcgaggccgggatgtgacactgctgtattctcaactgcaggtgtttttctcttccgtcctgtgcgctaaacctcgaagcagccgcaacagttccatcgaggcgtttgctgtatgccaagggtatgacccaccggagggttttatcccagacctatccaagcctctcctggatcacagttatgatccagactttaaccagctggatggacccacacggattatcgtcccttttgttacctgcggagacctgagttcgtatgattccgatcggtcttaccccctggatcttgaaggtgggagtgagtataagtacacccctcctactcagcctccgatcagcccgccataccaggaggcgtgtacacttaaacggaagggtcaattggcaaaagagattcggccccaagactgcccaatctcacgggtggacacatttccacagccgttggccgctccacagtgccacaccttgctggctccagaaatggaggataatgagatgtcttgtagcccttag

SEQ ID NO: 188319 - DNA, 579 bp, Artificial Sequence
  Description of Artificial Sequence: Synthetic coding sequence
atggccctgaacatcgccacccacgtgctgaagcccggcggctgcttcgtggcaaagatcttcagggggcgggacgtgacacttctgtattctcagctgcaggtattcttctcttccgtactgtgcgcaaagccgcgtagcagtaggaatagctcaatagaagcctttgcggtttgccagggttacgacccaccagaggggtttattcccgatctctctaaacctcttttagaccacagctatgacccagacttcaatcaacttgatggacccacgcggattatcgtgcctttcgtgacctgtggggatctttcttcttatgatagcgatcgcagctaccccttagatctcgaagggggttcggaatacaaatatacaccccctacacaacccccaatttcacccccttatcaggaagcttgcacactgaaacgcaagggccaactggcgaaggagatccggccccaggattgtcccatttcacgggtagataccttcccacaacctcttgcggcgccacagtgtcatacccttctcgccccagagatggaagataacgagatgtcgtgcagtccatag

SEQ ID NO: 188320 - DNA, 984 bp, Artificial Sequence
  Description of Artificial Sequence: Synthetic coding sequence
atgggccggaccagcaaggacaagcgggacgtgtactaccggctggctaaggagaatggatggagggcgcggtctgcttttaagctgctgcaactggacaaggagtttcagttattccagggggttacacgggccgtcgacctctgtgctgcccccggcagctggtctcaggtgctgagtcagaagattgggggccaagggagcggccacgtggttgccgtagatctccaggcgatggccccccttcctggggtcgtccagattcagggcgatatcacacagcttagcaccgccaaagagattatccagcattttaagggatgtccagccgacttggtggtctgcgacggagctcctgacgtcacaggattacacgacgttgatgaatatatgcaagcccagttgctgctggcagccttaaatatcgcgacgcacgtcctgaaacctggcggatgtttcgtagctaagatcttcagggggagggatgtcactctgctctattcacagcttcaggtattctttagctccgtgctgtgtgctaaacctcgcagtagcaggaatagctccatagaggcttttgccgtgtgccagggttacgacccgcctgaggggttcattcctgacctgagcaaaccgctccttgaccatagctacgacttcaaccagctggacgggccaacacggatcatcgtcccatttgtcacttgtggagacctaagttcctatgattccgatagaagttatcccctcgatctggagggcggttccgagtataagtatacccccccgacacaaccgcccattagccctccttaccaggaggcctgtaccctcaaaagaaagggccagctcgcaaaggaaattagaccccaggactgccctatctctagggtggatacattccctcagcccctcgctgccccgcagtgccatacgttgctcgcacctgaaatggaggacaatgaaatgtcatgttctccttag

SEQ ID NO: 188321 - DNA, 741 bp, Artificial Sequence
  Description of Artificial Sequence: Synthetic coding sequence
atggccggctacctgaagctggtgtgcgtgagcttccagcggcagggatttcacaccgtcggaagccgctgcaaaaacaggacgggggcagagcatctttggcttacccggcacctgcgcgaccctttcgttaaagccgctaaagtcgagtcttatagatgcaggagcgcgttcaagttgctcgaagtgaacgaaaggcaccagatcctgcgccccggacttagggtgttggattgcggagcggctccaggagcctggagccaggtcgccgtacaaaaagtgaacgccgcagggaccgatccaagtagccctgtggggtttgttctcggggtggatctcctgcacatcttcccactcgaaggagcgacctttctatgtcccgctgacgtgacagaccctagaacctcacagaggatacttgaggtccttcctgggcgccgggctgatgtaatcctgtcggatatggccccaaacgcaactggctttcgcgatctagaccacgatcgcctcatctctctatgcctcacgttactgtcggtgactcccgatattctccaacccgggggcaccttcctgtgcaaaacctgggcaggcagtcaatcccgcaggttgcagcggcgcctgaccgaggaatttcaaaatgtgagaatcattaaacccgaggctagtcggaaagaaagcagcgaggtgtactttttggcaacacaataccacggaagaaagggaactgtcaagcagtag

SEQ ID NO: 188322 - DNA, 438 bp, Artificial Sequence
  Description of Artificial Sequence: Synthetic coding sequence
atggccggctacctgaagctggtgtgcgtgagcttccagcggcagggatttcacactgtcgggagtaggtgtaagaatagaacaggagctgagcacctctggctgactagacatctcagagaccccttcgtgaaggcggcaaaggtcgaatcctatcgctgtaggagcgcgtttaagctgcttgaagtgaatgagaggcaccagatattaaggccaggactacgagtgctggactgcggcgcagctccaggagcatggagccaggtcgccgtccagaaggtgaacgctgctggcaccgatggcgtcagcctgctaccaaggctgcaatgcaacggcgttatcagtgcacactgtaacttgtgtctgcctggctccagcgactcccctgcgtcggctagccaaatccccgcccttctgttggcgagctgtttaggttag

SEQ ID NO: 188323 - DNA, 768 bp, Artificial Sequence
  Description of Artificial Sequence: Synthetic coding sequence
atgcccgagctgtacgacctggtgaacagctacaagcccgacctgatttggtctgacggcgagtgggagtgtccagatacctactggaactctaccaactttctgagttggctgtacaacgattcacccgtgaaagatgaggttgttgtgaatgatagatggggacagaactgtagttgtcaccacggcggctactacaactgtgaagataaatttaaaccgcagagtctgcctgatcacaagtgggagatgtgcacatctatagataagttcagctggggataccgcagagacatggcgctcagtgacgtcacagaggaatcagaaatcattagcgagcttgtgcagactgtgtccctaggaggcaattacctgcttaacatcggtccgacaaaggacggactcattgtccccatcttccaggagagattgttggcagtaggaaaatggctcagcatcaacggggaagcgatctacgcttctaagccatggagagtacagtgggagaaaaatactacttctgtatggtacacgtcgaaaggttctgccgtgtatgcaatcttcttgcactggcccgagaatggagtgctcaacctagagagtcctatcactacgagcacaaccaagatcacaatgcttggcatccagggagacctcaaatggtctacagatcccgataagggactattcatctcccttcctcagttgcccccttctgctgtccccgccgagtttgcgtggaccatcaaacttacaggagttaagtag

SEQ ID NO: 188324 - DNA, 1401 bp, Artificial Sequence
  Description of Artificial Sequence: Synthetic coding sequence
atgcgggcccccggcatgcggagccggcccgccggccccgccctgctcctgctattactattccttggggccgccgagagcgtgcgtcgagcccagccccctcgcaggtacacgcccgactggccctcactcgattcaaggcctctccccgcatggttcgacgaagctaagtttggagtgttcatacattggggggttttctcggtgcccgcctggggatcagagtggttttggtggcactggcaaggggaaggacgccctcagtaccagcgcttcatgcgtgataattatccacctggattctcatacgcagactttggccctcagttcactgcccggttcttccacccagaagaatgggcagatctcttccaggcagcaggcgccaagtatgtagtcttaactactaaacatcacgagggattcaccaactggccctcccccgtgagttggaattggaattccaaagacgttggacctcaccgtgatctggtaggagaattgggcacagccctgcggaagcggaacattcgctacggactgtaccactccttactggaatggttccatcccctgtatctgctcgataagaagaatggattcaaaactcagcatttcgtctccgccaaaaccatgccggaactgtatgatctggtgaatagctacaagcctgacctaatctggtccgatggtgagtgggaatgtccagacacctactggaatagcactaacttcctctcttggctgtataacgacagtcctgtgaaagacgaggtagtggttaacgatagatggggacagaattgcagctgtcaccatggcgggtactacaattgtgaggataaatttaagccccagagtctgcctgaccacaaatgggagatgtgtacttccattgataaattcagctggggttataggcgtgacatggctctgtccgacgtcaccgaggagtcggagattatctcagagctggtacagaccgttagcctgggaggcaactacctgctcaatatcggccccaccaaggatgggctgatcgttccaatcttccaggaacgtcttctggctgttggtaaatggctgtctataaacggggaagcaatttacgccagcaagccttggcgtgtgcagtgggagaagaacactaccagcgtttggtacacatccaagggttcagccgtctatgccatttttctacattggccagagaacggcgtgcttaatctggagtctccgattactacgagcaccaccaagataactatgttgggaatccagggcgatcttaaatggagcacggaccctgataaagggctctttatctccctgccacagctaccaccatccgcagtgccagctgaattcgcctggactatcaagcttactggggtcaagtag

SEQ ID NO: 188325 - DNA, 1404 bp, Artificial Sequence
  Description of Artificial Sequence: Synthetic coding sequence
atgcggccccaggagctgccccggctggccttccccctgctgctgctgctgttgctgctgcttcccccacccccctgcccggcgcactccgccacccgcttcgaccctacttgggaatcactcgatgcacgtcagctccctgcctggtttgaccaggccaaatttggtatctttattcactggggtgttttcagcgtgcccagctttggatcagagtggttctggtggtattggcagaaggagaagatccctaagtacgtagagttcatgaaggacaattaccctccctcttttaaatatgaggattttggcccgctctttacagctaaattcttcaacgccaatcagtgggccgacatctttcaggcttctggcgctaaatatatcgtgctgacgagcaagcatcacgagggctttaccctctggggtagcgaatactcatggaattggaacgccatcgacgaggggcctaaacgagatatcgtgaaggagctcgaggtcgccattagaaatcggaccgatcttaggttcgggttgtattacagtctcttcgaatggttccacccgctattcttagaggacgagtccagtagctttcacaaacgtcaattccccgtatctaaaacgctgccggagctatatgagctggtgaacaattatcagcccgaggtcttatggtccgacggagatggcggcgcgcctgaccagtattggaacagtaccggatttctggcatggttgtataacgagtcgcccgtgcgcgggacagtggtgaccaacgacaggtggggtgccggctcgatctgtaagcacggtggtttctatacctgttctgatagatacaatcctggccatctactgcctcataagtgggaaaactgtatgacaatcgataagctttcgtgggggtaccgtagagaggcagggatctccgattacttaacgatcgaggagctggtgaaacagctcgtggaaacagtgtcttgtggcggaaatctgctgatgaacattggccccacactagatggcacaatcagcgtagtgtttgaagaacggctgcgccagatgggaagttggctgaaggtaaacggcgaggctatttatgagacacacacatggcgatcccagaatgacactgtgactcccgatgtatggtatacgagcaagccgaaggaaaagttggtctacgctatcttcctgaagtggcctacatccgggcagctgttcctcggacatcccaaggccatcctgggggccaccgaagtgaagctactcggccatggacagccactgaactggatatccctggagcagaacggtattatggtggaactgccccagctgacaattcaccagatgccctgtaagtggggatgggccttggcccttacaaatgttatctag

SEQ ID NO: 188326 - DNA, 498 bp, Artificial Sequence
  Description of Artificial Sequence: Synthetic coding sequence
atgcggccccaggagctgccccggctggccttccccctgctgctgcttctgctcctcctcctcccccccccgccctgtccagctcatagcgccactagattcgaccccacctgggagtcactggatgccagacagctcccagcttggttcgaccaagccaagtttggcattttcatacactggggcgtgttcagcgttccgtctttcggcagtgagtggttttggtggtactggcaaaaggaaaagataccaaaatatgtggagtttatgaaagacaactaccctccttcgttcaagtatgaggacttcggcccactttttaccgctaaattttttaacgccaaccagtgggctgacatctttcaggccagcggggccaagtatatcgtgctaacatctaagcatcacgaagcaacttgtcgcgactcttttatgtggcgtaaatcttttgacgagtactgggcacatactcgctggcaccatttttgctccttttag

SEQ ID NO: 188327 - DNA, 498 bp, Artificial Sequence
  Description of Artificial Sequence: Synthetic coding sequence
atgcggccccaggagctgccccggctggccttccccctgctgctgctccttctgctgctgctgccccctcccccctgtcccgcgcactctgctactaggttcgaccctacgtgggaatcgctcgatgcccgccagctgcctgcctggttcgaccaggccaagtttggtatatttatacattggggcgtgttctctgtgccttccttcgggtctgaatggttctggtggtattggcaaaaggaaaagatacctaagtacgtcgagtttatgaaggataattatccaccctcttttaagtacgaagattttggaccattgttcacagccaagttcttcaacgccaatcagtgggccgacattttccaggcatctggcgccaagtacatcgttctcacgagtaagcaccatgaagccacctgccgggattcttttatgtggcgcaagtcattcgatgaatactgggcacacacacggtggcaccatttctgcagtttttag

SEQ ID NO: 188328 - DNA, 330 bp, Artificial Sequence
  Description of Artificial Sequence: Synthetic coding sequence
cagctggtggagaccgtgagctgcggcggcaacctgctgatgaacattggccctaccttggacggcactatcagcgttgtttttgaggagagactcaggcagatggggagctggctgaaagtgaacggagaggcaatatacgagacgcacacttggcggagtcaaaatgatactgtgactcccgatgtgtggtacacctccaagccgaaagaaaagcttgtctacgctatctttttgaaatggcctaccagcggacagctttttctggggcaccctaaggctattttgggcgctactgaggtgcgcggaaactttacactcttcctgtag

SEQ ID NO: 188329 - DNA, 1098 bp, Artificial Sequence
  Description of Artificial Sequence: Synthetic coding sequence
atgtggctgcggagccaccggcagctgtgcctggccttcctgctggtgtgtgtgctgagtgtcatcttctttctgcatattcatcaagactcttttccccatggtctggggttgtctatcctttgccccgatcggagactggtcacgccaccagtagccatattttgcctgcctggaaccgcaatgggcccgaatgcctcctcctcatgtcctcagcaccctgcgtcactgagtggaacctggaccgtgtacccgaatggacgctttgggaatcagatggggcaatatgcgaccctactggcacttgcacaattgaacggacggcgggcttttatccttcctgctatgcatgccgcgctggcccctgtcttccggatcacactcccagtgctggccccggaggtggacagtaggaccccatggcgtgagctgcagctgcacgactggatgtccgaagagtatgctgatcttcgcgatccatttcttaaactttctgggttcccatgctcgtggaccttctttcatcacctgagagagcaaatacgacgggagttcactctgcatgaccacctccgggaggaggcccaaagtgttctcgggcagcttaggttgggaagaacgggcgatagaccgagaacattcgtgggagtacatgtgcggagaggagactacctgcaggttatgcctcagagatggaagggggtcgtcggggactcagcgtaccttaggcaggccatggactggttccgggctcggcatgaggcacctgtattcgtggtcacaagcaatggcatggaatggtgtaaggaaaacatcgatacgtctcagggcgatgtcactttcgctggtgatgggcaagaggccacaccttggaaggacttcgctttgctcacacaatgcaaccacactattatgacgattggcacttttggattctgggctgcctatcttgcgggcggggatacagtttatttggccaactttacattacccgatagtgagttcctcaagatctttaagccagaagccgctttcttgcctgaatgggtgggcattaacgccgatttaagccccctgtggactctggcgaaaccttag

SEQ ID NO: 188330 - DNA, 1068 bp, Artificial Sequence
  Description of Artificial Sequence: Synthetic coding sequence
atgtggctgcggagccaccggcagctgtgcctggccttcctgctggtgtgcgtcctctctgtgatcttcttcctgcacatacaccaggatagctttccacacggtctgggattaagcatattgtgccctgacagacggttggtgactccacctgtggcgatcttctgcctgcctgggaccgccatgggaccgaacgcttcttccagttgtccacagcaccctgcgagcctgtccggtacttggaccgtgtatcccaacgggaggtttggcaaccagatgggacaatatgccaccctcttggctttagcccagttaaacggccgccgagccttcattctacctgccatgcacgctgccctagcccctccagaagtagactctcgtacaccatggcgtgaactgcagctccatgactggatgagtgaggagtacgccgacttacgcgacccgttcctcaaactaagcggatttccctgctcatggacattctttcatcatctaagggagcagattcggcgcgaattcaccctccatgaccacctacgggaggaggcccagtccgtgctcggacagttacggctgggtcgcaccggtgataggcctcggacttttgtcggtgtgcatgtccggaggggcgactacttacaggtgatgccacagcgttggaagggcgtagttggagattctgcctacctgcggcaggccatggactggtttcgcgcgcggcacgaagcccccgtgtttgtagtgacaagtaacggtatggaatggtgtaaagagaatattgacacctcccagggtgatgttacattcgctggtgacggacaagaggctacaccctggaaggatttcgccctcctcacacaatgtaaccacaccatcatgacgatcggcacttttggattttgggcggcatacctggccgggggcgacaccgtgtacctggcaaactttacgcttccagactccgagttcctcaaaatatttaagcctgaagcagcatttctcccggagtgggtgggaattaatgcagacctatccccactgtggaccctggccaagccatag

SEQ ID NO: 188331 - DNA, 1032 bp, Artificial Sequence
  Description of Artificial Sequence: Synthetic coding sequence
atgctggtggtgcagatgcccttcagcttccccatggcccacttcattcttttcgtattcacagtgtctacaatttttcatgtccagcagcggttggcaaaaatacaagccatgtgggagttgccggtgcagattcccgtgcttgcctctaccagcaaagccttgggcccctcacaactcagaggcatgtggacaatcaacgcgatcggaaggctcggaaaccaaatgggagaatacgcgacactgtacgccttagccaaaatgaacggaagacccgcattcataccggcacagatgcactctacgctggctccaatttttagaattactctcccagtccttcatagcgccacggcctcacgaatcccatggcagaactatcacttgaacgactggatggaagaggaatatcgacatatacccggagaatacgtccgctttacagggtatccctgctcttggactttttaccatcacctgagacaggaaattctgcaggagttcactctgcacgatcatgtgcgcgaagaggcacagaagttcctccgtggcctccaagttaacggctcaagaccaggcacttttgttggagtacatgtgcgccggggcgactacgtccacgttatgcctaaagtgtggaaaggagtcgtggccgaccggagataccttcagcaggcactagactggtttagagctcgctatagctcgctgatctttgtggttacatctaatggcatggcctggtgtcgcgagaacattgacacaagtcatggggatgtcgtctttgctggggacgggatcgagggctcccctgcaaaagatttcgctctgctcactcaatgcaaccataccattatgacgatagggacctttgggatttgggccgcatatctgactggaggggacacaatctatctagctaactacacattgcctgactcccccttcctcaaaattttcaaaccagaagccgcctttctgcccgagtggacggggatcgcagcagatctgtccccacttctcaagcactag

SEQ ID NO: 188332 - DNA, 1032 bp, Artificial Sequence
  Description of Artificial Sequence: Synthetic coding sequence
atgctggtggtgcagatgcccttcagcttccccatggcccacttcattctgtttgtttttacagtctctaccatattccatgtccagcagcgtttagccaaaatacaggccatgtgggaactgcccgtccagatccctgttttggcatcaacctccaaggcgctgggtcccagccagttaagaggaatgtggacaattaacgccataggacggctcgggaaccaaatgggcgagtacgcaaccctatacgcattggctaagatgaatggaagaccagcctttatcccggcccagatgcatagtacgctggcccctatattccgcatcacccttcctgtgctgcattccgcgaccgcgagcaggataccttggcagaactaccaccttaatgattggatggaggaggagtatcggcacataccaggggaatacgtccgatttacaggttatccatgcagctggaccttctatcaccatcttcgccaggagattttgcaggaattcactcttcacgaccacgtacgagaggaggcacagaagtttttaagggggctgcaggtgaatggttccagaccgggcaccttcgtgggcgtgcacgttcgacgaggggattacgttcatgtcatgcctaaggtatggaaaggagtggtcgccgatcggagatatctccaacaggctctggactggtttcgtgcacgctattccagtctgatattcgtggttacgtctaatggcatggcctggtgcagggaaaacattgatacttcgcatggggacgttgtcttcgcaggcgatggaatcgagggtagccccgcaaaagacttcgctctgttgacacaatgtaatcatacaatcatgacgattggaacttttggaatctgggccgcttatcttaccggcggcgataccatatacctggccaactacacactgcctgactcacccttcctgaaaatatttaagcctgaagcagccttcttgccagagtggacggggatcgctgccgacctgtcacccttactgaaacactag

SEQ ID NO: 188333 - DNA, 663 bp, Artificial Sequence
  Description of Artificial Sequence: Synthetic coding sequence
atgctggtggtgcagatgcccttcagcttccccatggcccacttcattctcttcgtgtttaccgtgtcaacgatcttccacgtgcagcagcgcctggccaagattcaggccatgtgggaactgcctgtgcagatccctgtgctggcttccacctcaaaggctttaggtccttcccagttaaggggcatgtggacaatcaatgcaattgggcgtctaggaaaccagatgggggaatatgccacgctgtatgccctggcgaaaatgaatggaaggcctgcattcattcccgcccaaatgcatagcacactggcccctatatttcgcattaccctgccagtgctacacagcgctacagcaagccggatcccctggcagaactatcatctgaacgattggatggaagaggagtatagacacattcctggcgaatatgtaaggtttaccggctacccatgcagctggactttttatcaccatttgagacaggaaatcctccaggaatttactctgcacgatcatgttcgggaggaggctcagaagttcttaagaggcctgcaggtgaacgggagccggcccggcacatttgtcggggtgcacgtgaggcggggggattatgtgcatgttatgcctaaggtctggaagggggtcgttgctgacaggtag

SEQ ID NO: 188334 - DNA, 1086 bp, Artificial Sequence
  Description of Artificial Sequence: Synthetic coding sequence
atggaccccctgggcgccgccaagccccagtggccctggcggcggtgcctggccgctcttttgtttcaactcctggtggctgtgtgcttttttagctacctgagagtgagcagggacgacgcaaccgggtccccacgcgcaccatcaggatcttcccgccaggatactacccccacacgccccaccttgctgatacttctgaggacatggccattccatatcccagtggccctgagcaggtgcagcgaaatggtgcctggaactgccgactgccatatcacagccgaccgtaaggtctatccccaggcagatatggtgatagtgcaccactgggacatcatgagtaaccccaaaagccgcctcccgccttctccccgacctcaggggcagagatggatctggttcaacctggagccaccgcctaactgtcagcatcttgaggcccttgaccggtactttaatcttacgatgagttaccgtagcgattctgacatcttcaccccttacggctggctagaaccttggagcggccaaccagctcatcctccgctgaacctgtctgccaagaccgaactggtggcctgggctgttagcaactggaaaccggacagcgctcgggttcgatactaccaaagcctgcaggctcacctgaaggtggatgtgtatggacgttcacacaaacccctacctaaaggcacaatgatggaaacactgtcacgatataaattctatctggcatttgagaatagcttgcatccagactacatcacagagaagttgtggcgcaacgccctggaagcttgggccgtgccagttgttctgggacccagtaggtcaaattacgagcgcttcttgccacccgacgcctttattcacgtcgacgactttcagagtccaaaagatttggctagatatttgcaagagttggacaaggatcacgcccgctatctctcctactttaggtggagagagacgttacgccccaggagttttagctgggcgctcgatttttgtaaagcctgttggaagctgcaacaagaatctcgctaccagacagtccgatccatcgccgcatggtttacctag

SEQ ID NO: 188335 - DNA, 1086 bp, Artificial Sequence
  Description of Artificial Sequence: Synthetic coding sequence
atggaccccctgggcgccgccaagccccagtggccctggcggcggtgcctggcagccttactcttccagttacttgtggccgtgtgtttcttctcttaccttcgcgtgtctagagacgacgcaactggatcccccagggcaccgagtggctcatcgagacaagacacaacccccacgcggccgacattgttgatcctgctacgcacttggccatttcacattccagtggcgctgagtcgttgcagcgaaatggtgcctggaaccgcggactgccacatcaccgcagatcggaaggtctaccctcaggccgacatggtaatcgtgcaccactgggatattatgtcgaatcctaagagtcgattgccccctagcccccggccccagggccaacggtggatctggttcaacttggaacctccacccaactgccagcacctcgaggccctggatcgctattttaatttgactatgagttatagatcggactctgacattttcactccatatggatggctggagccgtggtctggccagcccgctcacccacctctgaacttgagtgctaagaccgagctggtcgcatgggctgtctctaattggaagcccgatagtgcacgcgttagatactaccaaagtctccaagcgcatctgaaggtggatgtatatggccggtcccacaagccactgccaaagggcacaatgatggaaaccttgagtcggtacaaattctatcttgccttcgagaacagcctgcatcctgactatatcacagagaagctctggcggaatgctctcgaggcatgggctgtgcctgtggttttggggccatctcgatctaattacgaacgcttcctgccacccgacgcctttatccacgtggatgatttccagtcaccgaaagacctggccagatatctgcaagagctggataaggaccacgctaggtacctgtcttactttcgatggagagagactcttagaccccgctcattctcctgggccctggacttttgcaaggcctgttggaagctccagcaggagtcacggtaccagactgtgcgtagtatcgccgcctggtttacttag

SEQ ID NO: 188336 - DNA, 1086 bp, Artificial Sequence
  Description of Artificial Sequence: Synthetic coding sequence
atggaccccctgggcgccgccaagccccagtggccctggcggcggtgcctggccgcattgttgttccagctgctggtcgctgtctgtttcttttcatatcttcgcgtgtccagagacgacgccactggaagcccaagggccccctctggtagcagccggcaagatactacacccacacggcctaccttgctgattttactgcggacgtggccctttcacatccctgttgcgttgagtcgttgcagcgagatggttcctggcaccgcagactgccatattacagcagacaggaaggtttaccctcaggccgatatggtgatcgtccatcattgggatattatgagtaatcctaagtcaaggctgcccccatctccaaggccacaaggacagcgctggatttggtttaacttggagccgccacccaactgtcagcacctcgaggccctcgacaggtattttaatttgaccatgtcttatcggtccgattccgatatatttactccttatgggtggctcgagccatggtcgggacagcccgcacaccccccactgaatctgtcagcaaagaccgaactggtcgcctgggctgtttctaattggaagcctgacagtgccagagtccgctattaccagagtctgcaggcccacttaaaggtggacgtttacgggaggtcgcataagccactgcctaagggaaccatgatggagaccctgtctaggtataagttctatttagcgtttgagaattctctccaccctgactatatcaccgagaagctgtggcgtaacgctctggaagcctgggccgtgccggtggtgctggggcctagtaggtctaactatgaacgtttcctgcccccggacgcattcatccacgtggacgatttccagtcacccaaagatctagccaggtacctacaggagcttgataaggatcatgcccgatatctgtcttattttcgatggcgcgagacattgagaccccggtccttctcctgggcactggacttttgcaaggcttgttggaagctccaacaggaaagtcgctatcagacggttcgttccattgccgcatggttcacatag

SEQ ID NO: 188337 - DNA, 1086 bp, Artificial Sequence
  Description of Artificial Sequence: Synthetic coding sequence
atggaccccctgggcgccgccaagccccagtggccctggcggcggtgcctcgctgctctcttatttcaactgctggtggctgtctgtttcttcagctatcttcgggtgtcccgcgatgacgcgaccggcagcccccgagcccctagcggcagtagccggcaagacactacacctacacgacccactctcttgattctgctgaggacttggccgtttcacatacctgtggcactgagccgatgctctgaaatggtccccggcacggctgactgccatataaccgctgaccgtaaggtgtacccccaggcagatatggttattgtgcatcattgggatataatgtccaacccaaaatcccgtttgccgccatcccctcgaccacagggccagcgctggatctggtttaatcttgagcccccccccaattgccaacatttagaagccctcgacagatacttcaatctcactatgagttatagatccgactcggacatctttacaccatacgggtggctcgaaccttggtcaggtcagccagctcacccaccgttaaacctcagcgcaaagaccgagctggtggcttgggccgtctccaattggaaaccggactcagctcgcgtccgctattaccagagtctgcaggcgcatctgaaggtggacgtctacggtcgctcccataagccgttgccaaagggaaccatgatggagactctctcaaggtacaagttctacttggccttcgaaaatagcctgcatccagattatattacagaaaagctgtggcggaatgccctggaggcttgggcagtcccagtagtgctggggccatctcgctctaattacgaaaggttccttccgcccgacgccttcattcacgtcgacgattttcagtcaccaaaggacctcgctaggtatctgcaggaactcgataaagaccacgcgagatatctgtcatatttccgctggagggagactctgcggcctagatcattttcatgggctctagatttctgtaaggcttgttggaagctgcagcaggagtctagatatcagacggtgaggagcatagccgcatggttcacttag

SEQ ID NO: 188338 - DNA, 1593 bp, Artificial Sequence
  Description of Artificial Sequence: Synthetic coding sequence
atgcggcggctgtggggcgccgcccggaagcccagcggcgccggctgggagaaggagtgggcagaagcaccccaggaggcaccaggagcctggagcgggaggctagggccggggagatcaggtcgtaaaggccgggccgtgccaggctgggccagttggcccgcccacttggcacttgcagctaggcccgcacgccatctcggcggcgcagggcaggggcctagaccactgcatagtgggactgcgcccttccactctagggcttccggtgagcgtcagaggcgcctggagcctcagctgcagcacgagagcagatgtagatcctctactcctgcggacgcctggcgtgcggaagcagctttgcctgtgagggccatgggagctccatgggggtctccaacggcggccgcaggtggccgccgcgggtggagaagggggaggggcctgccatggacagtctgcgtgctggcagcggccggtctgacgtgcacagccctgattacatacgcctgctggggtcagctgccacctctgccttgggcctcgcctacccccagcagacctgttggcgtgctgctctggtgggagcctttcggtggaagagatagtgccccgcggccgcctccagattgccgactaagatttaatatctctgggtgccggctactcaccgatcgtgcttcctacggcgaggcccaggctgtgctgtttcaccaccgggatctggtgaaaggaccaccggattggcctcctccttggggaatccaggcacacacagcggaagaggtggacctgcgggttctggactatgaagaggccgcagcagctgccgaagccttagcaactagttcaccacgccctccagggcagcgatgggtctggatgaacttcgaaagtccgtcccatagccccggcttacgcagcttagcgtcaaacctgttcaactggaccttgagctaccgcgcagactctgatgtcttcgtgccttatggctacctgtaccctcgtagccatcctggagatcccccatctggtctggcgcccccattgtcgcgaaagcaggggctagtggcctgggtggtttcacattgggatgaaaggcaggcaagagtgagatattaccaccaactctcccagcacgtcacagtggacgtgtttgggcgtggaggtccaggacaacccgtccccgagattggactcctacacaccgtagccaggtacaagttctatctcgcgttcgagaacagtcagcacctggattacatcacagaaaaactgtggagaaatgctcttctcgccggcgctgttccagttgtgctcgggcccgaccgagcgaattatgagcggttcgttcctcgtggcgcttttatccacgtagatgacttccctagtgccagctcactcgcttcgtatctgctgtttctagataggaatcctgccgtgtaccgaaggtattttcactggcggaggagctacgctgtgcatattacatcattttgggatgagccatggtgtagggtgtgccaggcagtccaacgtgcaggagacaggcccaagagtattcgtaatctggcgtcctggtttgaacgctag

SEQ ID NO: 188339 - DNA, 1125 bp, Artificial Sequence
  Description of Artificial Sequence: Synthetic coding sequence
atggaccccctgggccccgccaagccccagtggctgtggcggcggtgtttggctgggcttctgttccagttactggtcgccgtctgcttttttagttaccttcgggtttcacgagatgacgccacaggttcacctcgaccgggcctgatggccgttgagccagtgaccggggcgcctaatgggtctaggtgccaggatagcatggctactcccgcacaccctacgctgcttattttgctctggacatggccttttaacacgccggtcgccctcccaagatgttcagagatggtcccgggggctgcagactgcaacatcaccgccgatagcagcgtatacccacaggcagacgcagtcattgtacatcactgggacatcatgtacaatccatctgcgaacctgcctccccccactagaccccagggccagcgttggatttggtttagcatggaaagcccaagtaattgcagacacctcgaggcactggatgggtacttcaatttaactatgtcttatcggtccgattcagacattttcaccccatatggctggttagaaccttggagcggccaacccgctcatcctcccctcaatttatccgctaaaactgagctcgtcgcctgggctgtgtctaactggaagccagattccgcccgtgtccgctactatcaatctctgcaagctcacctgaaggtggatgtgtatggccgcagccacaaacctcttcccaaagggacaatgatggaaacactcagccgctacaaattctatcttgccttcgagaacagcctccaccccgactacatcacggagaagctatggagaaacgcattagaggcttgggcggttcccgtagtgctcggtccatctagatccaactacgagcgatttctgccacctgacgccttcatccatgttgacgactttcaatctcccaaagatttggcgaggtatctgcaagagctcgataaggatcatgctcgctacctgtcatacttccattggagagagacactgcgcccgagaagcttctcgtgggctttggcattttgtaaagcctgttggaaattgcagcaagagtcacggtaccagaccgtcagatctattgcagcctggttcacgtag

SEQ ID NO: 188340 - DNA, 1125 bp, Artificial Sequence
  Description of Artificial Sequence: Synthetic coding sequence
atggaccccctgggccccgccaagccccagtggctgtggcggcggtgcctggccggtctgctgttccagctgctggtggcagtgtgctttttctcttacctgagggtgtctcgggatgacgccaccggctccccaagaccggggttgatggcggtggagcccgtgaccggtgcaccaaacggatcaagatgccaggatagcatggcgacacccgcccatcccactctcctcatcctgctgtggacttggccctttaacactcctgtggctctgcctaggtgtagcgagatggtgcccggggcggctgattgcaacattactgcagacagctccgtataccctcaggctgacgcggtcatagtccaccattgggacatcatgtacaacccttccgcgaaccttcccccacctacccggccacaaggacaacggtggatctggttctccatggaatcaccctcaaactgccgacacctggaggcactcgatggctacttcaatcttaccatgagctacagaagcgactctgacattttcaccccctatggttggctggagccatggtcaggccagcctgcacacccccctctcaacctctccgcaaagaccgaattagtggcttgggcggtaagcaactggaagcccgactcggcacgcgtgagatattatcaaagtctacaagctcacctgaaggttgacgtttatggacggagtcacaaaccactgccaaaagggaccatgatggaaactctctctaggtacaagttttatctggcttttgagaacagccttcatccagactacattactgagaagttgtggagaaatgccctggaggcctgggctgttcccgttgtgctcggtccttctcgctccaattacgaaagatttcttccaccggatgcctttattcacgtggacgacttccagagtcctaaggacctagctagatacctgcaggagctcgataaggatcacgcccggtatctgtcctatttccactggcgagagacattgcgccccagatccttctcctgggcgttagcgttttgcaaggcttgttggaaattacagcaagagtctagataccaaactgtgaggagtatcgctgcctggttcacctag

SEQ ID NO: 188341 - DNA, 1080 bp, Artificial Sequence
  Description of Artificial Sequence: Synthetic coding sequence
atggaccccctgggccccgccaagccccagtggagctggcggtgctgcttgaccaccctgctgtttcagctcctgatggcagtatgcttcttctcatacctgcgcgtgtcccaggacgatcctacggtctatcctaatggaagcagatttcccgattctactggaactccagcccattcaattcccttgattctgctgtggacttggccattcaacaagcccattgcactacctcgctgcagcgagatggttcccgggaccgccgattgtaacataaccgctgatcggaaggtctacccgcaagctgacgctgtcatcgtccatcatcgtgaagtgatgtacaacccaagcgcccagttaccacgcagcccgcgccgccaaggacagagatggatttggttttcaatggagagtccaagccactgttggcagttaaaggcaatggacgggtattttaacctgacaatgagctaccggtctgacagtgatatcttcaccccatacggatggctcgagccatggtcgggacagcccgcccatcctcctcttaacctctcagcaaaaacggagctagtcgcgtgggccgtgtccaactgggggcccaactccgctcgagtgaggtattatcagagtctgcaagcccacctcaaagtggatgtctacggaagaagccacaaacccctcccacagggtactatgatggagaccctgtctcgatataaattttacctggccttcgagaactccctgcatcccgattacatcaccgagaaactgtggagaaatgccctggaagcttgggcagtaccggtggtcttggggcccagcagatctaactacgaaaggttccttccgccagatgccttcatccacgttgatgactttcagagccctaaagaccttgccagatatttgcaggagcttgacaaggatcacgctcgatacctctcatattttagatggcgggagacccttcgcccccggtcatttagctgggccctcgctttctgtaaagcgtgctggaagttacaggaagagtcacgatatcagacacgcggtatcgcagcatggttcacctag

SEQ ID NO: 188342 - DNA, 1080 bp, Artificial Sequence
  Description of Artificial Sequence: Synthetic coding sequence
atggaccccctgggccccgccaagccccagtggagctggcggtgctgtctaacaaccctcctgtttcagctgcttatggctgtgtgttttttttcttacctgagagtgtcacaggatgaccccacagtgtatcctaacggaagtagattcccagattcaacaggcacccccgctcactccattcctctcattctgctgtggacctggccattcaacaagcccatagctctcccccgctgctcagaaatggtgcccggtacagccgattgtaatataactgctgacaggaaggtttacccacaggcagatgccgtgattgttcaccacagggaggtcatgtacaacccctctgcacaattgcctcgctccccacgccggcaggggcaaaggtggatctggttctctatggaatcaccatctcattgctggcagctcaaggccatggacggatattttaatttgacaatgtcttatagaagtgatagtgatatattcaccccgtatggatggctggaaccatggtcagggcagccagctcacccccccctcaacctgagcgcaaaaacagagttagtcgcgtgggctgtgagtaattggggtccgaactccgcccgagttagatattaccagtctctccaggcacacctgaaagtggatgtctacggcaggagccacaagccccttcctcaggggactatgatggagactctgtctagatacaagttctatctggcatttgaaaactcactgcatccagactacatcactgaaaagctctggaggaacgcactcgaagcatgggccgttcccgtggtactgggaccgtcgagatcaaattatgagaggtttttgccccctgacgcctttatccatgttgacgacttccagtcccccaaagacctggcccgataccttcaggagttggataaagaccacgcaagatacctcagttattttcgctggagggagacattgagaccacgtagcttcagctgggccctggccttttgtaaggcctgctggaaactccaagaggaatcccggtaccaaactagaggaatagctgcctggtttacctag

SEQ ID NO: 188343 - DNA, 1098 bp, Artificial Sequence
  Description of Artificial Sequence: Synthetic coding sequence
atggaccccctgggccccgccaagccccagtggagctggcggtgctgcctcacaacactactgtttcaactattgatggccgtgtgctttttctcatacctacgcgtatcccaggatgatcctacagtgtatcccaacgggtcccgttttccagacagcactggaaccccagcccacagtatccctctgattctgctatggacatggccattcaataagcccatcgctctgccccgatgcagcgaaatggtccctggcacagccgactgtaacatcaccgccgaccggaaagtctatccacaggctgacgccgttattgtgcaccatcgggaagtgatgtataacccctcggcccagctccctcgcagtccccggcggcagggccaacgatggatctggtttagtatggagtcgccgtcccactgttggcagcttaaagctatggacggatattttaacctgacaatgtcgtatagaagtgactccgatattttcaccccttatggctggctcgagccttggagcggacaaccagcccaccccccattgaacctttcagccaagaccgaacttgtagcttgggccgtatctaattggggacccaatagtgcacgggtgagatactaccagtcactccaggctcacctgaaggttgacgtctatggacgaagtcacaagccactgccccaggggactatgatggagacgcttagccggtataagttctacctggcattcgaaaattccctgcacccggattatatcactgaaaaactgtggcgcaatgccctggaagcttgggctgtgcctgttgtgctcggccctagtaggtcaaattatgaacgttttttacccccagatgccttcatacatgtggacgatttccagtcccccaaggacctcgcgcgctacctgcaagaactcgacaaagaccatgcccgctatctctcttatttccgctggagagagaccctccggcccaggtcattctcatgggccctggccttttgcaaagcctgttggaagctgcaagaggagtcgcggtcaggtggactgatttatttgagaacgaggcttcccgaggcttcgcctgcctag

SEQ ID NO: 188344 - DNA, 1080 bp, Artificial Sequence
  Description of Artificial Sequence: Synthetic coding sequence
atggaccccctgggccccgccaagccccagtggagctggcggtgctgtcttactactctccttttccagctccttatggcagtgtgcttctttagctacctcagggtttcccaagacgacccaaccgtgtaccccaatggctcacgctttcccgactccaccggtactcctgcccacagcattcctctgatcctcctttggacgtggccattcaacaaacctatcgcgctacctaggtgtagcgaaatggtcccggggactgccgactgcaacattaccgcagataggaaggtctatccccaagcagacgctgtgatagtgcatcatagagaggttatgtataacccttcagcccagctccccagaagcccccggcgccaagggcaacgatggatctggttctctatggagagcccttcccattgctggcagctgaaagccatggacggttattttaatttaactatgtcctaccggagtgattcagacatttttaccccttacggctggcttgagccttggtccggacagccagcacacccacccctgaacctgtctgctaaaaccgaactggtggcctgggctgtgtcaaactggggcccgaactccgcccgcgtgaggtattatcaatctcttcaagcccatctgaaggtagacgtctatggccgctcccacaagcctttgccgcaggggacgatgatggaaacactatccaggtataagttctacttggcctttgagaacagcctccacccagactatatcacagaaaagctgtggcggaacgccctggaggcctgggctgtccctgtagtgctcggacccagccggtcaaattacgaaagattcctaccaccggacgctttcatccatgttgacgatttccaatctccaaaagatcttgctcggtatctccaggagctggataaggaccatgccaggtatctgtcctattttagatggagggagacccttcgacctcgttctttctcctgggcccttgccttctgtaaggcctgctggaagcttcaggaggagagccgctaccagactcgcggcattgcagcctggtttacgtag

SEQ ID NO: 188345 - DNA, 1080 bp, Artificial Sequence
  Description of Artificial Sequence: Synthetic coding sequence
atggaccccctgggccccgccaagccccagtggagctggcggtgctgcctgactaccctgttattccaacttctaatggccgtctgcttctttagttacctcagggtttcgcaagatgacccaacagtatatccaaacgggagtaggttccccgactcaacaggcactcctgcccactccataccactaatcctgctgtggacctggccgtttaacaagccaatcgcccttccgcggtgttctgagatggttcccggcactgcagattgtaacatcactgctgaccgaaaagtgtatccccaggccgatgctgtgatagttcatcatcgggaggttatgtacaaccccagcgcccagctccccaggtcacccaggagacagggccagagatggatctggttcagcatggagtcaccgtcacactgttggcaactgaaggcgatggatggttattttaacttaacgatgtcctatcgaagcgactccgacatttttacaccttacgggtggttagagccttggtccggacagcctgctcaccctccactgaatctctccgctaaaaccgagttagtggcatgggccgtctcgaactggggaccaaattcggcccgtgttaggtattaccagtctctgcaggcccacttgaaggtggatgtatacgggagaagccacaagcccctcccgcagggtactatgatggagacgctgagcagatacaaattctatctagcatttgagaactccctgcaccctgactacattacagagaaattgtggcggaatgctcttgaagcttgggccgtgcccgttgtgctaggaccatctaggtccaactacgaacggttccttccacctgatgcttttatccatgtcgacgatttccagtcaccgaaagaccttgcaaggtatttgcaggagttggacaaggaccacgcccgctatctttcctacttccgatggagggagacactccgacctaggtctttctcgtgggcgctcgcattttgcaaggcgtgctggaagcttcaggaggagtctcgttaccaaactagaggtattgccgcctggtttacatag

SEQ ID NO: 188346 - DNA, 93 bp, Artificial Sequence
  Description of Artificial Sequence: Synthetic coding sequence
atggaccccctgggccccgccaagccccagtggagctggcggtgctgtctcaccaccctgttgttccagctgctgatggcggtgtgcttttag

SEQ ID NO: 188347 - DNA, 414 bp, Artificial Sequence
  Description of Artificial Sequence: Synthetic coding sequence
atggaccccctgggccccgccaagccccagtggagctggcggtgctgcctaacaaccctgctcttccagctgcttatggcagtttgcttcttcagttatctaagagtctctcaagacgatcccaccgtctaccctaatggcagccgctttcctgacagcaccggaactccggcacacagtatcccactgattttgctttggacgtggccctttaataaaccaattgccctgcctaggtgctcagagatggtacctggtaccgcagattgtaacatcaccgcggatcgcaaagtttacccccaggctgacgccgtcatcgtccatcatcgggaggttatgtataatccatccgcccagttgcctagaagccctcgcaggcagggacagagatggatctggttctctatggagtag

SEQ ID NO: 188348 - DNA, 210 bp, Artificial Sequence
  Description of Artificial Sequence: Synthetic coding sequence
atggaccccctgggccccgccaagccccagtggagctggcggtgctgcctgactactcttctgttccagcttttgatggctgtgtgctttttttcatacctgcgtgtgagccaagatgacccgacagtctatcctaatggttcaaggttcccagatagtactgggacccccgcacatagcataccgttgatccttctatggacctggtag

SEQ ID NO: 188349 - DNA, 201 bp, Artificial Sequence
  Description of Artificial Sequence: Synthetic coding sequence
atggaccccctgggccccgccaagccccagtggagctggcggtgctgtcttacgaccctgttattccagcttttgatggcggtgtgcttcttctcctacctcagggtgtcccaggacgaccccaccgtgtacccaaatggatcaagattccccgactccacgggaactccagcacactccatcccactgatcctgctctag

SEQ ID NO: 188350 - DNA, 138 bp, Artificial Sequence
  Description of Artificial Sequence: Synthetic coding sequence
atggaccccctgggccccgccaagccccagtggagctggcggtgctgtttaacaaccttactgttccaactcctcatggctgtctgttttttttcatacttgagggtgtctcaggacgatcctactgtctatccatag

SEQ ID NO: 188351 - DNA, 1029 bp, Artificial Sequence
  Description of Artificial Sequence: Synthetic coding sequence
atgaacaacgccggccacggccccacccggcggctgcggggcctgggggtactggcaggagtggctcttctagccgccctctggctcctgtggctactcggtagtgctccccgaggcactccagcgccccaaccaactatcaccatattggtgtggcattggccctttactgaccagccacccgaattgccaagcgacacttgcactaggtatgggatcgctcgatgccacttaagtgctaatcggagcctgctcgccagcgcggatgcagtggtgttccatcatcgcgagctgcagacccgcagaagtcacctgcccctagcccagcgacctagaggacagccttgggtgtgggcctcaatggagtccccctcccacactcacggattgagccacctgcgaggaatctttaactgggtgctcagctataggagagatagtgatatatttgtgccatacggaaggctggaaccacactggggaccctccccccccctgcctgctaaaagccgtgttgctgcctgggtggtgtctaactttcaagaacggcaacttcgggctcgcctctaccgacagctggcacctcacttgagggttgacgtgttcgggagagccaatgggcgcccattgtgcgcttcctgcctggtgccaacagtggctcagtatcgcttttacctcagctttgagaatagccagcaccgcgactacattacagaaaaattctggcgcaatgcgctcgtggctgggacagtgccagtggtgttaggacctcctcgtgccacgtatgaggcctttgtgcctgctgacgcattcgtgcacgtggacgactttggttcagctcgcgagcttgcagcatttctgaccggcatgaacgagtcacgctaccagcgcttcttcgcatggcgggatcggctaagggtgagactgttcactgactggcgcgagcgcttctgcgcgatctgtgaccggtaccctcaccttccgaggagtcaggtttacgaggatctggaaggatggtttcaggcatag

SEQ ID NO: 188352 - DNA, 1728 bp, Artificial Sequence
  Description of Artificial Sequence: Synthetic coding sequence
atgcggccctggaccggcagctggcggtggatcatgctgatcctgtttgcttggggaacactgctgttctacatcggcgggcatctcgtcagggacaatgaccaccctgaccactcatcacgagaactcagcaagatactggctaaattggagcggctgaagcaacaaaacgaggatctgagaaggatggcagaaagcctgcgtatacctgagggccctatagatcaaggaccagccatcgggcgggtgagggtccttgaggagcagctggtgaaggctaaggagcagatcgagaattataagaaacaaacgcgaaatggtctaggaaaggatcacgagattttgcggagaaggatagagaacggggccaaggaactgtggtttttcttgcagagcgaactaaaaaagctcaagaatctggaaggcaatgagctacagagacacgccgacgagtttttacttgatctgggacatcacgaaaggagcatcatgaccgatctctattacctgtctcaaaccgacggtgcgggcgactggagggaaaaggaagccaaagacctgactgagctggtgcagagacgcattacctatctccaaaatcctaaagactgtagtaaagccaagaaactggtatgcaacatcaacaagggctgtggctacggttgccagttacatcatgtggtatactgtttcatgattgcctacggaacacagaggaccctcatcttggagtcccagaattggcggtacgcaactggcggctgggagacagtgttccgcccagtgagcgaaacctgcaccgatcgcagcggcatcagcacaggccattggtctggggaagttaaagacaaaaatgtgcaagtagtggaattgccaatcgttgactccctgcaccctaggccaccttacctcccccttgccgtcccagaagatttggcagatagactcgtgagagtgcatggagaccccgccgtttggtgggtctcacaattcgtaaaatacctcattagacctcagccttggctggaaaaggagattgaagaggccactaaaaagcttggctttaaacatccagtcattggtgtgcacgtgcgtcggacagataaagtcgggacggaggcagcctttcaccctatcgaggagtacatggtacacgtggaggagcacttccagctgcttgctcgacggatgcaagtcgataaaaagcgggtctaccttgccacagatgatccctccctgctgaaagaagcaaagacaaagtacccaaattacgaattcatttcagataattctatcagctggagcgcagggctgcataataggtacactgaaaattctctgcggggcgtgatcctggacattcacttcctgagccaggccgattttctggtctgcaccttttcttcccaggtttgcagggtggcatacgaaattatgcagaccctgcaccccgatgctagtgccaattttcacagcctagacgacatctattatttcggtggacaaaacgcacataatcagatcgctatctatgcccaccagccacgcactgcagatgaaatacctatggaaccaggcgatatcatcggtgttgcaggtaaccattgggacggctattctaagggtgtaaatcgcaagttgggacgcacaggcctttacccatcatacaaggtaagggagaaaatcgagacagttaagtaccctacctatccggaggctgaaaaatag

SEQ ID NO: 188353 - DNA, 1728 bp, Artificial Sequence
  Description of Artificial Sequence: Synthetic coding sequence
atgcggccctggaccggcagctggcggtggatcatgctgatcctgttcgcctggggtacactgctgttctatatcggggggcatctggtgagggacaatgaccaccctgatcattccagccgcgagctgtcgaagattctagccaagctggagcgtttgaaacagcagaacgaggaccttcgacgtatggccgaatcattgcggatacccgaagggcctattgaccagggcccagccatcggcagggttcgtgtgctcgaagaacaattggtcaaggcaaaggagcagattgaaaactataaaaagcaaacaaggaacggccttggaaaggatcatgagatcctgaggcggcggatcgaaaacggcgcgaaggaactgtggttctttctgcaatccgaactgaagaaactgaaaaatctggagggaaacgagcttcaaagacatgccgatgagtttctgctggatctggggcatcatgaaagatccatcatgacagatctgtattacctctcccagacagacggcgccggggactggagggaaaaggaagctaaagatctcacagaactcgtacagcgaaggattacttacttacagaaccccaaggactgtagtaaagctaagaaattagtatgtaacattaataagggctgtggttacggctgccaactgcaccacgtcgtctactgtttcatgatagcatatggaactcagcggacattgatcttagagagtcagaactggagatatgcgactggagggtgggaaactgtattcagaccagtgtctgagacatgcacagaccgcagcggaatttcaactggccactggagtggggaagtgaaagacaagaacgtgcaggtcgtcgagctcccaattgtggactccctgcacccacggccgccttacttacctctcgcagtcccagaagacctggcagatagactggttagagttcacggcgatcccgcagtatggtgggtcagccaatttgtgaaataccttattcgccctcagccatggcttgagaaggaaatcgaagaggccacaaagaagctgggattcaagcacccggtcatcggagtacacgttcggcgcactgataaggtgggtaccgaagccgcttttcatcccatcgaagagtatatggtgcacgtggaggaacactttcagctgttggctagaagaatgcaagtggataaaaagcgcgtgtacctcgccaccgacgatccctccctactgaaagaggccaaaaccaagtacccgaattatgagtttattagtgacaacagtataagctggtcggcggggttgcacaaccgttacaccgaaaattcactcagaggcgtgatactcgatatacactttctctctcaggccgactttctggtgtgtacgtttagtagccaggtttgtagagtggcctatgagattatgcagaccctgcatcccgacgccagcgctaactttcatagcctggacgacatctattattttggaggccaaaatgcacacaatcagattgcaatttatgcacatcaaccccgtactgcagacgaaattcccatggagccgggtgatataataggagtggccggcaaccactgggacgggtacagcaagggagtaaatcgaaaactggggaggactggactctacccaagttacaaggtgcgggagaagatagagacagtcaaatatccgacctacccagaagccgagaagtag

SEQ ID NO: 188354 - DNA, 1728 bp, Artificial Sequence
  Description of Artificial Sequence: Synthetic coding sequence
atgcggccctggaccggcagctggcggtggatcatgctgatcctgtttgcttgggggacattgctgttctacataggcggccacctggtgagagataacgaccatcccgatcatagtagcagagaactgagtaagatcttggccaagcttgagcggctgaaacaacaaaacgaggacctgagaaggatggctgaatctctgcggatcccggaaggcccgattgaccaaggtcccgctataggcagagtccgggtcctggaggaacagctcgtgaaggcaaaggagcaaatagaaaattataaaaaacaaacccgtaacggcttgggcaaggaccacgagatcctgcgtcggaggatagagaacggtgcaaaggaactctggttcttcctgcagtcggaactgaagaaactgaaaaacctggaaggtaatgaactacaaaggcatgcggatgagtttctcctggatctcgggcaccacgagaggagtataatgaccgatctttattatctgagtcagacagacggagcaggtgactggcgggagaaggaggcaaaggatttgacggaacttgtgcagaggcggatcacctatttgcaaaacccaaaggattgttccaaagctaaaaagctggtatgcaatattaacaagggctgcggatacggctgccagttacaccatgtggtgtattgcttcatgattgcctacggaactcaaaggactctcatactcgaatcacagaactggaggtacgccaccgggggctgggagacagtttttagacccgtgagcgagacctgcaccgataggtcgggaatcagcaccggtcattggtcaggagaggtgaaagacaagaatgtacaagttgtggaactccctatcgtggactccctgcacccacgtccaccgtatctgccactggcagtcccggaagaccttgcagaccgcctcgtgcgcgttcacggggatcctgcggtgtggtgggtttcccagtttgtcaagtatctgatacggcctcaaccgtggcttgagaaagaaatcgaggaggctaccaaaaaattggggttcaaacatcctgtcatcggggtgcacgttcgaaggactgataaagtgggtaccgaagccgccttccaccccatcgaggagtacatggtgcacgtcgaagagcatttccagctcctggcacgacggatgcaagtcgataagaagagggtgtatttggcaactgatgacccttcactcctgaaggaggctaaaacaaagtacccgaactatgaattcattagcgacaatagcattagctggagcgctggcttgcacaatcgatatacagagaatagtcttcgaggggtgattcttgatattcacttcttaagtcaggccgactttctggtgtgcaccttctcaagccaggtctgtagggtggcctacgaaatcatgcagactctgcacccggatgcctctgccaattttcacagtctggacgacatttattattttgggggccagaatgcgcataatcagatcgcgatctatgctcatcagccaagaaccgcagacgagattcccatggaaccgggcgacattattggggtggccggcaaccattgggatgggtactccaaaggagtgaatcggaaactgggaagaaccgggctgtacccttcttataaagtacgggagaagatcgaaaccgttaagtaccccacttacccagaagccgaaaaatag

SEQ ID NO: 188355 - DNA, 510 bp, Artificial Sequence
  Description of Artificial Sequence: Synthetic coding sequence
atgcaccggcagatctggcacctgcactggaccctggtgcggtaccccaactacgagtttatcagtgacaactcaatcagctggagcgccggactgcataatcgatacaccgaaaatagcctgaggggtgtgatcctggacattcactttctgtcccaagctgactttctagtgtgcaccttttcttcacaggtttgcagagtagcgtatgagatcatgcagacgctccatccggatgcatctgcaaatttccactctctcgatgatatctactacttcgggggacagaatgcacataaccaaatcgctatctacgcacatcagcctcggactgcggatgaaattcctatggagcccggcgatattatcggcgtagcagggaaccattgggacggatactcaaagggagtgaacagaaaactcggaagaaccggcttataccctagctataaagtgcgagagaagatagaaaccgtgaaatatccgacgtatccagaagcagagaagtag

SEQ ID NO: 188356 - DNA, 48 bp, Artificial Sequence
  Description of Artificial Sequence: Synthetic coding sequence
atgcggccctggaccggcagctggcggtggatcatgctgatcctgtag

SEQ ID NO: 188357 - DNA, 135 bp, Artificial Sequence
  Description of Artificial Sequence: Synthetic coding sequence
atgcggccctggaccggcagctggcggtggatcatgctgatcctgtttgcgtggggcaccctactcttttacattggcggccacctggtgcgagataatgaccatccggaccatagctctcgagagctgtcctag

SEQ ID NO: 188358 - DNA, 141 bp, Artificial Sequence
  Description of Artificial Sequence: Synthetic coding sequence
atgcggccctggaccggcagctggcggtggatcatgctgatcctgttcgcctggggcactctgcttttctacatcgggggtcatctcgtgagagataatgaccacccagaccattcttctcgtgagctttcaaagatttag

SEQ ID NO: 188359 - DNA, 126 bp, Artificial Sequence
  Description of Artificial Sequence: Synthetic coding sequence
atgcggccctggaccggcagctggcggtggatcatgctgatcctgttcgcatggggcacacttttattctacattggagggcatctggtcagagacaacgaccaccccgatcactctagtcgttag

SEQ ID NO: 188360 - DNA, 93 bp, Artificial Sequence
  Description of Artificial Sequence: Synthetic coding sequence
atgcggccctggaccggcagctggcggtggatcatgctgatcctgtttgcctggggcaccctcctattctacatcggaggccatctggtatag

SEQ ID NO: 188361 - DNA, 1239 bp, Artificial Sequence
  Description of Artificial Sequence: Synthetic coding sequence
atgaccgacctgtactacctgagccagaccgacggcgccggcgactggcgggagaaagaggccaaagacctgaccgagcttgtacagagaagaataacgtatctgcagaatcccaaagactgtagtaaggctaagaagctagtatgcaacataaacaaggggtgtggctacggttgtcagctgcatcacgtggtgtactgctttatgatcgcctacggtacacagcgcaccctcattctggagtcccagaactggcggtatgctacgggagggtgggagacagtgttcagaccagtgtcggagacttgcactgacaggagcggaatctctactgggcactggtcaggcgaggtgaaggacaaaaacgttcaggtggttgaactgcctattgttgatagcctgcatccccgcccaccatacttgcccctggctgttccggaggacctggcggaccgcctggtgcgggtgcatggcgacccagcagtatggtgggtatcccagtttgtcaagtaccttatcaggccacagccctggctcgagaaagagatagaggaagcaactaaaaagctcggattcaaacaccctgtcatcggggttcacgtgaggagaacggacaaagtgggcacagaggctgcatttcacccaatcgaggagtacatggtgcacgtcgaagagcacttccagcttttggctaggcgcatgcaggtcgacaagaaacgcgtatatctagccacggatgatccctctttgctcaaagaggcaaaaaccaagtacccgaactacgagttcatttccgacaattctatctcctggtccgctggccttcacaaccgttacacagagaacagcctcaggggtgtgattttggatatccacttccttagccaggccgactttctggtctgcacgttctcaagccaagtatgcagggtggcatacgaaatcatgcagaccctgcatcctgacgcctcggcgaatttccattcactggacgacatctactatttcgggggacaaaatgcacacaatcagatagccatctatgctcatcagcccaggacagctgacgaaatacccatggaacctggagacattattggcgtcgcgggcaatcactgggacggatattccaaaggcgtgaaccgaaaacttggccgcactggactgtacccttcctataaagtgagagagaagatcgaaaccgtgaagtatcccacgtacccagaggcagaaaagtag

SEQ ID NO: 188362 - DNA, 153 bp, Artificial Sequence
  Description of Artificial Sequence: Synthetic coding sequence
atgcggccctggaccggcagctggcggtggatcatgctgatcctgttcgcctggggcacgctgttgttttacatcggtggacacctcgtccgtgacaacgaccatcccgatcatagttctcgggagctttctaagatactcgcaaagctttag

SEQ ID NO: 188363 - DNA, 1080 bp, Artificial Sequence
  Description of Artificial Sequence: Synthetic coding sequence
atgaccagcaccagcaagggcatcctgcggcccttcctgatcgtgtgtatcattttgggatgcttcatggcatgtttgctgatctacataaagcccaccaactcatggatcttctcaccgatggagagtgcctcatcagttctaaagatgaagaacttcttctccacgaaaacagattacttcaatgagactacgatcctggtgtgggtttggcccttcggccagacatttgatctgacttcctgccaggcgatgtttaacatccaagggtgccatcttaccacagatcggtctctgtacaataagtcccacgccgtattgatccaccatagggacataagctgggacctaacaaatttgcctcagcaagcgagacctccattccagaagtggatttggatgaatctggagtccccaactcatacccctcagaagagcggaattgagcatttgttcaaccttacattgacatatcgtcgagacagtgatatacaagtgccatatggcttcctgacggtgtccacaaatcccttcgtgtttgaggttccatccaaggagaaactcgtatgttgggtggtctcgaactggaatcccgagcatgcccgggtcaagtactataacgagctgtccaagtctatcgagattcacacctatggtcaggccttcggcgagtacgtgaacgacaaaaatctaatccccactatttcaacctgtaaattctacctttcttttgaaaactcaatccacaaggattacatcactgagaagctgtataacgcgttcctggctgggagcgtcccagtcgtgcttgggccctccagggaaaactacgagaattacatccctgctgactcctttattcacgtggaagattataactctccttccgaactggcaaagtatctcaaagaggtggataagaacaataaattatacctgtcgtatttcaattggaggaaagactttaccgtgaacctgcccaggttttgggaatcacacgcatgtctggcatgcgaccacgtgaaacgacaccaagaatacaaaagcgtgggtaatctcgaaaagtggttttggaattag

SEQ ID NO: 188364 - DNA, 660 bp, Artificial Sequence
  Description of Artificial Sequence: Synthetic coding sequence
atgaaccggctgttcggcaaggccaagcccaaggccccccccccctctcttacagattgtatagggacagtggatagtagagctgagagcatcgacaagaagatttccaggcttgacgcggagctggtgaagtacaaggatcagatcaagaaaatgagggaggggcccgcaaaaaacatggtgaaacagaaagctctaagagtgctgaagcaaaagagaatgtatgaacagcaaagagataatctcgcccagcagagcttcaatatggaacaggcaaactacaccatccagtcccttaaagacactaaaaccactgtggatgccatgaaactgggagtgaaggagatgaaaaaagcgtacaaacaggtgaagatcgaccagattgaggacctccaggaccaactcgaagacatgatggaagacgccaatgaaatccaggaggccctgagccgatcgtatggaaccccagaactggacgaagacgacctcgaggccgagctcgacgcgctgggagatgaactactggctgacgaagacagctcctatctcgatgaagccgccagcgcaccagccatacctgagggggtgccaacggatacgaagaacaaggatggagttctggttgatgaattcggtcttccacagatcccagcctcttag

SEQ ID NO: 188365 - DNA, 1293 bp, Artificial Sequence
  Description of Artificial Sequence: Synthetic coding sequence
atgagccggatcaacaagaacgtggtgctggccctgctgaccctgactagctctgcttttctgctgttccagttgtattactacaagcactacctctctacaaaaaacggtgctggtctgagtaaaagcaaggggagtagaatagggttcgacagcacacagtggcgagccgtgaagaagttcatcatgttgacttctaaccaaaacgtcccggtctttctcatcgatccactgattctggagctgatcaacaagaactttgagcaggttaagaacacatcccatggcagtacttctcaatgcaaatttttctgcgtgcctcgagactttaccgcatttgcactccagtaccacctgtggaaaaacgaggaaggctggttcagaatcgccgaaaacatgggttttcagtgtctcaagatagaaagtaaggatccccgcctggatggcatagatagtctatcgggaaccgaaatacccctccattacatatgtaagcttgcgacccacgctattcaccttgtggttttccatgagcgcagtggtaattatctctggcatggtcacctgagactgaaagagcacattgatagaaagttcgtccccttcaggaagcttcaattcgggcggtatccgggtgctttcgatcgacccgagttgcaacaagtgacagttgacggcctggaggtgctgatcccgaaagatcccatgcatttcgtcgaggaagtgccacattcgcggttcatcgagtgcagatacaaagaagctagggctttttttcaacaatatctggacgataacaccgtggaggcggttgcattcaggaagtccgccaaagagttgctgcagctggccgccaaaacgctgaacaagttgggcgtgccattctggctgtcctccggcacatgcctgggctggtaccgccagtgtaacatcataccatactcaaaagatgtcgacctaggaatcttcattcaggactacaagtcagacatcattctggcctttcaggatgctggattgcccctcaaacacaagtttgggaaagttgaggactctctggaattgagtttccagggcaaggacgatgtgaaactggacgtgtttttcttctatgaagagaccgaccacatgtggaatgggggaacccaggctaaaaccgggaagaagtttaagtatctgtttcccaagttcacattatgttggacagaattcgtggatatgaaggtccacgtgccttgtgagactctggaatatattgaggcgaactacggaaaaaatcaacagggggcctag

SEQ ID NO: 188366 - DNA, 708 bp, Artificial Sequence
  Description of Artificial Sequence: Synthetic coding sequence
atgatcctggaggtgggcgagaacaacggcttcttcagcaagagcctgctgccaaggtacgcaagtaaaaagttgaaatcctcactcccccactctagggcagtaaagaagttcataatgttaacaagcaaccagaatgttccagtgttcttaatcgacccactaatcctcgaactgatcaataagaatttcgagcaggtcaaaaacacctcgcatgggagcacctctcagtgcaaattcttctgtgtcccaagggacttcaccgccttcgctctccaataccacttatggaagaatgaggagggttggtttcgcatagcggagaatatggggtttcaatgtctgaaaattgagtccaaggacccacgactggatggcatagatagcttatctggaacggagattcccctgcactacatctgcaaactcgccactcacgcaatacacctggtggtatttcacgagaggtccgggaactatctgtggcatggccatttacgcctgaaggagcacatcgataggaagtttgttcctttccgcaaactgcagttcgggaggtacccaggagcattcgaccgccctgagctgcagcaggtaaccgtcgacggcctggaggtgctcattccaaaagatccgatgcatttcgtggaagaggtcccgcacagcaggttcatcgaatgtcgttacaaagaagcaagggctttctag

SEQ ID NO: 188367 - DNA, 552 bp, Artificial Sequence
  Description of Artificial Sequence: Synthetic coding sequence
atgagccggatcaacaagaacgtggtgctggccctgctgaccctgactagctccgcctttctgcttttccagttatattattacaagcactacttgtccacaaagaatggagccgggctgtctaaatctaaggggagtaggatcggatttgactccacacagtggagagcagttaagaaatttatcatgctgaccagtaaccagaacgtccccgtttttctgattgatcctttaatcctcgaattaatcaataagaattttgaacaggtgaagaatacctctcacgggtcgacgtcccagtgcaagttcttctgcgtgcccagagacttcacagctttcgccttgcagtaccacttgtggaaaaacgaagaggggtggttcagaatcgcagagaatatgggattccagtgtctgaagatcgagtccaaggaccctcgcctggacggaatcgacagcctatctggcactgagatccctctgcactacatctgcaagttggctacacacgctattcacctggtggtattccatgaaagaagtgggaattattag

SEQ ID NO: 188368 - DNA, 483 bp, Artificial Sequence
  Description of Artificial Sequence: Synthetic coding sequence
tgatggtaccggcagtgcaacatcatcccctacagcaaggacgtggaccttggaatcttcattcaagactacaaaagcgacattatcctcgccttccaagacgctggtctgccactgaaacataagttcggaaaagtcgaggattccctggagctgtctttccaggggaaagacgacgtcaaactagacgtcttctttttctacgaggagacagaccacatgtggaacggcggaactcaggctaaaactggaaagaagtttaagtacttatttccgaaattcaccctgtgttggacagaattcgtagatatgaaggttcacgtcccttgcgagacacttgagtacatcgaagccaattatggaaaagaggcagagagctacatactatctatgctgttccgcacgaccttttggtcgttagccgacttccctctcacccctgagaacaactccagcctgaagaatggcaacctcaacgtgtag

SEQ ID NO: 188369 - DNA, 816 bp, Artificial Sequence
  Description of Artificial Sequence: Synthetic coding sequence
atgagccggatcaacaagaacgtggtgctggccctgctgaccctgaccagtagtgcattcctgctttttcagttgtactattataagcattacctctccaccaaaaacggtgccggtttgtctaagtccaagggatcgaggatagggttcgatagcacacagtggagagccgtcaaaaaatttatcatgctgacctctaaccagaacgtgcccgttttcctgattgaccctttaattttggaactcatcaacaagaacttcgagcaggtgaaaaatacctcacacgggtctacttcacagtgtaaatttttctgtgtgcctcgagactttaccgccttcgctttgcagtaccatctgtggaagaatgaagagggctggttcaggatcgccgagaacatgggttttcagtgtctgaagatcgagtcaaaggatcctagacttgacggtattgacagcctcagcggaacagagatcccccttcactatatctgtaagctcgccactcacgcgattcacctcgttgtgtttcatgagcggtccggcaactatctgtggcatggacatctccgccttaaagagcacatcgacagaaagttcgtgccctttcgcaagctacagttcggtagatatcctggggccttcgaccgaccggagctgcagcaggttacagtcgacggtctagaagtattgatacctaaagaccctatgcattttgtagaagaagtgccccacagccgcttcatagagtgtaggtacaaagaggcgagggccttctttcagatccccgtgtctgaagtttacactgtgctagactag

SEQ ID NO: 188370 - DNA, 1488 bp, Artificial Sequence
  Description of Artificial Sequence: Synthetic coding sequence
atgcggctgacccggtgccaggccgccctggccgccgccatcaccctgaatttgttagtcctgttttatgtctcatggctacagcaccaaccccgtaatagcagggctcggggcccccgaagggcatcagcagcaggaccaagggtgactgtccttgtcagggaatttgaggctttcgataacgccgtgcctgaattggtcgattcattcctacaacaggaccctgctcagcccgttgtcgttgcagctgacactctcccctatccacccctggccctgccgcgtattcccaacgtacggctagcacttctgcagcccgccttggaccgtccagcagctgcttccaggcctgagacatatgtggctacggaattcgtcgcgttggtcccggacggggctcgcgccgaagcccccgggttgctagagcggatggtggaagcccttagagctggctcagcccgccttgtcgccgccccagtcgcaaccgccaaccctgcacgatgcttggcactaaacgtgagcctcagagagtggaccgcccgctacggggccgcaccagctgctcccaggtgtgatgctctagacggagacgcagtcgtcctgctgagggcgcgcgatctgtttaatttatccgcgccgctggcacggccggtgggcaccagcctgtttctccagaccgcccttaggggttgggccgttcagctgctggacctgacttttgccgccgcacggcagcccccactggctaccgctcacgccaggtggaaggctgaacgtgagggtagggctagaagggccgccttactgcgagccttgggcatcagattagtgtcttgggagggcggcaggctagagtggtttggctgtaataaagagacgacacgctgcttcgggaccgtggttggcgacaccccggcctacttatacgaggagcggtggacccccccatgttgcctcagagcccttcgagagaccgccaggtacgtcgtgggagtgcttgaggcagcaggcgtaagatattggctggagggcgggtcgctcctcggagctgcacgacatggtgacattataccatgggattacgatgtcgatttgggcatttatttggaggatgtgggaaattgtgagcagctgaggggagctgaggctggcagtgtggttgatgaacgtggctttgtgtgggagaaggctgtggagggggacttcttcagagtccagtatagcgaaagtaaccacctgcatgtggatctgtggcccttttacccaagaaatggcgtgatgactaaggacacatggctcgatcaccggcaggacgtggagttccctgaacacttcctgcagcccctagttccactgccctttgctggcttcgtggcccaagctccgaacaattaccggcggtttctcgagttgaagttcgggcccggagtgatcgagaacccacagtacccaaaccccgcgttgctgagcctgaccggttcagggtag

SEQ ID NO: 188371 - DNA, 1488 bp, Artificial Sequence
  Description of Artificial Sequence: Synthetic coding sequence
atgcggctgacccggtgccaggccgccctggccgccgccatcacccttaatctgttggtcttattttatgtttcatggctccagcaccaacctcggaactcccgggccagggggccccggagagccagcgccgcaggtccacgtgttactgtgctcgttagagagtttgaagccttcgacaacgctgtgcccgaactggtagacagtttcctccaacaggaccctgctcagccagttgtggtggctgcagatacgctgccatacccccctctggcccttccccggatcccaaatgtgaggcttgcactgcttcagcccgctctcgacaggcccgctgctgcttcccggccggagacttacgtggccacagagtttgtcgcattggtcccagacggggcccgggctgaggcacccgggttattggaacggatggttgaggccctgcgtgccggctctgcgcggttggtggctgcccccgtcgctacagccaatcccgccaggtgcctcgccctgaatgtgtcgctgcgggagtggacagctagatacggagccgccccagcggctccgcggtgcgacgctctggatggagacgccgtggtgctgcttcgggctagagatttgttcaatctatccgccccactggctagacctgtgggcacaagcctgttcctacagactgccctacgcggatgggctgtccagctgttggatctgacatttgccgctgctcggcagccccctctggcaaccgcccacgcacgatggaaggcagaaagagaaggccgcgctaggcgtgctgctcttcttcgtgctcttggcatcaggctggttagctgggaaggcgggaggctagaatggttcggctgcaacaaagaaactaccaggtgtttcgggactgtggtgggggacacccccgcttacctttatgaggaacgttggactccaccatgttgcctgagggcactccgcgagacagcaagatacgtcgtcggcgtgttagaggccgcgggcgtgagatattggttggaggggggcagcctactcggagcggctcggcatggggacattatcccctgggactatgacgtggatcttgggatctaccttgaagacgtcggcaactgcgaacaactaagaggagccgaggcagggagcgtggtggacgagagaggctttgtgtgggaaaaagcggtcgaaggcgacttcttcagagtgcagtactcagagtctaatcacctccatgttgacctgtggcctttctatcccagaaatggtgtgatgaccaaggatacctggctggaccaccggcaagacgtcgaattccctgaacacttcttgcagcccctcgttccactcccttttgccggattcgtagcacaggcacccaacaactatagaagatttcttgaattgaagttcggccctggcgtaatagaaaacccacagtaccccaatccagccctgctgtctctcaccgggagcggctag

SEQ ID NO: 188372 - DNA, 2385 bp, Artificial Sequence
  Description of Artificial Sequence: Synthetic coding sequence
atggagctgcggccctggctgctgtgggtggtggccgccaccggcacactggtgctcctggctgccgatgcgcaaggtcagaaggtgttcactaatacctgggcagtcagaatccccggcgggcccgctgtcgctaactctgtagctcgcaagcacgggtttctgaatctgggacagatttttggggattattatcatttctggcaccggggggttacgaagcgcagcctatctccacatcggcctaggcattcaaggctccagcgcgaaccccaagtacagtggctcgaacaacaagtggccaaaagacgaactaagcgcgatgtgtaccaggagcccacagatccaaaattcccccagcaatggtacttgtccggcgtcacccagcgggacctcaacgtcaaagccgcctgggcccagggctataccggacatggcatagtagtgtccatcctggatgatggtatcgagaaaaaccatcccgatcttgcaggcaattacgaccccggcgcgtcctttgatgtgaatgatcaagacccagatcctcagcctcggtatactcagatgaatgacaatcggcacggcacccggtgcgcaggggaagtggccgctgtagccaataacggtgtttgcggtgtgggggttgcctataacgcccggatcgggggggtgagaatgcttgacggtgaggttactgacgccgtcgaggctcgcagccttgggctgaaccctaaccatatccatatatattccgcctcctggggtcctgaggatgatggcaaaactgtggacgggccagcccgactggccgaagaagccttcttccgtggcgtcagtcaagggcgcggaggcttgggttctatctttgtttgggcaagcggcaacggaggccgcgaacatgacagttgtaattgcgacgggtacacaaattctatctacaccctgagcattagctccgctacacagttcggtaacgttccgtggtactctgaggcttgctcctccaccttggcaaccacatacagcagcggcaaccagaacgagaagcagatagtgactaccgacctccgccagaagtgcacagaaagtcacaccggtacttccgcgtccgcaccactggccgcagggattatcgctcttacacttgaagcgaataaaaatctcacatggcgagatatgcagcacctggtagtgcagacatccaagccagcacacttgaatgccaacgattgggccaccaacggcgtgggaaggaaggtctcccactcgtatggatacggtctcctggatgcgggcgcgatggtagctttggcccagaattggaccaccgtcgcaccccagcgcaagtgtatcattgacattctgacagaaccaaaagatatcggtaaaagactcgaggtgcgaaaaaccgtgacagcttgcctgggcgaacctaaccatattacccggctggagcacgcacaggctagattaaccctgtcctacaaccggcggggcgatctggccatacatctggtatcgcccatgggaaccaggagcacattactggccgccagaccacacgactatagcgctgacgggtttaacgattgggcatttatgacgacccattcctgggacgaagatccatccggcgagtgggtgttagaaatcgagaacacatccgaggccaacaattacggcaccctgaccaagtttacactggtgctatatgggacggcgcctgaggggctccctgtcccccccgagtctagcgggtgcaaaaccctcacctccagtcaggcctgcgtggtgtgcgaggagggctttagcctccatcagaagtcgtgcgtacagcattgtcccccaggcttcgccccacaggtgctggatacacattactctaccgaaaacgacgtcgagaccatccgcgcttccgtgtgtgccccatgccatgcatcctgtgcaacatgccaagggccggcattgaccgactgtctgtcttgccctagccacgcctccctcgaccctgtcgaacagacgtgtagccgtcaatcgcagtcctcccgtgaatcacctccccagcaacagccccctcgactcccgcccgaggtggaggcaggacagaggctgcgcgcgggactgctcccctcgcatctgccagaggttgtggcaggcctgtcatgcgcgttcatcgtcctggtcttcgttacggtgttcctcgtcctccagctccggtctggtttcagcttccggggtgttaaggtttatacgatggacaggggcttaatctcctacaagggactgcctcccgaggcctggcaggaagagtgcccttctgacagtgaagaagacgaaggacggggagagagaaccgcgtttatcaaagatcaatctgccttgtag

SEQ ID NO: 188373 - DNA, 210 bp, Artificial Sequence
  Description of Artificial Sequence: Synthetic coding sequence
aagcccgcccacctgaacgccaacgactgggccaccaacggcgtgggtcgtaaagtctcgcactcctacggctacggcttgtggacacaagctccatggtggccttggcctagaattggaccccagtggcccccatcgggtagcgcctcatctaccagcagcccctctccaaagacctctggtaacggcagtcggtgcggaagaccctag

SEQ ID NO: 188374 - DNA, 210 bp, Artificial Sequence
  Description of Artificial Sequence: Synthetic coding sequence
atggagctgcggccctggctgctgtgggtggtggccgccaccggcacccttgtactcctagccgccgacgctcaaggccagaaagtgtttacaaatacctgggctgtgcgcatacccggcgggccagcggtggccaactctgtcgcgcgaaaacacgggttcctgaatctgggacagatcttcggagactactatcatttttggcattag

SEQ ID NO: 188375 - DNA, 1581 bp, Artificial Sequence
  Description of Artificial Sequence: Synthetic coding sequence
atggccagcaacgactacacccagcaggccacccagagctacggcgcctaccctacccagcccggccaggggtattctcaacagtcttctcagccctacggacagcagtcttactccggctactcacagagcactgacacgagcggctatggccagtcttcctacagttcctacggccaatctcagaacaccggctatggcacccagtctacacctcagggttacggatcaacaggaggatatggctcctcccagagttcccagagtagctatggtcaacagtcatcttacccaggctacgggcagcagcccgccccttcctctacgtccggttcctatggatcttcttcccagagttcatcatacgggcaaccccagagcggctcctattcccagcagccaagctacggcggacaacagcaaagttacggccagcagcagagctataacccaccacagggatacgggcagcaaaaccagtataattcatcatccggaggcgggggagggggcggcggaggagggaactacggacaggaccagtcaagcatgtcttctggaggcggctcggggggggggtatggcaatcaagatcagagcggcggcgggggtagcggaggttatggacagcaggaccggggaggtagaggcagagggggatcggggggcgggggcggcggtggggggggaggttacaatcgttcctctggaggctatgaaccgaggggcagaggtggtggcagggggggccgaggaggaatgggtggatcagatagaggcggattcaacaaattcggggggcctagggaccaaggatcccgacacgacagcgagcaggacaatagtgacaataacactatttttgtccagggcctgggtgagaatgttactattgagagcgttgcagattattttaaacaaatcggcatcatcaagacaaataagaagacaggacagccgatgattaatctctatacagaccgcgagacaggcaagctcaaaggcgaggcgacagtgtccttcgatgacccaccctcagctaaggccgcgattgattggtttgacggtaaggagtttagcggaaatccgatcaaagtctctttcgccactaggagagctgactttaacaggggtgggggcaacggcagaggcggccgaggcaggggaggccctatgggtcgggggggctacggcggcggcggtagcggcggcggaggacgcggcggcttcccaagcgggggcggtggtggcggaggtcagcagagggcaggggattggaaatgccctaatccaacctgcgaaaacatgaatttctcatggcgtaacgagtgcaaccaatgtaaagctccgaagcccgacggccctggagggggcccaggtgggtcccatatgggcggcaactatggcgacgatcgccgaggaggtcgggggggctatgatagaggtgggtacaggggccgcgggggcgataggggcgggttcaggggtggtcgcggtgggggcgacagaggcggttttggacccggaaaaatggattcacgcggtgagcaccgtcaagaccggagggagcgcccttactag

SEQ ID NO: 188376 - DNA, 456 bp, Artificial Sequence
  Description of Artificial Sequence: Synthetic coding sequence
atgaaccccgaggtggtggaggtggccgtggaggccgaggtggcctgggccgaagtcactgttgtagcgtccatcaatcttgttgccttaggaactaaagaccatgtgatgacacctaccaacaaaaagacgggtcagcctatgattaacctttacacagatagggaaactggaaaacttaagggagaggccaccgtgagcttcgatgatcccccctcagcgaaagctgctatagactggttcgatggcaaagagttctcaggaaaccccattaaagttagctttgccacacgccgcgcagatttcaatcggggaggaggcaacgggagggggggaagaggacgaggaggccccatgggccgaggcggctacggcgggggggggagcggaggtggaggacgcggcggatttccttcaggggggggaggcggaggaggccagcagagagcaggctag

SEQ ID NO: 188377 - DNA, 1290 bp, Artificial Sequence
  Description of Artificial Sequence: Synthetic coding sequence
atggccagcaacgactacacccagcaggccacccagagctacggcgcttaccctacccagcctgggcaagggtacagccagcagtccagccaaccatacggccagcaatcctattcaggttatagccagtccacagacacatccgggtacggccagagctcctactccagctatggccagagtcagaatacgggatatggcacccagagcaccccccagggatatggctctaccggcggctacggcagctctcagagtagtcagtcctcctacgggcaacagtccagttatccggggtacgggcagcagccagctccatccagcactagcggatcatacggctcaagctcacagtccagcagttatggacagccccagtcaggaagctacagccagcagccctcctacggcggccagcagcagtcgtatggacagcagcaatcctacaaccccccccagggctacgggcagcagaatcagtataactcttcaagcggaggatatgaacccaggggacggggaggagggagaggcggacgcggtggtatggggggctcagaccgcggggggtttaataagttcggtgggcccagagaccaaggcagccgccacgacagcgagcaggacaatagcgacaataacacaatattcgtgcagggcctcggcgagaatgtcacgatcgagtcagtcgctgattattttaagcagattgggatcatcaagaccaacaaaaaaacaggacagcccatgattaacctgtacaccgacagagaaacaggcaagctcaaaggggaagccactgtgagctttgatgatccaccgtccgctaaggcagcaatcgactggttcgacgggaaggaattctccgggaatccaatcaaggtgtctttcgctaccaggcgggctgacttcaatcgcggaggtggtaacggacgtggcgggcgtggccggggaggcccaatgggaagggggggatacggagggggaggttctggcggaggcgggcgcggtggcttccccagcggaggtggcggaggcgggggccagcaaagggctggagactggaagtgccccaatcccacctgtgagaacatgaacttctcatggcgcaacgagtgtaatcagtgcaaggctcctaagccagatgggccggggggaggacccggcggctcgcatatgggcgggaactatggcgatgacaggagaggcggcgacaggggcgggttcggacctggtaagatggattcaagaggggaacataggcaagacaggcgcgagcggccatactag

SEQ ID NO: 188378 - DNA, 1257 bp, Artificial Sequence
  Description of Artificial Sequence: Synthetic coding sequence
atgggcgaggagggcaccggcggcaccgtgcacctgctgtgcctggctgcctcttcaggtgttccactgttctgcaggagtagcaggggcggggctcccgcgcggcagcagctccctttttcagtcataggtagtctgaatggggttcacatgttcggacagaatcttgaagtccagctgagctctgcacgaacagagaatacgaccgttgtctggaagtcctttcatgactctataacgctgattgtattgtcaagtgaggtgggcatcagtgagctgagactggagcggttgctgcagatggtgttcggcgcaatggttctgcttgttggacttgaggaactcacgaacatcaggaacgtggagaggctgaaaaaagacctgcgtgcctcttactgcctcattgattctttcctgggggactctgagctgatcggcgacctgacgcaatgtgtggattgcgtcataccgccggaagggtctctgctgcaggaggcccttagcggcttcgcagaggcggcaggaactacattcgtcagcttagtggtcagcgggcgcgtcgtggccgccacagaaggctggtggcgcctggggacccccgaggccgtgctgctgccatggctggtcggtagtttacctccccagacggcaagagactaccctgtatatctcccacacgggtcgcccacagtccctcaccgattgctgacactgactcttctgccctcgctagagctctgcctactgtgtggtccaagcccacccttatcccaactgtacccacagctactggagcgctggtggcagcctctcctggacccactgagagcttgtctgcccctaggacctagggcgttacctagcggattccctctccatacagatatcctgggtctcctgttgctccatctcgaactgaaacgatgtctgtttactgtggaaccgctgggggacaaagagccttccccagaacaacgtcgacgcctgttgaggaacttctacacgctcgtcacgagcacccacttccctcccgagcccggtccacccgaaaagactgaggacgaagtgtatcaggctcagctaccccgagcctgctacttagtgctcggaacagaagagcccggaacaggcgtccgactagtggctctgcagctggggcttcggcggctgctgctgctgctctcaccacagtcccctactcacggactgcggtcactggctacacacaccttacacgcgcttaccccactgctttag

SEQ ID NO: 188379 - DNA, 711 bp, Artificial Sequence
  Description of Artificial Sequence: Synthetic coding sequence
atgggcgaggagggcaccggcggcaccgtgcacctgctgtgcctggccgcaagcagtggagtgccccttttttgccggagcagcagggggggagctcccgcgagacaacagttgcctttcagcgtgatcggaagtttaaacggagtacacatgttcggccagaatctggaagtacagctgtcttctgcaaggacggagaatacgaccgtggtctggaagagctttcacgatagcattaccctgattgtcttgtcctcggaagtggggatcagcgaactgagactcgagcgtctgctgcagatggtctttggtgccatggtgcttctggtggggttggaggagttgaccaatatccggaatgtggaacggctgaaaaaagacctgcgcgcttcttattgtctaattgattctttccttggagatagcgagctgatcggcgatctgacccagtgcgtagactgtgtgatcccacccgagggcagtctcctgcaggtgctgggcatgctgtggaaactgcttcatctgttttgttggccctggctgagcccccacccgctgtcgtctgggccgctgagtcagcccccgcctattctgagcgccagttctcccattcccacttggtctcaaaaaaatttattcagcttcttcttcagcttcctatctttgtcctttctttttagcttcctgtccctttttctctttgaaacttag

SEQ ID NO: 188380 - DNA, 1164 bp, Artificial Sequence
  Description of Artificial Sequence: Synthetic coding sequence
atgggcgaggagggcaccggcggcaccgtgcacctgctgtgcctggcagcatcttctggggtgccattgttttgtagatctagtcggggaggtgcacccgcccgacagcaattgcccttttcggtgatcggctccctcaacggcgtccatatgttcggccagaacctagaggtccaactgagcagcgcacggacagaaaataccacagttgtgtggaaatcttttcacgatagcattaccctgatcgtgctgtccagcgaggtggggatttctgagctcaggctggagcgactacttcagatggtctttggggctatggttctgttagtgggtctagaggagctgactaacattcggaatgtcgaaaggctcaaaaaggacctgcgagcttcctactgcttgatagattccttcctcggtgattcagagttgataggggacctcacacagtgtgttgactgcgttatcccccctgaaggcagtttgcttcaggaagcgctctctggctttgccgaggcggctggcacgacatttgtcagcttggtggtgtctggtcgcgtcgtcgcggctacagagggctggtggagactgggcactcccgaagcagtgttacttccttggctagtcggaagcttaccaccacaaacagcccgggactatccagtgtacctgcctcacggatcccctaccgtgccgcacaggctgctcacattgacacttctgcccagtctggagctttgtctcctctgcgggcccagcccacctctgtcccagttatatccacaactgctggagcgttggtggcaacctctcctggacccgctcagggcctgtctccctctgggccctcgcgccctgccctcgggctttcctctgcacaccgacatcctgggtcttctcctgctccacctcgagctgaaacggtgcctgttcaccgttgagccattgggtgacaaggagccctcccctgagcagcggcggcggctccttcgcaatttttacactctggtcacatcaacacacttcccccccgagcccgggccacccgagaagaccgaagacgaggtatatcaggctcaactgcctagggcctgttatctggtgatgggggatggccatcgacacggggcagtgtctgtaagcctcttcatccgttcccagtag

SEQ ID NO: 188381 - DNA, 1149 bp, Artificial Sequence
  Description of Artificial Sequence: Synthetic coding sequence
atgggcgaggagggcaccggcggcaccgtgcacctgctgtgcctggcggcctctagtggggtcccattgttctgccgtagctctaggggaggagctccagccagacagcaactccccttttctgtgatcggcagcctgaatggggtccatatgtttgggcaaaatctggaagtccagctgtcctcggctagaactgaaaataccaccgttgtgttgctggtcggcctcgaggagctgaccaacatccggaatgttgagagattgaaaaaggatctgagagcgtcctactgtttgatcgactccttcctcggggacagcgagcttattggcgatctcactcagtgtgtagattgtgtgatacccccagaggggtccttgctgcaggaggccctatccggtttcgctgaggccgccgggactacgttcgtctcgctcgtagtgtccggccgagtggtggccgctaccgagggttggtggagattggggaccccggaggctgtgttgttgccctggctcgttggctctctgcctccccaaacagctcgcgactatcccgtatatctccctcatggtagtccaacagtgccgcaccgactactgacgttgacattgctgccctccttggagctctgcttactgtgcgggccatctccgccactgagccaactgtacccccagctgctggagagatggtggcagccacttctggaccctctgagggcatgcttaccccttggcccacgcgctctgccttcagggtttcctctgcatacagatatactgggtctgcttctccttcacttggaactcaaacggtgcctcttcactgtggaacctctcggtgataaagagccctccccggaacaaaggcgtagactgttacgcaatttttacaccctggtgacttccacccacttcccaccagaacctggcccccctgaaaaaactgaagatgaggtgtaccaggctcagctgcccagagcgtgctatttggtcctggggacagaggagcccgggaccggggtcaggctcgtggctctacaacttggattgcggaggctcttactgctgctgagtccgcagagtcctacccacggcttgagatccctggcaacccacactttgcatgccctaaccccattgctctag

SEQ ID NO: 188382 - DNA, 279 bp, Artificial Sequence
  Description of Artificial Sequence: Synthetic coding sequence
atggccagcctgggccacatcctggtgttctgcgtgggcctgctgacaatggcaaaggctgaatctcccaaagagcacgatcccttcacctacgactaccagagtctgcagatcggtgggctcgtgatcgctggaatcttgttcatactgggtattctgatcgttctgagcaggagatgtcgctgtaaattcaaccagcagcaacgcacaggcgagcccgatgaagaggaaggtacattcagaagtagcatccgccggcttagcactagacgacgatag

SEQ ID NO: 188383 - DNA, 279 bp, Artificial Sequence
  Description of Artificial Sequence: Synthetic coding sequence
atggccagcctgggccacatcctggtgttctgcgtgggcctgctgacaatggcaaaggctgagtcacccaaagagcacgacccttttacttacgactatcaatccctgcaaattggcgggctggttatcgcggggattctcttcattctcggcattctgatagtgttatctagaagatgccgatgcaagtttaatcagcagcagagaaccggagagcctgatgaggaagaaggcacatttaggtccagtattcggaggctaagcacgcggaggagatag

SEQ ID NO: 188384 - DNA, 195 bp, Artificial Sequence
  Description of Artificial Sequence: Synthetic coding sequence
atggaccggtggtacctgggcggcagccccaagggcgacgtggaccctttttactacgactatgaaacagtccgcaacggcggactcattttcgcgggcctggctttcatcgttggcttactgatcctgctgagcaggcgtttcaggtgtggcgggaacaagaaacgcagacaaataaacgaggatgaaccctag

SEQ ID NO: 188385 - DNA, 201 bp, Artificial Sequence
  Description of Artificial Sequence: Synthetic coding sequence
atgaccggcctgagcatggacggcggcggcagccccaagggcgacgtggacccattttactacgactatgagacggtgcgcaatgggggactcatcttcgctggcctggcctttattgtggggctgctgatactgctgagcaggaggtttcgctgtgggggaaataaaaagagaagacagattaacgaggacgagccttag

SEQ ID NO: 188386 - DNA, 195 bp, Artificial Sequence
  Description of Artificial Sequence: Synthetic coding sequence
atggaccggtggtacctgggcggcagccccaagggcgacgtggacccattctattacgactacgagaccgtccgaaatggaggattgatattcgccggactggcatttatcgtgggacttctcatcttgctgtctcggcgcttcaggtgtggtgggaataagaagcgaagacaaataaacgaggatgagccctag

SEQ ID NO: 188387 - DNA, 264 bp, Artificial Sequence
  Description of Artificial Sequence: Synthetic coding sequence
atgcagaaggtgaccctgggcctgctggtgttcctggccggcttccctgtcctcgatgctaatgacctcgaggataaaaactcgcctttctactatgattggcacagcctgcaagtgggaggcttgatttgcgcgggggttctgtgtgctatgggcattatcatagtcatgagcgccaagtgcaagtgtaagttcggtcagaagagcggacatcaccccggagagacgcctccattgattactcctggatccgctcagtcctag

SEQ ID NO: 188388 - DNA, 342 bp, Artificial Sequence
  Description of Artificial Sequence: Synthetic coding sequence
atgcagaaggtgaccctgggcctgctggtgttcctggccggcttccctgtcttggacgctaacgacctggaagacaagaacagccctttttattacgattggcacagtctgcaggtgggcggactcatatgcgcaggagtgctatgcgctatgggcatcatcatcgtgatgagtgaatggcggtcttctggcgagcaggcgggacgcggctggggaagtcctcccctcacgacacagctgtcacctacaggtgcgaaatgcaagtgcaaattcggccagaagagtggacatcaccccggagagacgcccccactgattactcctgggagtgcccagtcatag

SEQ ID NO: 188389 - DNA, 291 bp, Artificial Sequence
  Description of Artificial Sequence: Synthetic coding sequence
atgcagaaggtgaccctgggcctgctggtgttcctggccggcttccctgtattagatgccaatgacctggaggataaaaacagtccgttctactatgattggcattccctgcaagttggcggactgatatgtgcgggcgtattgtgtgctatgggcataattattgtgatgagcgagtggaggtcatctggagagcaggccgggagaggctgggggagcccccctctgacaactcagttgtctcctacgggcgccaaatgcaagtgcaagttcggtcagaagtccggctag

SEQ ID NO: 188390 - DNA, 264 bp, Artificial Sequence
  Description of Artificial Sequence: Synthetic coding sequence
atgcagaaggtgaccctgggcctgctggtgttcctggccggcttccctgtgctggatgctaatgacctggaagacaaaaacagtccattttactatgactggcattctctccaggttggcggtctgatctgtgcaggcgtcctttgtgctatgggaataattattgtaatgtcagctaaatgcaaatgcaagtttggacagaaatcaggccaccacccaggtgagactcctccactaattaccccaggatcagcccagtcttag

SEQ ID NO: 188391 - DNA, 435 bp, Artificial Sequence
  Description of Artificial Sequence: Synthetic coding sequence
atgggccggggctacagcggcgccctgcaggcccggggcggcctggaggagcctctcgagaggggcttgcgtggtccatccttcacccaaagcccactccatggggcggccgcagcatacctgtctgcgcagcgggatgccagcctgcctgtacccggccaacgaagcgatatgcagaaggtgaccttgggccttttggtgtttctcgccgggtttccggtgctggacgccaatgacctggaagacaagaatagtccattctactacgattggcactccctgcaggttgggggccttatttgtgcgggcgtgctctgcgcaatgggcatcattattgtgatgagcgccaaatgcaaatgcaagttcgggcagaaatcagggcaccatcccggagagaccccacctctcattacgcctgggtcagcccaatcttag

SEQ ID NO: 188392 - DNA, 186 bp, Artificial Sequence
  Description of Artificial Sequence: Synthetic coding sequence
atgcagaaggtgaccctgggcctgctggtgttcctggccggcttccccgtgctggacgccaacgacctggaggataagaattcaccattttattacggcgaaagtccctgccccctgtcacccccacacaaccccacatattgtctagtccctcgagtgcctatccagggatggggcctgacttag

SEQ ID NO: 188393 - DNA, 435 bp, Artificial Sequence
  Description of Artificial Sequence: Synthetic coding sequence
atgggccggggctacagcggcgccctgcaggcccggggcggcctggaagaaccactggagaggggcctgcgtggcccctcgtttacacagtcaccactgcatggcgctgcagccgcctatctaagcgctcagcgggatgcatcgctgcctgtgcctggacaaagatcagatatgcagaaagtgacgttgggcttactggtgttcttagccggattccccgtcctagacgcgaatgatcttgaggacaagaactcgcccttctattatgattggcactctcttcaggtgggcggtctgatttgcgccggcgtactctgtgctatgggaatcattatcgtaatgtccgctaaatgcaaatgtaagtttgggcagaagtctggccaccacccaggtgaaacaccaccactcattacaccaggaagcgcccaatcctag

SEQ ID NO: 188394 - DNA, 288 bp, Artificial Sequence
  Description of Artificial Sequence: Synthetic coding sequence
atggagctggtgctggtgttcctgtgcagcctgctggcccccatggtgctggcttcagcggccgaaaaggaaaaggagatggatccatttcactatgactaccagaccctgcgtatcggaggactggttttcgccgtggtgctgttctctgtgggtattctgttgatcctaagtcgtcgctgcaaatgtagcttcaatcagaagccaagggccccaggcgacgaggaagctcaggtggaaaatctgattaccgccaacgccacagaaccgcaaaaagcggaaaactag

SEQ ID NO: 188395 - DNA, 288 bp, Artificial Sequence
  Description of Artificial Sequence: Synthetic coding sequence
atggagctggtgctggtgttcctgtgcagcctgctggcccccatggtccttgcctcagcggccgagaaggagaaggagatggacccgtttcattacgactatcaaacccttaggatcggtggtttggtctttgcagtcgtgctctttagtgtaggcatcctgcttatcttatctagaagatgcaaatgctccttcaaccaaaaacctcgtgcacctggggatgaagaagcacaggtagagaatcttattaccgcgaacgccacagagcctcagaaggctgaaaattag

SEQ ID NO: 188396 - DNA, 288 bp, Artificial Sequence
  Description of Artificial Sequence: Synthetic coding sequence
atggagctggtgctggtgttcctgtgcagcctgctggcccccatggtgctggcttccgcagcagagaaagaaaaagaaatggacccattccactacgattatcagaccctgaggattggaggactcgtgtttgctgtggtcctgttttccgtcgggatacttctgattctcagtcgaaggtgcaaatgttcatttaaccagaagcccagagcacccggtgacgaggaagcgcaggtcgagaacctgatcactgccaacgcaacagagccccagaaagccgagaactag

SEQ ID NO: 188397 - DNA, 288 bp, Artificial Sequence
  Description of Artificial Sequence: Synthetic coding sequence
atggagctggtgctggtgttcctgtgcagcctgctggcccccatggtgctcgccagcgccgcagaaaaagaaaaagagatggatcctttccactatgactatcagacactgcggatagggggacttgtatttgctgtggtcctgttctccgttgggatccttctgatcctttctcgtagatgtaaatgcagtttcaatcagaaacctagagccccaggcgacgaagaggcccaggtcgagaacctgattacagctaatgccacagagcctcaaaaggcagagaattag

SEQ ID NO: 188398 - DNA, 288 bp, Artificial Sequence
  Description of Artificial Sequence: Synthetic coding sequence
atggagctggtgctggtgttcctgtgcagcctgctggcccccatggtgctggcctcagccgccgagaaagagaaggaaatggatcccttccattacgactatcagaccctgcgaatcggtggtctggtatttgcagtcgttttatttagcgtggggattctgctgatcctgtctcggaggtgcaagtgttcctttaatcaaaagccacgcgccccaggcgacgaagaagctcaagtggaaaatttgataacagcaaacgcaaccgagcctcagaaggccgagaactag

SEQ ID NO: 188399 - DNA, 288 bp, Artificial Sequence
  Description of Artificial Sequence: Synthetic coding sequence
atggagctggtgctggtgttcctgtgcagcctgctggcccccatggtcttagcttccgcagctgagaaagagaaggaaatggacccttttcactatgactaccagaccctcaggattggcgggctggtgttcgccgttgtgctgttttccgtggggattctgcttatcctgtccaggcgatgtaaatgctcatttaatcagaagcctcgcgctccgggagacgaggaggcacaggtggaaaacctaattacggcaaatgctacggagccgcagaaagcagagaattag

SEQ ID NO: 188400 - DNA, 243 bp, Artificial Sequence
  Description of Artificial Sequence: Synthetic coding sequence
atggccacccccacccagacccccaccaaggcccccgaggagcccgatcctttctattatgactataacactgttcagactgttgggatgactctggccactatactatttctattggggatcctcattgttatttcaaaaaaagtgaagtgcagaaaggccgactcgcggtcagaaagtccaacctgtaagagctgcaaaagcgagttaccaagctcggcacccggcgggggaggtgtatag

SEQ ID NO: 188401 - DNA, 402 bp, Artificial Sequence
  Description of Artificial Sequence: Synthetic coding sequence
atggtgagcgtgggcttcggcgaccgggccggcctgggcagcagctgtcgctgctcacaaataaccccggacatggcgagtgccgtcgcaaccagatatgtgctgggacactggccccgcgaccacatctgcggctgtggctcacaccaattaagttcctggagagctgagcccgatggcggtgtgggtatgccacacaccctgagtgagccccccagcggactcacgggcatttgggcaggcgctctggtatcccctgaaaaacagatgaaggagaacctgcgatctaatgatagtgagcctagattgcctgggtttgagtcatgcctgatccactccctggctgtatggccgtgggcttctaattttgcttcactcggcccgagcgtaaacaagggctag

SEQ ID NO: 188402 - DNA, 882 bp, Artificial Sequence
  Description of Artificial Sequence: Synthetic coding sequence
atgtacttcctgacccccatcctggtggccatcctgtgcatcctggtggtttggatatttaaaaacgcggatcgctctatggagaagaaaaagggcgaacctcgaaccagagcggaggctcggccatgggtggatgaggaccttaaagacagctctgatctgcaccaggctgaggaagatgctgacgagtggcaggaaagcgaagaaaacgtagaacacatccccttcagccataatcactatccagaaaaagagatggtgaagagatcacaggaattctatgaactcctcaacaagcgtcgctcagtgcgcttcatcagcaacgaacaggtgcccatggaagttatagacaatgttatccgcactgccggcacggcaccgtccggcgcccacactgaaccctggacatttgttgttgttaaggaccccgatgttaagcataagatccgaaagatcatcgaggaagaggaggagattaattacatgaaaagaatgggccaccggtgggtgaccgacctgaaaaagctgcggaccaactggattaaggagtacctggatactgcgccaatcctgatccttatcttcaagcaagtgcatgggtttgccgccaatggaaaaaagaaagtgcattactataacgagatcagtgtgtctatcgcatgtggcatcctgctcgccgctctacaggttaacaatggcataacgatgaggcaccaaacagctcggcatcgccacttgatcgaagggccaggaaggtcctccgaagcctgtagcaaactgtccagccaggggtgccctgaatgtagaagcggcgattgccattatcactccagtcaactgtggcctagcacggaaggagctcccgggcctccaagaacttag

SEQ ID NO: 188403 - DNA, 1458 bp, Artificial Sequence
  Description of Artificial Sequence: Synthetic coding sequence
atgggctgcgtgcagtgcaaggacaaggaggccaccaagctgaccgaagagcgggacggcagcctgaatcaaagctcaggttatcggtatggcactgatcccacgcctcaacactacccatctttcggtgttacctccatccccaactacaacaactttcacgccgccgggggtcagggcctgacggtctttgggggagtgaatagcagttcacatacgggtactttacgaacacggggcggaaccggggtgaccttgtttgtcgctctgtatgactacgaggctagaacggaggagtggtactttgggaagctgggaaggaaggacgccgagcggcaacttctgagctttgggaatccaagaggaacgtttctcatccgggagagcgaaaccacaaaaggtgcatactcgctgagtatcagagattgggatgatatgaagggcgatcacgtcaagcactacaaaataagaaaacttgacaatggaggatactatataactactcgcgcccagttcgagaccttgcagcagctggtccagcattactccgagaaagctgatggcctgtgtttcaacctgacggtaattgcatcaagctgcacaccgcaaacgtctggcctggcaaaggacgcctgggaggttgcacggaggtcactttgcctggagaagaagctgggacaggggtgcttcgccgaagtgtggctggggacctggaatgggaatactaaggtggcaatcaagacactgaaacccggcacaatgtcacccgaaagctttctagaggaagcccaaatcatgaaaaaattgaagcatgacaagctagtccagttatatgcagtcgtgtccgaagagcccatatacatagtgaccgagtatatgaataaaggcagccttctagattttctgaaagatggggagggacgggccctaaaacttccaaatctggtggacatggccgcacaggttgccgccggtatggcttatatcgagcgcatgaattacatacacagagatctcagatccgcaaacatcctcgtcggtaacgggttgatatgcaaaattgcggacttcgggcttgcccggctcattgaagataacgagtataccgcccgtcagggggcgaagtttcctattaaatggacggcccccgaggccgccctttatggccgctttacaatcaagagcgatgtgtggtccttcggaatcctcttaaccgagttggttacgaaaggccgggtcccctaccccggcatgaataatcgggaggtgctggaacaagtcgagcgcggatatcgcatgccctgcccccaggattgccctattagcctccacgaactgatgatccattgttggaaaaaagaccccgaggagcgccctacattcgaatacttgcagtcttttttggaggattatttcacggcgaccgagccccaatatcagcctggagaaaacttgtag

SEQ ID NO: 188404 - DNA, 1614 bp, Artificial Sequence
  Description of Artificial Sequence: Synthetic coding sequence
atgggctgcgtgcagtgcaaggacaaggaggccaccaagctgaccgaggagagagacggaagtctcaaccagtcctcaggctaccggtacggcacagacccgaccccccagcattatccctcattcggtgtgacgtcaattcctaactacaacaatttccatgcggctggaggccaggggctgaccgtctttggtggagttaattcttccagtcataccgggacactcaggacaagagggggcacgggggtgaccttgttcgtggctttatatgattacgaggcacggacagaggatgatctgtcatttcacaagggagaaaagttccaaatcttaaacagtagtgaaggagattggtgggaggcacgctccttgaccactggtgaaacgggctacattccgagtaattacgtcgctcctgtggatagcattcaggctgaggaatggtattttggtaaactgggcaggaaagatgcagagaggcaactactgtccttcggcaacccaagaggcacctttctgattcgtgaatccgagactaccaaaggcgcctacagcttaagtatccgagactgggacgatatgaaaggcgatcatgtgaagcactataagataagaaagctggataatggcggttattacatcaccacccgagctcaatttgagacgctacagcagctcgttcaacactattccgagcgcgcagccggtttgtgctgcaggctggttgtcccctgccacaaaggtatgccacgcctgactgatctctcggtgaagaccaaagacgtgtgggaaattcccagagagtccctccagctcattaaacgcctgggtaacggtcagtttggggaagtctggatgggtacatggaatgggaatacaaaggtcgccattaaaacactcaaacctgggaccatgtctcccgagagttttttggaagaggctcaaatcatgaagaagctcaaacacgacaagctggttcagctatacgccgtggtctccgaggaaccgatttacatcgtgacggagtatatgaataaagggagtcttcttgacttcctgaaagacggtgagggtcgcgctctgaagctgcctaacctcgtcgacatggctgcacaggttgctgctggaatggcgtatatcgagcgtatgaactatatccatcgggacctgcgcagtgctaacatcttagtcggtaatggcctcatctgcaagatagccgactttggcctagcacggctcatcgaggacaacgaatatacagcccgccagggtgctaaatttcctattaagtggacagcccctgaagctgctctgtatggtcgttttaccattaagtccgacgtgtggagcttcggtattttacttacggagcttgtcacaaaggggcgggtgccttacccaggaatgaataacagggaggtccttgagcaggtggagaggggatatcgtatgccctgcccccaggattgtcctatatcactccatgagctcatgatccattgttggaagaaggaccccgaagagagacccactttcgaatacctccagtccttcttagaagactatttcaccgccacagagccccaataccagccgggcgaaaacctatag

SEQ ID NO: 188405 - DNA, 1449 bp, Artificial Sequence
  Description of Artificial Sequence: Synthetic coding sequence
atgggctgcgtgcagtgcaaggacaaggaggccaccaagctgaccgaagagcgcgacggatccttaaaccaaagttcaggctaccggtatggtaccgaccctacgcctcagcactatccatccttcggagttaccagcatcccaaactacaataacttccatgctgcaggaggtcagggtctcactgtctttggcggggtcaactcttcatcgcatacagggactttgagaactcgcggcggaacgggcgtcacactctttgtcgcactgtatgactatgaggcaagaaccgaggacgacttatcttttcacaaaggagaaaagtttcagattctgaacagcagcgaaggggattggtgggaggcccgctcccttactaccggcgagaccgggtacatcccctcgaactacgtggcacccgtggacagcatacaggcagaagaatggtattttgggaaactaggacggaaagacgctgaaagacagcttctctctttcggcaaccctcgagggactttcttgataagagagagtgagacaaccaagggtgcctatagccttagcatcagggattgggacgatatgaaaggagatcacgtcaaacattataaaattcgtaagctcgacaatggtggctattatataactacacgcgcgcagtttgagactctgcagcagctcgtacagcactattctgggacatggaatggtaacacgaaggtcgctatcaaaaccttgaaacccggcacaatgtcccctgagtctttcctggaggaggcccagattatgaagaaactaaaacacgataagctcgtccaactgtatgccgtagtgagtgaggaacctatatatatcgtgactgaatatatgaataagggtagcctgttggactttctgaaggacggcgaagggagggctttgaaactacctaatctggttgatatggcagctcaggttgccgctggcatggcatacattgaaaggatgaattacatccacagagatctcagatcagctaacattctggtcggcaacgggctgatatgcaaaattgccgacttcggcttagcccgactgatcgaggacaatgagtacactgcgaggcaaggtgcaaagtttcccattaagtggaccgcaccagaggctgctctgtacgggaggttcacaataaagtccgacgtgtggtcgttcggcattctattgacagaactggtaaccaagggtagagtaccctatccgggcatgaacaacagggaggtcctggagcaagtggaaaggggttatcgcatgccgtgcccccaggattgtcccatttctctgcatgagctgatgattcattgctggaagaaggatccagaagagcgcccgacctttgagtacttgcagtctttcctggaggactattttacggcaaccgagccccagtatcaacctggagagaatctttag

SEQ ID NO: 188406 - DNA, 1614 bp, Artificial Sequence
  Description of Artificial Sequence: Synthetic coding sequence
atgggctgcgtgcagtgcaaggacaaggaggccaccaagctgaccgaagagcgggacggctcccttaatcagtctagtggatacagatacgggacagaccccactccacaacattacccatccttcggcgtcacctctatcccaaattacaataacttccacgccgcaggcggccagggactcacggtttttgggggggtcaattcttctagccacaccggcactctccggactaggggtggcacgggggtcaccctgtttgtggccctctatgactacgaagctcgcacggaagatgatctcagttttcacaaaggggagaaatttcaaattctaaatagctccgagggggattggtgggaggctagatctctgaccaccggggagacgggatatattcccagcaactatgtggcgcctgtcgacagtattcaggccgaagaatggtattttggaaaacttggtcgaaaggacgccgagcgccagctcctgtcattcggtaatcccaggggtacctttctaatcagagagtctgagaccactaagggagcctactccctgagcattcgcgattgggatgacatgaaaggcgatcacgtcaagcactacaaaatccgtaagttggacaatggagggtattatattacaacgcgcgctcagttcgaaaccctccagcaactagtgcagcattattctgagcgagctgccggactttgctgtagactggtagtgccctgccacaaaggaatgcctaggcttaccgatctgagtgtaaaaacaaaagacgtttgggagattcctcgcgagtctcttcagctaattaagaggttgggcaacggacagtttggggaggtgtggatgggaacttggaatggaaatacaaaagtggccatcaaaactttgaagccaggtactatgtcccccgagtccttcctggaggaggctcaaatcatgaaaaaattgaagcatgacaaacttgtccagctgtacgccgtggtgagcgaagagccaatctacatcgttaccgagtacatgaacaaaggctcacttttggactttttaaaggacggcgagggtcgggcactgaaactcccaaacttggtggatatggctgcccaggtcgcagctgggatggcctatattgagcggatgaattatatccatcgagatctccggagcgcaaatatcctggtcggcaatgggctgatatgcaaaatcgctgatttcggcttggcccgcttgatagaagacaatgagtacaccgcgaggcaaggggctaagtttcccattaaatggacggcacccgaagctgccctgtacggcagattcaccattaagagtgacgtctggtcttttggtatcctcctgactgaactggtaactaaaggaagagttccttatcccggaatgaataatagagaggtgctggaacaggtggaacgcgggtatcgcatgccctgcccacaagattgcccgatttctctgcatgaactgatgatccactgttggaagaaagatcccgaggaacgccctacgttcgaatacctgcagtccttcctggaagactatttcaccgccacggagccacagtaccagccgggtgaaaacctctag

SEQ ID NO: 188407 - DNA, 1605 bp, Artificial Sequence
  Description of Artificial Sequence: Synthetic coding sequence
atgggctgcgtgcagtgcaaggacaaggaggccaccaagctgaccgaagaacgcgacgggagtttaaaccagagctccggctatagatacggcacagatcctactccacagcattacccctcatttggcgtgacttctatcccgaattataacaacttccatgctgctggcggccaggggctaaccgtgtttgggggggttaacagcagctcgcatacaggcaccctgaggactaggggcggcacaggggtcacactgtttgtggctctgtacgattatgaagcccgcaccgaggacgacctctcctttcacaaaggcgagaagtttcagatacttaactcatcggaaggtgactggtgggaggctagatctctcacaacaggagagactggatacattccaagcaactacgttgcacctgtcgattcaatacaagcagaagagtggtactttggcaagctgggaaggaaggatgcggagcgccagttgctgtcatttggtaaccctcgaggcacattcctgatccgggagtcagaaaccactaagggagcttactcgctgagcatcagagactgggatgatatgaagggggatcacgtcaagcactataaaatccgaaagctggacaacggcggatattacatcacgactcgcgctcagtttgagaccctgcagcagctggtccaacattattcggagaaagccgacggcctctgcttcaatctgacagtgatagcttcgagttgtactcctcagaccagcgggctggccaaggatgcgtgggaggtcgcccggaggtccttgtgcctcgagaagaagctggggcagggctgttttgccgaagtgtggctgggaacctggaatgggaacacgaaggtagctatcaaaacattgaagcccggcacaatgagccccgagagcttcttggaggaagcccagattatgaaaaaactaaagcacgacaaactcgttcagctctacgctgtcgtgagcgaagaaccgatttacatcgtgacagaatacatgaataagggctccctgctggatttcctgaaggacggggaagggcgcgcgctgaagctgccgaacttagttgatatggctgcgcaggtagcagccggcatggcttacattgagaggatgaattacatccacagggacctccggtccgccaacatccttgtgggcaacggtctcatatgcaagattgccgattttggtttagctaggctcatagaggataacgagtacacagcaaggcaaggggccaaatttccaatcaagtggaccgccccagaagccgccctttatggaaggtttactataaagtcggatgtgtggtccttcggcatactactgactgagttagtcactaaaggacgggttccctaccccgggatgaataacagggaggtgttggaacaagtggagcgcgggtaccgcatgccttgcccccaagactgtccaatatccctccatgagctgatgattcactgctggaagaaggatcctgaagagcgcccaacctttgagtatctgcagtcatttctcgaggattacttcaccgctaccgagccccagtatcagcctggcgaaaacctgtag

SEQ ID NO: 188408 - DNA, 1605 bp, Artificial Sequence
  Description of Artificial Sequence: Synthetic coding sequence
atgggctgcgtgcagtgcaaggacaaggaggccaccaagctgaccgaggagcgggatggatctctgaatcagagctctggttaccgttacggtactgacccaacaccccaacactatccaagctttggggtcacctccattcccaactataacaatttccatgctgctggcggacaaggactgaccgtgtttggcggtgtgaactcttcctcacacaccggtaccctgaggacaagaggtgggacaggagttactctctttgtggctttgtacgattacgaggcaagaacggaagatgatctcagctttcataaaggagaaaagttccaaattttgaactcaagcgaaggagactggtgggaggctcggagcttaacaacaggagagacaggttacattcccagcaactacgtggcccctgtggatagcatccaggctgaggagtggtattttggtaagttgggcagaaaagacgccgaacgccaactgctgtcattcgggaaccctagggggacattcctgatccgcgagtctgagacaacaaaaggagcttatagcctctcaattagagattgggatgatatgaagggcgatcacgttaaacactataagattcgcaagctagataacgggggatactacattaccacccgggcccagttcgaaaccctccagcaattggtccaacactactcggagaaagctgacggtttatgtttcaacctgaccgtgatcgccagttcttgcactccacagacatccggcctcgctaaggatgcctgggaagtcgcgcgtagaagcctgtgccttgaaaagaaactgggtcaggggtgctttgcagaagtctggctcggtacctggaatggcaatacaaaagttgcaattaaaactctgaaacctggcaccatgtctccagaatccttcctggaggaggctcagatcatgaagaagttaaagcatgataagctggttcagttatacgcggtggtgtctgaagagccgatttacatcgtcactgaatacatgaacaagggatctcttctggactttctgaaagatggggaaggacgggctctgaaactaccaaacctggtggacatggccgcccaggtcgcagccggcatggcatacattgagagaatgaattacattcatagagacctccgctcagctaatatccttgtcggcaatggactcatttgcaaaattgccgatttcggactcgcgcggctcattgaggacaatgagtatacagctaggcagggagccaagtttccaattaaatggacagcccctgaggccgcgctctatggacgatttactataaagtcagatgtatggtcattcgggatccttctaacagaactggtgactaaagggcgggtcccataccctggaatgaataatcgggaagtgctcgaacaagttgagcgcggctatcgaatgccctgcccacaggattgccccataagcctgcacgagctcatgatccactgctggaagaaagatcccgaggaacggccaaccttcgaatacctgcagtcatttctggaagattatttcaccgctacggagccccaataccagcctggggagaacctgtag

SEQ ID NO: 188409 - DNA, 363 bp, Artificial Sequence
  Description of Artificial Sequence: Synthetic coding sequence
atgggctgcgtgcagtgcaaggacaaggaggccaccaagctgaccgaagaacgtgacggtagcctaaatcagtcatctggttacaggtatggcacagacccaactccgcagcattatccttccttcggcgtgaccagcatacctaactataacaatttccacgccgccggaggccagggcttgacagtgtttggaggggtcaacagcagttcgcacacagggaccctgaggacccggggtggtaccggagttacgttattcgtcgccctctacgattatgaggcgcgcaccgaagacgacctgtcctttcacaagggagaaaagttccaaattctcaactccagtgagggggactggtggtag

SEQ ID NO: 188410 - DNA, 699 bp, Artificial Sequence
  Description of Artificial Sequence: Synthetic coding sequence
atgggctgcgtgcagtgcaaggacaaggaggccaccaagctgaccgaggagagggatgggtccttaaaccagtcctcaggctaccgttacggcactgatccaacacctcagcactacccctccttcggagtgacgtcaatccccaattacaacaattttcatgcagccggcggccaaggactcactgtgtttggcggagtgaactcctcttcccataccggcacccttaggacccggggtggaaccggtgtcaccctctttgtcgctttgtacgactatgaggctcgtacggaggacgacctttcattccacaaaggagagaagttccagatcctcaactcttcggagggggactggtgggaagcccggtccttgactaccggagagacaggctacattccaagcaattacgtggcgcctgtcgatagcattcaagccgaggagtggtactttgggaagctgggacggaaagatgctgagcgacagcttttgtcctttggcaacccacgagggaccttcttaatccgggaaagcgaaacaacaaagggcgcttactccctctccattagagactgggacgacatgaagggcgaccatgtgaagcactataaaatacgcaagctggataatggcggatattacatcactactcgggcgcagttcgagaccctgcagcagttagttcaacactactcctag

SEQ ID NO: 188411 - DNA, 321 bp, Artificial Sequence
  Description of Artificial Sequence: Synthetic coding sequence
atgggctgcgtgcagtgcaaggacaaggaggccaccaagctgaccgaggagcgggacgggtcgcttaaccagtctagtggctacaggtacgggacagatccgactcctcaacactaccccagttttggcgtgacaagcattcctaattataataatttccatgctgctggaggtcagggtctgactgtgtttggtggggtgaactcaagcagtcatacaggaacgctaaggacgaggggcgggaccggcgtcaccctgttcgtagctctgtacgactacgaggctagaactgaggacgatctctctttccataagggatag

SEQ ID NO: 188412 - DNA, 198 bp, Artificial Sequence
  Description of Artificial Sequence: Synthetic coding sequence
atgggctgcgtgcagtgcaaggacaaggaggccaccaagctgaccgaggaacgggatggtagtcttaatcagtcttcaggctaccgctatggtactgacccaacaccccaacactacccctcttttggggtgacatccatccctaattataataattttcacgccgcaggcgggcaggggctgacagtttttgggtag

SEQ ID NO: 188413 - DNA, 528 bp, Artificial Sequence
  Description of Artificial Sequence: Synthetic coding sequence
atgggctgcgtgcagtgcaaggacaaggaggccaccaagctgaccgaggagcgagatggatccctgaaccagtctagcgggtatcgctacggcactgaccctaccccacagcattatccatctttcggcgtcactagtattcccaactacaataattttcatgcggccggggggcaaggcctcacagtctttggcggcgtcaattcatcaagtcataccggcaccttacggactaggggtgggacaggggttacacttttcgtcgcactctatgactatgaggctcgtacagaggatgacttgtcttttcacaagggagagaaattccagattctgaacagttccgaaggagactggtgggaggctcgatctctaacaacaggggagaccggctacatccccagcaactatgtcgccccagtggactctatccaggccgaggaatggtacttcggcaaactggggaggaaggacgctgagcggcaacttctgagttttggcaatcctcgcggcacgttcctaatatag

SEQ ID NO: 188414 - DNA, 462 bp, Artificial Sequence
  Description of Artificial Sequence: Synthetic coding sequence
atgggctgcgtgcagtgcaaggacaaggaggccaccaagctgaccgaggaacgagatggaagtctgaatcagtcttctggttatcgatacggcaccgatccgaccccccagcattatccatcgtttggagtcacttctataccaaattacaataactttcatgccgctggcggacagggtctgactgtgttcgggggagtcaatagcagttcccataccggaaccctgcgaacacggggtggaaccggcgtgacactttttgtcgcgttatatgattatgaggcacgtacagaggatgacctcagtttccacaaaggcgaaaagtttcagattctgaattcgtctgaaggcgactggtgggaggcacgctccctgaccacgggcgaaaccgggtatatccccagcaactacgtggctcccgtggactctatccaggcagaagaatggtattttggcaagtag

SEQ ID NO: 188415 - DNA, 357 bp, Artificial Sequence
  Description of Artificial Sequence: Synthetic coding sequence
atgggctgcgtgcagtgcaaggacaaggaggccaccaagctgaccgaagagcgcgacggttcactgaaccagagctccgggtatcgttatgggactgatcccacgccccaacattatccctcgttcggcgtgacgtccatacccaactataataatttccatgcagccggtgggcaggggctgactgtgttcgggggagtaaactcctcttcgcacaccgggacgctgaggacccgtggcgggacaggcgttaccctgtttgtggcgttgtatgactatgaagcccggaccgaggacgatctaagcttccacaagggagagaaatttcaaatcttaaacagctcagagggagattag

SEQ ID NO: 188416 - DNA, 561 bp, Artificial Sequence
  Description of Artificial Sequence: Synthetic coding sequence
atgggctgcgtgcagtgcaaggacaaggaggccaccaagctgaccgaagagcgtgacgggtccctcaaccagtcctccggctataggtacggaactgaccccacaccccaacactacccgtcatttggggtcacatctatccctaactacaataacttccacgcagcaggcggacaagggcttaccgtgttcggtggagtgaactcctcctcccacactggaaccctgagaacaaggggaggcacgggagttacattgttcgtggccttatacgactatgaagcaaggacagaggacgacctgagcttccacaaaggcgaaaagttccaaatcctcaattcttctgagggcgactggtgggaagctcggtctctgaccacaggggagactggatacattccgtcaaattatgtagctccagtcgactccatccaagccgaagaatggtactttgggaagctggggaggaaagatgcagagcgccagctgctatctttcggcaatcccagagggaccttcttaatcagggaatcagaaacaacaaagggagcctattcttag

SEQ ID NO: 188417 - DNA, 312 bp, Artificial Sequence
  Description of Artificial Sequence: Synthetic coding sequence
atgggctgcgtgcagtgcaaggacaaggaggccaccaagctgaccgaggaacgggatggatccctcaatcagtcctctgggtaccgctacggaaccgaccctaccccccagcactacccaagcttcggcgtgacgtccataccaaactacaataatttccacgcagctggcggtcagggattaaccgtgtttggaggtgtaaacagctcctcccataccggcactttgcgcactcgcgggggaaccggcgtgacactgttcgtagcattatatgactatgaagccagaacagaagatgacttaagcttttag

SEQ ID NO: 188418 - DNA, 459 bp, Artificial Sequence
  Description of Artificial Sequence: Synthetic coding sequence
atgggctgcgtgcagtgcaaggacaaggaggccaccaagctgaccgaagagagggatggcagtttgaaccagagctccgggtacagatatgggactgatcctacgccacagcattaccccagtttcggcgttacaagcattccaaattacaacaacttccacgccgctggtggccagggactcaccgtgtttggtggagttaatagctctagccacaccggcacgctgagaacccgtggcggtactggagtgactctgttcgtcgctctgtacgactacgaggctaggaccgaggacgacctgagcttccacaagggagagaagttccagatactcaactcaagtgagggtgactggtgggaagcgaggagtttgaccaccggcgagaccgggtacattccttccaattacgtcgctcctgtggattcgatacaggcagaggagtggtatttcgggtag

SEQ ID NO: 188419 - DNA, 351 bp, Artificial Sequence
  Description of Artificial Sequence: Synthetic coding sequence
atgggctgcgtgcagtgcaaggacaaggaggccaccaagctgaccgaggagcgtgacggctcactaaatcaatcctccgggtatcgctacggcaccgatcccactccacagcactacccgtccttcggcgtgacttctatccccaattataacaactttcacgctgccggcggtcagggcctcaccgtttttgggggtgtgaacagcagttcccatacgggtaccctacgcacgcgcggtggtacgggggtgacactttttgtagctttgtacgattacgaagccaggactgaggacgacctgtcctttcacaagggagaaaaattccagatccttaatagctcagagtag

SEQ ID NO: 188420 - DNA, 423 bp, Artificial Sequence
  Description of Artificial Sequence: Synthetic coding sequence
atgggctgcgtgcagtgcaaggacaaggaggccaccaagctgaccgaggaacgggacggctctttaaatcaaagttccggataccgttacgggactgaccccacgcctcagcactacccatcgtttggcgtgacaagcatacctaactacaacaatttccatgccgccggcggacagggacttaccgtcttcgggggtgtgaacagctcgtcccacactggaaccttgcggactcgaggaggcacaggcgtcaccctattcgtcgccctttacgattacgaagccaggactgaggatgacctgagcttccacaagggagaaaagtttcagatcttgaattcttctgagggggactggtgggaagcacgctctctcacgactggggagacagggtacattccatccaattacgtcgcaccatag

SEQ ID NO: 188421 - DNA, 438 bp, Artificial Sequence
  Description of Artificial Sequence: Synthetic coding sequence
atgggctgcgtgcagtgcaaggacaaggaggccaccaagctgaccgaggaacgcgatgggagtctaaatcagtcaagcgggtatcgctatgggacagaccctaccccccagcattacccttcttttggcgtgacaagcatccccaattacaataatttccatgctgccggaggtcagggattgacggtgttcggcggggtaaactcttcaagtcatactggcaccctccggacgcgcggcggcacaggcgtcacgttgttcgtggccttatatgattatgaggctcggacagaggacgatcttagttttcacaagggagaaaagttccagattctaaacagttccgagggcgattggtgggaggcacgttccttgacgacaggcgagaccggatatatccccagtaactatgtcgcccccgtggactccatccagtag

SEQ ID NO: 188422 - DNA, 1605 bp, Artificial Sequence
  Description of Artificial Sequence: Synthetic coding sequence
atgggctgcgtgcagtgcaaggacaaggaggccaccaagctgaccgaagagcgggatgggagcctgaaccagtcttcgggctacagatatgggacggatcctactcctcagcattatcccagcttcggtgtcacctccattcccaattacaacaactttcacgctgcgggtgggcaaggactcaccgtgttcggaggggtgaactctagctcccacaccggtactctgcgaactcgagggggaacgggagtgaccctgtttgtggcactatacgactatgaggctcgtaccgaggacgatctgtcctttcacaagggagaaaagttccagattctcaacagttcagaaggggattggtgggaggccaggtctctgacaactggcgaaactggatatatcccgagcaattatgtagcaccagtcgactcaatccaggcagaggagtggtatttcgggaagctcggccgtaaagacgcagaacgacagctcctatcctttggcaacccaagaggtacctttctcattagggagtctgagacgacaaaaggtgcctattcgttgagtatccgggattgggatgacatgaaaggggatcatgtcaagcactataaaatcagaaaactggacaacggtggctactatattaccactcgtgctcagtttgagacacttcaacagctggtgcagcactactcggagaaagccgatggactctgttttaacttaactgtaattgcgtcatcctgcaccccacagaccagcggactcgctaaagacgcctgggaggtggctcgccgaagcctttgccttgagaagaaactcggccagggatgctttgccgaagtttggctgggcacgtggaacgggaataccaaagtggccattaagactctcaaacctggaacaatgagccccgaaagttttctcgaagaagctcagataatgaaaaaactaaagcacgacaagctggtgcagctttacgcagtggtgagcgaggagccaatttatatcgttactgaatatatgaataaaggctccctactggatttcctgaaggatggcgaggggcgcgcccttaaattacccaacctggtcgatatggccgcccaggtggctgcgggaatggcatacatcgaacgcatgaactacatccacagagatcttcgctcggctaatattctggtgggcaacggactgatctgtaagattgccgatttcggattggcacgcctaatcgaggataatgagtatactgcacgccaaggagccaaattcccgattaaatggaccgcccctgaagcggcactatacggacgctttaccatcaaatctgatgtgtggtcctttggaattctgctgaccgaactcgtgactaaaggacgtgtaccatacccgggcatgaataacagagaggtcctcgagcaggtggagaggggttatcgcatgccatgccctcaggactgcccgatttctctgcatgaattgatgatacattgctggaagaaggaccctgaagaacgaccgacatttgaataccttcagagctttttggaggactactttacggctactgagcctcagtaccaacccggtgaaaacctgtag

SEQ ID NO: 188423 - DNA, 1458 bp, Artificial Sequence
  Description of Artificial Sequence: Synthetic coding sequence
atgggctgcgtgcagtgcaaggacaaggaggccaccaagctgaccgaagaacgcgacggtagtctgaatcaatccagcggctaccgttacggtactgatccaaccccacagcactacccatcattcggagtaaccagcatcccaaactataataatttccacgctgctggcgggcagggcctgaccgtcttcgggggcgttaactcttctagccacacaggcacgttacgcactaggggcggcacaggcgttactctgttcgtggctctttatgactacgaagcacaggcagaagaatggtactttggtaaattgggcagaaaagacgccgagcgtcagctcctaagcttcgggaatcctagggggacgtttctcatccgggagtcggaaacaacaaagggtgcttactccctctccatccgcgattgggacgacatgaagggagatcatgtgaagcattacaagatcagaaaactcgacaatggcggttactatattaccacccgcgctcagttcgaaacacttcaacagctcgtccaacattacagtgagaaggccgatggactgtgcttcaatcttacagtcatagcttcttcatgcactccccagacctcaggcctggcaaaagacgcttgggaagtggccagaagaagcctgtgcttggaaaagaagctcggccaggggtgcttcgcagaagtctggttggggacatggaatggtaatacaaaggtagctatcaaaacgttgaagccaggcactatgtcaccggagagctttttggaggaggctcaaatcatgaagaagcttaaacatgacaagctggtacagctttacgcagttgtgtctgaggaaccaatctacattgttactgagtatatgaacaaggggagcctgctcgattttcttaaggatggcgagggaagagcactcaaactccctaatctcgtagacatggcagcccaggtcgctgctgggatggcgtatatagaacgcatgaattacatacatcgcgatttgcgcagcgctaacatccttgtcggtaacggactgatttgcaagattgcagatttcggcctggcacgtctcatagaggataatgagtatactgccagacagggggccaagttccctattaagtggaccgcgccggaggctgccttatatggcagattcactattaagtctgatgtatggtcatttggcatattgctcaccgagcttgttacaaaagggcgagttccctaccccggcatgaacaacagggaggtcctagagcaagttgaaagaggatatagaatgccttgcccccaggactgtcccatctcactccatgaactgatgatccattgctggaagaaagaccccgaagagaggccaacatttgaataccttcaaagttttctggaggactatttcaccgcaaccgagccccagtatcagcctggggaaaatctttag

SEQ ID NO: 188424 - DNA, 4437 bp, Artificial Sequence
  Description of Artificial Sequence: Synthetic coding sequence
atggccagcaccaacgccgagagccagctgcagcggatcatccgggacctgcaggacgccgttacagagttgtcaaaggaattccaggaagcgggagagcccattacagatgacagcacatcactccacaagttctcatataagctcgaatatttactgcaatttgaccagaaggagaaagccactttactggggaataaaaaggactattgggactacttctgcgcctgtctggctaaagtgaagggtgcgaacgatggcatccggtttgtaaaatcgattagtgaacttcgcacctccctcggaaaagggcgtgctttcatcaggtattctctcgtgcatcagaggctcgcggatactctccagcagtgcttcatgaacacaaaggttactagtgattggtactacgctagatctcccttcctgcagcctaagctctcatccgatattgtgggccagctctacgaactcacggaagtccaattcgaccttgcttcacgggggtttgacctcgacgcagcttggcccaccttcgccaggagaaccctgaccactggatcatccgcatacctgtggaagcccccatccaggtctagctcaatgtcaagtttggtgagctcatacctgcagacccaggagatggtctcgaacttcgatttgaattccccactgaacaacgaggctcttgaagggtttgacgagatgcgactggaattggaccagttagaagtacgggaaaagcagctgcgagagcgcatgcagcagttggaccgggaaaatcaagaactgagggccgcggttagccagcagggcgagcaactgcaaactgaacgggaacgaggacggacggctgcggaggacaatgtcagactgacgtgcctggtggctgaactccaaaaacaatgggaggtgacacaggctactcaaaacactgtaaaggaactgcagacatgtctccagggtcttgagctaggggcagcggaaaaggaagaggattatcataccgctctaaggagactggaatcgatgctccagccccttgctcaggagcttgaggcaacgcgcgattccttggataaaaaaaaccaacacctggctagtttccctgggtggttagctatggcccagcagaaagccgatactgcatccgacacaaaaggacgccaagagcccattccctctgacgccgcccaagagatgcaggagctcggagagaagttgcaggctctggagcgcgaaaggacaaaagtcgaggaggtcaatagacaacagtctgcccagctggaacagctggtcaaggagttacagctgaaagaagacgctcgggctagtctcgaacggctggttaaagagatggctccccttcaggaggagctctctggcaagggacaggaggcagaccagctgtggcgccgcttgcaggagttattagcacatacctctagctgggaagaagaactcgccgagctgcggagagaaaagaagcaacagcaggaggagaaggagctgctggaacaggaagtacggtcacttacccgccagctgcaatttctcgagacccagctggcacaggtttcacaacacgtgtccgatctggaggaacagaaaaaacagctgattcaggataaggatcacctgtcgcaacaggttgggatgctggaacgcctggccgggccccctggacctgaactgcctgtggcgggagagaagaacgaagctttggtgcccgtcaatagctcactccaggaagcctggggcaagccggaggaggaacaaaggggcttgcaggaggcccaactagatgatactaaggtacaggaggggtcccaagaagaggaattacggcaggccaatcgtgaactggagaaagagctgcagaatgttgttggtcgcaatcaacttctcgaaggtaaactacaggctctgcaggcagactatcaggcgttgcaacagagggagtccgctattcagggctcgctcgctagtttggaagccgagcaggcttccatcaggcatctgggcgatcagatggaggcatcactgctggcagtgcggaaggcaaaggaagctatgaaggctcagatggcagaaaaggaggccatacttcaaagcaaggaaggcgagtgtcaacagctccgcgaggaggttgagcaatgtcagcagctggcagaggcccgacatagggagctgcgcgctctggaaagccagtgccagcagcaaacccaactgattgaagtgctcaccgccgagaaaggccaacagggagtgggcccccctaccgataatgaagcgcgggaacttgctgcacaattggcgctctctcaggcgcaactggaggtccatcagggcgaggtccagcgcttacaggcccaagtggtggaccttcaggctaagatgcgggccgcactcgacgatcaggataaggttcagagccagttgtccatggctgaagcggttttaagagaacacaagacactggtacagcagttgaaagagcagaatgaagcactgaatcgcgcgcacgtgcaggagctcctacagtgttctgaaagggaaggtgcacttcaggaggagcgagccgacgaggcccagcaacgagaggaagaactcagagccctccaagaggagctgagccaggccaaatgctccagtgaggaggctcagctggagcacgccgagctccaggagcagctgcatagggccaacactgatacagccgagctaggtatccaggtgtgtgcccttaccgtagaaaaggagagagtggaagaggccctggcttgcgcggtgcaggaactacaggatgcaaaggaggcggcgtcacgcgagagagagggcctggagaggcaagtggctggcctccaacaagagaaagagtccctccaggaaaaactgaaagccgcgaaggctgcggccgggagtctccctggattgcaagcacaactcgcccaggccgagcagagagcgcagagcctgcaggaggccgcccaccaggaattgaatacactgaagtttcaactgtccgccgagattatggactaccagtctcgcctgaagaatgccggcgaggagtgcaagtcactgcgaggccagttggaagagcagggtcgacagttgcaggcagctgaggaggccgtggagaagctgaaagctacccaagcagacatgggggagaagctttcatgcactagcaatcatctggccgagtgccaggccgccatgctccgcaaggacaaagaaggtgccgccctgagagaggacctcgagcggacacaaaaggagctggaaaaagccaccaccaaaattcaagaatactataataagctgtgccaggaagtgaccaaccgagagcgcaacgatcagaaaatgttggccgacctggacgacctgaacaggactaaaaaatatctcgaagaacgcctgatcgagttgttgcgcgataaggatgctctctggcaaaaatctgatgcactggagtttcagcagaaactcagcgcagaagaacgatggctgggagatactgaagcgaatcattgtctggactgcaaaagagaattcagttggatggtccgcagacatcactgcagaatatgtggccgcatcttctgctattattgttgcaacaattatgtgctctccaagcacggaggcaaaaaagagcgttgttgtagggcctgttttcaaaagctctcagaaggacccggaagtccagatagctctggttccgggacaagtcagggcgagcccagccctgcactgtccccggccagcccagggccgcaggccaccggcggtcagggagcaaataccgattaccggcctcctgatgacgcagttttcgatataataactgatgaggagctgtgccagatccaggagtcagggtcatctctgccagaaacacctaccgagactgacagcctggacccaaatgctgccgaacaagatacaacttcgacaagccttacccccgaggacactgaggacatgcctgttggacaggattcagagatctgtctgctgaaaagtggggagcttatgatcaaagtgcctctcactgttgatgaaattgctagcttcggcgagggctcgagggagttattcgtgaggagcagtacatactctctcatccccatcaccgtggcggaggcggggttaaccatctcttgggtgttctcttctgatcccaaatctatcagcttcagcgtggtgttccaagaggctgaggatacccccctcgaccagtgtaaggtgctcattccaactactcgctgtaactcacacaaggagaacatacaggggcaactgaaagtgcgaactcccgggatctacatgcttatcttcgacaataccttcagcagatttgtgtccaagaaggtgttctaccatctgactgtcgaccgaccagttatttatgacggctccgacttcctttag

SEQ ID NO: 188425 - DNA, 804 bp, Artificial Sequence
  Description of Artificial Sequence: Synthetic coding sequence
tgaagcaagcacggcggcaagaaggagcggtgctgccgggcctgctttcagaagcttagtgagggacctggttccccagacagctctggctccggcacatctcagggagagccatcacccgcactttctccagccagtccaggcccgcaggcaacgggggggcagggcgctaacactgactacaggccacccgatgatgccgtgtttgacatcattactgacgaagagctgtgccaaatacaggaatctggtagttccctcccagagacgcctaccgaaactgattctctggacccaaatgccgctgaacaggatacaaccagcacctctctaacacccgaggataccgaagatatgccggtggggcaggactcggagatctgccttctgaaatccggagaactaatgatcaaggtgccgctcacagtggatgagatcgcgagctttggtgagggatcccgcgagctctttgtgcgtagctccacttactccctgattcccattacagtcgcggaggctggcctgaccatatcttgggtgttttcttccgatccgaaatcgataagcttcagcgtggtgtttcaggaggccgaggacaccccgctggatcagtgcaaagtgctgatacccacaacacgctgcaattcacacaaggagaacattcagggccagctgaaggtccgtaccccaggcatttacatgctgatcttcgacaatacattttcccggttcgtgagcaagaaggttttttatcacctgaccgtggataggcctgtgatttatgacggctcggattttctgtag

SEQ ID NO: 188426 - DNA, 4497 bp, Artificial Sequence
  Description of Artificial Sequence: Synthetic coding sequence
atggccagcaccaacgccgagagccagctgcagcggatcatccgggatctccaggacgcggtcacagagctgtcgaaggagttccaggaagcgggagagccaataacagatgactccacgtctcttcacaagttctcttataagttggagtatctgctgcagttcgatcagaaggagaaggccacactcctcgggaataaaaaagattactgggattatttttgtgcctgtttagccaaagtcaaaggtgctaacgacggtatcagatttgtgaaatcaatctccgagttgagaacttcactcggtaagggacgggcctttatcagatactccctggtccaccagcggctggcagacacacttcagcagtgtttcatgaacacaaaggtgacgagtgattggtactatgccagatctccatttctccagcccaaactgtcttcagacattgttggccagctatatgagctgactgaagtccagttcgacctggctagcaggggctttgatttggatgccgcctggccaacatttgcacgccgcaccttaacaaccgggtcctctgcctacctgtggaagcccccctcaagaagttcctcgatgtcgagtctggtgtcttcctacttacagacccaggaaatggtgagcaatttcgatctaaactcaccactgaataacgaggctctggaaggttttgatgaaatgcgccttgagcttgaccaactcgaagttagggaaaaacaattgagggaacggatgcagcaactggacagggaaaaccaggagttgcgggccgcggtgagccagcagggagagcagctgcagacagaaagggaaagaggaaggactgctgcagaagacaatgtgcgattaacatgcctcgtggctgagctgcagaaacaatgggaggttacacaggccactcagaacacagttaaggagctgcagacgtgcctgcaaggcctggaattgggtgccgccgagaaagaagaggattaccacactgctctaagacggttggaatccatgctccaacctctcgctcaggaacttgaggccaccagggattcactcgacaagaagaaccagcatttggcctccttccctggctggctcgcgatggcccagcaaaaagcagacactgccagtgatactaaaggacggcaagaacccatcccctccgatgccgcacaggagatgcaggaactgggggagaaactacaggctctcgagagggagcgaactaaggtagaggaggtgaatcgccaacaaagcgcccagttagagcaactggtgaaggaactccaactgaaagaggatgcgcgcgcttcgctggagcgcctggtcaaggagatggcccctctgcaagaggagctctccgggaaaggccaggaagccgatcagttgtggcggaggctacaggagctcttggcccacacgtcgtcttgggaggaagaattagccgagctaagaagggagaaaaaacagcaacaagaagaaaaagagctgctagaacaggaggtcagaagcctaaccaggcagctgcagttcctggaaacgcagctcgcccaggtgtctcagcatgtgagcgacctcgaggagcagaagaaacaactcatccaagacaaggatcacttgtctcagcaggtcgggatgctcgagaggctagccggccctcctggacccgagttgcccgtggcaggtgaaaagaatgaggctctggtccctgtgaactcatcccttcaggaggcttggggcaagcctgaggaagaacagcgcgggctacaggaggcacagctggacgacaccaaggttcaggaggggagtcaggaagaagaacttaggcaggcaaatcgtgagttagagaaagagcttcagaacgtcgtgggtcggaaccaactcctggaaggaaaactgcaggcactacaggcagactaccaggccctgcaacagcgtgagtccgcaatccagggcagcctggcgagtctagaagcagaacaggccagtatacggcatttgggggatcagatggaggcctcactgctcgcggtccgaaaggcgaaagaggcgatgaaagcccagatggctgagaaggaagccattctgcagtccaaggagggggaatgtcaacaattgcgcgaagaagtggaacagtgccagcagctggcagaagcccgacatcgtgagctgcgggcactggaatcccagtgccagcagcagacacaactgattgaggtgcttaccgctgaaaagggccagcagggcgtcggtcctcctaccgacaacgaggctcgcgaattggcggctcagctggccctctcgcaggcacagctcgaggtacatcaaggcgaggtacagcggctccaggctcaggttgttgacctacaggccaaaatgcgtgcagcacttgatgatcaggacaaggtgcagtcacaactcagcatggcggaggccgtacttagagaacacaaaactcttgttcagcagctgaaggaacaaaatgaggcattgaacagggcccatgtgcaagagctactgcagtgcagtgagcgggagggagcgctgcaggaagagagggccgatgaggcccagcaacgggaggaagagctgcgggctctccaggaggaactgtcccaggcaaaatgcagcagtgaggaggctcagctcgagcacgccgagttgcaggagcaacttcatcgagcaaacaccgacacggctgaactggggattcaggtgtgtgctcttaccgtagaaaaggaaagggttgaggaagcacttgcatgcgctgtgcaagagctgcaagatgctaaggaggcggcttccagggagcgcgaagggctggaacggcaggtagcaggccttcaacaggaaaaggagtccttacaggaaaagctgaaggcagccaaggctgccgctgggtctctccccggactccaagctcagctggcgcaggccgagcagcgtgcccagagccttcaggaggcagcccaccaggaactcaatacgcttaaatttcagctgtctgccgaaatcatggactatcaaagccgattaaagaatgccggggaagagtgtaagagcctcagagggcagctggaagagcagggccggcagctgcaggccgcagaagaagctgtcgaaaagcttaaagccacgcaggctgatatgggggagaagttgtcatgcacaagcaaccatctggcagaatgccaggccgctatgctccggaaggacaaggaaggcgcagctcttcgcgaggatctcgaacgtacccaaaaagaattagaaaaagcgacaacgaagattcaagagtattacaataaactttgtcaggaggtgactaacagggagcggaacgatcaaaaaatgctggctgacctcgatgacctcaaccgaaccaaaaaataccttgaagaacgtctgatcgaactcttacgcgataaggatgcactttggcagaaaagtgacgcactggagttccagcagaagttgagcgccgaagaaagatggctcggagacacagaagctaatcactgcctcgactgtaaaagagagttctcttggatggtgcgccgtcaccactgtaggatctgtgggcgaatcttctgttactattgttgtaacaactatgtgctgtcgaaacacggaggcaaaaaggagcgttgttgtagagcttgttttcaaaaactgtccgagggccctgggtcacccgatagttcgggcagcgggacaagccaaggagaaccatcaccagcactgtcgcctgcctcaccagggccccaagccaccggaggtcagggggccaacacggattatagaccaccagatgatgcagttttcgatatcattactgacgaggagttgtgtcagatccaagaatccgggtctagcctgcctgagactcctaccgaaactgatagcttagatccaaatgcggccgagcaggccagcgtgggagcttccaagggactgggcaacctgctatgtgaatcctccgcgtgccgtgacaccacaagcacctctttgacccccgaggataccgaggacatgcccgtgggccaggactccgagatctgcctcctaaagagtggtgaacttatgattaaagttccattgaccgtcgatgagattgcaagtttcggtgaaggctcccgtgagctgtttgtccggagttcaacctatagcctgattcctatcaccgtagctgaggcaggactcacaatctcctgggttttttcgagcgaccccaaaagtatctccttcagcgttgtgtttcaggaagccgaggatactcctttagaccagtgcaaggttctgatcccgacaacaagatgcaattctcataaggagaacattcaggggcagctgaaggttagaacacccggcatttacatgttgatattcgacaacaccttctctcgtttcgtgtcaaagaaagtgttctaccatcttacagtagaccgtcccgtcatctacgatggttcagatttcttgtag

SEQ ID NO: 188427 - DNA, 2886 bp, Artificial Sequence
  Description of Artificial Sequence: Synthetic coding sequence
atgcacggccaccgggcccccggcggcgccggccccagcgagcccgagcacccggccactaacccaccaggcgccgccccaccggcctgcgccgattccgatccgggcgcctccgaaccgggtcttctggcccgccggggttctggtagtgctcttggaggtcccctggatccccagttcgtgggtccatctgataccagcttgggtgcagccccaggccacagagtgttgccttgcgggccttcccctcaacatcaccgagctctacgcttctcttaccacctcgagggctctcaaccccgtcccggactgcatcaggggaatcggattctggtcaaatccctttcactggatcctggccaaagcttggaacctcaccccgagggccctcagaggctgcgctcggaccccggcccccctaccgagactccctctcaaagaccatctccactaaagagagcacccgggcctaagccacaagtgccccctaagccatcttacctgcaaatgcctaggatgccaccacctctcgaaccgatccctccaccaccttctcgccccctgcctgccgatccacgtgtcgctaagggcttggcccctagggcggaggcatcaccctccagcgcagccgtatcgtccctgattgagaagtttgagagggagccggtcatcgtggcttccgaccgccctgtgcctggaccttctcccgggccgccagagcccgttatgctgcctcagcccacgagccagccgcctgtcccccagctaccagaaggagaggctagcaggtgtctatttctgttggcaccaggaccccgcgacggggaaaaggtccccaatagagactccggcattgacagcatttcctccccttcgaattctgaggagacttgttttgtgagcgatgatggccctccttcccacagtctgtgccccggccccccagccttggccagcgtccccgttgccctggcagatccccaccgccccgggagccaggaggtcgattcagatctggaggaggaagacgatgaggaggaagaagaagagaaggaccgggagattcccgtgccgctgatggaaaggcaggaatccgtagagcttacagttcagcagaaggtgttccatatcgctaacgaactgctccagacagaaaaagcatacgtgtcgagactacatctattggaccaagtcttttgcgccagactcctggaggaggcgcgcaaccgatctagcttccctgcggatgtcgtacatggcatcttctcgaacatttgttctatatattgcttccatcagcagttcctccttcctgaactcgaaaagcgaatggaagagtgggataggtatcctaggatcggagacattctccagaagctggccccatttcttaagatgtacggtgagtatgtcaagaacttcgatagagcagtcgaactggtgaacacctggacggagcggagtacccaattcaaagtgataatccacgaggttcagaaagaggaggcatgtggaaacctcacgctgcagcatcacatgttagaacccgtacagcgcatcccccgttatgaattgctgctgaaggattatctccttaagctgccccatggaagcccggactccaaagacgcacagaaaagcctcgaactgatcgctacggctgcagagcattctaatgccgccattcgcaaaatggaacgcatgcataagctgttaaaggtctatgaacttcttggcggggaggaggacatagtgagcccaactaaggaactgatcaaggaggggcatattttgaaactgagtgcgaagaatggtacaacccaggaccgctatctcatcctctttaatgaccggctgctttactgtgttccacgtctgcgcctactgggacagaagttctctgtgagagcccggatcgatgtggacggtatggagctgaaggaaagttcaaatctgaacttgccacgcacttttttggtttcagggaagcaacggtctctagagctgcaggcaagaactgaggaggaaaagaaggattgggttcaggcaatcaacagcactctgctcaaacacgagcagacactcgagacatttaagctcctgaacagcacaaatagggaggacgaagatacacctcctaacagccctaatgtcgacctcggaaaacgggcacccactcccatccgtgagaaggaagtaacgatgtgcatgagatgccaggaaccattcaactcaataacaaaaagaagacaccactgtaaggcatgtgggcatgtagtgtgcggaaaatgtagtgaatttagagcacggttggtctatgacaacaatagatctaatagagtatgcacagattgctatgttgcactgcacggcgtgcctggttcttcacccgcttgctcacagcataccccccagaggcgacggagcatactcgaaaaacaggcttccgttgcagccgaaaacagcgtgatctgcagctttctgcattacatggaaaaagggggcaaaggctggcacaaagcatggtttgtagtgcctgaaaacgagccgctggtgctgtatatctatggagctccgcaggatgttaaggcccagagaagtctccctctaatcggatttgaagtgggccccccagaggcgggggagcggcccgacagacgacacgtgttcaagataacccagtctcatctgtcttggtatttctccccagaaacagaggagttacagaggaggtggatggcagtgttgggtagggctggtaggggcgatactttctgccccgggcctaccctatctgaagatcgggagatggaggaggctcccgttgctgccctcggcgccacagcagaacccccggagtctccgcagacacgggacaagacgtag

SEQ ID NO: 188428 - DNA, 1968 bp, Artificial Sequence
  Description of Artificial Sequence: Synthetic coding sequence
atgaagggcgccagcgaggagaagctggccagcgtgagcaacctggtcactgtgtttgagaatagtcggaccccagaagctgcccctcgggggcagcgcctggaggacgtgcaccatagaccggaatgccgccccccagagagcccaggcccgcgggaaaaaactaatgtgggcgaggcagttgggtccgagccaagaactgtcagtagacgatatctgaactcattgaagaacaagttgtcctccgaggcctggcgcaagagctgccagccagtcaccctgagcggaagcggcactcaggaacccgaaaaaaagatcgtgcaagagctcctggaaaccgagcaggcctatgtcgcccgactccatctgttggatcaggtttttttccaggaacttctgaaaacagccagaagcagcaaggccttcccggaagatgtggtgagagtgatcttctccaatataagttcgatctatcagtttcacagccagtttttcctgcccgagctgcaacggagactggacgactggactgccaatccaagaattggcgacgtgatacaaaaactggctccgtttctgaagatgtattctgaatatgtgaagaactttgaacgtgctgccgagctacttgccacatggaccgataagtctccgctgttccaggaggttttaactagaattcagtcctccgaggcgagtggctcacttacactccaacatcacatgctggagcctgtgcaacggattcccagatacgaactgcttttaaaagagtatatccagaaacttcctgcccaggcccccgatcaggcagatgcacagaaggctctcgacatgattttttctgcggcacaacacagcaatgcagcgattacagaaatggagagactgcaggacttgtgggaagtgtaccagcggctggggctcgaagacgacatcgtagaccctagcaacacactgctgcgggagggacccgtcctgaaaatctctttccggcgaaatgaccccatggagaggtatctgtttttatttaataacatgcttctgtattgcgtgcctagagttatccaagttggagctcagtttcaggttcggaccaggatcgacgtggccggaatgaaggttagggaacttatggatgcagaattcccccactcgttcctcgtgagtggcaagcagcgaacacttgagctgcaagcccgcagtcaagaggaaatgatatcgtggatgcaagcatttcaggctgcgatagaccagatcgagaaacgcaacgaaacattcaaagccgctgcccagggtccagaaggcgacatccaagagcaggagctgcagtccgaggagttgggactgagagccccacagtgggttagagacaagatggttacgatgtgtatgaggtgtcaagaaccttttaacgctctcactcgccgaagacaccactgcagagcatgcggctacgtggtgtgcgcccggtgctctgactaccgcgccgagctgaagtatgatgataatagaccgaatcgcgtttgtctccactgctacgcctttctcacaggaaatgtcctgccggaggcaaaggaggacaaaagaagagggatcttggaaaaaggcagctccgccaccccagaccagagtctcatgtgcagcttccttcaactgattggggataaatggggtaaaagtgggcctcgggggtggtgcgtaattccacgcgacgatccactcgtactctacgtctacgcagcccctcaagacatgagggctcacacttccataccactattagggtatcaagtaaccgtcggccctcagggggatccgagggtgttccagctacagcaatctggacagctgtatacctttaaggccgaaacagaggagttgaagggcagatgggtgaaggccatggaacgtgccgctagtgggtggtcgccctcctggccgaacgacggcgacctgtctgattag

SEQ ID NO: 188429 - DNA, 852 bp, Artificial Sequence
  Description of Artificial Sequence: Synthetic coding sequence
atgaaggtgcgggagctgatggacgccgagttcccccacagcttcttggtatcgggtaaacagcgcaccctggagttgcaggctcgctctcaagaagaaatgatttcttggatgcaggcctttcaagcggccatagaccagattgagaaacgcaacgagaccttcaaagcagcagcccaagggcccgaaggagacatacaggagcaggagctgcagtccgaagaactgggccttcgagcaccccagtgggtaagggataaaatggtcaccatgtgcatgagatgtcaagagcccttcaacgctcttacgagacggcgccaccactgcagagcttgtggctacgtcgtgtgtgcacgctgttcggactatcgggccgaattgaagtacgatgataatcggcccaatcgtgtgtgcttacattgctatgccttcctcactggcaacgtgctgcccgaggctaaggaggacaaaaggcgcggcattctggagaaggggagctccgccacccctgaccagtctctgatgtgctccttcttacagctgataggagataagtggggtaagtcaggcccacgtggatggtgtgtgattccaagggatgatcccctagtgctgtatgtgtacgccgctccccaggacatgcgagctcatacctcaatccccctcctgggatatcaggttacagtcggccctcagggcgacccacgcgtcttccagctgcagcagtccggacagctgtacacttttaaagccgaaacagaagaactgaagggcaggtgggtaaaagccatggagagggccgctagtggatggtccccgtcctggccaaacgatggagacctgtccgactag

SEQ ID NO: 188430 - DNA, 2178 bp, Artificial Sequence
  Description of Artificial Sequence: Synthetic coding sequence
atggagagcggccggggcagcagcaccccccccggccccatcgccgctctcggaatgcctgacactggaccagggagcagctctctgggaaaactccaggctctgcctgtgggccccagggctcactgcggcgatcctgttagccttgctgcagctggcgacggctcaccggacatcgggccaacgggagagctgtcaggctcactgaagattcccaatagagactctgggattgactcgcccagctccagcgtcgcaggcgagaattttccatgcgaggagggcctggaggcgggccctagtccaacagtgctgggcgcccacgccgagatggccttagacagccaggtaccaaaagttacgccccaggaagaagctgatagcgacgtcggcgaggaacccgactcagaaaacactcctcagaaagcagacaaagacgccgggttggcccagcattcaggaccccagaagttattgcacattgcccaagagctcctccatactgaagaaacatatgtcaaaagacttcatcttctggaccaggtattctgtactagactgactgacgctggcattccgccggaggttatcatggggatctttagcaacatttcatccatccacagattccacggtcaattccttcttccggagcttaagactaggattacagaagaatgggacactaacccgcggttaggagatattctccagaaattggcaccttttctgaaaatgtacggtgaatacgtgaaaaatttcgatagagcggtaggactggtgtcaacctggactcagcgttcacccctctttaaggatgtggtccatagtatccagaagcaagaggtgtgcgggaacctcactttgcagcaccacatgcttgaaccagtacagcgggtgccacggtacgaactcctcctgaaggactacttgaaaagactgccacaggatgcacctgacaggaaagacgctgagaggtcgctggagctgatcagtacagctgcgaaccacagcaatgccgcaatcagaaaggttgagaaaatgcacaagctccttgaggtctatgaacaactgggcggggaggaggatatagttaatccagcaaacgaactcatcaaggaggggcagatacagaagcttagtgcaaagaatggtactccacaggaccggcacctcttccttttcaatagcatgattctttactgcgtgccaaagctcaggttgatgggccaaaaattcagcgtaagggaaaaaatggacatcagtggtctacaggttcaggatattgttaagcccaacactgcccatacattcattatcaccggacgtaagaggtctctggagctgcaaacgagaactgaggaggagaagaaggagtggatccaaatcatccaagctacgattgaaaaacacaagcagaatagtgaaacattcaaagctttcggcggcgctttttcgcaagatgaggaccctagtttaagtcccgatatgcctataacttccacctcacccgttgagcccgtggtgactacggagggcagctccggagccgccggccttgaacccaggaagctgagtagcaagacacgtagggacaaggaaaagcagagctgtaaatcttgcggcgaaactttcaacagtatcacgaagagaagacatcactgtaagttatgcggcgcagtcatctgcggcaagtgtagtgagttcaaagcggaaaacagtcggcagtctcgggtctgcagggattgcttcctgacgcagcccgtcgcccctgagtccacggaaaagaccccgacggcagatccacagccatctctgctctgtgggcccctcaggcttagcgaatcaggggagacctggtccgaagtatgggccgcaattcctatgagcgatccccaggtgttacatctgcagggagggagccaggacggacggctgcctcgtacaatccccctaccttcctgcaaactgtctgtccccgacccagaggaacggctggatagcgggcacgtttggaagctgcagtgggcgaaacagtcctggtacctgagcgcatcgtccgctgaactccagcagcagtggctcgagaccttgtccaccgccgcgcacggcgacaccgcacaggactccccaggcgcattacagttgcaggtgccgatgggggccgccgccccgtag

SEQ ID NO: 188431 - DNA, 2178 bp, Artificial Sequence
  Description of Artificial Sequence: Synthetic coding sequence
atggagagcggccggggcagcagcaccccccccggccccatcgccgctctgggcatgccagacacgggcccaggaagcagctcactgggcaaacttcaggccttacctgtgggacctcgggcccactgtggcgatcctgtgagcctcgccgctgccggtgatggatctccggatatcgggcctaccggggagctctccgggagtttgaagatccctaatagggattcaggaatcgacagtcccagtagctctgtcgcaggcgaaaacttcccatgcgaagagggactggaagctgggccttcccctacagttctgggagcacacgccgagatggctctggactcccaggtgcctaaagttactccgcaggaggaagcagattcggatgttggggaagagcctgactctgagaacacgccccaaaaggctgataaggatgctggactggctcaacacagtgggccacagaagctgttgcacattgctcaggagctgctgcataccgaagaaacctatgttaagaggctgcacttgctggatcaggtcttctgtaccaggctgacggatgctggcatcccacccgaagttatcatgggaatcttttccaatatatcctcaatccaccgctttcacggacagttcttactgcccgaattgaagaccagaatcaccgaggaatgggacactaatccccgtttaggggacattttgcagaagctggcacccttccttaagatgtacggagagtacgttaaaaacttcgacagggcagtgggactggtgtctacatggacccagcggagtccactcttcaaggacgtggtgcactctattcagaaacaagaggtgtgcggtaacctgactctgcaacatcacatgcttgaacccgtacagcgagttcctagatacgagctgctcctgaaggactacctaaagagactgccgcaagatgcgccagacagaaaggatgcggaacggtctctggagctgatctccacagctgccaaccattcgaatgccgccatcagaaaagttgagaagatgcataaattattggaggtgtatgaacagttgggaggcgaggaggacatcgttaaccccgccaatgagttgattaaggagggacaaattcagaagctgagcgctaaaaatggcacaccccaggatcggcatctgttcctgttcaacagtatgattttatactgtgttcccaaattgcgccttatgggccagaagttttctgtacgggagaagatggatatttctgggcttcaggtccaggatatcgtgaaacctaatacagcccacacattcattattacaggaagaaaacgctctctggagttgcagacacggaccgaggaggagaagaaagaatggatccaaatcatccaggctaccatcgaaaagcataaacaaaattctgagacttttaaggcatttggaggggccttctcacaggacgaggaccccagtctgtcgccagatatgcccattacttccacctcccctgtggaaccggtggtgaccaccgaaggctcctccggagccgcaggtctagaaccccgaaaactgtcttctaaaacacggagagacaaggagaagcagtcttgtaagagctgtggagagaccttcaactcgattaccaagcggaggcaccactgcaagctctgtggcgctgtgatttgcggaaagtgttcagagttcaaagccgagaatagtcggcagtctcgagtctgtcgcgattgtttcctgacccagccggtggcacccgaatccacagagaagacccctactgcagaccctcaacctagtttgctgtgcggtcccctccggctctctgagagcggcgagacttggagcgaagtctgggcagcaatccccatgtctgacccacaggtacttcatctgcagggtggttctcaggacggtaggctcccccgcacaatccccctaccatcatgcaaactttcagtgcccgaccccgaagaacgcctggattccggccatgtctggaagttgcagtgggcaaaacaaagctggtatttatccgcttctagcgctgaattacagcagcaatggctcgagacgcttagcaccgcagcccacggggatactgcccaggactcacccggcgcgctccaactacaggtgcccatgggggcagccgccccgtag

SEQ ID NO: 188432 - DNA, 2175 bp, Artificial Sequence
  Description of Artificial Sequence: Synthetic coding sequence
atggagagcggccggggcagcagcaccccccccggccccatcgccgccttgggcatgcctgatactgggccgggtagctcatcgttaggaaaactgcaggcccttcccgtgggaccacgcgcacattgcggcgacccagtctctctggccgcagcgggagatgggtctccagatatagggcccaccggtgaacttagcggatctcttaaaatccccaatcgcgactcggggatcgactctccatcttcctctgtcgcaggcgagaatttcccctgcgaggaaggactggaagcaggcccatcacccaccgttctgggggcccacgcggaaatggcgctcgacagtcaggttccaaaagttacccctcaggaagaggccgactccgacgttggggaggagcccgactctgaaaacacaccacagaaggccgataaagatgctggcctggcccaacactctggtcctcagaaactgctgcatattgcccaggagctgctgcataccgaggaaacctatgtcaagagactgcacctcctggatcaggtgttttgcactaggctaaccgacgctgggatcccccccgaggtcataatgggcattttcagcaacatcagctctattcatcgcttccacggccagtttttgcttccagaactgaagacccgaattaccgaagaatgggacaccaatccacggctgggagacatcctccagaagttggctcctttcctgaaaatgtacggggagtacgttaagaactttgatcgggccgtggggctagtctccacctggacccagagatcaccactgtttaaggacgtcgtccactctatccaaaagcaggaagtgtgcggaaacctgactctccagcaccacatgttggagcccgtgcaaagggtccccagatacgaacttctgctgaaagattacctgaaacggttgccacaggacgctcctgaccgtaaggacgccgaaagatctttggagctgatttccaccgcagcgaatcactccaatgcagcaatccggaaggtggagaagatgcataaattgctcgaggtatacgagcaactggggggagaagaagacattgtgaaccccgccaacgaattgatcaaggagggacagattcaaaagttgtctgcaaaaaacggcacaccccaggataggcatctgtttctgtttaattccatgatactgtattgcgttcctaagctgcgtctgatggggcagaagttttctgttcgggaaaagatggacatctccggtcttcaagttcaggatattgtgaaaccaaacacagcacacacattcatcatcactggaaggaaacgctcactagaactccagactagaaccgaggaagagaagaaggaatggatacagataatacaggctaccatcgagaaacataaacagaactctgagacctttaaagcattcggcggagcattctcccaggacgaggacccctccctgtctccggacatgcctattactagcacctcccccgtggagcccgtagtgacaactgaaggttcatcgggagcagccgggcttgagcccaggaagctttcgagcaagacaaggagagacaaggagaagcagagttgtaaaagctgcggggagacgttcaacagcattacaaagagacgccaccattgcaagttgtgcggtgcagtcatatgtggcaaatgtagcgagttcaaggcagagaacagtagacaaagcagagtctgtcgcgattgctttcttacacagcctgtcgccccggagtcaactgagactccgacagctgatcctcaaccttcgttattatgcggcccccttagactgagcgaatcaggcgagacctggtcagaagtgtgggccgccatccctatgtccgacccacaggtgctgcatctgcagggagggtcccaggatggccggcttccacgaaccattcccttacccagctgcaagctgtcggtgcccgatccagaagagagactggatagtggacacgtctggaagctccagtgggccaagcagagctggtatctcagcgctagctcagcagaactgcagcagcagtggcttgagaccctctctactgcagcccacggggatactgcccaggactcacctggtgcgctgcagctacaagtgcctatgggtgcagcggcaccttag

SEQ ID NO: 188433 - DNA, 987 bp, Artificial Sequence
  Description of Artificial Sequence: Synthetic coding sequence
atgatcctgtactgcgtgcccaagctgcggctgatgggccagaagttttccgtgcgggagaagatggacatttctggcttgcaggtgcaagacattgtaaaacctaatacagctcatacatttatcataacaggcaggaaaagatccctggagctccagactcggactgaagaagagaagaaagagtggattcagatcattcaggcgactatcgagaaacataaacagaattctgaaaccttcaaagctttcggaggcgccttcagccaagacgaagacccgagcctctccccggatatgccaatcacatccaccagtcctgttgagcccgtcgttaccacagagggatcatccggagcggctgggctcgagccaaggaagctttcctcgaagacccggcgggacaaggagaagcagagctgcaagtcatgtggagagacatttaactcaatcaccaaacgccgccaccactgcaagttgtgcggcgcagtaatatgcggaaaatgttcggagtttaaagcagagaattctaggcagtctagggtttgtcgggactgttttctcactcagccagtggcccctgagtcgacagaaaaaactccgactgcagaccctcaaccgagtctgctgtgtgggccactgcggctctcggagagcggggagacctggtctgaagtctgggccgccattccaatgagcgacccacaggtgctgcatttacagggaggctcccaggatggaagactccctcgtaccatccccctgccatcctgcaagctctccgtaccagaccccgaggagcggctggactccggccacgtgtggaagcttcagtgggcgaagcagagttggtatctctccgcgagcagcgcggaacttcagcagcaatggctagagacactttcgacggcagcacacggcgacacagcccaagacagccccggagcccttcagcttcaagtccccatgggcgcggcggctccctag

SEQ ID NO: 188434 - DNA, 1416 bp, Artificial Sequence
  Description of Artificial Sequence: Synthetic coding sequence
atggtgaacaagatcttcagcaacatcagcagcatcaacgccttccactcgaagtttcttcttcctgaactcgagaagaggatgcaggagtgggagactactcctcgaatcggggacatactacagaaactcgctcctttccttaagatgtacggcgagtatgtgaaggggttcgacaatgccatggaattagtgaagaatatgaccgagcgaattccacagtttaagtctgtagtggaggagatccaaaagcaaaaaatttgcggctcattgactcttcaacatcacatgcttgagcctgtgcagaggatccccagatatgaaatgctactgaaggactacttacggaagctccccccagattctctggattggaacgacgcaaagaaatctctagaaattatttctaccgctgctagtcattccaattccgccataaggaagatggaaaatttaaagaagctcctggaaatctacgagatgctgggagaggaagaagacatcgtgaatccttctaatgaacttataaaagaaggacagatcctgaagcttgccgcacggaacactagcgcccaggaacgatacctgttcttattcaacaatatgcttctttattgtgtccccaagttttccctggtcggctccaaatttaccgttaggacccgggtgggtatagatgggatgaaaattgtcgaaacgcagaacgaggaatatccgcacacctttcaggtgtcaggcaaggagcgaacgcttgaactccaggcctcttccgcccaggataaggaggaatggatcaaggccctgcaagagaccatagacgcatttcaccagagacatgagactttccggaatgcaattgcaaaagacaatgacatccacagcgaggtctccactgctgagctggggaaacgagcacccagatggatccgcgacaatgaggtaactatgtgcatgaagtgtaaagaaccctttaacgcgctgacacgaagacgccatcattgcagggcctgcgggtacgtagtgtgctggaagtgtagtgattacaaggcccagttagagtatgatggaggtaagctgtcgaaagtttgcaaagattgttaccaaatcatttccggctttaccgattctgaggagaagaaaagaaaaggaatcctcgagatagagagcgcagaagtgagtggaaattcagtggtctgctcttttcttcaatatatggagaagagcaaaccctggcagaaagcctggtgcgtcatccccaaacaggaccctctcgtgctttacatgtatggagccccccaagtttctaaaccacacctcagcgaaggaactgacgctctgggtggcaaaggtaaacgggtggatagcggattgaagatctgcagaacaagagtacaagctgtgagtctgttccactag

SEQ ID NO: 188435 - DNA, 843 bp, Artificial Sequence
  Description of Artificial Sequence: Synthetic coding sequence
atggtgaacaagatcttcagcaacatcagcagcatcaacgccttccactctaaattcctgctacctgagctggaaaaacgcatgcaggaatgggaaaccactcctcggataggcgatatccttcagaagcttgcccccttcctgaagatgtacggagaatatgttaaaggctttgacaatgctatggagctagtcaagaacatgacggagaggatcccccagtttaaatctgttgtcgaggaaatccaaaaacagaagatatgtggctcattgacactgcagcatcacatgctggagcccgtgcagcggatccctaggtacgaaatgctgctaaaggattatctgcgcaagctgccaccggatagtctggattggaatgatgccaagaaatcgctggagattatctctactgcagcctcccattcgaattctgccataaggaaaatggagaatctgaagaagctgctggaaatatatgagatgttaggcgaggaagaggatatcgtaaacccgagtaacgaattgataaaggaaggtcagatcctgaagctcgctgcccgcaatacatccgcccaggagcgctatctattccttttcaacaatatgctgctttattgcgttccaaagttctcactggtggggtcaaagtttacagtgcgaacaagagtcggcattgacgggatgaaaatcgtggagacacaaaacgaagagtatccgcacacatttcaggtatcgggaaaagagcgcacactggaactgcaggcgtccagcgcccaggataaggaagaatggattaagaggaggggtttcgctatgttgcccagacttatttccaattcttag

SEQ ID NO: 188436 - DNA, 567 bp, Artificial Sequence
  Description of Artificial Sequence: Synthetic coding sequence
atgttcagctgcttcctgtgcatcctgagcttcagcagcctgagcaactattctgacctaaaaaaggagagcgccgtgaacctgaacgccccacgcactccgggacgccacggcctcaccaccactcctcaacagaaattactgtctcagcatctgccccagcgccagggcaacgatactgacaaaacacagggcgcacagacttgtgtggctaatggcgttatggcagcacagaaccagatggagtgtgaggaggaaaaggcggccacattgtcttccgacacctctatacaagccagtgaaccactactggatacccacattgtgaatggagaaagagatgagaccgcaaccgcgccagccagccccacgactgacagctgcgacgggaacgcaagtgactccagctataggacccctgggattgggcctgtgctgcccctagaggagcggggcgcggagacagagacaaaggtccaggagagggaaaatggcgaaagtcccttggagctcgaacaactcgatcagcatcacgaaatgaaggtagaacacgagacttcctcatag

SEQ ID NO: 188437 - DNA, 2301 bp, Artificial Sequence
  Description of Artificial Sequence: Synthetic coding sequence
atggaggagatcaagcccgccagcgccagctgcgtgagcaaggagaagccgtccaaggtgtctgacttgataagtcggttcgagggcggatctagcttaagtaattactcagacctcaagaaggaatcagccgtgaaccttaatgctccccggaccccagggagacacggcttaacaacaaccccccagcagaagctactgtcacaacacctgccccagagacaagggaacgatactgataaaacccagggagcccagacgtgtgttgccaatggggtgatggccgctcagaaccagatggagtgtgaggaagagaaagcagccacactcagcagcgacacttcaattcaggcatccgagcccctcctggatactcatattgtcaacggagaaagagatgagactgctacagctcctgccagtccaaccactgactcttgcgacggaaatgcttctgacagcagctaccgaacacccggaatcggacctgtgctccccctcgaagaacgcggggccgagactgagacgaaagtgcaggaacgtgagaatggcgaatcccccctggagttggagcagctggaccagcatcatgagatgaaggaaactaacgagcaaaagttacataagatagctaatgaactcctgttaactgagagagcgtatgtcaatcgtctggacctgttggatcaggtgttctactgtaagctgctggaggaagcgaaccgtggtagcttccctgccgaaatggttaataagatattctccaacataagcagtatcaacgccttccacagcaagttcctactgcctgaattggaaaaaagaatgcaggagtgggagacaacccccaggatcggcgacatccttcagaaactggccccgttcctgaaaatgtacggcgaatatgttaaaggttttgataacgctatggagctggttaaaaacatgacggaacgtattccacagttcaaatccgtggtagaggagattcagaagcaaaagatttgcgggagcctgaccttgcagcatcacatgctggagcccgtacagaggatcccccggtacgagatgctgctgaaggactatttgcgaaaactccccccagatagtttggactggaacgacgctaagaagtccctcgaaatcatttctaccgctgctagtcatagcaactcagcgatcagaaaaatggagaacctgaagaagttattagagatctacgagatgttgggcgaagaagaggacatagtgaacccctccaatgagcttattaaggaaggccagattcttaaactggccgctaggaataccagcgctcaggaaaggtacttattcctgttcaataacatgctcctttactgcgtcccaaagttttcactcgtgggcagcaaatttacagtccgtactcgggtaggcattgatgggatgaagattgtggagactcagaacgaggaatacccccatacgttccaggtgtctggaaaggagcggactctcgaactccaggccagttcagcacaggataaagaagagtggatcaaggctctgcaggagaccatcgatgcatttcaccagaggcacgagaccttccgaaacgccattgcaaaggacaacgatattcacagtgaggtttcaacagccgagctcggcaagcgggccccacgatggatccgggataatgaagttacaatgtgcatgaagtgtaaagagccattcaatgcccttacacgcaggagacatcattgccgcgcctgtggctacgtagtctgttggaaatgctcagactacaaggcacagttggagtatgacggcgggaagctgtctaaggtctgcaaggattgctaccagattatctctggctttaccgattctgaggaaaagaaaaggaagggtatcctggaaatagaatccgccgaggtttccgggaacagcgtagtttgcagcttccttcagtacatggagaagtcgaagccttggcagaaagcatggtgtgttattccgaagcaggatcccctggttctctatatgtatggcgcaccacaagatgttcgcgctcaggcaactatccctcttctcggctacgtggttgacgagatgccgcgcagcgcagatctaccccactcctttaagctgacacagagcaagtccgtgcatagcttcgcggccgactctgaggagctaaaacagaaatggctaaaggtcattctgctggccgtgacaggagagactccaggcggcccgaacgaacatcccgcaaccctggatgatcacccagagcctaaaaaaaagagcgagtgttag

SEQ ID NO: 188438 - DNA, 624 bp, Artificial Sequence
  Description of Artificial Sequence: Synthetic coding sequence
atggaggagatcaagcccgccagcgccagctgcgtgagcaaggagaagccatctaaggtgagcgatctcatatcacgattcgaaggcggcagtagtctgagcaactatagcgacctgaagaaagagagcgcagtgaatctgaatgccccccggactccaggacgccacgggctgactacaaccccacagcagaagctactttcacagcatctgccccagcgacagggaaacgacacagataagacacagggcgctcaaacatgtgtggctaacggcgtgatggcagcgcagaaccaaatggagtgcgaagaagagaaggctgcgaccctctcttctgatacaagtatacaagcttcggagccactgctcgatacccatatcgtgaatggagagcgcgacgaaacagccacagcacctgccagcccaactaccgattcctgtgacgggaatgctagcgattcctcatataggacccctggcatcgggcccgtccttccactggaggagcgtggcgccgagacggaaaccaaggtgcaagagcgggaaaacggagaatcacctctcgagctggagcagttggaccagcatcacgaaatgaaggtcgaacacgaaacttctagttag

SEQ ID NO: 188439 - DNA, 2637 bp, Artificial Sequence
  Description of Artificial Sequence: Synthetic coding sequence
atgaacttcaagcgggtgaagcccaacatcttcctgctgaaccagtcccgcctgatcataagcatttgcgagataatgtctaccgatcagggttcaagcacgtgcccaaagatcgcactggtgcccccgtgcagcacttcttcaaccacaactctggtcggggagaacgtctctgaggaagaggcccagggcatcaacggcaacagaccggcaaaacactccgccgcgtcccccaaacctcaggtaccgccaaagcccctgcacctgcaaaattccccatcatccaacattcaccagactcctcgccataaggcactccccagtgccaagcctcggatggaggagatcaaacccgcctctgcatcctgcgtgtcaaaagagaagccctcaaaggtaagtgacctaattagtagattcgagggaggtagtagcttgagtaattatagcgacctgaagaaggagagcgccgtgaaccttaatgcgccccggaccccaggcaggcacggcctgactaccacgccccagcagaagttgctgtctcagcatctaccgcaaagacagggcaacgataccgataaaacccaaggtgcacaaacttgtgtagcgaacggagttatggctgctcaaaatcagatggagtgcgaggaggagaaggccgccacactctcctcagacacctctatacaggcttcagaacccctgttagatacccacattgtcaatggtgagcgggacgagactgccacagcgcctgcgtcccctactacagatagctgtgatggaaacgcaagcgacagcagctataggacaccagggataggaccggttctgccactggaagagcggggggcagagaccgagacaaaagtccaggagcgggagaatggcgaatcaccactggaattggaacagctcgatcagcatcacgagatgaaggaaaccaacgagcagaagctgcataaaatcgccaacgaactccttctcacagagagggcttatgtgaaccggctagacttacttgaccaggtattctattgcaagctgttagaggaagcaaatcgtgggagttttcctgcagagatggttaataagattttttcaaatattagctccattaatgctttccattctaaatttctgctcccggaattagagaagcgaatgcaggagtgggaaactacaccgaggattggcgacatcctgcagaaacttgctccattcctcaaaatgtacggagagtatgttaaaggtttcgataatgcaatggagctcgttaagaacatgaccgagcggatcccgcaattcaaaagcgtcgtagaagaaatccagaagcagaagatctgtggctccctcacattacagcaccatatgttagaaccagtgcagcggattccgaggtacgagatgctgctgaaggactacctgaggaaactgccaccagattctttggattggaatgacgcgaagaagagtctggagattatttccactgccgcttcccactctaactcagccatcaggaagatggagaatctgaaaaagcttcttgagatatatgagatgctcggagaagaggaggacatcgtcaaccccagtaatgagctcatcaaggaaggccaaattcttaagttggccgcgagaaatacaagtgcacaggagaggtatctgttcttgttcaataacatgctgctatattgcgtcccaaagtttagtctggtcggaagcaagttcacggtgcgtacaagagttggtatcgacggaatgaaaatagtggagactcagaacgaggaatacccccacacctttcaagtcagcgggaaggaacgcacgctggaactgcaggcgagctctgcacaggataaggaggagtggatcaaagccctgcaggagaccattgacgcttttcatcaacggcatgagacatttcgcaacgctatagccaaggacaacgatatccacagcgaagtcagtacagcagagcttggcaaacgagcgcccagatggattagagacaatgaggttaccatgtgtatgaagtgtaaagagccatttaacgctttgactcgccggcgtcaccactgccgcgcctgcggatacgtcgtatgttggaagtgttccgactataaagcccaactggagtacgatggcggcaaactgtccaaagtgtgtaaggactgttaccagatcataagtggcttcactgacagcgaagaaaagaagcggaagggtattttggagatcgaatccgcggaagtgagcggaaattctgtggtgtgcagttttctgcagtacatggaaaagagtaagccttggcagaaagcctggtgcgtaattcccaagcaggaccctctcgtactgtacatgtatggtgcgcctcaggatgtgcgcgcccaggccaccatccccttattaggctacgtggtagatgaaatgccaagatccgcagatcttccacacagcttcaagctgacccagtcgaaatccgttcacagcttcgcagccgattctgaagagcttaaacagaagtggctaaaagtgattctgcttgccgtgacaggcgagacaccagggggaccaaacgaacatcctgcgactctagacgaccacccagagcccaaaaaaaaaagcgaatgttag

SEQ ID NO: 188440 - DNA, 2556 bp, Artificial Sequence
  Description of Artificial Sequence: Synthetic coding sequence
atgggcggctgcagcagcacctgccccaagatcgccctggtgcccccctgctctacttcatcaacgaccacccttgtgggcgagaacgtcagtgaggaggaagctcaggggattaatgggaaccgacctgccaagcactcagcagccagcccaaagccccaggtccctcctaagcccctacatctgcagaacagtccgtcttccaacatccaccagactccacggcataaagcactgccctctgccaaaccccggatggaggagattaaacccgctagcgcttcttgtgtttccaaggagaagcccagcaaggtgtctgatctgattagtaggttcgaaggaggaagctccctgtctaactattccgacctaaagaaggaaagcgccgtcaacttaaatgctccaagaacacctggtaggcacggtttgaccaccacacctcaacagaaactgctgagccagcatctcccacagagacagggcaacgatacggacaagactcagggagcacagacctgcgttgcgaacggagtcatggcggctcaaaatcagatggaatgcgaagaggagaaggctgcaactctgtccagtgacacaagtatacaggcgtctgagcccctgctcgacactcatatcgtgaacggggagagagatgaaacagctaccgcacctgcatccccgacgaccgactcctgtgatgggaacgcaagtgactcatcataccgcacccctggcatcgggcccgtgctgccgttagaggagcggggtgctgagactgagaccaaagttcaggagcgcgagaacggcgagtcccccttggaattggaacagctggatcaacatcacgagatgaaggagaccaatgaacaaaaactacacaagatagccaatgaacttctcctaaccgagagggcctacgtcaatcgactggatttgcttgaccaagtgttttattgcaaattgctggaggaagccaatcgcggaagttttcccgctgaaatggtgaataagattttttccaacataagctctatcaatgcctttcactcaaaatttttactgcctgagctggaaaaacggatgcaggaatgggagactacgcctcgaattggggacatactacagaaattggccccctttttgaaaatgtacggcgagtacgttaaaggctttgacaatgctatggaactagtgaagaacatgacagagaggattccccagttcaaaagtgtggtcgaggaaatccagaaacagaaaatctgtggatcacttaccttgcagcaccatatgctcgaaccagtgcagaggatacctcgctatgagatgctgttgaaggattacttgagaaaactgccccccgacagtttggattggaacgatgccaagaagtccctggaaataataagcaccgccgcgagtcattccaattctgcgattcgcaagatggaaaatctgaagaaattgttagaaatctacgagatgttgggagaagaagaggatatcgttaatccatctaacgagttgatcaaagaagggcagatcctgaaactggccgctagaaatacatctgcacaggagcgttacctgtttttatttaataatatgcttctctactgtgtcccaaagttttctctagtggggtcaaaattcaccgtgcgcactcgcgtgggcatagacggtatgaagattgtcgagactcagaatgaagagtacccccatacttttcaagtgtctggaaaggaaaggaccttggaactgcaggcttcatcggcccaggataaggaggaatggataaaagcattgcaggagaccatagacgcttttcatcaacggcatgaaactttcagaaacgccatcgccaaggacaacgacatccacagcgaggtttccacagcagaacttgggaaaagagcaccaaggtggattagggataacgaggtaactatgtgcatgaagtgtaaagagcctttcaatgcgcttacacgccgaaggcatcattgtagagcttgtggatacgtcgtctgttggaagtgcagcgactataaagctcagctcgagtacgatggcggcaaactttccaaggtctgtaaggactgttatcagatcatctccggttttactgactcagaggaaaaaaagaggaagggcatcctggagatcgagtctgccgaagtgtccgggaattctgtggtttgtagtttcctccagtatatggagaaaagtaaaccatggcagaaagcatggtgtgtaatccccaagcaagatccccttgttctgtacatgtatggggctccacaggatgttagagcgcaggccacaattccactcttgggctacgttgtggacgaaatgccgcgttccgctgacttaccacatagtttcaaattgactcagagcaaaagtgtccattcttttgccgccgactcagaggagctgaaacagaaatggctcaaggtgatcctgcttgcggttacaggcgagacgccagggggccctaatgagcacccagccactctggatgatcaccccgagcccaagaagaagtccgagtgctag

SEQ ID NO: 188441 - DNA, 2712 bp, Artificial Sequence
  Description of Artificial Sequence: Synthetic coding sequence
atgagcgacgagggcggcagcaacttccggcgggtggccatccggcgtaaatccaaccctagttatctgcctccgggggtgccacgcccatggagtcggccggcaagccatttggggcgcgtcggaaccgctgcatttaaaggccaggtccccagtggtgcgacaggtagcagtacatgtcctaaaatagctttggtgcctccctgttcaactagctcaaccacaactctggtgggtgaaaatgtttctgaagaagaagctcagggtatcaatggtaatcgacctgctaaacactcagccgctagcccaaagccgcaggttcctcctaaacccttacatctgcagaattccccctcctccaacatccaccaaacccctcgccacaaagcactcccaagcgctaagccaaggatggaagagatcaagccagcctcagcgtcatgtgtctctaaagagaaaccgtcgaaagttagtgatttgatatcaagattcgaggggggctccagcctctccaattatagcgacctgaaaaaggagtccgccgttaacctgaacgcacctcgaactcctggccgccacgggcttacaactacaccgcagcaaaagttgctgagccagcatttgccgcagagacagggaaatgatacagataagactcagggtgcgcagacatgcgttgcgaatggggtgatggcagctcagaaccagatggagtgtgaagaagagaaagccgccaccctgagcagtgacacaagcattcaggccagcgagcccctccttgatacccatattgttaacggtgagagggatgaaaccgcgaccgcgcccgctagtccaactactgactcatgcgatggcaatgcttctgactcaagttatagaactcctgggatcggccctgtgttacctctggaagagcgtggggctgagacggagactaaggtccaggagcgagaaaatggcgaatcccccctggaattggagcaactggatcagcaccatgaaatgaaagagaccaatgagcagaaactgcacaagattgccaatgagctgctgctaacagaaagggcgtacgtgaaccgcctcgatctgcttgaccaggtgttctattgtaagctccttgaggaagccaacagggggtctttccccgcagagatggtgaataagatattcagtaacatcagcagcataaatgcattccactcaaaatttttgctgccggagttggaaaagcgcatgcaagaatgggagaccaccccgagaattggagatattcttcagaaactcgcgccatttctgaaaatgtatggcgaatatgttaaggggttcgacaatgcaatggaacttgtcaagaacatgacagaaagaatcccgcagtttaagtctgttgtagaagagatccagaaacagaagatttgtggaagccttaccctgcagcatcatatgctggaacctgtgcagagaatccccaggtatgaaatgctgctcaaggactatctgaggaaactacctccagatagtctagactggaatgatgccaagaagagcctcgagattatttcaacggccgcaagccactcaaattccgctatccggaagatggaaaatctcaagaagcttttggaaatctacgagatgctaggcgaagaagaggacatcgtgaacccatctaatgagcttatcaaggagggacagatactgaaactcgctgctaggaatacgagcgcacaggagagatatcttttcctatttaataatatgctgctttattgcgtgccaaaattctcactggtggggagcaagttcactgtccgaacgagggttgggattgatggcatgaaaattgtagagacacaaaatgaagagtatccacacactttccaggttagtggtaaagagaggacactcgaattgcaagcctcttcagcccaggacaaagaggagtggattaaagccctgcaagagaccattgacgcctttcatcagcggcatgagacattccggaatgctattgcaaaagataacgatatccactcggaagtgtcaaccgcagagctaggcaaaagagcccctcggtggattcgagacaatgaagtgacaatgtgcatgaagtgcaaggagccttttaacgctctgactcgaagacggcatcattgtcgtgcatgtgggtacgtagtttgttggaagtgctctgactataaggcacagctggaatacgatgggggaaaacttagtaaggtgtgcaaggattgttaccagattatttccggtttcaccgactctgaggagaagaaacggaagggcattctcgaaatcgagagtgcggaggtttctggcaactctgtcgtctgctccttcctgcagtatatggagaagtcgaaaccgtggcaaaaggcatggtgtgtgatccccaagcaagatccactagtgttgtatatgtatggagcacctcaggacgtgagagcgcaggcaaccattcctctactgggatatgtggtcgatgagatgcctcgaagcgctgaccttccacactcctttaaactgacccagtcaaaatctgtccatagcttcgcagccgattcagaagagctcaaacagaagtggctgaaagtgatcttgctggctgttacaggtgagactcctggcggacccaacgagcatcccgccaccctagacgatcaccctgaacctaagaagaaaagtgagtgttag

SEQ ID NO: 188442 - DNA, 420 bp, Artificial Sequence
  Description of Artificial Sequence: Synthetic coding sequence
atgagctggcggggccggagcacctactactggccccggccccggcgatatgtccagcctcctgagatgatcggccccatgaggccagagcaatttagtgatgaggtggagccggccaccccggaggagggcgagccagccacacaacgacaggacccagccgccgcccaggaaggggaggatgagggcgcctcagccggacagggccctaagcccgaggccgacagccaggagcaaggccatccccaaaccggctgtgagtgcgaggacggcccagacggccaggagatggatcctccaaaccctgaggaagtgaaaacacctgaggaggagatgcggtcacactatgtggcacaaacaggcattctctggctcctgatgaataactgcttccttaacctgtctcctagaaagccatag

SEQ ID NO: 188443 - DNA, 351 bp, Artificial Sequence
  Description of Artificial Sequence: Synthetic coding sequence
atgagctggcggggccggagcacctaccggagccggccccggctgtacgtggagccccctgaaatgatcggccccatgcttcccgaacagtttagtgatgaggttgaaccggcgaccccagaagaaggagagccggcaactcaaaggcaagacccagcagccgcacaggagggtgaagacgaaggcgctagtgccggtcagggcccgaaaccggaagcagattcacaagagcaggttcatcctaaaacgggatgcgagtgcggcgacggaccagacgggcaggagatgggcctccccaatccagaggaggtaaaacgaccggaagaaggagagaaacagagccagtgctag

SEQ ID NO: 188444 - DNA, 354 bp, Artificial Sequence
  Description of Artificial Sequence: Synthetic coding sequence
atgagctggcggggccggagcacctactactggccccggccccggagatatgtacagcctcctgagatgatcggacccatgcggccagagcaattctccgacgaggtggagcccgcgacaccagaggaaggtgagcccgctacacagtgtcaggatccggcggccgcacaggagggcgaagatgagggcgcctccgctggacaagggcccaagcctgaggcccacagtcaggagcagggacatccgcagaccggatgcgagtgtgaggacggcccagatgggcaagaaatggacccacccaaccctgaggaagtgaagacacccgaggagggtgagaagcagagccagtgctag

SEQ ID NO: 188445 - DNA, 354 bp, Artificial Sequence
  Description of Artificial Sequence: Synthetic coding sequence
atgagctggcggggccggagcacctactactggccccggccccggcgatacgtgcaacctcctgaaatgatcggcccaatgaggccggagcaattcagcgacgaagtggagccagcgacaccagaggagggcgaaccggccacacagtgtcaggatcccgcggcggctcaagagggcgaggacgagggagcaagtgcaggacagggcccgaaacccgaagctcactcgcaggagcagggacatcctcagacaggatgtgagtgtgaggatgggccagatggacaggaaatggatcctcctaaccccgaagaggttaaaaccccggaggagggagagaaacaatcacagtgctag

SEQ ID NO: 188446 - DNA, 354 bp, Artificial Sequence
  Description of Artificial Sequence: Synthetic coding sequence
atgagctggcggggccggagcacctactactggccccggccccggcgatatgtacagcccccggagatgattgggccaatgagaccagagcagtttagcgatgaagtggaacctgctacacccgaggaaggcgaacctgctacacaatgtcaggaccccgccgccgctcaggagggtgaggatgagggcgccagcgctggccaggggcccaaaccagaggcacattcccaggagcagggccatcctcagaccggttgtgaatgtgaagatggccccgatggacaagagatggacccaccaaaccccgaagaggtcaagacccccgaggaaggcgaaaaacaatcccaatgctag

SEQ ID NO: 188447 - DNA, 354 bp, Artificial Sequence
  Description of Artificial Sequence: Synthetic coding sequence
atgagctggcggggccggagcacctactactggccccggccccggcgttacgtccagccacctgaaatgattgggcctatgagaccagagcagttctcagacgaggtggagcccgccactccggaagagggagagccagctacgcagcgccaggatcctgccgccgcccaggaaggggaggacgagggcgccagtgcaggccagggtcccaagcccgaggcccactcccaggagcagggccacccccaaactggatgtgaatgcgaggatggacccgacggtcaagaaatggaccctccaaatcctgaggaggttaaaacaccagaggagggggaaaagcagtctcagtgttag

SEQ ID NO: 188448 - DNA, 354 bp, Artificial Sequence
  Description of Artificial Sequence: Synthetic coding sequence
atgagctggcggggccggagcacctactactggccccggccccggaggtacgtgcagccccctgaaatgatcggcccaatgagacccgagcagtttagtgatgaggtagagcccgcgacgcctgaggaaggtgaacccgcaactcaacgccaggaccctgctgctgcccaagagggagaagatgagggagcatcagcgggccagggaccgaagccggaggcgcacagccaggagcaggggcatccgcagaccggttgcgagtgcgaggacggtcccgatggccaggagatggaccccccgaaccctgaggaggtcaaaacaccagaagagggggagaaacagtcccagtgctag

SEQ ID NO: 188449 - DNA, 354 bp, Artificial Sequence
  Description of Artificial Sequence: Synthetic coding sequence
atgagctggcggggccggagcacctactactggccccggccccggaggtatgtgcaaccacccgaaatgatcggccctatgcgccctgagcagttcagcgatgaggtggaacccgccacgccagaggagggagagcctgccacccagtgtcaggaccccgccgctgctcaaaaaggagaagacgagggcgcctctgctgggcagggcccgaagcccgaggcccactcacaggagcaaggacatcctcagaccggctgtgagtgcgaggatggtcctgacgggcaggagatggatccccccaacccagaggaggtgaaaacgccggaagagggagagaagcagagccagtgttag

SEQ ID NO: 188450 - DNA, 354 bp, Artificial Sequence
  Description of Artificial Sequence: Synthetic coding sequence
atgagctggcggggccggagcacctactactggccccggccccggccgtacgtgcagccacccgagatgatcggacccatgcgcccagagcaattctccgacgaggtcgagcccgcaactccggaggaaggagaaccagctacgcagaggcaagatcccgctgccgcccaggaaggcgaggatgagggagcctctgccgggcagggcccaaagccagaagcagattctcaagagcaagggcaccctcagactggatgcgagtgcgaggacggccccgacggacaggagatggatcctcccaacccagaagaggtgaaaaccccggaagaaggcaaaaagcagtctcagtgttag

SEQ ID NO: 188451 - DNA, 354 bp, Artificial Sequence
  Description of Artificial Sequence: Synthetic coding sequence
atgagctggcggggccggagcacctactaccggccccggccccggcggtacgtggagcccccggagatgattgggcccatgaggcccgagcagttttctgacgaagtggaaccggctacacctgaagagggagagcccgccacccagtgtcaagatcccgccgcagcacaagaaggggaagacgagggcgcttcagccggacaaggacctaaacccgaggctgactcacaggagcagggacatcctcaaaccggttgtgagtgcgaggacgggccagatggccaggagatggaccctcctaatcccgaggaggtgaagacacctgaagaggggaaaaagcagtcgcagtgttag

SEQ ID NO: 188452 - DNA, 351 bp, Artificial Sequence
  Description of Artificial Sequence: Synthetic coding sequence
atgagctggcggggccggagcacctaccggccccggccccggcggtacgtggaacctcctgaaatgatcgggcccatgcgtccagagcagttctccgacgaagtggaacctgccacaccagaagagggagagcctgctacccagcggcaggaccccgcggccgcccaagagggacaggacgagggagcatcggcagggcagggcccaaaaccggaggcccactctcaggagcagggacatccacagacaggatgtgagtgtgaagatggacctgatggccaggagatggaccctcctaatcctgaggaggtgaagacgcctgaggagggggagaagcagtctcagtgctag

SEQ ID NO: 188453 - DNA, 351 bp, Artificial Sequence
  Description of Artificial Sequence: Synthetic coding sequence
atgagctggcggggccggagcacctaccggccccggccccggcggtatgtcgagccaccagaaatgattggaccgatgagacccgagcaattcagtgatgaagtggaacccgccactccagaagaaggggagcccgctacacagcggcaagacccagcagcggcccaagaaggcgaagatgagggagcttctgcgggccagggccctaagccagaggctcacagtcaggaacaaggacacccccaaacaggctgcgaatgtgaggatggccccgacggacaggagatggacccccccaaccccgaggaagtcaagacacccgaggagggggagaaacagagccagtgttag

SEQ ID NO: 188454 - DNA, 351 bp, Artificial Sequence
  Description of Artificial Sequence: Synthetic coding sequence
atgagctggcggggccggagcacctaccggccccggccccggcggtatgtggaaccccctgaaatgattggacccatgcggcccgagcagttctccgatgaggtcgagccagctacccctgaggaaggagaaccagccactcagcggcaagacccagccgcagcccaggaaggtgaggacgagggcgcatctgctggccaaggccccaaacccgaggcccactctcaggagcaggggcacccacagaccggctgtgagtgcgaagatgggcccgacgggcaggaaatggatccgccaaacccggaagaagtgaaaactccagaagaaggggagaagcagtctcagtgctag

SEQ ID NO: 188455 - DNA, 351 bp, Artificial Sequence
  Description of Artificial Sequence: Synthetic coding sequence
atgagctggcggggccggagcacctaccggccccggccccggcggtatgtggagcctcccgaaatgataggacctatgcgtccagagcagttttcagacgaagtggaaccagctactcccgaggaaggcgagccggccacccaaagacaagatccagcagccgcgcaggagggtgaggatgagggggcctccgcaggacaggggcccaagcctgaagccgattcccaggagcaaggccacccccagaccggatgcgagtgcgaagatggtcctgatggacaagagatggatccacccaaccccgaagaggtgaagacccctgaagagggcgaaaagcagagccagtgctag

SEQ ID NO: 188456 - DNA, 351 bp, Artificial Sequence
  Description of Artificial Sequence: Synthetic coding sequence
atgagctggcggggccggagcacctaccggccccggccccggcggtacgtggaaccccctgaaatgatcggacccatgcggccagagcagttctccgatgaagtggagccagcgactccagaggaaggggaacctgcgacccagcgccaggatccggccgctgcccaggagggcgaggacgaaggcgcatccgctggacagggccctaagccagaggccgacagccaggagcaaggacacccccaaactggctgcgagtgcgaagacggcccagacggtcaggagatggacccccccaacccagaagaagtgaagactcctgaggaggggaagaaacaatctcagtgctag

SEQ ID NO: 188457 - DNA, 435 bp, Artificial Sequence
  Description of Artificial Sequence: Synthetic coding sequence
atgttcctggaggagaagatccccagcatcagcgacctgaagctggccatccggagggcgacgctcaagcgctctttcacacccgtgttccttggcagcgccttgaagaataaaggagtccagcctctgctggatgcagtactggagtatctacctaacccatctgaagtgcagaactacgctatcctgaacaaggaggacgattcaaaggagaaaactaaaatccttatgaatagttctcgcgataattcgcatccatttgtaggcctggcttttaagttggaatttttgtccagatccttttttcggttgactcggcagaaggatcacaggcgacctatacaaaggactaccctgtatctcattgttatgtccccctacgatctgttgggttgtaacagctttctcgacttcccttgtttctctagggactag

SEQ ID NO: 188458 - DNA, 2256 bp, Artificial Sequence
  Description of Artificial Sequence: Synthetic coding sequence
atgcggctgctgggcgccgccgccgtggccgccctgggccggggccgagctccagcctccctgggctggcaacgcaagcaggtgaattggaaggcctgccggtggtcctcttcaggagtcattcccaatgaaaaaatccggaatatcggcattagtgctcatatagatagcggcaagaccacactgacagagcgggtgctgtactacactgggcggatcgccaagatgcatgaagtcaaggggaaagacggagtcggggctgttatggactctatggagcttgagcgtcagaggggaatcactatccaatctgcagctacttacacaatgtggaaggacgtcaacattaacatcatcgatacccccgggcacgtggacttcactatagaggtggagcgtgcacttagggtcctggacggcgccgtcttggttttatgcgccgttgggggggtgcagtgccagacaatgacagtaaatcggcaaatgaagaggtacaatgtcccttttctgacttttattaacaagttggaccgcatggggtctaacccagcgcgcgctcttcaacagatgcgcagcaaactgaatcataatgctgcctttatgcagattccgatgggactcgagggcaatttcaaaggaatcgtcgatctgatagaggaacgagcgatttatttcgatggagacttcggacaaattgttcgttacggagaaattcccgccgagctgagagctgccgcgactgaccaccggcaggagctgatcgagtgcgtggccaacagcgatgagcagctgggggagatgttcctcgaagaaaaaattccctccataagtgacctaaaactggcaatccggagagcaacattgaagcgcagtttcactcccgtgttcctcggctctgctcttaagaataagggagtgcagccactgctcgatgcagtgcttgagtatctcccaaatcccagcgaagtacaaaactacgccattctgaacaaagaagatgactctaaggagaagacgaagatcctgatgaactctagccgggataactcacatccttttgtaggactggcgtttaagctcgaggtcggcagatttggtcagcttacatatgtacggagctaccaaggagagctgaagaaaggagacactatttataacacccgaacccgcaaaaaggttagactgcagcgtctggcgaggatgcacgcagatatgatggaggacgtggaggaagtgtacgctggcgacatctgcgcactgttcggcattgattgtgccagcggagatacattcaccgacaaagctaacagcggccttagtatggaaagtattcacgttccagatccggtaatctcaatagcaatgaagccctcaaataaaaacgacctggaaaaattctctaagggtatcggtcgtttcacccgggaagacccaacattcaaggtttacttcgatactgagaacaaagaaactgtaattagcggaatgggcgagcttcatctcgaaatatatgcgcagaggttggaacgagagtacggctgcccatgtattaccggaaagcctaaagttgcattcagggagacaataactgctccagtcccattcgattttacgcataaaaaacagagcggcggtgccggccagtacggcaaggtcattggggtgctggaacccctggatcctgaggattacaccaagttagaattttctgacgagacctttggatccaatatccctaaacagttcgtcccggccgtagagaagggctttctggacgcgtgcgagaaggggcctctgtccggacacaaattatcgggactgcgattcgttcttcaagatggtgcccaccacatggtggactccaatgaaatatcatttatccgcgccggcgaaggcgctctcaagcaggcactggcaaacgcaaccctttgcatcctggagcccattatggccgtcgaggttgtggcgcctaatgagtttcagggacaagttatcgctggcattaatcgtcggcatggcgtcatcaccgggcaggacggtgtagaggattacttcactttatatgccgacgtaccccttaacgacatgtttgggtactcaaccgagctcagatcctgcacagagggaaaaggtgagtatacgatggaatactctagatatcagccctgtctcccctccactcaggaggacgtgatcaataagtacctggaagcaaccgggcagctgccggtcaagaaaggaaaagccaagaattag

SEQ ID NO: 188459 - DNA, 459 bp, Artificial Sequence
  Description of Artificial Sequence: Synthetic coding sequence
atgagcctggtgatccccgagaagttccagcacatcctgcgggtgctcaatacgaacattgacggcagaaggaagattgcttttgctatcacggccattaagggggtcggccgtcgttacgcgcacgttgtgctccggaaagctgacattgacctgaccaaacgcgcgggcgaactcaccgaggacgaagtagaaagggtgatcacaataatgcagaacccacgacagtataagatcccagactggtttctgaacagacagaaggatgtaaaagatgggaaatacagtcaagtgttagccaatggtctggataataagcttcgagaggatttggagcggctgaagaagatcagggcccataggggccttagacacttctggggattaagggtgagaggacagcatacaaaaaccacggggaggcgcggaaggacagtcggcgtgtcaaaaaaaaagtag

SEQ ID NO: 188460 - DNA, 1071 bp, Artificial Sequence
  Description of Artificial Sequence: Synthetic coding sequence
atgagccggcccctgctgatcaccttcacccccgccaccgaccccagcgatctgtggaaggatggccagcaacaaccccagccagagaagccagaaagtacactagatggggccgccgcacgagccttttacgaagcgctgataggggacgaaagtagtgcacccgatagccagcgatcgcaaacagagcccgcacgcgagaggaagagaaaaaaacggcggattatgaaggcgcccgccgctgaggctgtggcagagggagcgtcgggcaggcatggccaagggaggtctctggaggccgaagataaaatgacccacagaatcctgcgtgctgctcaggagggtgatctgccagagttacggagactcctggagccacacgaggccggaggtgccggcgggaacatcaatgccagggatgccttctggtggaccccgctcatgtgcgctgcacgggcgggtcagggagccgccgtctcctatctcttggggagaggcgccgcttgggttggtgtgtgtgagttatccggccgcgacgccgctcagctcgccgaggaggctggcttcccagaagtcgctaggatggtgcgggaatcacacggtgagaccaggtcccctgaaaatcgcagtccgacaccgtcattgcagtattgcgagaattgtgatacacacttccaggactcaaatcacagaacatctactgcccatctcctgtcgttgagccaaggccctcaaccgccgaacctcccattgggggttccaatttcatcacccggatttaaactcctgctgcgaggcggttgggaacctggcatgggtttagggcccagaggcgaaggcagggccaaccctattcctacggttcttaagagagatcaggagggactgggctacaggagcgctcctcagcccagggtgacacattttcctgcttgggacacacgggccgtggctggacgcgaaagaccacccagggtagccacactgtcctggcgcgaggagcgccgcagagaagagaaggacagagcttgggaaagggatctcagaacttacatgaacctggaattctag

SEQ ID NO: 188461 - DNA, 1071 bp, Artificial Sequence
  Description of Artificial Sequence: Synthetic coding sequence
atgagccggcccctgctgatcaccttcacccccgccaccgacccctctgacctgtggaaggacggccagcagcagccccaaccggaaaaacccgaaagcacgctggacggagccgctgcaagggcattctacgaagcactgattggtgacgaatcttccgcccccgactctcagaggagtcagactgagcctgcaagagaacgaaaacgtaagaaaagaaggatcatgaaggccccagccgccgaggcagtggctgagggcgcttcgggtaggcatggtcagggccgctccttagaggcggaagacaaaatgacgcatcgcatcctgagggctgcccaggaaggagacttgcctgaactgaggaggctgctggagccgcatgaggccggaggagctgggggcaacatcaacgcccgggatgcattctggtggaccccgctgatgtgtgctgccagagcaggacagggtgctgccgtgtcttacctgttgggcagaggagcggcatgggtgggcgtgtgcgaactttccggccgggacgcggcccagctcgcagaagaggccggcttccctgaggtcgctagaatggtgcgagaaagccacggggagacacgttctccggagaacagaagtcctaccccttcgctccaatactgcgaaaattgcgatacacactttcaggacagcaatcatcggacgagcactgcgcatctcctgtctttgagccagggcccacagccacctaatttgcctttgggcgtgcccattagttcacccggtttcaagctcctgcttcgcggcggatgggaacccggcatgggcctgggccctcggggcgagggcagggccaacccaattcccacagtgctgaagcgggatcaggaaggactgggctacaggtccgcaccacagcccagagtgacacacttccccgcctgggacaccagggcagtggccggcagggaacggcccccgcgggtcgcgaccttaagctggcgcgaagaacgaagacgggaggaaaaggacagagcctgggaaagggacctgagaacctatatgaacctggagttctag

SEQ ID NO: 188462 - DNA, 1071 bp, Artificial Sequence
  Description of Artificial Sequence: Synthetic coding sequence
atgagccggcccctgctgatcaccttcacccccgccaccgacccctccgatctgtggaaggacgggcagcagcagcctcagccagagaaacccgagtccacactggatggcgcagctgcgagagctttttacgaagcacttattggggacgagagttctgcaccagactcacaaaggtcccagaccgagcctgcaagagagagaaagaggaaaaagcgccgcatcatgaaggcaccagccgccgaggctgtcgccgaaggggccagcggccgacatggccagggccgcagtctcgaggccgaggataagatgacacatcggattctccgtgctgcccaagaaggcgatctgccagaactgagaaggctcttagagccccatgaggccgggggcgcgggcgggaacattaatgcccgcgacgcattctggtggacacccttgatgtgtgccgcccgagccggacaaggtgctgctgtctcctacctgctgggccgtggcgccgcctgggtcggcgtgtgtgaactgagcgggagggatgccgcgcagctggctgaagaagcaggcttccccgaggtcgcgcgcatggtaagggaatcccacggcgagactagatcccccgagaacagatcacctaccccatctctgcaatattgcgaaaattgcgacacacactttcaagactcaaaccaccgcacaagcaccgcccacctactctcgctgagccagggcccccagccgcccaatttacccttgggtgtgccgatttcgtctccgggcttcaagcttcttctgaggggaggatgggagcctgggatgggactcggtccacggggggaggggcgggcaaaccctatcccaactgtgctgaagcgggatcaggagggcttgggctaccgtagcgctcctcaacccagagtgactcatttcccggcctgggatacccgcgcagttgccgggcgggaacgccctccaagagttgccactctcagttggcgcgaagagaggcggcgcgaggaaaaggacagagcttgggagcgagatctgcggacctacatgaatctggagttctag

SEQ ID NO: 188463 - DNA, 1071 bp, Artificial Sequence
  Description of Artificial Sequence: Synthetic coding sequence
atgagccggcccctgctgatcaccttcacccccgccaccgacccctcagacctgtggaaagacggccaacaacagccccagcccgagaaacccgagtccactttagacggcgctgctgctcgagccttttatgaggcactgataggggacgagtcaagcgcacctgattctcagcgatcccagacagagcctgccagagagcgcaagaggaagaagagaagaattatgaaggcacctgcggccgaagcagtggccgaaggagcttcaggacggcatggacagggccgaagtttagaagctgaagataagatgacccaccggatcctcagagccgcccaggaaggcgatctaccagaactgcggagactgcttgaaccccatgaggccgggggcgcgggcggaaacattaatgctcgggatgcattctggtggactcctctgatgtgtgccgcccgagctggccagggcgccgcggtcagttacctcctggggcgtggcgctgcctgggtgggggtgtgcgaactgtcagggagggacgccgcccagcttgcggaggaagcgggctttcctgaggtagcccgtatggtcagagaatctcatggagagaccagatccccagagaacagatctccaacaccttccctccaatactgcgaaaactgtgatactcactttcaagattccaatcaccgtacctccacagcccatctactgtccctgtctcaaggaccacagcctcccaacctcccacttggcgttcccatttccagccccggctttaagttgctactgcgtggtggctgggagcctggtatgggtttgggacccaggggcgagggacgagccaatccaattcctacagtgctgaaacgggaccaggaaggtctcgggtatcggtcagccccccagccccgggttacccatttccctgcctgggacaccagagccgtagcgggtcgcgaacgacccccacgcgtggccacgctcagctggcgcgaagagaggcgcagggaggagaaagaccgggcctgggaaagagatcttcgcacatatatgaatttggagttctag

SEQ ID NO: 188464 - DNA, 1071 bp, Artificial Sequence
  Description of Artificial Sequence: Synthetic coding sequence
atgagccggcccctgctgatcaccttcacccccgccaccgaccccagtgatctctggaaggacggacagcagcaaccccagcccgaaaagcctgagtccaccttggacggtgctgcagctagagccttttacgaggctttaattggcgatgagagttcggcgcccgatagccagaggtcccaaacggagccggcccgagaacggaaacgcaagaagcgtaggatcatgaaagctccagctgcagaggccgtggctgaaggcgcgtccggccgccacggtcagggaaggagtctggaagcggaagataagatgacccatagaattctgcgcgcagcccaagaaggagacctacctgaactgagaagactcctcgagccccacgaggccggcggagcgggcgggaacatcaatgctcgggacgcattctggtggacgcccttaatgtgcgccgcgcgggcaggccaaggggcagcggtgagctatctgctgggtagaggggccgcatgggtgggtgtatgtgaactgtctggcagggacgccgcccagctcgccgaggaagctggctttcccgaggtggccagaatggtcagggagtctcacggggaaacccggtccccagagaatcgttcacctactcccagtctgcagtactgtgaaaactgtgacacgcactttcaggactctaatcatcggacaagcacagcacacctgctgtcgctgtcccaggggccacagccccctaatttgccgctgggtgttcccatttcttcacccggctttaagttgttacttagagggggctgggaacctggtatggggctggggccaagaggagagggtcgcgccaatccaatcccaactgtgttaaaaagggatcaagaggggctcgggtaccggtcagcccctcagccaagggtgacccatttccctgcttgggacacacgggccgtcgccggacgggaacggcctccaagggtagccacactctcctggcgcgaggagaggaggagagaagagaaggacagggcttgggagagggacctgcgcacgtacatgaatctggagttctag

SEQ ID NO: 188465 - DNA, 1071 bp, Artificial Sequence
  Description of Artificial Sequence: Synthetic coding sequence
atgagccggcccctgctgatcaccttcacccccgccaccgacccctccgacctgtggaaggatggccagcagcagcctcagccagagaaacccgagagcacactggatggcgcagcagcgctcgctttttatgaagccttgatcggggacgagtcatccgctccagattcacagcgctcccagacagaaccagctagagagcgcaaaagaaaaaagaggagaattatgaaagcaccagcagctgaagccgtggcagaaggagccagcggccgccacggtcaggggagatctctggaggccgaagataaaatgacccataggatcctacgggccgcacaggagggggatctgcccgagctccggcgcctccttgagccccacgaggccggtggtgcaggagggaacatcaatgcccgtgatgccttctggtggacccctcttatgtgcgccgcgagggccggccaaggggccgccgtgtcctacctcttgggccggggagccgcatgggtaggagtatgtgagctgagcgggcgcgacgcggcgcagctggcagaggaggccggattcccagaggttgctcgcatggttcgagagtcacacggagagactagatctcccgaaaatagaagtcctacaccttctcttcaatactgtgagaattgtgacactcattttcaggactccaatcaccggacttctaccgcacacctcttgtcactgtcacagggaccccaacctccaaatctcccactgggtgtgcctatctcttctccagggtttaaactcctgctccgcggcggatgggaaccagggatggggctaggccccaggggagaaggtagggccaacccgataccaaccgttctgaaaagggatcaggaggggttgggctaccggtctgctcctcagccacgtgtgacccactttcctgcctgggacactcgtgctgttgctggtcgggagaggccaccacgtgtcgccacactgtcatggcgggaggagcggcggagagaagagaaagaccgcgcttgggaacgagacctccgaacctatatgaacttagagttttag

SEQ ID NO: 188466 - DNA, 1071 bp, Artificial Sequence
  Description of Artificial Sequence: Synthetic coding sequence
atgagccggcccctgctgatcaccttcacccccgccaccgacccctcagatctctggaaggacggccagcagcagcctcagcccgaaaagccagaaagcacactggacggtgcggctgcgctggcattctatgaggcgctaataggagacgaatcgtccgcacccgacagtcagaggtcccagactgaaccagccagagagaggaagcggaagaaacggagaattatgaaggctcccgccgccgaagccgttgctgaaggagcaagcggacgccatggccaggggcggtccctagaggccgaggataaaatgactcataggatattacgcgctgcccaggaaggggacctgccagagctgaggcggcttctggagccgcacgaggccggaggagcaggcggtaacattaacgctagggatgccttttggtggacgcccctgatgtgtgcggctagagctggccagggagcagccgtttcttacctgctgggccgtggcgctgcatgggtgggggtatgtgagctttctggccgcgatgccgcacaactggccgaagaggccggatttccggaagttgcaaggatggtacgagagtcccatggcgaaacgcgatccccagagaataggtctccaacacccagcctgcagtattgcgagaattgcgacacccattttcaagatagtaaccacaggaccagtacagcccaccttttgtcgttgagccaagggccacaaccccccaaccttccccttggtgtgcccatatccagccccggtttcaagcttctgttgcgcggcggctgggaacccggcatgggattaggaccaagaggcgaggggagggccaatcctatacccaccgtgctgaagagagaccaggaggggttgggctatcggagtgcgccccaaccgcgggtcacccattttccagcctgggacactcgcgctgttgccgggcgggagcggcccccaagagtcgccaccctgtcatggcgggaggagaggcgaagagaggagaaggatcgcgcttgggaacgggaccttcgaacctacatgaatctcgaattctag

SEQ ID NO: 188467 - DNA, 1071 bp, Artificial Sequence
  Description of Artificial Sequence: Synthetic coding sequence
atgagccggcccctgctgatcaccttcacccccgccaccgaccccagcgacctgtggaaggacggccaacagcagccccagcccgagaagccagaaagcaccctggacggagcagctgcccttgccttttatgaagccttaattggcgacgagagcagtgctccagacagccagcgatctcagaccgagccggcaagagaaaggaaacgaaaaaaacgcaggattatgaaggctcctgccgccgaagccgtggcagagggtgcttctgggcgccacggacaggggcggagcctggaggcagaggataaaatgacacacagaattctaagggctgctcaggagggtgaccttcccgagctgcgcagactgctggagcctcacgaggccggcggcgctggcggcaatatcaatgcccgagatgcgttctggtggacccccttgatgtgcgctgcccgcgcaggccagggcgctgccgtctcatatcttttgggaaggggggcagcctgggtgggagtgtgtgagctatctgggcgcgatgccgcacagctggccgaagaagcaggttttccggaagtggcgcggatggtgcgggaatcccacggtgagactcggtccccagagaataggtcaccaactcctagtcttcaatattgtgaaaattgcgatacacattttcaggatagtaatcatagaaccagtacagcccacctcctgtccctgagtcaggggccacaacctccgaatctccccctcggcgtaccgatctctagtccgggatttaaactcctgttaaggggaggttgggagcccgggatgggcctaggtccgcgaggagaggggcgagccaaccctatccctactgtactcaaacgcgaccaggaaggactcggttatcgttcagctccacaacctagagtgactcactttccagcgtgggatactagagccgtagctggacgtgaacgacctcctcgggtggccacactgtcttggagggaggagaggagacgggaggagaaggacagggcctgggaaagagaccttcggacatatatgaacctggagttctag

SEQ ID NO: 188468 - DNA, 1071 bp, Artificial Sequence
  Description of Artificial Sequence: Synthetic coding sequence
atgagccggcccctgctgatcaccttcacccccgccaccgaccccagtgacctatggaaagacggccaacagcagcctcagcctgaaaagccagagtctactctggatggcgctgccgcactggcattctacgaggcgctgatcggtgatgagtcatctgccccagactcccaacgctcccagacggagcccgcaagggaaaggaagcggaaaaaaaggaggattatgaaggccccagctgctgaagccgtcgctgagggcgccagcggtcggcacgggcagggccgtagtcttgaagcggaggacaagatgacacatagaatcctgagggctgcccaagagggcgatctccccgaactgcggcgtttattggagcctcatgaagctgggggggccggtggcaatattaacgctagggatgccttttggtggacaccactaatgtgcgctgctagagccggccagggagctgcggtcagctacctccttggccgcggagcagcatgggtgggcgtgtgcgagctgagcggcagagatgcggcccagctggccgaagaagcaggttttcctgaggtggcgagaatggtgcgggagtctcacggcgagacgaggtctcccgagaaccggagtccaactcctagtctgcagtactgcgaaaactgcgatacccatttccaagacagcaatcaccggacaagcacagcccatttactgagtctgagtcagggtccacaaccacccaaccttcccctgggagtacctataagctcacccgggttcaaactgcttttaagaggaggttgggagccgggcatgggccttgggccacggggagagggtcgcgctaatcccatccccactgtgctgaaacgtgatcaggagggactgggctacaggtctgccccccaaccaagagttacgcacttccccgcttgggatacgcgggctgtcgccgggagagagcgcccacctagggtggccaccctgtcctggcgcgaggaacgccgcagagaggaaaaagacagagcctgggaacgagacttgcggacttatatgaaccttgagttctag

SEQ ID NO: 188469 - DNA, 1071 bp, Artificial Sequence
  Description of Artificial Sequence: Synthetic coding sequence
atgagccggcccctgctgatcaccttcacccccgccaccgacccctcagacctctggaaggacggtcagcaacaaccccaacctgagaaacccgagagcacattggacggagccgctgccctggccttctacgaggcactaattggtgatgagagcagcgcacccgatagccaacggagtcagaccgagcccgcccgcgagaggaaaaggaaaaaaagaaggataatgaaggcgcctgctgcagaagccgtggcagaaggggcatcaggtagacatgggcaaggccggtcactggaggcagaagacaaaatgacccatagaatcttgagagcagctcaggaaggagaccttccagagttacgcaggctactggaacctcacgaggctgggggagccggaggaaatatcaatgcccgcgatgccttctggtggactccactgatgtgcgcagccagggctggccagggagctgctgtctcctatttgctagggagaggtgctgcatgggtgggagtttgcgagttatccggacgtgacgcagctcaactggcagaagaggccgggttccctgaagtggcacgtatggtgagagaaagccatggggaaacacgaagtccggaaaaccgttctcccacaccaagcctgcagtattgcgagaattgtgatacccattttcaagactctaatcatcgaacatcaacagctcacctcctgtcgctgagccagggcccacaacccccgaacctccccctcggggtgccaatctcctctcccggctttaaactgttgctcagaggggggtgggagccaggaatgggtctgggacccagaggagaggggcgcgccaatcctatccccacagtgcttaagcgcgaccaagaggggctgggataccgtagtgccccacagccccgcgtgacacacttcccagcctgggatactcgggctgttgccggcagggaacgcccaccccgagttgccactcttagctggcgcgaagaaagacggcgcgaggagaaagatagggcatgggaacgggatctgcgaacctacatgaatctggagttctag

SEQ ID NO: 188470 - DNA, 498 bp, Artificial Sequence
  Description of Artificial Sequence: Synthetic coding sequence
atgagccggcccctgctgatcaccttcacccccgccaccgacccctcggacctgtggaaagacgggcaacagcaaccccagcccgagaaacccgaaagcaccttggatggtgctgctgctcgggccttttatgaggccctgattggcgacgagtccagtgctccggatagtcaacggtcacagacagagcccgcacgcgagaggaagaggaagaagcggagaattatgaaggctcctgctgccgaggctgtggcagagggagcaagtggtcggcacggccaaggccgatctctggaagcggaggataaaatgactcaccggattttaagagctgcccaggagggcgatctgcctgaactgcggagactgctggagccccatgaggcaggaggtgccggtgggaacatcaacgcacgcgatgccttctggtggacacctctgatgtgtgcggccagagctggtcagggggcagcggtgtcttacttactgggccggtag

SEQ ID NO: 188471 - DNA, 459 bp, Artificial Sequence
  Description of Artificial Sequence: Synthetic coding sequence
atgagccggcccctgctgatcaccttcacccccgccaccgacccctctgatctgtggaaggatgggcagcagcagccccagccggagaagcccgaaagcacgctggatggtgccgccgcactggccttctatgaggctcttatcggagatgagtcgtctgcccccgactcgcagcgttctcaaacagaacccgcgagggaaaggaagcgtaagaaacggcgcatcatgaaggcacctgcagccgaggctgtagccgagggggcttccggcaggcatggtcaggggcggagtctagaggccgaggataaaatgacccacaggatcctcagggcagcacaagagggggatttgccagaactgcgcagactgttggaaccacacgaagccggcggggcaggaggaaatataaacgcgagggacgcattctggtggacccctctgatgtgcgccgcacggtag

SEQ ID NO: 188472 - DNA, 1071 bp, Artificial Sequence
  Description of Artificial Sequence: Synthetic coding sequence
atgagccggcccctgctgatcaccttcacccccgccaccgacccctctgatctttggaaggacggacagcagcaaccacaacctgaaaaacctgaatcgacgcttgatggtgccgccgccctggccttctatgaggcactgattggcgatgaaagttccgccccagattcccagcgcagccagacggaacccgcacgggaaagaaaacggaagaaacggagaatcatgaaggctccggccgccgaagctgtggctgaaggggcatccggaaggcacggtcagggccggagtttggaagcggaggataagatgacacacagaattcttagggcagctcaggaaggagacctccctgagctgagacgcctgctggagccacacgaagccggcggtgctggcgggaacatcaatgccagggacgccttttggtggactccccttatgtgtgctgcgcgcgctgggcaaggagccgcagtgagctacttattgggcaggggggcagcttgggtaggggtgtgcgaactgtccggacgagatgcggcccagttggccgaagaggccggcttccccgaggtcgccaggatggtgcgtgagagccatggagagacccgctctccagagaaccgcagccccacgccgagcttacaatattgcgagaactgcgacacacacttccaggactcgaatcatcgcacctctacagcccacctgctgtcactctctcagggtccccagccacccaacctacctcttggcgtgccaatcagtagcccaggattcaagctgctgctgagagggggatgggagccaggtatgggcctgggccctcggggtgagggccgcgcaaatcctatccctactgtgcttaaacgggaccaggaggggctgggttaccgatcagcaccccagcctcgggtgacgcacttcccagcgtgggacacccgcgcagtggcgggccgcgagaggcccccccgcgtggctactctgagctggcgcgaagaaaggaggcgagaagaaaaggatagggcctgggaacgggatttacgcacgtacatgaacctagagttttag

SEQ ID NO: 188473 - DNA, 459 bp, Artificial Sequence
  Description of Artificial Sequence: Synthetic coding sequence
atgagccggcccctgctgatcaccttcacccccgccaccgaccccagcgatctgtggaaagatgggcagcagcaaccacagccagagaaacctgaatctactcttgacggcgccgcggcaagagctttttacgaggccctaatcggcgatgaatcttcagcccccgactcccaacgctcacagacagaacctgcaagggagaggaaacggaagaaacggaggattatgaaggccccagctgccgaggccgtagcagaaggtgccagcgggcgccacggccagggccgctcattagaggccgaggacaagatgacacaccgaatcctaagggccgcccaggaaggcgacctgcccgaattgcgccgtctgctggagccacatgaagctggcggggcaggggggaatatcaatgcaagggatgctttctggtggacgcccctgatgtgcgcagcacgatag

SEQ ID NO: 188474 - DNA, 498 bp, Artificial Sequence
  Description of Artificial Sequence: Synthetic coding sequence
atgagccggcccctgctgatcaccttcacccccgccaccgacccctccgacctgtggaaagatggccagcagcagccacagcccgagaaaccagagtctacacttgatggggcagcggctctcgctttttatgaggcactcatcggggacgagagctccgctccagatagccagcggtcgcagactgagccggcccgcgagaggaaacgcaagaaaagacgcatcatgaaggcgccagccgctgaggctgtagccgagggagccagcggccggcacggccaggggcgatccctcgaggcagaggataagatgacccaccggatactcagggctgcccaggagggcgacctgcccgaactgcgcaggcttctagaaccccatgaagccgggggcgcgggcggaaacatcaatgccagagacgcattctggtggacacccctgatgtgtgccgctcgtgctggacagggcgcagctgtcagctacctcctcggccggtag

SEQ ID NO: 188475 - DNA, 273 bp, Artificial Sequence
  Description of Artificial Sequence: Synthetic coding sequence
atgagccggcccctgctgatcaccttcacccccgccaccgacccctccgatctctggaaagatggtcagcagcaaccccaacccgagaagccagagagtactctggacggggctgctgcccttgcattctacgaagccttaataggcgacgaaagcagtgcccctgacagccagagaagtcagaccgagcctgccagggagaggaaacgtaagaagaggaggatcatgaaggctccagccgctgaggccgtcgcggaaggggccagcggttag

SEQ ID NO: 188476 - DNA, 1071 bp, Artificial Sequence
  Description of Artificial Sequence: Synthetic coding sequence
atgagccggcccctgctgatcaccttcacccccgccaccgacccctctgacttgtggaaggacggccagcagcaaccacagcccgagaagccagaatccaccctggacggtgccgctgcaagagccttttacgaggctcttattggggacgagtcaagcgcccctgactcccaacggagtcaaacggaacctgcacgcgagcgaaagcgcaagaagcgcagaattatgaaggccccagctgctgaggccgtggcagagggcgcgtccgggcggcacggacaagggcggtcattggaggctgaggataaaatgacccacaggatcctgcgcgccgcacaggagggcgatctgcccgagctgaggcgcctgctggagccacacgaagccggaggcgccggaggcaacatcaatgctcgtgatgcattctggtggacgccactaatgtgtgcggcccgagccggtcaaggagccgcggtcagttatttgttgggcagaggggctgcgtgggtcggggtgtgtgaactgagtggaagggacgctgcccagttagcagaagaggcaggatttcccgaggtggcccggatggtacgcgagagccatggcgagacgcggtcacctgagaataggtccccaactccttctttgcagtactgtgaaaactgcgacacgcattttcaagactctaatcatagaaccagcacagcgcatttgttatcgctgtcccagggaccgcagcctcctaatcttccacttggtgttccaatctcttctccaggattcaagcttctgctgcgcgggggctgggaacccggcatgggcttgggcccaagaggtgaagggcgcgctaatccaataccaactgtgctgaagagagaccaagaggggctggggtacaggtccgctcctcagcccagagtgacacacttccccgcatgggatactagagctgtcgcaggccgcgagcgaccaccccgggtggccactctgtcttggagagaggagcgacgcagagaggaaaaggatagggcctgggagcgcgatttgaggacctatatgaacctggaattttag

SEQ ID NO: 188477 - DNA, 1071 bp, Artificial Sequence
  Description of Artificial Sequence: Synthetic coding sequence
atgagccggcccctgctgatcaccttcacccccgccaccgacccctccgacttgtggaaggacggtcaacagcagcctcagccagaaaagccggagtctacccttgatggcgccgccgcacgggctttttatgaggctctgattggtgatgagtcctctgccccggatagtcagagatcccaaacagagccggctagggaacgcaaaaggaaaaagaggcgcatcatgaaagccccagccgcagaggcagtcgcagaaggcgctagcggccggcatggtcaagggagaagccttgaagccgaggacaaaatgacgcatagaatactgagggcggcccaggaaggcgacctacccgagctaagacggttgctggaacctcacgaggcaggcggcgccggggggaacattaacgcccgtgacgcattttggtggacccctctcatgtgtgcagcacgcgcaggtcagggcgcagcggtgtcctacctgttaggacgcggtgcggcctgggtcggcgtttgtgaactgtccggaagagatgcagcccagctcgccgaagaagccgggttccccgaggtcgccagaatggttcgagaatctcacggcgagactaggtcaccagagaacagaagcccaaccccgagtttacagtattgtgagaactgtgacactcacttccaggactccaaccaccggacgtccactgcccatttattaagtctcagccaggggccacagccgccaaacttaccgctcggagttcccatttcaagtcccggatttaaacttttactgcgcggcggctgggaaccaggcatgggcctagggcctcggggagagggcagagccaacccgattccgaccgtactcaagagagatcaggaggggctcggctaccggtccgccccccaaccacgggtcactcattttcctgcttgggatacacgggctgttgcgggacgagagcgaccaccccgtgtggcaacgctctcttggagagaggaacgccgccgagaggaaaaagatcgagcatgggagagagatctgcgtacttatatgaatttagagttctag

SEQ ID NO: 188478 - DNA, 324 bp, Artificial Sequence
  Description of Artificial Sequence: Synthetic coding sequence
atgagccggcccctgctgatcaccttcacccccgccaccgaccccagtgatctgtggaaggatggacagcagcaaccccaaccggaaaagcctgagtcgactctggatggggctgccgcacgcgccttctacgaggcattaattggcgacgaaagtagcgcacccgacagtcagcggtcacagacggaacccgcgagggaacggaagaggaaaaagaggcggattatgaaagctcctgccgctgaagccgttgcagagggcgcctcaggaaggcatggccaaggacggagcttggaagccgaggataagatgacccatcgctag

SEQ ID NO: 188479 - DNA, 324 bp, Artificial Sequence
  Description of Artificial Sequence: Synthetic coding sequence
atgagccggcccctgctgatcaccttcacccccgccaccgacccctccgatttgtggaaggacgggcagcagcagccccaacccgagaaacctgagagtacgctggacggggccgcagctctggctttttacgaagcgctgattggcgacgagtcatcagcccccgatagccagaggtcacagacagaacccgcacgggaacgcaagcggaagaaaagaagaatcatgaaggccccggccgctgaggcagtcgcggaaggagcaagcggaagacacgggcaaggacggagccttgaggcagaggataagatgacccatcggtag

SEQ ID NO: 188480 - DNA, 1071 bp, Artificial Sequence
  Description of Artificial Sequence: Synthetic coding sequence
atgagccggcccctgctgatcaccttcacccccgccaccgacccctccgatctttggaaggatgggcaacagcagccacagccagagaagccagaaagtaccctggacggtgccgctgcacgtgccttttacgaggcccttatcggcgatgagagcagcgcccctgactcgcaacgtagccaaaccgaacccgctcgcgaaagaaagcgcaaaaaacggagaatcatgaaggcccctgccgccgaggccgtggccgagggcgcttcaggtcgccacggccaaggccggtccttagaggcagaggataaaatgactcacagaatcctacgggctgcgcaagagggagatttgcctgagctgcggcggcttctggagccccatgaggctgggggagctggggggaacattaatgcaagggacgcgttctggtggactcccctcatgtgcgctgctcgggctggccagggcgctgctgtttcttatcttctggggcggggagcggcttgggtgggcgtctgcgagctgagcggcagggacgctgctcaactggcagaggaagccggcttcccagaggtcgcccggatggtacgggaatctcacggtgaaactaggtcacctgaaaatcgttccccaaccccaagcttacagtattgcgaaaactgcgacactcatttccaagattccaaccatcgcactagcacggcccacctgctgtcattgagtcaaggcccacagccccctaacctcccactgggggtacccatctcatcccccggttttaagcttttattaagaggcggttgggagcctgggatgggcttagggcctcgaggcgaggggagagccaacccaattcccaccgtgctcaagcgggaccaggaggggcttggctatagatctgctccacagccccgagtgactcatttccccgcatgggacacccgggcagtcgcagggcgagagcgaccacccagggtggcaacactgtcctggcgagaggagcggcggcgtgaggagaaagaccgagcatgggaacgggatctgcgcacatacatgaacttggagttctag

SEQ ID NO: 188481 - DNA, 1071 bp, Artificial Sequence
  Description of Artificial Sequence: Synthetic coding sequence
atgagccggcccctgctgatcaccttcacccccgccaccgaccccagcgacctgtggaaggacggacaacagcagccacagcctgagaagccagaatctacgctcgacggtgctgcagcccgggctttctacgaggctctcattggggatgaatcctctgctccagattcccaaaggagccagacggagccagctcgtgaacgaaaacgtaagaaaaggagaattatgaaggcccctgccgcagaggccgttgcggagggcgcttctggtcggcacgggcaaggtagaagcctcgaagccgaggacaagatgacacaccgcatcctacgggccgcccaagagggcgacttgcctgagctgagacgcttgctcgaaccccatgaagccggaggcgctgggggcaacatcaacgcacgggacgccttctggtggaccccactcatgtgtgccgcccgggccgggcagggagcggccgtttcttacctgcttgggcgaggagcagcttgggtgggggtctgcgaactgagcgggagggacgcagcccaactcgcagaagaggcgggattccccgaagtggctcggatggtgcgagagagccatggagagacccgaagtccagagaaccggagccccacaccttcacttcaatactgtgagaactgtgacacacacttccaggactcgaaccataggacgtccacagcacaccttctatctctgtcccagggcccccagccccctaacctgcccctgggagtacccatctcctccccgggatttaaactgctgctgagacgggggtgggagccagggatgggcctgggccccagaggcgagggacgggcgaaccctattccaaccgtgctcaagcgagatcaggagggtttaggctatagaagtgcgcctcagccaagggtgacccacttccctgcatgggacacgcgcgcggtggctgggagagagaggcctccgagagtcgcgaccctctcatggagggaggagcgacgaagggaggaaaaggaccgcgcatgggaacgcgatctcaggacatacatgaatctggagttctag

SEQ ID NO: 188482 - DNA, 1071 bp, Artificial Sequence
  Description of Artificial Sequence: Synthetic coding sequence
atgagccggcccctgctgatcaccttcacccccgccaccgacccctcagacctgtggaaggacggacaacagcagccccagccagaaaagccagagagcacactggatggagctgctgcaagggccttctacgaagctcttattggggacgaatcaagcgcacctgactctcaaagatctcaaacagagccagccagagagcggaagaggaaaaagcgaaggattatgaaagcacccgctgctgaggcggtggcagagggagcttcagggcggcatggccagggacgatccctggaggccgaggacaaaatgacacatagaattctgcgggcggcccaggaaggtgatctcccagagctccgtcgcctgctagagccgcatgaagcgggcggggcaggaggtaacattaacgctagggacgccttttggtggactccccttatgtgcgccgcgcgcgccggccaaggtgctgctgtgagctacctgctaggcaggggcgcggcgtgggtcggggtgtgtgagctgtcggggcgggatgctgcccagctcgcagaggaagcaggcttccctgaggtagccagaatggtgcgtgagtcacatggtgagacgaggtccccagaaaatcgctctcccaccccttctctgcagtattgcgaaaactgcgacacacacttccaggattctaatcacaggaccagcacggcccacctactgtcgttgtcgcagggcccgcagccaccaaatctgccccttggagtgcccatcagcagcccaggattcaagcttctgctgagaagggggtgggaacccgggatgggattaggcccgcgcggtgaagggcgcgccaatccgatacctacggtgttgaaacgggatcaggagggccttgggtaccgaagcgccccccagcctagagtgactcacttcccggcatgggacacccgcgccgtagctggtcgagagcgcccgcctcgggttgcaacgctttcttggagggaagagagaagaagggaggagaaggaccgggcttgggagcgcgatctacgcacttacatgaatctggaattctag

SEQ ID NO: 188483 - DNA, 498 bp, Artificial Sequence
  Description of Artificial Sequence: Synthetic coding sequence
atgagccggcccctgctgatcaccttcacccccgccaccgacccctccgacctctggaaggatggacagcagcagcctcagcccgaaaagcccgagagtaccctggatggcgccgccgcccgggcgttctacgaagcattaattggggacgagagcagtgcccccgactcccagcggtctcagactgagcctgctcgggaacgcaagagaaagaaacggaggataatgaaggcacccgctgctgaagccgtggcagaaggcgccagtgggcgacacggacagggaagatcgctcgaagcagaagataagatgacccaccggattctccgggcagctcaagaaggtgatctccccgagcttcgcaggctgttagaaccgcatgaagccggaggcgccggcggcaatataaatgccagggatgctttttggtggacccccctgatgtgcgctgcgagagcaggacagggtgcggccgtcagctatctccttggcagatag

SEQ ID NO: 188484 - DNA, 1071 bp, Artificial Sequence
  Description of Artificial Sequence: Synthetic coding sequence
atgagccggcccctgctgatcaccttcacccccgccaccgacccctccgacctgtggaaagacggccaacagcagccccaacctgaaaagccagagagcacactagatggtgccgctgcacgagcattctacgaggccctcatcggggatgaaagtagcgcccctgatagccaacgctctcaaaccgagcccgcccgagaacggaagcgcaagaagaggcggataatgaaggcccctgctgcagaggcagtcgcggaaggcgcctccggccggcacggccagggtcgaagcctggaggccgaggataaaatgactcaccggatcctccgcgctgcacaagaaggagacttgcctgagttgcggaggttgctagaacctcacgaagccggcggtgcgggcgggaatataaacgctagagacgcattttggtggacaccgctgatgtgcgcggccagggccggtcagggcgctgcggtgagctacctgctggggcgtggggcagcctgggtcggcgtgtgcgagctaagtggtagggacgccgcacagttggcagaggaagccggctttcctgaggtggcacgcatggtgagagaaagccatggggaaaccagatctcctgagaaccgtagccccacgccaagtctccagtattgtgagaactgtgatactcatttccaggacagcaatcacaggacttcgaccgcacacttattgtcacttagtcaggggcctcagcctcctaatcttcccctgggggttccgatcagctcccccggcttcaagctgctcctgcgaggcgggtgggagcccggcatgggcttgggaccccggggcgaaggaagagctaatccaattcccactgttttgaagagagaccaagaggggctcgggtatcggagcgcaccccagccgcgtgtgacccacttccctgcctgggacacgagagcagttgcagggagagagaggcccccccgcgtcgccacactgtcgtggcgggaagagaggcggcgcgaagaaaaggatcgcgcctgggagcgcgatcttagaacatacatgaatcttgagttctag

SEQ ID NO: 188485 - DNA, 597 bp, Artificial Sequence
  Description of Artificial Sequence: Synthetic coding sequence
atgagccggcccctgctgatcaccttcacccccgccaccgacccctctgacctgtggaaggatggacagcagcagccccaacccgaaaagccggaatccactctcgatggagccgccgcccgtgccttttatgaagcgttgattggcgacgagtcgtccgcccctgatagccagagatcccaaacagaacctgcccgggagaggaaacgtaagaagcggcgaatcatgaaggctcccgccgccgaagccgtggctgaaggcgcctctggaaggcacggacaaggacggagtttggaagcagaggataagatgactcatcggatattgcgggcagcccaggagggtgatctgccggaactcaggcggttgctggaacctcacgaggctggcggcgccggcggaaacatcaatgcccgcgacgcattctggtggactcctttgatgtgtgcagccagggcggggcagggcgctgcggtgtcttatctgctcggccggggagccgcttgggtgggcgtctgcgagctgtctggacgcgatgccgcccagctcgcggaagaggcaggctttcctgaagtggcaagaatggtgagagaatag

SEQ ID NO: 188486 - DNA, 1071 bp, Artificial Sequence
  Description of Artificial Sequence: Synthetic coding sequence
atgagccggcccctgctgatcaccttcacccccgccaccgaccccagtgacctgtggaaagacggccagcagcagccacagccagagaagcccgaatcaactctggatggagcagctgccagagccttctacgaagcactgatcggagacgagtcttctgccccggatagccagcgatcccagacagagcccgcccgcgaaaggaaaaggaagaaaagaaggatcatgaaggctccagcagccgaagctgttgccgagggagcctctggaagacacgggcaaggacgctcgctggaggccgaggacaagatgacgcatagaatccttagagccgcacaggagggcgatttgcccgagctgagacggctactggagccgcacgaagccgggggtgctgggggcaatatcaatgccagggacgcattttggtggaccccgcttatgtgtgctgctagagctggccagggcgccgccgtcagttacctgctcggccgtggcgcggcgtgggtcggcgtctgtgagctgtctggtcgggatgctgcccagctcgccgaggaggcgggctttcctgaagttgccaggatggtccgcgaatcacatggcgaaactcggtcacccgagaatcggagccctaccccctctctgcagtattgcgagaactgcgacacccacttccaggattctaaccatagaacgtccacggcgcacctgctgagcctaagccaaggcccccagccccctaacttaccccttggcgtgcccataagcagccccggattcaagcttctgttgagaaggggctgggagccaggcatgggtttggggcctagaggagaaggcagggccaaccccattccaaccgtactcaaaagggaccaggaaggcctgggatataggtcagctcctcagcctcgtgtgactcatttccctgcctgggataccagggccgtggctggaagagagcggcctccacgcgtcgcaaccctgagctggagagaggagagacgaagggaagaaaaggatagggcatgggagcgagatttacggacgtatatgaacctcgaattctag

SEQ ID NO: 188487 - DNA, 498 bp, Artificial Sequence
  Description of Artificial Sequence: Synthetic coding sequence
atgagccggcccctgctgatcaccttcacccccgccaccgaccccagtgatctgtggaaggatggccagcagcagccccagccagaaaagccagaatctactcttgacggggcggccgcgctcgccttttatgaggcgttaattggggatgagagcagtgcacctgactcgcaacgcagccagactgagcctgccagagaacggaagcggaagaaacggcggatcatgaaggcaccggctgctgaagccgtggccgagggagcaagcgggcgccatggtcagggtcggtccctcgaagcggaagataagatgactcatcgaatactgcgggctgcacaagaaggggacctgcccgaacttcgccgcctgctggaacctcatgaggctggaggggctggcggaaatatcaacgctagagacgctttctggtggacacctctcatgtgcgcagcacgtgccgggcagggcgcggccgtttcctatctactgggccgctag

SEQ ID NO: 188488 - DNA, 459 bp, Artificial Sequence
  Description of Artificial Sequence: Synthetic coding sequence
atgagccggcccctgctgatcaccttcacccccgccaccgacccctctgatttatggaaagatgggcagcagcagcctcagccagaaaaacccgaatctactttggacggggccgctgctctggccttttatgaagccctgatcggagacgaaagctccgcacccgatagtcaacggtcacaaacagaacccgccagagagcggaagcgaaagaagaggcggatcatgaaggccccggcagccgaagccgtggcagagggagcatccggacggcacggccagggacggtcgctcgaggctgaggacaaaatgacgcaccgtatcctgagagctgcacaagaaggggatctgccagagcttaggaggttacttgaaccacatgaggccggaggggctgggggcaacattaacgcaagagatgctttttggtggacccctctgatgtgcgccgccaggtag

SEQ ID NO: 188489 - DNA, 459 bp, Artificial Sequence
  Description of Artificial Sequence: Synthetic coding sequence
atgagccggcccctgctgatcaccttcacccccgccaccgacccctccgatctctggaaggatggccaacagcagccacagcccgagaaacccgaatctactctggatggggcagccgcgctggctttctacgaagcattgattggcgatgaatcctctgctcccgattcccagaggtctcagactgaaccagctagggagaggaaaagaaagaagcgcaggattatgaaggctcctgccgcggaggcagttgcggaaggtgcctcaggtagacacggccaagggaggtccctggaagcagaagacaagatgacccatcggattttgagggctgctcaggaaggcgacctgccggaattgcgcagactcctggagccacatgaggccggcggcgctgggggtaacataaatgcccgcgacgctttttggtggacacctttaatgtgtgcggccagatag

SEQ ID NO: 188490 - DNA, 597 bp, Artificial Sequence
  Description of Artificial Sequence: Synthetic coding sequence
atgagccggcccctgctgatcaccttcacccccgccaccgacccctcagatctgtggaaggatggtcaacagcagcctcagcccgaaaaacctgaaagtaccctcgatggagctgcagcattggccttctatgaggccctgatcggtgacgaaagtagcgccccagatagtcagagatcccaaaccgaacccgctagggaaaggaaaagaaagaagcgacgcatcatgaaggcgcctgccgccgaggcggtcgcagagggagcatccgggcgtcacggacaggggcgttctctggaggccgaagataaaatgacccatcggatacttcgagcagctcaagagggagatctcccagagctgcgtagactgctggaaccacatgaggccggaggggcgggagggaatattaacgcacgggacgccttttggtggacacccttaatgtgtgcagcacgagctggacagggcgccgctgtttcttacctcctcggaagaggagccgcatgggtgggcgtgtgcgaattatccggccgtgatgctgcacagctggcggaggaggccggcttcccagaagtggcaagaatggtccgtgagtag

SEQ ID NO: 188491 - DNA, 597 bp, Artificial Sequence
  Description of Artificial Sequence: Synthetic coding sequence
atgagccggcccctgctgatcaccttcacccccgccaccgacccctccgacctgtggaaggatggacagcagcagccccagcccgaaaagccagaatctaccctggatggcgcagctgccctcgccttctacgaagctctgatcggcgatgaatcaagcgcccccgactcacaaaggtctcagacagaaccagctcgggagcggaaacgaaagaagcgccggattatgaaggcacctgcagcagaggccgtggcagagggtgctagtggacggcacggccagggccgctcgctggaagctgaagacaagatgactcatagaatactacgcgctgctcaggaaggcgatctccccgaattgagacggctcctagagccccacgaggccggaggagccggaggcaacattaacgcccgggacgcattctggtggacaccgcttatgtgcgcggctagggctgggcaaggggcggcagtgtcctacctactgggccggggggccgcgtgggtgggtgtgtgcgagctgtccggcagagacgccgcacagctagctgaggaggccggcttccctgaagtggcaagaatggtgcgcgagtag

SEQ ID NO: 188492 - DNA, 1071 bp, Artificial Sequence
  Description of Artificial Sequence: Synthetic coding sequence
atgagccggcccctgctgatcaccttcacccccgccaccgaccccagcgacctttggaaagacggacagcagcagcctcagccagaaaagccagagagtacccttgatggggctgctgcccgagctttctacgaagcgttaatcggcgatgagtcttccgctccagactcgcagcggtctcaaacggagccagccagagaacggaagcggaagaaaaggagaattatgaaggctcctgccgccgaggccgttgctgagggggccagcgggaggcacggccagggcaggtctctggaagccgaggacaaaatgacgcatcggatcttgagggcagcacaagagggggacctgcctgaactgaggagattactggaaccccatgaggccgggggcgcaggcggaaacattaacgctagagacgcattttggtggactcctttaatgtgcgccgccagggcagggcagggagccgctgtaagctatttattggggcggggcgcagcctgggtgggtgtctgcgagctgtctggtcgtgatgctgctcagttagccgaagaagccggctttcctgaggtagctaggatggtccgagagagccacggcgagacgcggtccccagaaaatcgttcacccactcccagcctacaatattgcgagaattgcgacacccactttcaggattcaaatcaccggacttctactgctcacctgctctccttgtcccaggggcctcagccacccaacttacctcttggagtgccgattagttctcccggatttaaactcttgctgcggaggggttgggagcccgggatggggctcggcccccggggggagggcagggccaaccctatccctaccgtgctgaaacgggaccaggagggactcggctaccgctcagccccacagcctcgggtgacccactttcctgcctgggacacgagagcagtggctggcagagagcggcctcctagggtcgccacgttaagctggcgggaggaaagaagaagagaagagaaggatcgggcatgggaacgagacctgcgcacctacatgaatctggagttctag

SEQ ID NO: 188493 - DNA, 1071 bp, Artificial Sequence
  Description of Artificial Sequence: Synthetic coding sequence
atgagccggcccctgctgatcaccttcacccccgccaccgacccctccgatctctggaaagacggccaacaacagccacagccagagaagccagagagcaccctggacggcgccgccgctctcgccttttacgaagccttaattggagacgagtcatcggcacccgatagccagaggtctcagactgaaccagctcgggaaaggaagcgaaaaaaaagacgaattatgaaagcccccgctgccgaggcagtggctgagggagcctcaggaaggcacggacaggggagatccctggaggcagaagacaaaatgacgcacagaatcctgcgcgccgcgcaagaaggcgatctgcctgagctgagacgcctgctggagccacatgaggccggaggagcaggtggcaacattaatgctcgggacgctttctggtggacacctctaatgtgtgcggcacgggcaggccagggcgctgccgtctcctatctcctggggaggggagccgcttgggtcggagtttgtgaactgtccgggcgtgatgcagctcagctggcagaagaagcgggtttcccggaagtagcaaggatggtgcgcgaatcccacggagagacaagatcgcctgaaaatcgttcaccaacccctagcctgcagtactgtgaaaattgtgatacacactttcaggattcaaaccaccgaacgtctaccgcccacctgttgagcctaagccaaggtcctcagcctcctaatctgcccctgggggtgcccattagctcgcccggattcaaactgctgctgcgaggcggatgggaaccagggatgggcttggggcccagaggcgaaggacgggccaaccctatccctacagtcttgaagcgggaccaagagggccttggttatcgcagcgcgccccagccacgcgttacacattttcccgcttgggatacacgcgccgttgctggccgggaacgaccccctcgggttgccaccctgtcgtggcgcgaagagcggcggcgcgaggagaaggatagggcctgggagagggatctaagaacatacatgaatctggagttctag

SEQ ID NO: 188494 - DNA, 597 bp, Artificial Sequence
  Description of Artificial Sequence: Synthetic coding sequence
atgagccggcccctgctgatcaccttcacccccgccaccgaccccagcgatctgtggaaggacgggcagcagcagccccagcccgagaagcctgaaagcaccctggacggcgcggctgccctggcattttatgaggcccttattggggacgaatcctccgcacccgattcgcagcgatcccagacggagccagcacgcgagagaaagaggaaaaagcggaggatcatgaaagcccctgccgccgaggcagtggctgaaggtgccagcggcagacatggacagggccgaagcttggaggcagaggacaaaatgacacatcgcattctgcgagcagcgcaggaaggcgacttaccggaattacggcggttgctggagccccatgaagcaggtggcgctggcggcaacattaatgctagagacgcgttctggtggacccccctgatgtgtgccgctcgcgccggccagggcgcggccgtgagctatctgctggggcgcggagccgcctgggtgggagtgtgtgaactgtccggcagagacgccgcccagctggctgaggaggccgggtttcccgaagttgctagaatggtgcgtgagtag

SEQ ID NO: 188495 - DNA, 1071 bp, Artificial Sequence
  Description of Artificial Sequence: Synthetic coding sequence
atgagccggcccctgctgatcaccttcacccccgccaccgacccctcagacttgtggaaagatggtcagcagcagccccaaccagagaaacccgagtcaacactcgatggcgctgctgcactggcattttatgaggcactgatcggtgatgagtcctccgcacccgatagccagagatctcaaaccgagcctgcccgcgaaaggaagaggaagaaacggaggatcatgaaggcccctgccgcggaagcagtggcggagggcgcatcaggcagacacggccaggggagatcgctcgaggcggaggataagatgacccatagaattttacgcgcagcgcaggaaggggacctgccagagctgcggcgcctccttgagccgcatgaagccgggggggctgggggtaacattaacgccagagacgcattctggtggacacctctgatgtgtgcagcaagggccggtcagggagcggcggtctcttatcttctcggccgtggagccgcctgggtcggggtttgcgaattgtctgggcgcgacgccgctcaattagccgaagaagccggtttccctgaagtggccagaatggtccgtgagagtcatggtgaaacgcggtctcccgagaacaggtcacccacacctagtcttcagtactgcgaaaactgcgatactcatttccaggatagtaaccacaggacctccaccgcccacctcctgtcactgagccagggaccgcagccacccaatctgccattaggggtcccaatctcctcgcccggctttaagctcctgctaagggggggctgggaacctgggatgggtctggggcctcgtggtgaagggagggcgaacccgatccctaccgtactgaagcgggatcaagaggggctgggttaccgtagtgcgccccagcctcgcgtgacgcacttcccagcttgggacactcgtgctgtcgccgggcgggaacgtccccctcgagtggccacgctgtcttggagagaagagaggaggcgcgaggaaaaggatagggcatgggagagggacttgcgaacatatatgaacctcgaattttag

SEQ ID NO: 188496 - DNA, 597 bp, Artificial Sequence
  Description of Artificial Sequence: Synthetic coding sequence
atgagccggcccctgctgatcaccttcacccccgccaccgaccccagcgatctgtggaaggacggacagcagcagccccagcccgagaagcccgaatcaacactggacggagcagccgccagagccttttacgaagcactgattggagatgaatccagtgcacctgattcacagagaagccagactgagcccgcaagggagaggaagaggaaaaaaaggcgaatcatgaaagctccggcagcagaggccgtcgcagagggtgcctctggtagacacgggcagggtaggtctttggaagcagaagataagatgacccatagaatcctacgcgctgcgcaggaaggcgacctccccgagcttcgtcgacttcttgagccacatgaagcaggcggcgctggggggaatattaacgcaagggatgccttttggtggacacctctgatgtgcgccgctcgtgcaggtcagggcgccgccgtttcctatctactcgggcgaggcgccgcgtgggtcggcgtgtgtgaactatccggtcgtgacgctgcccagttggcagaggaagcaggctttcccgaggtggctcggatggtgagagagtag

SEQ ID NO: 188497 - DNA, 1071 bp, Artificial Sequence
  Description of Artificial Sequence: Synthetic coding sequence
atgagccggcccctgctgatcaccttcacccccgccaccgacccctcagatctgtggaaggacggccaacaacagccacagcccgagaaaccagagtccacccttgatggggcagccgctcgggctttctacgaggcattaatcggtgacgagtcctcagcgcctgactctcagcgttcccaaaccgagcccgccagggaacggaaacggaagaaacggcggattatgaaagccccagcggccgaagcagtggcagagggtgcatctggccggcatgggcaaggccgcagccttgaagccgaggataaaatgacgcaccgcatcctgcgcgccgctcaagagggtgatctgcccgagctgaggcgcctgctggagcctcacgaagccgggggggcaggcggcaacatcaacgcacgggatgccttctggtggacaccactcatgtgcgcagcacgcgcaggacagggcgcggctgtctcttatctactcggccggggagcggcatgggttggcgtgtgcgaactgagtggccgcgatgcggcacagctggccgaggaagccggcttcccagaggttgctcgaatggtacgagaatcacacggcgagaccaggtctccagaaaaccgtagtcctactccttcactgcagtattgtgagaactgtgacacccatttccaagattcaaaccaccgaacctccacagctcacctactgtcccttagtcagggtccacagcctccgaacttgcctctgggcgtgcccatatccagtccaggtttcaaattgctgctgcgtggcggatgggagccagggatgggtcttggccccagaggagaaggccgtgccaatccgattcccacagtccttaagcgggatcaagaaggcctgggttaccggtccgcaccacaaccacgcgtgacccacttccctgcctgggacactcgcgccgtcgctgggagagagagaccaccaagggttgctacattgtcctggcgcgaagagaggagacgcgaagagaaagatcgggcgtgggagagagacctgcgtacttacatgaatttggaattttag

SEQ ID NO: 188498 - DNA, 324 bp, Artificial Sequence
  Description of Artificial Sequence: Synthetic coding sequence
atgagccggcccctgctgatcaccttcacccccgccaccgacccctctgatttgtggaaagacggccagcaacaaccccagcccgaaaagcctgaatcgactctcgacggtgccgcggcgagagcattctacgaagccctgattggcgatgagtcgagcgcccctgatagtcagagaagccaaacagagcctgcgagggaaaggaaacgcaagaaaaggaggatcatgaaggcgccggccgctgaggctgtggctgaaggggcctcaggccgacatggccaggggcgttccctggaagcagaagacaagatgacccataggtag

SEQ ID NO: 188499 - DNA, 1071 bp, Artificial Sequence
  Description of Artificial Sequence: Synthetic coding sequence
atgagccggcccctgctgatcaccttcacccccgccaccgacccctctgacctgtggaaagatggccagcaacagccacagccagaaaaacctgagtctacacttgacggggcagccgccagggcgttctacgaagccctgatcggggacgagagctcagcccctgattcgcagcggagccaaaccgaacctgcccgcgaacgcaagcgcaaaaaaagacgtattatgaaagcacctgcggcagaagctgtagctgagggggcctcaggcaggcacgggcaggggcgctcgctcgaggctgaggacaagatgacgcacagaattttgcgcgccgcccaggagggggatctccctgagttacgcagactgctcgagccacatgaagcaggcggagctggcgggaatattaatgcaagggacgctttttggtggacacctctgatgtgcgctgcccgggctgggcaaggcgctgccgtttcttatctgctggggaggggcgctgcgtgggtgggggtgtgtgaactgtctggcagagatgcagcccagctcgccgaggaggctggcttccccgaagtagccagaatggttagagaaagtcacggggagacccgatccccggaaaacagatcacctactccttctctgcagtactgtgaaaattgcgacacacactttcaggatagtaaccatcgaacgagcaccgcccacctgctgtccctgtcacaaggccctcagccacctaatctgcccctgggagtgccgatttctagtcctggattcaaacttctcctcaggcgtggatgggagcccgggatgggcctaggaccaaggggcgaaggccgcgctaaccctattcccacggtgctgaaacgcgaccaggagggcctgggatacaggtctgctccccagccacgcgtgacacatttccctgcttgggacacgcgcgccgtggccggccgcgagagacccccccgggtggctacgttgagttggcgggaagagagacgccgagaggaaaaagatcgtgcctgggagcgggatctgaggacgtatatgaatttagaattctag

SEQ ID NO: 188500 - DNA, 324 bp, Artificial Sequence
  Description of Artificial Sequence: Synthetic coding sequence
atgagccggcccctgctgatcaccttcacccccgccaccgacccctccgacctgtggaaagatggccagcagcagcctcaacccgagaagcccgagagcacactggacggagctgcggcacgcgccttttacgaagccctgattggagacgagtcgtccgccccggactctcagcggtctcagaccgagccagccagggaaagaaaacgcaaaaaaagaagaataatgaaggccccggctgccgaagctgtcgcagagggagctagtggcagacatggtcagggaaggtctctggaggccgaagacaagatgacccaccgctag

SEQ ID NO: 188501 - DNA, 459 bp, Artificial Sequence
  Description of Artificial Sequence: Synthetic coding sequence
atgagccggcccctgctgatcaccttcacccccgccaccgaccccagcgacctatggaaagacggccagcagcagccacagcccgaaaagcccgaaagtaccctcgacggcgccgcggctcgcgcgttttacgaagccctgataggagacgaaagctcggcccctgactcccagcggagtcagacggagccggcgagggaacggaagcgaaagaaaaggcgtatcatgaaggctccagctgcagaggccgtggccgaaggcgcgtccgggagacatggccaaggccgctctcttgaggcagaggacaaaatgactcatcgtattctgcgagccgctcaggagggtgacctgcctgaacttcgaaggctgttagaaccacatgaagcaggaggagcgggcggcaatataaatgctcgggatgctttctggtggacgccacttatgtgcgcagcccgttag

SEQ ID NO: 188502 - DNA, 1071 bp, Artificial Sequence
  Description of Artificial Sequence: Synthetic coding sequence
atgagccggcccctgctgatcaccttcacccccgccaccgacccctccgacctgtggaaagatggccagcaacagccacagccagaaaaacccgaaagcaccctggatggcgccgccgctcttgctttttatgaggccctgatcggtgacgaatctagcgcccccgactctcagcggagtcaaacagagcccgctagagagaggaaacggaagaagcgccgtatcatgaaggctcctgccgctgaggccgtggctgaaggcgcctccggccgacacggccaggggcgctctctggaggctgaggacaaaatgacccatagaatcctccgcgccgcccaagaaggtgacctgccggagttaaggcggcttctcgagcctcatgaggcaggcggcgccggtggcaatatcaacgcaagggacgccttttggtggacgcccttaatgtgtgccgcaagagccgggcaaggcgccgccgtgtcatacctcctaggccgaggggccgcttgggtgggagtctgcgagctttccgggcgggacgctgcacagttagccgaagaagctggatttcccgaggtggcaagaatggttcgcgagagtcacggagagactagatcccccgagaataggagcccaactccttcactgcagtattgcgaaaactgtgacacgcacttccaggactccaaccatcggacttctactgctcatctgcttagcctatcgcagggcccgcagcccccaaaccttccattaggcgttcccatatcctcacctggatttaaactcctcctacgcggggggtgggagccaggcatggggctgggaccccgcggggaaggtcgcgccaaccccattcctactgtgctgaaaagggaccaggaagggctcgggtatcggtcagccccacagcctagagtgacacacttccctgcttgggacacacgcgccgtggctggtcgtgaacgcccaccaagagtagctactctctcttggagagaggaaagaagacgtgaggaaaaggatcgcgcttgggagagagacctgcgcacgtacatgaatctggagttctag

SEQ ID NO: 188503 - DNA, 1071 bp, Artificial Sequence
  Description of Artificial Sequence: Synthetic coding sequence
atgagccggcccctgctgatcaccttcacccccgccaccgaccccagcgatttatggaaggacggccaacagcagccccagccggagaaacccgagtctacgctggacggggccgctgcgctagcgttttacgaggctctgattggggacgagtcttctgctccagactcccaacggagtcagacagagccagctcgggaaaggaagcgcaaaaagcgcagaattatgaaagcgcccgcagccgaagccgttgctgagggcgcctcaggtcgacatggccagggccgctcattggaggcggaagacaaaatgactcacagaatcctgagggcagcccaggagggcgatctacccgaactcagacggctgctggagccacacgaggcaggcggagcaggtggcaacatcaacgctagggatgctttttggtggactccgctgatgtgtgcagcaagggcaggtcagggcgctgccgtcagctacctgctagggaggggcgcggcatgggttggagtgtgcgaactttccggtagggacgccgcacagctggccgaagaggccggttttccagaggtcgcacgaatggtcagagagtcccatggagaaacgcggagccccgagaatcggtctccgacacccagcctgcaatattgcgaaaattgtgatactcactttcaagattccaatcatagaacctctacggcccaccttcttagcctgagccagggcccacaaccacccaacctccctctgggggtccccatttcatccccaggctttaaactcttgttgaggggcggctgggaaccaggcatgggcctgggccctcgaggggaaggtagagcaaacccgatccctaccgtcctaaagcgcgaccaagagggactgggatatcgatcagccccacagccccgagtcacacactttcccgcgtgggacacccgagccgtcgcgggaagagaacgacctccgcgcgttgctaccctctcatggagggaggaaagaaggcgcgaggaaaaggacagggcgtgggagcgggatctccgcacttacatgaaccttgagttttag

SEQ ID NO: 188504 - DNA, 498 bp, Artificial Sequence
  Description of Artificial Sequence: Synthetic coding sequence
atgagccggcccctgctgatcaccttcacccccgccaccgacccctctgacctgtggaaagatggacaacaacagccccagcctgagaaacctgagagcacactagacggggccgcggcccgcgctttctacgaggctctcattggggatgagtcatccgctcccgatagccagaggtcccaaaccgagcctgcccgagaacgtaagcgcaaaaaaagaagaattatgaaagcccctgccgcagaagcagtggctgaaggggcctcgggaaggcatggccagggacgctctctcgaagctgaggacaagatgactcataggattttgcgcgccgcccaagaaggtgacctgccggaactgcgacgcctacttgaaccccatgaagcagggggcgcaggcggtaacatcaacgctcgcgatgccttttggtggacccctctgatgtgcgcggctagagcagggcagggggccgccgttagctacctccttggccgatag

SEQ ID NO: 188505 - DNA, 273 bp, Artificial Sequence
  Description of Artificial Sequence: Synthetic coding sequence
atgagccggcccctgctgatcaccttcacccccgccaccgacccctcggacctgtggaaggatggccagcagcagccacagcccgaaaaaccagagtctactctggatggcgcagctgcgcttgcgttttatgaggccctgattggggacgagtccagcgcgcctgattcccagcgatcccagaccgagcccgcgcgggagcgtaagagaaagaagagacgtatcatgaaggccccggcagctgaagccgtggcagagggcgcttccggttag

SEQ ID NO: 188506 - DNA, 1071 bp, Artificial Sequence
  Description of Artificial Sequence: Synthetic coding sequence
atgagccggcccctgctgatcaccttcacccccgccaccgacccctcagatctgtggaaagatggccagcagcagccacagcccgaaaagcctgaaagcacgctcgacggggcggcagcccgggccttctatgaggccctgattggcgatgagagctccgctccagatagccagaggtctcaaacagaacctgctcgggagagaaagagaaaaaagcgtcggataatgaaagcccccgcagccgaggcagtggcagaaggagcatccggcagacacgggcaaggcaggtcccttgaagctgaggacaagatgacacataggatcctccgcgccgctcaagaaggtgatctaccagagcttcgccgactgctggagccccatgaagccggtggtgctggcgggaacatcaacgcccgagatgcattttggtggactccattaatgtgtgccgccagggcgggacaaggggcggccgtttcttacttgctgggtcggggtgctgcttgggtgggcgtgtgcgaacttagcggccgcgacgccgcccagctcgccgaggaggcaggctttccagaagtggcacgcatggttagagaaagtcacggggaaacaagaagccccgagaataggtcgcccactccatcacttcagtactgcgagaactgcgatacacacttccaggactccaaccatagaaccagcaccgcccacctgctcagcctgagccagggtccccaacctcctaacttgcccctgggggtaccaatctcctctcccggattcaagcttttgctaagaggaggatgggagccagggatgggcctcggcccacggggcgagggtagagctaaccccattcccaccgtactcaaacgagatcaggaggggctcggctatcgcagtgccccacagcctagggtaacccacttcccagcctgggacacccgcgccgtggctggacgcgagcgaccccccagagttgcaactctatcgtggcgggaggagaggcgccgtgaggagaaagatcgcgcttgggaacgtgatctgcgcacttatatgaatctggaattctag

SEQ ID NO: 188507 - DNA, 273 bp, Artificial Sequence
  Description of Artificial Sequence: Synthetic coding sequence
atgagccggcccctgctgatcaccttcacccccgccaccgacccctccgacttgtggaaggacggccagcagcaaccacagcccgagaaaccagagtccaccctggacggagccgctgccttggctttttatgaggcgctgataggtgacgaatcttctgcccccgatagccagcgctcccagacagagcccgcccgagagcgcaaacgtaaaaaaaggaggataatgaaggctcctgctgcagaggccgtggccgagggtgccagcgggtag

SEQ ID NO: 188508 - DNA, 1071 bp, Artificial Sequence
  Description of Artificial Sequence: Synthetic coding sequence
atgagccggcccctgctgatcaccttcacccccgccaccgacccctccgacctatggaaggatgggcagcagcagccccagccagagaaaccggaatcaactctggatggcgctgctgctagagctttctatgaggcgcttatcggagatgaatcctcagcgcccgattcacaacgttcacagaccgaaccagcccgggagcggaaaagaaaaaagaggcgaatcatgaaggcaccagctgcagaagccgtggcagaaggggctagcggtcgtcacggccaaggtcggtcgttggaggccgaggacaagatgacccatagaatcctgcgagcggcccaggagggcgatctgccagagctccgacgtcttttagagccacacgaagcagggggcgccggtggcaatatcaacgcgcgggacgcgttctggtggacccctctgatgtgcgccgcaagggctggtcagggggccgccgtgagttacctgttggggcgcggtgcagcttgggtaggtgtgtgtgaattatctggcagagacgcagctcagcttgcagaggaggcaggctttccagaagtagccaggatggttagagaatcacatggggagacaaggagcccagagaataggtcaccaacgcccagtctgcagtattgcgagaactgcgacacgcacttccaggatagtaaccaccgcacaagcactgcccatttactttcgctgagccaggggcctcagccaccaaacctgccgctcggagtcccaattagttcaccagggttcaagttgctgctgagaggcggctgggagccgggcatgggcctgggacccaggggggaagggcgagccaatccaattcctacagtcctgaaacgggaccaggagggcctggggtaccgaagtgcaccacagccccgcgtcacacacttccctgcctgggacacacgcgccgtagcagggcgcgagaggccgccgagggtggccacgctgagttggagagaagagcgacggagagaggagaaggatcgagcctgggaaagagacctgcgcacctacatgaacctggagttttag

SEQ ID NO: 188509 - DNA, 597 bp, Artificial Sequence
  Description of Artificial Sequence: Synthetic coding sequence
atgagccggcccctgctgatcaccttcacccccgccaccgaccccagcgatctttggaaggacggtcagcaacagcctcagcccgaaaagcctgaatccaccctcgatggggccgccgcccgagccttctacgaggccttaatcggcgacgaatccagcgcccccgacagtcagagatctcagactgaacctgcccgcgagcggaaacgaaagaagcgcagaattatgaaggcccccgcagccgaggccgtggcggaaggcgcatctggccgccatgggcaagggagaagtctggaagctgaagacaagatgacccatcgcatcttaagagcggcgcaggaaggagacttgccggaactgagaaggcttctcgaaccacacgaagccggtggcgcaggggggaacatcaatgctagagacgccttctggtggactccactaatgtgcgctgccagggcgggccaaggagcggccgtgtcgtacctcctgggaaggggtgccgcttgggtgggtgtttgcgagttgtcaggacgcgacgctgcccagctggcggaagaagctggctttcccgaggttgcacgaatggtgcgggaatag

SEQ ID NO: 188510 - DNA, 324 bp, Artificial Sequence
  Description of Artificial Sequence: Synthetic coding sequence
atgagccggcccctgctgatcaccttcacccccgccaccgacccctccgacctgtggaaggatgggcagcagcagccgcagcccgaaaagcctgaatccactctagacggcgccgcagccttagcattttacgaagcactgatcggagacgagtcaagcgcacctgacagtcaaaggtcccagaccgagcccgcaagggagcggaaaagaaaaaagcgccgcattatgaaggctccagcggctgaggccgtcgccgaaggcgcgtcagggcgacacggtcaaggaaggtccctggaggctgaagacaagatgactcaccgctag

SEQ ID NO: 188511 - DNA, 324 bp, Artificial Sequence
  Description of Artificial Sequence: Synthetic coding sequence
atgagccggcccctgctgatcaccttcacccccgccaccgaccccagtgacctgtggaaagatgggcagcaacagcctcagccggagaagcctgagtctaccctggacggcgccgcggccctcgcattctatgaagcacttattggagatgaatcctccgctccagacagtcagaggagccagaccgagcctgccagagagagaaagcgaaagaaaaggaggatcatgaaagcacccgcagctgaagcagttgctgagggagccagtggacgacacggccagggccgaagcctggaagcagaggataagatgacacatcgatag

SEQ ID NO: 188512 - DNA, 273 bp, Artificial Sequence
  Description of Artificial Sequence: Synthetic coding sequence
atgagccggcccctgctgatcaccttcacccccgccaccgacccctctgatctttggaaagacggccagcagcagcctcagccagaaaaacctgaaagcaccctcgatggggcagccgccagagcattctatgaagctctgatcggcgacgaatcctctgcaccagacagccaacggtcccagaccgaaccagcccgcgagaggaaacgcaagaaaaggcgtatcatgaaggctccagccgccgaggcagtagccgaaggagccagcggatag

SEQ ID NO: 188513 - DNA, 273 bp, Artificial Sequence
  Description of Artificial Sequence: Synthetic coding sequence
atgagccggcccctgctgatcaccttcacccccgccaccgaccccagtgacctgtggaaggatggacaacaacagccccaaccggaaaagccggagtcaacactggacggagcagccgctagagcattttacgaggccctcatcggagatgagtccagtgcccccgactctcagaggtcccagactgagcctgcacgagaaaggaaacggaagaagagaaggatcatgaaggctcctgcagcggaggcggtcgccgagggagcttctgggtag

SEQ ID NO: 188514 - DNA, 459 bp, Artificial Sequence
  Description of Artificial Sequence: Synthetic coding sequence
atgagccggcccctgctgatcaccttcacccccgccaccgaccccagcgacttgtggaaagacggccagcagcagccccagcccgaaaagcctgagagtacgctggacggcgccgctgctagagccttctacgaggccttaatcggtgacgagtcttccgcaccagattcgcagcgatcccagacagaacccgctcgagaaagaaagcgcaagaagcggagaattatgaaggcacccgctgccgaggccgtagccgagggagcctctgggaggcatggtcagggccgatctcttgaagcggaagacaagatgacacacaggatacttagggctgcccaagaaggcgatctcccggaactgcgaaggttattggaaccccacgaagctgggggggccggaggcaacattaacgcccgcgacgccttctggtggacgccccttatgtgcgcagctcggtag

SEQ ID NO: 188515 - DNA, 597 bp, Artificial Sequence
  Description of Artificial Sequence: Synthetic coding sequence
atgagccggcccctgctgatcaccttcacccccgccaccgaccccagtgatttgtggaaagatggccagcaacagccgcaacccgaaaaacctgagtccactttggatggtgccgcggcacgggctttctacgaggccctgattggggatgaatcaagcgctcctgacagtcagagaagccagacagagcccgcacgcgagcgcaagcgaaagaagcgcagaattatgaaagctccagccgctgaggccgtagctgagggcgcgtccggtagacacggtcagggccgctcgcttgaggctgaagacaaaatgacgcacaggattctgagagcggcccaggaaggcgacctcccagagctgcgccgactgttggagcctcacgaagccgggggcgccggagggaatataaatgcccgagatgccttttggtggacacccctaatgtgtgctgctagagctggtcagggcgcggccgtgtcatatttgttgggaagaggagccgcctgggtgggggtttgtgagttgagcggccgggatgcggcccagctggccgaggaggctggctttccagaagtggccagaatggtgagggagtag

SEQ ID NO: 188516 - DNA, 1071 bp, Artificial Sequence
  Description of Artificial Sequence: Synthetic coding sequence
atgagccggcccctgctgatcaccttcacccccgccaccgaccccagtgacttgtggaaagacggtcagcagcagccacaaccagagaaaccagaaagcacattggatggagccgccgcacttgcgttttatgaggctctcatcggcgacgaaagtagcgccccagattctcagcgctcccagaccgagccggccagagaaaggaagcggaaaaaacgccgaattatgaaagcacccgcggcggaggctgtggccgagggagcctccggacgccatggacaaggaaggtcacttgaagctgaagacaaaatgactcaccgcatcctgagagcggcccaggagggcgacctccctgaactgaggcggcttctcgaaccgcacgaggcgggtggcgccgggggaaatatcaatgccagagatgccttctggtggactcctctcatgtgcgccgctagagcgggtcaaggcgccgctgtatcatatctgctgggcaggggagctgcctgggtcggcgtgtgtgaactatctggaagggacgccgctcagttagccgaggaggcgggctttcctgaggtggcacggatggtacgcgaatcccacggtgagacaagatccccagagaatcggtctcctaccccaagtctgcaatactgcgaaaactgcgatacccatttccaggactccaatcatagaacgtccacggcccatctgctgtccctgagccagggccctcaaccccctaaccttcccttaggagtgccgattagctcacctggattcaagttgctgctccgtggcgggtgggagccaggaatggggctcggtcctcggggcgagggacgcgccaaccccatacctacagtgttgaaaagggaccaagaaggcctgggatatagatctgcgccacaaccgcgggtaacccatttccccgcatgggacacgagggctgtggccggacgggagagacctccgagggtggcaacgttgtcctggagggaggaacgccggcgtgaggaaaaagaccgggcatgggagcgcgaccttcgcacctatatgaaccttgagttctag

SEQ ID NO: 188517 - DNA, 1071 bp, Artificial Sequence
  Description of Artificial Sequence: Synthetic coding sequence
atgagccggcccctgctgatcaccttcacccccgccaccgacccctcagacttgtggaaagacggacagcagcagccacagcctgagaaacccgaaagcaccctggacggagcagccgcccgcgccttctatgaggcactgatcggagacgaatcgtctgcacccgattctcaaaggagtcagactgagccagctcgggaaagaaagaggaagaagcgtaggataatgaaggctccagctgcggaagctgttgctgaaggggcttcggggcgccacgggcagggcagatctctggaggcggaggacaagatgacccatcggattctccgtgccgcccaggagggcgacctccctgaactgcgccggttactcgaaccacatgaagccgggggcgctggcggaaacatcaacgctagggatgctttctggtggactccccttatgtgtgccgcgcgggctggtcagggagcagccgtatcttacctgctcggtcggggcgccgcgtgggtgggagtttgcgagctgtctggccgcgatgccgcccagttagccgaggaggctggctttccagaagtcgctaggatggtgcgcgagagtcatggtgagactcggtcacctgagaacaggtcacccaccccttccctccagtactgcgaaaattgtgatactcacttccaggattcaaatcatcgaaccagcacagcacacctgctctccctttcacagggcccacaacctcccaatctccctcttggcgtacctattagctccccagggttcaagctgttattgcgtggtggctgggaaccaggtatgggcctaggacccaggggggaaggcagggccaaccccattcctaccgtgctaaagagggatcaggaaggtctggggtatagaagtgcaccccagcctagggttacccactttccggcctgggataccagagcagtggccggcagggaacgccccccacgggttgctactctgtcctggagagaagagcggaggagggaggagaaggatcgggcctgggagcgcgatctgcggacctacatgaacctggagttctag

SEQ ID NO: 188518 - DNA, 1071 bp, Artificial Sequence
  Description of Artificial Sequence: Synthetic coding sequence
atgagccggcccctgctgatcaccttcacccccgccaccgacccctccgacttatggaaagacggacagcaacagcctcaacccgagaagcccgagtcaacccttgatggtgcagcggccagagccttttacgaggcgctcataggcgatgaatcctcagcccccgattcgcagcgtagccagacagaacctgcaagagagcggaagcggaagaagcgacgtatcatgaaggcacccgcagcagaagccgtggcagaaggcgctagcgggagacacggacagggccgttcattagaagcagaggacaaaatgacccatcggatcctgcgggctgctcaagaaggcgacctacctgagctcaggcggctacttgagccccacgaggccggcggcgcaggtggcaatatcaatgcaagagacgcgttctggtggactcctctgatgtgcgccgcccgcgccgggcagggagcggcagttagctatctccttgggaggggcgccgcctgggtgggggtgtgtgagctctccggtcgcgatgcagcccaacttgctgaagaagccggctttccagaggtggccagaatggtcagggaatcacacggagagactagatcaccggaaaatagatccccaactccatcacttcagtactgcgagaattgtgatactcattttcaggactcaaaccatagaaccagcacagcccatctgctctcactgtcgcaagggccgcagcccccaaacctgcctcttggagtccccatatcgtctcctggtttcaaactgctgctccggggcggatgggagcctgggatgggccttgggcctcgtggggaaggcagagccaaccccattccgacggttttgaagcgagaccaagaggggttaggttatagatcggctccccagcctagggttacacatttccccgcctgggatacaagagctgtggccggcagggagaggccacctcgcgtggcgaccctcagttggcgagaggaaagaaggcgcgaggagaaggacagggcctgggagcgcgatctccgaacatatatgaaccttgagttctag

SEQ ID NO: 188519 - DNA, 498 bp, Artificial Sequence
  Description of Artificial Sequence: Synthetic coding sequence
atgagccggcccctgctgatcaccttcacccccgccaccgacccctccgacctctggaaagatggtcagcagcagccccaacccgagaaacctgagtccacactagacggcgccgcggctctggcgttttatgaggcactgattggcgatgaatccagcgcccccgactctcagagaagtcagaccgaacctgctagagagcggaaacgtaaaaaacgaaggattatgaaggccccagctgcagaggctgtggctgaaggcgcgtcggggaggcacggccaaggacgttccctggaggccgaagacaaaatgacccaccggatcctccgagctgctcaggagggtgacctccccgaattgcggcgcctgctggagcctcatgaggcggggggcgcaggtgggaacattaacgccagggacgccttttggtggaccccactcatgtgcgcggcccgcgccggacaaggcgcggccgtgtcatacttgctgggcaggtag

SEQ ID NO: 188520 - DNA, 273 bp, Artificial Sequence
  Description of Artificial Sequence: Synthetic coding sequence
atgagccggcccctgctgatcaccttcacccccgccaccgacccctcagacctgtggaaggatggacaacagcagccgcaacccgagaagccagagtccaccctggatggagctgcagcaagagccttctacgaggccctgattggggatgagagtagcgctccagactctcaacgatcccagacagaaccagcgcgtgagcgaaagagaaagaaacgaagaataatgaaggcacctgctgccgaagccgttgctgagggagcgagtggctag

SEQ ID NO: 188521 - DNA, 324 bp, Artificial Sequence
  Description of Artificial Sequence: Synthetic coding sequence
atgagccggcccctgctgatcaccttcacccccgccaccgacccctccgatctgtggaaggatggccagcagcagcctcagccagaaaagcctgagagcaccctggacggagctgcagcgcgggctttctatgaggccctgattggcgatgagtcttccgccccagactctcagcggtcgcagacagaaccggccagggagaggaagaggaaaaagcggaggatcatgaaggctccagccgcagaggccgtcgccgaaggagccagtgggcgacatggacagggccgctctctggaggccgaggataaaatgacacaccgttag

SEQ ID NO: 188522 - DNA, 1071 bp, Artificial Sequence
  Description of Artificial Sequence: Synthetic coding sequence
atgagccggcccctgctgatcaccttcacccccgccaccgaccccagtgatctttggaaggatgggcagcagcaaccacagccggagaaacccgagtcaactcttgacggagccgcagcaagagcattctatgaggccctaatcggggacgagtcttctgcgcctgattcacagagaagccagacggaacctgcccgcgaacgcaaacgcaaaaaaaggcgtataatgaaggcccccgctgcagaagccgtcgccgaaggagccagcgggagacatgggcagggcagatctctagaggctgaggacaagatgacccacaggattctgcgagctgctcaagagggggatctccccgagctgcggaggctgctcgaacctcacgaagcaggcggagcagggggaaacatcaacgcccgcgacgcgttttggtggacaccattgatgtgcgccgcccgggccggacaaggtgcagctgtatcttacctgctcgggcggggtgcagcttgggtcggagtttgtgaactgagcggccgcgatgcggcgcagttagcagaggaagccggattccctgaagtcgcacgcatggtgagagaaagccacggggagacacgtagtccggagaatcggagcccaaccccatctctacagtactgtgaaaattgcgacacacacttccaagatagtaatcaccgaacctccaccgcccatctcttatcgctgtcacagggcccccagccccctaacctccccctgggggtccctatctcctcacctggatttaagcttctgctcaggggcggctgggagccaggcatgggcctcggcccccggggcgaaggtagagctaaccccatccccactgttttgaagagagatcaggagggtctaggctacaggagtgctccccaacctcgtgtgacccacttccccgcatgggacacacgagccgtcgctggaagggaacgcccaccgcgcgtggcaaccctcagctggcgagaggagcgccgacgtgaagaaaaagaccgggcttgggagcgggatctgaggacgtatatgaatctcgaattctag

SEQ ID NO: 188523 - DNA, 1071 bp, Artificial Sequence
  Description of Artificial Sequence: Synthetic coding sequence
atgagccggcccctgctgatcaccttcacccccgccaccgaccccagtgacctgtggaaggacgggcagcagcagcctcagcctgaaaagccagaaagtacactggatggcgccgcagccttggccttctacgaagctcttattggcgatgaaagctcagcccctgactcccagcgttcgcagacagagccggcacgagaacgcaagcgtaagaaacgtcggataatgaaagctccagcagcagaggccgtcgctgaaggcgcctctgggcgccacggccaggggaggtcattagaagctgaggataaaatgacccaccgcattctgcgggcagcccaggagggagacctgcccgagctgcggcgtttgcttgaaccccatgaggcaggcggtgcaggcggcaacatcaacgctcgagatgcattctggtggacgcctttgatgtgcgccgctcgggccggtcagggagctgccgtaagttacctgttgggtaggggggctgcatgggtgggtgtgtgcgagctgtccgggcgagatgctgcccagttagccgaggaagctgggttcccagaggttgctcgcatggttcgagagtcccatggagagacccgaagccctgagaataggtcaccaaccccatcgctacagtattgcgaaaactgtgacacacacttccaagatagtaaccacagaaccagcactgcacatttactttcactaagccagggcccgcagccccctaatctgcccctcggggtcccgatctcgtcacctggcttcaagctgctcctccgtggtggctgggaaccaggtatgggactcgggccacgaggtgaaggccgggctaacccgatacccacagttctcaagcgcgatcaggaaggccttggatataggtcagcgccacagcctcgagttactcactttccagcgtgggacaccagagcggtggccggccgggaacggcctccacgtgtcgccaccctgtcatggagggaggagcggagacgggaagagaaggatcgagcctgggaacgggacctgagaacatacatgaatctagaattttag

SEQ ID NO: 188524 - DNA, 1071 bp, Artificial Sequence
  Description of Artificial Sequence: Synthetic coding sequence
atgagccggcccctgctgatcaccttcacccccgccaccgacccctctgacctctggaaggatggtcagcagcagcctcaacccgagaagccggaatcaacacttgatggtgcagccgctctagcattctacgaagctctcatcggcgatgaatctagcgctcccgactctcagcgttcccagacagagccagcaagggagcggaaaagaaagaaacggaggatcatgaaagctcctgcagcagaagcagtcgccgagggagctagcgggcgccatggccagggcaggtcccttgaggctgaagacaaaatgacccatcgtattttgcgggcggctcaggagggtgacttgccggaactgcggcgtcttctcgaaccccacgaagccgggggcgcaggcggaaatatcaacgccagagacgctttctggtggactcccctgatgtgcgccgcccgagccggccagggcgctgcggtaagttatctgctgggcaggggagccgcctgggttggagtttgtgagctgtccggtcgggacgcagcccaactggctgaggaagcaggattcccagaagtggctaggatggttagagaatcccacggggaaacccgatcccccgaaaatcggtcccccactccatcgcttcagtattgcgagaattgcgatacccatttccaggattcgaaccaccgcacaagtaccgctcacctcctgtccctctcacagggacctcagcctcccaacctgcccctcggagtccccatcagctcgccaggctttaagctgttgttgcgaggcgggtgggaacctggaatgggcctgggtcctcgaggagaggggagagccaacccaatcccgaccgtgctgaagcgagaccaggaaggactgggctataggagcgcaccgcagccgagagtaacccacttccctgcttgggacaccagagccgtggcaggtcgcgaaagaccgcctcgtgttgcgaccttgtcatggagggaggagcggagaagagaagaaaaagatagggcttgggagagagatttgaggacttatatgaatctggagttctag

SEQ ID NO: 188525 - DNA, 273 bp, Artificial Sequence
  Description of Artificial Sequence: Synthetic coding sequence
atgagccggcccctgctgatcaccttcacccccgccaccgacccctccgatctttggaaggatgggcagcagcagccgcagcccgagaagccggaatccaccctggatggtgcagccgcgcgagcgttctacgaggcacttatcggagatgagtcatccgctcccgactcccaacgatctcaaaccgaaccagctagagaaaggaagcggaagaagcgaagaatcatgaaagccccggcggcagaggctgtcgctgagggggcatcaggctag

SEQ ID NO: 188526 - DNA, 1071 bp, Artificial Sequence
  Description of Artificial Sequence: Synthetic coding sequence
atgagccggcccctgctgatcaccttcacccccgccaccgacccctctgacctctggaaggatgggcagcagcagccccaaccagagaaaccagaatctactctcgacggcgctgccgcactggcattttacgaagccttaatcggagacgaatcctcagcccccgattctcaaaggagccagactgagccagcaagagagcgtaagagaaagaaacggcggatcatgaaggctccagcagccgaagccgtggccgaaggcgctagcggtagacacggacagggtcggtctctcgaggctgaggataaaatgacccaccgaatcctgcgggccgcccaggagggagacctgcccgaactcaggcggctgctggaaccacacgaggccggtggcgcagggggcaacattaacgcccgggacgctttctggtggactccactgatgtgtgctgctagggccggacagggtgccgccgtgtcatatctgctcgggaggggggctgcttgggtgggcgtgtgcgaactgtctgggcgggatgctgctcagctggccgaagaggcggggtttcctgaagtagctaggatggttcgggagagtcatggggaaacaaggtcacctgagaacaggagccccactccttcactccaatattgtgagaactgcgacacacacttccaggattccaaccaccgcacctctaccgctcatttactatcattgtcccagggcccacaaccccctaatcttcctttaggcgtgccaattagttcgcccggctttaagttactcctgcgggggggatgggaacccgggatgggtcttggaccgagaggagagggacgcgctaaccctattcccactgtgttaaagcgggatcaggagggactggggtatagatctgccccacaacctcgagtaactcattttccagcgtgggatacacgggccgttgctgggagggaacggccaccgagggtcgcaacactgtcctggagagaagaaaggcggcgggaagagaaggacagagcatgggaaagagaccttcgaacctatatgaatctggaattttag

SEQ ID NO: 188527 - DNA, 498 bp, Artificial Sequence
  Description of Artificial Sequence: Synthetic coding sequence
atgagccggcccctgctgatcaccttcacccccgccaccgacccctcagacctatggaaagatggtcagcagcagccacagcccgagaagcccgaatccactcttgatggcgccgccgctagggccttttatgaggccctgatcggggacgagtccagtgcaccagactctcagagatcacagacagaaccggcccgagaacgcaaacggaagaagaggcggattatgaaagcgcctgctgccgaagctgtcgcggaaggcgcctctggcagacatggtcaggggcgctccctggaggctgaggataagatgacccaccggattctgcgcgcagcccaggagggcgatcttccagagttgagacgtctattagagccacacgaagctggcggggctggcggcaatatcaacgcacgagacgcattttggtggacccccctcatgtgtgcagccagagcaggccagggagccgccgtgtcctacctgctcgggcgctag

SEQ ID NO: 188528 - DNA, 459 bp, Artificial Sequence
  Description of Artificial Sequence: Synthetic coding sequence
atgagccggcccctgctgatcaccttcacccccgccaccgaccccagcgatctgtggaaggatggacaacagcaacctcagcctgagaaacctgaatcaacgttagatggagcagctgcaagggcattttacgaggcattaattggcgatgagtcttccgccccagactcccagcgcagtcaaactgagccagcacgcgaacgaaaacgaaagaagcgacgtattatgaaggcgcccgctgccgaggctgtcgcggaaggtgcaagtgggagacatgggcagggtcgctctctggaggccgaagataagatgactcataggatccttcgagctgcccaagagggagacctacctgagctacggcgccttctggagccccatgaagccgggggcgcgggtggcaacatcaatgccagggacgctttctggtggaccccattaatgtgtgcagcaagatag

SEQ ID NO: 188529 - DNA, 4509 bp, Artificial Sequence
  Description of Artificial Sequence: Synthetic coding sequence
atggccgaccggttcagccggttcaacgaggaccgggacttccagggaaaccacttcgaccaatacgaagaagggcatctcgaaattgagcaagcatcacttgacaagcccattgagagcgataacattgggcatagattgctgcaaaaacacggctggaagctcggtcaaggactcggcaaatccctccagggaagaaccgaccccatccccattgtggtgaagtacgatgtcatggggatgggaagaatggagatggagcttgattatgccgaggatgcaaccgagcgacgacgcgtcctcgaggttgagaaagaggatacagaggaattgagacagaagtacaaggactatgtcgataaggaaaaggcaatcgctaaagctttggaagacctccgtgcgaacttctactgcgagctctgcgacaagcagtaccagaaacaccaggagttcgataaccatattaatagctatgatcacgcccataagcagcggctgaaggacttgaagcagcgtgaatttgcaagaaatgtgtcatctcggtcccggaaggacgagaagaagcaagagaaggccctccggcggctgcacgagctcgctgaacagaggaagcaggctgaatgcgctcctgggtctggccccatgtttaagccaactaccgtagccgtcgatgaagagggaggcgaggatgataaagatgagagcgcgactaactcaggcactggcgccactgcatcctgtgggctgggctctgagttttcgaccgataagggcggccctttcacggcggtgcagattactaacaccaccggactcgctcaggccccaggcttggcatcgcagggtattagctttggaattaagaacaatctcggaactcccctacagaaattgggtgtgtcattctccttcgccaagaaggccccagtgaaactggaatctatcgcttccgtgttcaaggaccacgcagaagaggggacctctgaggacgggacaaaacccgatgagaaaagcagtgaccaagggctgcagaaagttggtgattccgatgggtcttcgaatctggacgggaagaaggaagatgaagaccctcaggatgggggaagcctagccagtacactgtcaaaactgaagcggatgaaaagagaagagggggccggggccacagagccagagtattaccattatattccacctgcacattgtaaggtgaagcccaacttcccgtttctgctgtttatgcgggcttccgagcagatggacggagacaacaccacacatccaaagaacgcccccgaaagcaagaaaggttcttccccgaaaccaaagagctgcatcaaggcagccgcatctcagggggccgaaaagacagttagcgaggtgtctgagcagcccaaggaaacctctatgaccgagccctcggagcctggctccaaggctgaagccaaaaaggctctaggcggggatgttagcgaccagagcctcgagagtcattctcagaaggtgtcagagacacagatgtgcgagtcaaacagttctaaggagacaagtctcgcgacccctgctggcaaagagagtcaggagggacccaaacatcccaccgggccttttttccccgtgttgagtaaggacgaatcgacagcactccaatggcccagtgaactcctgatctttactaaagcagagccttccatcagctatagttgtaatcctctgtatttcgattttaaactgtcaagaaacaaagatgccagaactaaaggtacggagaaaccaaaggacattgggagcagctctaaagaccatctgcagggtctagatcccggagagcctaataaatctaaggaagtgggcggagaaaaaatcgttcggtcatcagggggacggatggacgctcctgctagtggctctgcatgttctgggctgaataaacaggaacccggaggatcccatgggtctgagacagaggacacaggcaggagcctcccttccaagaaagaaaggtcggggaagagccatcgccataagaagaagaaaaaacacaagaagagcagtaaacacaagagaaagcataaggccgacactgaagagaaaagttccaaggcggaatctggggagaagtctaaaaagcggaaaaagcgtaagagaaaaaaaaataagagtagcgctccggccgactccgagcggggccccaagcctgaaccccctgggagtggatccccagcgcctccacgtagacgcaggagagcccaagatgattcccaaaggcggagtctccccgccgaggagggctcatccggcaagaaagacgagggtggcggcggatcaagtagtcaggatcacggaggccggaaacacaagggggagttgccccccagctcctgccaaaggcgagccggaaccaaaagaagctctcgatcaagccacagatctcagccctcttccggcgacgaagattccgacgatgcctcatcccatcgtcttcaccaaaaatcaccgagccagtattccgaagaggaagaggaagaggacagtgggtcagagcattccaggtcgagatctaggtctgggcgtagacactcctcccaccggagctccagacggtcttactcctcttcttcggacgcttccagcgatcagagctgctattctaggcagagatcatattcagatgattcctattcagactatagcgacagatcccggcgtcactccaaacgcagtcacgactccgacgactccgactacgcaagctcgaaacacaggtccaaacggcataagtatagcagttctgatgacgactactcactaagctgcagtcaatcccgttcacgctcccgcagtcacacacgtgagcggtcaagaagtaggggtcggagccgatcttcctcatgctctagatccagaagtaaacgtagaagtagaagtaccacagcccatagctggcagcggtcgagaagttactcgcgtgataggtctaggtctacgagatcgccgtcacaaagatcaggatctaggaagcggagctgggggcacgagtctcccgaagagagacactccggtcgtagagatttcattcgctcaaaaatatacaggagccagtctccacattactttcggagcggccgcggcgaaggccccgggaagaaggatgacgggcggggagacgactcaaaagccaccgggcctccatctcagaatagcaacatcggcacaggacgtggcagcgaaggcgattgttcccctgaggataaaaattccgtcacagctaagttgctgctcgagaagatccagtcgagaaaggtggagcgcaagcccagcgtctctgaggaagtccaggcaacgcctaataaagcagggccaaagctcaaagaccctcctcagggatacttcggccctaagctgccaccttcactgggaaataagccagtactcccccttatcgggaaacttcctgccactcgcaaaccaaacaagaaatgcgaggaatctggcctggagagaggggaagaacaggagcagtctgaaacagaagaggggcctccaggaagctccgacgcgttgttcggacaccagtttccctcagaagagaccacgggaccgctgctggaccctccacctgaagagagtaaaagtggggaagctacagctgatcaccccgtggcccccctgggtacacccgcacactcagattgctaccccggagacccaaccatctcacacaactaccttcctgaccccagcgatggcgacacactggagagcctggattcatctagtcagccaggcccagttgaatcaagcctactgcctatcgctcctgacttggagcattttcccagctacgcaccccccagcggtgaccctagcatcgagagcaccgacggtgcggaggatgcaagcctagcccctctcgaaagccaacccatcacgtttactccggaggaaatggagaaatactccaagctccagcaggcggctcagcagcacattcagcagcagctactagcaaagcaggtgaaagcgtttccagccagtgcagcactagctccagccactcccgcactgcagccaatccacattcaacagcctgctacagcatctgctacatcgataaccacagttcaacacgccatattacagcaccacgcggcggccgcggcggctgctattgggattcacccccatccacacccacagccactggcacaggtgcaccatataccacagcctcacttgacgcctattagcctgtctcacctcacccacagcataatcccagggcaccccgccacattcttagcctcgcacccaattcatatcattcctgcctctgctatccaccccgggccctttacattccaccctgtgccccatgctgccctgtatccaacactgctggcaccacgaccagctgcagcagcagccaccgctctgcacctacacccattgctccatccaatttttagtgggcaagacctccaacatcctccctcccacggaacatag

SEQ ID NO: 188530 - DNA, 4275 bp, Artificial Sequence
  Description of Artificial Sequence: Synthetic coding sequence
atgggcatgggccggatggagatggagctggactacgccgaggacgccacggagcggcgtagagtgttggaggtcgagaaggaggacacagaagagctgaggcagaagtataaggattatgttgacaaggagaaagctatcgccaaggcacttgaggatctccgggccaacttttattgcgagctatgcgacaagcagtaccagaagcaccaggagttcgacaatcacatcaatagttacgaccatgcacacaagcagcggctcaaagacctgaaacaaagggagttcgcgcgaaacgtctcgtctcggagtcgcaaagatgaaaaaaaacaggagaaggccctcaggcggctgcacgagctagcagagcagcggaaacaggccgaatgtgccccaggcagcggtcccatgtttaagcctacaactgtggcagtggacgaggagggtggcgaagacgataaggacgagtctgctacaaactctggcacaggggcaacagcctcctgtggtcttgggagcgagttcagcactgacaagggcggacccttcaccgctgttcagattactaacaccacagggttagctcaggcccccggactggcaagtcaaggaatctccttcggcatcaagaacaatcttggaacgccgctgcaaaagcttggagtctcctttagcttcgccaagaaggctccagtgaagctagaaagcatcgcctcggtatttaaggaccacgccgaagaggggacgagcgaggatgggacaaaacccgatgaaaagtcctccgatcagggtctgcagaaggtaggagattctgacggatctagcaacctggacgggaagaaggaggacgaagacccacaagacggtggatcgctggcaagcactctgtctaagctgaaacggatgaaaagggaagagggtgccggagcaacagaacccgagtactaccattacattccaccggcccattgtaaggtcaaacctaacttcccatttttgttgtttatgagagcctctgagcagatggacggcgataatacgacgcacccaaaaaacgcaccggagtctaaaaaaggtagctccccgaagcctaagagttgtatcaaggccgctgctagtcaaggggctgaaaaaaccgtgagtgaagtctcagagcagcctaaagaaacgagtatgactgaaccctccgagccaggttccaaggctgaggccaaaaaagccctcggcggtgacgtcagcgaccagtccctcgagtctcactcacagaaagtatcggaaacgcagatgtgtgaatctaatagttctaaagaaacttctcttgccacaccagccgggaaggagtctcaggaaggtcccaagcatccaaccggaccattctttcctgtgctctccaaggatgaatctaccgccttacaatggccgagcgaattgctgatttttacaaaggcagagccgtccatttcctatagctgtaacccgctgtacttcgacttcaagttgtcccggaacaaggacgcacgcaccaagggcacagagaaacctaaggacattggctcatcgtcaaaggaccatctgcagggccttgatcccggggaaccgaacaagagcaaggaagttggcggggaaaaaattgtaaggagttccggcggtagaatggacgcaccggcatccggcagcgcctgctccggactcaataaacaagagcctggtggttcccacgggagtgagactgaagataccggaagaagtctgccttccaagaaagagcgctccggaaagtcgcatagacacaaaaagaagaagaagcacaaaaagtcgagcaaacacaaacgcaaacacaaagccgacacggaggagaaatcaagcaaagctgagtcaggcgagaaaagcaagaaacggaaaaagaggaagaggaagaagaataagagtagcgcacccgcggattcggagcgcggacccaagcctgagcctccaggctccggcagccctgccccccctagaaggcgaaggcgcgcccaagatgacagtcagcgacggtccttaccagcagaagaggggagtagcgggaaaaaggacgaagggggcggcggttcaagttctcaggatcatggaggacggaagcataagggagagcttcctccttcaagctgccaacgaagggcaggcaccaagcgcagcagtcggagcagccaccgaagccagccttcatcaggcgacgaggactcagatgacgcctcaagtcataggctccaccagaagtcccctagccagtattccgaggaagaggaggaggaagattctggctccgaacatagcagaagccgctctcggtctgggaggagacatagtagtcaccgtagcagtcgcaggtcctatagttcatctagcgatgccagcagtgatcagagctgctattctcggcagagatcctacagcgatgactcctactcagactacagcgaccggtcgaggcggcactccaagaggagtcatgattcggatgactccgattatgcatcctctaaacaccgaagtaaaagacacaagtattccagtagcgacgatgattactccctgagctgctcacagagccggagtcgctcgagaagccatacccgggaacgtagtagatcccggggcaggtcccggtcatcttcttgcagcagaagccgcagcaaacgacggagcaggtccaccactgcgcactcttggcagcgaagcaggagttatagtagggacagaagccgctccacacggtctccatcccagaggtcgggttcccggaagcgttcttgggggcacgagtcccctgaggagagacattccggtcggcgcgactttatcagaagcaaaatctaccggagtcagtcaccacactactttaggtccggccgcggggaaggaccaggaaaaaaggacgatgggcggggcgacgattcgaaagctacaggacccccctcacaaaatagtaacattgggacaggtcgtggatcagaaggagactgtagccccgaagataagaactcggtgaccgcgaagctccttctagagaagatccagagcaggaaagttgagagaaaaccatccgtgtctgaggaagtgcaggcaaccccaaataaagccggtcccaagctaaaagacccccctcaggggtacttcgggcccaagctcccaccgagccttggcaacaagcctgtacttcctctaataggaaagctcccagctaccaggaagccaaacaagaaatgcgaggaatctgggctcgagagaggagaggaacaggaacagtccgaaactgaggaagggccccccggttcatccgatgccctcttcgggcaccaattccctagtgaggagacgacaggccccctactggatccccctcctgaggagtccaaatctggagaggctactgccgaccaccccgtcgccccgctgggaacccctgcgcattcagattgctatcctggcgaccccacaatctcccataattatctgccagacccatcagacggcgacacgttagaatccctcgattcatcctctcaacctggcccagtggaatccagcctgctcccgatagcacccgacctggagcactttccttcctacgccccaccctctggagaccctagcattgaatcaacagacggggcagaggacgctagcctggcaccgctcgaatctcagcctattacattcacaccagaagaaatggagaagtactccaagctgcagcaggcagcacagcaacacatccagcagcagctactggccaaacaggtgaaggcctttccggcctctgccgcactcgcaccagcaaccccagcactgcagcccatccacatccagcagcccgccactgcgtccgcaacaagcatcaccacggtgcagcatgctatccttcagcatcatgcggcagctgcagctgctgccatcgggatccacccacacccccacccccagccactggcacaagtgcaccatataccacagcctcatttaacgccaatcagcttgagccatctgactcatagcataattccaggacacccagccaccttcctcgccagccatccaatccatatcatcccggcttcagcaatccatcctggtccatttacttttcatccagtgccccatgctgccctatacccaaccctgttagctccaagacccgctgctgctgctgctactgcgctccacctccacccactgcttcaccctattttctctggccaggacctccagcacccaccttcacatggtacctag

SEQ ID NO: 188531 - DNA, 132 bp, Artificial Sequence
  Description of Artificial Sequence: Synthetic coding sequence
atggccgaccggttcagccggttcaacgaggaccgggacttccaggggaatcacttcgatcagtacgaggagggtcatcttgagatcgaacaggcttcacttgacaaaccgatcgaaagctcgtgcttttag

SEQ ID NO: 188532 - DNA, 4509 bp, Artificial Sequence
  Description of Artificial Sequence: Synthetic coding sequence
atggccgaccggttcagccggttcaacgaggaccgggacttccaggggaaccatttcgatcagtacgaagaagggcacctcgagattgagcaggcctctctggacaagcccatagagtctgacaacatcggccaccgcctactccaaaagcatgggtggaagctgggacagggcctgggtaagtcattgcagggacggaccgaccccatcccaatcgtggtgaagtatgacgtcatgggcatggggaggatggagatggagctagactatgcggaggatgccactgagaggaggcgtgtcctagaagtggagaaagaggatacggaagaacttcggcaaaagtacaaagactatgtagataaagagaaggccatcgctaaggctctcgaggatttgcgtgccaatttctactgcgagctgtgcgataagcaatatcagaagcaccaggaattcgataaccacatcaattcttacgatcatgcgcacaagcagcgactgaaagatctgaaacagcgcgagtttgctaggaacgtcagttcaaggtctcgcaaggacgagaagaaacaagaaaaagccctgaggcgcttgcatgagctggctgaacagcggaaacaggccgagtgcgcaccagggtcaggtccaatgttcaaacctacaacagtcgctgttgacgaagaagggggtgaggacgacaaggatgagtccgccaccaacagcggaacgggtgccactgcatcgtgtggtcttggttccgagttctcaactgataaaggtggtccattcacagccgtgcaaatcacaaacaccacggggctagcacaggcacctggactcgcctcccaggggatttcgttcgggatcaagaataacctggggaccccactccagaagctcggggtgtccttctccttcgccaagaaggctccagtgaagctcgaatctatcgcgagtgtgttcaaggatcatgcagaggagggaacctccgaggatgggaccaagccagatgagaagtcctccgaccagggactgcagaaagtgggcgattcagatggatcctccaacctggacgggaagaaagaggatgaggatccccaagatggcggctccctggcttcaaccctgtccaagctgaagaggatgaagagagaagagggcgctggcgctacagagccagaatattaccactacatcccacccgctcattgcaaggttaagccaaatttccctttcctgcttttcatgcgagcttcggagcaaatggatggtgataatactacacacccaaagaatgccccagagtctaaaaaggggagtagtcctaagcccaagtcatgtatcaaggcagccgcgagtcagggcgccgagaagactgtgtccgaggtgtccgagcagccgaaggaaactagcatgacagagccttccgagcccgggagcaaggccgaggccaagaaagcccttgggggagatgtgtcagatcaaagcctggaaagtcattctcagaaggtttccgaaacacagatgtgcgaatcaaacagcagcaaggagacgtctctggccacccccgctggcaaagagagccaggagggtcccaagcaccctactggaccattcttccctgtgctctcaaaggatgaaagcaccgcactgcagtggccctcggagctactcatcttcaccaaggccgaaccttctattagttactcgtgcaacccgctttatttcgacttcaagttaagtcgaaacaaagatgctagaactaaaggcacagaaaaaccaaaggatatcggcagtagctctaaagaccacttacagggactggacccgggcgagccaaataaatctaaagaggtgggaggagagaaaattgtgcgatctagcggcggacgtatggacgccccggcatctgggagcgcctgctctgggctgaataagcaggaacccggtggatcccacggctccgagaccgaggacactgggcggtccctcccctcaaagaaggagcgaagcggaaagtcccataggcacaagaagaagaaaaaacataagaagagtagtaagcacaagagaaagcacaaagccgatacagaagaaaaatcctcaaaggctgagagcggcgaaaaaagtaaaaaacgcaaaaagcggaagagaaagaaaaataaatcatcagccccagcagactcggagcgcggccccaaacccgagccccccggcagcggtagccctgcacctccacgccgtcggagaagggctcaggacgacagccagaggagaagcctgcccgcggaagaaggcagctccggcaagaaagatgagggcggcggaggcagctcatctcaggatcatggtggccggaagcacaaaggggagctgcccccctcatcgtgccagcgtagggcaggcacaaagaggagctctcggtcctcgcaccgaagccagccaagtagcggtgacgaggacagcgacgacgcctcctctcatagactccatcagaaatctccatcccagtactcggaagaggaggaagaggaagattccggcagtgaacacagccgctctagatctcgctccggccgccggcactcctcacatagatcctctagaagatcttatagctcaagtagtgatgcctctagtgatcaatcttgttactccaggcagaggtcctactctgacgattcttattctgattattcggataggtctaggcggcatagtaagcgctctcacgactctgacgactccgactacgcgagctctaagcaccgaagcaaacgacacaaatactcttcatccgatgacgattacagcctgagctgtagtcagtccaggtcccgttcacggtcccacacaagggagcgtagccggagtagaggtcgttctagaagctcttcttgcagcaggtcccgttctaaacgcaggagtaggagcacgacagcccattcatggcagaggagccggtcctacagccgggataggtcccgcagtacacggagcccgagtcagcggagcggatcccggaagaggagctgggggcatgagagtccggaagagagacacagcgggagacgagatttcattaggtcaaagatttacagatcgcaaagcccacactattttcggagcggccgaggggaaggtcctgggaagaaagatgacggacgcggcgacgacagcaaggcaaccggacccccttctcagaactccaatattggaactgggaggggaagcgagggggattgctcccctgaggacaagaactccgtcacagccaagttgctgctcgaaaagatccagagccggaaggtagagcgtaagcccagtgtcagtgaggaagtccaggctacacccaataaagccggcccgaagctgaaggatcccccccagggatattttgggcccaagctgccgccgagccttggaaacaagccagtgctccctctgataggaaagctgccagccactagaaagccaaataagaaatgtgaagagagtgggctggaaaggggcgaggagcaagaacaaagcgaaacagaggagggtcctccaggcagttctgacgccctattcgggcaccagtttcccagcgaggaaacgacaggtcctctgctggatcccccccctgaggagagcaagagcggggaggcaaccgccgatcatcccgtcgccccattagggacccctgcccacagcgactgttacccaggtgaccctactataagccacaattacctgcccgacccaagcgacggggacactctggagtcccttgacagttcctcccagccagggccagtggagagcagcctattgccaattgctcccgacttagagcacttcccgtcatatgcccccccatccggagacccctctattgagagcacagacggagcagaggacgctagtctggctcccctggaaagtcaaccgataacattcacccccgaagaaatggagaaatacagtaaattgcagcaggcggcccaacagcacattcagcaacagctcctagcaaaacaggtcaaggcgtttccggcaagcgctgccttggcccctgcgacccccgctctccaaccaatacacatccagcaaccggcaacagctagcgcaacctccattactaccgtccagcacgccatcttgcagcatcatgccgccgctgccgcagccgccattgggattcatccacacccccacccccagcccctggctcaggtccatcacattcctcagccccacctcacacctatttcactttcccacctgacgcacagcattattcccggccaccccgctacttttctggcctcccacccaattcacataatccccgcctctgcgatacacccaggtccttttacctttcatcccgttccgcacgctgcactatatccaactctgcttgcacccagaccagccgcggctgccgcaaccgcactgcacctccatccgctcctgcaccccatttttagcggacaggatcttcagcatcctccatctcacgggacttag

SEQ ID NO: 188533 - DNA, 1476 bp, Artificial Sequence
  Description of Artificial Sequence: Synthetic coding sequence
atgcccctgcccgtgcaggtgttcaacctgcagggcgccgtggagcccatgcaaattgacgtggacccccaggaagatccgcagaacgctccagatgtcaactacgtggtagagaatccatcactcgacctagaacagtatgccgctagttactccgggctgatgaggatcgagcggcttcagttcatcgccgatcactgccctacattaagagtggaagctttgaagatggcattgagcttcgtgcagagaacttttaacgtcgacatgtacgaggaaattcaccgcaagttatccgaggcgacccgaagcagcttgcgtgagctgcagaatgcccctgatgccatcccagaaagcggcgtggaacctcccgcactggacaccgcatgggtcgaagcaaccagaaagaaagcactgctgaagctggaaaaattagacaccgatctgaagaactacaaaggtaattccattaaggaaagcatccggcgcggacacgacgaccttggcgatcattatttagactgcggcgatctgagcaacgccctgaagtgttactcccgggctagagattattgcacatctgcgaaacacgtgatcaacatgtgcttgaatgttatcaaggtttccgtgtacttgcagaactggagccatgttcttagctatgttagtaaggcagagtccaccccagagattgcagaacaaagaggggaacgcgactcacagactcaggcaattctgactaaactgaagtgcgctgccggcctggctgaactggcagcgaggaagtacaagcaagccgctaagtgtttgctcctcgccagcttcgaccattgcgactttccggaactcctgagtccatcaaacgtggccatctatggaggactgtgcgccctggcaacatttgatcggcaggagttgcaacgaaacgtgatctctagcagctcgtttaagctgtttctcgagttggagcctcaagtcagggatattatcttcaaattctacgagagcaagtatgctagttgcctgaagatgctggacgagatgaaggataatctgctccttgatatgtacctcgccccacacgttcgcactctgtacacccagatccggaaccgggctctgatccagtatttcagcccgtacgtttctgctgatatgcaccgcatggcagccgctttcaatacaaccgttgccgctttagaggacgaactgacccagttgatcctggaagggctgatttccgccagggtggattctcactccaagattctgtacgctagggacgtcgaccagagaagtaccaccttcgagaagtccctgctcatgggcaaagaatttcagaggcgcgccaaagccatgatgcttagagcagcagttctcaggaatcaaatccacgtgaagtcccctcctcgggaaggaagccagggggaactgacaccggctaactcacagagccgcatgagtacaaacatgtag

SEQ ID NO: 188534 - DNA, 1653 bp, Artificial Sequence
  Description of Artificial Sequence: Synthetic coding sequence
atgcccctgcccgtgcaggtgttcaacctgcagcagcccgccagctctgtgagtggatccggaggggccgaaagccaggaccggatgagggactccagtgccccaagctctgcatcctcttccgtcaccgatctctattgtactccccacagttcgcggtctgacctggtacttcccgggactgcaggagatttttctctctcggcgtccctgtccgcctgcactcttctatatgagggagcagtggagcccatgcaaatcgatgtggaccctcaggaggacccacagaatgcaccagatgccatacccgagtcaggagtagaacccccagctctggacacagcttgggttgaagctactaggaagaaagccctgctaaagctggagaaattggacaccgatctgaaaaactacaagggtaactccataaaagagtccatcaggcggggtcatgacgacctgggcgaccactacctcgattgtggcgacctgtcaaacgcactgaagtgctacagccgcgccagagattactgcaccagcgcgaaacatgtgatcaacatgtgtcttaacgtgataaaggtgtcagtttatctccagaactggtcgcacgtgctgtcctacgtgtcaaaagccgaaagcacccccgaaattgccgaacagcgtggggagcgcgattcccagacgcaggccatcctgaccaaactcaagtgcgcagccgggctcgctgagctggcagcaaggaaatacaagcaagccgccaagtgcctactgctcgcctcctttgatcactgcgattttccagagctccttagcccttctaatgtggctatatatggcggactctgcgctctggccacgttcgataggcaagaactgcagcgaaacgtgatctcttcaagcagctttaagctgtttctcgaactggagcctcaggtccgggacatcatatttaagttctacgaatctaagtatgcttcttgcctgaaaatgctggatgagatgaaggacaatctgctgctggatatgtaccttgctcctcacgttcggaccctctatactcaaattaggaaccgggccctcatacagtatttcagcccgtacgtttccgccgacatgcaccggatggctgcggcattcaatacgactgtggcggcgctggaagatgaactgacacaacttatccttgaaggtctgatatctgcccgggtggatagccactctaaaatattgtatgccagggacgtagatcagcgaagcaccacatttgaaaaaagtttactcatgggaaaggaatttcagaggagggccaaggccatgatgctacgggccgcagtcctgcgaaaccagattcatgtcaaacctctgcccacaagtacagatctaggtccacctggcggaagtgtactgcctgctgcacagctgagaggtctcgccaccggatgccatcccgcctgcgtaccgtccctgggtttaagaagacaggcagcagcttcttgcggaccatcctggaaagagaggccagctggtctcgatcccgtgggcttttgcccccagggggccgactgcgcagcaccccggccttcaggaacaatctctcagaccccgccagttcctgccagcgtgaggtgccgccaggtgggaggggtccactag

SEQ ID NO: 188535 - DNA, 1584 bp, Artificial Sequence
  Description of Artificial Sequence: Synthetic coding sequence
atgcgggacagcagcgcccccagcagcgccagcagcagcgtgaccgacctgtactgtaccccgcatagcagtagatccgacctggtcctgccaggcacagctggtgatttttctctcagcgcttccctgagtgcctgcaccctcctgtacgagggggccgtggagcccatgcagattgatgttgacccgcaggaagaccctcagaacgcacctgacgtaaactatgtggttgagaatccgtccttggacctcgagcaatacgcggctagctactcagggctgatgagaatagagaggctacagtttattgccgaccactgcccgactctgcgcgttgaggcgctgaaaatggctctctcttttgtgcagcgaacgttcaatgtcgacatgtatgaggagattcaccggaaacttagtgaggccacaagagagctgcagaacgcgccagatgcgatcccagaatctggtgtggagcccccagccctggacacagcgtgggtagaggccacccgtaagaaggctctgttaaagctagagaagctggacactgacctcaaaaattataagggcaatagtattaaagaaagcatccgtcgtggtcacgatgacctgggagatcactacctggactgcggcgatttatcaaacgcactgaaatgttatagtagggcacgcgattattgcacatcggcaaaacacgtcataaacatgtgcctcaacgtcattaaagtcagcgtgtatctgcagaactggagccacgtcctctcttatgtgtccaaagctgagtccacccctgagatcgcagaacaaagaggcgagcgcgactcccagacacaagcaatactgaccaaacttaaatgcgctgccggcctggccgagctggcagctcgcaagtacaagcaggcagccaaatgtctgttgctggcctccttcgaccactgcgactttcctgagctgctttctcccagcaatgtggctatctatggagggctgtgtgcactcgccacttttgacagacaagaactgcagcgtaatgtcatctcttctagcagctttaagctgtttctggaactggaaccccaggtcagagacatcatcttcaaattttacgagagcaaatacgcctcgtgtctcaaaatgcttgatgagatgaaagataatcttctgctcgatatgtatctggcgccacatgtcagaaccctctatacacagatcaggaatagagccctgattcagtacttcagcccatacgttagtgccgatatgcatcgcatggccgcagcgttcaacacaacagttgctgcattggaagacgagctgacacaacttatcctggaaggactcatcagtgcaagagtcgattcacactccaaaattctttacgcacgggatgtcgaccaaaggagcaccacgtttgagaagtcactcctgatgggaaaagagttccaaaggagagccaaagccatgatgctacgggcggctgtactgcggaaccagatccacgtgaaaagccctcccagagaggggtcgcagggagaattgactccagcaaacagccaaagtcgtatgtctactaatatgtag

SEQ ID NO: 188536 - DNA, 855 bp, Artificial Sequence
  Description of Artificial Sequence: Synthetic coding sequence
ggccagcccgagatcggcggcttcctgcccagcagcctggcccccgtgacggcagctattctgatggcacgctctagtctccgagagcttcagaatgcgcccgacgccatcccagagagcggcgttgagcctcctgccctggacaccgcctgggtggaggcaacaagaaaaaaggcactgctgaagctggaaaagctggatacagaccttaaaaactacaagggcaattcgatcaaagaatccatccggagggggcatgatgatcttggcgatcactacctagattgtggagatctttccaatgctctgaagtgttactctagagcacgcgactactgtacttccgcaaaacacgtgataaatatgtgtttgaacgttataaaggtcagtgtatatcttcagaactggtctcatgtcttaagctatgtatcgaaggcagaatccaccccggaaattgctgaagtgcgcgccacgtcgtccgagacccttccgccaggtttcctaactactgctggaccctcatgtccacccccaccacactcacctcctgatctcaacctgccctcatcccccctgtccttgggagccggacatcgggccctgggtaatgtagagcacggaccccacgcctgcggcttcctgttgcagcagcgcggcgaacgagatagtcagactcaggcgatcttgacaaagctgaaatgcgccgctggcgagggactgggacacgcccagcttaccccccgcagtccagtagcaaagtcgtctcagccccgtgccgttggctggagcctgccacagcctggcaagacctcactggccggtcgtcggatgctttgggcccacgtgcaagtatag

SEQ ID NO: 188537 - DNA, 1584 bp, Artificial Sequence
  Description of Artificial Sequence: Synthetic coding sequence
atgcgggacagcagcgcccccagcagcgccagcagcagcgtgaccgacctatattgcactccgcatagctcgcgtagcgatctggttcttcccgggacagccggggacttctctctcagtgcttccctgtctgcctgcaccctgctgtacgaaggcgcagtcgaacctatgcagatcgatgtggatccccaagaagacccgcagaacgctcccgatgtgaactatgtggtcgaaaatccttccctggacttggagcaatatgcggctagctatagcggcttaatgcgcattgagcgcttgcaattcattgccgatcactgtcctacgctgcgggttgaggcactgaagatggcgctgagcttcgttcaacgaactttcaatgtcgacatgtatgaggagatccacaggaaactgagtgaagctactcgcgagctgcagaacgccccagacgcaattccagagagtggcgtggagccacccgccctggacacagcttgggtcgaagcaacgcgaaaaaaggccctcctgaagctagagaagcttgatactgacctcaagaattacaaaggcaacagtattaaggagtccattcggcgtggccatgacgatctcggcgaccattatctcgattgcggggatctgtccaatgccttgaagtgctactctagagctagagactactgcacaagtgcaaagcacgttataaacatgtgcttaaatgtcattaaggtgagcgtttacctccaaaactggtcgcacgttttatcctacgtctccaaggctgaatctacacccgagatagcagagcagaggggtgaacgggactctcagacccaagccatccttacaaaacttaagtgcgccgcaggcctggcagagctggccgcgagaaagtataagcaggcggccaaatgtctgttgctggcctcatttgatcactgcgattttcccgaattgctttccccctccaatgtggccatttatggtggactctgtgccttagccactttcgaccgccaggaattgcagagaaatgtcatctctagctcaagttttaaactgttcctcgaactggagcctcaggtgcgggatattatattcaagttctacgaatccaagtacgccagctgcctcaaaatgttagatgagatgaaagacaatctgttgcttgatatgtatctcgctccacatgtgagaactttatacacgcagattagaaaccgggcgctcatccaatatttctcaccttatgtgtcagccgatatgcatcgcatggccgccgcttttaatacaacagtggcagctcttgaagatgagcttacacaactgatcctcgagggtctcatttccgcaagggtggatagccacagtaagatattatacgctcgcgacgtcgaccagagatctacaacattcgaaaagtctctattaatggggaaagaatttcagaggagggctaaagcaatgatgttacgcgccgccgtcttaagaaaccaaatccatgttaagtccccacctcgtgagggcagccagggggaactgacacccgccaattcccagagtaggatgtccaccaacatgtag

SEQ ID NO: 188538 - DNA, 993 bp, Artificial Sequence
  Description of Artificial Sequence: Synthetic coding sequence
atgacccccaacagcaccggcgaggtgcccagccccatccccaagggagccctcggcctcagcctcgcgctagcctccctcatcatcactgccaacttactgctcgccctaggcatagcatgggatcggcgcttacggtcccctcctgccggctgtttcttcttaagtctactgctggctggtttgctgacgggactagctctcccaaccctgccggggctctggaaccagtctcgccgcggatactggagctgtttgctcgtgtacttagccccaaacttcagcttcctcagtctgcttgctaacctgctgttggtccatggtgaacggtatatggctgtgctgagacccctgcaaccccccgggtctatcaggctggcccttctgctcacatgggcagggcccctgcttttcgcgagcctacctgcattaggttggaaccactggacccccggcgccaactgtagtagtcaagctatttttccagcaccatacttgtacttagaggtctacgggttattattacctgccgtcggagccgctgcattcctatccgtgcgagtgctcgccactgctcaccggcagctacaggatatttgccgcctcgagagagccgtttgtagggatgagccctctgcattagcgagagcacttacctggcgccaggcacgggcgcaggctggcgctatgctgttgtttgggttgtgttggggtccttatgtcgccacactgctcctatccgtactggcgtatgagcagcgcccaccattaggacctggcactttactgtctctgctgagtctcggctcagcatccgcagctgccgtacccgtggccatgggtctgggagaccagcggtatacggccccctggagagctgctgcccaacgctgccttcaggggctgtggggaagggcgagccgcgactcacccggcccatccattgcctatcatccatcgagtcagagtagcgtggatctagacctgaactag

SEQ ID NO: 188539 - DNA, 993 bp, Artificial Sequence
  Description of Artificial Sequence: Synthetic coding sequence
atgacccccaacagcaccggcgaggtgcccagccccatccccaagggggcccttggactcagtttggctctggcgtctctgattatcacagctaacctattgctggcgttgggcattgcttgggaccgtcgcctccgttccccgcctgctgggtgcttctttctctccctgctgcttgctggcctcctaaccggcctggccctcccgaccctgccaggcctttggaaccaatcacggcgtggctactggagttgcctacttgtatatctggcacccaatttttctttcttatccctccttgccaatctcctccttgtgcatggcgaaagatatatggcagtgctgcgacccctgcagccccctgggagcatccgcctagccctgcttctgacatgggctgggcccttactcttcgcctctctacctgccttgggctggaaccactggacacctggcgcgaattgctcatcccaggccatcttcccagcaccttatctttacctcgaggtgtatggcttgctgctgcctgctgtgggcgccgccgcctttctgtcagtgcgggtactggctactgcccatagacaactacaggatatttgcaggcttgagcgggccgtgtgccgcgatgagcctagcgcactagcccgcgctctcacctggagacaggctcgggctcaggccggcgctatgctgctcttcggactttgctggggcccgtatgttgccactctgcttctcagtgtactggcatatgagcagcgcccacctctaggacccggtacattgctcagtctgctgtcccttggcagcgctagcgccgcggctgtgccagtagcaatgggtcttggggaccagcgctataccgctccatggcgggcggctgcacagcgctgccttcagggactctggggaagagcctctcgcgacagcccaggtccctccatagcttaccacccctcttctcaaagttctgtcgatcttgacctgaactag

SEQ ID NO: 188540 - DNA, 993 bp, Artificial Sequence
  Description of Artificial Sequence: Synthetic coding sequence
atgacccccaacagcaccggcgaggtgcccagccccatccccaagggggcactcgggctgagcctggcgcttgcctccctgattattactgccaacttgctcttagcgctgggtattgcgtgggacagacgccttcgcagcccccccgccgggtgtttcttccttagtttacttctagcaggcctgcttaccggactggccctccctaccttgcctggcctgtggaatcagtcaaggcgtggctattggagctgccttctggtctaccttgctcccaacttctccttcttgtcccttctggcaaacctgctactcgtccatggagaacgatacatggccgtcctgcgacccctgcaacctccaggaagcatccggctagccctacttcttacctgggctggccccctgctcttcgccagcctccccgccttgggttggaatcattggacgcctggcgcgaattgttcttcccaggcaattttcccagctccctatctgtatctcgaggtgtatggcctgctcctaccggccgtgggagccgcagcctttctttccgtgcgagtactggctactgctcacaggcaactgcaggatatctgtcggctcgaacgtgccgtctgtcgggatgaaccatcagccctggcccgggcactaacttggagacaggccagggcacaggcaggcgccatgctgctgttcggcctctgctggggtccatatgtcgccaccctacttctgagtgtgttggcatatgagcagcgaccacccttaggacccggtactcttctgtcactcctctcacttggatccgctagcgcagccgcggtgcccgtggcgatgggccttggcgatcaaagatacaccgcaccttggcgagccgcagcccaaaggtgtttgcagggtctgtggggcagagcctctcgtgattccccaggaccatccatagcatatcacccctcgtcacagtcttctgtggacctcgatttaaattag

SEQ ID NO: 188541 - DNA, 993 bp, Artificial Sequence
  Description of Artificial Sequence: Synthetic coding sequence
atgacccccaacagcaccggcgaggtgcccagccccatccccaagggagccctcggtctgtctctggcgttggcttcgttaataataaccgctaacctgctgctcgctctcggtatcgcttgggataggagactccggagcccaccggctggctgcttttttctctccctactgctcgcaggcttgctgaccggtttggcactcccaaccttacccgggctttggaaccaatcacgtcgcggctattggtcctgcctgctggtgtatttggcccccaacttctcctttctcagtctcctggccaatctccttctcgttcacggggagcgttatatggcagttctacgaccattgcagccacccggatccattcggctggctctgctgctcacctgggccggacccctgctatttgcaagtctgcccgccctggggtggaaccactggacacctggagcaaactgctcttctcaagcaatctttcctgcgccctacctatacctcgaggtttacgggctcttgctgccagccgtcggcgccgcagccttcctgagtgtgagagtactcgcaacggctcatcgccagctccaagacatatgtagattagaacgggccgtatgcagagatgagccctcagccctggctcgcgccctgacctggagacaggctagggcccaggccggagccatgcttctgtttggattatgttggggaccatacgtggcaactcttcttctctccgttctcgcttacgagcaacggccacctttagggcctgggacgctactaagtctgttatctcttggttccgccagtgccgccgcagttcctgttgcaatgggtttaggggatcaacgctatacagcaccatggcgcgcagccgcccagaggtgcctccaggggctatggggaagagcctctagggattctcccgggcccagtatcgcataccacccgagcagtcagagcagcgttgatctagatctaaattag

SEQ ID NO: 188542 - DNA, 1128 bp, Artificial Sequence
  Description of Artificial Sequence: Synthetic coding sequence
atggacgtgaccagccaggcccggggcgtgggcctggagatgtaccccggtacggcgcagcctgccgcccctaatactacatccccggaactgaacttgagtcatcccctgttgggaactgccctcgccaatggcaccggcgaacttagtgaacaccagcagtatgtgatcgggttattcctgagttgtctgtacaccatctttttgttccccatcggtttcgtcgggaacattctgattctcgttgttaacataagcttcagggaaaagatgactattcccgatctgtactttataaacctggccgtcgcagacctcattctggtggcagactcactgatcgaggtctttaaccttcacgagaggtactatgacatcgcagttctgtgtaccttcatgtctctcttccttcaagtaaacatgtatagcagcgtgttcttcctgacgtggatgagcttcgacagatacatcgcactggcccgggctatgagatgcagcctgttcagaactaaacaccacgcccggctgtcctgcggattaatctggatggcctcagtctcagctaccctcgtcccattcacagcagtgcatttacaacacacagacgaggcctgcttttgcttcgccgacgttcgcgaagtgcagtggctggaggtcactctgggcttcatcgtgcctttcgccattataggactgtgttactctctcattgtgcgggtgctggtgagggctcatcgccaccgggggctgagaccccgtagacagaaagctctgcggatgatcctggcagttgttctcgtcttctttgtgtgctggctgcctgagaatgtgtttatttccgtacatctgttgcagagaacacagcctggcgccgccccttgcaagcagtccttcaggcatgctcacccgctgaccggccatatcgtaaacctggccgcattttctaactcctgcctcaacccactcatctactcctttcttggggaaaccttccgcgataagttgaggctgtacatagagcaaaagactaaccttccagcactgaacaggttttgccatgctgccctcaaagcagtgatacctgattccaccgagcagtcagatgtgaggttttcctctgcagtgtag

SEQ ID NO: 188543 - DNA, 531 bp, Artificial Sequence
  Description of Artificial Sequence: Synthetic coding sequence
atgagcctgaactgcggccagatgtggctgctggccccccggggcctggcccgcgtgacactggcctggtcaccttggggttgtttgggaaatctcactacaggacacctggcattattgactcagaattgttataatccgaaggccctcgcaccgcagggccctaaggcctccggcgaccagcctgtgactcagctgctgccagctaatcctgcgtgtcgttgcacatgtctgcccctccaagaaaccttcctgtctgtgttgcatcttccaggatggcagcagtggcgttgtgctgcttcacccgggccgcgtggtgccgccgctctggggcccgagcagcaggaagggccaagtgtcgagcgcccaccctccgcccccggttggttttcgcattgcctcttaacttctacttggcagttgcattcttgtggtctgggcccttgtgagctgccttgtggactggtcgggtgccaggacaacgaaattctccaacacctctggctgacaaatctgttcctgcaaaaatag

SEQ ID NO: 188544 - DNA, 1128 bp, Artificial Sequence
  Description of Artificial Sequence: Synthetic coding sequence
atggacgtgaccagccaggcccggggcgtgggcctggagatgtaccctggaacggcgcagcccgcagcccctaacacaacctcacccgaactaaatctttcacacccattgttgggcactgccctggcaaatggtactggagagcttagtgaacatcagcagtatgtcatcggtctgtttttaagctgtctgtataccatcttcctatttccaataggctttgtgggcaatatcctcattctcgtggtgaatatatcattcagggagaaaatgaccatcccagacctctacttcataaacctagcagtggcagacctgatcctcgttgccgatagcctgattgaggtctttaaccttcacgaacgctactatgatatcgctgtcctttgcacatttatgagtctttttctgcaggtgaacatgtactcgtccgtgtttttcctgacatggatgtccttcgatcggtacattgctctagcaagagccatgagatgtagtctttttagaacaaagcaccacgcccggctgagctgcggactaatctggatggcgtccgtctcggccactctcgtgcccttcacagcagtgcatctgcagcacactgacgaggcttgtttctgcttcgcagatgtgcgggaggtgcagtggcttgaagtgactctgggattcatcgtcccgttcgcaattataggcttgtgctactccctgattgtacgtgtgctggtgcgagcacaccgccataggggattgagaccccggaggcagaaggctctcaggatgattctggctgtggtgttggtgttctttgtttgctggctacccgagaatgtctttatatcggttcatcttttacagcgaacccaacccggcgcggctccttgcaaacagagttttagacatgcacacccacttacgggtcacatcgtgaacctcgcggcgttctcgaactcctgtctgaatccgcttatctacagttttctgggggaaaccttcagagacaaactgagactctacatagaacagaagactaacttaccagccttgaatcggttttgccatgcagctctgaaagcagtaatcccagatagtaccgaacaatccgacgtccggttctcctcagctgtctag

SEQ ID NO: 188545 - DNA, 1128 bp, Artificial Sequence
  Description of Artificial Sequence: Synthetic coding sequence
atggacgtgaccagccaggcccggggcgtgggcctggagatgtacccgggaaccgcccagccagccgctcctaacactacatcgcctgaactgaatctgagtcatcctttgttgggcacagccctggccaacggtaccggagagcttagtgagcaccaacagtacgtgataggcttgtttttatcctgtctgtataccatattcctattcccaataggtttcgtggggaacattctcatcttagtggttaacatcagctttcgcgagaagatgaccattccggatctttattttatcaacctggccgttgctgacctgatcctggtagccgatagtctgatcgaagtgtttaatttgcatgaacggtattatgacatcgctgtgctctgtacttttatgagcttgtttctccaagtgaatatgtatagctcagtgttctttctgacgtggatgagcttcgatagatacattgctctcgcaagggcaatgcggtgtagccttttccggaccaaacatcatgcacgcttaagttgtggcctgatatggatggcctctgtgtcggccaccttagtgcccttcactgcagtacacttgcaacacaccgatgaagcgtgtttttgcttcgccgatgttagagaggtccagtggctcgaggtgactcttggcttcatcgtccctttcgctataattggtttatgttattcactcatcgttcgcgtcctggttcgggcgcaccgccatagaggattacgcccccggagacagaaagcactcaggatgatcctcgcggtggtgctggtgttctttgtgtgttggcttcctgagaatgtgtttatcagtgtacacctcctacagcggacccagcccggcgctgccccctgtaagcagagcttccgacacgcgcaccctttaaccggccacattgtgaatctggcggcttttagtaactcatgtttgaaccccctgatttattcctttttaggagagactttccgagataaactgcgactgtacattgaacagaaaaccaatctgccggctctgaacagattctgccatgcagccctgaaggctgttattccagattctacggagcagtccgacgtccggttttcctctgccgtctag

SEQ ID NO: 188546 - DNA, 1128 bp, Artificial Sequence
  Description of Artificial Sequence: Synthetic coding sequence
atggacgtgaccagccaggcccggggcgtgggcctggagatgtaccctggcaccgcacagccagcagcacctaatactacttctcctgaactcaatctatcgcatccattgctcggcacggctctcgccaacggaaccggtgagctctccgagcatcaacagtatgtgattggcctgtttctgtcctgcctgtataccatatttctgtttccgattggctttgtgggtaatatcctgatactagtcgtcaatattagtttccgcgagaagatgaccatccctgatctttacttcatcaatctcgcagtggcggatctcattctcgtggcggactctctgattgaagtgtttaacttgcacgagagatactacgatattgccgtgctgtgcactttcatgtccctgttcctccaggtgaatatgtatagtagcgtctttttcttaacttggatgtccttcgatagatacatcgccctggccagagctatgagatgtagcctgtttagaacgaaacaccacgccaggctctcctgtgggctgatctggatggcctcggtgtccgccacattagtcccatttactgcagtgcatttgcagcatacggatgaagcttgtttctgctttgccgatgtaagagaggtgcagtggttggaggttactcttggtttcatcgttccgtttgcaataattggcctttgctactctctgatcgttagggtcctcgtgcgtgcacaccggcaccggggcctacgtccaaggcggcagaaagccctgcgtatgatactcgctgtggtgttggtgttcttcgtgtgttggctccctgagaatgtgttcattagcgtgcatctgttacaacggactcaaccaggggccgccccttgcaagcagtcattcaggcacgcccaccccctaaccgggcatatcgtgaatctcgctgcattttcaaattcgtgtctcaatccactgatttactccttcctgggagagacttttagagataaactgaggctttacatcgagcagaagaccaacctccccgcactgaaccgtttttgtcacgctgccctgaaggcagtcatcccagactctacagagcagtctgatgttcgattttcatcggctgtgtag

SEQ ID NO: 188547 - DNA, 222 bp, Artificial Sequence
  Description of Artificial Sequence: Synthetic coding sequence
atggacgtgaccagccaggcccggggcgtgggcctggagatgtaccccggaaccgcccaacctgcggcacctaacaccacctctccagagcttaatctgtcccatcccctgctgggtacggctctcgctaacgggaccggagagttaagcgagcaccaacaatacgtgatcggcttgttcttgagctgcctgtacaccattttcctgttcccaatcgggtag

SEQ ID NO: 188548 - DNA, 1227 bp, Artificial Sequence
  Description of Artificial Sequence: Synthetic coding sequence
atggacgtgaccagccaggcccggggcgtgggcctggagatgtaccccggtaccgcacagcccgctgcaccaaacactacgagccctgagcttaacctatcccaccccctcctaggaaccgctctggcaaacggaaccggggaattgtctgaacatcagcagtacgtgattggactattcctgtcttgtctctacactatttttctatttcccattggtttcgtggggaatattttgattctggtggtgaatatcagtttcagggagaagatgaccataccagatctgtacttcataaatttggcagtagccgaccttatcctagttgccgactctttgatcgaagtgttcaacctgcacgaaagatattatgacatcgcagttctttgtacatttatgagcctgtttttgcaggtcaacatgtactctagtgtgttttttctgacatggatgtcttttgaccggtacatagcactcgctcgagccatgaggtgctccctgttccgaaccaagcatcacgccagattgagctgtggattgatctggatggcctctgtgagcgcaaccctggtgccatttactgccgtgcacctgcaacataccgatgaagcttgcttctgtttcgccgacgttcgagaagtgcaatggctcgaggtgaccctgggatttatagtgcctttcgccataatcggactatgttattccctaatcgtgcgggtcctggtacgggcccatcgacataggggacttcgtccacgacggcaaaaggccttaagaatgatcctcgcagtggtgttggtgttctttgtgtgctggctgcctgagaatgtgttcataagcgtgcacctgctgcagagaactcagcctggcgccgctccctgcaaacagagcttccggcacgcacatcccctgactcatggccatgttatgtctctgaattgtggccaaatgtggctgttggccccacgaggcctggctcgtgttacactggcctggagcccctggggatgcttaggtaacctgacaacaggtcacctggcgttgcttacacagaactgctacaatcctaaagcattagctccccagggccctaaagcatccggcgaccagccagtgacgcagctgctgccggccaacccagcatgtagatgtacttgcctgccactccaagagacttttttgacccctagcaccagaaaggcaactcggcgggggcactgtgggtag

SEQ ID NO: 188549 - DNA, 1068 bp, Artificial Sequence
  Description of Artificial Sequence: Synthetic coding sequence
atggaggacctggaggagaccctgttcgaggagttcgagaactacagttacgacctggactattacagcttggaatctgatctggaggaaaaggtgcagcttggtgttgtccattgggtcagcctggtcctttattgtcttgccttcgtgttggggatccccggtaatgccatagttatctggtttaccggattcaaatggaagaagactgtcactacactgtggttcttgaacttagcaatcgccgattttatttttctgctgttccttccattgtatatttcatacgtggcgatgaactttcactggccatttggcatttggctgtgcaaggctaacagtttcacagctcaactgaatatgttcgcatcagtcttcttcctaacagtgatctccttagaccactatattcatctgatccatccggtgttgtcccataggcaccgaaccctgaaaaactcgcttatcgtaataatcttcatctggctgctggcttctctaatcggtggcccagctctgtactttagggacactgtcgaatttaacaatcacaccctctgttacaacaattttcagaaacatgatcctgacctcacactgattcggcaccatgtgctcacttgggtgaagtttattataggctacctttttcctctcctcaccatgtccatctgttatctgtgtctgatctttaaagtcaagaagcggtccattctgatttcatcccgacacttttggacaattttagtggtcgtggtagcattcgtcgtgtgctggaccccatatcatctattcagcatatgggaactcaccatccaccataattcttatagccaccatgtgatgcaggccggtatcccactgtccaccggccttgccttcctaaactcctgtttgaaccctatcctctacgtgttgatctcaaaaaagttccaggcccgcttccgatcctctgtggcagagatacttaagtataccttgtgggaggtctcctgttccggcacagtgtcagagcagttgcggaactcggaaacaaagaacctgtgcctgcttgaaacagcccagtag

SEQ ID NO: 188550 - DNA, 225 bp, Artificial Sequence
  Description of Artificial Sequence: Synthetic coding sequence
atggaggacctggaggagaccctgttcgaggagttcgagaactactcatacgacctggattactattcgttggagagtgatttggaagaaaaggtgcagttgggagtggtacattgggtttccctggtgttatattgtcttgcgttcgtgctgggcatccccggcaacgcaatagtaatatggttcactggcttcaaatggaagaaaactgtgactactctctag

SEQ ID NO: 188551 - DNA, 1068 bp, Artificial Sequence
  Description of Artificial Sequence: Synthetic coding sequence
atggaggacctggaggagaccctgttcgaggagttcgagaactactcttacgacctggactactattccctcgagtctgatctggaggagaaagtgcagctcggggtggtacactgggtttcactggtgctgtactgtctagctttcgtgcttgggattcctggtaacgccatagtgatctggttcaccggtttcaaatggaaaaagactgtgaccacgttatggtttttgaacttggccatcgcggatttcatcttcttgctgtttttgcctctgtatatttcatacgtggctatgaactttcactggcccttcggtatttggctgtgcaaggctaactctttcacagcccagctgaacatgttcgccagtgttttcttccttaccgtaattagtctcgatcattatattcatctcatccatcctgtgctgagccaccggcaccgcacgctcaagaattctctcatcgtgattatattcatatggctgctggctagcctgattggaggcccagccctctacttcagggatacagtagagttcaacaaccacaccctttgttacaataactttcagaagcacgaccccgatttaacattgattaggcaccacgttctgacctgggttaaatttataattgggtacctttttccacttttgactatgtcaatttgctatctgtgtcttatctttaaggttaagaaaagatcaattctcatcagctcacggcacttttggaccattttggtagtcgtcgtggctttcgtggtgtgttggaccccatatcacttgtttagcatatgggagctgaccattcatcataattcctacagccaccacgttatgcaggccggcattcccctcagcaccggcctcgctttcctcaatagctgtctgaacccgatcctgtatgtgctaattagtaaaaaattccaggctagattcaggtccagtgtggctgaaatactgaagtacaccttatgggaggtttcttgctctggcacagtcagtgagcaactgaggaacagtgaaacaaagaacctgtgtttgctcgagacagctcagtag

SEQ ID NO: 188552 - DNA, 249 bp, Artificial Sequence
  Description of Artificial Sequence: Synthetic coding sequence
atggaggacctggaggagaccctgttcgaggagttcgagaactacagctacgatcttgattactattctctagaaagcgacttggaggaaaaagtgcagctgggagtcgtgcactgggtgtccttggtgctctactgtttggctttcgtgctgggtattccagggaacgctattgtcatttggttcactggctttaagtggaagaagacagtgactacgctgtggttcctgaatctggccatagcgtag

SEQ ID NO: 188553 - DNA, 684 bp, Artificial Sequence
  Description of Artificial Sequence: Synthetic coding sequence
atggaggacctggaggagaccctgttcgaggagttcgagaactacagctatgacctggactactacagccttgagagcgatctcgaggagaaggtgcagctcggggtggtgcactgggtgtctttggtgctgtactgccttgctttcgtcctcggcatccctggtaatgccatcgtcatctggtttacaggatttaaatggaagaagaccgtgaccaccctgtggttcttaaacttggccatcgcggactttatcttccttttgtttctgcctctgtacatcagctacgtcgccatgaactttcactggcccttcggcatctggctttgcaaagccaacagctttaccgcccagctcaatatgttcgcatctgtttttttcctcaccgtgatcagtttggatcactacattcacctcatccacccagtgctgagccaccgtcatcggactctcaagaactccttgatcgtgatcatcttcatctggctgttagcgtccttgattggcggtcccgcactgtacttccgtgacaccgtcgaatttaacaaccacacactttgctacaataattttcagaagcacgacccagacctaaccttgattcggcatcatgttttgacgtgggtcaaattcatcatcgggtacttgttcccattgctgacaatgtccatttgctacctctag

SEQ ID NO: 188554 - DNA, 414 bp, Artificial Sequence
  Description of Artificial Sequence: Synthetic coding sequence
atggaggacctggaggagaccctgttcgaggagttcgagaactacagttacgacttggactactacagcctcgaaagcgacctggaagagaaggtacagctgggggtggttcattgggtgtcactggtgttgtattgtcttgccttcgtgcttggcattcccgggaatgctattgtgatctggttcaccggtttcaaatggaaaaagacagtgacaactctgtggtttctgaatctggccatagccgatttcatctttttgcttttcctccccctgtacatcagctacgtggccatgaacttccactggccatttggtatctggctgtgtaaggcaaacagttttactgcccagctcaatatgtttgcgagcgtattcttcctaacggtgatttcattagatcattacatctag

SEQ ID NO: 188555 - DNA, 537 bp, Artificial Sequence
  Description of Artificial Sequence: Synthetic coding sequence
atggaggacctggaggagaccctgttcgaggagttcgagaactactcctatgatctggactattactccttggagagcgacctggaagagaaagttcagttgggtgtggtccattgggtatcgcttgtgctgtactgcctggccttcgtgctcggcatcccgggcaatgcaattgtgatttggttcacaggcttcaagtggaagaaaaccgtcacaaccctatggttcctaaatctcgccattgccgattttatttttctgctgttcctgccactgtatatctcatacgtagccatgaattttcattggcccttcggtatatggctttgcaaggcgaactcctttacagcccagctgaatatgtttgcctccgtgttcttcctgacagtcatcagcctggaccactacattcatctgatccatccagtgctcagccaccggcaccgtactttaaagaatagtctgatcgtgattatatttatctggctattagcgtctctaattggcggaccggcattatactttcgggacacatag

SEQ ID NO: 188556 - DNA, 60 bp, Artificial Sequence
  Description of Artificial Sequence: Synthetic coding sequence
atggaggacctggaggagaccctgttcgaggagttcgagaactactcatacgatctatag

SEQ ID NO: 188557 - DNA, 1527 bp, Artificial Sequence
  Description of Artificial Sequence: Synthetic coding sequence
atgaccagcacctgcaccaacagcacccgggagagcaacagcagccatacatgtatgcccttgagcaaaatgcccatttctctggcacacgggattattaggagcactgtgctggtgatatttttggctgcatctttcgtaggaaatatcgtactagccctcgtcctgcagaggaagccccagctgttacaggtgacaaataggtttattttcaacctgctggtgactgacctcctgcagatttctttggtggccccctgggtggtcgcaacgagcgtgccactgttttggcccttaaactcacacttctgcacagctcttgtctctttaacacacttgttcgcctttgcaagcgtgaatacgatcgttgtggtcagtgtggacagatacctgtcaattatccaccctttaagttacccatctaagatgacccaacgccggggctatctgctgctgtacggaacgtggatcgtcgccattctgcagagcactccaccgctgtatggatgggggcaggctgcttttgatgagagaaacgctctgtgttcaatgatttggggggcatcaccatcatatacaatcctaagcgtggtcagctttattgttatacccctgattgtgatgatcgcatgttactcagtcgttttctgcgccgccagaaggcagcacgctttactgtataatgtgaaacgtcattcgctggaagttagggtaaaagattgcgtggagaacgaggatgaggagggggccgaaaaaaaggaggaatttcaagatgaatccgagttcaggagacagcacgaaggtgaagtgaaggcgaaagagggtaggatggaagcaaaggatgggagcctcaaagcaaaagaggggagtaccgggacgtcagaaagtagtgtagaagcccgggggtctgaggaagtgagagaaagcagcactgtggccagcgatggatcaatggagggaaaggaaggctcaacaaaagtggaagagaactcaatgaaagcagataaaggtagaaccgaggtgaatcagtgcagtatcgatctgggggaggacgacatggagttcggagaagatgacattaatttctctgaagacgacgtggaggcggtgaatatccctgagagtttgccccctagcagacgtaacagcaactcaaacccccctctacctaggtgttatcagtgtaaagcagctaaggtgatctttatcattattttctcatatgtattgagcctggggccttactgttttctggccgtgcttgccgtatgggtcgatgtagagacacaagtcccccagtgggtcatcactatcatcatatggttattcttcctgcagtgttgtattcacccctatgtatacggatatatgcacaaaacaatcaagaaggaaattcaggatatgctcaagaaatttttttgcaaggaaaagcctcctaaagaagactctcaccctgatctcccggggacagaagggggaacggaggggaaaattgtaccaagctatgactcagctactttcccttag

SEQ ID NO: 188558 - DNA, 2088 bp, Artificial Sequence
  Description of Artificial Sequence: Synthetic coding sequence
atgaagatgaagagccaggccaccatgatctgctgcctggtgttcttcttaagtactgagtgcagccactacaggtccaagatccacctgaaggctggcgacaagttgcagagcccagaagggaaacccaaaaccggtcggatacaggagaagtgcgaagggccatgcatttcctcatccaattgctcacagccttgtgctaaggactttcacggagagatcgggtttacttgcaatcagaagaagtggcagaaatccgcagagacttgtacctccctctccgtggagaagctgtttaaagatagcacgggcgcttcccgtctcagcgtagccgccccatccattcctctgcacatcctcgattttcgggcgcccgagacaatagagtcagtcgcacaggggatcagaaaaaactgtccatttgattatgcttgtatcactgacatggtgaagtcatcagagactactagcggaaatatagctttcatcgttgaactgctgaaaaatatcagtactgatttgtctgacaatgtgacacgggaaaagatgaagagttacagcgaggtcgctaatcacatattagacaccgcggctatctccaattgggcttttattcctaataagaacgcctctagcgatctgctgcaaagcgtgaatctttttgcccgccagctccacatccacaataatagtgagaacatcgttaacgaattattcatccaaaccaagggttttcatatcaatcataacacgagcgaaaagagcctgaactttagcatgagcatgaacaacaccacagaagatatcctgggaatggtgcaaatcccaagacaggagttgcgtaagctctggcccaatgctagtcaggctatctcgattgcttttcccactctgggtgccatactgagggaggcacacttgcagaatgtctccctccccagacaagtgaacgggctcgtcctgtccgtggtcctcccagaacggttgcaggaaataattttgaccttcgagaaaatcaacaagacccgtaatgcccgagcacagtgtgtcggatggcattccaaaaaacggcggtgggatgagaaagcatgtcagatgatgctcgacattcggaatgaagtgaagtgtcggtgtaactacaccagtgtggtgatgtccttcagtatactgatgagctccaagtccatgaccgacaaagtgttggactacattacgtgcattggcctgagcgtttctatcctttctctggtgttgtgtctcatcatcgaggctacagtctggtctagggtcgtggtgaccgaaatatcctatatgcggcacgtctgtatagtcaacatagccgtatcactgctgactgctaacgtgtggtttatcattggaagtcattttaacatcaaagcacaagactataacatgtgcgtggctgtcacgtttttttcccatttcttttacctcagcctttttttctggatgctctttaaggctctgttgatcatttatgggattctggttatatttcgacggatgatgaagagcaggatgatggtaatcgggtttgccattggctacggatgcccacttattatcgctgtgacgaccgtggccataaccgagccagaaaaaggttatatgcggcctgaagcctgctggttgaactgggataacaccaaagcgctactcgcattcgccatccccgcctttgtaattgtggcagtcaatctgatcgtggttcttgttgtggcggtgaacacgcagaggccatccatcgggagttccaaatctcaggatgtagtgattatcatgcgaatttcgaaaaatgtggccatcctcaccccgcttctcggcctgacctggggttttggcatagccactctcatagaaggcacttcacttaccttccacatcatcttcgccctgctcaacgcgttccagggtttttttatccttctgttcggcacaatcatggatcacaagatccgagacgctctgaggatgagaatgagcagtctcaaaggaaagagcagggccgcagagaatgctagtttgggccctactaatgggagcaagctgatgaacaggcaaggatag

SEQ ID NO: 188559 - DNA, 2088 bp, Artificial Sequence
  Description of Artificial Sequence: Synthetic coding sequence
atgaagatgaagagccaggccaccatgatctgctgcctggtgttcttccttagtacagaatgttcacattacagaagcaaaatacatcttaaggccggcgataagctccagtcacctgagggcaagccaaagactggtcgaatacaggaaaagtgcgaaggaccgtgcatctccagcagcaattgtagccagccatgtgctaaagactttcacggcgaaatcggattcacttgtaatcaaaagaagtggcagaaatcagcagagacttgcacctccctgtccgttgagaaactatttaaggactcgactggcgcttcacggttatcggtggcggctccttccatccccctgcacatcctggattttagagccccggagaccattgagtctgtagcacagggcattcgcaagaactgccccttcgactatgcttgcatcacagacatggtgaagagcagtgagacaacttctggcaatatcgccttcattgtcgaattgcttaaaaatatcagcacagacctcagcgacaatgttaccagggagaaaatgaaatcttattccgaggttgccaaccacatactggacactgctgccatttctaactgggccttcatacccaataagaatgccagcagtgaccttctgcagagcgtgaatttattcgccagacaactgcatatccacaataacagtgagaatatagtgaacgaactgtttattcaaacaaagggcttccacatcaatcacaatacctcagagaaatcactgaacttctcaatgtccatgaacaataccaccgaggatatcttaggcatggtccagattccaagacaggagcttcgtaaactgtggcctaacgcgtcccaagctatctcaattgcgtttccaacactgggtgcaatacttagggaggcacatctgcagaacgtaagtctgccccgccaggttaatgggctagtgctttctgtggtactgccagagagactgcaggaaataatcctgacctttgaaaagatcaataaaaccaggaatgcccgggcccagtgtgtgggatggcactctaagaagcgaaggtgggatgagaaggcctgccagatgatgcttgatattcgaaacgaggtaaagtgcagatgcaattacacgagcgtcgttatgagcttctcaatcctgatgtcctcaaagagcatgacagacaaggttctcgactatatcacatgtataggcctgagtgtgagcattctgagcctcgtgctctgtctcataatcgaagccacagtgtggagccgtgttgttgtgaccgagatcagctacatgcggcatgtttgtattgtgaacattgctgtctcactgctgaccgcgaatgtgtggtttataattgggagccatttcaatatcaaggcacaggattataacatgtgcgtcgcagtcacctttttctcacatttcttttacctgagcctgttcttctggatgctctttaaagcattgctcattatttatgggatcctcgttatcttcagacgaatgatgaaatcccgcatgatggtgatcgggttcgcaattggatacggctgtccgctcattatcgccgtgacaaccgttgccatcaccgagcccgagaaaggctacatgcggcccgaagcctgctggctgaattgggacaacacaaaagctctgctggcgttcgcaattcccgcattcgttatcgtcgccgtcaatttaatcgtggtgttagtggtagcggtgaacacacagcggcctagcatcggtagttctaaatctcaggacgtagtcattatcatgcggattagcaaaaatgttgcaattctcactcccctgctgggattgacgtggggcttcggaatcgcaacattgatcgaggggacctcactcaccttccacatcatttttgctctgttaaacgcgttccagggcttctttatcttgcttttcggtaccatcatggaccacaagatcagggacgccctaagaatgcggatgtcctcacttaagggaaagagcagggcagctgaaaacgcatcactgggccctacaaacggcagcaagttgatgaacaggcaaggatag

SEQ ID NO: 188560 - DNA, 2259 bp, Artificial Sequence
  Description of Artificial Sequence: Synthetic coding sequence
atgtacaccggcccctgcaaggtgctgcacctgagcagcggcctgctgccaaacagcggtcgcttcggtatagtactgtccgatgaataccaagtagtgacatccctgtggtgccaactttacactacacatgctccacagcaggcctctggaatgctgctgctgaactacctcgtcatcccctctaaggctcaggtcaataaacccggctacattccgaatcttggcgagtgctctcattatcggtcaaagattcacctgaaagcaggagataagcttcagtcccccgaggggaagcccaagaccggtcgtatccaggagaagtgcgagggcccgtgcatatctagcagtaattgttctcagccatgcgccaaagacttccatggcgagatcggcttcacctgcaaccagaaaaagtggcagaagagtgctgagacctgtacctccctgagtgttgaaaaactgttcaaggatagcaccggagcctcgaggctgtctgtagctgcaccttccatcccccttcatatcctagatttccgcgcaccagagacaattgaatcggtagcacaagggataagaaaaaattgtcctttcgattacgcatgcatcacagacatggtcaagagctcggagaccactagtggcaatattgccttcattgtagagctcctaaagaacatctctactgatctgagcgacaatgttactcgtgagaagatgaagtcatacagcgaagttgcaaatcacattttggacactgccgccatatctaattgggcttttataccaaacaagaatgcctcgagtgaccttcttcagtcagtgaacctcttcgcacgacagttacacattcacaataactctgagaacatcgtcaacgaactgtttatccaaaccaagggattccatatcaatcacaatacatcggaaaaaagcctcaacttttccatgtctatgaataataccacagaagatattctcgggatggtccagattccaaggcaggagttgagaaagctgtggcctaatgcaagtcaggctatctcaatcgctttccctactctgggggccatcctgcgggaggcgcacctgcaaaacgtcagcttgccccggcaagtgaatgggctggtgctctcagttgtgttgcctgagagactccaagagatcatcctgacattcgaaaagattaacaagactagaaatgccagagctcagtgcgtcgggtggcacagcaagaaaaggagatgggatgaaaaggcctgtcaaatgatgctggacatccggaatgaggtgaaatgccgatgcaactacacatctgttgtgatgagcttcagtattttaatgagttctaaaagcatgacagataaagttcttgattatatcacctgcataggcctgtcagtctctattctttctttagttttgtgcttgataattgaggccacagtctggtcaagagtggttgtgacagagatttcgtacatgaggcacgtctgtattgtgaatattgcggtgtccctcctgacggcaaacgtctggtttattattggttcacattttaatattaaggcccaggactataacatgtgcgtggccgtgacattcttctcacactttttttaccttagcttgttcttttggatgctattcaaggctctactgattatctatggcatcttagtgatattcagacggatgatgaagtctcgcatgatggtgattggattcgccattggctacgggtgtcctcttataatagctgtcaccaccgtcgctattacagagcctgaaaaaggctacatgcggccagaagcttgttggctgaactgggataacacaaaggcccttttggctttcgccattccagctttcgtgattgtagctgtgaacctcatcgttgtcctggtggtggcagtcaatactcaacggccgagcattgggtcaagcaagtcacaagatgtcgtgatcatcatgcgcatctccaagaatgttgcaatccttaccccactgctggggttaacatggggattcggcatagcaaccctcattgagggtacaagtctgaccttccacattatctttgctttgctcaacgcctttcaaggcttctttatcttactatttggtaccatcatggatcataaaatcagagacgccctaaggatgcgtatgtcgtccctcaagggaaagagtcgagctgcagagaacgcttccctcgggccaacaaacggtagtaaattgatgaaccggcagggctag

SEQ ID NO: 188561 - DNA, 1005 bp, Artificial Sequence
  Description of Artificial Sequence: Synthetic coding sequence
atgaacgaggacctgaaggtgaacctgagcggcctgccccgggactatctggatgcggccgccgccgagaacatctctgcggcagtgtcatcccgcgtgcctgctgttgaacccgagccggaacttgtggtcaacccttgggatatcgtgctctgcacttccggcaccttgatcagttgcgaaaacgcaatagtggtactgatcatcttccacaacccctcccttagagcccccatgttcctgcttattggcagcctcgcgcttgccgatctgttggcaggtatagggttaattacgaatttcgtctttgcctatttgctgcaatctgaggcaacaaaactagtcaccattgggttaatagtcgcgagtttcagcgcctccgtctgtagcctccttgcaatcacggtcgaccggtacctctccctctattacgccctaacatatcattccgagaggactgtcacattcacttacgtgatgctggtaatgctttgggggacaagcatatgcctcgggttgctgcccgtgatgggttggaactgcctgcgagacgagtctacatgctctgtcgtgaggccactgacaaagaataacgctgccatacttagtgtcagttttctgtttatgtttgcgcttatgcttcaactgtatatacaaatttgcaaaattgtgatgcgacatgcacaccaaatcgcccttcaacaccacttccttgccacatcccattatgttacaacccgaaagggtgtcagtactctggcgattatactggggacctttgccgcgtgctggatgcctttcacactgtattctctcattgcagactatacatacccatccatttacacttatgccacgctgctgcctgccacttacaactctatcattaatccagtaatctacgccttcaggaaccaggagatacagaaggctctctgcctgatatgttgcggatgtatcccttcctctctcgctcagagggcccgcagcccctccgatgtctag

SEQ ID NO: 188562 - DNA, 1005 bp, Artificial Sequence
  Description of Artificial Sequence: Synthetic coding sequence
atgaacgaggacctgaaggtgaacctgagcggcctgccccgggactacctggacgcggcagctgccgagaacatctccgccgctgtctcttctagggtgcccgccgttgagcccgaaccagagctggtagtgaacccctgggatattgtgttgtgtaccagtgggactctcatctcatgtgagaacgccattgttgtgctcattatctttcataatccatccctcagggcaccaatgtttttgctgatcggctcactcgcattggccgacttgctagcaggtatcggacttatcaccaacttcgtttttgcgtacttgctgcagtcagaagctactaaactggtgacaatcggactcatcgtcgcgtcattttctgcttctgtatgttccctgcttgcaatcacagtggaccgctatctgtccctgtactacgccttaacataccactcagaacgcaccgtgaccttcacttacgtcatgcttgtaatgctgtggggcacctctatctgtcttggtcttctaccagtgatgggatggaactgcctcagagacgaatccacttgttccgtggttagacccctgaccaagaacaatgcagctatcctctctgtctccttcctgttcatgttcgccctgatgctgcagttgtatatccagatctgtaagatagtgatgcgccacgcacatcaaatcgcactgcagcatcatttcctggcgacatcacattacgttacaacccgaaaaggagtctccaccctagccatcattttggggacatttgcagcttgttggatgccgttcactttgtattctctgatagccgactacacatacccctctatttatacatatgccacattgctgccagccacgtacaattccatcatcaacccagttatttatgccttcaggaatcaagaaattcagaaggccctttgtctcatctgttgtggctgcatcccgtcatcacttgctcagcgagccaggagcccttcagacgtgtag

SEQ ID NO: 188563 - DNA, 3840 bp, Artificial Sequence
  Description of Artificial Sequence: Synthetic coding sequence
atgcggggccacggcaaccacagccggctgaagagccggtgcgcctctttgggcaacgtgcaccaccatcaggcccagatggcccatggcgcgcactgtcgcggtgggcgcactccccagtcacccgactctcgggggcctacagctgggggacacaccagaggccgatggacttatagacctatcgaagccttaattaatgtgagtttccctggagctaagggtggtcggacggccgagggcgagccatcttgggcatgggtcttcagaagcggatatttgcagaggcaggcgctgccgggcctacctgtcagtactagagtggctgcatgttggtggcaacatcaccccgggagagacagtggctttctcggcccaggtttcatcgacttgctcagagaggagccttcaggccgtgccgacggcaaagcagcagcccaaaagacaggcagactttacctttttccaactttcctcgggaacaaactcccagaggccgccgattcttttggcgagatcgcgtcgggcaactcagtgattttcacttctgtattgcagtcaagccatcctcccgggactcctccgccttccgcaaggaagccctcgccgggcgcggcaatgctggtgtgcgaggagaccctcgaactcggggcccagggctgttggggcagcacttctccccgcggtcaggcggtgagcctggtggggggtccaacagcaggcggcagtagattagggggggctgggtgtaccatgggccttctaatggcattgcaggcaaggaggcctagagatgggacctgggctgacccacgcagatgcagcagagccgttgagggatccggtctgacacgggcagcgctggtgagccccggcccctctggtgttgaggaagatacgaggcgagaagggtgtgttttagtcggatcatggaggtcatctacgcataggtctcgggtgctcataattaacaccccatctggtcgaactccctggagtcaaggtagcctcggctctacgggccgctacaatcagacaagagctccgggttcacagcaacaggggctgtgcagcgacgcagctcttcacgaagactttgtcccggagcctacaccggccttcttccagtacccaccgcaggccttttccaagaccaaagttcgcgatctgggacgcggcgggctgtacgcattctcgaaggaggaaaaggtatccgaggcccagcgcgtagaggcatacgaaactcatggtttaggactttcaaccgggaggcagaatcccgtgccatccccttgtaaaccggggtgcgtctgccagggactggcgctggacgctgaggcctggcccaggcatcccgggcgtcgtccctgtgccgctaaggaggcttgtttggggccacctggttgctctggcgagctgtcgctgcccgaggaagaaggcattgcacctggggctgcaactgccgcacctgcctgggttcctcacggacgagtatcgcgcttcctgaccgtcaaactgtttacgtatgtgactatgtatcagtgcaagcaggagcgaatcctgagactttgcatctctggagagagtgggcgctatgtccgccgttcccgattccgcaatttcgccgccctgatggtgagtaccggggtccctggcgtattacagcttggggcacgacccctgaggggaggcgggcacccctacggcgattctcaggcaggcaaagtggtggagtggcgggctggagaccgggcatccgggctgtccgccggagaacgtcgatttctcagtcaatccgagctccagacatggcctcggactccccactgcgtcggcaaaaaggtgcctcaaccggttggtgcagccgatcttgcacctgacactagtctctgccggaaagagggaagctccgcttctcgaagctgtcggcctggcccgggacacctgactcgccgcgaggaggattcatttcgccagctggccttcccgaggttcgaagaggtgactttccctccacttactgcagcagagagggcaccgagcgtccatggaggacactctctggctagccaaggactggtgttagcagggaggaccaggtctgtcgctagcggcggaaagcaagaactctcgggacccctggccgcttgcatcccgacacaggatcttaagaccgtgctgtctctacctcgctatcccggggaatttctacacccagtggtgtacgcctgtaccgctgtcatgttgctgtgcctcctggcttcttttgtcacgtacattgtgcatcagagcgcaatacggatcagccggaagggccgtcacacgctgctaaacttctgttttcacgcagccctgacctttacagtgttcgccggcggaataaacagaactaagtaccccatactctgccaagcggtgggtattgtgcttcattacagcacactgagcaccatgttgtggattggcgttactgccaggaatatatacaagcaagtgacaaagaaggcccctttgtgcttagataccgatcagcccccctatccaagacagcctctgttgcgtttctatctggtttccggtggtgtgccattcatcatctgtggagtcactgcggctacaaatattcgaaactatggtactgaggacgaagacacagcctgctggatggcgtgggaaccctctcttggagccttctacggccctgctgccatcatcaccctcgtcacctgtgtatacttccttggcacgtatgttcagcttcggcgccatccaggccgccggtacgaactgcggacccagcctgaagaacagcgtcggctggctactccggagggcggacgaggaatcagaccgggtacgcctccagcccacgatgccccgggagcatcagtccttcaaaacgaacacagcttccaagcccaactgcgcgctgcagccttcaccctattcctatttacagccacctgggcatttggcgccttggccgttagccaaggccactttcttgatatggtatttagctgtctttatggggcgttctgcgttacactgggtttgttcgtgcttattcatcattgcgcaaaacgtgaggatgtgtggcagtgttggtgggcatgctgtccgccccgcaaggatgctcatcctgcactcgacgccaatggagccgccctcggtcgagctgcttgtcttcactcacctggcctggggcagccaagaggtttcgcccacccaccaggcccatgtaaaatgacaaacctgcaggcggctcaggggcacgcctcctgtttgagtccagccacaccctgttgcgcaaagatgcactgcgaacctctcacagctgacgaagctcacgtccacctgcaggaggagggggcattcggccacgacccccatctccacgggtgccttcagggtcgcactaagccgccatacttcagccgacatccagccgaagaaccggagtacgcttatcatatcccctcttccctggatggttcacccagaagcagtcgcacagacagtcctccatcaagtctggacggcccagcagggactcacactctggcatgttgcacacagggagacccattcccgatggttacccaacctgaggggtcggatggatccccagctttgtacagctgccccacccagcctggccgcgaagctgcactgggacctggccacctggaaatgcttcgcaggacccagtccctgccctttggtggccctagccagaacgggctgccaaagggcaaactgctagaggggctcccattcgggactgacggcactggcaatattaggaccggcccttggaagaatgagactacagtatag

SEQ ID NO: 188564 - DNA, 1395 bp, Artificial Sequence
  Description of Artificial Sequence: Synthetic coding sequence
atgctgtggatcggcgtgaccgcccggaacatctacaagcaggtgactaaaaaggccccactgtgcttagacaccgatcagcctccatatccgcggcagccactcttgtctcggttttaccttgtatcggggggcgtgccgttcatcatctgcggcgtgaccgcggccaccaacatccgaaattacggcaccgaagatgaggataccgcatattgctggatggcttgggagccatccctcggcgcattctacggaccggccgcgatcattacgctcgttacgtgcgtctatttcctgggtacctacgtacagctgagacgccaccctggaaggaggtacgaattgaggactcagcctgaagagcagagacggttggccactcctgagggtgggaggggcattaggcctggaaccccacctgctcacgatgctccaggagcatccgtgttgcagaatgagcactcattccaggcacagctgcgtgccgctgcgttcaccttattcctgttcacagcaacctgggctttcggtgccttagctgtcagccaggggcactttctcgatatggtattctcttgcctttatggagcattctgcgtgacgttagggctttttgtgcttatacaccattgtgcaaaacgcgaagatgtctggcaatgttggtgggcgtgctgcccacctcgtaaggatgcccaccccgcacttgacgccaatggtgctgcactggggagagctgcgtgccttcactcaccagggttaggtcagcctcgcgggttcgctcatcccccggggccttgtaagatgaccaacctgcaagctgcccaggggcacgcatcctgtttgtcacccgcgactccatgttgcgctaaaatgcactgtgaacccctgactgcagatgaagcccatgtgcatctacaagaagagggcgcattcggacatgatccccatttacatggctgtctacagggaaggaccaaacctccctacttcagtcgccaccctgctgaggaaccagaatacgcatatcacataccctcatccctggatgggagtccccggtcttcccgcacagattctccaccttcatccctcgatggccccgccggcacacacactctcgcttgctgtacacagggagaccccttccctatggtaacccagcctgagggatcggacggcagccctgcactgtatagctgcccgacccaaccaggacgcgaagctgcactggggcctggtcatctggaaatgttgagacgaacacagtcactgccctttggtggtcccagccagaatggactgccgaaaggcaagctgctggagggcctgccttttggcactgatggtacaggaaacataagaaccggaccttggaaaaatgagacaacggtgtag

SEQ ID NO: 188565 - DNA, 1683 bp, Artificial Sequence
  Description of Artificial Sequence: Synthetic coding sequence
atggacctgaagaccgtgctgagcctgccccggtaccccggcgagttcctgcacccggttgtctatgcgtgcactgcggtaatgctgctctgcctgttggcttctttcgtgacctatatcgtgcaccaatccgccatcagaatcagcagaaaggggagacacacactcctcaatttctgctttcatgccgctctcacattcactgtgtttgccggaggtatcaacagaaccaagtacccaatcctctgtcaggccgtgggcatcgttctgcattactctactctgtccactatgctgtggattggagtgaccgccaggaacatttataagcaggtcacgaaaaaagcacctctttgcctggataccgatcagcctccatatccgcgtcagccacttctgcgcttttacttggtgagtggcggagtgccttttattatctgtggcgtgacagcagccacaaacatccgaaactatggaacagaagatgaggacacggcctactgctggatggcctgggagcccagcctgggggcattttatggccccgctgcaatcatcactctcgtcacctgcgtctactttttggggacctatgttcagctgcgaaggcacccaggacgccggtacgagctcagaactcagcctgaagagcagcgtaggcttgccacgccagaaggcggtagaggaatccggcccggaacgcctcccgcccacgacgctcctggtgccagcgttttgcagaacgagcactcgtttcaggcccaattgcgcgccgcggcattcaccctgtttctgtttacagcaacttgggcgttcggcgctcttgccgtgtcccaaggccacttcctggatatggtttttagttgcctgtacggcgccttctgtgttacactgggcctgttcgtgcttatccaccattgcgctaagagagaggatgtgtggcagtgctggtgggcctgttgcccaccgagaaaagatgcccatcccgctctcgacgcgaacggggctgctttaggtagagctgcatgtctgcatagccccggcttgggccagcctcgcggtttcgctcatccgccgggaccatgcaagatgactaacttgcaggcagcccagggccacgcaagttgtctgtctcctgcaactccctgctgtgcaaaaatgcactgtgaacctctcaccgctgatgaagcacacgtgcatcttcaggaggaaggcgcttttggtcatgacccccatttgcacggctgtctgcaaggaaggaccaagcccccctacttcagcagacaccccgctgaagagccagaatatgcttatcacattccatcatcactggatgggtctcctcgtagttctcgcacagatagcccaccgtcctccttggatggccctgcgggcacacacacacttgcctgctgtacccagggcgatcccttcccaatggtgactcagccagaaggctctgacggcagtccggcactctatagttgccctacccagccagggcgcgaggcggctcttggcccgggacacctggaaatgctgcggcgcacccaatctctgccctttggtggcccctcccagaacggcctgccaaagggcaagctcctggaagggctgccttttggaaccgacgggacgggcaatatacgtacaggcccttggaagaacgaaactaccgtctag

SEQ ID NO: 188566 - DNA, 2562 bp, Artificial Sequence
  Description of Artificial Sequence: Synthetic coding sequence
atgcggggccacggcaaccacagccggctgaagagccggtgcgccagtctggggaatgtacatcaccatcaggcgcagatggcccatggcgcgcactgcagagggggaagaaccccccaatcccccgatagccggggccctactgctgggggacacaccaggggcaggtggacatatcgccccatcgaggcactgataaatgtcagtttccccggggcaaaaggcggtcggacagcagagggggaaccgtcctgggcttgggtgttccggtcaggctacttgcagaggcaggcgcttcctgggctgcccgtctctactcgagtggccgcctgttggtggcagcatcaccccggtagggattcagggttccttggccctggctttatagatctgctgcgagaagaacccagtggaagggcagatgggaaggccgccgcccagaagaccgggcggttgtacctctttcctacatttttaggtaataaattacccgaagcagctgattcattcggcgaaatcgcttcaggtaactcagtcattttcacctccgtgctgcaaagctcacacccaccagggactccccccccatctgccaggaaaccttccccgggcgcagcaatgttggtctgtgaggaaaccctcgagctcggtgcacagggatgctgggggtctaccagtccaaggggccaagcggtttcattggtcggcggacccaccgctggtggttcacgactgggtggcgccgggtgtacaatgggcctgctcatggctctccaggcacgccgtccccgcgacggtacctgggccgatccgcgtagatgttctcgggccgtcgagggctcgggtcttacgagagccgccctggtgagccccggtcctagtggggtggaagaggacacaaggcgcgagggctgcgtccttgtggggagttggcgctcaagcacacacagatccagagtgctaattatcaatacgccgtccgggaggaccccatggtctcaaggaagcttaggaagcactggaagatacaatcagacaagggccccaggcagtcaacaacaggggttgtgcagtgatgctgccctacacgaggacttcgttcccgagcctacaccagctttcttccaatatcccccgcaagcattcagtaaaactaaggtaagagaccttggcaggggggggctgtacgccttctccaaagaggagaaagtgtctgaggctcagcgtgtcgaggcctatgagacgcatggcctgggactgtctaccggccggcagaaccccgtcccatcaccttgcaaacctggctgtgtgtgtcagggcctggcgcttgatgcagaagcgtggccaagacacccagggaggagaccgtgcgccgctaaggaggcatgcctaggtcctcctggatgcagtggggagctatcattaccagaagaagagggcatagcccctggagccgccaccgctgctcccgcatgggtgccgcacggccgagtctccagattccttaccgtgaagctgttcacctatgtcaccatgtatcagtgcaaacaggaaaggatcctgcggctgtgtattagtggcgagtccggtcgctatgttcgcaggagtaggtttagaaattttgctgccctaatggtgtccactggcgtgccaggagtgttacagctgggagcgcgccccctgaggggcggcgggcacccttacggcgattcccaggctggaaaagtcgtggagtggagggcgggcgatcgcgcctcgggtctttccgccggagaaaggagattcctatctcaaagcgaattacagacttggcccagaaccccccattgtgtgggcaaaaaagttccacaaccagtgggtgctgctgatctcgcacctgatacgtcactgtgtcgcaaggaggggagcagtgcatctcgctcatgtcgccctggacctggccatttaacccgccgcgaagaagactctttccggcagttggctttcccccgatttgaggaagtcactttcccaccactcaccgccgcagaacgcgctccatctgttcacggtggccactcactggcttcgcaaggcctggtgttggccggtcggactaggagcgtagcctctggcggaaagcaagaactgagcggacccctggcagcctgcattcccacacaagacctgaagaccgtgctttcactgccccggtaccccggagagtttctgcacccggtagtttacgcctgtacagctgttatgttgctttgcctgctcgcgtcattcgttacatatatagttcaccaatccgccattcgaatctccaggaaaggcaggcatacactgctcaatttctgttttcacgcagcggaacaccccggcgtgacccctcttcgtacgtcacctcctctgccttggtggaccccaattcaggtcggcattgtactgcactactctactttatccaccatgctgtggatcggcgtcactgcgcgtaatatatacaaacaggtgacaaagaaagctccactgtgcctagacaccgaccagcccccctatcctcgccagccactcttatag

SEQ ID NO: 188567 - DNA, 3366 bp, Artificial Sequence
  Description of Artificial Sequence: Synthetic coding sequence
atgggcgccggcggccggcggatgcggggcgcccccgcccggctgctgctgcccctattgccttggctgctcctgttgctggcccctgaggcgaggggcgccccaggttgtcccctgtccatcagaagctgtaagtgctctggcgagcgccctaaaggcctgtccggaggtgtaccaggtccagcgaggaggagggtggtgtgctctggcggggacttaccggaacccccggagcccgggttactccccaacgggaccgtgacactgctcctctcaaataacaaaattacaggattgcgtaatggatcgtttctgggtctgtcactgctcgaaaaactggatctgcggaataatatcatctctactgtgcaaccaggtgcattcttaggactaggtgaacttaaaagactcgaccttagcaataataggatcggctgcctgacatccgaaacttttcaaggcctgccccggttgctgcgtctcaatatttctgggaacattttctcgtccctacagcctggggtgtttgatgaactgcccgccctgaaagttgtggatctggggaccgaattcctgacatgtgattgtcatctgagatggctgctaccgtgggctcagaaccgctccctccagctgtcggagcatacactgtgcgcttaccccagcgccttgcacgctcaggcgcttggctctctacaagaggcacagctatgttgcgaaggcgcactggagttacatacgcatcatttaatccctagtctccggcaggttgtcttccagggggaccgactgcccttccagtgtagtgcaagctaccttggtaacgatacacgtattcggtggtatcacaaccgcgctcccgtggagggtgacgaacaggctgggatcctgctggctgagtctttgatccacgactgtacattcatcacttcagagctgaccctatcacatatcggcgtttgggcgagtggcgagtgggagtgtaccgtatcgatggcacagggcaatgcatctaagaaagtcgaaatagtcgtcctggagacatccgcttcctattgcccagcagagcgagtcgcaaataatcgcggggactttcggtggcctaggacgttggcaggaataacagcctatcagtcatgcctccagtatccttttacatccgtacctctaggcgggggagcaccgggtactcgagcctcccggcggtgcgatagggccggccgctgggagccgggggattactcacactgcctttacacgaatgacatcacgcgggttctctacacgtttgtgctgatgcctatcaacgcttcgaatgcacttacactggctcatcagctgagagtgtataccgctgaagcggcctctttcagtgatatgatggacgtagtctacgttgcgcagatgatccagaaatttctcggctatgtcgatcagataaaggagctcgtcgaggtgatggttgacatggcgtcaaacctgatgctggtggatgaacatctgctttggcttgcccagcgcgaagacaaggcttgctccagaatcgtgggcgctctcgagcggatcggcggcgccgcgctttcccctcatgcccaacacatctccgtggagctgtccgcattcccaagggaagtgggcggcgctggagcaggtctgcatcctgtggtatatccttgtacagctctgctgcttctctgcctctttgcgacaatcataacctacatcctgaaccatagcagcattagggtgtcacgcaagggctggcatatgctgctgaatctgtgtttccacattgctatgaccagtgccgtcttcgccggtggaataaccttgaccaactaccagatggtgtgccaagcagtgggtatcaccctgcactatagcagtctgagcactctcctttggatgggggtgaaagcgagggtcttacacaaggaattgacctggcgagctcctcctccacaggaaggagacccagctctgccaacgccatctcccatgctgcgcttctacctcatcgcaggcggcatccctctgatcatctgcggtatcaccgccgctgtgaacatacataattacagagaccacagcccctactgctggctggtatggagaccatcactcggcgccttctacataccagtcgcactgatcctgctcatcacctggatttattttttgtgcgctgggcttagactgcgaggacccctggcccaaaatccgaaggctgggaacagcagggcgagcctggaagcgggtgaggagcttaggggtagcacaaggctgaggggcagcggcccactcctgtccgactcagggtccttattagccacaggtagcgcgagagtgggtacacctggcccgcctgaagatggagatagcctatatagcccaggggtccagctgggagcactggtcaccacccatttcttgtacctggctatgtgggcctgcggagccttagctgtgtcacagaggtggctgccaagggtggtgtgctcctgcctgtacggagtggcagcttctgcattgggactgttcgtgttcacccaccactgcgctcgcaggagggatgtcagggcctcttggcgcgcatgttgcccccctgcatcacctgctgcacctcacgctccgcccagggcactccccgctgcggctgaggacggttcgcccgtcttcggggagggtccccctagccttaaatccagcccttcgggatcctccggccaccccttagcattggggccttgtaaactaaccaacttgcagttggctcagtctcaggtgtgtgaggcaggggcagcggcagggggcgagggagagcccgagcctgccggaactcgaggcaacctagcccacagacacccgaacaacgtgcatcatggtcgaagagcgcacaagtcacgggctaaaggccatcgcgctggcgaggcatgcggaaaaaaccgactgaaagcattgcgcggaggcgctgccggagctctggaactgttgtcttccgagtctggatcactccacaatagtccaaccgatagctatctgggctctagcagaaactctccaggggcgggactccagcttgaaggcgaacctatgctgacacctagcgagggttcggatacatccgctgcacccctgagcgaagccggcagggcaggccaacgacgatctgcaagccgagactcactgaagggaggaggcgctttggaaaaagagtcacatcggcgctcatatccactgaatgccgcttctctgaacggagctcccaagggcggtaaatacgacgatgtgacactgatgggggccgaagttgcttcaggaggctgcatgaaaaccggtttgtggaagtcagaaaccaccgtgtag

SEQ ID NO: 188568 - DNA, 4017 bp, Artificial Sequence
  Description of Artificial Sequence: Synthetic coding sequence
atgggcgccggcggccggcggatgcggggcgcccccgcccggctgcttctccctcttctgccttggctgctacttctgctagctccagaagcacggggcgcccccggctgtcctctgtctatccgctcatgcaagtgtagcggcgaaagacctaaagggctgagcggaggcgtacctggacccgcccggcggagggtggtttgcagtggtggtgatttacctgaaccccccgaaccaggactgcttcccaacgggaccgtgacactcctgttgtccaacaataaaatcaccgggcttcgtaacggcagcttcctcggcctctccctcctggagaaactggatctacggaataacattatctcaactgttcagcctggagccttcctggggctcggtgagttgaagcgcttagatctgtcgaataatagaattggttgcctgaccagcgagacttttcaggggcttccccggctccttaggttaaacatatcggggaacatttttagctccctgcagcccggcgtgtttgatgaactcccggccctgaaagtggtggatttagggactgaattcctgacttgcgattgccatctccggtggctgctgccttgggcccaaaacagatccctacagctcagcgagcatactctgtgtgcatatccaagtgcactgcacgcccaggcactaggttctttacaagaggctcagctctgttgtgaaggggcactagaactacacacacaccacctcattccttccctgcgccaggtggttttccagggggatcgcctccccttccagtgttctgccagctatctgggaaatgatacacgcattaggtggtatcacaaccgcgctcccgttgaaggggacgagcaggcgggcatcttactggctgagtctcttattcacgactgcacgtttatcaccagcgaactgactcttagccatattggggtttgggccagtggcgaatgggagtgcacggttagtatggctcaggggaatgctagcaagaaggttgaaatcgtcgtgctcgagacgtctgcttcttattgccccgcggaacgagtggccaacaaccggggagattttcggtggccccggacactcgctggaattactgcatatcagagttgcctacagtacccatttacctcagtccccctgggaggaggcgcgcccggaacacgcgcatctcgccggtgcgatcgtgcgggccgctgggagccgggtgactacagccactgtctctatacaaatgacattacaagagtgctctatacttttgtactgatgccgattaacgcctcaaatgcgcttacactcgctcatcagctgcgcgtgtacactgctgaggcggccagcttttctgacatgatggacgtggtctacgtggcacagatgatccagaagtttttggggtatgtcgaccagattaaagagctagtcgaggtgatggtggacatggcgagtaatctgatgttagtggatgagcacctgctgtggctggctcagagagaggataaagcctgcagcaggatcgtgggagcactggaacggatcgggggggccgccctctccccccatgcccaacacatatctgtcaatgccagaaacgtggcactcgaggcatatttaattaagccccatagctatgtgggactcacctgtaccgcttttcagagacgcgaggggggtgtgccaggcacacggccaggcagccccggtcagaacccacccccagagcccgaaccacccgcagatcagcagctgcgattccgttgcaccactggtcgcccaaacgtgtctctatccagctttcacatcaaaaacagtgtggcccttgcctctatccaactgcccccctcgctgttttcctcgctgccagcggcattggcccctccagtgccaccagactgtactttgcagctgttggtgtttaggaatggacgcctttttcattctcacagcaacacttcaagaccgggagccgcggggccaggtaagcgaagaggggtcgctacccctgtgattttcgcgggtacgagcggatgcggggtaggcaatcttaccgaaccggtggctgtgtctctacgccactgggctgagggtgctgagccggtcgccgcgtggtggtctcaggaaggccctggcgaggcaggcggctggaccagcgagggatgtcagctccgcagctcccagccaaacgttagtgccctgcactgtcagcatctggggaacgtcgcagtcctgatggaactttcagcgtttccgcgggaagtggggggagccggagccggactgcatcccgtagtatatccatgtaccgcactgttgttgctctgcctgttcgccaccattattacttacattctgaaccattctagtatcagggttagccggaaggggtggcatatgctgctgaatctctgttttcacattgccatgacctccgccgtgttcgcaggcggcattactttaacaaactaccaaatggtatgccaggcagttggaattacactccactattcttcccttagcacactgctgtggatgggcgttaaggcgagagttctgcataaagaactcacctggagggccccccccccacaggagggggaccctgctctgcccaccccatccccaatgttgcggttttacttaattgctgggggtatacctcttattatttgcggcatcaccgctgccgtcaatattcacaattatcgtgatcacagcccctactgctggctggtgtggaggccgtcactcggcgcattctacattccggtggcattgatattgttaatcacatggatctactttctttgcgccggactgaggttgaggggcccgcttgcacaaaacccaaaggcaggcaacagccgcgccagcctggaggctggtgaggaactgcgtggctcaacacgtctccgcggcagcgggcccctgcttagtgatagcggcagcttgctggcaaccggctcagcccgcgtggggacccccgggccccccgaagatggcgactccctgtatagtcctggggtgcagctgggggccctggttactacccattttctgtacctagccatgtgggcatgtggcgcccttgcggtaagccagcggtggttaccccgtgtggtgtgcagctgcctttacggcgtcgctgctagcgctttgggactctttgttttcacccatcactgtgccagacggcgagatgtcagagcctcgtggcgggcctgctgtccaccggcatctcccgctgccccgcacgcgccacccagagcacttcctgccgctgccgaggatgggtcgcccgtgtttggggagggtcccccatctcttaagtcatccccatctgggtctagtggacacccactcgctctgggtccgtgcaaactcactaatctgcagctggcccagtctcaggtatgcgaagccggggccgcagctgggggtgagggggaaccagagcctgcgggtacccggggaaacctggcacaccgccacccgaacaacgtacatcacggcaggagagcacacaagtcaagagcaaagggtcaccgggccggcgaagcttgtggtaagaaccgcctgaaggctttaaggggtggcgcagctggcgccctcgagctgctaagttcagagtccggctctctgcacaattcacccacagattcctaccttgggtcatcaagaaactctccaggcgccggcctccagttggagggcgagcctatgctaacccccagcgagggatccgatacttctgctgccccactctcggaggctggtcgagctggccaacgtaggtccgccagccgggattctctgaagggcggcggcgcactcgagaaggaaagtcatcgcaggtcctatcccctcaacgccgcctcccttaacggtgctccaaaaggaggaaagtatgatgatgtgaccctgatgggcgccgaggtggcctcaggaggatgcatgaaaaccgggctgtggaagtccgagacaactgtctag

SEQ ID NO: 188569 - DNA, 3771 bp, Artificial Sequence
  Description of Artificial Sequence: Synthetic coding sequence
atgcggggcgcccccgcccggctgctgctgcccctgctgccctggttactcctcttactcgcacctgaagcacgtggcgcccccggttgtccactctcgatccgctcctgcaagtgttctggggagcgtcccaaaggcttatccggaggtgtcccagggcccgccaggagacgggttgtatgcagcggcggcgacttgccagaacctcccgaacctggtcttctgccaaatggcaccgtcaccttgttgctctctaacaacaaaattaccggtttacggaacggctctttcctcgggctgtcccttttggagaagctagacctgcgtaacaacatcatctctaccgtgcagcccggcgccttcctgggcttgggcgagttaaaaagacttgacctctctaataacaggataggttgtttgacaagcgagactttccaaggacttccacgcctgctgagactgaacataagtggtaatattttttcttctctgcagcctggcgtgtttgacgagctgcccgccctcaaagtggtggacctgggcaccgagttccttacctgtgactgccatctgcgatggttactgccctgggcccaaaataggtcactgcagctgtcagaacacaccctgtgtgcctacccgagcgcactgcatgctcaggccctaggaagcctgcaggaagcccaactatgctgcgaaggcgcacttgaactgcacacccatcacctgataccaagcctcagacaggtcgtcttccagggagatagattaccttttcagtgcagtgccagctacttggggaatgacactaggattcgttggtaccataatcgggctccagttgagggtgatgagcaagccggtattctgcttgccgaatctttgatccacgactgcaccttcattacctcagagctgacgctctctcacataggggtgtgggcttccggagaatgggagtgtaccgtttctatggcacaagggaatgcgtcaaaaaaagtggagatagttgtcttggaaactagcgcatcgtattgccccgccgagcgggtggccaataatagaggagacttcagatggccacggaccctcgccggaatcaccgcttaccagtcttgcttgcagtacccgttcacatctgtgccacttggaggaggcgctcccggaacgcgcgctagcaggcggtgtgatagggcagggcgctgggaaccaggggattatagccattgtctgtacacgaacgacattaccagagttctgtacactttcgtcttgatgccaatcaatgcttctaacgccctgacgctcgcacaccagctcagggtctacacagccgaggctgcaagtttcagtgacatgatggatgtagtctacgtggcccagatgatccagaaattcctgggctatgtggaccagatcaaggaactggtggaagtcatggttgacatggcgagcaacctcatgctcgtggatgagcacctgctctggttagcccagcgggaagataaagcatgttcaaggatcgtcggggcccttgagcgaatcggaggcgcggcactcagcccccacgcacagcacatatctgttaatgcgcgcaatgtggccctggaagcctacctgataaagcctcatagctatgtcggtctcacttgtacggcattccagaggagagaaggcggcgtcccaggcacccgcccagggagccccggacagaacccccctcctgagcctgaaccccccgctgatcaacaactgcggttcaggtgtaccaccgggcgcccaaatgtgagcctcagctctttccacattaaaaacagcgtagccctggcatctatacagttgccaccgtctctattcagctcccttcccgccgccctggcgccgccagtgccaccagactgcacgctccagctgttagtgttccgcaacgggcggttgtttcatagtcactctaatacctcaagacctggcgcagcaggtcctgggaaaaggcggggggtggctaccccagtcatttttgccggcaccagcggatgtggagtgggaaacttgaccgagccggtggcggtcagtctgcgccactgggcagagggcgccgaaccggtggctgcttggtggtcccaggaaggaccaggcgaggctgggggatggacttcagaggggtgtcagctgcgttccagccagcccaacgttagcgcgttacactgtcagcacctcgggaatgtagctgtcctgatggaactgtcagcattccctcgcgaagtgggcggcgccggggccgggcttcacccagtagtgtacccctgcaccgctctccttctgctgtgcctgttcgccaccataatcacatatatcttgaaccacagctctattcgcgtgtcccggaagggctggcacatgttgctgaacctatgcttccacatcgcaatgacatcggctgtatttgccggtggtatcaccctgaccaactaccagatggtctgccaggccgtgggaatcacactgcattacagtagcttgagtacattactgtggatgggagtcaaggcgcgggtcttgcataaagagctgacttggcgggccccacctcctcaggaaggggacccagcccttcctaccccctctcctatgttgaggttttatctaatcgccggcgggatccccctgatcatatgcggcatcaccgccgccgtgaatatccacaactaccgagaccactccccatactgctggctggtatggcgaccgtctctcggagctttttacattccagtggctctcattctcctgattacatggatttactttttatgcgccggcctgcgcctcaggggcccactggcacagaaccctaaggccgggaacagcagagcaagcttggaagctggtgaagagctgagaggcagtacgaggcttcgggggagcgggcctctgctatcggacagcgggtccctcctggctaccggatctgccagagtaggaacaccaggccccccagaggatggggatagcctgtattcccccggtgtccaacggggtgccggggatcacgcacttccggttttgggacatgtgggactgcgtggcagcggctccgtgcctgccctggcagcgcctggtggtgtacagctgctggtccgggggggctccctcaggcctggtccactcaggctgcattcgcccctgtgtcaggctgagggacgcgaatcccttgtagcaaggctgctacctccctgcctctctcgcggaccaccttgtcccgcccccggccctgcccgtaggcggagggggagattccctggggtgcggggaggacctccattgccccaggtgcttcccaaaaggcagcagaggccttcagccggatctggacccctacaggcacatcagcccgccgccggccccgagagtggggtgcgtgggggaggcggcgggcgtcgcggtcgcagggcaggagcaggggggcacccaggcaaacctaggccccctcctcctcagcagagagcacctagggcatcaggagcgcaggagccgggacagggaacccctcggggaggtggattgaggcaagagccagcacaaggcccagcaagggggaggggtggcggcgctggagctgctgtccaaagggaacgacagagtgcccagcagccacataggcagctgcccggccagcagcctcaacaaccagggcggcggcctgcagctggcaggcgcgcgcacgcacatgctgtgagaggacagcggcaccaaagacgggcagccttctag

SEQ ID NO: 188570 - DNA, 3966 bp, Artificial Sequence
  Description of Artificial Sequence: Synthetic coding sequence
atggagccccccggccggcggcggggccgggcccagccccccctgttactccccctgtccttgctggcacttctcgcattgctaggcggggggggcggaggcggcgcagcggccctaccagccggatgcaagcacgatgggagacctcgaggagcgggccgagcagctggcgccgctgaaggcaaggtagtgtgctcttccttagagctcgcacaagtgctgccacccgacaccctgcctaacaggacagtgaccctgattctctccaacaataagataagtgagctcaaaaatggatcattctccggcctgagcctactggagaggttagacttgcggaacaacctgatctcatctatcgaccccggagcgttctggggcctctcctccctgaagaggctcgatttaaccaataatcggattggctgtttgaatgcagatatttttagaggtctgactaatctcgttcggctcaatttatctgggaacctgtttagcagcctgtcacagggaacattcgactatttggcatctttacgtagccttgaattccagaccgaatatctgctgtgtgactgcaatatactctggatgcatagatgggtcaaggaaaagaatataactgtgagggacactaggtgcgtataccccaaatcccttcaggctcaacccgtcactggagttaagcaagaacttttgacctgtgacccccccctagagctcccatcattctacatgacacccagtcacagacaggtggtgttcgagggcgacagcctgccattccagtgcatggccagttatatcgaccaagatatgcaggtgctttggtaccaggatgggcgcattgttgagacagacgagtcccagggaatctttgttgaaaaaaatatgatccacaattgttcccttatcgcaagtgcactgaccatcagcaacatacaagctgggtccactggtaactggggctgccacgttcaaacaaaaagaggcaacaacactcggacggtagatattgtggtactggagtcctccgcccaatattgccctccagagagggtcgttaacaataagggtgattttagatggccacggacccttgcgggtataactgcttacctgcagtgcacccgcaatacccacggctctggtatttaccctggtaacccccaagacgagcgtaaggcgtggcgcaggtgtgatcgggggggattctgggccgatgatgattactcccgctgccagtacgctaatgacgtcaccagagtgctgtatatgttcaatcagatgccattaaatcttaccaacgccgtcgcgactgcaagacagctgttggcttacacagtggaggccgccaacttcagtgacaagatggacgttatctttgttgcggaaatgattgaaaagttcggccggtttacaaaggaagaaaagagcaaggagctgggggacgttatggtcgacattgcctccaatatcatgcttgcagatgagcgggtcctgtggcttgcacagcgcgaggccaaagcatgcagtcgcatcgtgcaatgcttgcagaggatcgcaacctatcgactggccggcggtgcccatgtttacagcacatatagccccaacatcgcgctggaagcatacgtcatcaagtctaccggctttaccggcatgacatgtaccgtcttccagaaagtagcagcatccgaccgtacaggcctgtctgactacgggagacgggaccctgaagggaatttagataaacagttaagctttaagtgtaacgtgagcaatacgttctcgtcactcgctctgaaaaacaccatagtggaggcctctatccagctgccaccaagcctattctctccaaaacagaaaagggagcttcggcccaccgatgactccctttacaagctgcaactgatcgcttttcgcaatggaaagctattccctgccacagggaattccacaaacctggctgacgatggcaagcgccgcaccgtggtaacgcccgtcatcttgaccaaaatcgacggggtcaacgtcgatacacatcacataccagttaacgtgactcttaggcggatcgcacacggcgcagacgccgtggcagctcgatgggacttcgacctgctgaatgggcagggtggatggaaatcagatggatgtcacatcctttatagtgacgagaacatcacaaccattcagtgttactccctcagtaactacgccgttttgatggacctgacgggcagcgaattgtacactcaggccgctagtctgctgcatcctgtggtctatactacagccatcatccttctgttatgcttgctggcagtcatagtctcatacatctatcaccattccctcatccggatcagtctcaagagctggcacatgctagtcaatctgtgcttccacatattcttaacatgtgttgtgttcgtcggcggcattacacaaacaaggaacgcttctatttgccaagctgtggggatcattctgcactactccacactcgccacagttctgtgggtcggggttactgccagaaatatctacaaacaggtgaccaagaaggccaaacgatgccaggacccagacgaacccccacccccaccccgaccaatgcttagattttacctcatcggaggaggcattccgattatcgtttgtggcatcaccgctgccgccaacataaagaattacggaagcagacccaacgctccatactgttggatggcgtgggagccaagcctgggggctttctacggtcccgcctcatttattaccttcgtgaactgcatgtatttcctgtctatctttatccaactgaagagacatccggaaagaaagtatgagctgaaggagcccacggaagaacagcagaggctggcggcaaacgagaacggcgagataaatcatcaagacagtatgagcctgtccttgatctcgacaagcgccctagagaatgagcacactttccacagccagttgcttggagcatcgctgaccctgcttctctatgtggccctttggatgttcggtgcacttgcagtctctttatattatcctcttgacctcgtgttttcctttgtattcggcgccacctctctgtccttctcggccttctttgtagtgcatcactgcgtgaaccgcgaggacgtacgccttgcatggatcatgacatgctgtcctggacggagttcgtatagtgtgcaggtgaacgtacagcccccaaattctaatggcacaaacggggaagccccaaagtgcccaaactcctccgctgagagctcttgcaccaacaagagtgcttcgtcttttaagaacagttctcaggggtgcaagctgactaacttgcaggccgccgccgcccaatgccatgccaactctctgcccttgaattctacccctcagcttgacaactctctaactgagcatagcatggacaatgacatcaagatgcatgttgcccccctggaggtacagttcagaacaaatgtgcattcttcaagacaccacaagaacaggagcaagggccatagggcctctcgcctcacggtgctgagagaatacgcttacgatgtcccaacctctgtggaaggatcggtgcagaacggcttgcccaagagtcgtctgggaaacaacgaaggccattcccgctctcgacgggcttatcttgcctatcgggagcgccagtacaacccacctcagcaagactcaagcgacgcttgcagcacacttcctaagagctcccgtaacttcgaaaagcctgtaagcaccacttcaaaaaaggatgccctgaggaaacccgcagtggtggagctggagaatcagcagaaaagctacggtctgaatctagctattcagaatggaccaattaaaagcaatgggcaagaagggcccctgctgggtacagactcaaccggcaacgtgagaaccggcctctggaagcacgaaaccaccgtgtag

SEQ ID NO: 188571 - DNA, 1851 bp, Artificial Sequence
  Description of Artificial Sequence: Synthetic coding sequence
atggagccccccggccggcggcggggccgggcccagccccccctgcttctcccactgagtctgcttgcattgttggccctcttaggaggagggggaggtggcggagcagccgcactgccagcgggatgcaaacacgacggacgccccaggggagccggaagagcggccggagccgccgaagggaaagtggtgtgctcgtccctggagctcgcccaggtgctaccacctgacaccctgccaaatcgtactgtcacactaatcctatctaacaacaagattagcgagttgaaaaacgggtcgttctccggactcagcctcctcgagaggcttgacctccggaacaacctgatctcctctatcgacccaggggccttttggggcctgagtagtcttaagcgtcttgatctcactaacaatcggatcggctgcctaaatgctgatatcttccggggcttgaccaacctcgtgagactgaacttgtcaggcaatttgtttagctcactgtctcaggggacttttgactacctcgccagtttgaggagccttgaattccaaacagaatatctgctctgcgattgtaacatcctttggatgcaccgatgggtaaaagagaagaatataaccgtcagggacacccgatgtgtgtaccccaagtcactgcaagcacagcctgtgacgggggtgaaacaagagctgctgacctgtgaccccccgcttgaactcccttcattctacatgactccttcccacaggcaggttgtgttcgagggcgacagcctcccctttcagtgcatggctagctacattgaccaggacatgcaggtgctgtggtaccaggacggaaggatcgtggagaccgatgaatctcaagggatattcgtggagaagaacatgatccataattgctccctcatcgcttctgctctgacgatttccaatatccaagccggcagcacgggtaactggggttgtcacgttcagactaaacgtggcaataatacacgtaccgtggacatcgtggtgttagaaagtagcgcacagtactgccctccagaacgcgtggtgaataataagggcgattttaggtggcccagaacactcgctggaatcaccgcatatcttcagtgcactagaaatacacatggctccggaatctatccagggaaccctcaggatgaacgaaaggcatggagaaggtgtgacaggggtggcttttgggctgacgatgactacagccgctgccagtatgctaatgacgtcaccagagtcctatatatgtttaaccagatgccgttaaacctcaccaacgcggtcgccacagctagacagctgcttgcttacaccgtcgaagccgcaaacttcagcgataaaatggacgtgatttttgtagcggaaatgattgagaaattcgggagattcacgaaagaagagaaatcaaaagaacttggagacgtcatggtggatatcgcgtctaacataatgctggctgacgaacgggtgttatggctggctcaaagagaggcaaaggcttgctcccgtattgtgcagtgcctgcagagaattgccacctaccgcctcgccggaggagcccacgtgtatagtacatattctcccaatattgccctggaggcctatgtaatcaagtccaccggcttcactgggatgacttgtacggtgttccagaaagtggccgccagcgaccgcacaggcttatctgactatggtagaagggaccccgaaggcaatctcgacaagcagctgagctttaaatgcaacgtgtccaatactttctcaagcctggcgctaaaggtctgctacatcctgcagtcgtttaagactatatatagctag

SEQ ID NO: 188572 - DNA, 1146 bp, Artificial Sequence
  Description of Artificial Sequence: Synthetic coding sequence
atgcccctgaagcggaacaacagcaagtacccccccctggagctgcctagtttctacatgaccccaagtcaccgccaggtggtcttcgagggcgacagtttgccctttcaatgtatggcttcatacatcgatcaagacatgcaggtcctctggtaccaggacggcagaattgtggaaaccgatgaaagccagggtatctttgtcgagaagaacatgattcacaactgttcgcttatcgccagcgccttgacaatatccaatatacaggcggggagcaccggcaactgggggtgtcatgtgcagacaaagcgtggaaacaacacgcgcacagtagacatagtggtgttagagtctagcgcccagtactgtccccctgagcgtgtggttaataacaagggggactttcggtggcctcgcactctggcaggaattacagcctacctccaatgcaccaggaacacccacggctccggaatctacccgggaaatccccaggacgaaaggaaagcctggcgcaggtgcgacagaggtgggttctgggccgacgatgattactcccgctgtcagtacgcaaatgacgtgacgagggttctgtatatgttcaaccagatgccacttaatcttaccaatgccgtggccacagctcgccaactgctcgcatatactgtggaggcagccaatttcagcgataaaatggatgtaatatttgtcgcggaaatgatcgagaaattcgggaggttcacgaaggaggagaaaagcaaggagcttggcgatgttatggtcgacatagcttctaatattatgctggccgatgaacgcgtgctgtggctggcacagcgggaggccaaggcgtgttcccgaatcgtgcaatgcctccaacgcatcgctacatataggctcgcaggtggagctcacgtttattcaacctatagtcctaatattgcattagaggcttatgtgattaaaagcaccggttttactgggatgacctgtactgtctttcagaaggtggctgccagtgatcgcacagggctatccgattacggacggcgagatccagaaggcaacttagacaagcagttatcttttaagtgcaacgtatccaacacgttctcttctcttgccctgaagggcaagtttaggtag

SEQ ID NO: 188573 - DNA, 2724 bp, Artificial Sequence
  Description of Artificial Sequence: Synthetic coding sequence
atgcccaccgccgccgcccccatcatcagcagcgtgcagaagctggtgttgtatgagactagagccaggtactttctggtggggtccaataatgcagagacaaagtacagggtcttgaaaattgaccgaaccgagcctaaggatttagttattatcgatgacagacatgtgtatactcagcaggaagtacgcgaactactcgggcgccttgatttagggaaccgaacaaagatggggcagaaggggtcatcaggcctgtttagagccgtcagcgctttcggcgtggtgggtttcgtccggttcctggagggctactacatcgtactcatcactaaacgccggaagatggccgacattggcggacatgcgatctataaagttgaagacactaatatgatttacattccaaatgatagcgtaagagtcacccatccagacgaagcacgatacctgcgcatcttccagaacgtggacttgtcttcgaatttctatttcagctacagttatgacctctctcatagcttgcagtacaaccttacggttctgaggatgccgctcgagatgctgaagtctgagatgacacaaaatcgccaagagagctttgatatcttcgaggatgaaggcctgatcactcaggggggctctggtgtcttcggaatttgctccgaaccgtacatgaagtacgtatggaatggagagctcctggacataattaaaagcacagtacatagagactggctattgtacatcatccacggcttctgtggtcagagcaagctgcttatctacggccggcccgtgtacgtcacgttgattgcacggaggtcctccaagtttgctggcacaagattcctgaagagaggtgccaactgcgagggcgacgttgcaaatgaggtggaaacggaacaaattctctgcgatgcaagcgttatgtcttttacagccggcagttattcgtcatacgtccaggtgcggggttctgtccccctgtactggtctcaggatatctctaccatgatgcccaaaccaccaatcacgttggatcaggccgacccctttgcccatgttgctgcgctgcattttgaccagatgtttcagagatttgggagcccgattatcattcttaacctggtgaaagaaagggaaaagagaaagcatgagcggatcctatctgaagagctggtcgctgcagtcacttatctaaaccagttcctgccacctgaacacacaatcgtctacatcccctgggatatggcaaagtatacaaagtccaaactttgcaatgtcctggatagactcaatgtcatcgctgaatcagtagtgaagaaaacgggcttctttgtgaacaggcccgactcttactgttccatcctgaggcctgacgagaagtggaatgaattgggaggctgcgtcattcccactggcagactccagacagggatcctgcgtaccaactgtgttgattgccttgacagaacaaataccgcgcagtttatggttggcaagtgtgcactcgcgtatcagctgtactcacttggactgatcgataaacctaacctgcagtttgatacagatgctgtaagactgtttgaggagctttatgaggaccacggggacacactgagcctgcaatacggaggcagccagcttgtgcatagggtcaagacatacagaaaaatagccccctggacccagcattccaaggatataatgcagactctgtctcggtactatagcaacgcattcagtgacgcagatagacaagattcaattaatttattcctaggggttttccatccaacggaaggcaagccccacctgtgggagctgcccaccgatttttacctccaccataaaaatacaatgcgcctgctccccactcgaaggtcctacacctactggtggacccctgaggtgattaaacatttaccactaccctacgatgaggtgatatgtgccgtcaatcttaagaaattaattgtgaagaagtttcacaagtatgaggaagaaatagacatccacaatgaattttttaggccttacgaactgagttcgtttgacgacactttttgcttagccatgacctcctcagcacgcgattttatgcctaagactgtggggattgatccctccccgtttaccgtgcgaaagccagacgagactgggaagtcggtgttgggcaacaaatccaaccgcgaggaggccgtgctccagagaaagaccgctgctagcgcccccccccctcccagcgaggaggcggtgagctcttcctctgaggatgatagtggaacagaccgtgaggaggaagggtccgtgagtcagcggtcaacccccgtcaaaatgactgacgctggggactcggcaaaagttactgaaaatgtggtccaacccatgaaagagctttatggcataaatctctctgacggactgtccgaggaagacttctccatctactcacgttttgtccaattagggcagtcacagcacaagcaagataaaaactcccaacagccctgcagccggtgctcagacggcgtcatcaagctgaccccaatttccgctttctctcaggacaacatatacgaggtccagccacctcgtgttgatcggaaaagtaccgagatttttcaggcgcatattcaggcatcccaggggataatgcagcccctgggtaaagaagactccagcatgtatcgggagtacattcgaaaccgttatctgtag

SEQ ID NO: 188574 - DNA, 3582 bp, Artificial Sequence
  Description of Artificial Sequence: Synthetic coding sequence
atgatgttccggagcgaccggatgtggagctgccactggaagtggaagccatctccactgttgttcctgttcgcactatacatcatgtgtgtcccccacagtgtgtgggggtgcgccaattgcagggtggtgctgagcaacccgtccggaacgtttacttctccatgctatcccaacgactatcccaacagccaggcctgtatgtggaccctgagagccccgacagggtacattatacagattacattcaatgattttgacatcgaggaagcacccaattgcatctacgatagcttatctctcgataacggtgagagccagacaaaattctgtggggccacagctaagggattgtcattcaacagcagcgcaaatgagatgcacgtgtcgttttcttctgatttcagtatccagaaaaaaggctttaacgccagctacattcgagttgcggtgtcgctaaggaatcagaaagtcattctgccacagacttccgacgcataccaggtctcggtggccaaaagcatttctatccctgagcttagcgccttcacactttgctttgaggcgaccaaggtcggtcatgaggattccgactggacagccttctcctactcaaatgccagcttcactcagcttcttagttttgggaaggccaaaagcggatattttctcagcatcagtgattccaagtgcttgttaaacaatgccctgccagtgaaggagaaggaggacatattcgcagaaagcttcgaacagttgtgtctggtctggaataattctctggggtcaataggcgtgaacttcaaacggaactacgaaactgtgccctgcgactcaacaatcagcaaggtgatccctggcaatggtaagcttcttctcggtagcaaccagaatgaaatagtctctctgaaaggcgatatatacaactttcgcctgtggaatttcaccatgaacgccaaaatcctgagcaacctgagctgcaatgtcaaaggcaatgtagtggattggcagaacgacttctggaatattcctaacttggcccttaaggcggagtcaaatctctcctgtggaagctacctgatccctctccccgccgccgagctagcctcgtgcgcagacctaggcaccctgtgccaggatggcatcatctatcgtattagtgtagtcatacagaacatcctccgtcacccagaggtcaaggtccaaagcaaagttgccgaatggctgaattccacattccagaattggaactatacagtctatgtcgttaatatatcatttcacttgtccgctggtgaggacaaaatcaaggtcaagagaagtctcgaggacgaaccccggttggttttatgggcacttctcgtatacaatgctaccaataacacaaacctggaaggcaaaattatccagcaaaagcttctcaagaataacgaatcactggacgaggggctgcggctccacacggtcaacgttcggcagctcggacattgtctggctatggaagaacctaagggatactactggccaagcatccagccgtccgagtatgtgctcccctgccccgataagcctggatttagtgcaagtagaatttgtttctacaacgcaaccaatcccctcgttacgtactggggacctgtagacatatccaactgtctcaaagaggctaacgaggtggcaaaccagatcctgaacctgaccgcggacgggcagaacctgacatctgctaacataacaaacatcgtggaacaggtcaaacgtatcgtgaataaggaagaaaatatcgacattaccctcggtagcacactgatgaatatttttagcaacatcctatctagtagcgatagcgatctcctggaaagctcctccgaggcactcaaaaccatcgatgagctcgcgttcaagatcgatctgaattctaccagtcatgtgaatattactacaaggaacctcgccctctccgtgagctcccttctgccaggtactaatgccattagcaatttctctataggactcccatctaacaacgaaagctactttcaaatggacttcgagagcgggcaggtggaccccctcgcctctgtgatcctacctcccaatctcctcgagaatctgagtcctgaagattcggtgctagtgcggagagcccagtttacatttttcaataagaccggtctgttccaggacgtggggccccagagaaagacactcgtgagctatgttatggcatgttctattggaaacattacaattcagaacttaaaggaccctgtacagatcaaaattaagcatacgaggactcaagaagtgcaccatcctatctgcgcattctgggatttgaataagaataagtcttttggtggctggaatacctcgggctgcgtcgcccatcgagattccgacgcctcagagacagtctgcctgtgcaatcactttacacactttggggtcctcatggacctgccacggtctgccagccagttggacgcccggaatacaaaggtgctcactttcatttcttatatcgggtgcggcatcagcgccatcttcagtgctgcaaccctgctcacttacgtggccttcgagaagcttagaagggattatcctagcaagatcttgatgaacctgtccactgccctgctcttcctgaatctgctgtttctgctagacggctggatcacatctttcaatgtggacggcctgtgtatcgctgttgccgtgctgctccactttttcctcctggctaccttcacatggatggggttggaagcaattcatatgtacattgccttagtgaaggtattcaacacttatatccggcggtacattctgaagttttgtattatcggttggggactgcccgccctggtggtgtccgtggttctggcctcacggaacaataatgaggtctatggcaaggaatcttatggaaaggagaagggtgatgagttttgctggatccaagaccccgtcattttttacgtaacatgcgccgggtattttggcgtgatgttcttcctcaatattgccatgtttattgtggtgatggtacagatctgtgggcgtaacgggaagaggtctaaccgaaccctacgtgaggaggtgttaagaaacctgcgctcggtagtttcgttaaccttcttactgggtatgacctggggttttgcattttttgcctggggacctctcaacattccatttatgtatctgttctcaatattcaacagcctgcaggggttgtttatttttatcttccactgcgcaatgaaggagaacgtgcagaaacagtggcgccaacatctctgctgtggtcgatttaggttagctgacaactccgattggtcgaagacagctacaaacatcatcaaaaagagttcagacaatttaggcaagagtctgagtagcagcagcatcggcagcaattcaacgtatctcacgagtaagagcaaaagctcaagtactacatatttcaagcgaaactcgcacaccgacaatgtctcttatgagcactcattcaacaaaagcggatctctgcgccagtgtttccatggccaggtgctggttaagactggaccgtgttag

SEQ ID NO: 188575 - DNA, 3669 bp, Artificial Sequence
  Description of Artificial Sequence: Synthetic coding sequence
atgatgttccggagcgaccggatgtggagctgccactggaagtggaaaccctctcccttgctgttcctgtttgcgttatatatcatgtgcgtgccgcactctgtgtggggctgtgccaactgtagggtggtgctcagcaatcccagcggcacattcacaagcccgtgctacccaaatgattaccctaatagccaggcctgtatgtggactctaagggcaccaactgggtatattattcagatcacgttcaacgattttgacatcgaagaagcccccaactgcatatatgatagtctttcgctcgacaacggcgagtctcagactaaattctgtggagctacggccaaaggactaagtttcaactcctcagccaatgagatgcacgtgtccttctcttctgacttcagcatacagaagaagggattcaatgcctcatacattcgcgtggcagtgtccttaagaaatcaaaaggtgatacttccgcagaccagcgacgcctaccaggtgagcgttgccaaaagtatctccatccccgagctgtctgcgtttaccctctgttttgaagcaactaaagtaggccatgaggactcagactggaccgcgttttcctacagtaacgcttccttcacccagttactgtcattcgggaaggcaaagagcggttatttcttgtcgatttcagattcgaagtgtctgcttaacaacgcgttgcccgtgaaggagaaggaggacatctttgctgagtcattcgaacagctgtgcctcgtctggaataatagcctgggttcaatcggcgtgaactttaaacggaactacgaaaccgtgccttgtgactcgactatctcgaaggtaatccccggcaatggtaagctcctgcttgggagcaatcagaatgaaatcgtctcattaaagggggacatttataattttaggctgtggaacttcactatgaacgcgaagatcttatctaacctcagttgtaacgtcaaggggaatgttgtggattggcagaacgacttctggaacattcccaacctcgcccttaaggctgagtcaaacctctcatgcgggagctatctgattccactccctgcagccgagttggcgtcttgcgctgatcttggaactctctgccaagacggcattatctatcggatctctgtcgttatccagaacattttgcgacaccccgaagtaaaagttcagtccaaggtggctgagtggctaaacagtacattccagaactggaactacaccgtttacgttgtcaacataagttttcacctgtctgcaggcgaggacaaaatcaaggttaaacgcagcctcgaggatgagccaagattggtgctgtgggcgctgctggtgtataatgccaccaataatactaatttagagggaaaaatcattcagcagaagttgctgaagaacaacgaaagcctggatgaaggacttaggctccataccgtgaacgttaggcaactaggccattgcctggccatggaagaacctaagggatactactggccaagcattcaaccctctgagtacgtgcttccgtgtcccgacaaacccggcttctccgcctccagaatctgtttctacaatgcaacaaaccccttggttacgtattggggtcctgtggacatatccaattgcctgaaggaggctaatgaggtggcaaatcagatactgaatctgaccgccgacgggcagaacctaacttctgccaatattaccaacatcgtggagcaggtcaagcgaatcgtcaataaagaggagaacattgacatcacactgggaagcactctaatgaatatcttcagtaacattttgtcctccagtgacagcgatttgctggaatcctcttccgaggcactgaaaaccatagatgaactggctttcaaaatagatctcaacagtacatcccatgtcaacataaccacacgcaacctcgccctttcagtttcaagtttattgcctggaacaaacgccatctctaacttttctattggtctgccatctaacaatgagtcttacttccagatggattttgagagcggacaggtggaccccttggcctcagtgatcctgcctcccaatctcctggagaacctctcccctgaggactccgtactggtcagaagagcccagtttacgttctttaacaagacaggattgtttcaggacgttggcccccagcgaaaaacccttgtttcttacgttatggcctgctcaatcggaaatattacgatccagaatttgaaagacccagtccaaattaaaattaagcatacgagaacacaggaggttcaccaccccatctgtgctttttgggacctgaacaagaataaatcttttggcggatggaacacctcagggtgcgttgctcatcgcgattccgatgcatctgaaacagtgtgtctgtgtaatcatttcactcatttcggggtgttgatggacctgcctcgaagcgcctcccagttggacgcccgtaatacgaaggttctgaccttcatctcctacattggctgcggaattagcgcaatattctctgcagcgacattgctcacctacgttgcttttgagaagctccgaagggattatccgtccaagatcttgatgaatctcagtacagcgttgctgttcttgaatctgctgttcttactggatggctggattaccagttttaatgtcgatggtctgtgcattgctgtggccgttctgttacactttttcctgctggctactttcacttggatgggcctcgaagcaattcacatgtacattgccctggtcaaggtgtttaatacatatatccgccgctacatcctcaaattttgtataataggatggggccttcccgcactggtagtgagtgtggttctggcatctcggaacaataatgaagtgtacggcaaggaaagttacggtaaggaaaaaggcgatgagttctgttggatccaagatcccgtcatcttctacgtaacttgtgcaggttattttggagtcatgtttttccttaacattgctatgttcatcgtggtaatggttcagatctgcgggcgaaatggcaagcggtctaacaggaccctacgggaagaggtgctccgaaacctgcggtctgtcgtaagtctcacctttctgctgggcatgacctggggcttcgctttcttcgcatggggtccactaaacattccctttatgtacctcttctcaatcttcaattctctccagggtcttttcatatttatatttcactgcgcgatgaaagagaacgttcagaaacaatggcgtcagcatctgtgttgtgggagatttagactagccgacaatagtgactggagtaaaaccgcaacaaacatcatcaaaaagtcaagtgacaatttagggaagagtctgtcaagctcgtctattggatccaactcgacgtacttgacttctaagagtaagtctagctccacaacctattttaagcgcaactctcacacagatagcgcaagcatggataagagtctgagtaaactcgctcacgctgacggggaccagacgtccattattccagtgcatcaagtcattgataaggtcaagggatattgtaatgcacacagtgacaatttttataaaaatattataatgtcggacactttttcccattcaaccaagttttag

SEQ ID NO: 188576 - DNA, 3753 bp, Artificial Sequence
  Description of Artificial Sequence: Synthetic coding sequence
atgatgttccggagcgaccggatgtggagctgccactggaagtggaaaccctcccccctgttattcttgttcgcactctatatcatgtgtgtgcctcacagtgtctggggctgtgctaattgccgggtggtgttgtctaacccctctgggaccttcacatccccctgctacccgaacgattatcccaattcccaggcttgcatgtggaccctaagagctcctactggctacattatccaaataactttcaacgattttgatatcgaggaggcaccaaattgcatatatgattctcttagcttagataacggagaatcccaaaccaagttttgtggggcaaccgccaaagggctgagttttaattctagcgctaacgaaatgcacgtctctttctctagcgatttctccattcaaaaaaaaggcttcaatgcctcctacatccgtgtggccgtgtctcttagaaatcaaaaggtgatccttcctcagaccagcgacgcctatcaggtgtcagtggcaaagtccatttccatcccggaactttcagcctttacgttgtgcttcgaggcaactaaagtcggtcacgaagattccgactggaccgcgttctcctatagcaacgcttccttcacccagctgctgtcatttggcaaggccaaatcaggctatttcctcagtatttcggattccaagtgcctattaaacaatgcactgccagtcaaggagaaagaagacattttcgctgaatctttcgagcagctctgccttgtgtggaacaactcacttggcagcatcggggtgaattttaaacgtaattacgaaacagtgccatgtgactctacgatctccaaggtgatccccggcaatgggaaactgttgctcgggtccaaccagaacgaaattgtgtccctcaagggagatatctacaacttccgtctctggaacttcactatgaacgctaagatcctgagtaacctctcttgtaacgttaaaggaaacgtcgtggactggcagaacgacttttggaatatcccgaatctggccttgaaagcagagtccaatctgtcatgtggcagttacctgatccctctccctgctgcagaactggcctcttgcgcagacttgggcactctgtgccaggcgacggttaactctccatctacaacccccccgactgtaacgaccaacatgcctgttacaaaccgaatcgacaagcaaagaaacgacggcatcatctacagaatttccgtcgttattcagaatatcctcaggcatccggaagtaaaggtccagagcaaagtggctgaatggctcaactcaaccttccagaattggaattacacggtatacgtggtaaatatcagcttccatctgtccgcaggtgaggacaaaatcaaagtaaaacgtagtctagaggacgagcctcgtctcgtgctatgggccttactcgtgtacaatgccacaaataataccaatctggaaggaaagatcatccagcaaaagttattgaagaataacgagtccctggatgaaggtttgcgcctccacactgtgaacgtccggcaactgggccactgcctcgccatggaggagcctaaagggtattactggccctcaattcagcccagcgaatatgtacttccgtgccccgacaaacccgggttctcagcctccagaatctgtttctacaacgctactaatcccctcgtgacgtactggggccctgttgacattagcaactgcctcaaagaggcaaatgaagtggctaaccaaatcctcaaccttacagcggacggacagaatctaacctctgccaatataaccaacattgtggaacaggtcaaaagaatcgtaaacaaagaagaaaacatcgacattaccctcggctccacactgatgaacatattctctaatatcctgtcctcaagcgatagcgatttattggagagttctagcgaggcactcaagaccatcgacgagctggcctttaaaattgatttgaattctactagccatgtcaacatcactacaagaaacctggcgctctccgtgtcctccctgctgcctggcaccaacgccatcagcaactttagtatcggactgccttcaaataatgaatcctatttccagatggactttgaaagcggacaagtcgacccactggctagcgtcattcttccccccaaccttctggagaacttgagccctgaggactccgtactcgtacgtagagcgcagtttacgttcttcaacaaaacagggctgtttcaagacgtagggccacaacggaaaaccctggttagctacgtcatggcctgtagtatcggcaacatcacgatccaaaatttgaaggatcctgttcagattaaaattaaacacacgcggactcaggaggtgcatcaccccatctgtgcgttttgggacctgaataagaataagtccttcggtggctggaatacatcaggttgtgtcgcacatcgggacagcgacgcatccgagacggtctgcctatgtaaccattttacccatttcggagtcctcatggacctgccccgcagtgcgagccagctcgacgctcgaaatacaaaggttttaactttcatctcatatatcgggtgcggcatttcagctatcttctctgcagcaaccctgctcacatatgtggcgttcgaaaaactgcggcgtgattaccccagcaaaatactcatgaatctttcaactgccttactcttcctaaatctgctattcctcctggatggctggattacaagctttaacgtggatggactgtgcatcgctgtggcagtgctcctccacttctttttactggctaccttcacatggatgggactggaagccatacacatgtacatcgcgcttgtgaaggtctttaatacctatatccgaaggtacattctcaaattctgtattataggctggggtctgcctgcactggtggtctccgtggtgctggccagtcgtaataacaacgaggtgtacggcaaagaaagctacgggaaggaaaagggagacgagttctgttggatccaggatccagtgattttttacgtcacttgcgctggttattttggcgtgatgttctttctgaacattgccatgtttatcgtggtgatggttcaaatttgtggccggaacggaaagagatccaatagaacattacgtgaagaggtcctgaggaatctaagatcagtagtgagtctgacatttctcttgggaatgacatgggggttcgcatttttcgcttggggtcctttaaacatccccttcatgtacctattcagcatctttaattcactgcaggggctatttatctttattttccactgcgcgatgaaagagaatgtgcaaaagcagtggcgacaacacctgtgttgcgggcggttcaggctggcagataacagcgactggtccaagacggccacaaacattattaagaaaagctctgacaacctgggcaagagcttgtcttcaagctccataggctccaacagtacatacctcacctcaaaatcgaagagctcctccaccacctactttaaacgcaatagtcataccgattctgccagtatggacaaatctctgtcaaagctagctcacgcagacggcgaccaaacgagcattattcctgtacaccaggtcatcgacaaagttaagggttattgcaacgctcactccgacaacttctataagaatataatcatgagcgacacattctcccattctactaagttctag

SEQ ID NO: 188577 - DNA, 2394 bp, Artificial Sequence
  Description of Artificial Sequence: Synthetic coding sequence
atggccagctgccgggcctggaacctgcgggtgctggtggccgtggtgtgtggccttttgacgggaatcatacttggattgggaatttggaggattgtgattaggatccagcgaggcaagtctacaagctcctcatctaccccaaccgagttttgtcgtaacggggggacctgggagaacgggcggtgcatctgcactgaggagtggaaggggcttcgctgtacaatcgcaaatttctgcgagaatagcacctatatgggctttaccttcgcacgcatccctgttggacgatatggcccctctttacaaacatgtgggaaagataccccaaatgccgggaatccaatggcagtacggctgtgctccctcagtctgtacggcgaaatcgagctccagaaggtgacgatcggaaactgcaacgaaaaccttgaaactctggagaagcaggtgaaagacgtgaccgcacccctgaacaacatttcctctgaagtccaaatcctgactagcgacgctaacaaactgactgcggaaaacattactagtgcgacccgcgtcgttggtcagatttttaacacgagcagaaacgcatctccggaggctaagaaagttgccatcgttacagtgagccagttactcgatgcttccgaggatgcctttcagagagtggcggctaccgcgaacgatgacgcccttaccacgctaatcgagcagatggagacctatagcctgtccctagggaatcagtcagtggtcgagccgaacattgccattcagtctgctaatttctccagcgagaatgccgtcggcccatctaacgtgaggttttctgtccaaaagggcgcaagctcctcactggtgtcctccagtacttttatccatactaacgtggatggactcaatcctgacgctcaaacggaacttcaggtcctcctgaacatgaccaagaactataccaagacctgtggctttgtggtgtaccaaaacgataagctgttccagtcaaagacatttacagcaaagtccgatttttctcagaagatcatctcttctaagaccgatgaaaacgaacaggatcagtcagcttctgtggatatggtgttttccccgaagtacaaccagaaagagtttcaactgtactcttatgcctgcgtgtattggaacctgtccgcaaaagattgggatacatacggctgtcagaaggataagggaactgatgggttcctgcgctgccggtgcaaccacaccaccaacttcgccgtattaatgacttttaaaaaagactaccaataccctaagtcactggacatcctttcaaacgtgggatgtgcattgtcagtgacaggactggccctgactgtgatcttccagatagtgacacggaaggtgagaaaaacttctgtgacatgggttctcgtgaatctgtgtatttccatgctgatatttaatttactctttgttttcggaattgaaaattctaacaagaatttacagacaagcgacggagacatcaacaatattgattttgacaataacgatatccctcgtactgacactataaacatccctaacccgatgtgcactgcgatcgctgctctgttacactactttcttctggtgacatttacttggaacgccctttcggccgcccagctttattatctgctgatcagaaccatgaaaccactgccaaggcattttatcttgtttattagcctgatcggatggggagtgcccgccatagtcgtggcgattactgttggcgttatatacagccagaatggaaacaacccccaatgggagctggactatcgacaggaaaagatctgctggctggccattcctgagcctaatggcgtcataaagtcccctttgctgtggtccttcatcgtgccagtgacaatcattctgattagcaatgttgtaatgtttatcactatcagtatcaaagtcctctggaagaacaatcagaacctgacctccacaaaaaaggtgtcatctatgaagaaaatagtcagtaccctatcagtggcggtggttttcggtatcacctggatcctcgcttacctgatgttagtgaatgatgactctattcggatcgtcttctcttacatcttttgcctctttaatacaacgcagggcctgcagatctttatcctgtacaccgttcgcacaaaggtttttcagagcgaggcctccaaggtgctgatgctgctctcctcaatcgggcggagaaaatctctgccctcagttaccaggcctaggttgagagtgaagatgtataacttcttgagaagcctccctaccctccacgaacgttttcggctgctcgaaacctcaccaagcactgaagaaataacccttagcgagtctgacaacgccaaagagagcatctag

SEQ ID NO: 188578 - DNA, 1509 bp, Artificial Sequence
  Description of Artificial Sequence: Synthetic coding sequence
atgcccgtgaagatgctgttcaaggagctgctgctgctgctgatgatgatgccattacagcattataccaaaacttgcggatttgtagtgtatcagaacgacaagctcttccagtctaagacatttacagcgaaaagcgacttctcccagaagatcatctctagtaaaacagatgagaacgagcaggatcagtcagcaagcgtggacatggtgttcagccctaagtataatcaaaaagaattccagctatactcatatgcctgtgtctattggaacctcagcgcaaaagattgggacacctacggctgtcagaaggacaaaggtaccgatggcttccttcgatgtcgttgtaatcacactacaaatttcgcagtgttaatgacgtttaagaaggattatcagtacccgaaaagtctggatattttgagcaatgttggatgtgctttgtcagtgactggtcttgcactcacagttattttccagattgtaacacgcaaggtccgaaaaactagcgtgacatgggtactggtgaatctgtgcattagcatgctaattttcaatcttctcttcgtgttcggtatcgaaaattctaataaaaacctgcaaacttccgacggggacattaacaatattgacttcgacaacaacgacatccctcgaacagatacaattaacatcccaaatcctatgtgcactgctatcgccgccctcctccactacttcctcctggtaacattcacttggaacgcactctcagcagcgcagctttactacctcctcataaggaccatgaaaccgcttccccgccacttcattctgtttatcagcctcataggatggggcgtgcccgccatcgtcgttgccattacagtgggcgtgatttacagccagaacggcaacaatccacaatgggagttggattataggcaggagaagatttgctggctcgccatacctgagccaaacggcgtgatcaagtctcccctgctgtggagttttatcgtacctgtgaccataatactgattagcaatgtggtcatgttcatcactatctccattaaggtgctgtggaagaataatcagaatctgacatcaaccaagaaagtctcttccatgaaaaagatagtgagcaccctgtccgtggccgtcgtcttcggcataacctggatcctcgcatatctgatgctcgtcaacgatgactccatacgcatcgtcttttcttacattttttgtctgtttaacaccacgcagggtctgcagatttttatattatacacagttaggacaaaggtgttccaatctgaagcgagtaaggttctgatgttgctttcaagcattggcaggagaaagagcctgccttccgtgacacgccctcgcctgcgtgtcaagatgtataattttctgcgcagcctccccacacttcacgaaagattccggttactagagacatctccttcaaccgaggagatcacgctctccgaaagcgataacgctaaggaaagcatctag

SEQ ID NO: 188579 - DNA, 1143 bp, Artificial Sequence
  Description of Artificial Sequence: Synthetic coding sequence
atgtgccccatgctgctgaagaacggctacaacggcaacgccaccccagtcactacaacagcaccatgggccagcctgggactgtccgccaaaacctgcaacaatgtctcctttgaggaaagccggattgtcctagtggtcgtgtatagcgctgtgtgtacgctcggagtgccagccaactgtctaaccgcttggttggccctgttgcaggtcctgcagggcaacgtgttagcagtgtatttgctatgcctggctctctgtgagctcttgtataccgggacattaccactgtgggtaatttacataaggaaccagcataggtggacacttggcttgcttgcctgcaaagtgaccgcctacatttttttttgcaatatctatgtgtcgatactattcctctgctgtatttcttgtgaccggttcgtcgccgttgtgtatgccctcgagtcccgcgggcgtaggagacgtcggacagctatcctcatcagtgcctgtatttttatcttggtgggcatcgtgcattatccagttttccagacagaagacaaagaaacttgttttgatatgctgcagatggactcacggatcgccggatactattacgcccgcttcacagtgggctttgcgattccgcttagcatcatcgcatttacaaaccatcgcatctttagatcgatcaagcagagcatgggtctatcagctgcccaaaaagctaaggttaaacacagcgccatagcagtagtagtaatctttctggtatgttttgccccataccatctggtgctgttggtgaaggccgcagcattctcctactacagaggcgatcggaatgctatgtgcgggttagaagagcgtctgtataccgcttccgtggtatttctgtgcctgtcaaccgtcaatggggtggccgatcccattatatatgtcctggctactgaccattcccgacaggaagtgtcccgcattcataaagggtggaaggaatggtccatgaagaccgatgtgacgaggctgacacacagccgggatactgaagagcttcagtcacccgtcgccctggccgaccactacacctttagtcgtccagtgcatccacccgggagcccttgccccgctaaaagacttatcgaggagtcttgttag

SEQ ID NO: 188580 - DNA, 1116 bp, Artificial Sequence
  Description of Artificial Sequence: Synthetic coding sequence
atgcccggcaacgccacccccgtgaccaccaccgccccctgggcctctctcggcctgagcgctaaaacatgcaataacgtgtcatttgaagaaagccgtatagtgcttgttgtagtgtactcagccgtgtgtacccttggcgttcctgcaaattgccttactgcctggctggccctgttgcaggtcttgcaggggaatgtacttgcggtctacttattgtgcctggctctttgtgaactgctgtacacaggcactctgcctctctgggtgatttacatcagaaaccagcatcggtggacactaggtctacttgcttgcaaggtgacagcttatatctttttctgtaacatatatgtgtccattctgttcctatgctgtatatcatgcgatcggtttgtcgccgttgtttacgccttagaatctcgaggacgaagaagacggcgaacggctatcttaatttccgcctgtatctttatccttgtcggcatagttcactatcccgtgtttcaaactgaggataaagaaacctgcttcgacatgttacagatggattcacggatagctggctactactatgcacggttcaccgtgggattcgcgattcccctttcaatcatcgccttcaccaatcaccgcatctttcggtccatcaagcagtccatgggcctgtctgctgcccagaaggctaaggtgaagcactcagcgatcgccgtggtggtcatctttctggtctgtttcgcgccttaccacctcgtactcttggttaaggctgccgcattttcatattatcgtggagaccggaacgctatgtgcggcctcgaggagcggctttataccgctagcgtggtgtttctgtgcctgagtacagtcaatggagtggcagatcctatcatctatgtactggccacagatcatagccggcaggaagtgtcgcgcattcacaaaggctggaaggagtggagtatgaaaacggatgtcacacgccttacgcacagcagagacacagaggaacttcaatccccggttgccctggccgatcactacactttttcgcgcccggttcatccaccaggatctccatgccctgctaaaaggctgatcgaagagagctgctag

SEQ ID NO: 188581 - DNA, 1143 bp, Artificial Sequence
  Description of Artificial Sequence: Synthetic coding sequence
atgtgccccatgctgctgaagaacggctacaacggcaacgccacccctgtgaccacaaccgctccatgggcctctctggggttatccgccaaaacctgcaacaatgtttcctttgaagagtcgcgaatagtgttggtggtcgtctacagtgctgtgtgcactcttggtgttcccgcaaattgtctcacagcatggctggccctccttcaggtgcttcagggaaacgttttggccgtctacctcctgtgtttggcgctgtgtgagctcctgtataccggcaccttaccgctctgggtcatctatattaggaatcagcacagatggacactgggactgctggcctgcaaagtaacggcctacatcttcttttgcaacatatacgtgtccatcttgttcctgtgttgcatctcatgtgacaggttcgtcgcggttgtgtatgctttagagagtcgcggccgcagacggagaaggacggccattcttatctctgcttgcatctttattctggtggggatcgtccattacccggtgttccagacagaagataaagagacctgctttgatatgcttcagatggactcccgaatagccggatactactacgcaaggtttactgtcgggtttgcgatccccctgagcatcattgcctttactaatcacaggatttttcgcagcatcaagcagtctatgggtctctcagccgcccagaaagctaaggtcaaacattccgcaatcgccgttgttgtgatattcctggtttgcttcgccccatatcatctggtcctcctggtgaaggccgccgccttcagctattatcgcggggacagaaacgccatgtgcggactcgaagagaggttgtacactgcatccgtggtctttctctgcctatccacggtgaacggcgtggctgatcccataatctacgtgctcgcaaccgaccacagccgtcaagaggtgtcccgaatccacaagggttggaaggagtggtcaatgaaaacagacgtgacaagactgacgcacagtagagacaccgaggagttgcagtctcccgtggccctggccgaccactacaccttctctcgacccgttcatcctccaggttccccatgccctgccaaaagactcatcgaggagagttgttag

SEQ ID NO: 188582 - DNA, 33 bp, Artificial Sequence; identical to SEQ ID NO: 82388
  Description of Artificial Sequence: Synthetic coding sequence

SEQ ID NO: 188583 - DNA, 2625 bp, Artificial Sequence
  Description of Artificial Sequence: Synthetic coding sequence
atggagaagctgctgcggctgtgctgctggtacagctggctgctgctgttctattataattttcaagtgagaggtgtatatagtcggagccaggaccatcccggcttccaggtgctggcctccgcctcacactactggcccttagagaatgttgacggcatccacgagctccaggatactaccggcgacatcgtcgaaggcaaggtgaataagggaatttacttaaaggaggagaagggagttacgttgctatattatggcaggtacaatagtagctgcatctcgaaacccgagcagtgcggacctgagggtgtgacatttagttttttttggaagacccagggggaacaaagccggcccatcccatctgcctatggcgggcaggtgattagtaatggctttaaggtatgctccagcgggggcagaggctctgttgaactatatacacgtgataatagtatgacttgggaagcttcgttcagcccccctgggccatactggacccatgtcctgtttacttggaaatcgaaggagggcctaaaagtgtacgtgaacggaaccctttctacaagtgaccctagtggcaaagtgtcacgcgactatggagagagtaatgtgaacctggtgataggtagtgaacaggatcaggcaaagtgctacgaaaacggcgcctttgatgaattcatcatttgggaacgggcactaaccccagacgaaatcgctatgtacttcacagccgccattggtaaacacgcccttttatcaagcactcttccaagcctgtttatgactagcacggcaagcccggtaatgcctaccgacgcctatcaccccattatcacgaatctgactgaggagcgaaaaaccttccagagtcccggggtgatcctctcctatctgcaaaatgtatccttgtcccttcccagtaagtcgctttctgaacagactgcactcaatttaacgaagacgtttctcaaagccgtcggcgagatcctgttgcttccggggtggatcgctctgtccgaggattctgccgtggtgttgtctctgatcgacaccattgataccgtaatggggcacgtgtcttcgaacctgcacggcagcacgccacaggttacggtcgagggatcctccgcaatggccgagttctccgtggccaagatcctgccaaaaactgtcaacagctcacattacaggttcccagcccacggtcagtcgtttatccaaattccacacgaggcttttcacagacatgcttggtctaccgtcgttggtttgctctaccactcgatgcattactatctcaacaacatctggcctgcccatactaagattgcggaggccatgcaccatcaggactgtctcctgtttgccacgtcacacctgatttctctcgaagtcagccccccccccaccctctcccagaacctgagtggatcaccactgattacagtccacctaaaacatagactgacacgcaaacaacactcagaggccaccaactcgtcgaacagagttttcgtgtactgcgccttccttgatttcagcagcggagagggtgtgtggtctaaccacgggtgtgcgctgaccagaggcaatctgacctactctgtgtgtaggtgtacccatttgacaaattttgcaattttgatgcaggtggttcctcttgagctggcgcgaggacaccaagttgccctgtctagcatctcctatgtaggctgctctttgtccgtgctgtgcctggtggctaccctagtgacctttgcagtgctgtctagcgtgtccacaatccgaaatcagaggtatcacatccatgccaacttaagcttcgctgtgcttgtggcgcaagtgcttctgctgataagtttccgcctcgagcccggcaccaccccctgccaagtgatggccgtgttgctgcattattttttcctgagcgcttttgcctggatgttagttgagggactgcacttgtacagcatggtcattaaagtgtttggtagcgaggacagcaaacatcgatattattacgggatgggttggggattcccccttctgatctgtattatctccctgtccttcgctatggactcatacggtacatccaataactgctggttgtcacttgccagcggcgctatatgggccttcgttgctccggcactgtttgtcattgtggtgaacatcggcatactcattgccgttactagggtgatcagtcaaatttccgctgacaattacaagattcacggcgaccccagcgcatttaagctcacagccaaagctgttgccgtgctgttgcctatcttgggcaccagttgggtttttggcgtgctggcagtcaatggttgcgctgtagtgttccagtacatgtttgcgactctcaacagtctgcagggcctgttcattttcctgtttcattgtctgctgaatagcgaagtcagggcagcctttaaacacaagaccaaggtatggtcactgaccagctcaagcgcgcgaactagcaatgccaagccctttcactccgatttgatgaacggcacaaggcccgggatggcttctactaagctcagtccttgggataagtctagtcattccgcccatagagtggatctttccgcagtctag

SEQ ID NO: 188584 - DNA, 687 bp, Artificial Sequence
  Description of Artificial Sequence: Synthetic coding sequence
tgacacggcgtgagcgcccgggacgtgctggagagccggacccggaagcagcattctgaggcaacgaattcttctaaccgagtgtttgtctattgcgcttttcttgacttctcatcaggggaaggcgtgtggtccaaccacggctgcgcgctgacacggggtaacctcacctactccgtgtgtcggtgcacgcatctgaccaactttgccatcctcatgcaggtcgtgccactcgaggtaaatattggaatcctcatcgcagtgactagagtaatttcacagatctccgcagacaactataaaatacatggggacccctctgcttttaaactgaccgcaaaagctgtcgccgttctgttgcccatccttggtaccagctgggtgtttggcgtgctcgccgtcaatggttgtgctgttgtgttccagtacatgttcgcaactctaaacagcctacaagggttgttcatatttctgtttcattgtctcctcaactccgaggtcagagctgcctttaagcacaagaccaaggtctggtccctcacgtcctcatccgcgcggacatcaaatgccaaaccattccactccgacctaatgaatggcacgcgtcctggcatggcatctaccaaattgagcccttgggataagagttctcattctgcccatcgggtggacctcagtgcagtgtag

SEQ ID NO: 188585 - DNA, 2721 bp, Artificial Sequence
  Description of Artificial Sequence: Synthetic coding sequence
atggagaagctgctgcggctgtgctgctggtacagctggctgctgctgttctactataattttcaggtgcgaggggtgtactcaaggagccaggatcatcctggatttcaggttctcgcatcagcgtctcactattggcccctggagaatgttgacgggattcacgagctgcaggacacgaccggggcttctcgaacacacaagctaacggtcctcccttcgcgtaatgccacgttcgtgtactcaaatgactctgcctacagtaacctcagtgccaccgtggacattgtcgagggaaaggttaataaaggcatatatctgaaggaagagaaaggagttactctcctgtattatgggaggtataacagctcctgcatttctaaaccggagcaatgcgggccggagggtgtcacctttagcttcttctggaaaactcagggcgagcagtcccgcccaatccccagcgcctatggcggccaggtaatctcaaacggtttcaaagtgtgttcttcaggcggtaggggtagtgttgagctttatacacgtgacaactcaatgacatgggaggctagtttttccccgcctggaccttattggacccacgtgctctttacatggaaaagtaaagagggactcaaggtttacgttaacggtacactatcaacttctgaccccagcggaaaagttagccgcgactacggagagagcaacgttaacctggtgatcggatctgagcaggatcaagcaaaatgttacgaaaacggcgccttcgacgagtttatcatctgggagcgcgccctgactccagacgaaatagcaatgtactttaccgcagccattggaaagcatgccctgttaagttctacactccccagcctgtttatgacctccacagcgtcaccggtgatgccaaccgatgcataccaccctattattactaacctgactgaagagaggaaaaccttccaatctcctggcgtgattctcagttacctgcagaacgtatccctgtctctgccctccaagtctctgagtgagcagactgctctgaacttgacgaaaactttccttaaagccgtgggggagatactgctgctcccaggctggattgccttatctgaggattctgctgtagtgctaagcctgattgatacaattgacactgtgatgggccatgtttccagtaatctgcacgggagcacaccccaggtcacagttgagggaagctccgcaatggccgaattcagcgttgccaaaatcctgccgaaaaccgtgaattcatctcactacagattcccagctcacggccagtctttcattcagatcccgcatgaggctttccacagacacgcctggtctaccgtagtaggcctcctctaccattctatgcactattacctgaataacatatggccagctcataccaaaatcgccgaggccatgcaccaccaggattgcctgctatttgctacaagccatctgatctctctcgaagtctccccccctccaaccctaagccagaatctgtccgggtcccctttaatcaccgtgcatttgaaacaccgactgacacgcaagcagcactctgaggcgaccaatagctccaatagagtgttcgtgtactgcgcctttctggacttctcgagcggagaaggcgtgtggtccaatcacgggtgtgcactaacacggggcaatttgacatatagtgtctgtagatgcacccatctgactaattttgccatcctcatgcaggttgtacctctggaactcgcaagaggtcaccaggtggccttgtcctctatttcttacgtaggatgcagtctgagcgtgctttgcctcgtcgctactctcgtcaccttcgcggtgctctcctccgtttctacgattcgcaatcagcgatatcacatacatgctaatctttcattcgcagtgttggtcgcccaggtcctgttgttgatttcattccgactggagccagggacaacaccatgccaggtaatggcggtattgctccattatttttttttgtccgcattcgcctggatgctggtggagggtcttcatctgtactccatggtaataaaggtttttgggagcgaggattcaaaacaccgctattattacggtatgggatggggatttcctctgctgatctgcatcataagcctgtcattcgccatggatagctatgggacatccaataactgttggctttccctggcctctggcgcaatctgggcattcgtagccccggcactattcgtaattgtggtgaacatcggcattctgattgccgtgactcgggtcatctcccaaatatccgccgacaattataagattcatggtgacccctctgctttcaagctgaccgctaaagctgtggcggtgctactcccaatcctggggacaagctgggtattcggcgtcctggcggtcaatggctgcgctgtagtgttccagtacatgtttgccaccctgaattccctccagggcctgtttatcttcttgttccattgtctcctgaattccgaagtcagagccgcatttaaacacaagacaaaagtgtggagcttaaccagctcgtccgctagaacgagtaacgccaaacctttccattcagatctgatgaatggcacgagacccggaatggcatctactaagctgtcaccctgggacaagtctagccactcggcacatcgtgtcgatctttccgccgtgtag

SEQ ID NO: 188586 - DNA, 1275 bp, Artificial Sequence
  Description of Artificial Sequence: Synthetic coding sequence
atgacccaggccggccggcggggccccggcacccccgagccccggcccaggacccaacccatggcatctcctcgactggggacattttgttgccctaccagagacgctgccacgcaattggttctgtccttccagccccgagcctttcacgccctatgcctcggcagcggtggcctgaggctcgctttggggctgttacagcttctccccggacgtcgaccagcagggcctgggtcgcccgccaccagcccccctgcctcagtgcggatcttgcgcgccgccgccgcttgcgacttgctagggtgtctgggcatggtaatccggtctacagtgtggcttggctttccgaattttgttgactccgtgagtgatatgaaccacactgaaatctggcctgccgccttctgtgtgggtagtgcaatgtggatccagctcttgtacagcgcctgcttctggtggctgttctgttacgcagtggatgcttatcttgtcataaggaggagcgctggcctttcgaccattcttctctaccacatcatggcctggggcctcgccaccctgttatgtgttgagggcgcagcaatgttatactacccatcagtttcacgctgtgaaagaggtctggaccacgccattccccactatgtcacgatgtatttgccactactcttagtgctggtcgcgaaccccatactctttcagaaaacggtgaccgcagtcgctagcctacttaaaggccgccaaggcatatacactgagaatgagagacgaatgggggccgtcatcaagattagattcttcaaaataatgctcgtgctaattatctgttggttatccaatattatcaacgagtcactgctattttacttagagatgcaaactgatatcaatggcggctccctgaagcctgtcaggactgcggcgaaaaccacatggtttattatgggcattctaaaccccgcccaaggttttttgttgagcttagccttctatggctggactggatgtagcctaggttttcagtcaccacggaaggagatccagtgggaaagccttacaaccagcgcagcagagggcgctcaccctagcccactgatgccgcacgagaatcctgcctctggcaaagttagccaggtcggaggtcaaacttccgatgaggcactgagcatgctatctgagggctctgatgcctctaccatcgaaatacacaccgcctcggagtcatgtaacaagaatgagggcgacccagccctccctactcacggcgatctgtag

SEQ ID NO: 188587 - DNA, 516 bp, Artificial Sequence
  Description of Artificial Sequence: Synthetic coding sequence
atggtgatccggagcaccgtgtggctgggcttccccaacttcgtggattcagtgtctgacatgaaccacacggaaatctggccagcagccttttgcgtgggctcagctatgtggattcagttactttatagtgcttgcttctggtggctgttttgttatgccgtcgatgcctacctcgttatccgcaggtccgctggtctcagcaccatacttctctatcacatcatggcttggggtcttgcaaccctgctgtgcgttgaaggggcagcgatgctgtactacccaagtgtgtctcgatgcgagagggggttggatcacgccattccacactacgttactatgtacctccccctactcctagtgctcgtagccaaccccattctttttcaaaagacagttaccgctgtcgccagtttgctgaagggaagacaagggatctacactgagaatgaaagacgaatgggtgccgtgatcaagatccgatttttcaaaatcatgctggtgctcattatctag

SEQ ID NO: 188588 - DNA, 864 bp, Artificial Sequence
  Description of Artificial Sequence: Synthetic coding sequence
tgaaccgccggccccgtgaccggcagcgccagccggggccccgcccgcggcccgaaaggcatggtcattaggagtacagtctggctcgggtttcctaacttcgttgacagcgtgtcagatatgaatcacactgaaatttggcctgccgcattctgtgtgggctctgccatgtggatacagctgttgtattctgcctgtttctggtggctcttttgttacgcggtggacgcctacttggtgatccgccgcagcgccggactctctaccattttgctgtaccatatcatggcctgggggcttgccacactcctgtgcgtggagggggccgccatgctgtattacccttccgtgagtaggtgcgagcgtgggttggatcatgccataccacactacgtgactatgtatttgccgctgcttttggttctcgtggccaatccaattctgttccaaaaaacagtaacagccgttgcatccttgctcaaaggaagacagggaatctacaccgaaaatgagaggcggatgggggcggtcatcaaaatccggttcttcaaaataatgctggtgttaattatctgctggcttagcaatatcatcaacgagagtttgcttttttacttggaaatgcagactgacatcaacggcggctccctcaaacctgtgagaaccgctgccaaaacaacttggttcatcatggggatcctgaatccagcccagggatttctgttaagcttggccttctacggctggacaggctgtagtctgggttttcagagcccccggaaagagatacagtgggagagcctaactacaagcgcagcagaaggcgcacacccatcccccctgatgccacatgaaaacccctag

SEQ ID NO: 188589 - DNA, 1215 bp, Artificial Sequence
  Description of Artificial Sequence: Synthetic coding sequence
atggccagcccccggctgggcaccttctgctgccccacccgggacgcagccacccagctggtgctctctttccagcctcgcgcctttcacgcgttgtgtttgggttcggggggcttaaggctcgccctgggtctcttacagctgttaccaggtcgccgtcctgccggcccaggatcaccggcgacaagtcctcctgcctcagtacgcatcctgcgcgcggccgccgcttgtgacctgctcggttgcctgggaatggtaataaggtccacggtctggctgggttttccaaactttgtggacagtgtgtcagatatgaaccacactgaaatttggcctgccgccttctgtgtaggcagcgcgatgtggatacagttgctctacagcgcttgtttctggtggctgttctgttacgccgtcgatgcgtatcttgtgatccgtaggagcgctggtctgagcaccattttgttataccatatcatggcatggggcctggcaaccttactgtgtgtggagggtgccgccatgttatattacccttcagtgtctcgttgcgaaagaggactggaccacgcaattcctcattatgtaacaatgtacctgcccctcctcctggtgctggtggctaaccccatcctgtttcaaaaaaccgtaaccgccgtcgcgagcctgttaaaagggcggcaaggcatctatacagagaacgagaggcgcatgggagccgttattaagatccgattttttaaaattatgttagttctgattatctgctggctatccaatattattaatgaatctctgctgttttacttagaaatgcagactgatattaatggaggaagtttgaagcctgtgcgaacagccgccaaaactacttggtttataatgggcatcctgaacccagcgcaagggttcctgttaagtctggccttctacgggtggacagggtgctcactcggcttccaatctcccaggaaagaaatccaatgggagagtctaaccactagcgcagcggaaggcgcccaccccagccccctgatgccacacgagaaccccgcttcagggaaggtctcccaggttggcggacagaccagcgacgaagccttgagcatgctgagtgaagggagtgacgctagcacaatagagatccacacggcctccgaaagctgcaataaaaatgagggggatccagccctccctacgcacggagatctgtag

SEQ ID NO: 188590 - DNA, 1083 bp, Artificial Sequence
  Description of Artificial Sequence: Synthetic coding sequence
atggaccccgaggagaccagcgtgtacctggactactactacgccacttctccgaatagcgacatcagggaaacacattcccacgtgccctacacatccgtctttttacctgtgttttataccgccgtctttctaaccggagttctaggtaatctggtgctgatgggcgccctgcactttaagcctgggagccggagacttatagacatcttcataatcaatctcgctgcttctgattttatcttcctcgtgaccctgcctctttgggtggataaagaggcgtcactcggcctctggcggactggatctttcctctgcaagggttcatcttacatgatttcagtaaatatgcattgctccgtcctgttgctgacatgtatgtcggtggatagataccttgccattgtttggccagttgtcagtagaaaatttcgccgcacagactgtgcatacgtggtttgcgcgtctatttggttcatttcctgcctgctcggtttaccgacgctcctgagtagagagttaaccctgatcgatgataaaccctattgcgcggagaagaaggctacacctattaagctgatctggagcctagtggctcttatttttactttctttgtgccactactgtctattgtgacctgctactgttgtattgctagaaaattgtgtgcccactaccagcagagtggtaagcataacaaaaaactgaaaaagtcaatcaagatcatatttattgtggtggcagcttttctcgttagctggctcccctttaatacatttaaattcctggctatcgtatctggactgcgccaggaacattatctcccctccgccatcctccagcttgggatggaggtttccggccctttggcatttgccaattcttgtgtgaacccatttatctattacattttcgactcctacatcaggcgggcaatagtgcattgcctgtgcccttgtctgaaaaattatgactttggcagcagcaccgagacgtctgactctcacctgaccaaagccctgtcaacatttattcatgcagaagacttcgcacgccggaggaagcgttccgtttctctgtag

SEQ ID NO: 188591 - DNA, 1830 bp, Artificial Sequence
  Description of Artificial Sequence: Synthetic coding sequence
atgagcgacgagcggcggctgcccggcagcgccgtgggctggctggtttgtggagggttgtcactgttagctaacgcatgggggattctgagcgtgggcgcaaaacagaaaaaatggaaacctctagagtttctgctctgcaccctggctgctacccacatgttaaacgtagccgtgcctatagctacatatagtgtggtgcagttgaggcgccagaggccagacttcgaatggaacgagggtctgtgcaaagtctttgttagcaccttctataccttgacactggctacgtgttttagcgtaacgagcttgtcttaccatcgcatgtggatggtgtgttggcctgttaattacaggttgtcaaatgccaagaaacaggccgtgcacacggttatgggtatatggatggtgtcttttatcctatccgctctacctgctgtgggctggcacgacacatcagagaggttttacactcacggctgccgctttatcgtagccgaaatcggactgggcttcggcgtgtgctttctgctcttagttgggggcagcgtggctatgggagtcatatgtacagccattgccctgtttcagaccctcgccgtccaggtcggaagacaagccgacaggagggcattcaccgtgcctaccattgtcgtggaggacgctcaaggcaaaagaaggtctagcatcgatggctcagaacccgcaaagacaagcttgcaaactacaggacttgtgaccacaatcgttttcatttatgactgccttatgggctttcctgtgttggtggtgagcttcagttccctgcgggctgatgcctcggccccctggatggccctgtgtgttctttggtgcagcgtggcccaggccctgcttctgcctgtctttctctgggcctgtgataggtacagggccgacctcaaagctgtgcgggaaaagtgcatggcattgatggccaatgacgaggaaagcgacgacgagacctccctagagggcgggattagtcccgacctggtccttgagcgtagcttagattacgggtatgggggggattttgtagcactggaccgcatggccaagtatgaaatttctgccctggaggggggacttcctcagctgtaccccctgaggcctttacaggaggataaaatgcagtatttgcaagtgcccccaactaggagatttagtcacgatgatgccgacgtctgggctgctgtaccgctccctgcgtttctcccaaggtggggctccggggaagatctggcggcccttgctcacttagtcctgccagcgggccctgagcggaggcgcgccagtttactggcgttcgccgaggatgcacctcccagtagggcacgtcgcaggtctgcggaatcgctgttaagtctgaggccgtctgcgctggactccggtcccaggggtgcccgggatagcccacctggcagccctcgccgccggcccgggccaggcccccgctcggcttcagcaagcctcctccctgacgcctttgccctaacagcatttgaatgcgagcctcaggccctgaggcggcctcccggtccgttccctgctgcacctgcagcacctgacggagcggaccctggcgaggctcctactcccccatcctctgcccagcgcagtccgggaccgcggccttcagctcactcccatgctggctctcttaggcccggcctgtcagcctcttggggagagcccgggggcctgagggccgcaggcggaggcggctcaacatcaagcttcttatctagtccttccgaatcctcaggctacgccacactccactccgacagtctaggaagtgctagttag

SEQ ID NO: 188592 - DNA, 2445 bp, Artificial Sequence
  Description of Artificial Sequence: Synthetic coding sequence
atggagcccgagatcaactgcagcgagctgtgcgacagcttccccggccaggaattggaccgtcgtcctcttcacgacctgtgtaagacaactattactagtagtcaccacagtagcaaaacaatcagcagcctgagtcccgtcctgctggggatagtgtggacattcctttcttgtggactgctgctgatactgttctttttggcgttcactatccattgtcgaaaaaacagaatcgttaagatgtcatcccctaacctgaatattgtgaccttgcttgggtcttgcttgacatattcttccgcctacttgttcggaatccaagatgttctggtaggatcttccatggaaactttgatccagacacgactgtccatgctttgcattggaacaagcctagtctttggtcctatcctggggaagagttggcggctgtataaagtcttcactcagcgggtccctgataaacgcgttattattaaggacctgcagctgttaggcctggtggccgcactgttgatggctgatgtgatccttttaatgacatgggttctcactgatcccatccagtgcctgcaaattcttagcgtgtctatgaccgtgaccggcaaggacgtctcttgtacctcaactagcacccacttttgtgcttccaggtatagtgacgtgtggatagcactgatctggggatgcaaaggattgctcctgctgtatggggcctatctggcaggcctgactggccacgtgtcaagtcctcccgtcaatcagtcattaacgataatggtcggggtgaacctactggtgctggcggcaggcctgttgttcgttgtgacaagatatctgcacagttggccgaacttggtgtttggcttgacttccgggggcatcttcgtttgtactaccacaattaactgcttcatttttatcccacaattgaagcagtggaaggcctttgaggaagagaaccagacaatcagacggatggccaagtatttttccacccccaataagtcattccacacccaatacggcgaagaagaaaactgtcacccgcgcggcgaaaaaagctcaatggagagattgctgactgaaaagaatgctgtgattgaatcactgcaggagcaggtcaacaacgctaaagagaaaatcgtccggctcatgtccgccgagtgtacgtacgacctgcccgagggagcagcgccccctgccagttccccgaataaagacgttcaagcggtagcctccgtgcatacgctcgctgcagcccagggacccagcggccacctgagcgattttcaaaatgatccaggaatggctgctcgcgacagccagtgtacgtccgggccaagctcatacgcccagtccctggaagggcctggcaaggactcctcattctcaccaggcaaggaggagaagatttctgactccaaggatttttctgatcacttggattcaggctgcagccaaaaaccttggaccgagcagagtctggggccagagcgaggcgaccaggtgccaatgaatccctcgcaatcactgctgccagaacgcgggggcagtgatcctcaacgccagcggcacctggaaaactccgaagaaccgcctgagcggaggagccgcgtaagttccgtcatcagggaaaagctccaggaggttcttcaggatcttggtctcggacccgaagcctcattgtcgacggctcctagttgccatcaacagacctggaaaaactccgcagccttcagtccacaaaagatgccgctatctaaggaattggggttctcaccctacatggtgcgcagaaggcgcgcggctcagcgcgcacggagccactttcctggaagcgccccaagtagtgtgggtcacagagctaatcgcaccgtacctggagcacattctagattacacgtccagaatggcgattcgccctccttagccccacaaaccactgactcccgagtgaggcgaccctcttcacgtaaaccgagtctcccaagcgacccacaagaccgccctggaacactcgagggctcaaagcagagccagaccgagccagaaggtgcacggggtagcaaagccgctttcctcagacagccgtccggctcaggccgggctccctctcctgccgccccctgcctttccaaagccagcccggatctccctgagcagtggcagctctggcctcctgtgcccagtggttgtgctagcttaagtagccagcactcttactttgacactgaatcttcttcttctgacgagttcttctgccgttgtcacagaccctattgcgagatctgcttccagtcctcctctgactcgtcagatagcggtacttccgatactgatccggagcccacagggggcctcgcatcttgggagaagttgtgggctcgcagcaaacctatagtaaatttcaaagatgacctgaagcccactctcgtttag

SEQ ID NO: 188593 - DNA, 2445 bp, Artificial Sequence
  Description of Artificial Sequence: Synthetic coding sequence
atggagcccgagatcaactgcagcgagctgtgcgacagcttccccggccaagaattagaccgccgccccctgcatgatctatgcaaaactactataacctcttcccaccacagctccaaaaccatttcatctttatctcccgtgctccttgggattgtatggacatttctaagctgtggcctgctgctgatcctttttttcctcgcttttactattcactgtagaaagaatcggatcgtgaagatgagttcacctaatctgaacatcgtgaccctgctgggatcctgtcttacttactcttctgcttatctgtttggtatccaggatgtcttggtaggctcgtcaatggagaccctcatccagaccaggctgagcatgctttgtatcggcacaagcttagtgtttggacccattctgggcaaaagctggagactttataaagtattcacacaacgagtgcccgacaaaagggtgatcataaaggaccttcagctgctcgggctagtggccgccctcttaatggccgacgtgattctgctgatgacatgggtgctgactgaccccattcagtgcctgcagatcctctccgtgagcatgacagtaaccggcaaggacgtctcctgcacaagcacatccacccatttttgcgcaagccgttacagtgacgtttggatcgcactgatctggggatgtaaaggtctgcttcttctatatggcgcatacctagcaggactgactggacacgtttcttcgccacctgtgaatcagagtctcacaatcatggtgggcgttaacctgctggtgcttgcagctggcctcctgtttgtggtgactcgatatttacattcctggcccaacctggtttttggactcaccagtggcggcatctttgtgtgcaccacgacaatcaactgttttatcttcatccctcagctcaaacagtggaaggcatttgaagaggaaaatcagacaatacggagaatggccaaatacttctctacaccaaacaaatccttccacacccagtacggagaagaagaaaactgccatccccgtggcgaaaaatcttctatggagaggttgctgacggaaaaaaacgccgtcatcgaatccctgcaggaacaggtcaacaacgccaaggaaaaaatcgtgcgcttaatgagcgcagaatgcacctatgatttgccagaaggcgccgcccctccggccagttcccccaacaaggacgtccaggcggtagcatcggtgcatactcttgctgctgctcagggcccctcaggccacttgtcagatttccaaaatgatcctggaatggccgctcgcgattcccaatgtacgagcggcccaagctcttacgctcagtcgctcgaaggtccagggaaagacagcagttttagccctggaaaagaagaaaagatcagcgactcaaaggatttctccgaccatttggactcaggatgtagtcaaaaaccatggacggagcagtccctcggacccgagaggggggaccaagtgccaatgaacccaagccagtccctgcttccagaacgcgggggatccgatcctcagaggcagcgtcacctagagaacagcgaggagccccccgaacgaagaagccgcgtgtcgtcggtgatcagggagaagcttcaggaagtgctccaagacctgggcctaggccccgaggcttcactgtccactgcaccttcctgtcaccagcagacctggaagaatagtgccgccttcagtccacagaagatgcccttgtccaaggagcttggcttctccccctatatggtccgcagacggagagctgcacagcgtgcccggtcccacttccctgggtccgctcccagttcggtgggccaccgagctaacagaaccgtacctggagcacacagtcgcctccacgtccagaatggcgactctcctagcctggcaccgcagactactgactccagggtcagacgaccaagtagtcggaagccttccctccccagcgatcctcaggacagaccaggcacccttgaaggctcgaagcagtcacagaccgaacccgaaggggctagggggtccaaggccgccttcctgagacagccgagcggcagcggtagggcaccaagtcctgccgccccgtgcctctccaaagctagccctgacttgcccgagcagtggcagctttggcctccagtgccaagtggatgcgcatctctttcctcgcagcacagttattttgatactgagtcgtccagcagtgatgaattcttctgcagatgccaccgtccttattgcgagatctgttttcagagctcttcagatagctcagactctgggaccagcgacacagacccggagcctacggggggcctcgccagttgggagaagttatgggctaggtccaagccaatcgtcaactttaaggacgatctgaaacccactctcgtgtag

SEQ ID NO: 188594 - DNA, 2433 bp, Artificial Sequence
  Description of Artificial Sequence: Synthetic coding sequence
atggagcccgagatcaactgcagcgagctgtgcgacagcttccccggccaggagctggatcgtcgaccgctgcatgacctttgcaaaacgaccatcacctcttcccatcattcctctaagactatctctagcctctcgcccgtactcctggggatcgtttggacctttctaagctgcggtctccttctgattcttttcttccttgcttttactatacattgcaggaagaacagaattgtgaagatgtccagtcccaacctgaacatcgtgaccttactcggatcttgtctaacttattcgtccgcttacctgtttggaattcaagatgtgttagtgggctccagcatggaaactttaatacagacccgattgagcatgctctgcatcggaacatctttagttttcggtccaatccttggcaagtcatggagactctataaggtcttcacccaaagggttcctgataagagggtgatcatcaaagacctgcaactgctcggattagtggctgctctgctcatggcagatgtgatcctactgatgacctgggttcttactgatcccattcaatgccttcagattctttcagtcaccggaaaagatgtctcttgcactagtacctccactcacttttgtgccagtcgatatagcgacgtgtggattgccctgatttggggttgcaaaggattgttgttgctgtacggggcgtatctggcggggctaacaggtcatgtatcctcccctccagtgaaccagtccctgacgatcatggtgggtgtgaacttgctggttcttgccgctggtctcttattcgtggttacccggtacctccacagctggcctaaccttgtgttcgggctaacatcaggtggaatcttcgtctgcacgaccacaataaattgtttcatatttataccacagttgaagcagtggaaggccttcgaagaagagaatcaaaccattcgcagaatggccaagtacttctccacccccaataagagttttcatacacagtatggtgaggaggagaactgtcacccaagaggagagaagtcgtcaatggagcgattgcttacggagaaaaacgccgtcatagagtctctccaggaacaggttaacaatgctaaagagaaaatagttagactgatgtcggccgaatgcacatacgatctccctgaaggcgccgcgccacctgcctcctcacccaataaagatgtgcaggcagtcgcctccgtgcacaccctggcagccgcccagggaccttctggccacctatcagactttcagaacgaccctgggatggcggccagggacagccagtgcactagcggtcccagttcatatgcacaatcccttgaaggacctggtaaagattcttcattctctccaggcaaagaagagaagatttcggactccaaggactttagcgaccatcttgactcaggatgcagccaaaaaccttggaccgagcagtctcttggccccgagcgcggtgaccaagtacccatgaatccctcccagtcgttgctccccgagcgcggcggcagcgaccctcagcgacagcgccacctggagaactccgaagagccccctgagcgtcgcagtcgagtgtcctctgttattcgagagaaactgcaggaggtgcttcaggacttggggctgggacccgaggctagcctctcgacagcgccatcgtgccaccaacaaacatggaaaaattccgccgcctttagcccccaaaagatgcctttgagcaaggagctggggttcagtccctatatggtgagaagaaggagggcggcacagagagccagaagtcattttcccgggtccgccccttccagtgttgggcaccgtgcgaaccgcaccgtccccggggcccattcgcgactacacgtccagaatggggacagccctagcctagccccccagaccaccgactcacgggtcagaaggcctagcagccggaagccatccttacccagtgatccgcaggatcgacccgggacattggagggcagcaaacaatcgcagacagagcccgagggcgcgcgaggctcaaaagcggcgtttctcagacagccgtctggcagcggccgcgccccttcgcccgcggctccttgcctgtcaaaggcctcccccgacctcccagagcaatggcagctatggccacctgtaccctccggatgtgcctccttaagtagccagcattcctacttcgacaccgagagttccagtagtgacgaatttttttgccgttgccatcgcccttattgcgagatttgcttccagtcatccagtgacagctcagattctgggacctcagatacagacccagagccaacaggaggtctggcctcatgggagaagctctgggccagaagcaaaccaatcgtaaattttaaggatgaccttaagcccacactcgtgtag

SEQ ID NO: 188595 - DNA, 1590 bp, Artificial Sequence
  Description of Artificial Sequence: Synthetic coding sequence
atgagcctgaacagcagcctgagctgccggaaggagctgagcaaccttaccgaggaggagggaggcgaagggggggtcatcatcacacaattcattgcaatcattgtgatcactatcttcgtgtgtttggggaacctggtaatcgtggtgaccctctacaaaaagtcttatttattaacattgtccaataagttcgtgttctcccttaccctgagcaacttccttctgtcggtccttgtcctgccatttgttgtcacttcgtcaatccgtagagaatggatttttggcgtcgtttggtgtaattttagtgctctcctgtatctcttaatcagttctgccagtatgttaaccttgggcgtcatcgccatcgatagatattatgcagtgctataccccatggtgtacccaatgaagattaccggcaaccgcgcagttatggctctggtctatatatggctccactcactcatcggttgcctcccccctctgtttgggtggagcagcgtagagttcgacgagttcaaatggatgtgtgtggccgcttggcaccgggagccggggtacactgctttttggcagatatggtgcgcgttgttcccatttctagtgatgctcgtgtgctatggcttcatatttagggtggcaagagtgaaagctcgtaaagtccactgcggcacagttgttattgtggaagaagatgcccagagaacgggacggaagaatagtagcacatccacgagcagctcaggaagccgacgtaacgccttccagggagtggtatactctgcgaaccagtgtaaggcactgatcaccattctcgtcgttctcggagccttcatggtgacttgggggccttatatggtggtgattgcctctgaagctctgtggggcaaaagttcggtctcaccgtcactagagacttgggccacatggctgtcttttgcaagcgctgtgtgtcatccattaatctacggcctgtggaataaaactgtacgaaaagaactgctgggaatgtgcttcggcgacagatactatagggagcccttcgtccagcgccagcgtacatcccggctttttagcataagtaacagaatcaccgacctaggcttaagcccccatctgacagcactgatggctggaggccaaccgctcgggcactcctccagtacgggcgacacaggtttctcgtgctcccaagatagtggaaccgatatgatgctgctggaggattacacaagtgacgacaaccctccgtctcattgcacctgtccgcctaagaggcggtcgtcggtgacattcgaagacgaagtcgagcagattaaagaggctgccaagaactcgatcctgcatgtcaaagcggaagtgcacaagtccctggacagttacgcagcttcccttgctaaagccattgaagccgaggccaaaatcaatttatttggggaggaggctctgccaggcgtcctggttaccgctagaacagtgcccggaggtggtttcgggggccgcagagggtcaaggaccctggtgagccaaagactgcagcttcagtctatcgaggaaggcgacgtcttggctgctgagcagaggtag

SEQ ID NO: 188596 - DNA, 1590 bp, Artificial Sequence
  Description of Artificial Sequence: Synthetic coding sequence
atgagcctgaacagcagcctgagctgccggaaggagctgagcaacttgacggaagaggagggcggtgagggaggcgtgattatcacacagtttattgcgattatagtgatcacgatcttcgtgtgtctaggtaacctggtcatcgtggtgacattgtataagaagtcttaccttctcactctgagtaataaatttgtgttcagcctcaccctatctaactttctgctcagcgtgctggtactgccgttcgtggtgactagcagtatccgcagggagtggatattcggggtagtctggtgtaacttctctgctctactgtacttacttatatcctcggcctccatgctcactctcggcgtgattgctatagaccgctattatgccgtactctatccaatggtgtatcctatgaagatcactgggaacagagccgtcatggcgctcgtctacatatggctgcattcacttattggttgcctgccaccgctgtttggctggtctagtgtagaatttgatgaatttaaatggatgtgcgtggctgcatggcaccgcgagcccggctacaccgcattctggcaaatctggtgcgctctttttcccttcctggtgatgctcgtttgctacgggttcatcttccgtgtggcgagagtcaaagctaggaaggtgcactgtggaactgtagtgatagtcgaggaggatgctcaacggaccggaaggaagaattctagcactagcaccagttcttccggctctcgtcggaacgccttccagggagtcgtctattccgctaaccagtgtaaggctctgattactatccttgtggtgctgggagctttcatggtgacatggggcccctatatggtggtgatagccagcgaggcactatggggtaaatcgtccgtgagtccatccctagaaacttgggctacttggctgtcattcgcctccgctgtgtgtcatccacttatttacggcctctggaataaaacagtccgaaaggagctgctgggtatgtgttttggggaccgatattacagggagccgttcgtgcaacggcagcggaccagtcgcctcttcagtatcagcaacagaattacagacctgggcttatcgcctcatcttaccgctctaatggctggcgggcagccgctcggccactctagttcgaccggggatacaggattctcatgtagccaggactccggcaccgacatgatgctgttggaagattacacgtctgacgacaatcctccgagccactgtacctgcccaccaaagcgccggagttcggttactttcgaagacgaggtcgagcagatcaaagaggccgcgaaaaacagtatcctgcacgtcaaagctgaggtgcataagtccctagacagctacgcagcatccctggctaaggctatcgaggccgaggccaagatcaatttgtttggggaggaagccctgccgggggttctagtgacggcccggactgttccagggggaggctttggcgggcgcagaggaagcagaacacttgttagtcaaaggctgcaattgcagtcaatcgaggaaggggacgtcctggcggccgagcaacgctag

SEQ ID NO: 188597 - DNA, 1590 bp, Artificial Sequence
  Description of Artificial Sequence: Synthetic coding sequence
atgagcctgaacagcagcctgagctgccggaaggagctgagcaacttgacagaagaggaaggaggcgagggcggggttattataacgcagtttatcgctatcatcgtcataacaatattcgtgtgtcttggcaatctcgtgattgtagtgaccctgtataagaaatcctatctgctcaccctttcgaataagtttgtctttagcttaactctgtccaacttcctgctgagcgtcttagtgctaccatttgtggtgacttcttctatccgcagagagtggatcttcggcgtggtatggtgcaacttcagcgctctgttgtacctgctgatctcttccgcatctatgctcaccctcggtgtgatagccatcgatcgctactacgcagtgctttatcccatggtgtaccctatgaaaatcaccgggaaccgggctgtgatggctttggtgtatatctggttgcactccctcatcggctgcttacccccattatttggatggtctagtgttgaattcgatgagtttaagtggatgtgcgttgcagcatggcaccgagagccaggatatactgctttttggcagatttggtgcgccctatttcccttcctagtgatgcttgtgtgttatggtttcatctttcgagtggctcgcgtgaaagcacgcaaagtgcactgcggcactgtcgtaatagtcgaggaagacgcacagcgcacaggaaggaagaactcctctacatcaacttcaagtagtggtagcagaaggaatgccttccagggcgttgtttactccgcaaatcagtgcaaagctctgatcactatcctggtggtgctgggggcctttatggtgacgtggggcccctatatggtggtgatagcttcagaagccctctgggggaagtcatccgtatcacctagtcttgagacatgggctacttggttgagtttcgccagcgccgtttgccaccccttaatctacggactctggaataaaacagtccggaaggagctgctcggtatgtgttttggggatcgctactacagggaaccgttcgtgcagagacagagaacctctcgactgttttctataagcaataggatcacggacctgggccttagcccccacctgaccgcacttatggctgggggtcaaccattgggtcattcaagttctactggcgatacggggttctcttgttctcaggattcagggactgatatgatgctgctggaagattacacctccgatgacaatccaccctctcactgcacttgcccccctaagaggcgcagctcagtgacattcgaggatgaagtggaacagatcaaggaagctgctaagaactccatccttcacgtgaaggctgaggtacataagtcccttgactcctacgctgcgtctctagccaaagcgatagaagccgaggccaaaattaacctgtttggtgaagaggccctgccgggtgtgctggtgacagcacgtactgtgccggggggggggttcggagggagacgcgggagccgcaccctggtgagccagcggctccagctccagtccatcgaggagggagacgtgctcgcagcagaacaaagatag

SEQ ID NO: 188598 - DNA, 1590 bp, Artificial Sequence
  Description of Artificial Sequence: Synthetic coding sequence
atgagcctgaacagcagcctgagctgccggaaggagctgagcaacttaacagaagaagaagggggggaaggcggagtgattattacgcagttcatagcgattattgtgataacaatctttgtctgcctgggaaatcttgtcattgtggtgacattgtataaaaaaagctatctcctgaccctgtccaacaagtttgtattctccctgacattgagcaacttcttgctgtctgtgctggtgttgccatttgtggtaacatcgagtatcagaagagagtggattttcggcgtcgtttggtgtaacttcagtgcactgctatatctgctgatcagcagtgcttccatgctgacgctgggggtgattgccatagaccgatactacgcagtcctatatcccatggtttaccccatgaagataaccggcaacagggccgtgatggctctggtctacatttggctgcacagcctcatcgggtgtctcccccctctcttcggatggtcctcagtcgagttcgatgaattcaagtggatgtgtgtggccgcgtggcacagggaacccggttataccgcattttggcaaatttggtgcgcacttttcccgtttctggtaatgctcgtgtgctacggtttcatatttagagtggctcgagtgaaggcgcgcaaggttcactgcgggaccgtggttatcgtagaggaggacgcccaaagaaccgggcgtaagaatagtagtaccagcacatcgtctagtgggtctcggagaaacgcctttcagggggttgtgtacagcgctaaccagtgcaaggccttaattacgatcctggtggtgctgggggctttcatggtgacttggggtccatatatggtggtgatagcatctgaagcactttggggcaaatcttcagtgtcgccatccctggagacatgggccacttggctgagctttgcttcggcagtgtgtcaccctctgatatatggactgtggaacaagaccgtccgcaaggagctgttaggcatgtgctttggcgaccggtactaccgggagccctttgttcagaggcagcgcacgtcgagactgttttcaatttctaaccggatcacggatctgggattatctcctcaccttacggcccttatggcaggtggacagcccctgggtcactcttcaagcaccggggacactggttttagctgttcacaggacagtggaactgatatgatgcttttggaggactacacgtccgatgataacccccccagtcactgcacctgcccgcctaagcggcgcagctccgttacttttgaggacgaagtcgagcagattaaggaagcagccaaaaatagtatcctccacgtgaaagcagaggttcataagtccttagactcatacgccgcatccctggcaaaagccatcgaggctgaggctaagattaacttgttcggtgaagaagccctacccggcgtgctggtcactgcccggacggtgccgggcgggggattcggcggccgacggggctctcgaaccctggtgtcccagcgactccagcttcagtctattgaggagggcgatgtgctggcagcggaacagaggtag

SEQ ID NO: 188599 - DNA, 1650 bp, Artificial Sequence
  Description of Artificial Sequence: Synthetic coding sequence
atgagcgcccggggcgtggtgcagcacgccctgcccaccccccggcgaggggcattgacgatgtcactgaatagcagcctgtcttgccgtaaggagctgagcaaccttactgaggaggaaggtggtgaaggaggagttatcattactcagttcatagcaattattgtgatcacaatttttgtgtgcctgggcaatttggtgatagtggtgaccctgtataaaaagtcctatctcttaactctctctaataagttcgtgttctccctgacgctatccaatttcctcttgtccgtgctggtccttccctttgttgtgaccagttctatcaggagggagtggatttttggcgttgtgtggtgcaacttttccgccctgctgtatctgcttatcagtagcgcctcaatgctgacattaggcgtgattgccattgatcgctactacgccgtgctgtatccgatggtttatcctatgaagattactggtaaccgagcagtaatggctctggtttacatctggctgcattctctgatcggatgccttccaccactcttcggttggagttctgttgaattcgacgaatttaaatggatgtgtgtggctgcctggcaccgggaacctggctatacggctttctggcagatctggtgcgccctgttcccgttcttggttatgctcgtatgctatggttttattttccgcgttgcgcgggttaaggcccgaaaggtccattgcgggactgtggtaatcgttgaggaggatgctcagcggacgggcaggaaaaactccagtaccagcactagctcatccgggtctaggagaaatgctttccagggagttgtgtacagtgctaatcagtgtaaagctctaatcacgatactggtggtgctgggcgcatttatggtaacatggggtccttacatggtggtcatcgcgtctgaagccctttggggaaagtcctctgtttcgccgagcctagaaacatgggctacatggctatcctttgcgtcagcagtgtgccaccctttgatctatggtctgtggaataagaccgtgcggaaagaactactgggaatgtgtttcggagataggtactaccgtgaaccattcgtgcagcggcagagaaccagtcgactgttttctatcagcaataggataactgacttaggcttgtccccacatttgacagctctcatggccggtggacagcccctgggccatagttcttcaacgggagatactggattctcttgtagtcaagactcaggtacagacatgatgttgctggaggattacacctctgatgacaatcctccgagtcactgcacatgcccgcccaaaagacggtcctcagtgaccttcgaggacgaagtcgagcagatcaaagaagctgcgaagaattccatcctgcacgtcaaggcggaagtgcacaaaagtctggattcttacgctgcctccctggccaaggctatcgaggccgaggcaaaaatcaacctcttcggggaggaggcactcccaggggtcctggttactgccaggaccgtgccaggaggtggcttcggggggcggcgtggatcccggactctagtttcacaacgcctccaactgcagtccattgaagagggtgacgtgcttgccgccgaacaacgctag

SEQ ID NO: 188600 - DNA, 1356 bp, Artificial Sequence
  Description of Artificial Sequence: Synthetic coding sequence
atgggcggccggcggtgcgtgcccggcaccctgcccatgcgggccgcccctccgggagccaaacgcctccacgtgccgctgcgcgccaaaggggtgggaaggagtggccacgctcctagattggaatcggtgcggacatcctattatgcagtcctttaccctatggtgtacccaatgaaaatcaccgggaacagagctgtgatggccttggtgtatatctggttgcactctctgattggatgcctcccccccctatttggctggagctcggtagagtttgacgagttcaagtggatgtgcgttgctgcctggcacagggaaccaggctacaccgctttttggcagatctggtgcgcgctgtttccattcctcgtcatgctggtgtgctacggtttcatctttcgcgttgctagagttaaggccaggaaggtgcactgcggtactgttgtcattgtagaggaagatgcccagcggacggggagaaaaaattcctccacttcaacaagctctagcgggtcacggagaaacgctttccagggagtggtttactcggccaaccagtgtaaggcattaatcacgattctggtggttctgggagcgttcatggtcacatgggggccctacatggttgtcattgctagcgaagccttatgggggaagagtagcgtaagcccctccttagagacatgggcgacgtggctctctttcgcctctgctgtgtgccatccactaatctatggcctatggaacaagacagtcagaaaagaactgctgggtatgtgttttggggatcggtactacagggagccgtttgtgcaaagacaacgcacatccaggctgtttagtatctccaaccggatcaccgatctcggcctctccccccacctaaccgccctgatggccgggggacaacccctcggtcactcctcttcaacaggtgatacagggttttcctgtagtcaagattccggaactgatatgatgctgctcgaagattatacttccgacgataaccctccttcacactgcacgtgccctcctaaaaggcggagcagtgtcacgtttgaagacgaagttgagcagatcaaagaggctgccaagaactccatcttacatgtgaaggctgaggtacacaagtcactggacagttacgctgcgtctctagccaaggccattgaagcggaggctaaaatcaatttgttcggagaggaggctttgccaggagtgctcgtgacagctcggacagtccctggtggcggcttcggggggcgtcgcggctccagaacactggttagtcagagacttcagctccagtctattgaggagggcgacgttctggctgccgagcaacgctag

SEQ ID NO: 188601 - DNA, 1248 bp, Artificial Sequence
  Description of Artificial Sequence: Synthetic coding sequence
atgctggtgcccgtgggctggatgaacgagagctactacgccgtgctgtacccaatggtttatccgatgaagattaccgggaacagggccgtcatggctctggtgtatatctggcttcattccctgatcgggtgcttaccaccactgttcggatggtcatcagttgaattcgatgagttcaagtggatgtgtgtggctgcctggcaccgggagccaggatatacggccttttggcagatctggtgtgctctgtttcctttcctggtgatgctagtgtgctacggtttcatttttagagtggccagggtcaaagctcgcaaagtccattgcgggaccgtggtcattgtggaggaagacgcccagcgtacaggtcggaaaaactcatcaacatcaacaagttccagtggtagcaggagaaatgccttccagggcgtagtgtatagtgcaaaccaatgtaaagccctcattactatattagtggtgctgggtgcctttatggtgacgtggggtccttacatggtggttatagccagcgaggccctctggggaaagtcctccgtcagtccttcccttgagacctgggctacttggctttcctttgcctccgccgtctgccaccccctgatctatggcctgtggaacaagacggtccgcaaagagctgctggggatgtgttttggagaccggtactacagggagccatttgtgcagaggcagcgcacatcgcgtctgttttctatttctaataggatcactgacctgggactatcaccgcacctaaccgcgctgatggcgggtggacaaccactaggccacagctctagcacaggggatactggcttctcatgttcacaggactctggcacagacatgatgctgcttgaggattatacctctgacgacaatcctccatcccattgcacctgccccccaaaaagaaggtcgagtgtcacgttcgaagatgaggttgaacagatcaaggaagccgccaagaatagtatcctgcacgttaaggccgaagtgcataagagcctggattcctacgctgccagtctggctaaggccatcgaagcagaagccaaaattaacctgttcggggaagaggctttgccgggggtgctcgttactgcccggacagtgcctgggggcggtttcggcgggcggagaggcagccggacactggtgagccagcggctccaacttcagtccatcgaagagggagatgttcttgcagcagaacaaaggtag

SEQ ID NO: 188602 - DNA, 1104 bp, Artificial Sequence
  Description of Artificial Sequence: Synthetic coding sequence
atgagcaagcggagctggtgggccggcagccggaagcccccccgggagatgctgaagcttagtggatctgacagttcccagagcatgaacggcctcgaggtggcgccgcctggacttatcacaaatttctccctggccacagccgaacagtgtggacaggagactccacttgagaacatgctattcgcctccttttacttgttggacttcattctggcgctggtcgggaacaccttggctttgtggcttttcattcgggaccacaagtccggaacccccgccaatgtatttctgatgcacctcgctgtcgctgatctttcgtgcgtcctggtacttccgacccgcctcgtataccacttttcgggaaaccactggccattcggcgagattgcgtgccggctcaccggcttcctgttctacctcaatatgtatgcctccatctatttcctaacctgcatcagtgccgatcggttcctggccatcgtgcacccggtgaagtctctgaagctgcgcagacctctgtacgcgcatctggcttgtgctttcctgtgggtcgttgtggctgtcgctatggctcctctgcttgtgagtccccaaaccgtacaaactaaccacacagtggtgtgcctgcaactgtaccgagaaaaggcatcccaccacgctctcgtcagtctggccgtggcctttactttcccttttattacaaccgttacttgttaccttttgatcattcgaagtcttagacaaggcctgagggtggagaaacggcttaaaacaaaagccgtgcggatgattgcaatcgtcctggctatcttcctcgtatgcttcgtgccgtaccacgtgaacaggtccgtctacgtcctccattatcgatcccacggcgccagctgtgctactcaacgtatcctcgcactggcaaaccggattacgagctgccttactagtctgaacggagccctggatccaatcatgtatttttttgtcgccgaaaaatttaggcacgcactatgcaacctgctgtgtggcaagcgattaaaggggccaccaccgagttttgaggggaaaaccaacgagtcctccctgtccgccaagagcgagctctag

SEQ ID NO: 188603 - DNA, 312 bp, Artificial Sequence
  Description of Artificial Sequence: Synthetic coding sequence
atgaacggcctggaggtggccccccccggcctgatcaccaacttctcccttgctaccgccgagcagtgtgggcaggagacacccctagaaaatatgcttttcgcatctttctatctgccacttcccagacaaccgaggatgtgcacagtcacagggctcactgccgggtctaccgcccgatccaaacagcacctcgaagttgtcttcgccgtgttacccgctttcaaactccaacggggtagaagagaacgcacaagcaagccacccatcattcccatgtcttctccaggaccttgttgggttagaacctag

SEQ ID NO: 188604 - DNA, 1104 bp, Artificial Sequence
  Description of Artificial Sequence: Synthetic coding sequence
atgagcaagcggagctggtgggccggcagccggaagcccccccgggaaatgttgaaactgtctgggtcagattctagtcagtcaatgaacggactagaagtggctccaccggggctgattaccaactttagtctcgcaaccgcagaacaatgcggccaggagacccccctggaaaatatgttgttcgcgtccttctacctgctggacttcatcttggcgctagtggggaacactctagccctgtggctcttcatacgggatcacaaaagcggaactcccgcgaacgtgtttcttatgcacttggctgtcgccgatctgagctgcgtactggttcttccgacgcggctagtgtaccatttcagtgggaatcattggcctttcggggagatcgcctgtaggctgaccgggttccttttctacctgaatatgtacgcgtctatttattttctcacatgcatcagcgcggacaggtttctggccatcgtgcaccctgtgaaaagcctcaagcttagaaggcctctttacgcgcatctcgcttgcgccttcctgtgggtggttgtcgcggtcgcaatggcgcccttgttggttagcccccaaacagtccagaccaatcacaccgtagtgtgtctgcagttgtaccgggagaaagcgagccaccatgctttagtgtctctcgctgtcgcctttactttcccctttatcacgaccgtaacctgttacttgctgataattcgtagtttacgccaaggactgagagtggagaagcgactgaagacgaaagctgtcagaatgattgctatcgtgcttgcaatcttcctggtctgtttcgtgccgtaccacgtgaaccgatctgtatacgttttgcattacagatcgcatggtgccagctgcgcaacccaaagaatcctggctctcgccaatcgaataacaagctgtctgactagcctcaacggagcactcgaccctattatgtatttttttgtcgccgagaaatttagacatgcgctgtgtaatctgctgtgtgggaagcgtctcaagggccctcctccaagctttgaagggaaaacgaatgagagctcgctcagcgctaagtccgagttgtag

SEQ ID NO: 188605 - DNA, 411 bp, Artificial Sequence
  Description of Artificial Sequence: Synthetic coding sequence
atgagcaagcggagctggtgggccggcagccggaagcccccccgggagatgctcaagctgagtggttcggatagttcccagtcaatgaacggccttgaggtggccccgcccggtttgataacgaacttctccctggcaacagccgaacagtgcggccaagaaactccactggaaaacatgcttttcgcttcattctatctgctagacttcatcctggccttggtgggcaatactcttgctctgtggctgttcattagggaccacaaaagtgggacgcctgcaaacgtatttctgatgcacctggccgtcgcagacttgagttgtgtactggtgctccccaccaggctggtgtaccatttctcaggcaaccactggcctttcggtgagatcgcttgccgtcttacaggttag

SEQ ID NO: 188606 - DNA, 1104 bp, Artificial Sequence
  Description of Artificial Sequence: Synthetic coding sequence
atgagcaagcggagctggtgggccggcagccggaagcccccccgggagatgctcaaactgtcagggtccgatagcagccagagtatgaacggcttagaagtcgcacctccaggcctgataaccaatttttcgttagccacagctgaacagtgcgggcaagagacgccacttgaaaatatgttgtttgcgtccttctatctcctggacttcatcctggcgcttgtggggaacaccttggctctctggttattcattcgggaccataaatcaggtacccctgccaacgtgttccttatgcacctcgcagttgctgacttatcatgtgtgctggttttgccaactagactcgtgtaccactttagcgggaatcattggcccttcggggaaatcgcttgccggctcacaggcttcttgttctacctaaatatgtacgcatccatctactttctgacctgcatctccgcggacaggttcttggcgatcgttcaccccgtaaagagtctgaagctccgtcgtcctctatacgcccacctggcctgtgcattcctatgggtcgtcgtggctgtggccatggccccactgctcgtcagtccacagactgtccagaccaatcacacagtggtttgtttacagctataccgggagaaagcctcccaccacgccctcgtaagccttgccgtggcgtttacctttccatttattaccacagttacatgttacttactaatcatcagaagtctgcggcagggcctgcgtgtggagaagcgcttaaagacaaaagccgttcgaatgattgctatcgtgttggccatctttcttgtctgctttgtcccttatcatgtgaaccggagtgtctatgtattgcactaccgctcgcatggcgcatcatgtgcaacacaacgaatactcgcactggcaaacagaattaccagctgccttaccagtttgaatggggcactggatcctatcatgtacttctttgtggccgagaagttccgccatgcactctgcaacctcctatgtggcaagcgcctcaagggtcctcctccgtccttcgaaggaaaaacaaacgagtcgtcacttagcgctaagtcagagttgtag

SEQ ID NO: 188607 - DNA, 1338 bp, Artificial Sequence
  Description of Artificial Sequence: Synthetic coding sequence
atggccgcccccacccccgcccggcccgtgctgacccacctgctggtagcactgtttgggatggggagctgggcagcagtaaatgggatatgggtggagctgcccgtggtcgtgaaggaactgccagaggggtggtctctcccttcctacgtcagcgtcctcgtggcacttggaaatttaggcctccttgttgtcacactgtggcggcgcctggcacccggtaaggacgagcaggtgccaataagagtagtccaggtgctcggcatggtgggaaccgcactcctcgcatccttgtggcaccatgttgctcctgtggccgggcagctccattcggtcgctttcttggctctggcattcgtgcttgcgctcgcctgttgtgcctctaacgtgacctttctccccttcttgagccatctacctcccaggttcctgaggtccttctttctcggccaaggcctctctgcgttactgccttgtgtccttgccctggtccagggcgtggggaggctggagtgtcccccagcgcccataaatggtacccccggcccaccgctggactttctggaaaggtttcctgcgtcaactttcttctgggccctgactgcgctcctcgtagcgagcgccgccgcatttcagggtctgctactactgttacctccacctccttctgtgcctaccggggaacttggctcaggactgcaggtaggggccccaggtgccgaggaagaagtcgaggagtcttcacctctgcaggaaccaccatcacaagcagctggtacgacccctggtccagatcctaaagcttatcagctgctgagcgcgcgctccgcttgtctgttgggtctgcttgctgcgactaacgcgctgactaatggcgttcttccagccgtgcagtctttttcttgtcttccatacgggcgcttggcgtatcacctggccgtggtgttgggatccgcagcgaacccacttgcttgctttttagctatgggtgtactttgcagaagccttgccgggctgggcggcctgtccttactcggagtcttctgcggagggtacctgatggcgctcgccgtgctgtctccctgtcccccattggtgggcaccagtgctggtgtagtgcttgtggtcctatcttgggtcctgtgtctgggcgtgttcagctacgtcaaggtggctgctagttccttactccacggcgggggcagacctgctctgctggccgcaggcgtggccatccaggtcggatctctccttggcgccgtcgccatgtttccccccacttctatctaccatgtctttcactcaagaaaggactgtgcggatccctgtgattcctag

SEQ ID NO: 188608 - DNA, 1338 bp, Artificial Sequence
  Description of Artificial Sequence: Synthetic coding sequence
atggccgcccccacccccgcccggcccgtgctgacccacctgctggttgcactgtttggtatgggcagttgggccgccgtgaacggtatctgggtcgagctgccggtcgtcgttaaggagctgcccgaaggctggagcctcccgtcctatgtgtcagtgctggtggccctagggaacctggggctgctggtggtgaccctgtggcggaggctggcacctggaaaggatgaacaagtgcctataagggttgtccaggttcttggcatggtgggtacggctttgctggcctccctgtggcatcacgtcgctccagtggccgggcaattgcactccgtcgcttttttggcactggcttttgttttggccctggcttgctgtgcgtctaacgtgactttcctcccatttctttctcacctcccgccgcgcttccttcgctctttcttcctcggacagggcctgtctgccctgctaccctgcgtgttggcactcgtgcagggcgtgggtcgtcttgagtgcccccctgcaccaatcaacggtacaccaggccctcctctagacttcctggagcggtttccggcgtccacatttttctgggctttgactgcactactcgtggcaagcgctgctgctttccagggcctgttgcttctgctgcctcctccgccatccgttcccactggtgagttgggatccggcttgcaggtgggggcacctggggcggaggaggaggttgaggagagctcacctctgcaagagcctccaagccaagctgctggaacaactcccggcccagaccctaaggcctaccagctattgtccgctcgctcagcctgcctgctaggcctgctggcagctacaaatgccctgacaaacggcgtgctgcctgcagtgcagtctttcagctgtctgccatacggtcgtctggcatatcacttggctgtggttctgggctctgccgctaacccccttgcctgctttctcgccatgggcgttctttgtcggagtctggctgggttaggcggtctgtccctgctgggcgtcttttgcgggggctatctgatggccctggccgtcctctccccgtgcccccccttggtcggaaccagtgctggggtggtcctcgtcgtgctgtcttgggtactctgtctgggcgttttctcttatgtgaaggtcgctgctagcagtttgctgcacgggggtggccgcccagccttgcttgctgctggggtggccatccaggtagggtctctcttgggagccgttgcaatgttccccccaacaagcatctatcatgtgttccacagtcgcaaggactgcgccgatccatgtgatagctag

SEQ ID NO: 188609 - DNA, 1338 bp, Artificial Sequence
  Description of Artificial Sequence: Synthetic coding sequence
atggccgcccccacccccgcccggcccgtgctgacccacctgctggtggcgctgtttggcatgggaagctgggcagctgtgaacgggatatgggtggagctccctgtggtggtaaaggagctgcccgaggggtggagcctgccatcctacgtctcagtgttagtcgccctgggcaatttaggcttactggtcgtcactctctggcgcaggctggctccggggaaagacgaacaagtgcccattcgcgtggtccaggtacttgggatggtcggcacagccctgctggctagtctctggcaccacgtggcaccggtcgccgggcagctacactccgtcgcctttctcgctctggcgttcgtcctggcactagcctgctgcgcttctaacgtgaccttcctgccattcttgtcccacctgccccctcggtttttaaggagttttttcctgggacaggggctgtcggccctgctgccatgcgtactcgccctggtacagggtgtcggcaggctcgagtgcccccccgctcctataaacggcacacccgggcccccgttagactttttagaaagatttcccgctagcaccttcttctgggctctgacagccctgctcgtagccagtgctgcagcattccagggtctactactgttattgcccccacccccatctgtgcccaccggggaactgggaagcggcctccaggtgggcgccccaggcgcggaggaagaggttgaagaatctagcccactccaggagccaccgagtcaggccgccggaaccactccaggccccgaccctaaggcataccagctattatccgcccgctcagcttgtcttcttggactcttggccgccacaaacgcactgaccaacggggtgctgcctgctgtgcagagtttttcgtgcctgccatatgggaggcttgcgtaccacttagccgtggtgctggggtcagctgccaacccactcgcctgttttctcgccatgggggtgctgtgtcgatcgttggccggcctgggtggactgagtttactgggcgtcttttgcggcggctacttgatggcgctcgctgtacttagcccatgtcccccccttgtcggaacctcggcgggcgtcgtcctggtagtgctatcctgggtcctgtgcctgggggtcttctcctacgtcaaagtggctgctagctccctcctccacggaggaggaaggccggctctgctcgctgccggagtggccattcaggtcggctctcttctgggagcggtggccatgttcccccctacatcaatttaccacgtgttccactcgagaaaggactgcgcggatccatgcgattcttag

SEQ ID NO: 188610 - DNA, 1338 bp, Artificial Sequence
  Description of Artificial Sequence: Synthetic coding sequence
atggccgcccccacccccgcccggcccgtgctgacccacctgctggtggccctgtttgggatgggttcatgggccgctgtgaatggtatttgggtggaactgccggtggtagtgaaggagctacctgaggggtggtcccttccttcctacgtgtccgtactcgtagcgcttgggaacctgggcctgctcgtggttacactctggagacggctcgcaccaggaaaggacgagcaggtgcccatacgagttgtgcaggtgttggggatggtcggtactgcccttctggccagcctctggcaccatgtggcccctgtcgctggtcagttacattccgtggcttttctagcgctggcctttgtgctggctctggcgtgctgcgcttctaacgtgacattcctgccctttctgagccatttaccacccagattcttgcgctcattttttctcggacaaggcctgagcgcactactgccttgtgtgctggcactggttcagggcgtggggcggctggagtgccctcccgctcccatcaatggtactcccggcccacctttggacttcctcgaacggttccccgcctccacatttttttgggcccttactgcactcctggtggcctccgcagctgccttccaaggtctgctgctgctccttcccccgcccccttctgtgcccactggggaacttggaagtgggctgcaagtgggcgccccaggcgccgaggaagaggtagaggaaagctcacctcttcaagaacctccctctcaggccgccgggacgacaccggggccagaccctaaggcataccagttgctctcagccagaagtgcctgtctgctggggctgcttgccgccactaatgctctgaccaacggcgtactgcccgccgtccagtcatttagttgtcttccctatggcaggctagcctaccacctcgccgtcgtcctcggctctgcggcaaatcccctggcctgcttcctggcaatgggggttttatgtagatccttagctgggctggggggccttagtttactgggcgtcttctgtgggggttatcttatggctctcgcagtacttagtccatgtccacctctcgtcgggacctctgcaggtgttgtgttagtcgtcctaagttgggttctctgtctcggcgtgttttcatatgtcaaagtggccgcttctagcctgttgcatgggggaggtaggccagccctgctcgccgccggagtggccatccaagtcggaagcctgctcggggctgttgcgatgttcccgcctacttctatctaccatgtctttcactctcgaaaagattgtgccgacccctgcgacagttag

SEQ ID NO: 188611 - DNA, 1338 bp, Artificial Sequence
  Description of Artificial Sequence: Synthetic coding sequence
atggccgcccccacccccgcccggcccgtgctgacccacctgctggttgccctttttgggatgggctcctgggccgccgtcaacggtatctgggtggaattgcctgtggtggtgaaggagctgccagaaggatggagcctacctagttacgtaagtgttctggttgcactggggaacctcggccttctggttgtgaccctgtggcgccgtctggctcctggcaaagacgagcaggtgccaatccgagttgtccaggtgcttggcatggttggaactgccttattggccagcctgtggcaccatgtggcccctgtggctgggcaactccacagcgtggcctttctggcattagctttcgtcctggctttggcgtgctgtgcatcaaatgttacattcttgccatttttatcacacctcccccctcgctttctgcggtcattttttctggggcagggactaagcgcacttctaccttgtgtgctcgcccttgtccagggggttgggcgactggaatgtccacccgcacctatcaatggaacccccgggccccccctggactttctcgagcggttcccagcatcaaccttcttctgggcattaaccgccctgctggttgccagtgcagcagccttccagggcctgcttctgctgctaccaccccccccaagcgtgcccacaggagaactggggtccggactccaagtcggtgcaccaggtgccgaagaagaagtggaggaatccagccccttgcaggagcccccgagccaagccgctggcactactcccggccccgatcctaaggcataccagctactaagtgcgagatcggcctgtctgctggggttgttggccgctactaacgccctgaccaatggcgttctccctgccgtacaatcgttctcctgtctcccttacgggaggcttgcgtatcatctggccgtggttctgggttcagctgctaacccacttgcctgcttcctcgccatgggcgtgctttgtaggagcctagccggattaggcggcctctccctcctaggcgtgttttgcggcggttaccttatggctttggcagtgttgtcgccatgcccccccctcgtggggacctctgcaggagtagttctcgttgtgttgtcctgggtactttgtttgggcgtgttctcctacgtaaaggtggctgcctcgagtctcctacacgggggaggacggcctgctctgctggctgcaggcgtagcaatccaggtgggttctctgctgggtgcagtcgctatgttcccccctactagcatctaccacgtgtttcattcgaggaaagattgcgccgacccctgcgattcttag

SEQ ID NO: 188612 - DNA, 1074 bp, Artificial Sequence
  Description of Artificial Sequence: Synthetic coding sequence
atggtgggcaccgccctgctggccagcctgtggcaccacgtggcccccgtcgccggtcagctgcactcggtcgcctttctggcactggccttcgtcctcgcccttgcttgttgcgccagtaacgtcacattcttgccctttttgagccacctgccaccaagattcttgagaagctttttcttaggccaggggctgtctgctctcttgccttgcgtgttggccctggtgcaaggcgtgggccgtcttgagtgcccacccgctccgatcaatggtaccccgggcccacccctcgatttcctcgagaggtttcccgcatctacatttttttgggctctgactgcacttctggtggctagcgctgccgcctttcaggggctgctcttactccttccgcctcctccgtcggtgccgaccggcgagctcggatccggactccaggttggcgctccgggcgctgaggaggaagtggaagagagcagcccacttcaagagccacccagtcaggctgctggcactacccctggtccagatccaaaagcttaccagctcctgagcgcaagatcagcctgtctcttaggattattggccgctaccaatgccttgaccaacggcgtcctgcctgcggtgcaatctttctcttgcctcccttacggacgcctggcataccaccttgctgtggttcttggttcagccgccaatcccctggcgtgctttttggccatgggtgtattgtgtcgctcattagctggactgggggggctaagccttctgggcgtgttttgtggggggtacctgatggccctcgcggtgctttcgccctgcccccccctggtcggaacgtcggctggtgtggtgctggtcgttctttcctgggtcctttgtctgggcgtgttttcatatgtaaaggttgccgcaagtagccttcttcacggcggaggacggcccgccctgctggccgctggggtcgccatccaggtgggtagcctgttaggcgctgtcgccatgtttccacctacatccatctaccacgtgtttcatagccgcaaagattgcgcagacccttgtgattcttag

SEQ ID NO: 188613 - DNA, 1347 bp, Artificial Sequence
  Description of Artificial Sequence: Synthetic coding sequence
atggccgcccccaccctgggccggctggtgctgacccacctgctggttgctctcttcgggatgggatcctgggccgccgtgaatggaatttgggtggagctgcccgtcgtcgttaaggatctcccggaggggtggagcctaccctcctacttatctgtagtcgtcgccttaggtaatctgggcctgctcgttgtgactctatggcggcagctggccccaggcaaaggtgaacaagtcccaatacaagttgtgcaggtactgtctgtagttggtaccgccctgctggcacctctatggcatcacgtggccccggtcgcagggcaattacatagcgttgcctttctgacactggctctggtgctcgccatggcctgttgcacctccaacgtcacattcctgccattcctatcccacctgccccctccatttcttcggtcctttttcctcggtcagggactgagcgcactgctgccgtgcgtgctcgcactggtgcaaggcgttggaagactggaatgtccacccgcccccacaaatggaacaagtggccccccactcgacttccccgaacgatttcccgcttcgacttttttctgggcactgacagcactccttgtgacttcagctgccgcgtttcgagggctcttgttgctccttcctagtttgccctctgtgaccaccggaggcagtggacctgagttgcagcttgggagtccaggagccgaagaggaggagaaagaagaagaagaagccctgcctttacaagaacctccctcacaggcggcgggtactataccgggaccagatcccgaagcccaccaactgttcagcgcgcacggagcgtttctgctaggactgatggcctttacctcagcagtcactaacggggttttgccctccgttcagtccttcagttgcctgccatacgggcgtctggcctaccacctcgcggttgttctgggctctgcagcaaatccactggcttgctttcttgcaatgggcgtcctgtgccgctcactggcaggactggtgggactttcattgctagggatgctctttggggcatacctgatggcattggccattctgagtccatgccctccactggtagggacgacagctggtgttgtgctcgtagtgctctcatgggttctgtgcctttgcgttttctcttacgtgaaggtggctgcttcatcactcctccatggcggggggaggcctgccctgctggcagccggggtggccatccaggtgggcagtctgctgggggccggagccatgtttcctcctacttcgatataccatgtcttccagtccaggaaagattgtgtggatccttgtgggccttag

SEQ ID NO: 188614 - DNA, 1347 bp, Artificial Sequence
  Description of Artificial Sequence: Synthetic coding sequence
atggccgcccccaccctgggccggctggtgctgacccacctgctggtggccctcttcggcatgggctcctgggccgcagtcaatgggatctgggtagaacttccagttgtggtgaaggatttgcctgagggctggagtctcccctcgtatctgtccgtggtcgtggcattgggaaatctggggctattggtggtgaccttgtggaggcagcttgcacccgggaaaggggagcaggtcccgatccaagtggtacaggtactatctgtggtcggcacagcactcctggctcctctgtggcaccacgtggccccagttgcagggcaactccatagtgtcgctttcctgactctagctctggtccttgcgatggcctgctgtaccagtaacgtgacttttttaccctttctttctcacttgccccctccctttctgcggtccttttttttgggacagggtctcagcgctcttctcccctgcgtgctcgcactagtgcagggcgtgggtcgacttgagtgcccccctgcaccgaccaacggcactagcgggccccctcttgatttcccagagaggtttcctgcgagtacatttttctgggccctgaccgcgctgctcgtcacatcagcggcagcttttaggggactcctcctgctcctcccctccctcccgagtgtgactactggcgggtcagggcctgagctccagttaggcagtcccggggccgaggaagaagagaaagaagaggaggaagccctgccactccaggaaccacccagccaggctgccggaaccataccagggcctgatccagaagcacatcagctcttctctgcccatggagcctttctgcttggactaatggctttcacctcggcagtgacaaacggagtactaccctcagtacaatctttctcttgtctgccttacggtcggctggcgtaccacctggcagtggtccttggttctgcagcaaaccctctcgcctgcttcttggctatgggcgttctgtgtcgatctttggctggtctggtggggctgtcactgctcggaatgctgttcggcgcgtatctgatggctctcgctatcctgagcccgtgtccccctctggtgggcacaacagcaggcgtggtgctcgtggtgctctcctgggtgctgtgcttgtgcgtcttcagttatgtgaaagtagcggcctcttcacttctccatggaggggggcggccagctctgctcgctgcaggagtggctatccaggtgggctccctgctgggcgctggcgccatgtttcctccgactagtatctaccacgtgttccaatcacgcaaagactgcgtggacccttgcggcccctag

SEQ ID NO: 188615 - DNA, 1053 bp, Artificial Sequence
  Description of Artificial Sequence: Synthetic coding sequence
atggccgcccccaccctgggccggctggtgctgacccacctgctggtagccctgttcgggatggggagctgggctgcagtgaatggcatctgggtggaactgccagtagttgttaaagacctgcctgaaggatggtcattgcccagctatttatcagtggtagtcgcccttggaaatctggggctcctggttgtgactctgtggcgccagttggctccaggtaagggcgagcaggtgcctattcaggtagtgcaagtgctgagcgtggttggaacagccctgctcgctcctctgtggcaccatgtcgcacccgtggccggacagctgcattcagtcgcgtttttgacactggccctggtacttgcaatggcctgctgcacaagtaacgttacttttctcccctttctgagtcacctaccacctccattcctgagatccttttttttgggccaaggtctttccgctctcctgccctgtgtgttagccctggtgcaaggggtggggcggctggagtgcccgccggctccaactaatgggacgtcagggccgcctttggattttcccgaacgcttcccagcaagcaccttcttctgggccctcactgcgctgttagtgaccagcgcagcggcttttcgcgggctcctccttttactgccaagtttaccctcagtaacaaccgggggttccggtccggaacttcagctagggtctccaggagccgaagaggaagaaaaagaggaagaggaagcgctgcctttgcaggaacctccaagtcaggccgctggtacaatacccggccccgatccggaggcccaccaactcttcagcgcccacggtgccttcttactgggtctgatggctttcacgagtgcggtgactaatggtgtgctgccgtccgtgcaatcattcagttgcctgccatatggtcgactggcttaccacttggcagtggtccttggcagtgctgccaatcccctagcttgtttcctagctatgggagtgctgtgtcggtgctgcaggggctgctgcgtttgtgtttgctctcacatgtag

SEQ ID NO: 188616 - DNA, 1413 bp, Artificial Sequence
  Description of Artificial Sequence: Synthetic coding sequence
atgcccgcccccctgctgctgatcagccggaccctgggcaacttcatggtgctgtggagtacatgccgcacaactgttttcaaatcggttactaatcgcttcattaagaatctggcctgcagcggcatttgcgccagcctggtgtgtgtgcctttcgatattatcctgtccactagccctcactgctgttggtggatctacaccatgttattctgcaaggtcgtgaaattcctgcacaaagttttctgtagcgtaacaattctgtccttccccgctatcgccctcgaccgctattacagcgtgctctatcccctggagcggaaaatctctgatgccaagtcccgggagctggttatgtacatctgggcccacgccgtggtggcaagcgtgccagtttttgcagtcaccaacgtggcggacatttacgccactagcacatgcaccgaggtctggtctaattccctgggacacctcgtgtatgtgttagtctataacatcaccacagtgatcgtgcctgtggtggtggtctttctgtttctgattctgataaggagagcgctgtctgcctcacaaaaaaaaaaggtaattatagccgcactgcggaccccccagaacacaatttcaatcccgtatgcaagtcagcgggaggccgagctgcatgcaacacttctttccatggtaatggtatttatcctgtgtagcgtcccctacgccaccctggtggtgtaccaaaccgtcctgaatgtccccgatacctctgttttcttgttgcttactgcggtttggctgcctaaggtcagtctgctggctaatcctgttctgtttttgaccgttaacaaatcagttcgcaagtgcttgataggtacactggttcagctacaccacagatattctaggcggaatgtggtgagcaccgggagcggcatggcagaagcaagcctggagccttccataaggtccggttctcagctgcttgaaatgttccatatcggtcagcagcaaatcttcaagcccactgaggacgaggaagaaagcgaggccaaatatatcgggagcgcagatttccaggccaaagagattttttcgacttgtttggagggtgagcaaggacctcagttcgccccttcagcaccacccctgtctacggtggattctgtgagtcaggtcgcaccggctgcgccagtggaacctgaaacttttcccgacaagtatagcctccagttcggattcgggccctttgagctgccgccccagtggcttagtgagacccgtaacagtaaaaagcggctcctacccccattaggcaatacccccgaggagctgatccagaccaaggtccctaaggttgggagggtcgagcgtaaaatgtctaggaacaacaaagtgtcaatcttccccaaggtcgacagctag

SEQ ID NO: 188617 - DNA, 1548 bp, Artificial Sequence
  Description of Artificial Sequence: Synthetic coding sequence
atgggccacaacggcagctggatcagccccaacgccagcgagccccacaatgcaagtggcgctgaagctgccggggtgaacaggtccgcacttggtgaattcggggaggctcaactttacaggcagtttacaaccacagtgcaggtggtaatatttatcgggtctctcctggggaacttcatggtgctttggtctacctgccggacgaccgtgttcaaatcagtgacaaaccggtttatcaaaaacctggcgtgctcagggatctgcgcaagtctggtttgtgttccgtttgatatcatcctatccacatctccccattgctgttggtggatctacactatgctgttctgcaaagtggtgaaatttctacataaggtattctgctcagtgaccattctgagttttcccgccattgcactcgataggtattactcagtgctgtatccccttgagcggaagatctctgacgccaaaagtagggagctggtgatgtatatttgggcccacgcagtcgttgcatcggtaccagtgttcgcagtgacaaacgtggccgatatctatgctacatccacttgtaccgaggtctggtcaaatagtttaggtcacctggtatatgttcttgtctataatattaccacagtcattgtgcccgtcgtggttgtattccttttcctgatcctcatcaggcgcgctctgagcgcttcacaaaaaaaaaaggtaatcatcgccgctttgcggacaccacagaataccatctctattccctacgctagccagcgggaagctgagcttcacgctactctcctttccatggtgatggtgtttattctgtgttccgtgccttacgcgacgctggttgtgtatcagactgtactcaacgtaccagatacatcggtgtttctgctgctgacagccgtgtggcttcctaaggtgtccctcctggccaatccagtcctcttccttactgttaacaaatccgtgagaaaatgtctgataggcaccctggttcagctgcaccataggtactcacggagaaacgttgtaagtaccggcagtggtatggctgaggcctctcttgaaccatccatccgttcgggaagtcagctgttagagatgtttcacataggccagcagcagatctttaaaccgaccgaggatgaggaagaatctgaagcaaaatatatcggtagcgcggactttcaggccaaggagatttttagcacatgtctggaaggcgagcaggggccccagttcgctccttcagcccctccattatccacagtggacagcgtgtcacaggtagcgcccgcagctcccgtggaacctgaaaccttccccgataaatactctcttcagtttggattcggaccgttcgagctcccccctcagtggctatcggagacccgcaacagcaagaaacggctgctccctcctcttggaaatacaccggaagagctgattcagactaaagtcccaaaggtcggacgggtcgaaaggaaaatgtcgcggaacaataaagtgtccattttcccaaaggtggacagctag

SEQ ID NO: 188618 - DNA, 1548 bp, Artificial Sequence
  Description of Artificial Sequence: Synthetic coding sequence
atgggccacaacggcagctggatcagccccaacgccagcgagccccataatgcctcgggtgctgaggctgctggggtcaaccgatcggccctgggtgaattcggcgaagcccaattgtatagacagttcactaccaccgtgcaggtggtgatcttcatcggctccttgcttggaaatttcatggtcttatggagtacctgtaggactacagtctttaaatctgtaactaatcgcttcattaagaatctcgcatgctccggcatttgcgcatcgctcgtttgtgtgccttttgacatcattttaagcacgtctccccactgctgttggtggatatatactatgcttttttgcaaggtagtaaagttcttgcataaagttttctgctcggttaccattttgtcatttcccgcaatcgcacttgaccgatactactctgttttatatcccctggaaagaaagatttccgatgctaaatctcgggaacttgtcatgtatatctgggcacacgctgtggttgccagcgtcccggtatttgccgttaccaacgtagccgacatttacgccactagcacatgcacagaggtctggtccaattcacttgggcatttggtgtatgtcttggtttacaacattaccaccgttatagtgcccgttgtagtggtgtttctttttctgattctgattaggagggcactttccgcttctcagaaaaaaaaggtgataatcgcggcgctcaggacccctcagaataccattagcatcccctatgccagtcaacgggaggccgagttgcacgcaactctcctgagtatggtcatggtattcatcctttgttccgtgccttacgccaccctcgttgtttatcagaccgtgttgaacgttcccgacacctcggtgtttttactccttaccgcagtctggcttcccaaggtgtccctgctcgccaatccagtgctgtttttaaccgttaacaaatcagtgagaaagtgtcttattggaaccttggtgcagcttcaccaccgatactcaaggagaaacgtggtatccaccggatcaggtatggccgaggcctccctggagccttctatccggtccggtagtcaactgctcgagatgttccacattgggcagcagcaaattttcaagcctactgaggacgaggaggagtccgaggccaagtatattggaagcgctgatttccaggcaaaggagatcttctccacatgtctggaaggggaacaaggaccacaattcgctccttcggctccgcctctaagcaccgttgatagcgtcagtcaagtagcacccgctgcccctgtggaaccggaaacattcccggataaatatagcttgcagtttggctttggaccttttgagctcccaccccaatggttgagtgaaactcggaactccaagaagcgcctacttccccctctgggcaacacaccagaagagcttatacaaactaaagtacccaaagtgggcagagtggagagaaaaatgagtagaaacaataaagtttctatctttcccaaagtggatagttag

SEQ ID NO: 188619 - DNA, 996 bp, Artificial Sequence
  Description of Artificial Sequence: Synthetic coding sequence
atgatcaccctgaacaaccaggaccagcccgtgcccttcaacagctcacatcctgatgaatacaaaatcgccgccctcgttttctatagctgcatctttatcataggactcttcgtgaacattactgccttatgggttttttcctgcacaaccaagaaaagaaccaccgtcactatctacatgatgaatgtggccctcgtcgacttaatctttattatgactttaccatttagaatgttctattacgcgaaagacgaatggccattcggggagtatttttgtcagattctaggagctctgacagtattctacccatcgatcgcattgtggttattagcgttcatctccgctgaccgctacatggccatcgttcagcctaagtacgctaaagaactcaagaatacgtgtaaggcagtgctggcatgtgtaggcgtgtggattatgacattaacgacaacaacacccctcctgctgctgtataaagatcctgacaaagacagcaccccagcaacatgcctgaaaatctccgacattatttatctgaaggccgtgaacgtgctgaatctgactagactaacctttttttttctaatccccctatttattatgattggctgctacctggtgattatacataatctgctccacggtcgaacctcgaaattgaagcctaaagttaaagagaaaagtatcaggatcatcataacactgctggtccaagttctggtgtgtttcatgcctttccacatctgttttgcattcctgatgctggggaccggagagaactcttataacccctggggggctttcaccaccttcctgatgaacctgagcacatgtttggacgtgatcttgtattacattgtgtctaagcagttccaagcacgcgtgatttcagtgatgctctataggaattatctgaggtcaatgaggcggaagtcttttcgctctggatctctccgtagcttgtccaacattaatagcgaaatgttatag

SEQ ID NO: 188620 - DNA, 996 bp, Artificial Sequence
  Description of Artificial Sequence: Synthetic coding sequence
atgatcaccctgaacaaccaggaccagcccgtgcccttcaacagcagtcaccctgatgagtacaaaattgccgctcttgtgttttactcttgcatcttcattattggcctttttgtaaatataaccgccctgtgggtgttctcttgcactactaagaagcgcaccaccgtaactatctacatgatgaacgttgccctcgtagacctgatcttcattatgactctgcccttccgaatgttctactatgccaaggacgagtggccctttggagagtacttttgtcaaattctgggcgctctcaccgtcttctacccaagtattgccctgtggctcctggccttcataagcgctgaccgctacatggccattgtgcagcctaagtacgccaaggaactgaagaacacttgcaaggcagtgttggcgtgtgtcggcgtgtggatcatgacgctgaccactactacaccactcttactgttatacaaggatccggacaaggactccaccccagctacttgccttaagatcagcgacattatctatctgaaggctgttaatgtactgaatcttaccaggctgaccttttttttcctcatccctctctttattatgatcggctgttacctcgtcatcatccacaatctgctgcacgggcgaacctctaagctgaaacctaaagtgaaggaaaagtcaatccgtatcattattacgctgctggttcaagttcttgtgtgcttcatgccattccatatctgcttcgcattcctgatgctgggcacaggtgagaattcctataacccttggggggcatttacaacgtttttgatgaatttaagtacctgtctggacgtcattctctattacatcgttagcaaacagttccaggctcgagtgatttcagtcatgctatataggaattatctgaggtccatgagacgcaagagctttcgtagtggcagccttcgcagcctgtcgaacatcaattcggaaatgctgtag

SEQ ID NO: 188621 - DNA, 996 bp, Artificial Sequence
  Description of Artificial Sequence: Synthetic coding sequence
atgatcaccctgaacaaccaggaccagcccgtgcccttcaacagctcccaccccgacgaatacaagattgcagctcttgtcttctactcttgcatattcatcatcggactctttgtgaacatcaccgcattgtgggtttttagttgtaccaccaagaagcgaactaccgtgacaatctacatgatgaacgtggcgctcgtggatctgatcttcatcatgactctacccttccgcatgttttactacgctaaggacgagtggcctttcggagaatatttctgtcagatcctgggagctttgacagtgttttaccccagcatcgccctctggctgctggcgtttattagtgcggaccgttacatggctatcgtccagccaaagtatgcaaaggagctgaaaaacacttgtaaagcagtgctcgcgtgtgtcggcgtttggattatgaccttgaccaccaccacacctttactcctgctctataaagaccccgacaaggatagtacccccgctacgtgcctgaaaatctccgatattatctatttgaaggccgttaacgtgctgaacctgaccaggctcactttcttctttctgatccccctatttattatgatcggatgttaccttgttattattcataatctcctgcatggccgtacttctaaacttaagcccaaagttaaggaaaaatctattaggatcatcataaccctgctagtgcaggtcctggtgtgttttatgcccttccacatttgttttgcttttcttatgctgggaacaggcgagaatagctacaacccctggggtgcgttcacaactttcctgatgaacttatccacatgcttggacgtgatcctgtactacatcgtgtccaaacagttccaggcccgtgtgatatctgtgatgctgtacagaaattacctgagaagcatgagacggaaaagttttcggtccgggtccttgaggtcgttaagcaacatcaattccgaaatgctctag

SEQ ID NO: 188622 - DNA, 297 bp, Artificial Sequence
  Description of Artificial Sequence: Synthetic coding sequence
atgatcaccctgaacaaccaggaccagcccgtgcccttcaacagcagccatccagacgaatacaaaatcgccgcactggttttttactcctgtattttcattattgggctgttcgtgaacattactgcattatgggtgttttcttgcaccaccaaaaagaggactacagtaaccatctacatgatgaatgtggccctcgtggacctgatctttatcatgaccctcccatttcgcatgttctactacgctaaggatgagtggccatttggggagtacttctgtcagattctgggatag

SEQ ID NO: 188623 - DNA, 1086 bp, Artificial Sequence
  Description of Artificial Sequence: Synthetic coding sequence
atggacatccagatggccaacaacttcaccccccccagcgccacccctcagggaaacgattgcgatctttacgcacaccatagcaccgcaaggatcgttatgccactgcactatagcctggtctttataattgggctagtcggcaatctgttagcactggttgtcatagtacaaaacaggaagaaaatcaacagcacaacactgtatagtaccaatctcgttatttctgatattttgttcactaccgcactgccaactcgcatcgcctattatgctatgggattcgactggcgcataggtgacgccctgtgcagaatcactgccttagtgttttacataaacacctacgcaggcgttaactttatgacatgcttgtccattgaccgctttatcgctgtcgtccacccattacggtacaacaaaatcaaacgcatcgaacacgccaaaggcgtttgcatatttgtgtggattttggtgttcgcacaaactctccctctgctcattaatcctatgtcaaaacaggaggcagagcgcatcacctgcatggagtaccctaattttgaggagaccaaatccctcccatggatccttctgggagcttgtttcatcggttatgtcctccctctgatcattattctgatatgttatagccaaatttgctgtaaactcttccgaactgccaagcagaaccctctgactgaaaagtctggggtgaataaaaaggccctcaacacaatcatccttatcatcgtagtgtttgtgctgtgtttcacaccttatcacgtggcaatcattcaacacatgatcaagaaactgcggtttagtaacttcctggaatgcagtcagagacacagctttcagatctctctccacttcaccgtgtgtttgatgaacttcaactgttgtatggatcctttcatctacttttttgcttgcaagggctacaaaaggaaggtcatgcgaatgttaaagcggcaggtctcagtctctatctcatctgccgtcaaatctgctcctgaggagaactccagagagatgacagaaactcagatgatgatccactcaaagagctcaaatggcaagtag

SEQ ID NO: 188624 - DNA, 1248 bp, Artificial Sequence
  Description of Artificial Sequence: Synthetic coding sequence
atggtgttcgcccaccggatggacaacagcaagccccacctgatcatccctaccctgctggtgcctctccagaataggtcctgtaccgagaccgcaactcccctcccttcacagtatcttatggaactgagtgaagagcacagttggatgagcaatcagacagatcttcactatgtcctcaagcccggcgaagtggcaacagccagcatctttttcgggatattgtggctgttctctatttttggcaatagcctggtgtgcctggtgatccataggtcccgccgaactcagtcgacaaccaattactttgtcgtctctatggcgtgcgccgatctgctcatttccgtcgcctctaccccattcgtgctgctgcaattcacaactgggcgttggaccctcggctctgccacatgtaaagttgtgcgttatttccagtacctgacaccaggcgtgcagatttatgtcctgctgtccatttgcatcgatagattctacactattgtatatccactgtctttcaaggtctctcgggagaaagctaagaagatgatagccgcaagctgggtctttgatgccggattcgtaaccccagttctttttttttacggaagcaattgggactcccattgcaactactttttgcccagctcatgggaaggaacagcatatacggtgatccatttcctagtgggtttcgtgattcctagcgttttaatcattttgttctatcagaaggtgattaagtacatctggcgcatcggaactgacgggcgcacggtccggcgcaccatgaacatcgtaccaagaaccaaggtcaaaaccataaaaatgttcctgattctcaacctcctattcttactgtcttggttgccgttccacgtcgcacaactatggcaccctcatgagcaagactataaaaagtcatccctggttttcaccgctattacctggatatcatttagcagcagcgcctccaaacccactctgtacagtatctataatgcaaacttcagacgcggtatgaaagaaaccttctgtatgtcaagcatgaagtgctacaggtctaacgcctacaccatcaccactagcagcaggatggcaaaaaaaaactacgtgggcatttcggagataccaagtatggcaaagaccataaccaaagattcgatatacgacagcttcgatcgagaggctaaggaaaagaaactggcatggccaataaacagtaatcccccaaatacattcgtgtag

SEQ ID NO: 188625 - DNA, 1248 bp, Artificial Sequence
  Description of Artificial Sequence: Synthetic coding sequence
atggtgttcgcccaccggatggacaacagcaagccccacctgatcatccccactctactggtgcctctccagaatcggtcctgtacggagacagccacccctcttccgagccaatacctgatggaactgtcagaggagcatagttggatgtccaatcagactgacctccattacgtgctgaagcctggggaggtggccaccgcgtccattttcttcggcattttgtggctcttttccatctttggtaattccctagtgtgtcttgttatccaccgaagtaggcgaacccaaagtacaacaaactacttcgtagtctccatggcctgtgctgacctcctgattagcgtcgcttccacaccctttgtcttgcttcagtttactacaggaaggtggaccttggggtcggccacctgtaaggtggtccgttatttccagtatttaactcccggagttcagatctacgttttattaagcatttgcatcgaccggttctatacaatcgtgtatccactgtcttttaaggtgagcagggagaaggctaagaagatgattgccgcgagctgggtttttgacgccgggttcgtcacccccgtactattcttttatgggagtaactgggattctcactgcaattacttcctgccctccagctgggagggtaccgcatacacggtcattcatttcctcgttggatttgtgatccccagcgtgctgattatcctgttctatcagaaagtgatcaagtatatctggcggattgggacagacggacgcactgtcaggaggacgatgaacatcgtccccagaaccaaggtgaagactattaagatgtttttaatcctgaatcttctgttcctcctgtcctggctgcccttccacgttgctcaactgtggcatcctcatgagcaggactataaaaagtcttctttagtctttactgccatcacctggatatcctttagttcttccgcttcaaaacccacattatattcgatctacaatgcgaattttcgcagaggcatgaaagagacgttctgtatgagttctatgaaatgctaccggtcaaacgcttatactatcactacctcgagccgtatggccaagaaaaactatgtgggtatctccgaaatcccatccatggccaagaccataactaaggattccatttatgatagtttcgacagagaagcgaaagagaagaagctcgcttggcccatcaactcaaatccacccaacacctttgtctag

SEQ ID NO: 188626 - DNA, 180 bp, Artificial Sequence
  Description of Artificial Sequence: Synthetic coding sequence
atggtgttcgcccaccggatggacaacagcaagccccacctgatcatacccactctgctcgtgcctcttcaaaatagaagctgcactgagaccgcaacccctctgccttctcagtatctgatggagctctcagaggagcatagttggatgtctaaccaaaccgacctgcattacgtctag

SEQ ID NO: 188627 - DNA, 1077 bp, Artificial Sequence
  Description of Artificial Sequence: Synthetic coding sequence
atgcccagcgtgagccccgccggccccagcgccggcgccgtgcccaacgccaccgccgtcactactgtgcggacaaacgcatctggcttggaagtacctttgttccatttgttcgcgcggctggacgaggaacttcatggcacttttcctgggctgtggctggcgctgatggctgttcacggcgccatcttccttgcaggactggtgctgaacggactcgccctgtatgtgttttgttgccgtacaagggcgaagactccatccgtcatctacacaatcaacctggtggtgacagatctgctggttggcctgtctctccctactaggtttgctgtatattacggtgccaggggctgtttgcgatgtgccttcccgcatgttctgggctacttcctcaacatgcattgttccattctctttctaacctgcatctgcgtggacaggtacctggcaatcgtgcggcctgagggtagccgaagatgccgacagcctgcttgcgccagagcagtgtgcgcttttgtgtggctcgcagctggcgccgttaccctgtccgtgctgggagtcaccggcagcagaccctgttgccgcgttttcgccctgactgtgctcgagtttctgcttccactacttgttataagcgtgttcacgggcaggattatgtgcgccctgagtagacccggtttactccaccaggggcgtcaacgacgagttagagccatgcagctgctgctgactgttctcattattttcctggtgtgttttaccccttttcacgctagacaagtggccgtggccctgtggcccgacatgccacaccatacttctctcgtggtgtatcacgtagctgttactctgtcttcactaaactcctgcatggatcctatcgtatactgcttcgtgaccagcggatttcaggccaccgtcagagggctgttcgggcagcatggggagcgcgaaccgagttctggggacgtggtcagcatgcaccggagttcaaagggctcaggtcgacaccacatcctctccgcaggcccccacgcactgacacaggctctagccaatggccccgaagcatag

SEQ ID NO: 188628 - DNA, 1050 bp, Artificial Sequence
  Description of Artificial Sequence: Synthetic coding sequence
atgaacagcaccctggacggcaaccagagcagccaccccttctgccttctcgcgtttggctacttagaaacggtgaatttttgtctgttggaggtgctaatcatcgtgttcttgaccgttcttattatttcagggaatattattgttatctttgtcttccactgcgcacctctactgaaccaccacactaccagttatttcatccaaactatggcctatgccgacctgttcgttggagtgagctgcgtggtgccttccctgagcctgttgcaccacccacttccggtggaagaaagtcttacgtgtcagatctttggatttgttgtctctgttctcaagagcgtgtcaatggcctctttagcctgtatctccattgatcggtacatcgccatcaccaagccactgacctacaacacactggtaactccctggcgtttaagattgtgtatctttctcatctggttgtacagtaccctggtatttcttccctcatttttccactggggcaaacccggataccatggagatgtcttccagtggtgcgccgagagctggcatacagacagttatttcactcttttcattgtaatgatgctgtacgccccagcagcactcattgtgtgcttcacctatttcaatatcttccgaatctgccaacagcacactaaagatatcagtgagaggcaggcacggttttcctcccagagtggggagacaggagaagtccaggcctgtcctgataagcgttacgccatggtgctctttcggattacatccgtgttctatatcctgtggttgccttacattatctatttcttactggagagctctacagggcattcgaatcgctttgctagcttcctgaccacgtggctggcgattagcaacagtttttgcaattgtgtgatttatagcctctccaactctgtgttccagagggggctgaagcgcctttccggggctatgtgtacttcatgcgcatcacaaacaaccgctaacgatccttacacagtgagaagcaaggggccccttaatggctgccatatttag

SEQ ID NO: 188629 - DNA, 753 bp, Artificial Sequence
  Description of Artificial Sequence: Synthetic coding sequence
atgaacagcaccctggacggcaaccagagcagccaccccttctgcctgctcgcatttgggtatctggagaccgtgaatttctgtttactggaggtgctgatcattgtcttcttaaccgttctcattatcagcggaaacattatcgtcatcttcgtgttccattgcgccccactgttgaaccaccacacgacatcttatttcatccagacaatggcatacgctgatttatttgtgggtgtctcttgtgtggtcccctcactgtcactgctgcaccatcccctccctgtcgaggaatctctcacttgtcagatctttggctttgtagtctccgtcttgaaaagcgtttcgatggcaagcctcgcctgcatatccattgatcgctacatcgcaatcacaaagcccctcacgtataacaccctggttactccttggagactgcggttgtgcatttttcttatctggttatattcaacattagtgttccttcctagtttcttccattggggtaagcccggctatcatggcgatgtgtttcaatggtgcgctgaaagttggcacaccgattcctatttcacactgttcattgtgatgatgctgtacgcccctgctgccttaattgtgtgttttacttatttcaatatttttagaatctgtcaacagcacacaaaggacatctcagaaagacaggctaggttttcttcccagagtggagagactggcgaggtgcaagcctgccccgtcagtaaccattag

SEQ ID NO: 188630 - DNA, 1302 bp, Artificial Sequence
  Description of Artificial Sequence: Synthetic coding sequence
atgtgcttcagccccatcctggagatcaacatgcagagcgagagcaatattacagtgcgggacgatattgacgacatcaatacgaatatgtaccagcctttgagctacccgctgtctttccaggtgtctctgactggttttttgatgctcgagatcgttcttggcctagggagtaacctgacagtgctagtattatattgcatgaagtccaacctcatcaacagcgtgagcaatatcattaccatgaatctgcatgtcctcgatgtcatcatttgtgtcggatgcattcctctcacaattgttatcttactactctctctagagtccaatacagcccttatctgttgtttccacgaagcgtgcgtatccttcgcttctgtgtcgactgccattaatgtcttcgcaatcaccctcgatagatacgacatctccgtaaagcccgccaatcgcattctgaccatgggcagagcagtgatgttgatgatcagtatctggattttttccttttttagctttttaatcccattcatcgaggtgaactttttttccctccaatccggcaatacatgggagaacaaaacactcttgtgtgtgtccacaaacgagtactatacagaattgggcatgtactaccacctgcttgtgcagattcctatcttcttttttacagttgtagtaatgctcataacatacacgaagatcctgcaggcacttaatatacgaattggcactcggtttagtaccgggcagaagaaaaaagctagaaagaagaaaaccatttccctgactacacaacacgaggccacagatatgagtcagtcatctggcggcaggaatgttgtcttcggagtgcggacctctgtcagcgttatcatcgctctccgacgggccgtgaaacgccaccgcgaacggcgtgagcgacagaagagagttttcagaatgtctctactgatcatctctactttcctcctttgctggaccccgattagcgtgctgaatacgactatcctgtgtcttggcccttctgatctgctggtcaaactcaggctgtgttttttagttatggcatatggtaccactattttccatcccctactctacgcttttactagacagaagttccagaaagtgctgaaatcaaaaatgaagaagcgcgtggtcagtattgtggaggctgacccactccctaataatgccgtcatccacaactcttggattgatcctaaacggaataaaaagataacttttgaggattccgagatccgcgagaaatgcctggtgccccaggtagtcactgactag

SEQ ID NO: 188631 - DNA, 1086 bp, Artificial Sequence
  Description of Artificial Sequence: Synthetic coding sequence
atggcccccaccgagccctggagccccagccccggcagcgccccctgggattatagcggcctcgatgggctcgaagaattagagctgtgcccagccggagacctcccatatgggtacgtgtatatcccagctctttatctcgcggcctttgccgtggggcttctgggtaatgcctttgtggtctggcttctggccggcagacgaggaccaaggcgattggtcgatacctttgtgctgcaccttgctgccgcggatttgggcttcgtgttaactctacccttgtgggccgctgcggcagccctcggaggcagatggccattcggggacggattatgtaagctctccagttttgcactggcaggaactagatgtgccggtgccctcctgctggcgggcatgagcgtggatcggtatttagccgttgtgaaacttctcgaggcccggcctctgcgcaccccccggtgtgcactggcgtcgtgctgcggagtatgggccgtcgccttgctggcggggcttccaagtctggtttacaggggactgcagcccctgccaggggggcaagattctcagtgtggggaagagcccagtcatgccttccaggggctttctctcctcctgctgctcctgacctttgttctccccctcgtagttaccctgttctgttactgccgcattagtcgacgacttaggcggccacctcatgtcgggagagcaagacgtaactctctgcggattatctttgcaatcgagagcacctttgtcgggtcttggctcccattttccgccctgcgcgccgtcttccacctcgctcgcttgggggccctgcctctcccttgtccgcttctccttgctttgaggtggggactgaccattgccacatgtctggcctttgtgaattcttgcgcaaatccactgatttatctgttgttagaccgttcctttagagcccgagcacttgacggtgcttgcggcagaactggacggcttgcgcgacgcatctctagtgcaagctctctgagcagggacgacagctctgtgtttcgatgcagggcccaggctgccaatacggcatcagcgagttggtag

SEQ ID NO: 188632 - DNA, 1014 bp, Artificial Sequence
  Description of Artificial Sequence: Synthetic coding sequence
atgaacagctgggacgccggcctggccggcctgctggtgggcaccatgggtgtcagcctcctctcgaatgcactcgtgctgctctgcctactccactccgccgacatccggcgccaggctccagcgctcttcacccttaatcttacatgcggcaacctcctttgtacggtcgtcaacatgcccctaacactcgcaggggtggtggcacagcgtcaaccggccggcgatcgcctctgtaggttggctgcgtttctggatacgttcctggccgccaacagtatgctcagtatggcagcgctctcaatagatcgttgggtcgccgtagtgtttcccctgtcatatagagccaaaatgcgactgcgggacgccgcccttatggtggcgtacacctggttacatgccctcaccttccccgccgcggccctggccctgagctggctgggcttccatcagctttatgcctcctgcacgctgtgttccaggcgcccagacgagcgcctgagattcgcggtgtttactggcgcatttcatgcactcagttttttactatctttcgtagtgctatgctgtacgtatctgaaagtgctgaaagtggccagatttcattgtaagaggatcgacgtaatcaccatgcaaacactcgtgcttctcgtggaccttcatccttctgtccgtgaaaggtgtttagaggagcagaaaagacgccgccagagggctactaaaaaaatctcgacatttatcggaactttcctagtgtgttttgccccgtatgttatcactcgactcgtggaactgttcagtacagtaccaatcgggagccattggggcgtactaagcaagtgcctagcctactcaaaggcggcaagcgaccctttcgtttactccctattacgacaccagtaccgcaagtcctgcaaggagattctgaatcgcctgctgcacaggagatccatccactcctccggattgactggagactctcacagccagaacatactgcctgtaagtgagtag

SEQ ID NO: 188633 - DNA, 1128 bp, Artificial Sequence
  Description of Artificial Sequence: Synthetic coding sequence
atggccaacgccagcgagcccggcggcagcggcggcggcgaggccgcagccctgggtcttaagctagcaacgctgagcttgcttttgtgcgtgtcccttgcagggaacgtgctttttgcactgttgatcgtacgcgagcgctctctccacagggctccctactatcttctactggacctgtgcttagccgacggactgcgtgctttggcctgtttgcccgccgtaatgctggcagctcggcgggcggcagccgctgctggcgcacccccgggtgctctggggtgcaagctcttagcgtttctagccgctctcttttgctttcatgcagcctttttactgttgggtgtgggggtcactcgctacctcgccattgcccatcaccgcttttacgcagagcggcttgctggctggccatgcgctgcaatgctagtgtgcgccgcttgggccctggccctggcagctgcattcccaccggttctagatgggggaggcgacgatgaagacgcgccctgcgctttagagcagaggcctgacggtgcgccaggcgcccttggattcctgcttctcctggcagtcgtagtgggagccactcatttggtttacctgcgtctgcttttctttattcatgataggagaaaaatgcggccagccagactggtacccgccgtctcccacgattggacctttcatggcccaggggcaactgggcaggcggccgccaactggaccgctggattcggtcgcggtcccactcctccagcgctggtaggcattcggcccgcaggaccgggacgcggggcccggcgactgttggtcctcgaggaatttaagacagagaagcggctgtgtaaaatgttctacgccgttactcttctgttccttctcctatggggtccttacgtggtcgccagttacctgcgtgtgctcgtgaggccgggtgccgtgccacaggcatacctgaccgcttccgtgtggttaaccttcgcacaggcaggcataaaccccgtggtgtgctttctgtttaatagggagctacgggattgctttcgcgcacagtttccctgctgtcagtctccacggacaacacaggccactcacccatgcgacctgaagggtattggactgtag

SEQ ID NO: 188634 - DNA, 993 bp, Artificial Sequence
  Description of Artificial Sequence: Synthetic coding sequence
atgatgtggggcgccggcagccccctggcctggctgagcgccggctctggcaacgtaaatgtcagttcagtaggaccagccgagggccctaccggtccggccgcccctttgccttctcccaaggcgtgggatgtcgtgctctgcatcagtggcacacttgtctcttgcgaaaatgctctcgtggtggcaatcatcgtgggaactccagcctttagggctcctatgtttctgctcgtaggtagtctcgctgttgcggatctgctcgctggactcggactcgtcctacactttgcagccgtcttctgcatcgggtccgcagagatgagtctcgtcctggtgggagttcttgctatggcctttacagcctcaatcgggagccttctagccattactgtggatcgctacctgagtctatataacgctttgacatattattctgagacgacagtgacgaggacctacgtcatgttagctctcgtgtgggggggggctctgggactaggcctgctgcccgtcctggcatggaactgtctggatggactgacaacctgtggcgtagtttatccactgagcaagaaccacttggtggtgctagctattgctttctttatggtcttcggcattatgcttcaactctacgctcagatatgtcgaattgtgtgtcggcatgctcagcaaattgcactgcagcgccatttattgcccgcctcacactacgtggcgacccgaaaaggaatcgccaccctggcagtagttttaggtgcattcgccgcgtgctggttaccctttactgtttattgtctcctgggggatgctcattcgcctccactgtatacttaccttaccctgttaccagcgacctataattcgatgattaatcccatcatatatgccttcagaaatcaggacgttcagaaagtgttatgggctgtctgttgctgctgtagcagtagcaaaattccatttaggtctaggtcgccttcagacgtatag

SEQ ID NO: 188635 - DNA, 960 bp, Artificial Sequence
  Description of Artificial Sequence: Synthetic coding sequence
atgcccttccccaactgcagcgcccccagcaccgtggtggccaccgctgtgggagtgctcctgggtcttgagtgcgggctgggactgttgggcaatgcagttgcgttgtggacctttttatttcgtgttcgggtgtggaagccatatgccgtttatctactgaacctcgccctggccgacctgctgctcgccgcttgcctgcccttcttggcagccttctacctaagcctgcaggcttggcatttaggccgggtggggtgctgggccttgcattttctcttggacctgtctagaagcgtggggatggccttcctggcggccgtcgccttggatagataccttcgtgtggttcatccaaggttaaaagtgaatctgctgtctcctcaggccgcactcggagtatctggccttgtttggctactcatggtagcgctgacttgccctggcctcttgattagtgaggccgcccagaactcaaccagatgtcattcattctactctagagcagatggctcgttttccatcatctggcaggaagcactgtcgtgtctgcagtttgtgcttccctttggattgattgttttctgcaacgctgggattatccgcgctcttcagaagcggcttcgagagcctgagaaacaacccaagctccagagggcacaggcgctggtgaccctggtggtggtgttgttcgctctgtgttttcttccttgtttcttagcgcgcgttctgatgcacatctttcagaacctcggatcatgtcgggctctctgtgctgtggcacacacatccgatgttaccggcagtctcacttatctgcatagtgtcctgaatcccgtcgtgtattgtttctctagtcccacctttaggtcttcctatcgaagagtctttcacaccctgaggggcaaaggccaggctgccgaaccacccgacttcaatccccgggatagttattcttag

SEQ ID NO: 188636 - DNA, 1071 bp, Artificial Sequence
  Description of Artificial Sequence: Synthetic coding sequence
atgaacggcgtgagcgagggcacccggggctgcagcgaccggcagcctggcgtgcttacacgcgatcgctcttgcagtagaaaaatgaactcctcagggtgcctgagtgaagaagttggatcactcaggcccctcaccgttgtaatattgtccgcttctattgtggtcggcgtattaggtaatggccttgtcctgtggatgactgtgtttagaatggccaggactgtatctactgtgtgctttttccatctggctctggcggatttcatgctgtcgctgtccctacccatcgcaatgtattatatcgtgagccgccagtggctgctgggggaatgggcctgcaagttgtacataacgttcgtgtttctttcctattttgcatctaactgtctgttggtcttcatttcagtggatcgttgtatcagcgtcttgtaccctgtgtgggccctgaaccacaggaccgtccaacgggccagctggcttgctttcggagtttggcttctcgcagccgccctgtgttccgcccatttgaagtttaggaccacgagaaaatggaatggttgtacccactgttacctcgccttcaactctgacaacgagacagctcagatctggatcgagggcgtcgtggaaggacatattattggaaccatcggacacttcctgcttggctttctcgggcccctggctatcatcggtacctgcgcccacctcatccgtgccaaactactccgggaggggtgggtgcacgccaacagacccaagaggctgttattagtcttggtgagcgcattctttatcttttggtctcctttcaacgtcgtactcttagtccatctgtggaggcgggtgatgttaaaggaaatttaccacccacgcatgctgcttattctgcaagcctcctttgccctggggtgcgtgaactcttcgttgaacccttttctctacgtatttgtgggcagggatttccaggagaagttctttcagagcctgacctctgccttagcgagagccttcggagaagaagagttcctgagcagttgtccccgcgggaatgccccccgtgaatag

SEQ ID NO: 188637 - DNA, 1146 bp, Artificial Sequence
  Description of Artificial Sequence: Synthetic coding sequence
atgcggagccacaccatcaccatgaccaccaccagcgtgagcagctggccatacagtagccatcgcatgagattcataaccaaccattctgatcagccacctcaaaatttcagcgcaacacctaatgtgaccacctgtcccatggacgaaaaacttctctctacagtgctgaccacctcttatagcgtcatatttatcgttgggctcgtgggtaatatcattgctctctacgtgtttcttgggatacaccgcaagaggaattctattcagatttacctgcttaacgtcgccatagctgaccttctgctgatcttctgtttgcctttccgaatcatgtatcacatcaatcaaaacaaatggacactaggggttatcttgtgtaaggtggttgggacactgttctacatgaacatgtatatttccatcatcttgctggggttcattagcctggaccgctacattaagatcaaccgctcaatccagcagcgtaaggccataacaacgaaacagtccatttatgtctgctgtattgtttggatgctggctctgggcggattccttacaatgattatactaacgctcaagaagggaggacataattccacgatgtgcttccattaccgggataagcataatgccaaaggcgaagccatatttaacttcatactcgttgtgatgttttggctcatctttcttctgattatcctgtcttatataaagattggaaaaaacctgctgagaatctcgaagcgaaggtcgaaatttcccaactccgggaagtacgccactaccgcacggaactcatttatcgttcttattatctttacgatatgctttgtgccgtaccatgcctttcgcttcatctacatatcatcccagctgaacgtctcttcttgttactggaaggagatcgtgcacaagactaatgaaatcatgctagtgctctcgagcttcaatagttgccttgatcctgtgatgtactttctcatgtcctctaatatacggaaaattatgtgccaactactctttagacgctttcagggcgaaccttcaaggtcagagtctacttctgagtttaaaccaggatattccctgcatgacacgtccgtcgccgtgaagatccagtcttcctcaaagtctacctag

SEQ ID NO: 188638 - DNA, 1146 bp, Artificial Sequence
  Description of Artificial Sequence: Synthetic coding sequence
atgcggagccacaccatcaccatgaccaccaccagcgtgagcagctggccctactcctctcatagaatgaggttcattaccaatcatagcgaccagcccccccagaattttagtgccaccccaaatgtaacaacatgcccaatggacgagaaattgctgtcaaccgttctgactacctcctatagcgtcatctttatcgttgggctcgttggcaacattattgcattgtatgtttttctgggcatacatcggaaaaggaattccattcaaatttacctgcttaacgtcgctatcgcagatctgttgctgatattctgccttcctttccggattatgtaccacataaaccagaataaatggacactaggggttatattgtgtaaggtagttgggactctgttctacatgaacatgtacatctccattattctgctgggattcattagcctggacaggtacataaagattaatagatcaatccagcagcggaaagcaatcacaacaaagcagtctatatacgtgtgctgcatcgtttggatgctcgcccttgggggatttttgacaatgataatcttgacgctgaaaaaaggagggcataattcaaccatgtgctttcactatcgggataaacacaatgctaagggagaggcaatctttaattttatccttgtcgtgatgttctggctgatctttctgttgattattctgagctatattaaaatagggaaaaatttgctgaggataagtaagaggagaagcaagttcccaaatagtggaaagtatgctacaaccgcaaggaattccttcatcgtgcttattatctttacaatctgcttcgtgccctatcacgcgtttcgctttatttacatctcatctcagttgaatgtctcttcctgctactggaaagaaattgttcacaagactaacgagatcatgttagtgctgagcagcttcaacagctgcctggatcccgtcatgtactttttgatgtcctcaaacattagaaaaatcatgtgccagctgctgtttaggcgattccaaggtgaacccagccggtcggagagcacgtctgagttcaagccaggatatagcctgcacgacaccagcgtggcggtgaagattcagtcgagtagcaagagcacctag

SEQ ID NO: 188639 - DNA, 1005 bp, Artificial Sequence
  Description of Artificial Sequence: Synthetic coding sequence
atggacgagaagctgctgagcaccgtgctgaccaccagctacagcgtcatcttcatagtaggcctggtgggtaacatcatcgcactgtacgtttttttaggcatccaccggaagaggaatagtattcaaatctacctgctgaatgtggccatagccgacttactgcttattttctgcctgcctttcagaatcatgtaccacataaatcagaataaatggacattaggtgtgatcctttgcaaggttgtgggcactctattctacatgaatatgtacatttccatcattctgttaggcttcattagtctcgaccgatacatcaagataaaccggtccattcaacagcgcaaggctattacaacgaaacagtccatctatgtgtgttgcattgtgtggatgctggccctgggaggattcctgacaatgattatactcaccctcaaaaaggggggtcataatagcacaatgtgctttcactatagggataagcataacgccaagggagaggccatatttaactttattttagtggtaatgttctggctgatttttttactaatcatattgtcttacataaagattgggaagaacctcctgagaatctcaaagcgaaggagcaagttcccaaacagcggcaaatatgccaccacagcacgcaatagctttatcgttttaataatatttaccatatgtttcgtgccctatcacgcctttaggttcatttacatctccagtcagttgaatgtcagttcatgctactggaaggaaatcgtacacaaaacaaacgaaatcatgctcgttttaagctcatttaatagctgccttgatcccgtgatgtattttcttatgagtagcaatataaggaagattatgtgccagttactgttcaggaggttccaaggggaaccaagccgatcggagtccacatctgaatttaagccaggttacagtctccatgacacctctgtggcagtgaagattcaatcatcttcgaagtctacctag

SEQ ID NO: 188640 - DNA, 930 bp, Artificial Sequence
  Description of Artificial Sequence: Synthetic coding sequence
atgaacggcacctacaacacctgcggcagcagcgacctgacctggccccccgccatcaaactcggcttttacgcatacctgggcgtgctgctggtgctgggactgttgctgaactctctcgcactctgggtcttctgctgtagaatgcaacagtggaccgagactcgtatttatatgacaaatcttgcagtcgccgatctgtgtttgctgtgcaccctcccctttgttttgcattccttacgtgacacaagcgatacaccactctgccagctgtcccagggaatttaccttaccaaccggtatatgagtataagcctcgtgacagcaatcgcagtggaccggtacgtagcagtgaggcatcctcttcgggcaaggggcttacgctccccccgtcaggccgctgccgtgtgtgcagtgctgtgggtgttagtgataggcagcctcgttgctcgctggctactggggatccaggaggggggcttttgttttaggagcactaggcataattttaattcgatggcgtttcccctacttggcttttatctgcccctggccgttgtagtcttctgttcacttaaggtcgtcacagctctggctcaacgaccgccaacagatgttggccaggcagaagctactaggaaagccgctagaatggtctgggccaacctgcttgtctttgtggtatgcttcctgccactccatgtgggactaaccgtaaggctggctgtgggttggaacgcatgcgctctgctcgaaacgattaggagagctctttacattacatctaaattgagcgatgctaactgctgtctagatgctatctgttactactatatggcaaaggaatttcaggaggcgtctgcgctagccgttgctccttccgctaaagcacataagtcacaggattccctctgcgtaaccctggcctag

SEQ ID NO: 188641 - DNA, 930 bp, Artificial Sequence
  Description of Artificial Sequence: Synthetic coding sequence
atgaacggcacctacaacacctgcggcagcagcgacctgacctggccacctgctatcaagctgggtttctatgcctatctgggcgtgttactggtgctggggctgctgcttaactcactagcgttatgggtattttgctgccgaatgcagcagtggacggagaccaggatttacatgactaaccttgccgtagccgatctgtgtctcctgtgtaccttgcctttcgttctccattccctccgcgatacatctgatactcccctgtgtcaactaagccagggcatatacctgacgaaccgttacatgagcattagtctagtcactgcgatcgctgtggatcgatacgtggcagtccggcatcctcttagggcacgcggattgcgcagtcctagacaggccgccgccgtgtgtgccgtcctgtgggtgctggtgattggtagcctcgtcgctcgatggctgttaggaattcaggaaggcggattttgttttcggtccacaaggcataactttaactccatggcattccccctgctcgggttctatctccctctggctgtggtggttttttgctccctgaaggtggtcaccgctttggctcaaaggcctcctactgatgtgggtcaggccgaggcaaccagaaaagctgcacggatggtctgggctaatttgctggttttcgtggtctgcttccttccgttgcatgttggcctaacagtgcggttggcagtcgggtggaacgcctgcgcgctgctggaaacaatccggagagctctttatatcacctccaagctctcagatgccaattgttgcctggacgcaatctgttattattatatggctaaggaatttcaggaggcaagtgctctagccgtcgcaccgtctgccaaggcgcacaagagccaggatagcttatgcgtcactcttgcttag

SEQ ID NO: 188642 - DNA, 930 bp, Artificial Sequence
  Description of Artificial Sequence: Synthetic coding sequence
atgaacggcacctacaacacctgcggcagcagcgacctgacctggccccccgcaatcaagcttggcttctacgcctatctcggggtcctgctcgtgctgggcctgttgctaaacagccttgcactgtgggtgttttgctgccgcatgcagcagtggaccgagaccaggatctacatgacaaatttggctgttgctgatctgtgcttactatgcacattgcccttcgtattgcacagcctacgggatacatccgacacacccctttgccagctgtcccagggaatttacctgaccaacagatatatgagcatctccctagtgaccgctatcgctgtggaccgatacgtggctgtgcgacatcctttgcgcgccagaggattaaggtcccccagacaggccgctgctgtttgtgctgtgctctgggtgctggtgatcggctccctcgtagcgaggtggttgctcgggattcaggagggcggcttctgttttaggtctacacggcacaacttcaattcaatggcattcccactcctgggtttctatttacccctagcagtagtagtattttgcagcctaaaagtggtgaccgccctcgctcagcgaccacctacggacgtgggccaggccgaagctactcgtaaagctgcccggatggtgtgggccaatttactggtcttcgtcgtgtgctttctgcccctacatgtcggcctcacagtgcgtctcgccgtaggttggaacgcctgcgcgttgctcgaaaccattagaagagccttgtatatcacttccaaactatcggatgcaaactgttgccttgatgccatttgttattactacatggctaaagagtttcaggaggccagtgcattggccgtggccccatctgccaaggcacataaatctcaggactctctgtgtgtgacactggcatag

SEQ ID NO: 188643 - DNA, 930 bp, Artificial Sequence
  Description of Artificial Sequence: Synthetic coding sequence
atgaacggcacctacaacacctgcggcagcagcgacctgacctggccacctgcgataaagctggggttttacgcatatctgggcgtactgctggtcttggggctgctgctgaattccctggctctgtgggtcttttgttgccggatgcaacagtggaccgaaactagaatttacatgacaaacctggctgtagctgacctttgcctgctatgtacgcttccttttgtcctgcattccctacgcgacacctctgatactcccctctgtcagctcagccagggcatctacttaacaaatcgctacatgtccatttctctggtgactgccattgcagtggataggtacgtcgcagtgcgccacccattaagagccaggggtttgcggtctccacgccaggcagctgcggtgtgcgcagtgctctgggtgctagtcattgggtccctagtcgcacgttggcttctgggcatccaagagggcggattctgttttcgctctacaaggcacaattttaattcaatggcctttcctcttctcggattctacctccctctagcggtcgtagtcttttgtagtctgaaggtggtaaccgctctcgcacaacgacctccaaccgacgtggggcaggccgaggcaacaagaaaagcggcccgcatggtgtgggccaaccttctagtgttcgtggtgtgtttcctcccactccacgtcggcctgactgtcaggctggccgtgggctggaatgcatgcgccctgctggagacaatcaggcgcgccctctacattacctctaagttatcagacgctaactgctgcctggacgcaatatgctattactacatggctaaagagtttcaggaggcctccgccttggccgtggcaccaagcgccaaagctcataaatcccaggacagtctatgcgtgacactggcctag

SEQ ID NO: 188644 - DNA, 1023 bp, Artificial Sequence
  Description of Artificial Sequence: Synthetic coding sequence
atgctgagcggcagccgggccgtgcccaccccccaccggggcagcgaggagctgttgaaatacatgcttcattccccctgcgtttccctgaccatgaacggaacatacaacacttgcggaagctctgacctgacctggcctccggctatcaagttgggattctatgcctacctcggggtcctgctggtgctgggcctgctcctgaattctctggccctttgggtgttttgttgtcggatgcagcaatggaccgagacacgcatctacatgacaaacctagccgtggctgacctgtgcctcctctgtacgctgcccttcgtgttacattcgctgcgggatacgtccgatactcccctgtgtcaattatctcagggtatatatctgaccaaccgctacatgtctatatcactggtgacggccatcgctgtggaccggtatgtggcagtgcgccaccccctgcgcgcacgcggcctgcgtagtcctaggcaggcggcagctgtgtgtgccgtcctgtgggtgctagtcatcggtagcctggtggcccgctggctactcggcattcaggagggcggattctgtttcagatctacaagacacaattttaactccatggcatttcctctgttgggcttttatcttcctttggccgttgttgtattctgttctcttaaagttgtaactgccctggcacaacgaccacctaccgacgtaggtcaagcagaggcgacgcgtaaagcagcacgcatggtgtgggcaaacctgctcgtcttcgtggtgtgcttcctgccactgcatgttggcctaaccgtccgcctcgccgttggctggaatgcctgtgctctgttagaaacaatccgtagagctctctacataacgtccaagctgtctgacgcgaactgctgcctggacgcgatctgctactattacatggcgaaggagtttcaggaggcctctgcgttggctgtggctcccagcgcaaaggctcataaaagtcaggactccctctgcgttacactggcttag

SEQ ID NO: 188645 - DNA, 1842 bp, Artificial Sequence
  Description of Artificial Sequence: Synthetic coding sequence
atgcgggcccccggcgccctgctggcccggatgagccggctgctgctgctgttacttctgaaggtttccgcatcttctgcactaggggtggcacctgcttcccggaacgaaacctgcctaggtgagtcgtgtgcgcccacggtaatccagcggcgcgggcgagacgcatgggggcccgggaacagcgccagggacgtcctgagagcccgcgctccgagagaggaacagggggctgccttcctcgccgggccaagctgggatttgcccgctgcacccggtcgcgacccagcggccggaagaggcgcggaagcatctgccgccggccctcctggccctcccacgagacccccagggccctggcgctggaagggggcacgggggcaggaaccgtcagagaccttggggcgcggaaatccaaccgcccttcagttgttcctgcaaataagcgaggaggaggagaaggggccccgaggcgccggcatttccggcaggagtcaagaacaatcagtgaaaactgttccaggcgccagtgacctgttttattggcccagacgtgcaggcaagcttcaaggatcccatcataaaccattatctaagacagctaatgggctggctggacatgagggttggaccatcgctctccctgggagagccctggcccagaatggtagcctaggcgaaggcattcacgagcctggagggccacgccgcggaaattccactaatagaagagttcggctcaagaatcctttctaccccctcacacaggagtcctatggtgcctatgcagtgatgtgcctgagtgtggtcatttttggtactgggattataggaaatttagccgtgatgtgcattgtatgtcataactattatatgcgctcgatctccaactctttgctcgcaaacctcgccttctgggactttctcatcatttttttttgccttccacttgttatttttcacgagctgacgaaaaaatggctcctggaagactttagttgtaagattgtgccatacattgaggtggcaagtctcggggtgacaacgttcacactgtgcgccctgtgcatcgaccggtttagagccgccaccaacgtgcagatgtattacgaaatgatcgaaaactgttctagcaccacagcgaaactggctgtgatttgggttggcgcgctgctcttagctctcccagaagttgtattaaggcaactcagcaaggaagacctggggttctctggacgcgctcccgctgaacggtgcataatcaaaatcagcccagatctgcccgacacgatctacgttcttgccctgacctatgacagcgcgagactgtggtggtacttcgggtgttacttttgcctgcctaccctgtttacaataacgtgttcgttggtgactgccaggaagattagaaaggccgaaaaagcgtgcacgcgagggaacaaacgccagatccagctcgagtctcagatgaactgcactgtggtggctcttactattttatacgggttctgtatcatccctgaaaacatctgcaatattgtgacagcatatatggcaacgggggtaagccagcagactatggacctactaaacatcatcagtcagttcctgctatttttcaaatcttgtgtgacaccagtgcttctcttttgcctgtgcaaaccattttcaagggcttttatggagtgttgctgctgctgttgtgaggaatgcatccagaaatctagtacagttacctccgacgacaacgataacgaatatactacggagctggaattgtctccgtttagcacaatcagacgagaaatgtccacgttcgcctccgtcggaacccactgttag

SEQ ID NO: 188646 - DNA, 1362 bp, Artificial Sequence
  Description of Artificial Sequence: Synthetic coding sequence
atggccagccccagcctgcccggcagcgactgcagccagatcatcgatcactctcacgttccagagttcgaggtggcaacctggattaagatcaccctaattctggtctacctgatcatcttcgtgatggggttactcggtaactcagcgacgattcgggtgacccaggtgctgcagaagaaggggtacttgcaaaaggaggtcacagaccacatggtgtccttggcttgttccgatatactcgtgttcctcatcggtatgcctatggagttttatagtatcatctggaatccactgacaaccagttcctacaccctgagctgtaaacttcatacgtttctgttcgaagcctgctcttatgccactcttttacatgttctcaccttatctttcgagaggtacatcgcaatttgccacccatttagatacaaggcggtgtctggaccttgtcaggtgaaactgttgatcggattcgtctgggtgacttctgcactggtggctctgcctctcctgtttgctatgggtactgagtacccgctggttaatgtgccatcacatcgcggtttaacctgtaaccggagttcaacaagacaccacgagcagcctgagacttctaacatgagcatatgcaccaacctatcatcccggtggactgtgttccaaagctccatcttcggtgctttcgttgtctacctagtcgtgttgctctcagtggccttcatgtgctggaacatgatgcaggtactgatgaagtctcagaaaggttccctggctggcggtacccgccctccacaactgcggaagagcgagtctgaggagtccaggaccgctcgtaggcagaccattattttcctgagattgatcgtggtgacattggccgtgtgctggatgcctaaccagatcagaagaattatggctgctgcaaagccaaagcacgattggactaggagctatttccgcgcgtacatgatcttactcccatttagtgagacgttcttttacctaagctcagtgattaaccctcttctctacaccgttagcagccagcagttcaggcgggtattcgtccaggtgctgtgctgccgactgtctctccaacacgcaaaccacgagaagcgcctgcgcgtgcatgcacattccaccacagacagcgcccggtttgtgcaaagaccattattatttgccagcagacggcagagctctgcgcgacgcacggaaaagatctttctatccaccttccagtccgaagccgagccacagtcaaagtcacagagcctctcactggaatcccttgaacccaattccggcgctaagcctgccaactccgccgccgagaacggctttcaggaacacgaggtatag

SEQ ID NO: 188647 - DNA, 1089 bp, Artificial Sequence
  Description of Artificial Sequence: Synthetic coding sequence
atgggcaaccacacctgggagggctgccacgtggacagccgggtggatcatctgttcccaccctctttgtacatcttcgtgattggtgtgggactgccgacgaattgtctggctctctgggctgcttatcggcaggtccagcagagaaatgaattaggtgtgtacctgatgaatctttccattgcagacttgctttatatttgtaccctgcccctgtgggtcgactattttctgcaccatgataattggattcacggtcctggaagctgcaaactctttggctttatcttctatacaaacatatacatcagcatcgctttcttatgttgcatttcagtagaccgctacttagccgtggcccaccctctccgctttgcccgcctgcgccgtgtcaaaacagctgttgccgtgtctagcgtggtatgggctaccgaactgggggccaactctgcccccctgtttcatgatgagctatttcgggacagatataatcataccttttgttttgagaagttcccaatggaagggtgggtggcttggatgaacctctaccgcgtgtttgtgggcttcctgtttccctgggccctgatgctgctctcttacaggggtattctgcgcgccgtgaggggatcagtcagtacggagcggcaggagaaggctaaaataaaacggctagccctgagtctgattgcaattgttctcgtttgcttcgcgccttaccacgtgctcctcctgtcccgctcagctatctaccttggacggccctgggactgtggattcgaggagagggtgtttagtgcttaccacagtagcttggccttcacctccctcaattgcgttgccgatccgatcctgtattgtctggtaaacgaaggcgcacggagcgacgtcgccaaagctctgcataacttgctgcgtttccttgcttccgacaaaccacaggagatggccaatgcatcactcacgctcgaaacccctcttacgagcaagagaaacagtaccgccaaggccatgaccggctcctgggccgctactcccccaagccagggtgaccaagtacaactcaagatgcttccacctgcccaatag

SEQ ID NO: 188648 - DNA, 1041 bp, Artificial Sequence
  Description of Artificial Sequence: Synthetic coding sequence
atggacaccggccccgaccagagctacttcagcggcaaccactggttcgtgttctccgtgtacctcctaacattccttgtgggactgccactcaacttgttagccttggtcgtattcgtgggaaagttaagatgcagacctgtcgcggtagacgtacttttgttgaatctcactgcctctgatttgctgctcttgctgtttcttccgttccggatggttgaagctgctaacggcatgcactggcccttacccttcatactttgtcccttatccggtttcattttttttaccacgatctacctgacggccctcttcctggccgccgtcagcatcgagagatttctgtccgtcgcgcaccctctgtggtataaaacccgcccccgcctggggcaggccggtttggtgagtgtggcgtgttggctcttggcttctgctcattgttctgtggtttatgttatagagttcagcggcgatatttcccactcacagggaactaacggaacatgctacctggagttctggaaagatcagctggccatcctcctcccagtccgattggaaatggccgtggtgttgttcgtagtgcccctgataatcacctcgtattgttacagcaggctcgtgtggattctggggcgcggaggctcccataggaggcagcgccgggttgccggcctggtggccgccacactgttaaatttcctcgtttgcttcggtccatacaacgtcagccatgtagttggatacatctgcggcgagtcacctgtttggcgaatttacgttacactcttgtccacgctcaattcctgtgtcgatccttttgtgtattatttttctagctcagggtttcaggcggactttcatgaactcctgaggcggctgtgtgggctctggggacagtggcagcaagaatctagcatggaacttaaagaacagaaggggggggaggaacaaagggctgatagaccggccgaacggaagactagcgaacactcgcaaggctgcggaacagggggccaggtggcatgtgccgagaactag

SEQ ID NO: 188649 - DNA, 1119 bp, Artificial Sequence
  Description of Artificial Sequence: Synthetic coding sequence
atggcctgcaacagcaccagcctggaggcctacacctacctgctgttgaacacctccaacgcttctgacagtggatccacccagctccccgccccactccgtattagtctcgccatagttatgctcctcatgactgtagtgggattcttgggcaataccgtggtgtgcataattgtataccaaaggcccgccatgcgttcagcaatcaacctcctgctcgccacactggcattttcggatattatgctcagcttgtgttgcatgccattcacagctgtcaccttgatcactgtgaggtggcatttcggagatcacttctgccgtctctctgcgactctgtattggtttttcgtgctggaaggtgtggccatcctgctgattatttccgtcgaccgctttctgataattgtgcaacggcaggacaaactaaacccaaggagggccaaggttataatcgctgtgtcctgggtgctgagcttttgtatcgccgggccaagcctgacgggatggaccctcgtggaagtgcctgcccgggccccgcagtgtgtgctgggatatacagagctccctgctgatagggcctacgtcgttactctcgtggtggcagtattttttgcaccattcggcgtcatgttatgtgcgtatatgtgtattctgaacactgttcggaagaatgctgttagggtccataaccagagtgactctctggatctgagacagctgacgcgggccgggcttcggagacttcagcggcagcagcaagtttctgtggacttaagttttaagaccaaggcctttacaactatccttatcctgtttgtcgggttcagtctgtgctggttacctcattctgtgtatagcctgttaagcgttttctcccagcggttttactgtggatcttcattctatgcaacctcaacctgtgtgttatggctatcctacctgaagtcagtttttaatcctatagtctattgctggcggatcaagaaattcagagaggcatgtattgagctgctgccacagacatttcagatcctgcccaaagtaccagagcgaattcgacggagaattcagccctccactgtatatgtttgtaatgagaaccaatccgccgtgtag

SEQ ID NO: 188650 - DNA, 837 bp, Artificial Sequence
  Description of Artificial Sequence: Synthetic coding sequence
atgagcgcccccggcagccccgaccaggcctacgacttcctgctgaagtttctgttggtcggggatcgggacgtgggcaagtccgagattctggagtctctccaggatgggacagcagagtccccctactcccatctggggggtatagattacaagacaacaaccatactgttggacggacagagggtgaagctgaagctgtgggacaccagcggacaaggacgtttctgtactatcttccgctcctattcgaggggagcccagggcgtgattttggtgtacgatattgctaacaggtggagcttcgaagggatggaccggtggatcaaaaaaattgaagaacacgcccccggggtgccgaagattttggtaggaaatcgtttacatcttgcatttaaaagacaggttcccagagagcaggcccaggcatatgctgagaggcttggagtgacatttttcgaggtctcgcccctgtgtaatttcaatataattgagagctttactgaattagcccgtatcgtgctgctccgccatcgcctaaactggttgggccgcccgagtaaagtattgagtctccaggatttgtgctgtcgaactattgtttcctgtaccccagtgcacctggtggacaagctgccgctgcccatagcactgaggtcgcatctaaagagtttctccatggcaaaaggcttgaacgcaagaatgatgaggggactgtcttatagccttactacttcttctacgcataagcggagtagcctctgtaaggtaaagattgtatgtcctccacagtccccgccaaaaaactgtaccaggaactcctgcaagatttcatag

SEQ ID NO: 188651 - DNA, 585 bp, Artificial Sequence
  Description of Artificial Sequence: Synthetic coding sequence
atggtgatcctggccgtgaccaagaacaagaagctgcggaacagcggtaacatctttgtggtaagccttagcgtggctgatatgctcgtcgctatttacccctatccactgatgctgcatgcgatgagcatcggaggatgggatttatcgcaactgcagtgtcaaatggttggtttcatcactggcctgagcgtggtagggtcaatttttaatatcgtggctatcgccatcaatcgctattgttatatatgtcatagtcttcagtatgaaaggattttctcagtgaggaacacctgtatatatttagtaattacatggatcatgacggtgctcgcagtgctgcccaatatgtacattggaaccattgaatatgaccccagaacctatacttgtatctttaactacctgaacaacccggtgttcacagtgaccattgtctgtattcatttcgttcttccgctcctaatcgtcggattttgctacgtgaggatctggaccaaagttctggctgcacgcgaccccgcaggacagaatcccgacaatcaactggcagagccgacgagtactgccgcctccactttatag

SEQ ID NO: 188652 - DNA, 1086 bp, Artificial Sequence
  Description of Artificial Sequence: Synthetic coding sequence
atgaacgagagccggtggaccgagtggcggatcctgaacatgagctccggcatcgtaaacgtgtctgaacgacatagttgcccgttggggttcggacattacagtgtcgttgatgtttgcatctttgagaccgttgtgattgtgctcctcacctttcttataattgctggaaacttaacggtgatctttgtcttccattgcgctcccctgctgcaccactacacaacatcttacttcattcagacaatggcctacgccgacttattcgtgggtgtgtcttgtctcgtcccaactttgtcgctgctgcattactctactggagtgcacgaatcactgacttgtcaggtatttggctacatcatctctgttttaaagagcgtcagcatggcttgcctggcatgtatttccgtggacaggtaccttgctatcactaaacccctctcttataaccagctggtgacaccctgtcgcttgcgtatttgtatcatccttatctggatatacagctgtctgatttttctcccatcgttctttggttggggcaaacctgggtatcatggggatatctttgagtggtgtgctacaagctggctgacaagcgcctacttcacagggtttatcgtttgcctcttgtatgcccccgctgcctttgtggtgtgttttacttatttccatatctttaagatctgtcggcaacacacgaaggagatcaacgaccggcgggcccgatttccaagccacgaagtagacagcagcagagagacaggacacagcccagatagaagatatgccatggtcctgtttcgtattactagcgtgttttacatgctgtggctgccatatattatatattttttgcttgagtcctctagagtcctggacaaccccaccctgtctttccttacaacttggctggccatatctaacagtttctgtaactgcgtcatctatagcctgtccaacagcgttttccggctcgggttacggcgactaagcgaaactatgtgcacttcctgtatgtgcgtgaaagatcaggaggcacaggaacctaaacccaggaagagggccaactcatgttctatctag

SEQ ID NO: 188653 - DNA, 960 bp, Artificial Sequence
  Description of Artificial Sequence: Synthetic coding sequence
atgagccagcagaacaccagcggcgactgcctgttcgacggcgtgaatgaactgatgaagaccctccagttcgctgtgcacatccccacattcgtcctgggcctgctgctgaatcttctggccatccacgggttcagtacattccttaaaaacaggtggcccgactatgcagctacatctatttatatgatcaacctggcggtctttgatctcctcctggtcctgtctctgccgtttaagatggtcctgtcccaggttcagtcacctttcccaagcctctgcacgctcgtggagtgcctgtattttgtgagtatgtatggctctgtattcacaatctgctttatatccatggaccgatttctggctattagataccctttactagtgtcccacctgcgctcaccaaggaagattttcggtatttgctgtaccatctgggttctggtatggactggctcaatccctatatactcctttcatggaaaagtggaaaaatacatgtgcttccacaacatgagcgatgatacatggagcgctaaagtctttttcccattggaagtcttcgggttcctgcttcctatgggcattatggggttctgctgcagcaggtcgattcacatcctgctgggccgtagagaccacacccaggactgggtgcagcagaaggcttgtatttactcaatcgccgcatccctggctgttttcgtcgtgagtttcctcccagtacacttgggattcttccttcaattcctcgttcgcaatagctttatcgtcgaatgtagggctaaacaaagcattagtttctttttgcagctgtctatgtgctttagcaacgttaactgttgcctggatgtattctgttattattttgtgattaaagaattcaggatgaacatcagagcgcacaggcccagccgagtccagctggtgttacaggacacgacgatatcacgtggatag

SEQ ID NO: 188654 - DNA, 960 bp, Artificial Sequence
  Description of Artificial Sequence: Synthetic coding sequence
atgagccagcagaacaccagcggcgactgcctgttcgacggcgtgaacgagctaatgaagaccctgcagttcgccgtccatatccctacatttgttctgggtttactcttaaacttgctagcgattcacggattttcaacattcctcaagaaccggtggcctgactacgccgccacaagcatctacatgattaatctggcagtattcgacctgcttttggtcctgtctcttccgtttaaaatggtgttatcacaagtgcagtcccctttcccttctttatgtacgctggttgagtgcttatactttgtgagcatgtatggcagcgtatttacaatttgctttattagcatggatcgtttcctggcaatccgctatcctcttttagtgtcccacttgcggtctccccgtaaaattttcggtatttgttgcaccatctgggttctggtgtggacagggtcgatcccaatttattcttttcacgggaaggtagaaaagtatatgtgttttcacaacatgtctgatgatacctggagcgccaaggtgtttttccctttggaagtgttcggcttcctgcttcctatggggattatgggcttttgctgctccaggtctatacacatcctcctgggtcgccgggatcatacgcaggactgggtgcaacaaaaggcctgcatctacagtattgccgcgtctttggcagtgttcgtcgtgagcttcctacccgtgcatctcggcttttttctgcagttcctcgtgaggaacagtttcatcgtggagtgccgggccaagcaaagcattagcttttttctgcagttgtcaatgtgcttctctaatgtgaattgctgcctcgatgtgttctgctactatttcgtaatcaaggaattcaggatgaatatccgggcacatcgccccagtagagttcaactcgtcctccaagacaccaccattagccgcgggtag

SEQ ID NO: 188655 - DNA, 729 bp, Artificial Sequence
  Description of Artificial Sequence: Synthetic coding sequence
atgagccagcagaacaccagcggcgactgcctgttcgacggcgtgaacgagttgatgaagacactgcagttcgccgtccatatcccaacattcgttttggggctactgttgaacctgcttgctattcacggctttagcacatttttaaagaatagatggccggattacgccgctacgtctatctatatgatcaatctcgctgtgttcgatctgcttctggttttgagcctcccttttaagatggtactttcacaggtacagagtcccttccccagcctgtgcacccttgtagaatgtttatatttcgtctccatgtatggatccgtgtttactatatgttttataagcatggaccgtttcctggcgatacgttaccctcttcttgtgagccaccttcgcagcccccgcaaaattttcggtatttgttgtactatttgggtactggtgtggaccggaagcatcccaatatacagtttccacggaaaagtagagaagtatatgtgcttccacaatatgagcgacgacacctggtccgccaaggtgttctttcctctggaggtgttcggattccttctgcctatgggcattatgggattctgctgcagtcgatccattcatatccttcttgggcgccgcgatcacacccaagactgggtgcagcagaaggcgtgcatctatagtatcgctgccagcttggccgtattcgttgtaagtttcctccccgtatag

SEQ ID NO: 188656 - DNA, 960 bp, Artificial Sequence
  Description of Artificial Sequence: Synthetic coding sequence
atgagccagcagaacaccagcggcgactgcctgttcgacggcgtgaacgagctaatgaagacgctgcagtttgccgtgcatataccaactttcgtgctgggccttctgcttaatctgctggcaatacacggcttctcaaccttccttaagaatagatggcccgattacgccgcaacgtcaatatacatgattaatctggcagtctttgatcttctcctggtgctcagcctgccattcaaaatggttctctcccaggtacaatcaccttttccttctctgtgtacccttgtggaatgtctttactttgtatcaatgtacgggagtgtgttcacgatctgcttcatcagcatggaccgatttctcgccattcgttatccattgctggtttcccatttaaggtctccacgaaaaattttcgggatctgctgcacaatctgggttttggtctggacgggatccatccccatctacagcttccatgggaaagtggagaaatacatgtgtttccataacatgagcgacgatacttggtctgccaaggtgttctttccactggaagtgttcggattcttactaccaatgggaataatgggattttgctgttccaggtccattcacattctcctgggtcgaagggaccacacacaggactgggtacagcagaaggcctgtatatactctatcgccgctagcctcgcagtctttgtcgtgtcctttctgcctgtccacttaggctttttcctccaatttcttgtgcgaaattccttcatcgtggagtgtcgagcaaaacaaagcatttcattcttcctgcaacttagcatgtgtttctcaaatgtcaattgctgcctggatgttttttgctattactttgtgatcaaggaattccgtatgaacatccgcgctcatcgcccatcacgagtgcagctggtgctccaagacaccaccatctcgcggggctag

SEQ ID NO: 188657 - DNA, 1572 bp, Artificial Sequence
  Description of Artificial Sequence: Synthetic coding sequence
atgaccccccagagcctgctgcagaccaccctgttcctgctgagcctgctgttcctggtccagggcgcacatggccggggacatagggaagattttcggttctgtagtcaacagctgcagagcctcgagtctaaactcacctccgtcaggtttatgggcgacatggtcagcttcgaagaggatcgcatcaacgctaccgtgtggaaactgcaacctacagctggactgcaagacctccatattcattcacggcaggaagaagaacaaagcgagatcatggaatactctgttctgctgccacgcactctctttcaacgcaccaaggggcgcagtggggaggccgaaaaacgactccttctggtggacttcagttcccaggctctctttcaagacaagaactcatcacaagtactaggagagaaagtacttggcatcgtcgtgcagaacacaaaagttgccaacctgacagagccagtggtcctgacattccaacatcagttacaacctaagaacgttacccttcagtgcgtcttttgggtggaagacccaaccctgtcctcgccaggtcattggtctagcgccggatgcgagacagtgaggagggagacccaaacatcctgcttctgcaatcacttgacatacttcgctgtgttgatggttagctctgttgaagtagacgcagtccacaagcactacttgtccctgctttcgtacgtgggatgcgtagtgtctgctttggcttgcctggtgaccatcgccgcctatctgtgctctagggtccctctgccatgtagacgcaaaccgagagactataccatcaaggtccatatgaacctgctattggccgtttttctcctggacacctctttccttctcagtgaaccagtagctctgacaggatccgaagccggctgccgcgcctctgctattttcttacatttctccctgttaacatgcctttcatggatggggttggaagggtataacttatatcgcctagtggtggaggtgtttggtacatatgtcccggggtatctgctcaaacttagcgccatggggtggggattccccattttcctcgtcaccctggtggcattggtggacgttgacaactatggacccatcatcctggccgtccaccgcaccccagaaggggtcatctacccatccatgtgctggattcgtgactccttggtgtcctatatcaccaatttaggactgttctccctggtgttcctgtttaatatggctatgctcgccaccatggtggtgcaaatcctgagacttcggccccatacgcagaagtggtcccacgtcctgacgctgctcggcctgagcctcgtgttgggactaccttgggcacttatctttttttcattcgcctctgggaccttccaactcgtggtactttacctgttttctatcatcacaagtttccaggggttcctgattttcatctggtactggtctatgagactccaggcgagaggaggtccatctcctttgaagtcaaactctgattctgctcggctacctatttcctctggctcgaccagttcaagccgtatttag

SEQ ID NO: 188658 - DNA, 2082 bp, Artificial Sequence
  Description of Artificial Sequence: Synthetic coding sequence
atgaccccccagagcctgctgcagaccaccctgttcctgctgagcctgctatttctagtgcagggcgcgcacggcagaggccaccgagaggactttcggttttgttcacaaaggaaccagacccacagaagcagtttgcattataaacctactcctgatttgcgaattagcatcgagaatagcgaagaggctttgacagtgcatgccccattccccgccgcccacccagcgtcacggagttttcccgacccacgtgggttgtaccacttctgcctctactggaaccgccacgccggacgcctgcatctgctatacggtaagcgcgacttcctcctttcagataaggcgtctagccttctgtgttttcagcaccaggaggaaagcctcgctcagggccccccgttgcttgccacatctgtaacttcctggtggtcaccccagaacatttcactgcctagcgccgcatcttttacatttagttttcacagtccaccccatactgcagcccataacgcgtcagtggatatgtgcgagttaaagcgcgacctccagctcctttcgcagtttctgaagcatccacagaaagcgtcgcggcggccaagtgcagcccccgcgtcacaacagctccaatctctagagagcaaactaacctctgtgcgcttcatgggcgacatggtaagcttcgaagaggacagaataaacgcaactgtgtggaaactgcagcctactgccggcctgcaagacctgcacattcactccagacaggaggaggagcagtccgagataatggagtatagtgtgctgctacctcgaacgttgtttcagaggacaaagggccgcagcggcgaggctgaaaagcgattactcctggtggacttctcatcccaggctctattccaggacaagaatagctcgcaagttcttggcgaaaaggtactgggcatcgtcgtgcagaacacaaaggtcgcaaacttgacggagcctgttgtcctaacatttcagcaccagctacagccaaagaacgtgaccctgcagtgtgtcttctgggtcgaggaccctaccctgagctccccagggcattggtcttccgctggctgcgaaacagtcagacgagagacgcagacctcctgtttctgtaaccacctcacttatttcgctgtgctgatggtgtcttctgtcgaggttgacgccgttcacaagcactacctgtcccttctcagctatgtcggctgcgtcgtcagcgctctcgcatgcttggtgaccatcgcggcttacttgtgtagccgggtacctctcccatgcaggcggaagccaagggactacaccattaaggtgcacatgaatctgctgctggctgtttttctgctagacacatcctttctgctatccgagcctgtggcgctgaccggatctgaggcagggtgccgagcatctgccatcttcctgcatttcagtctacttacctgtttgagctggatgggcctggaagggtataatctctacagactggtggtggaggtgtttggcacgtacgttcccggttatctgcttaagctgtcagcgatgggttggggattccccattttcctggtcacactggtggctctggtggacgtggataactatggccccattatcctcgctgtgcaccgcactcctgagggggtcatctacccctcaatgtgctggattcgggacagcctcgtgtcatacataaccaacctcggccttttttccctggtctttttattcaatatggcaatgttggccactatggtggtgcaaatcctgagactgaggccacacacacaaaaatggtcccacgtgctgaccctgttgggattgtcacttgtcttgggactgccatgggctctaatcttcttctctttcgcaagtgggacttttcagcttgtcgtgttgtacctcttttcgattataacatctttccaaggctttctgatttttatctggtactggtcgatgaggctgcaggcccgtgggggacccagcccactaaagtctaactccgacagtgccaggctgccgatttctagcggctctacatcttcctctagaatttag

SEQ ID NO: 188659 - DNA, 2082 bp, Artificial Sequence
  Description of Artificial Sequence: Synthetic coding sequence
atgaccccccagagcctgctgcagaccaccctgttcctgctgagcttgctttttctcgttcagggcgcccacggccggggccacagagaggactttagattctgcagccagaggaatcagacccacagaagtagcctgcactacaaacccacccccgatctgcggatttcaattgaaaactcagaggaggctttgacagtgcacgccccatttccagctgctcacccggctagtcgttcgttccctgaccctcggggactctaccatttttgcctgtattggaatcgacacgctggcagactccatttgctgtatggcaagagagacttcctcctaagcgataaagcatcttccttgctgtgcttccagcatcaggaggagagcctggcccagggaccacccctgttggccacctccgtcacgtcttggtggagtcctcagaatatctccctgccaagcgccgccagttttacattcagcttccactcccccccccacacagctgcacataatgcctcagtggatatgtgcgaactcaagcgggacttgcagctactgagccaatttctcaagcacccacagaaggcttcccgacgtccatcagccgcaccagcctctcaacagctgcaatccctggagagtaaacttacgagtgtgaggtttatgggcgacatggtgtctttcgaagaggatcgcatcaacgctactgtgtggaagctacagccgacggcaggattgcaggacctacatatacactcccgacaagaagaggagcagtctgaaattatggaatattctgttctgctgcctcgcacattatttcagcggaccaaaggcaggagcggagaggcagagaaaaggctcttacttgtagacttttcttctcaggctctgttccaggacaaaaactcaagtcaggtactcggcgagaaggtgctaggcatcgtagtccagaataccaaagtggccaatcttaccgaaccggtcgtcctgacatttcagcaccagcttcagcccaagaatgttacgctgcagtgtgtgttttgggttgaggaccctaccctctcatctccgggacactggtccagtgcaggatgtgagacagttcgaagagagactcagactagctgcttctgtaaccacctgacctactttgcagtcttgatggtaagttccgttgaagtggacgctgtgcataaacattacctttctctgctctcctacgtgggatgtgtggtgtccgcactggcctgtctggttactatcgccgcctacttatgctccagagtgcccttaccttgtaggcggaaaccacgtgactacactatcaaagtgcacatgaacctcctgttagccgttttcctactcgacaccagctttcttctctccgagccagtagcattaaccgggagtgaggccggttgcagggcctcagccattttcctgcacttctccttgctgacatgcctttcctggatgggtcttgaagggtataatctatatcgcctcgtcgtcgaagtgtttggtacctatgtacccggttacctgctcaaactttccgccatgggttggggctttcccatttttctagttaccttagtggccctggttgacgtagataactacgggccaataatcctggctgtacacagaactcctgagggcgtgatatatccatccatgtgttggatccgggatagcctggtgagctatataacaaacctgggactattttcactggtgttcctgttcaatatggccatgctggccaccatggttgtccaaatcctccgcctgaggccccacacacagaagtggtctcacgtgttgacccttttggggctttctctggtcctgggacttccgtgggctctgatttttttctcgtttgcctcgggtacttttcaacttgttgtgctgtacttgttttccatcattacgagtttccaaggcttcttaatcttcatttggtattggagtatgcgcctgcaggcccgaggggggcccagcccgttgaagagcaactcggactccgcacgtctgcctatttcatccgggagcacatcctcttctaggatctag

SEQ ID NO: 188660 - DNA, 2064 bp, Artificial Sequence
  Description of Artificial Sequence: Synthetic coding sequence
atgaccccccagagcctgctgcagaccaccctgttcctgctgagcctgttgttcctggttcagggggcccacgggagaggacatcgggaggatttcagattttgttcccagaggaaccagacacacaggagctccctgcattacaagcccacacccgatttgagaatctccatagagaatagtgaagaggcactgactgtgcacgctcccttcccagcagcacacccggcttcacggtctttccctgaccccagaggactgtaccatttttgcttgtattggaaccgccacgccggcaggctgcatctactgtacggaaagagagactttctccttagtgacaaggcttcaagcctcctctgttttcagcatcaagaggagtccttggctcagggaccccccctgctggcgacatctgtcacgtcctggtggtctcctcaaaacatctctcttcctagcgctgcctccttcaccttctcttttcacagccctcctcacaccgctgcgcacaacgcctccgtggacatgtgcgagcttaaacgggatttgcagctgctgtctcagttcctgaaacacccccagaaggccagtcgacgaccaagtgccgctcctgctagccagcaactgcagtcattagagagtaagttgacgagcgtgcgcttcatgggtgacatggtgagctttgaggaggatcgaatcaacgcaactgtttggaaactgcaaccgactgcggggctgcaggatctacacatccactcgaggcaagaggaggaacagtcagagataatggagtattccgttctgctgcctcgaactctcttccagcgcaccaaggggcgctctggggaagccgagaaaaggttgctgctcgtggatttcagttcccaggcactgttccaagacaagaacagttcgcaggtgcttggtgagaaggtcttgggcatagtcgtgcaaaacactaaggttgctaacctgaccgaacccgtggttctcacattccagcatcagctccaacccaagaatgtcaccctccagtgtgttttctgggttgaagaccccactctctcaagccctggacactggtcaagcgcgggttgtgaaacagtgagacgagaaactcagacctcttgcttctgtaaccaccttacgtacttcgccgtgcttatggtgtcaagcgtggaggtcgatgcggtgcacaagcattatctgagtcttctatcttacgtggggtgcgtcgtgagtgccctggcatgcctcgtaacaatcgccgcctatctgtgctcccgcaggaaacctagggactacaccattaaagttcatatgaacctcctgctagcagtcttcctgctagacacctcattcctgctaagtgagccagtggccctgaccggttctgaggcagggtgtagagcctccgcaatttttctgcacttttctctgctgacatgtttatcctggatggggttagaaggatacaatctctataggcttgtggtggaagttttcggtacctacgtgcccggctatttgctgaaactgtctgctatgggctgggggttcccgatctttctcgtgactttggtcgccttagttgacgtggataactacggacctatcattcttgccgtccacaggactccagaaggcgtgatctatccatccatgtgctggattagggactccctggtgagctatatcaccaatttaggactgttcagtctggtgtttttgttcaatatggcgatgctggcaaccatggtggtgcagattctccggctgaggccccacacccagaagtggagccacgttctcacattactgggactgagcctggtgctggggctgccttgggctctgatcttcttctccttcgccagcggaacttttcaactggtggtattgtatttgttttccatcatcacctcttttcagggcttccttatcttcatatggtattggtccatgcgactgcaagccagaggtggcccctccccgctgaagagtaactcagactcagccagactgcctattagttcaggtagtacatccagttctcgtatctag

SEQ ID NO: 188661 - DNA, 2082 bp, Artificial Sequence
  Description of Artificial Sequence: Synthetic coding sequence
atgaccccccagagcctgctgcagaccaccctgttcctgctgagcttgctctttcttgtgcagggggcccatggaagaggacaccgcgaggatttcaggttttgttctcagcggaaccagacgcacagatcttccctgcattacaagcctaccccagatttgaggatttccatcgaaaactctgaagaggcgctgaccgtgcatgccccgttccctgccgcccaccccgccagccgctcctttcctgaccccagggggctgtaccatttttgtttgtactggaatcggcacgccggccgcctccacctgttatacgggaagcgtgacttccttttatctgacaaagcttcatcgctgctgtgctttcagcaccaggaagaaagtctggcgcagggacccccattactcgccaccagtgttactagttggtggtcccctcagaacatctcccttccatctgctgcatcgtttacattcagcttccactccccaccacacacagctgcacacaatgcatcggtcgatatgtgcgagctgaagcgtgacctgcaactgctgtcccagttcctgaaacatcctcaaaaggcttcccgacgcccttctgccgcccccgctagccagcagctacaatctcttgagagtaaactgacctccgttcgcttcatgggagacatggtgtcattcgaggaagacaggattaatgcaactgtctggaagctgcagccaaccgccggtctgcaagatcttcacatccattcccggcaagaggaggagcagagcgaaattatggagtactcggtgttactgcccagaaccctgttccaacgcacaaaggggaggtcaggcgaagcagaaaagaggcttctgctcgtcgatttttccagccaagccctcttccaggacaagaactcctctcaggtgctgggtgagaaagtgctgggaatcgtcgtgcagaatactaaggtggcaaacctgaccgagcccgtcgttctcacatttcagcaccaactgcaacccaaaaatgtgacgctgcagtgcgtgttttgggttgaggacccaactttgagcagccctgggcattggtctagcgctggatgcgaaaccgtaagacgggagacccaaacctcttgtttttgcaaccatctcacctatttcgccgtgctgatggtatcgtctgttgaagttgacgccgtccacaaacactacctttccctgttaagctatgtcggctgtgtagtgtccgcccttgcctgcctcgtcacgatagcggcatatctgtgttcgcgcgttcccctgccatgccggcggaaacctcgcgattacacaatcaaggtgcatatgaatctactgctggcggtgtttctcctggacacctccttcctgctgagcgaacctgtcgcactgaccggatccgaagccggctgcagagcctctgctatcttcctgcacttttccctgctgacttgtctctcttggatgggtctcgaggggtataacctgtaccgcctggtcgtggaggtgtttggtacctacgtacccggctacttacttaaactttccgctatgggatggggattccccattttcttagtgacactcgtggccctggtggacgtggacaattatggaccaatcatactggccgtgcatcggacacccgagggggtcatctatcccagcatgtgctggattcgcgactcgcttgtgtcatacattacaaacctggggctgttcagtctcgtgtttctgttcaacatggcaatgctggcgacaatggttgtgcagatcctgcggctgcggccacacacccaaaagtggtctcacgtgctaaccctgcttggcctctctctcgtgcttggactcccttgggcgctgatcttttttagcttcgcctcagggactttccagctagtggtgctctatcttttcagcattatcacttccttccaggggttcctaatctttatttggtattggtccatgcggttgcaggcgcgcggcggtccaagccctctcaagtctaattccgattcagctaggctgccaatcagttccggcagtacttccagctccaggatttag

SEQ ID NO: 188662 - DNA, 2064 bp, Artificial Sequence
  Description of Artificial Sequence: Synthetic coding sequence
atgaccccccagagcctgctgcagaccaccctgttcctgctgagcctgctgttcttagtccagggcgcccatggtcgggggcatagagaggactttcggttctgtagtcagaggaatcagactcaccgatcctctctgcattacaaaccaactcccgacctgcgcattagcattgagaactcagaagaggcattaactgtgcatgctcccttcccagctgctcaccccgccagtcgctcctttcccgacccccggggtttgtaccacttctgcttatattggaacagacacgctggtaggctgcacctgctgtacgggaaacgcgatttcctgctatcggacaaggcctcttccctgctgtgcttccagcaccaggaggagagccttgcccaaggccctcctctgctcgcaacttccgtgacaagctggtggtctcctcagaatataagtctgccctccgcagctagctttaccttcagctttcactccccaccccacacagcagcccataatgctagcgtcgacatgtgtgagcttaagagggatctccagctgctgagtcaatttctgaagcacccccaaaaggcaagccgacggccaagcgcagctcctgcatcccagcagctgcagagtctggagtccaaactgaccagcgttcggtttatgggagacatggtttcatttgaggaagatcggatcaatgccactgtctggaagctacaaccaactgctgggctccaggatcttcacatccactcgagacaggaggaggagcaaagcgagattatggaatactctgttttgcttccccggaccctgtttcagagaaccaaggggcggagtggtgaggcagagaaacggctgctcctggtagatttctcttcgcaagctctattccaggataaaaatagttcccaggttctgggggagaaggtgcttgggattgtagttcagaacacaaaggtcgcaaaccttacagagcccgtagtcttaacattccagcaccaattacagcctaaaaacgtgactctacagtgcgtgttttgggtagaggatccaactttatcttcacccgggcactggtcatccgctgggtgtgagacagtgaggcgggagactcagactagctgtttctgcaatcatcttacttatttcgcggtactcatggtgtcttccgtcgaagtcgatgcagtccacaaacactacctgtctctcttgtcttacgtggggtgcgttgtgagcgcactggcttgtcttgtgaccattgctgcctacctgtgttcaagacgaaagcctcgggactacacaataaaagtgcatatgaatctgctgctggccgtctttcttctggacacgtcattcttgcttagcgaaccagtggctctgacgggcagtgaggccggctgccgtgctagcgcaatttttctccacttcagtttgttaacatgcctttcgtggatgggtctggagggttataacctgtatcgcctggttgtggaggtgtttggcacgtatgttcccggctacctgctgaagctgtccgcaatgggttggggcttcccaattttcctggtcacactggtagcacttgtggacgtcgacaactacggcccaatcattttggcagtacatagaacaccagaaggtgtcatctacccctcaatgtgctggattcgtgattccctagtgagttatatcacaaatctcggactcttcagcctcgtttttctgttcaacatggctatgttggccaccatggtggtgcaaatcctacggctgagaccccatacccagaaatggtcccacgtcctcaccttgctgggtctgtcactggtcctgggcttgccatgggcgttaatattcttctccttcgcctctggtacctttcagctcgtggttttgtatcttttctccataatcactagctttcaagggtttctgatttttatctggtattggtctatgagattgcaagctcgcgggggtccgagtccacttaagagcaactcagattccgcccggctcccaatctcaagtgggagtacctcaagctcgcgcatctag

SEQ ID NO: 188663 - DNA, 2064 bp, Artificial Sequence
  Description of Artificial Sequence: Synthetic coding sequence
atgaccccccagagcctgctgcagaccaccctgttcctgctgagcctgttattcctcgtgcaaggggctcacggccgcggtcaccgggaagattttagattctgctcccagcggaatcagacacacaggtcatctctgcactataagcccacccctgatttacggattagcattgagaactctgaggaagctctcacagtgcacgccccatttccagctgcgcatcctgccagccgatcatttcctgaccccagaggcctataccacttttgcctgtattggaatagacacgctggtcggctgcacctcctctacggcaagcgcgacttccttttatccgacaaagcttccagtctcctgtgtttccagcaccaggaggagagcctggcccaggggccaccacttcttgcgacctctgttacctcatggtggtcaccgcaaaatattagcctcccttccgccgccagctttaccttttcatttcactctcctcctcatacagccgcccataatgcctcagtcgatatgtgcgagttgaagcgagacctccagttactgtcacagtttctcaaacatcctcagaaggcctccaggagaccttcagcagcccctgctagtcagcagttgcagagcctcgaaagcaaactcacctctgtccgattcatgggcgacatggtgtccttcgaggaggaccggatcaacgcaaccgtttggaaactgcagcctacagcaggcctccaggatctccacattcactctcgccaggaggaggagcagtcggaaattatggagtactcagtattgctaccccgcactctgtttcagcgcaccaagggaagatccggagaagcagagaaacggctcctgttagtcgatttctcatcccaggccctcttccaggacaagaattcgagccaggtcctgggagaaaaggtgctgggtattgtggtgcagaacacaaaggtggcaaacctgacagaacccgtcgtgctcacgtttcaacaccagctccaacctaagaatgtgaccttgcaatgcgttttctgggtggaggatcccacgctcagcagtcctggacattggtcttccgccgggtgcgagactgtgcgaagagaaacccaaaccagctgcttttgcaatcatctgacctacttcgctgtcttaatggtttcgagcgttgaggtagatgccgtgcacaagcattaccttagcctgctatcttacgttggctgcgttgtgtcagcactcgcctgtttggtcacaattgccgcctatctgtgctctcgtcggaagccaagagactacaccatcaaggtacatatgaatctgctcttagctgtattcctcctggacacatcgttcctgctgtctgagccagtggctctgactggatctgaagccggatgtcgggctagtgcaatcttcctccatttctcgttgttgacatgtttgtcctggatgggtctcgaagggtacaacctgtatagactcgtggtggaggtttttgggacttacgtgccaggctatctgctgaagctcagtgcaatgggttggggattcccgatttttcttgtgaccctcgtggccctggtggacgtagacaattacggccctatcatcctggccgtacaccgtacccctgagggcgtgatttacccgagcatgtgttggatcagggatagtttggtgagctatatcaccaacctgggactgtttagcctcgtgtttctctttaatatggccatgcttgccaccatggtcgtccagatcttgcgtttgaggccccacacgcagaagtggtcccatgttctcacattgctcggattgtctctcgtgctggggctgccttgggccctcatcttcttctcctttgcttccggtacatttcaactagtcgtcttgtacctgttctcaatcataactagctttcagggcttcctgatcttcatttggtactggagcatgagactgcaggcgcggggcgggccttccccactgaagtccaattcagactcagcccgtctccctatttcttccggaagtacttccagttcacgcatctag

SEQ ID NO: 188664 - DNA, 1539 bp, Artificial Sequence
  Description of Artificial Sequence: Synthetic coding sequence
atgtgcgagctgaagcgggacctgcagctgctgagccagttcctgaaacacccccaaaaagcatctagacgccctagtgccgctcctgctagccagcagctgcagagtctcgagagcaagctaaccagcgttagattcatgggagatatggtgagtttcgaagaggaccggatcaatgccactgtctggaaacttcagccgacagcaggactgcaggacctgcacattcattccagacaggaggaggagcaaagcgagatcatggagtattccgttctgctgccgaggaccctgttccagaggactaagggaaggagcggcgaggctgagaagcggctcctgttggttgatttctcctcccaagcgcttttccaggacaagaactccagccaggtattaggcgaaaaagttctgggcattgtagtgcagaacactaaagtcgcaaatctcaccgaacccgttgtcctcacctttcaacatcagctgcaacctaaaaacgtcacgttacagtgcgtgttttgggtggaagacccaaccctttcctcccccggccactggagcagcgccggttgtgaaacagtgaggcgcgaaacacagacatcgtgtttttgcaaccacctgacctatttcgccgtgctgatggtgtcgtccgtggaagtggatgccgtacacaagcactacctctcactgctgtcctatgtcggctgcgtggttagcgccctggcctgcctggtaaccatcgctgcctacctctgttcacgccgaaaaccacgtgattatacaattaaggtgcatatgaaccttcttttggcagttttcctgcttgataccagctttttattgtccgaacccgttgccctgacagggtcagaagctggatgtcgggctagcgccatcttcctgcacttctctttgctgacatgtctgagttggatgggactggagggttataacttgtaccggctggtggtggaggtgtttggcacatacgtgcctggctacctgctgaagctatccgccatggggtggggtttccctattttcctggtaactctagtggctttagtcgatgtcgataattacggccccattattttagccgtccatcgcaccccagagggtgtcatatacccatcgatgtgctggatacgggactcactggtaagttatatcactaacctgggactgttctctcttgtattcctattcaatatggctatgctggccacaatggtcgtgcaaatccttaggcttcgaccacacacccagaagtggtcacatgttctgacactgctagggctttccctggtgctgggcctgccatgggcgcttatcttcttcagcttcgccagcggaactttccaactggtggtcctctacctcttctccattatcacttcattccagggcttcctaatatttatttggtactggtctatgcgcctgcaggccaggggagggccttcaccactcaagagtaacagtgactcagcacggttacccatttcaagtggtagtacttcctcttcgcgcatatag

SEQ ID NO: 188665 - DNA, 2064 bp, Artificial Sequence
  Description of Artificial Sequence: Synthetic coding sequence
atgaccccccagagcctgctgcagaccaccctgttcctgctgagcctcctatttctggtgcaaggcgcacacggccgcggtcatcgcgaggactttagattttgttcacaaagaaaccaaactcatcggagttctcttcactataagccaaccccagatctgaggatcagcatagagaactcagaggaggctctgacagtgcatgcaccctttcctgcagcacatccagccagtcggtcctttcctgacccaaggggtttgtatcacttctgtctctattggaatagacacgccggcagacttcacctgctctatggcaagagggacttcctgctcagcgacaaagctagttcactcttatgcttccagcatcaggaagaatccctagcgcagggaccgccgttgctcgccacctctgttacaagctggtggtcgcctcaaaatataagtttgccatctgccgctagtttcacattcagctttcattcaccaccacacactgccgcccacaatgcgtccgttgatatgtgtgaactgaaaagagatctgcagctcctttcccagtttctgaaacaccctcagaaagcttcacgtagaccatcggcagctcccgcctctcagcagctgcagtctcttgagtccaaactcacctcggtccgtttcatgggagacatggtgtccttcgaggaagatcggatcaacgctacagtgtggaagttgcagcccaccgccggactacaggaccttcacattcacagtcgacaagaggaagaacaaagcgagattatggagtactcggtgttactgccgaggactttgttccagcgaaccaagggccggagcggagaagccgagaaacgattgctgcttgtggatttcagctctcaagccctctttcaagacaagaactcctctcaggtcctcggtgaaaaagtcctaggaattgtggtccagaataccaaggttgctaatctgacagaaccagtggtgcttactttccagcatcagctccagcccaagaacgtaaccctccagtgtgtattctgggtcgaggatcctacgctgagcagcccaggccattggtcctcggccggttgcgaaactgtccggcgagagacacagacttcctgtttctgcaaccacctcacttatttcgcagtgctgatggtctcttctgtagaggtagacgctgtgcacaagcattatctatcgcttctgtcctatgtcggctgtgtggtgtccgccctggcttgtctagtcacgattgctgcgtacttgtgttcaagaagaaagcctcgcgactacacgatcaaggtgcatatgaatctcctgcttgcagttttcctcttggataccagtttcttgctgtccgaacctgtggccctgaccggatccgaagccggctgcagagcatctgctatctttctgcattttagtctgctaacctgtctatcctggatgggcctggaaggttacaatctgtacagactggtcgtggaagtgttcgggacctatgtgcctggctatctgctgaagctgtctgctatggggtggggcttcccaatctttttggttactctggtcgcactggttgacgttgacaattacggtcccatcatcctcgcagtgcatcggactcccgaaggagtgatctaccctagtatgtgttggatccgagacagcctcgtttcctacatcaccaacctaggtctattcagcctggtcttcctgttcaatatggctatgctggctactatggtcgtacagatactccgactacgaccccacactcagaaatggtcccatgtgttgacgctgttagggcttagcttagtgttgggactgccctgggcccttatcttcttttctttcgcaagcggaactttccagctggtcgtgctttatctcttctctataataacatcgttccagggattcctgatcttcatttggtattggagtatgaggctgcaggcacgagggggacccagtcctttgaagagcaattccgactccgctcgcctgcccatttcctccggtagtacatcttcaagtcggatatag

SEQ ID NO: 188666 - DNA, 2064 bp, Artificial Sequence
  Description of Artificial Sequence: Synthetic coding sequence
atgaccccccagagcctgctgcagaccaccctgttcctgctgagcttattattcctggttcagggggcccatgggagaggacaccgcgaggatttcagattctgctcccagcggaatcagacccacaggagttctctgcactacaaacctacccccgatttaaggatctcaatcgaaaatagcgaagaggcgctgaccgttcatgcacctttccccgctgcacaccccgcatcaaggtccttccctgatccccgcggtctctaccacttctgcttgtactggaatagacacgccggccggctccatctactttatggaaagcgagactttttactcagtgacaaagcgagctctctgctttgtttccaacatcaggaagagagcttagcccaaggtcctccgcttctggctacaagcgttacatcatggtggtcgccccaaaatatctcgttaccctccgcagcctctttcacattctcttttcacagccctccacacacagcagcccacaacgccagcgttgatatgtgtgagttgaaacgggacctccagctcctgagccaatttttgaaacacccccagaaagccagccggaggcctagcgctgcaccagcatcacaacagctccagagcctggagtcaaagctgaccagtgtgcgtttcatgggtgacatggtgtcctttgaggaagataggatcaatgctactgtctggaagctgcagcccacagctggattacaggatttacatattcactctcggcaggaagaggaacagtctgagatcatggagtattcagttcttctgccacgcaccctttttcaaagaactaaaggacgaagtggagaagccgaaaaacgccttttgctcgtggacttctcttctcaggctctctttcaggataagaatagttcacaggtgctgggagagaaagtgctgggcatcgtggtgcaaaacacaaaggtcgccaacttgacagaacctgtggtgctcacatttcagcatcagctgcagcctaaaaatgtgacccttcaatgtgtgttctgggtcgaagaccccaccctgtctagccccgggcactggtcatccgctgggtgcgagaccgtgcgaagggaaacccagacttcatgcttctgcaatcaccttacatactttgctgtcttgatggtatctagcgtcgaggtggacgccgtccacaagcattacctgtcactcctgtcctacgtgggatgcgtcgtgtcagcccttgcgtgcctcgtgacaattgcagcttacttgtgttccaggcggaagccccgagattacaccattaaagtgcacatgaatctactgttggcagtctttctcctggacacctcattccttctgtcagagcctgtggccctgaccggcagcgaagctggatgtcgagcttcagcaatctttctgcatttttctctcctgacgtgtttgagctggatgggattggagggctataatctttatcggctagtggtggaagtttttggtacatacgtccctggctacttgctgaaactgtccgccatgggatggggttttcccatcttcttagtgacactggtggcattggtggatgtggacaattacggacctattattctagccgtgcacagaactcccgagggtgtgatctacccctcgatgtgctggatccgagatagcttggtgagctatatcaccaatctggggcttttttccctcgtgtttctctttaatatggcgatgctggcaaccatggtcgtgcagattctcaggttgagaccccacacccaaaaatggagccatgttctgacactactgggcctgagtttggtcttgggactcccttgggctctcatatttttcagtttcgcctctggcacatttcagctcgtcgtgctgtacttgtttagcatcatcacctcattccagggttttctcatattcatttggtactggtccatgagactgcaagctagggggggaccatcccccctcaagtcgaacagcgattctgctcgcctcccgatctccagcggatccacctccagtagtaggatctag

SEQ ID NO: 188667 - DNA, 1089 bp, Artificial Sequence
  Description of Artificial Sequence: Synthetic coding sequence
atgaacgccagcgccgccagcctgaacgacagccaggtggtggtggtggccgccgagggagccgccgccgctgctactgcagcaggaggtcccgacacaggcgagtggggcccccctgctgccgcagccctcggcgcaggcggaggagcaaatggctcccttgagctcagctcgcagttgagtgctggcccccctgggctgctgttgcctgcagtgaatccctgggacgtgttgctttgcgtgtccggcaccgttatagccggcgaaaacgccctggtcgtggccttaatcgcttctactccagctctgcggactcctatgttcgtgttggtgggcagtctagctacggccgatctgctggcaggctgcgggttgattctacattttgtgtttcagtacctcgtcccctccgagactgttagcctgctcacagtggggttcctcgtggcctcgttcgccgcctccgtaagcagcctgttagcgataaccgtggacagatacctctccctgtataacgccctgacgtactacagtagacggacactgctgggcgtccatttgctgttggccgccacctggacagtgtcactgggtctggggcttctccccgtgctggggtggaactgtttggctgagcgcgctgcctgctccgttgtaaggccactcgcacgaagtcacgtggccctgctaagcgctgctttctttatggtgtttggtatcatgctgcatctgtatgtgcgcatctgccaggtcgtgtggagacacgcccaccagattgcccttcaacaacattgcttagctcccccacatttggctgcgactcgcaaaggcgtgggcaccctggccgtagtcctggggactttcggggcatcctggctgccttttgcaatctactgcgtagtgggatcacacgaagaccctgccgtctatacctacgcaacccttctaccagccacatataattcgatgattaacccaataatctatgcctttagaaatcaggaaattcagcgcgcactatggctgttactgtgcggctgtttccagagcaaagttccttttcgatctcgctcaccgagcgaagtttag

SEQ ID NO: 188668 - DNA, 1134 bp, Artificial Sequence
  Description of Artificial Sequence: Synthetic coding sequence
atgaccctgctggcctggtgcacccggggcgccaaccccgccgccatgaatgcttcagctgctagtttgaatgattcacaggttgtcgtcgtggccgcggaaggggccgcagccgccgccactgcagccggcggcccagataccggggaatgggggcctcctgccgccgccgctctgggagccggagggggggccaacggatccctcgaactgagctctcagttgagcgccggcccccccggactacttttgcccgcggtgaacccctgggacgtgttgttgtgcgtaagtggaaccgttatcgccggggagaacgcccttgtggttgcgctaatcgcctcaacaccagctttaagaacgcccatgttcgttttggtgggatctcttgccaccgccgacctgctggcaggctgtgggctcatcctgcatttcgtcttccaatacttggtccctagtgaaactgtgtcccttctgactgtcggctttcttgtggcctcttttgccgcatctgtctcgagcctactcgccatcaccgtggaccggtatttaagcctgtacaacgccctaacatattactcaaggcggacccttcttggagttcatctcctcctcgcagcaacgtggactgtcagtctcggactcggcttattacccgtcctcgggtggaactgcctcgctgaaagagcagcatgtagcgtggttcgtccactggcgcgatctcacgttgcgctgctcagtgcagccttcttcatggtgtttgggatcatgcttcacttgtacgtgcggatatgtcaggtggtttggcgacatgcccatcagattgccctccagcagcactgtctggcgccccctcacctggccgcaacccgcaaaggggtggggacactcgccgtggtgctcggtaccttcggagcctcatggttaccatttgctatctactgcgtagtcgggagccatgaggatccagccgtgtatacttatgcaacattgctgccggctacctacaattcaatgattaatccaattatatatgcttttaggaatcaggaaattcagcgggccctatggctgttactgtgcgggtgttttcagtcaaaggtgcccttcagaagccgtagcccctcggaagtatag

SEQ ID NO: 188669 - DNA, 1023 bp, Artificial Sequence
  Description of Artificial Sequence: Synthetic coding sequence
atgaacgccagcgccgccagcctgaacgacagccaggtggtggtggttgctgccgaaggcgctgctgcagcggcgactgcggccggggggcccgatacaggcgaatggggcccacccgcagccgcggccctaggcgctggtggtggtgcgaacggatcactcgagttaagctcacagctatccgccggaccccccggcctgctgttgccagctgtcaatccatgggacgtcctgctgtgcgtgtctggcaccgttatcgctggagagaacgctctggtggtggctctcattgcctcaactcccgccctgagaacacccatgttcgtcctggtgggaagtctggcaactgccgatctgttagcgggctgtggcctaattctccattttgtgtttcagtacctcgtgccttcagagaccgtgagcttactgacagtggggtttctggttgcctcattcgcagcctcagtcagttcactcctcgccatcacagttgataggtacttgtcgctgtataatgccctgacctattacagtagacgtactctgctcggggttcatttactcctggccgccacttggacggtgtcactcggcctcggcctcttacccgttctgggatggaattgcctcgcagaacgggccgcatgttcagtggttcggcccctcgcacgctctcacgttgcactgctcagtgccgcctttttcatggtgtttgggatcatgttgcatctgtatgtccgaatatgccaggtggtctggcgacacgcacaccagattgccctgcagcagcactgcctcgcacctccgcatttggcagcgactcgcaagggagtcggcacccttgccgtggtattgggaacatttggcgcgtcgtggttgccctttgccacgtacaactctatgataaaccccatcatttatgccttccgcaatcaggagattcagcgcgcgctctggttgctgttatgcgggtgcttccaaagcaaggttcccttccgatccaggtctcctagtgaggtgtag

SEQ ID NO: 188670 - DNA, 1740 bp, Artificial Sequence
  Description of Artificial Sequence: Synthetic coding sequence
aacccccggctgaccgtgctggagcgggtggagggctacggcgagcaagaatggcagaagggcgatggcaaggggaggggagaaggccactctgaaagtggagtcttgtcggggtccggctcatgcactagtcatgtgagctgcttccttgccgtgacaaaagcagacccagctgcgacctctggccagaagggggacgagctgctcatactgcaacttccaggtctcgcactgtgcacccagaccaatttacctaaacgtcttcagtgggaggtgcctcccaccaagcctggcagccttggacttggctccccgagtcaggggcgctggactcgaatgggggacggaccccaggaggtaccttgggttccatcttttgggcctatggagagcagtcccatcccccagtctagcgggaatagctccactcttggaagggtaccccaaactcccggccccagcacagcttcaggggttcctgaggttggtctcagagatgtagccagcgaaagtgtggcactctttttcatgctcctgctggacctaacagcagtggcggggaatgccgcagttatggccgtgatcgcaaagaccccagccctccggaagtttgtgtttgtgtttcacctctgtcttgtcgacctgctggcggctctgactctgatgccgttggctatgctctcaagttctgccctgttcgatcacgctctgtttggggaggttgcctgtaggctgtacctgttcctatcggtgtgcttcgtttcattggcgatcttgtctgtttcagctatcaatgtcgagagatactactatgtagtccatcccatgcgatatgaagttcgcatgacactgggtcttgtcgcctcggttctagtgggtgtgtgggtcaaggccctcgccatggcgagcgtccccgtcttgggcagagtgtcctgggaagagggggctccctccgtgccacccggatgctcactccagtggagccactccgcatactgtcagctattcgttgttgtgtttgctgtgctctattttctcctgcccctgctgctgatcttagtggtatattgttctatgtttcgagtcgcgagagtagcagctatgcaacacggacccctacccacgtggatggagacacctcgacagaggagtgagagcctctcaagtaggtcaaccatggtcacatccagtggcgcccctcagactactccacatcgtacattcggcgggggcaaggccgccgtcgttctcctcgccgtgggagggcagttcctgctgtgctggctgccttatttttccttccatctgtacgtggccttgtctgcccagcccatcagcacgggccaggtggaaagtgtggtaacttggatcgggtacttttgtttcacctccaacccctttttttatggctgtctcaatcgccagattagaggggaactgtctaagcagttcgtgtgctttttcaagcctgcccctgaagaggaactccgcctgccatccagggaggggagcattgaagaaaacttccttcagttcctgcaaggaactggttgtccatccgagtcctgggtctcccggccccttccttcacctaaacaggaacctccggccgtcgacttccgaattcctggccaaatcgcggaggaaacctccgagttcctcgaacaacagttaaccagtgatatcatcatgtccgactcctatctgagacctgccgctagccctagacttgaaagttag

SEQ ID NO: 188671 - DNA, 1356 bp, Artificial Sequence
  Description of Artificial Sequence: Synthetic coding sequence
atggagagcagccccatcccccagagcagcggcaacagcagcacccttgggagggtcccgcagactcctggtcctagtacagcgtctggagtgcccgaggtggggctccgggacgtagcttctgaatcagtagccctattttttatgctgttgttagatctgactgccgtggctgggaacgcagccgtaatggccgtgatcgcgaaaacgccggctctgaggaaattcgtattcgtatttcatctgtgtcttgtggacctcctggccgctctcaccctaatgccacttgctatgctcagcagcagtgcactcttcgaccatgcacttttcggggaggtggcttgtaggctttatctatttttatccgtgtgcttcgtgtccctggctattctgagcgtgagcgccatcaatgtcgagcgctactactatgttgttcacccgatgagatatgaagttaggatgactttaggactagtggcttcagtcctggtgggtgtgtgggtcaaggccttagccatggcttccgtgccagtgttgggaagggtttcctgggaggaaggcgccccgtctgtacctccgggatgcagcctgcagtggtcccactccgcttactgtcagttgttcgttgtggttttcgccgtgttgtacttcctgctacctctcttgcttatccttgttgtctactgttccatgttccgggtggcccgcgtggcagctatgcaacacggtccacttccaacttggatggaaacaccaagacagcgcagcgagagtctgagtagcaggtcaactatggtcacgagctctggcgctccacagaccacaccacacagaactttcggaggcggcaaagcagcagtggtgctgctggctgtcggggggcagttccttctttgttggcttccctatttttcattccacctgtacgtcgccctctccgctcaacccatttctaccgggcaggtggaaagcgttgtcacatggattggctacttttgcttcacttccaacccattcttttatggctgcctaaaccggcagatccgcggcgaactaagcaagcagtttgtttgtttctttaagcccgccccagaggaagagctgcgcctgccctcccgcgaaggttctatcgaggagaacttcctgcagttcctccagggaacaggctgcccctcggaaagctgggtgtcccggcccctcccaagccccaaacaggagccacctgccgtagattttcgcatcccgggccaaatcgcagaggaaacgagcgagttcttggaacagcagttgactagtgacatcatcatgagtgactcctacctcaggcctgcagcctcacccaggctcgagtcctag

SEQ ID NO: 188672 - DNA, 1356 bp, Artificial Sequence
  Description of Artificial Sequence: Synthetic coding sequence
atggagagcagccccatcccccagagcagcggcaacagcagcaccttaggcagagtcccccagacacctggaccctccactgcctccggagttccagaggtgggcctgagagatgtggcaagtgaatcggtagcactgttctttatgctcctgctggacctgactgccgtggctgggaacgccgccgtgatggcagtgattgcaaagacacccgcactgcgaaaatttgtcttcgtcttccatctctgtctagtcgacctcctagcggccctgactctcatgccgcttgctatgctttcctcctccgccctcttcgatcacgcactgttcggggaggtcgcctgtcggctctacctattcttatccgtctgcttcgtaagcctggctatcttaagcgtgtcagccatcaatgtcgagcggtactactacgtggttcatccaatgcgctatgaagtcaggatgactttgggcctggttgccagtgtgctggttggcgtctgggtcaaggcgctggcgatggccagtgttcctgttctaggacgcgttagttgggaggagggcgcgccctccgtgccacccgggtgttcactccaatggtcccactccgcatattgtcaattattcgttgtggtctttgctgtactgtattttttactacctttgctgctcatccttgtagtgtactgctccatgtttagagtcgccagggtcgctgctatgcagcacggcccgcttcccacatggatggagactcctcgacaacgatcagaatccctgtccagccgctcaaccatggtcaccagctccggcgccccgcagacaacaccacaccggacattcggcggagggaaagccgccgttgtgcttctggctgttggcggacagtttctgctctgttggctcccctatttctccttccatctttacgtcgccctaagcgctcaacccattagcacaggccaggtggaatcggtggtaacctggatcggatatttctgtttcacgtccaacccctttttctatggctgcctgaacaggcagatacggggggagctctcaaaacaattcgtctgtttcttcaaacctgcacctgaagaagagttgagattaccctcccgggagggctccatcgaagagaattttctacagtttctacagggcaccggctgccctagtgaaagttgggtgagccgcccgttgccatcacctaagcaggaaccgcctgccgtggactttagaattcctggccagattgctgaagagactagcgagttcttggaacagcaactaacatctgacatcatcatgtccgacagctatttgcggccagccgcttctccccgtttggagagctag

SEQ ID NO: 188673 - DNA, 1356 bp, Artificial Sequence
  Description of Artificial Sequence: Synthetic coding sequence
atggagagcagccccatcccccagagcagcggcaacagcagcaccttgggcagagtcccacagaccccaggtccgtcaaccgcttccggagtgccagaagttggcctgcgggacgtggcaagtgagtctgtggccctatttttcatgttactcctcgacctcaccgccgtggccggaaacgctgccgtaatggctgtcatcgcgaaaacgcccgctctgagaaagtttgtgttcgtgttccacctgtgtctggtcgatcttctggcggctctgacactgatgccactggctatgctttcatcaagcgctcttttcgatcacgccctgttcggcgaggtcgcatgtcgactgtacttgttcctgagcgtctgttttgtatcactggctatcctgtctgttagcgctataaatgtcgaacggtactactatgttgttcatcctatgcggtatgaagtgaggatgaccttaggcctcgtggcgtctgttctggtaggtgtgtgggtgaaagccctggccatggccagtgttcctgtgctgggccgagtttcatgggaggaaggcgcccctagcgtgccgcctgggtgcagtctgcagtggagtcacagtgcatattgtcagctgttcgtggtagtttttgctgtgttatatttcctattacctctcctgctgatcctggtagtctattgctctatgttccgagtcgcgagagtcgccgctatgcagcacggccccctccccacctggatggagaccccgcgacagcgctcagaatctttaagctctagaagtaccatggtcacttcgtctggcgcccctcagaccactccacaccgaaccttcgggggggggaaggccgccgtggtgctgctggcagtgggggggcagttcctgttgtgctggcttccctatttttccttccatctgtacgttgccttgagtgcgcagccaatatccaccggccaggtcgagagtgttgttacgtggatcggctatttttgttttactagtaaccccttcttctacggctgcttgaaccgccagatcaggggtgaactgagcaaacagtttgtgtgcttcttcaaacctgccccagaggaggaactccgcctgcctagtcgagaagggtctattgaggagaacttcctccaattcctccaggggacgggatgcccatcagaatcatgggtgagtagaccactcccgagtcctaagcaggaaccccccgccgttgattttcggatcccaggacagattgcggaagaaacaagcgagttcctggagcaacagttgacctccgacatcatcatgtctgactcttatctacgccccgctgccagtccccgtctagagagctag

SEQ ID NO: 188674 - DNA, 1107 bp, Artificial Sequence
  Description of Artificial Sequence: Synthetic coding sequence
atggccaacagcaccggcctgaacgccagcgaggtggccggcagcctggggcttatattagccgctgttgtggaggtaggagctttgctaggcaatggggcgttgctggtagttgtcctgcgcaccccaggccttcgcgacgccctgtatctggctcatctgtgcgtggtggatctgctcgctgctgcgtccattatgccgttgggcttgctagctgcaccaccaccaggcctggggcgagtaagactgggtcccgccccatgtcgggctgcaaggttcctttctgccgcattactcccagcctgtaccctcggcgtggctgccctcggactggcaaggtataggttaatcgtgcacccattgcgaccgggcagtagacctcctcctgtactggtgttaaccgcagtgtgggcggctgcgggactgttaggtgctctgagcctgctaggcaccccacccgctccacctcctgctcccgcccgatgctctgtcttggctggggggctcgggccatttcgacctctgtgggcgttactggcctttgccttgcccgcactgctcctgctcggcgcctacggtgggatattcgtggtggcccggcgcgccgctctccgcccgccccggcccgcacgcggttccagactacatagcgatagcctggattcccggctgtccattctgccgcccctgaggcccaggctccctggtggcaaggccgccctcgccccagccctggccgttggtcagtttgctgcttgttggctgccttatgggtgtgcttgcctggctcccgcggcccgcgctgctgaggctgaagcagccgtaacatgggtggcctacagcgctttcgctgctcatccgttcttgtacgggctcctgcagcgtccagtgagattggcactgggccgactgtctcgacgtgctctccccggaccagtgcgggcatgcacaccccaggcatggcatcctagggccctgctacagtgtcttcaacgcccgcccgagggtcctgcggtggggccttctgaagccccggaacagaccccggagttagcaggcggccgtagcccagcctaccagggacctcctgaatcttcccttagttag

SEQ ID NO: 188675 - DNA, 1434 bp, Artificial Sequence
  Description of Artificial Sequence: Synthetic coding sequence
atggccaacatgcagggcctggtggagcggctggagcgggccgtgtcccggcttgagtccctgagcgccgagagtcatcgtccacctggcaattgtggagaagtgaatggagtgatcgctggtgtcgcgcccagtgtggaagctttcgataagttgatggacagcatggtggcagaatttctgaagaacagtcgaatcctcgcaggcgacgttgaaacccacgcagagatggtgcatagcgcatttcaggcccagcgggcattcctgttgatggcgagccagtatcagcagccccacgagaatgacgtggcagcccttctgaagcccatcagcgagaaaatccaggaaattcagaccttcagggagaggaaccgcggttccaacatgttcaatcatctgtccgccgtctctgagtccatccctgctctgggttggatcgcggtcagccctaaaccgggtccctatgttaaggaaatgaacgatgctgctaccttttacacgaaccgtgttcttaaagattataagcacagtgatttgaggcacgttgattgggttaaatcctaccttaatatttggtccgagttacaagcatacatcaaggagcatcatacaacaggcctgacctggagcaaaactggtcctgtggcttctactgtctccgccttctccgtattgagcagcgggcctggtctcccaccccccccccctcccttgccacctccagggccgccccctctgttcgaaaatgagggtaaaaaagaggagtccagcccatccagatctgcattgtttgcccagttgaaccagggggaagcaatcaccaaaggactaaggcacgtgacagacgaccagaagacatacaagaatccttctctgcgagcgcagggaggacagacccagtcgccaactaagagtcatacgccgtccccaacgagcccaaagtcctatccaagccagaagcatgcccccgtcctggagctggaaggtaagaaatggagagtggagtaccaagaggacagaaatgacttggtgattagcgagaccgaacttaaacaggtggcctacattttcaagtgcgagaaaagtaccatccagattaaaggcaaagtgaatagcattatcatagataattgcaaaaaactgggcctggtgtttgataatgtggtgggaatcgtcgaagttatcaacagtcaagacatccagattcaggttatggggagagtgccgacaatttccataaacaaaactgaagggtgccacatctacctgagcgaagacgcactggactgtgagatagtttccgcaaagtcctccgagatgaacatcctgatcccccaggatggagattacagggaatttcctattcccgagcagttcaaaacggcctgggatggctccaagctgatcaccgaacctgccgagatcatggcctag

SEQ ID NO: 188676 - DNA, 1260 bp, Artificial Sequence
  Description of Artificial Sequence: Synthetic coding sequence
atggtgttcagcgccgtgctgaccgccttccacaccggcaccagcaacaccacattcgtggtttacgagaatacatacatgaacattacactccctcccccgttccaacatccagacctatctccactactaagatactcgttcgagaccatggctccaaccggtctgtccagcctaactgtgaattccactgctgtgcctacaactccagccgcatttaagtcattgaacctcccccttcagatcacactgtcagccataatgatattcattctttttgtttcctttctgggcaacctcgtggtgtgcctgatggtttaccagaaggccgcaatgcggtctgccataaacattctgctggcctcattggcgtttgccgacatgcttttggcggtcttaaacatgcctttcgccctagtgaccatactgaccacgcgctggatttttggaaagtttttctgtagggtaagcgctatgttcttctggctctttgtgatcgagggtgtggctattctgctgatcatctccatagacagattcctgatcatcgtgcagagacaggacaagttgaacccctatagagcaaaagtcctgatcgccgttagttgggcgacgtctttttgtgttgcattcccgcttgcggtgggcaacccagatcttcagatacccagtagagctccacagtgtgttttcggttataccaccaacccaggctaccaagcctatgtgatcctgatctcacttattagcttcttcattccgtttctggtgatcctctacagctttatgggaatactgaatactctaagacacaatgcattgaggatacactcatatcctgagggcatctgtctctcacaggccagcaagctgggtcttatgagcctacagcggccgttccagatgtccattgacatggggttcaagacccgtgctttcactacaattctgattctgttcgccgtgtttatcgtctgctgggccccatttaccacatattcactggtcgcgacatttagcaagcacttttattatcagcacaatttctttgaaatctctacatggctgctttggctctgctatctcaagagtgccctgaaccctctgatttactactggcggattaagaagtttcacgacgcctgtttggacatgatgccaaagtcttttaagttcctgcctcagctccccgggcacaccaaaagacgcatcagaccttcagcagtgtacgtttgcggagaacatagaactgtcgtttag

SEQ ID NO: 188677 - DNA, 1260 bp, Artificial Sequence
  Description of Artificial Sequence: Synthetic coding sequence
atggtgttcagcgccgtgctgaccgccttccacaccggcaccagcaacactacattcgtggtctatgaaaacacatacatgaatattacactgcctccaccttttcagcaccccgatctttcccccctgctccggtatagttttgaaacgatggcccctacaggcctgtcgagcctcaccgttaactctacagctgttccaaccacccctgcggcctttaagagcctcaatctgccactgcaaataactctcagtgctatcatgatcttcattctgttcgtatcattcctcggcaatttagtggtgtgtctgatggtgtaccagaaggccgccatgagaagtgcaatcaacatactgctcgcctccctcgcatttgctgacatgcttttggctgtgctgaacatgccctttgccctggtcaccatccttaccacccgctggatctttggaaagttcttttgccgggtgtctgccatgttcttctggctgttcgtcattgaaggtgtggccatcctacttataatttcaattgatcggttcttgataatcgtacaaagacaggacaagctgaatccctacagagctaaagttttgatcgcggtgagttgggccacgagcttttgcgtggctttcccgctggcagtgggcaacccggacctccagattcccagccgggcccctcagtgcgtctttggctataccactaaccctggctatcaagcttacgttattctgatatctcttatctcattcttcatccctttcctggtaatcctgtattcatttatgggcatattgaataccctccggcacaacgccttacggatccactcatatccagaaggtatttgcctgtctcaggcctccaaactgggacttatgtcactacaacgcccattccagatgtccatagacatgggatttaagacaagggcctttacaacgatcctcatcctatttgctgtctttatcgtctgctgggcaccttttaccacttactctctggtcgctaccttttccaagcatttctactaccaacataatttcttcgaaatctctacttggctcctgtggctgtgttatctgaagtcggcgcttaatccactgatttactactggcggattaagaaattccatgacgcctgcttggacatgatgcctaagagtttcaaatttctgccccaacttcctgggcacactaaacgccggattaggccctctgctgtgtatgtgtgtggcgagcaccgaaccgttgtctag

SEQ ID NO: 188678 - DNA, 1332 bp, Artificial Sequence
  Description of Artificial Sequence: Synthetic coding sequence
tactgctgcagcgtgctgaagtgcctgaagaacagctgcatcagcgcctgtatttttcacccgaccgagaccatggtattcagcgccgttctcacagccttccacactggaacatctaacaccacctttgttgtgtatgaaaacacttatatgaatattacacttcccccccctttccagcacccagatttgtcgccattgctgcggtacagcttcgagaccatggccccgactggcctatcaagcctaacagtgaacagcactgccgtgcccaccactccagccgcctttaagtctttaaacttgcctttacaaatcacactttccgcaatcatgatattcattctttttgttagcttcctggggaacctcgtggtgtgcttaatggtgtaccagaaagctgccatgaggtcagctattaatatcctgttggccagcctggcgtttgctgacatgctgctggcagtgctgaatatgccctttgccctggtcacaatcctgaccactagatggatcttcggcaagttcttttgtcgcgtatcggctatgttcttctggctctttgtgatcgaaggtgtcgccattttgctcatcatcagcatagaccgtttccttatcatagtgcagcggcaggataaattaaacccctaccgggcaaaagtgctcattgctgtctcgtgggccacatctttctgcgtcgcctttcccctggctgtgggcaaccccgatctccagatcccaagccgcgccccccagtgcgtcttcggctatactacaaaccctgggtaccaggcgtatgttatactaatctctctgatcagctttttcatccctttcctagtcatcctttacagtttcatgggcatcctcaataccctgcgccacaacgcgctgagaatacactcatacccagagggcatctgcctgagtcaggcgtccaaactgggcctcatgtcactgcaacgccctttccaaatgtctatcgacatgggattcaagacccgtgctttcacgactatattaattctatttgccgtgtttattgtatgttgggcccccttcacaacatactccctggtggcgaccttcagtaagcatttctactatcagcataacttttttgaaatcagtacctggctactgtggctctgttatttaaagtctgcattaaacccgcttatatactactggaggattaagaaattccatgatgcctgcctggatatgatgcccaagtcctttaaattcttacctcagctgcccggccataccaagcgccggatccggccttccgcagtctacgtgtgtggggagcatagaaccgtggtgtag

SEQ ID NO: 188679 - DNA, 2697 bp, Artificial Sequence
  Description of Artificial Sequence: Synthetic coding sequence
atggtgttcagcgtgcggcagtgcggccacgtgggccggaccgaggaggtgctattgacatttaagatatttctcgtcatcatctgtctccacgtcgtgttggtcacaagcctggaagaggataccgataactcgagcttgtccccccctccagaagtcgagaccacaagtctcaacgatgtgacactgagtctgctgccttcaaatgaaaccggagttaaacctcagcgcaacatttgcaatctgtccagcatctgcaatgattcagcttttttccgcggggaaatcatgttccagtacgataaggagtctactgtcccgcaaaaccagcatattaccaatggtacactaaccggcgtgcttagcttaagcgaattaaaaagatcagaattgaataagaccctccagacgctcagcgagacctacttcatcatgtgcgccactgccgaggcgcagtctacactcaactgcacctttacaattaagctaaacaataccatgaacgcctgcgccgtgattgctgctctcgagcgcgtgaaaataaggccaatggaacactgttgctgttctgtacggatcccgtgccccagcagccctgaagagcttgagaagctgcaatgcgatctgcaggatccaatcgtatgcttggccgatcatccacgcgggcccccattcagtagcagtcagagcataccagtcgttccaagggcaacagtgctgtcccaggtgccaaaggcaacttctttcgccgagccgcctgattacagccccgtgacacataacgttcccagtcctatcggcgaaatccagcctctttcaccccagccatctgccccaatcgcctccagtcccgccatcgacatgccaccacagtccgaaacaatatctagccctatgccacagacgcacgtgtctggaacccctcctcctgtgaaggcctccttcagttccccaacagtatccgctcctgctaacgttaatacaacatctgcccctcccgtccagactgatatcgtgaatactagctcgatttccgacctggagaaccaggttcttcagatggaaaaagcgctttctctgggaagcctggagccaaatctcgcgggagagatgataaaccaggtgagccggctgctgcactctcccccagatatgcttgcccctctcgcacagaggctgcttaaagtggtggacgatattggtctgcagctgaacttctccaatactactatctcactcacctccccatccctggccttagctgtgatccgcgtcaatgcgagctcattcaataccacgacctttgtggcgcaagaccctgcgaatctgcaggacgaattgacagttagatgcgtgttttgggacttgggacgcaatggcggacggggaggctggtctgataacgggtgctctgtcaaggaccggaggctgaacgaaaccatctgtacctgttctcatctcacaagctttggtgtgctgttggacctgtcacgaacgtctgtcctccccgctcagatgatggccctcactttcatcacatacatcggatgcggactgagtagcattttcctatctgttacccttgtcacttacattgcctttgagaagattcggagagactatccaagcaagattttgatccagttatgcgcagctttactcctgctaaacctcgtgtttctgctagatagctggattgccctgtataagatgcagggactctgtatttcggtggcagtgtttcttcattatttcctactggtgtctttcacatggatgggcttagaggccttccatatgtacctcgccttggtgaaagtgttcaacacctacatcaggaagtacatactcaagttttgtattgttggatggggggtgccagccgttgtcgttacgattatactgacaatttccccagataactacggcctaggaagctatggcaagttccccaacggatctcctgacgatttttgctggatcaataataacgctgtattttatattacggtggtaggttatttttgcgtcatttttctcctaaacgtgtctatgttcatagtcgtgctggtccagctgtgtcggatcaaaaagaagaagcagctcggggcgcagaggaaaaccagtatccaggatctcagatctatagccggtttgacattcctactggggattacctggggtttcgctttttttgcttggggccccgttaacgtaacatttatgtacctgtttgcgatattcaacacccttcagggcttttttatatttatcttttactgcgtggccaaagaaaacgtgaggaagcaatggcggcgatacctgtgttgcgggaagcttagactggctgagaattctgattggtctaagacagccacgaacggactcaaaaaacagactgtaaaccaaggcgtgtccagcagttcaaattctcttcagagtagttccaattccaccaatagtactacactgctggtgaataacgattgcagtgtgcacgctagcggaaacggaaatgctagcactgagaggaatggcgttagcttctccgtgcagaacggtgacgtgtgtctgcatgattttactggaaagcagcacatgttcaatgaaaaggaggactcttgtaatgggaaaggcaggatggccctgcgacgcacctccaagcgaggctcactgcacttcatagaacagatgtag

SEQ ID NO: 188680 - DNA, 3006 bp, Artificial Sequence
  Description of Artificial Sequence: Synthetic coding sequence
atggtgttcagcgtgcggcagtgcggccacgtgggccggaccgaggaggtcttgctcacattcaaaatattcttagtgatcatttgccttcatgtggtactggtgaccagcctagaggaggacactgacaattcctccctgagtccacctcccgatgaagaaaccggggcttgttctgacgtcactctgtcactgcttcctagcaacgaaacggaaaaaaccaagattaccatcgttaaaacctttaacgccagtggggttaaacctcaacgtaatatatgcaacttatcatcaatttgcaacgacagcgccttctttagaggggagatcatgtttcagtacgataaggagagcacggtgccacagaaccagcatattacaaacgggacactaacaggggtcttgtccctttccgaattaaagcgctctgaattgaacaagaccctgcaaaccctgagcgagacatattttataatgtgtgctacagctgaggcgcaatccacactcaattgtacgttcaccatcaaattgaataacactatgaacgcatgcgctgttatagcagccctggaacgggtgaagatccggcccatggaacactgctgttgctctgttagaattccatgcccctcaagtcctgaggagctggaaaagctccaatgcgatctccaggatcccatcgtgtgcctcgcagatcacccccgtggtcctccgtttagcagcagccagagcatacccgtggttccaagagccacagtcctgtcacaggtgccaaaggctacgagctttgccgaacctcctgattacagcccagtcacacataatgtcccctcccccattggcgagattcagcccctttccccgcagccaagcgcccctatagcgagcagtcctgcaatcgatatgcccccgcagtctgagactatttcatcacctatgcctcagacccatgtttctggaacccccccccctgtcaaagccagcttttcctcccctacagtctcggcccccgcaaatgtgaataccaccagcgctccccccgtgcagaccgatattgtgaacacctcaagcatttccgacttggagaatcaagtactacagatggaaaaggcccttagcttgggtagcctcgaaccgaatttagccggcgaaatgattaaccaagtgagccggctgctacactcaccacctgatatgctggccccgcttgcacagaggctgttgaaagttgtcgatgacataggccttcaactcaacttttcaaatacaaccataagtctgacctcaccctctttagctttggccgtaattagagtgaatgcctcttcctttaacactacaacctttgtagcgcaggatcccgctaaccttcaggtctcattagagacacaggctcccgagaactccattgggactattacactgccaagcagcctcatgaacaatctgcccgcccacgatatggaactggcatccagagttcagtttaattttttcgagacccctgcgcttttccaggatcccagtttagaaaatttatccctgatcagctacgtgattagttcctctgtcgccaatcttaccgtgaggaacctgacaagaaacgtgacagttactctaaagcatatcaacccttcgcaggatgaacttacagtcaggtgtgtgttctgggatctgggtcgaaacggtggacgcggtggctggtcagataacggctgttcggtgaaagatagaaggctcaacgaaactatctgtacttgctcccatttgacatcctttggagttcttctcgatctgtctagaacttctgtacttcccgcccagatgatggctctgacattcatcacctatatcggctgcgggctctcttccatcttcctatctgtgacactggtcacctacatcgcgttcgaaaagattcgtcgcgattacccttccaaaatcctcatccagctgtgtgctgccctgctgctcttaaacctcgttttcttgttggatagctggattgccctgtataagatgcagggcctctgtatatctgtggccgtgttcctccactattttctgctcgtgagctttacatggatgggtttggaagcatttcacatgtacctggctctggtcaaagtcttcaatacatatatccggaaatatattctgaaattctgtatcgtgggttggggggtgcccgctgtggtggtcacaataatcctgaccatcagtcccgacaactatgggttgggttcatatggcaagtttccaaacggatctccagatgatttttgttggatcaataacaacgctgtgttctacatcacagtcgtgggttatttctgtgtgatctttcttttaaacgtgagcatgtttatagtggtgctggtccagctctgtaggatcaagaagaagaaacagctcggcgctcagagaaagacctccatccaggacctgcggagcattgctggcttgacgttcctgctcggaatcacatggggtttcgcattcttcgcctggggcccagtcaacgtgacttttatgtacctgtttgccatattcaacacactacagggattttttatattcattttctactgcgtggctaaagaaaacgtccggaaacagtggagaaggtatctgtgctgcgggaaactccgtttagccgaaaactctgattggtccaaaacagctactaacggactgaagaagcaaacagtcaatcagggtgtgtcctcaagttcaaattcactgcaaagttcatctaactcaacaaattcgacgacgctcctggtaaataatgattgttccgtgcatgcgagtggcaacggaaacgcatccacagagagaaacggagtaagcttctctgtgcaaaacggagacgtctgcctgcacgactttaccgggaagcaacacatgttcaatgaaaaggaagattcttgcaacggcaaagggagaatggccttgaggaggaccagcaagcgcggttccctccactttattgagcagatgtag

SEQ ID NO: 188681 - DNA, 3012 bp, Artificial Sequence
  Description of Artificial Sequence: Synthetic coding sequence
atggtgttcagcgtgcggcagtgcggccacgtgggccggaccgaggaggttcttctgacttttaagatttttctggtcatcatctgtctacatgtggtactggtgactagccttgaggaagacacagataatagcagtctcagccctccacctgctaagctctctgtcgtttccttcgccccttccagtaacggaacacccgaagtggaaactacgagcttaaacgatgttactttaagcctcctgcctagcaatgagactggcgtgaagccgcagcggaacatctgcaacctgagctccatctgcaatgacagcgcgttctttcggggggagattatgttccagtatgacaaggagtctacggttcctcagaatcagcatattacaaacggaaccctcaccggggttttgtccttaagcgagctcaagagaagcgaactgaataagaccctgcagacgctgtccgaaacttattttatcatgtgcgcaaccgcggaggcccaatctaccctgaactgtaccttcactatcaaattgaacaacaccatgaacgcctgcgccgtcatcgccgccctcgaacgggtgaagatccggcccatggaacactgttgctgctccgtcaggataccctgtccgagttctcccgaggagctggagaagctacagtgtgacctgcaggatccaatcgtgtgtctcgcagaccacccacggggccctccattcagtagcagtcagtctattcctgtcgtgcccagagcaacagtgctgtcgcaggtaccaaaggccacctcctttgcagagcctccagattacagtcccgtcactcataatgttccaagtccgataggggaaatccagccactttcccctcaaccgagcgccccaatcgcttcctcccccgcaatcgacatgccccctcaaagcgagacaatcagcagtcctatgccgcagacacacgtttccggtactcccccgcccgttaaggcgtccttctcctctcctaccgttagcgcacctgccaatgtaaacaccacctctgcaccccccgttcagactgatatcgttaacacttctagcatatctgatctggaaaatcaagtgcttcagatggagaaggctctgagtctaggatctctggagccaaacctcgcaggagaaatgattaatcaggttagcagactactgcattcacccccggatatgctggcccccctcgctcagcgattacttaaggtggtggacgacattggtctccagctgaacttcagcaataccacaatttctctgaccagcccatccctggcccttgctgtaattcgggtgaatgccagctcatttaatactactacctttgttgctcaggatcccgctaatctgcaggtaagtctggagactcaggcccccgaaaacagtattggcaccatcacattacccagctctcttatgaacaatctcccagctcatgacatggagttggcgtcaagagtgcagtttaactttttcgagaccccagccctgtttcaggatccatccttggagaacctgtctttgatttcatacgtaatatcgagctctgtagctaatttgaccgtgcgcaaccttactaggaacgttacggtaacccttaagcacattaacccttcccaggacgaactcactgtccgctgcgtattctgggatctgggtcggaacgggggcagaggcggctggagcgataacggatgtagcgtgaaagatcgccgcttgaacgaaactatttgcacttgcagccacctgacctcttttggcgtgctcctggacttgtcccggacaagcgtgctacccgcccagatgatggctttaacgtttattacttacatcggatgcggattgtcatctatctttctcagtgtcacgctggtgacttacattgcattcgagaaaattaggagagactatccgtctaagattctgattcagttgtgcgccgctctcctcttgctaaatttagtttttcttctggactcctggatcgctctatacaaaatgcagggcctctgcatttccgtcgccgtgttcctccactactttctcctcgtaagcttcacttggatggggctggaggcctttcacatgtatctggccctagtgaaggtttttaatacctacatacgaaagtacattcttaaattctgcatcgtcggctggggtgtaccagccgtggttgtgacaatcatcttgactatttcaccagataactacggtctgggttcctatggaaagttccctaatggctcgccagatgacttttgttggatcaacaataacgccgtgttctatataactgttgttgggtacttttgtgtcatcttcctgctgaacgtgtcaatgttcatcgtcgttctggtgcagctgtgcaggatcaagaaaaagaagcagctgggagcacagagaaagacttctatccaggacttaaggagcatagcaggcctaacctttctgttgggaatcacatggggtttcgcgtttttcgcatggggacccgttaatgtgaccttcatgtacctgttcgcaatcttcaacacacttcaaggcttcttcatttttattttctattgcgtcgcgaaagagaatgtgcggaagcaatggcggagatacctttgctgtggcaagttgcgcctcgctgagaactcagactggtctaaaacagccactaacgggcttaagaagcagaccgtcaatcaaggagtatcctcctccagcaactcgttacagtcctcctccaacagcaccaacagcacgaccctcctcgtcaataatgattgttctgttcatgcgtccggcaatggaaacgcctccaccgaacgcaatggcgtttcgttcagcgttcagaacggcgatgtgtgcctccatgacttcacaggaaagcagcacatgttcaacgagaaagaagactcctgcaatgggaagggcagaatggctcttagacggacttccaaaaggggaagtctacatttcatcgagcaaatgtag

SEQ ID NO: 188682 - DNA, 2964 bp, Artificial Sequence
  Description of Artificial Sequence: Synthetic coding sequence
atggtgttcagcgtgcggcagtgcggccacgtgggccggaccgaggaagtactgctgaccttcaagatcttcctggttatcatttgtctgcatgtcgtactggtcacctctcttgaggaggatacagacaattccagcttaagcccgccgcctgaagtggaaactacgtccctgaatgacgtgacgctcagcctgctgcccagcaacgaaacaggcgtgaagccgcagcgcaacatttgcaacctgtcaagtatttgcaatgactcggccttcttccgcggagagatcatgttccagtatgataaagagtctacagtgccccagaatcagcacattacaaacggtactttgaccggcgtgctctctctcagcgagctgaagcgctcagagctgaataagactctgcaaacgctgtcagaaacatacttcatcatgtgcgctaccgccgaagctcagtccaccttaaattgcacatttactattaagcttaataacaccatgaatgcttgcgccgtcattgcggccttggagagggtcaagatcagaccaatggagcattgctgctgcagtgtgaggatcccctgtccatcctctcctgaggaactggaaaaactgcaatgtgacctgcaggacccaattgtgtgcctagcagaccatccaaggggacccccgttctcttcatctcagagcattcccgtagtgccacgcgccacagttctatcccaggtcccgaaagctacatctttcgccgaacctcccgactatagtccggtgacacataacgtcccatccccgatcggcgaaatccagcctctgtccccgcaaccatccgcccctatcgcttctagccccgcaatcgacatgccccctcagagcgaaacgatttcaagcccaatgccgcaaactcatgtgtctgggacaccacccccggtgaaggcttctttctcttcacctacagtttctgcacctgccaacgtaaacaccacttctgcccccccagtccagactgacattgtgaacacttcttccatcagcgacctggaaaatcaagtactgcagatggaaaaggccctctctctcgggtcattggaacctaacctggcaggcgagatgattaatcaagtcagccgtctactccactctccgcccgacatgctagccccattggctcagagactgttgaaggtagtagacgacatcggcctgcagctgaacttctctaatacaactatatcgcttaccagcccgagtctggcgcttgcggtcatcagagtcaacgcctcatcgttcaataccactacatttgtcgctcaggaccctgcaaacctacaggtgagcctggagacccaggcaccagagaactctatcggcacaattactctgccctcatccttgatgaacaacctgcccgcccatgacatggagctggcctcccgcgttcagttcaactttttcgagaccccagcactgtttcaggacccaagcctggaaaatctgagtttgatatcttacgtgatctcgtcttcggtggctaacctgacagtgagaaatctgactagaaatgtcaccgtgactcttaagcacattaatccaagccaggatgagctgactgtgcggtgtgtgttctgggatctgggtcggaatggtgggcgaggcggatggagtgacaacgggtgtagcgtcaaagaccgcaggctgaatgagactatatgcacctgtagccacctgacttcatttggggtgctgctggacctgagccggaccagtgtcctaccagcccagatgatggctttgaccttcattacctacattggctgcggtctgagctccatattcctgagcgtgacattggtgacatacattgcttttgagaaaatcagacgagattacccctctaaaattctgatccagctgtgcgccgctcttctcttacttaatctcgtattcctgctggatagctggatcgccctgtataagatgcagggcctctgtatttctgtggcggtattcttgcactatttcttactggtgtctttcacttggatgggattagaggcctttcacatgtatctcgctttggtcaaggtttttaacacatatatacggaagtacatcttgaaattttgcattgtaggatggggagtaccagcggtcgtcgtcacaatcattctcacgatttctcccgacaattatggcctggggtcttatgggaaattccctaatggctcgccggatgacttctgttggatcaataacaacgcggtgttttacataacggtggtcggctacttttgtgtgatcttcctccttaatgtgagcatgtttatcgtcgtgctggtccagctatgccgcataaagaagaagaaacagctcggtgcccagcgcaaaacctcgattcaggatctgaggtccattgccggtctcacctttcttctgggcatcacatgggggttcgcctttttcgcttggggccctgtgaacgttacattcatgtacctgtttgccatctttaatacacttcagggcttcttcattttcattttttattgcgtggcaaaagaaaatgtgcggaagcagtggagacgatacttgtgctgtgggaaactcagattggccgagaacagcgattggtccaagactgccaccaacggcctcaagaagcagactgtaaatcaaggggtgtcaagcagcagtaatagtctgcagtcatcgtctaacagcaccaactctacaaccctcttggtgaacaacgattgctcagtgcacgcctcaggcaatggaaacgcctcgactgagagaaacggggtctcattttccgtccagaatggcgatgtatgtctccatgattttactggaaaacagcacatgtttaatgagaaggaggatagttgtaacggaaaggggcggatggccctcagaaggacctctaaacggggatcacttcatttcattgagcagatgtag

SEQ ID NO: 188683 - DNA, 3045 bp, Artificial Sequence
  Description of Artificial Sequence: Synthetic coding sequence
atggtgttcagcgtgcggcagtgcggccacgtgggccggaccgaggaggtcctgttaaccttcaagatctttctggtaatcatatgcctgcatgtggtattggttaccagtctggaggaagataccgacaactcctccctcagccctcctccagccaaactaagcgtggtgtccttcgccccctcctccaatgaggtggaaactactagtttgaatgacgtgaccctctcattattaccatccaatgaaacagaaaagaccaaaatcaccatcgtgaagacattcaacgcctccggtgtgaagcctcagagaaacatctgcaatctgtcctctatttgtaatgactctgcctttttcaggggagagattatgttccaatatgacaaggaaagcactgtaccccagaaccagcacatcactaacggtacactgaccggtgtgctgtcactgagcgaactcaagcggtcagaactgaacaagactctgcaaactctttctgagacttactttattatgtgtgccacagctgaggcccagtccacgctgaattgcacatttacaatcaaactcaacaatactatgaatgcatgcgcagtgatagcagccctcgagagagttaagatacgtccaatggaacactgctgttgttccgtccgcattccttgtccttcatcccctgaagaacttgaaaagctgcagtgtgatcttcaggatcctatcgtgtgtctggccgaccatccccggggccctcccttctcctcttcccagagcatcccagtcgtgccacgagcaacagtcctctcacaggtgcctaaggccaccagctttgccgagccccccgactatagcccagtgacccacaatgtgccatccccgattggggagatacagccactgtcacctcagccaagcgctccaattgcttcctccccagcaatcgatatgcctccacagagtgagactatctcatcacccatgccccagacacacgtatccggtacccccccgcccgtcaaagcttcctttagcagccctaccgtgtcagcacccgctaatgtgaataccaccagcgccccgcccgtccaaacagacatcgtgaatacctcatcgatttctgacttggaaaaccaggtgctgcagatggagaaggccctgtcacttggcagccttgagccaaacctggcaggggagatgatcaatcaagtgtctcggttgctgcactccccccctgacatgttagcgcctctggcacagcgcctgctgaaagtcgtggacgacataggcctgcagctcaatttctccaataccaccatcagtttgacatctccctccctcgctcttgccgtcattagggtgaacgcctctagctttaacacgacaactttcgtggctcaggacccggctaacctgcaagtgtcactggagactcaagcacctgaaaattccattggcacaataacgctaccctcatctttgatgaacaatttgcctgctcacgatatggagctggcatcaagggtgcagtttaatttttttgaaacacccgctttgtttcaggacccttccctagagaatttatctttgataagctacgtgatcagctcaagtgtggcgaacttgactgtcaggaacctcacccggaacgttaccgtgacactcaagcatataaatccctcccaggacgaactcacggtgagatgcgtgttttgggatctggggcgcaatggcgggcgcggaggttggagtgacaacgggtgcagtgtgaaagataggagacttaatgagaccatctgcacttgtagtcacctgaccagcttcggcgtcctccttgatctgtcccggacatccgtgttgcctgcccagatgatggctcttacttttattacctacataggctgtggtctctcatccatttttctttccgtcaccttggttacctatatcgcgtttgaaaagatacggcgcgactacccaagtaaaattctgattcagctgtgtgctgccctgctcctcctgaatcttgtcttcctgctggatagttggattgccctgtataagatgcagggtctgtgcatctctgtcgcagtttttctgcattacttcctgcttgtttcgttcacttggatgggactggaggcattccatatgtatctggccctcgtcaaggtgttcaacacttacatccgaaagtacatcctcaaattctgtatcgtgggatggggagtgccagcagtcgtggttacaattatactcacaatcagtcccgacaactacggactcggatcatacggcaagttccctaatgggagtccggatgacttttgctggatcaacaacaatgcagtgttctatatcactgttgtgggctatttttgcgtgatttttctcctgaatgtttccatgttcatcgtggtgctcgtgcagctttgtagaatcaagaaaaaaaaacagttgggtgcccagcgaaaaacctccattcaggacctgagatcgatcgcgggtttgacttttctcctaggcatcacctggggatttgcttttttcgcttggggccccgttaacgtgactttcatgtacttatttgccatctttaatacactgcagggcttcttcatttttatcttttattgcgtagcaaaggaaaatgtgcgcaagcagtggcggcgctatctctgttgtggcaaactccggctggccgagaacagcgactggtctaaaactgccacaaatggactgaagaagcagaccgtgaaccaaggtgttagctcatcctcaaattctcttcagagttcaagcaattctactaacagtactactttgttagtgaacaacgactgcagcgtgcatgcctctgggaacggtaatgcttccactgagaggaatggggtctccttttccgtccagaatggcgatgtgtgtctacacgattttacgggcaagcagcatatgttcaatgagaaggaggattcatgtaatgggaaaggcaggatggccctgcgcaggacatcaaagcggggatccctgcacttcattgagcagatgtag

SEQ ID NO: 188684 - DNA, 2988 bp, Artificial Sequence
  Description of Artificial Sequence: Synthetic coding sequence
atggtgttcagcgtgcggcagtgcggccacgtgggccggaccgaggaggttctcttgacttttaagatttttctggtcatcatctgtctgcacgtcgtcttagtgacctcattggaggaggacactgacaactcgtctcttagtcccccaccagccaaactgtctgttgtttcattcgctccgtcgtcgaatggtacgccggacgtgaccttatcccttcttcccagtaacgaaaccggtgtcaaaccccagcgcaacatctgtaatctgtcttcaatctgtaatgactctgcgttcttccgcggtgaaatcatgtttcaatatgataaggagagcacagtgcctcaaaaccagcacattactaacggtactctgaccggggtcctgtctctctctgagctgaaaaggtccgagctaaataagacattgcagactctgtccgaaacatactttatcatgtgcgctacagcggaggctcagtccacactcaattgtaccttcacaattaagttaaacaatacaatgaatgcctgtgctgtgatagccgcactagagagagtcaagatcaggcccatggagcactgctgttgcagcgtgaggattccttgtccatcgagccccgaggaattggagaagctccagtgcgatctgcaggatcctatcgtctgcctggcggaccacccaagaggccctcctttctcgtcctcccagtccatccctgtcgtgcctcgagctaccgttctctcccaggtaccaaaagctacaagtttcgccgaaccgcctgactactctccagtcacacacaatgttccgagtcccattggagagattcagccactgtccccgcagccctcagcccctattgccagcagccccgctattgatatgccgcctcaatccgagaccatttcctcaccaatgccccaaacccatgtgtcagggaccccacctcctgtcaaggcgtccttcagtagccctacagtgtcggctcccgctaacgtgaacactacatctgcccccccagtacagaccgacattgtcaacacgtcgtctatctccgatctggaaaaccaggtattacagatggagaaggcgcttagcttagggtctttagagcccaatcttgcaggagagatgattaatcaggtcagtcggctcctacactccccaccagacatgctcgcacccctggcccagaggttgctgaaagtcgtggatgatattggcctgcagctcaacttctctaacactactataagtctcacgtccccaagtcttgccttggcggtcattcgggtgaacgcctcaagcttcaatacaactacattcgtagcccaggaccccgcaaacctgcaggtctctcttgagacgcaggcaccagagaattctatcggaactatcacgttgccgtctagtctcatgaacaatcttccagctcatgatatggagctggcttccagagtgcagttcaacttttttgagacccctgccctttttcaagacccttctttagagaacctctccctcatttcttacgtgatttcttcctccgttgccaacctgactgtcagaaatctaactcggaacgtcaccgtgacgttgaaacacattaacccttcccaggacgagctgactgtgaggtgtgtgttctgggacctggggcgtaacggggggagaggcgggtggtctgataatgggtgctccgtgaaggatcggcgtttgaatgaaaccatctgcacctgttcccatttgacatcatttggcgtgctcctggatttgtcgagaacatcggttcttcccgcccagatgatggctctcacctttatcacgtacattggctgtgggttgagctccatctttcttagcgtcactttggtgacctatatcgctttcgagaaaattaggcgcgattatccttctaaaatcctgatccagctttgcgccgccctgctgttgctgaatctggttttcttgcttgattcatggatcgcgctgtataaaatgcaaggtctgtgtataagcgttgctgtctttttgcactactttctcctcgtgtctttcacgtggatgggcttagaggcatttcatatgtacctggctcttgtcaaggtgtttaacacctatatccgtaaatacatccttaaattttgcatagtaggatggggcgtacctgccgtggtcgtgaccatcattttgaccatttcacctgacaactacggcttgggcagttatgggaaatttccaaacggttcgcccgacgatttctgctggatcaacaataatgctgtcttttacatcacggtggttggatacttctgcgtaatctttcttctgaacgtgtccatgtttatcgtggtccttgtgcagctttgtcggatcaagaaaaaaaagcagttgggagctcagcgtaagacaagtatccaggaccttaggtcaatcgcagggctgacttttcttctggggattacgtggggattcgcattcttcgcgtggggaccagtcaatgtgacttttatgtacttattcgccattttcaacaccctgcaagggtttttcattttcatattctactgcgtcgctaaagaaaatgtccgaaaacagtggaggagatatctgtgttgcgggaaactgcggctcgccgagaactccgactggtctaagactgcaacgaacgggctgaaaaaacagacagtgaatcaaggagtgtcaagttcctctaattcattgcagagctcttctaactccacaaattcgacgacccttctggtgaataatgattgtagcgtgcacgccagcggcaacggaaacgcctcgacggaaagaaatggcgtgtccttcagcgtacagaacggcgacgtctgtctgcacgacttcacaggcaaacaacacatgtttaacgagaaggaagattcttgcaacggcaagggtaggatggccctccggagaacaagcaagcggggcagtctgcactttattgaacagatgtag

SEQ ID NO: 188685 - DNA, 3054 bp, Artificial Sequence
  Description of Artificial Sequence: Synthetic coding sequence
atggtgttcagcgtgcggcagtgcggccacgtgggccggaccgaggaggtgctcctgacattcaagatttttttagtgatcatttgcctgcacgtggtgctggttacatctttggaagaggacacggataactccagcctgtcaccacccccagccaaattatcagtggtctcttttgcccccagctccaacggcacaccggaggtggagacaacttcattgaacgacgtgacactttcattattgccatcaaatgaaacagagaaaaccaagatcacgatagtgaagaccttcaatgcctctggtgtcaaacctcagcggaatatatgcaacctgtccagtatttgtaatgacagcgctttctttagaggtgaaataatgtttcagtacgacaaggagagcactgtaccccagaaccaacatatcacgaatggcaccctgaccggtgtcctctcactttcagagctgaaacgatccgaattgaacaaaacgttgcagaccctaagcgagacgtatttcattatgtgtgccacagctgaggcccaaagcacattgaattgcacattcaccataaagttaaataataccatgaatgcttgcgctgtgatcgccgctcttgagcgagtgaagatcagacccatggaacactgctgctgctctgtgagaataccctgcccctcctcccctgaggagttggagaaactgcagtgcgacctgcaagatccaattgtgtgtctggcagaccaccccagggggcctccattcagtagtagccaaagcatccctgtcgttccccgagcgacagtcctgtcccaggttccaaaggctaccagcttcgcagaaccaccagactactctccagtgactcacaacgtacccagtcctatcggagagattcaacccttgtcaccccagccttctgccccaattgcctcatccccagccatcgatatgccacctcagagtgagactatcagcagtcctatgccccaaacccacgtgtccgggacgccccccccagtgaaggctagcttctccagcccgacagtaagcgcccccgcaaatgtgaatacgacctccgcccctccagtgcagaccgacattgtgaatacctcttcaatcagcgacctggagaatcaagttctgcaaatggaaaaagctctgtccctgggcagcctggagcccaatctggctggggaaatgatcaatcaggtgtctagactgctgcactcgccacctgacatgttagctcctctggcacaaaggctactaaaggtcgtggacgacatcgggctccagctaaacttttcgaacacaacaatcagcctgacctcacctagcctcgctcttgccgtaatccgagtcaatgcctcctcttttaacacaacaacatttgtcgcccaggatcccgctaatctgcaggtttctctggagacgcaggcaccggagaattcgatcggaacaattacattgccaagctccctgatgaacaatctgcctgcccatgatatggaactggcatctcgggtccagttcaacttcttcgagactcccgctctcttccaggatccctctctcgagaatttaagtcttatcagctatgtgatctcatcttcagttgccaacctgacggtccgtaatcttacgaggaacgtgactgttacgctgaagcacattaacccatctcaggatgagctcacagtacggtgtgttttctgggatctcggccgcaatgggggccgtggcggttggagtgacaacggctgcagcgtaaaggatcgtagactgaacgagaccatatgtacatgttcccacctgacatcgttcggggtcctgctggacctctctcggacttccgtactccccgcgcagatgatggctctgaccttcatcacgtacatcggatgtggcttgagtagcatattcctctcagtgacactcgtgacctacattgcctttgagaaaattcgccgcgattacccgagcaagattctgatacagttgtgcgcagcactcttgctgttaaatcttgtttttctactagatagttggatcgcactttacaagatgcagggtctgtgtatatcagtggcagtgtttctgcactacttcctccttgtgagctttacctggatgggcctggaagcattccatatgtacctcgccttggtgaaggtgttcaatacctacattagaaagtatatccttaaattctgcattgttgggtggggcgttcctgcggtcgtcgtgaccattatcctaactatttcccccgacaattatggtctaggcagttatgggaaatttccgaatggatctccggacgacttctgctggatcaacaacaatgcagttttttatattactgttgttggatacttctgcgtgatctttctacttaacgtatccatgttcatagtcgtgcttgtgcagctctgcagaatcaagaaaaagaaacaactcggagcacagcgtaagacgagtatccaggacctgcgctccatcgcgggactgacttttctgttggggatcacatggggctttgccttctttgcctggggacctgtgaatgtgactttcatgtatttatttgccatctttaacactctccaaggattcttcattttcatcttctactgtgtcgccaaagaaaatgtgagaaagcagtggaggcgctacctatgttgtggaaagctgcgcctggcagaaaattcggactggagcaagactgcaacgaatggactcaagaaacagacggttaatcagggggtctcatccagctcaaactcactccagagctcatcaaacagcacaaatagcactaccctcttggttaataacgattgtagcgtgcacgcaagcggtaacggcaacgcttccacagagaggaacggagtgagcttttcggttcagaacggtgacgtctgcctgcatgattttactggaaaacaacacatgtttaatgagaaggaagactcatgcaacggcaagggtcgaatggcacttaggcggacttcaaaacgcggaagcctgcatttcatagagcagatgtag

SEQ ID NO: 188686 - DNA, 2901 bp, Artificial Sequence
  Description of Artificial Sequence: Synthetic coding sequence
atggtgttcagcgtgcggcagtgcggccacgtgggccggaccgaggaagtgctgttaacattcaaaatcttcctggtcattatctgtttacacgtggtcctggttacgagccttgaagaggacacggacaattccagcctaagcccacctccagccaaactgtccgttgtgtccttcgcccccagttccaatggtactcccgaagtagagaccacgtctctaaacgatgtgacactgtctcttttgccttctaacgaaaccgagaagacaaagattacaattgttaaaactttcaatgcctcaggggtgaagcctcagagaaacatctgtaacctttcatctatttgcaatgattccgcctttttccgcggcgagatcatgtttcagtatgacaaggaaagcaccgttccacaaaatcagcatattactaacgggaccctgacgggagtcctatcactgtcagagcttaagaggtcggagctgaataaaaccttacaaactttgtctgaaacgtacttcataatgtgcgctaccgccgaggcacaatctacgttaaactgtactttcactattaaactgaacaacacaatgaacgcctgcgcggtgatcgctgcactggaacgcgtcaaaatacgcccaatggagcactgttgctgtagcgtccgcatcccttgtccaagctcccccgaggagttagaaaagctacagtgcgatctccaggatcccatagtctgtctggctgatcacccgcggggcccccccttcagcagttctcagtccattcccgtcgtgcccagagctaccgtacttagccaggtcccaaaggctactagcttcgctgagcctcctgactacagccccgtgactcacaatgttccctcccccattggtgagatccagcccctaagtccccagcctagtgccccgattgcatccagcccagccatagacatgccaccacaaagtgaaacgatttccagccccatgccccaaacccatgtctccggaactccgcctcctgtgaaagcgtccttcagctcacctaccgtctctgctccggcaaatgtgaacacaacctccgctccaccggtgcagacagacattgtgaacacctcctccatctccgatctcgagaaccaggtgctgcaaatggagaaggccctgagcctgggatccttagagcccaacctagccggagagatgatcaaccaggtgtctagattgctccacagtccacctgacatgctggcaccgctggcccagagactgctcaaggttgtcgatgacatagggttgcagctgaacttctcaaacaccaccatctccttaacatctcccagcctggccctggccgtgatacgcgtgaacgcttccagcttcaatactactactttcgtcgcacaagatcctgcaaatttgcaggtctccctggagactcaggcaccagaaaacagcatcggtactataactctcccatcgagtctgatgaacaatctgcctgcacatgacatggaactggcaagtcgcgtacaattcaacttcttcgagacgcccgctttgttccaggacccgtccctggagaatctgagtctgatctcctatgtgatctctagctctgttgctaacctcaccgtccgcaacctgacaaggaatgtgactgtgacactgaagcacattaaccccagccaggatgagctcacagtcagatgcgttttctgggatctggggcggaacggcggccggggaggctggtcagataatggatgcagtgtgaaagatcggaggctgaacgaaactatttgcacctgctcccacctgacgagttttggggtgttactcgatctctcgagaaccagcgtgctccccgcgcagatgatggccctaacctttatcacttatataggctgtggcttgtccagcatctttttgagtgtcaccctcgtgacgtacatagcctttgaaaagattcgccgtgattacccctccaaaatcttaatccagctctgtgccgctttgctgctgcttaacctggtgtttcttctggatagctggattgccctgtataaaatgcagggcctgtgtataagtgtggccgtctttcttcactacttcctgctggtttcttttacctggatgggattggaggcctttcacatgtacctggcactggtgaaggtgtttaacacatacatacgtaagtatatccttaagttttgcattgtcgggtggggtgtccctgccgtggtcgttactatcatcctaactatctctccagacaattacggtctgggaagctacggcaagtttccaaatgggtcacccgacgacttttgttggatcaacaacaatgcggtattttatatcactgtcgtcggctatttctgtgtcattttcctgttgaatgtgtccatgttcatcgtcgttctggttcagctgtgcagaatcaaaaagaaaaagcagctgggggctcaaagaaaaacctccatccaggatctgcgttctatcgcggggcttacatttctgctcggcatcacttggggattcgcattcttcgcctggggtccagttaacgtcacgttcatgtacctattcgccatcttcaacactttgcagggctttttcattttcatcttctactgcgtagccaaggaaaatgtgaggaagcagtggcgccgctacctttgttgcggcaagctccgtctcgccgagaactccggtaacgcatcaactgagcgtaacggcgtttctttcagcgtgcagaatggagatgtgtgcctgcacgatttcaccggcaaacaacacatgttcaatgaaaaggaggatagttgtaacgggaaagggagaatggctctccggcgcaccagtaagaggggatcactgcattttatagagcagatgtag

SEQ ID NO: 188687 - DNA, 2982 bp, Artificial Sequence
  Description of Artificial Sequence: Synthetic coding sequence
atggtgttcagcgtgcggcagtgcggccacgtgggccggaccgaggaagtgttgctgacattcaaaatttttctcgtgattatctgcctccacgtggtgctggtgacatctctggaggaggatactgataatagctcactgtctcctccacccgatgtgaccctgtctctcctgccctccaatgagaccgagaaaaccaaaataacaatcgtgaagactttcaacgcctccggcgttaagccgcagcgcaatatttgcaacctgagctcaatatgtaacgacagtgctttttttagaggagagattatgttccaatacgacaaggagtctacagttccacagaaccagcatatcactaacggaaccctgaccggcgtgctttccctctcagagctgaagcgaagcgaactaaacaagacacttcagaccttgagtgaaacctacttcattatgtgcgcgaccgccgaagcccagtccacactaaactgtacattcactatcaaactcaataataccatgaacgcgtgtgccgtgattgcggctctggaacgggtgaagatacgacccatggaacactgttgctgctccgtgcgcataccatgtccttcctcccctgaggaattagaaaagttacagtgtgatctgcaggaccccatcgtgtgtttggcggatcaccctcggggcccccccttctcgagtagccagtcaatacccgttgtgccacgggccaccgtgctcagccaggtccccaaggccacctctttcgcagagccccctgattacagccccgtaacccataacgtccctagcccgattggagaaatacagcccctctcacctcaacctagtgctcctatcgcttcgagcccagccatagacatgcctcctcagagtgagactatctcaagccccatgcctcagacacacgtgtccgggacaccaccgcctgtcaaagcctccttttcgtcgccgaccgtgtctgcgcctgccaatgttaatacaacaagcgcgccgcctgtacagaccgatatagtcaacactagcagtatcagtgacctagaaaaccaggtgctgcagatggagaaggccctctccctcggttctttggaaccaaatctggcaggagaaatgatcaaccaggtctctaggttgttacactctcctccagacatgctggcccccttggcacaacggctactgaaggttgtagatgatatagggctccagctcaacttctccaatactactattagcctgacatctcccagtctggctctggccgtcatccgggtaaacgcctctagcttcaacacgaccaccttcgttgcccaggatcccgccaacctgcaggtttctctcgagacacaggctccagagaattcgatcggaaccattacacttccatcctcattaatgaataacctgccagcccatgacatggaattggcgagcagagttcagttcaacttttttgagacccctgccctgttccaggatccttcactggagaacctgtccctgatatcctacgtgatttcctccagcgtagctaacctcaccgtgagaaatcttactcggaatgtgactgtgaccctgaaacatataaatccgtctcaggatgaactcaccgtgcggtgtgtcttctgggaccttggacgcaatggaggtagaggaggatggtcagacaatggttgtagcgtaaaggaccggcgattgaacgagaccatatgcacttgctcccatttgacttccttcggcgtcttactggacctgtctaggactagcgtgctgcccgctcagatgatggcactgacgttcatcacctatattggatgtggtctatcttcaatctttctgagtgtaacattagtgacatatattgcatttgagaagattcgacgcgattacccatccaagatcctcatccagctgtgtgctgccttgctgctgctcaacctcgttttcctcctagacagctggatcgcactatacaagatgcagggtctgtgtatctctgtggccgtattcctccactacttccttctggtgagctttacatggatgggtctggaagctttccatatgtacttagctctggtcaaggtttttaatacgtacatcagaaagtacattctgaagttctgcatcgttggctggggagtcccagcagttgtggtgacaatcattcttacaatcagccccgacaactacggcctcgggagctacggaaaatttcctaatggcagtccagacgatttctgttggatcaataataatgctgtgttttacattaccgtggtagggtatttttgtgtcatcttcctactgaatgtcagcatgtttatagtcgtgctggtccagctgtgcagaattaaaaaaaagaaacagctgggagctcaacgtaaaaccagtattcaggacctccgatctattgccgggttaactttcctcctcgggataacctggggtttcgctttttttgcctggggccctgtgaatgtaaccttcatgtacctcttcgcaatattcaacacattgcaaggattcttcatcttcattttctactgtgtggccaaagaaaatgtcagaaagcagtggcggcggtatctctgttgtggtaaattgaggctcgccgagaacagcgattggtctaagaccgccacgaatggactcaagaagcagaccgtgaatcaaggggtatcaagctctagcaatagtctccagagttcttctaatagcaccaactcaacaacattgctggtcaataacgactgcagtgtgcatgcaagcgggaatggcaacgcctccaccgagcggaacggcgtctcgttttccgtacagaacggcgatgtgtgcctgcatgacttcactgggaaacagcatatgttcaatgaaaaagaagattcatgcaacggaaaaggacggatggcacttaggaggacatcgaaacgcgggagtctccattttatcgagcagatgtag

SEQ ID NO: 188688 - DNA, 3006 bp, Artificial Sequence
  Description of Artificial Sequence: Synthetic coding sequence
atggtgttcagcgtgcggcagtgcggccacgtgggccggaccgaggaggtgctcttaacgtttaaaattttccttgttatcatctgcctgcacgtggtgttggtgacttctttggaagaggacaccgacaatagcagcttgtcccctccccccgaggttgaaactacaagcctgaatgatgttactctgtccttgttaccatccaacgagactgaaaagaccaaaatcacaatcgtcaagacctttaatgccagtggagtgaagcctcaacgcaacatctgcaacctgagctctatctgtaacgattcggcttttttcagaggagaaataatgttccagtacgataaggagtcgacagtgccacagaaccagcatattactaatggaacactgacgggggtgcttagcctgtctgagctaaaacggtctgagctaaataagaccctgcaaaccttatcggagacatacttcattatgtgcgccactgcggaggcgcagtccacattaaactgtacgttcactattaagttgaacaacactatgaacgcctgtgctgtgatagcagcattggagagggtcaaaattaggcccatggagcattgctgctgttccgtgagaatcccctgtcctagtagtcccgaagaacttgaaaagcttcagtgcgaccttcaggaccccatcgtctgcctggcagaccatcctcgggggcctcctttctcctcgtctcaaagcatacctgtggtgccacgggccactgtgctgtctcaggttccgaaagcgacctcattcgcagagcccccagattattcccctgtgacccataatgtgccttcccctatcggggaaattcagccacttagccctcagccttctgcaccgatcgcctcatctcctgctattgatatgccgcctcagtccgaaacaatttcatcacctatgccccagacccatgtttcaggaactcccccgcccgtaaaagcctctttcagtagtcccaccgttagcgcacccgccaacgtgaacactacctcagcccctcctgtgcagacagatattgtaaatacctcttctatcagtgatctagaaaaccaggtccttcagatggagaaggccttgtcgcttggtagtttggaacccaatttagccggagaaatgattaatcaagtcagtaggttgctccacagccccccagacatgctggcccctctagcgcagcgtttacttaaggttgtggacgacatcgggttgcagcttaatttcagtaacaccacaatctccctgacgagcccctctttagcgttagccgtcatccgcgtaaacgcttcctcctttaatactaccacttttgtggcgcaggatcccgccaatctgcaggtgagcctagaaacccaggccccggagaatagcatcggcacaattaccctgccttccagcctcatgaacaacctcccagcgcacgacatggagttggccagcagagtgcagttcaattttttcgaaacgcccgctctctttcaggacccctcattagaaaatctgtctcttatcagttacgtgattagtagttcagttgcaaatctgacagtcaggaacctgacaaggaatgtaactgtgactttgaaacatatcaaccctagtcaggatgaactaacagtgcgctgcgtattctgggacctgggccgtaacggtggccggggggggtggagtgataacggatgtagcgtgaaggatcgcagactgaatgagactatctgtacctgttctcatctgacaagtttcggcgtattacttgacttatcaagaacctccgtgctcccagcacagatgatggcgcttacatttattacatatattggatgcggactttcctcaatcttcctgtcagtaaccctggtcacctatattgcgtttgagaagatacgccgtgactacccttctaagatcctgatccagctgtgcgccgccctgctgctgctcaacttagtgttcctgctcgatagctggatcgccttgtataaaatgcaggggctgtgtattagcgttgcagtatttctgcactactttctgttggtgtccttcacctggatgggactagaggcctttcacatgtaccttgctcttgttaaggtgtttaatacatacatccgtaaatatattctgaagttttgcatcgtgggatggggggttcccgccgtggtcgtcactatcatattgactatctcacctgacaattatgggcttggatcatacggcaaatttcccaatggatctcccgatgatttctgctggattaacaacaatgccgtgttttacatcacggtggttggctacttttgtgtgattttcttgttgaacgttagcatgtttatcgtcgttctggtgcagctgtgtcgcatcaagaagaagaaacagcttggcgcacaaagaaagacaagcattcaggacctgaggtccatcgctggcttgacgttcctgcttggcattacctggggcttcgcattctttgcatgggggcctgtaaatgtgacattcatgtatctgtttgctatctttaatactctgcagggatttttcatcttcatcttttattgtgtcgccaaggagaacgtgcggaagcagtggcggaggtatttgtgttgtggaaagctacgtctagcggagaactcagactggagtaaaactgctacgaatggcttaaagaaacagacagtcaatcaaggggtctcctcttcctctaactccctgcagagctcttctaacagcaccaattctaccaccttgctggttaataacgattgttcagtgcacgcaagcggcaatgggaacgcttccactgagcgcaacggcgtctccttcagcgttcagaatggcgatgtgtgtttacatgatttcaccgggaagcagcatatgtttaacgagaaggaagatagttgcaatggcaaaggtaggatggccttgcgccgcacatccaagcgagggagtcttcacttcattgaacagatgtag

SEQ ID NO: 188689 - DNA, 354 bp, Artificial Sequence
  Description of Artificial Sequence: Synthetic coding sequence
atcctgctgaccatgcagcacatcaacaccggcatcgacatgctgaatcagctagggtgtgtgtttttcgctggggttaaacctcagagaaacatctgtaatctttcatctatttgcaatgactccgctttcttccgtggggaaatcatgttccaatacgacaaggaatcgacggtgccccaaaatcagcacatcaccaacggaacactgactggcgtattaagcttgagtgagctcaagcggtcagagcttaacaagacactgcagacgctgagcgagacatactttatcatgtgtgctacagccgaggcccagcgccacattaagctctacatccataataagactgagtag

SEQ ID NO: 188690 - DNA, 1014 bp, Artificial Sequence
  Description of Artificial Sequence: Synthetic coding sequence
atgaacagcacctgcatcgaggagcagcacgacctggaccactacctgttccctatcgtttacatcttcgtcattatcgtgtctataccagccaatataggaagcctgtgcgttagctttctgcaggccaagaaagaatctgagttgggcatctatctattcagtctgtccctcagcgacctgctgtacgctctgaccctccctctttggatcgactatacttggaataaagacaactggacattttctcccgccctgtgcaagggatcagcgtttctgatgtatatgaacttctactctagtacagctttcctcacctgtatcgctgtggatcgctacctcgcggtggtttaccccttgaagttcttttttctgcgcacccggcgctttgccctgatggtctcattgtccatttggatcctggagaccatctttaatgccgtcatgctttgggaagatgagactgtggtggaatactgcgacgccgagaaatctaacttcaccctgtgctatgataagtacccactcgaaaagtggcagataaatttgaacctgttcagaacatgtactggttatgcaattccgttggttacaatcttgatttgcaatcgcaaggtgtatcaagccgtacgccataataaggctactgaaaacaaggagaagaagcggattataaaactgctggtgagtataacggtgacttttgtcctgtgcttcacgccatttcatgtcatgctcctgattagatgcatactggagcacgccgtgaatttcgaagaccactcaaacagtggaaagcgcacgtatacgatgtatagaataacagtcgcccttacatcactgaattgcgtggcggatccaatcctctattgttttgtgaccgaaacaggacgatatgacatgtggaacatcctgaagttctgcaccgggagatgcaatactagtcaacgccagagaaagcggatcctctccgtcagcactaaagacaccatggagttagaagtgctagagtag

SEQ ID NO: 188691 - DNA, 1623 bp, Artificial Sequence
  Description of Artificial Sequence: Synthetic coding sequence
atgaacagcaccggccacctgcaggacgcccccaacgccaccagcctgcacgtgccacattcccaggagggaaattcaacatcactgcaggaaggcctccaggatctgatccacaccgcaaccctggtcacatgcactttcttgttggccgtgatcttttgcctgggatcgtacggtaactttatagtcttcctgtccttcttcgatcctgccttcagaaaatttcgtactaacttcgactttatgatcctgaacctcagtttctgtgacttgtttatttgcggtgttaccgcccctatgttcacatttgtgctgtttttctcctccgcttcttccataccagacgccttttgctttactttccacctaactagcagcggatttatcatcatgagtcttaaaaccgtcgcagtgatagccctgcaccgcctgaggatggtcctcggtaagcaacccaacaggacggccagttttccatgcactgtactgttgacactcctcctatgggctactagttttacgcttgccaccctcgcgaccttaaaaacgtcaaagagtcatctatgcttgccaatgagcagtctcattgcaggtaaggggaaagccatcctttctctctatgtcgtcgatttcacattctgcgtcgccgttgtttctgtgagctacattatgatcgcccagaccctgagaaaaaacgctcaagtccgcaagtgtccaccagtgattacagtggatgcaagccggccacaacctttcatgggcgtcccagtgcaaggagggggggatccaatccagtgtgccatgccggctctctaccgaaatcagaattataacaaattgcaacatgtccaaactaggggctacactaaaagccccaatcagcttgtcacccccgccgctagtcgtctgcaactggttagcgccattaatctgagtacagctaaggacagcaaagccgtggtgacctgcgtgattatcgtgttatctgtgttggtgtgctgtttacctctcggcatatcccttgtgcaggtggttctttcttctaacggctcctttattctctaccagtttgagcttttcgggttcaccctcattttctttaaaagtggtcttaatccatttatatacagtaggaattccgctggtttaagaaggaaggtcctgtggtgtctccagtacatcgggctgggatttttctgttgcaaacagaaaacgaggctaagagctatgggtaagggaaacctcgaggtaaaccgaaacaaaagcagccaccacgagactaacagcgcttacatgttgtccccaaagccacaaaagaagttcgtcgaccaggcatgcggaccttctcactctaaagaaagcatggtttctccaaaaattagtgccggtcaccagcactgtggacaaagttccagtactccgatcaacacaagaatagagccatactacagtatctacaactcgtccccatctcaggaggagagcagtccctgcaacctgcagcctgtgaatagcttcggcttcgccaactcctatattgcgatgcactaccatactaccaacgaccttgtgcaggagtatgatagtacctcggcaaagcaaattcccgtaccgagcgtatag

SEQ ID NO: 188692 - DNA, 1092 bp, Artificial Sequence
  Description of Artificial Sequence: Synthetic coding sequence
atgggccccggcgaggccctgctggccggcctgctggtgatggtgctcgccgtggctttgctgtctaatgcccttgtattactgtgttgtgcatattccgctgagctgagaaccagggcctcaggtgtccttttagtcaatctctcactaggacacttgctacttgcggcactggacatgccttttaccctcctcggggtcatgcgcggaagaacacccagcgcacccggcgcctgccaggtaatcggattcctagacacctttctggcgagtaatgctgctctaagtgtggccgcactgtccgctgaccagtggctggcggtgggatttcctctgagatacgctggccgactgcgccccagatatgcaggactgttgctaggttgcgcctgggggcaaagtcttgctttttctggtgctgccttaggttgctcctggctgggatatagctccgcatttgcatcttgttcccttcgtctgcccccagagcccgagcggccccgctttgcagcctttactgcaacattacacgctgttggtttcgtgctgcccctggctgtcctctgtctgactagcctgcaggtgcaccgtgtggccagacggcactgccaaagaatggatactgtcaccatgaaggcccttgctctgctcgctgatctacacccttccgtccgccagaggtgccttattcagcagaagagaagacggcaccgggccacgcgcaaaattgggatcgcaatcgccaccttcctcatctgcttcgccccttatgttatgacaagactggctgaactggtgccctttgtgaccgtgaacgcacaatggggtatcctgtccaagtgcctgacatactccaaggctgtggctgacccctttacttattccctcctgaggcgaccatttcgtcaggttttggcaggaatggtccatagacttcttaaacgtaccccaagacctgcaagtactcacgactctagccttgacgtggctggaatggttcaccaactgttgaaaagaacccctcgccctgcctctacacataatgggtcagtagatactgagaacgactcatgtctgcaacagacccattag

SEQ ID NO: 188693 - DNA, 1011 bp, Artificial Sequence
  Description of Artificial Sequence: Synthetic coding sequence
atgaacaacaacaccacctgcatccagcccagcatgatcagcagcatggccttgccaattatttacattctcctgtgtattgtgggcgtattcgggaacaccctgtcccaatggatcttcctgacaaaaatcggcaagaagactagcacgcatatttatctgagccacttggttactgccaaccttctggtttgttctgcgatgccctttatgagcatatatttcctcaagggctttcagtgggaatatcagagcgcacagtgcagagtagtcaactttctgggaacactgtctatgcacgcttcaatgtttgtttcactgttaatcctcagttggattgctatcagccgctacgcaacacttatgcagaaagacagctcccaagagacaactagttgttacgaaaaaattttctatggccacctactcaaaaagtttaggcaacctaatttcgctcgcaaactgtgtatctacatatggggtgtggtgctcggaatcatcattccagtaacagtctactacagtgttatcgaagctaccgagggagaggagtctctctgttataatcgccagatggagttaggagccatgataagtcagatcgcaggactcattggaactacattcatcgggttctccttcctggtggttctgacttcctactactcgtttgtgtcccacctgcgaaagatacgcacatgtacatcgatcatggaaaaggaccttacgtactcgtcagtcaagagacatttgctggtaatccaaatccttctgattgtgtgtttcttaccctatagtatttttaagccgatcttttacgtattacaccagcgagacaactgccagcaactgaattatctgatcgagacaaagaatatactgacatgtttagcatcagctcggagctcgacagacccgataattttcctgttactagataagacctttaaaaagactctgtataacttgttcactaagtccaattcggcgcacatgcagagctatggatag

SEQ ID NO: 188694 - DNA, 1272 bp, Artificial Sequence
  Description of Artificial Sequence: Synthetic coding sequence
atggtgccccacctgctgctgctgtgcctgctgcccctggtgcgggccactgaaccgcatgagggcagagcggatgagcaatctgcggaggcagcactggccgttccaaacgcttctcatttctttagctggaacaactatactttcagcgactggcagaacttcgtcggcagaagaaggtacggcgccgaaagccagaacccaaccgtgaaggccctgctgattgttgcctatagctttattatcgttttctcactctttggcaacgtgctggtatgccacgttatttttaaaaaccaaaggatgcactctgcaacaagcctatttatagtgaacctcgctgtggctgatattatgattactcttttaaacaccccatttactttagtaaggttcgttaacagcacatggatcttcgggaaggggatgtgtcacgtgtcaagattcgctcagtactgctccttgcacgtgtcagcgctcacactcactgctatcgccgttgatcggcaccaggtcatcatgcacccacttaagccacgtatctcaatcactaagggcgtaatctacatagccgtgatctggacaatggctacatttttttcgctgccccatgctatctgtcagaaattattcacctttaagtacagtgaagacattgtgcgctccctgtgtctgcccgacttcccagagcccgccgatcttttctggaaatacttggacctcgccaccttcatactgctgtatatccttcccctactcatcatctcggttgcttacgccagagtggctaagaagttgtggctctgcaacatgataggagacgtgactacggaacaatatttcgcgctgcgaaggaagaaaaagaaaacaatcaagatgctcatgctggtcgttgtcttgttcgccctctgctggttcccgcttaattgctatgttctgctgttgtcatcaaaggttattcgcacaaacaatgcactatattttgcttttcattggttcgcgatgtcctccacctgctataaccctttcatctattgctggctgaatgagaacttccgaatagagttgaaggctctactgtcgatgtgccagcgaccgccaaagcctcaggaagataggccaccctcccccgtgccctcattcagagttgcctggaccgaaaagaacgatggacagagagcccccttggcgaacaacctcttgcccacctcccagttacagagcgggaaaactgatctctcttccgtcgagcctattgtgacgatgtcctag

SEQ ID NO: 188695 - DNA, 1191 bp, Artificial Sequence
  Description of Artificial Sequence: Synthetic coding sequence
atgtggaacagcagcgacgccaacttcagctgctaccacgagagcgttctgggctacaggtatgtcgctgtcagctggggtgtggttgtggccgtgaccggaaccgtgggcaatgtgttaacactcctggcccttgcaattcaacccaagctgcgtactcgattcaacctgcttattgctaacttaacacttgctgacttgctctactgcaccctgttgcagcccttttcagtggacacatacttgcacctgcactggagaacaggagcaacattttgtcgcgtgtttggactcttactgttcgccagtaattctgtttctatcttgaccctctgcctcatcgcactgggccgctatttactgatcgcccacccgaaactgtttccccaagtattttcggccaagggaatcgttctggcacttgtgtccacctgggtagtgggagtggctagcttcgcgcccctgtggccgatttacatcttagtaccggtggtgtgcacctgctcatttgataggattcgaggaaggccttacacaactattctgatgggcatttacttcgtcctcggtctttccagtgtgggcattttctactgtttgattcaccgccaggtgaagagggctgctcaggcactggaccagtacaagctgcgccaggcttcgatccacagtaatcacgtggcaagaacggacgaagcaatgcccggacggtttcaggaacttgactcacggttggccagcgggggtcctagcgaaggcatctcatcagagccggtgagtgccgccaccacacagactctggaaggcgatagcagtgaggtaggcgaccaaatcaactccaagcgtgctaaacagatggctgagaaatctccccccgaagcctcagcaaaggctcagccaattaaaggtgcgcgccgggcgccagatagtagcagtgagttcggcaaggtaactcggatgtgcttcgcagttttcctgtgctttgctctatcatatattcctttcttgctgttgaatattctggatgcccgagtccaagccccacgcgtagtccacatgctggctgcaaacctgacgtggctcaacggctgcataaacccggtgctgtacgccgccatgaatcgacagttcaggcaggcatatggctctatcctgaagcgcgggcctcggtcttttcacagactgcactag

SEQ ID NO: 188696 - DNA, 1191 bp, Artificial Sequence
  Description of Artificial Sequence: Synthetic coding sequence
atgtggaacagcagcgacgccaacttcagctgctaccacgagagcgtgcttggttacagatatgtcgctgtctcctggggggtggtggtcgctgtgactggcaccgttggaaatgtacttactctgctggctttagccatacagcccaaactgcgcacaagatttaacctgctgattgcaaacctcaccctcgccgacctcctatattgcacactgctgcagcccttctccgtggacacttatttgcacctccactggagaactggagctacgttctgcagagtgttcggcctcctgctcttcgcaagtaactctgtctcaatactgaccctatgtctgattgccctgggtaggtatctcctcattgcgcacccaaagctgtttccccaggtattttccgccaaagggatcgtgttggctctggtctctacctgggtggtgggagttgcatcctttgctcccttatggcctatctacatattagtgccagtcgtttgtacttgtagctttgataggattcgcggacggccctacaccacaatacttatgggcatttacttcgtgttagggctgagcagtgtcggaatcttttattgcctcattcatagacaggtgaagcgagcagctcaggcactggatcagtacaaacttaggcaggcctccattcattctaatcacgtggctagaacggacgaggcaatgcctggaagatttcaggagctggattcacgattggcctccggcggccctagtgagggcatatcatcagagccagtatccgctgctacgacacaaacactggagggtgacagtagcgaggtgggtgatcagataaactccaaaagagcgaagcaaatggcagaaaaatctccacctgaggccagcgcgaaggcgcagcctattaaaggtgcccgcagggcgccagactccagttccgagtttgggaaggtgaccagaatgtgctttgccgtgtttctttgctttgccctttcctacatacccttccttctactaaatatactagatgctagagtgcaggcccctcgcgtcgtgcacatgctggctgcaaatctgacctggctaaacggttgtattaacccagtgttgtatgccgctatgaacagacaattcagacaggcatacgggtctatcctgaagagaggaccaagatcctttcacaggttacattag

SEQ ID NO: 188697 - DNA, 1113 bp, Artificial Sequence
  Description of Artificial Sequence: Synthetic coding sequence
atggccaactacagccacgccgccgacaacatcctgcagaacctgtcacctctgacagcatttcttaaactcactagcctcggctttatcatcggcgttagcgtagtgggtaatttgcttatctctatcttgctagtgaaggataagacactgcaccgcgcgccttactatttcctcctggacctgtgttgttcggatattttaaggagcgctatctgctttcccttcgtctttaattcagtgaaaaacggctctacctggacttacggtacactcacatgcaaggtgatcgctttccttggcgtcctctcctgcttccacacagcgttcatgctcttctgtatttcggtgacaaggtatttagctatcgcacaccaccgcttctatacgaagcgcctaaccttctggacttgtctagctgttatatgcatggtgtggaccctgagcgtggccatggcttttccccccgttctggatgtgggaacgtactcatttattagggaagaggatcaatgcacgttccagcatagatcttttagagctaacgattccctgggctttatgttactgctcgcccttatcctgctcgccacccaattggtatatctcaagctgattttcttcgttcatgaccgacgtaagatgaagccggttcagttcgttgcggctgttagccagaactggacgttccatggccccggcgcatcaggacaggccgcagcgaattggttggctggcttcgggcggggtcccaccccgccaactctcctcgggattcgacagaatgctaacacgactggtaggcgcagacttctggtgctagatgagtttaaaatggagaagcgcatttctagaatgttctatatcatgacttttttattcctgacactgtggggaccatatctggtagcatgttattggagggtgttcgcaagaggaccagtggtgccaggcgggttccttacagccgcagtctggatgtcctttgcacaggccggcattaatccttttgtctgcatctttagtaatcgggaacttagaagatgcttctccaccacccttctgtactgtagaaagagccggctgccccgggagccgtactgtgtgatctag

SEQ ID NO: 188698 - DNA, 1113 bp, Artificial Sequence
  Description of Artificial Sequence: Synthetic coding sequence
atggccaactacagccacgccgccgacaacatcctgcagaacctgtctcccctgactgccttcctgaagctcacgtcattgggattcataattggcgtcagcgtggtggggaatctcctcattagcatcttgctggtcaaagataagaccttacaccgagccccgtattacttcctgctggatctatgttgcagcgacatcctgcgctccgctatctgcttcccttttgttttcaatagcgttaagaacggctcaacatggacgtacggcactctgacgtgtaaggtgatcgccttcctcggagtgctcagctgctttcacaccgcctttatgttgttctgcatttccgttacacgttacctagcaattgcgcatcacagattctacaccaaaaggcttacattctggacctgtctcgcagtgatttgtatggtctggacattgtccgtggccatggcctttcctccagtgcttgacgttgggacttatagtttcatccgggaagaggatcagtgcacgttccagcatcggagttttcgggcgaatgattcccttggcttcatgctgctgcttgctttgatcctgctggccacgcaactagtctatctgaagttgatattctttgttcatgaccggagaaagatgaaacccgtccagtttgtggccgctgtgtcgcaaaattggacctttcacggtccgggggctagcggccaggcggccgccaactggctagccggattcggacgtgggcctaccccccccaccctgctgggaattcgacagaatgccaacactaccggcagaagacggctcctggttctggacgagttcaaaatggagaaaagaatctcacggatgttctacatcatgacctttctgtttttgaccctgtggggcccatatttagtagcctgttactggcgggtgttcgcgcgggggcctgtggtgcctggaggatttctcaccgccgctgtttggatgtcgttcgcccaggctggtataaatccatttgtgtgtattttctcaaatagggaactgaggcgctgtttcagtacaactttgctctattgccgaaaatcacgactccccagggaaccctattgcgtcatttag

SEQ ID NO: 188699 - DNA, 216 bp, Artificial Sequence
  Description of Artificial Sequence: Synthetic coding sequence
atggccaactacagccacgccgccgacaacatcctgcagaacctgagccctttgactgcatttctcaagctgacctccttgggctttatcattggcgtttctgtggtcggaaatctgctaatttctatactcctggttaaagataagaccctgcaccgggccccatactacttcttgttagatctctgttgcagtgacatcctgcgtagtgcctag

SEQ ID NO: 188700 - DNA, 1113 bp, Artificial Sequence
  Description of Artificial Sequence: Synthetic coding sequence
atggccaactacagccacgccgccgacaacatcctgcagaacctgtcccccctgacggctttccttaagttgactagtctcggttttattatcggcgtaagcgtggttggcaacctactgattagcatactcctagtcaaggacaagacgctacatcgagcaccatattacttcctcttggatctgtgctgttctgacatcctgagatccgccatttgttttcctttcgtgttcaacagtgtcaagaatggtagcacttggacatatgggaccctgacgtgtaaggttattgcatttctcggcgtgttaagctgttttcacacagcgttcatgctgttctgcatttccgtgacacgatacctagccatcgcccatcatcggttctacaccaagaggctgacattctggacatgtctggccgtgatttgcatggtttggacactgagcgtggcgatggcttttcctcccgtcctagatgtcgggacctattcctttattagagaagaagaccaatgcacttttcagcataggagttttagggctaacgactccctggggttcatgctgctgttggctttgattctgttggcaactcagctcgtctatctcaaattgattttcttcgtgcatgaccgccgcaagatgaagcccgtccaatttgttgctgctgtcagccagaattggacctttcatggacctggggcgtcaggacaagctgctgcgaattggcttgctggcttcgggcggggcccaactcctcccacccttttggggatccggcagaatgcaaacaccacaggcaggcggcgactgctggtgctggatgagttcaagatggagaaacgaatcagtcgcatgttttacatcatgacttttctattcttgacattatgggggccatacctggtggcttgctactggcgagtctttgcgcgcggacctgtggtccctggaggcttcctcaccgcggcggtgtggatgtctttcgcccaggccggaattaatccctttgtttgcatttttagtaaccgcgaactgagacggtgcttttccactactctcctgtattgccgcaaaagccggttgcctagagagccctattgcgtaatttag

SEQ ID NO: 188701 - DNA, 366 bp, Artificial Sequence
  Description of Artificial Sequence: Synthetic coding sequence
atggccaactacagccacgccgccgacaacatcctgcagaacctgtcccccctaaccgcttttctaaaactgacttccctgggcttcatcattggggtgtcagtggtagggaatctgctcatcagcatcctgctggtaaaggacaagaccctgcaccgtgccccttactattttttgctcgacttatgctgtagcgacatcctgagaagcgccatttgctttccctttgtgtttaacagcgtgaagaatggtagcacctggacctatgggactctcacctgtaaggtgattgcgttccttggggtactcagttgtttccacaccgcctttatgttgttctgtatctcggtgaccagatatctgtag

SEQ ID NO: 188702 - DNA, 1113 bp, Artificial Sequence
  Description of Artificial Sequence: Synthetic coding sequence
atggccaactacagccacgccgccgacaacatcctgcagaacctgagccccctcacagccttcttgaaactcacatcactgggttttattataggcgttagcgtggtcggcaatcttctcattagtatccttctcgtaaaagacaaaactttgcatagggctccttattatttcctcttagatttatgctgttctgacatactgagatctgcaatctgttttccatttgtgttcaacagtgtgaaaaacggaagcacctggacatacggaaccttaacctgcaaggtcatcgctttcctgggcgttcttagctgtttccatactgcttttatgcttttctgtatctccgtgacgagatatttggcgatcgcacaccatcgattctacaccaagagactgacgttttggacctgcctcgccgtcatttgtatggtgtggactttgtctgttgccatggcattcccgccagtgttggacgttggcacctacagttttattcgggaggaggatcaatgcacattccagcacagaagcttccgggccaacgactccctgggctttatgcttctgctcgccctgatcctgctcgctacacagctggtgtacctgaagctcatattctttgtccacgatcggaggaaaatgaaacctgttcagttcgtcgcagccgtttctcagaattggacatttcacggacccggcgcatcagggcaggctgccgctaattggttggctggctttggccgcggtccaacccccccaaccttgctgggcatacggcagaacgctaatactacgggtcgaaggcgcttacttgtgctcgacgagttcaaaatggagaagcggatctccagaatgttttatatcatgaccttcctgttcttaacactctggggaccttacttggtagcatgctactggcgggtgtttgctaggggccccgtggttccgggcggattcctcaccgcagccgtatggatgtcattcgctcaggctggtattaatcctttcgtgtgcattttctccaatcgcgagttaagacggtgtttctccactaccctcctgtattgcaggaagtctaggttgcctagagaaccctactgcgtgatatag

SEQ ID NO: 188703 - DNA, 1077 bp, Artificial Sequence
  Description of Artificial Sequence: Synthetic coding sequence
atgggcttcaacctgaccctggccaagctgcccaacaacgagctgcacggacaggagtcccacaacagtgggaatagatcagatggcccgggcaagaacaccaccctccataatgagttcgacaccatcgtgcttccagtcttgtacctgatcatctttgtggcctctattctcctgaatggattggcagtgtggattttttttcacattcgtaataaaacctcatttatcttctatttaaaaaacatcgtggtggcggatttaattatgacgctgacttttcctttcaggattgtacacgacgctggtttcgggccgtggtatttcaagtttattttgtgccggtacaccagtgtactgttctacgctaatatgtacacctctattgtgttcctgggcctgatttccattgatcggtacctgaaggtcgtaaagccctttggtgactcccggatgtattccattactttcaccaaggttctgagcgtgtgtgtctgggtaattatggccgtgctttccttacccaatattattctgacaaacgggcaacccacagaggacaacattcacgattgctcaaaactgaagtctcccctcggcgtcaagtggcacacagcagtcacctacgtaaactcatgtctattcgtagccgtgctcgtgatactgattgggtgctatattgccatttctagatacattcacaagtcaagcagacagtttatctcccagtcctcccgaaagagaaagcataatcagtcaattcgggtggtggtagctgttttcttcacatgctttctcccctatcacctttgtagaattccattcactttctcacacttggaccgcctcctagacgagagcgcccagaagatactgtattactgtaaagagattactctattcctgtcagcctgcaatgtctgcctggacccaattatatactttttcatgtgcaggagtttctctcgccgtctattcaagaaatctaatatacggacgcggtccgagtctatccgcagccttcagtctgtgagacggtccgaggttcggatctactacgactatacggacgtttag

SEQ ID NO: 188704 - DNA, 1368 bp, Artificial Sequence
  Description of Artificial Sequence: Synthetic coding sequence
atgagcttcctgatcgacagcagcatcatgatcaccagccagatcctcttcttcgggttcgggtggctgtttttcatgcgacagttattcaaagattatgaaatcaggcagtacgtggtacaagtgattttcagcgttacgtttgcattctcctgtacaatgtttgagctgattatttttgaaatcctgggagtgctcaatagcagcagcagatatttccattggaaaatgaacctgtgtgtgatactgctgatcttggtgttcatggttcccttctacatcggctacttcattgtatcaaacatcaggctccttcacaagcaaagactcctcttttcgtgtctgctctggctgacttttatgtacttcttttggaagttaggcgacccgttccccatcctcagccccaagcatggtattctgtccatcgaacagctgatctccagggtcggagttatcggtgttaccctgatggcactgttatccgggtttggcgctgtcaactgtccttacacatatatgtcgtacttcctgaggaacgtcaccgatacggacattctagctctggagcgcagattgctgcagacgatggacatgataatcagcaagaagaagcgcatggctatggcacggcgtactatgttccaaaagggggaggtccataacaagcctagtggcttttggggaatgatcaaatctgtaacaaccagcgccagcggctcagaaaatctgaccctgattcagcaggaggtggacgctctagaggaattaagccgtcagctgttcttggaaactgccgacctgtacgctaccaaagagcggatcgagtacagtaagacattcaaaggaaagtatttcaacttcctcggttacttctttagtatctactgtgtgtggaaaatcttcatggcgacaattaacattgtctttgatcgcgtgggaaaaaccgatccagtaacaagaggcatagagataactgtgaactatctggggattcagttcgatgtgaagttctggtcgcagcatatcagctttattctcgtagggattataatagttacttccatcagagggctgcttattaccttgacaaagttcttttatgccatttcctcctctaaatctagcaatgtgatcgttctgctcttggcgcagatcatgggaatgtattttgtctcgtctgtcttactgattcgaatgtctatgcctctcgagtatcgcaccattatcacagaggtactcggcgaattgcaatttaacttctaccaccgatggttcgatgtgatattcctggtgagcgctttgtcttccattctcttcttgtatctggcccataagcaggccccagagaagcagatggccccctag

SEQ ID NO: 188705 - DNA, 1008 bp, Artificial Sequence
  Description of Artificial Sequence: Synthetic coding sequence
atgtacttcttctggaagctgggcgaccccttccccatcctgagccccaaacatgggatcctctcgatcgaacagcttatctctagagtcggcgttatcggcgtgacgctcatggcgctcctgtccggtttcggtgccgttaactgcccttacacatacatgagctattttctgcgtaatgtgacagatactgacatcttagcccttgaaagacgcttacttcagacaatggacatgatcattagtaagaaaaagcgtatggcgatggcccgtcggacaatgttccagaagggagaggtgcacaataaaccttcagggttctggggcatgatcaaatccgtcactacctcggcctctggctccgagaatctgacactgattcagcaagaagtagacgccctggaggagctaagtagacaattgtttctcgagaccgccgatttatatgcgacgaaggagcgcatagaatactctaagactttcaaaggaaagtacttcaacttccttggatactttttttctatctattgcgtctggaaaatttttatggcaacaataaacatagtatttgatcgcgtgggaaagacagaccctgtgactagaggcattgagattaccgtgaattacttgggtatccagttcgacgttaagttctggtctcaacatatcagcttcatactcgtgggaattataatcgttacatcaatcagaggactgttgataactctgacgaagtttttttacgccatctcctcaagtaagtcctccaacgtgatcgttttgttgctagctcagataatgggaatgtactttgtgagctccgtgctcttgatcagaatgtcaatgcctctggaatatcgaacaattataacagaagtactgggtgagctgcagtttaatttctatcacagatggtttgacgtcatcttcctagtctcagcactgtcctccatcctgtttctctatcttgcgcacaagcaggctcctgagaagcagatggccccctag

SEQ ID NO: 188706 - DNA, 1368 bp, Artificial Sequence
  Description of Artificial Sequence: Synthetic coding sequence
atgagcttcctgatcgacagcagcatcatgatcaccagccagatcctgttcttcggatttggatggctgttcttcatgcggcagctgtttaaggactatgagatcagacagtatgtagttcaggtcatctttagcgtaacctttgcattttcttgtacgatgttcgagctgatcattttcgaaatcctaggagtgctcaactcctccagtaggtattttcattggaagatgaatctatgcgtgattctgctgattctggtctttatggtgcccttttacataggttacttcattgtaagcaacatccggctcctccacaaacagagattactcttcagctgcttgctctggctcacattcatgtactttttctggaagctcggagaccctttcccaatactttcaccaaaacacggaattttaagtattgagcagctgatttcacgcgtgggtgtgattggagtgacccttatggcgctgctcagtggatttggggcagtgaattgcccctatacatacatgtcatatttcctgcgcaatgtgactgacacagatatcttggcactggagcgtagactacttcagaccatggatatgatcatttccaaaaaaaaacgcatggcgatggcccgtaggaccatgtttcagaaaggggaggttcacaataaaccgagtgggttctggggcatgataaagtctgtgacaacatcagcctctggttcggaaaatttgacactgatccagcaggaagttgacgctttagaggagctgtcacggcaactgttcttagaaacagctgacctgtatgctaccaaagaacggatagagtattccaaaacttttaaggggaagtattttaactttctgggctacttcttctccatctattgtgtgtggaaaatatttatggctaccataaacatcgtgttcgaccgggttggaaagacagatccagtcactcgaggaatcgaaataactgtcaattatcttgggattcaattcgatgtcaagttttggtcacagcatatcagcttcattcttgtgggaataatcatagtaacctcaattcgggggctgttgatcacactcaccaaattcttctacgctatcagctcctctaagagttcaaatgtgattgtgcttttactggctcagatcatgggaatgtatttcgtatcctccgtgctgctgattcgcatgtcaatgccactcgagtaccgaacgattatcactgaagtactcggtgaacttcagtttaatttctaccataggtggtttgatgtaattttcttggtatcagctctgtcgagcatactgttcctgtacctcgcgcataaacaggcccctgagaaacagatggcgccttag

SEQ ID NO: 188707 - DNA, 18921 bp, Artificial Sequence
  Description of Artificial Sequence: Synthetic coding sequence
atggacatcttcctggtgctgggcatgcccagcgccagcctgctggtaaacctactgtctgccctgctgatcctgtttgtcttcggcgagactgagatacgcttcacgggacagactgagttcgtggtgaacgagacctcaacgaccgtaatcaggttgattattgagaggatcggtgagccagctaacgtaactgcgatcgtctcactgtacggtgaggatgcaggagatttttttgacacttacgcggcagcttttattcccgctggggagactaaccggacagtgtatatagccgtctgtgacgacgacctgcccgagcctgacgagaccttcatcttccatctcactctgcaaaaacccagtgctaacgtgaaactgggctggccccgaactgtcacagtcacaatactgtctaatgacaacgcattcggcatcatttcctttaacatgctgccctccatcgcagtgtccgaacctaaaggccgaaatgaatctatgcccctgactctgatcagagagaaagggacctacggcatggtgatggtgacgtttgaggtggagggggggcccaaccctcctgatgaagatttgagccccgtcaaggggaacatcaccttcccccccgggcgcgcaactgtgatctataacctcacagtcttggacgatgaggtccccgaaaatgacgagatcttcctcatccagcttaaaagtgttgaaggaggggcagagattaacaccagtagaaacagtatagaaataatcattaagaagaatgactcgccagtgcgattcctgcaaagtatctatttggtgcccgaggaagaccatatcctgataattccagtcgtacgcggcaaggacaataatggcaatttgatcggctctgatgaatatgaggtatctatctcatatgctgtgaccactggaaattcaaccgctcatgcccaacagaatctcgacttcatcgatcttcaaccgaataccactgtcgtctttccccccttcattcacgagtcacatttgaaattccagatcgtggacgatacaatacctgagatcgccgaatccttccacataatgctcttgaaggacacgctacagggggacgctgtcttgatcagccccagcgtcgtgcaagttacaattaagcccaacgacaagccctacggagtgttgtccttcaactcggttctctttgagcgcacggttatcatcgacgaggaccgaattagtagatatgaagagattactgtggtcagaaatggtggcacccatggaaatgtaagtgctaattgggtgttaaccaggaattcgaccgatccttctccggttactgccgatatacgaccaagttccggcgtattacacttcgcccaaggtcagatgctcgctactatcccactgaccgtggttgacgacgatctccccgaagaggccgaagcttacttgctgcaaatactgccgcacactatcagaggtggcgctgaggtgagcgagccagcagagctactattctatatccaggactcagatgacgtgtacggattaatcaccttcttccctatggagaaccagaagatcgagagctctccaggagagagatacctgtccctctccttcacacgtctgggaggtactaaaggcgacgttagattgctttatagtgtgctgtacatacctgcaggcgccgttgatcccctgcaggccaaggaaggcatcctgaacatttccaggagaaatgacctgatcttccccgagcagaagacacaggttacaaccaagctcccgatccgcaacgacgcttttctacagaacggagcccacttcctggtgcaactggagacagtggagctgttgaacattatcccgttgataccaccgattagtcctagatttggcgagatctgtaatataagcttacttgtgaccccagccatcgctaacggggagatcggctttctttctaacttgccgattatactgcatgagcctgaggatttcgcagcggaggtggtgtacattccactgcatagagacggaacagacgggcaagctaccgtgtactggagcctaaaaccttccggctttaacagcaaagccgttacccccgacgacattggacctttcaatggatccgttcttttcttatctgggcagagcgatacgactatcaatataaccatcaaaggcgacgatattcccgagatgaatgaaactgtcacgctgtccttggacagggttaacgttgaaaatcaggttcttaaatccggatacaccagtcgcgacctgatcatcttggaaaacgatgaccccggcggagtgttcgaattctcacccgcatctagggggccttatgttatcaaggaaggcgagtcagtggagctgcatataattcgttcccggggctcactcgtcaaacagttcctgcattaccgcgttgagccacgggactccaacgagttctacggtaacacgggcgtcttggagtttaaaccgggcgagcgcgaaattgtgataaccctcctggcacgtctggacggaataccagaactggacgagcactattgggttgtcctgtccagtcacggagagcgcgagtcaaagctgggtagtgcgacgatcgtgaatattacaattctcaagaatgacgacccacacggcatcatagaatttgtaagtgatgggcttatcgtgatgatcaatgagagtaaaggggatgctatctatagtgcggtgtacgatgttgttagaaataggggaaacttcggcgatgtgtctgtgtcatgggttgtgtctcctgacttcacacaggatgtattccccgtgcagggaaccgtcgtgtttggcgatcaagaattcagcaaaaacatcaccatatattctctgccggatgagattcctgaggagatggaggaatttacggtgattctcctgaacggaacaggaggggccaaggtgggaaaccggacaactgcaacactgcgcatccggcgcaacgacgatcccatctatttcgccgaaccccgggttgttagagtgcaggaaggagagactgccaattttaccgtgctccgcaacggctcagtggacgtcacctgtatggtgcagtatgccacgaaggacgggaaggccacagctcgagagcgggatttcatcccggtagaaaaaggagaaacactcatatttgaggtggggtcgcgacagcagtccatcagtatatttgttaatgaggatgggattcccgagacagacgaacccttttacatcatcctactcaatagcaccggcgacactgtggtgtatcaatacggcgtcgccaccgtgattatagaggcgaatgacgaccccaacgggatcttcagcctcgaaccaatagataaggctgtcgaggagggcaagacaaatgcattctggatcctaaggcatcgcggttatttcggcagtgtgtccgttagttggcagctgttccaaaatgacagcgcccttcagccaggtcaggagttctacgaaacttctggaactgttaacttcatggacggcgaagaggctaaacctattatcctccacgcattcccagacaaaatacctgaatttaacgaattctacttcttgaagctggtgaatattagcggcgggagccccggccctggcggccaactcgcagagacaaacctccaggtgaccgtaatggtccccttcaatgacgatccattcggggtctttatcctcgaccctgagtgtttggagagggaggtggctgaagatgttctcagcgaggatgatatgagctatattactaactttactatcctccgccagcagggtgtgttcggtgacgtacaattggggtgggagattttgagctcagaattcccagctggcctgcctcctatgattgactttctcttggttggaattttcccaacgacagtacacctgcaacaacatatgcgccggcaccattctggtacagacgccctgtactttaccggcttggagggcgcatttggcaccgtcaaccctaagtaccaccctagtcggaacaatactattgccaactttacttttagcgcttgggtaatgccgaatgcaaataccaatggtttcattatcgccaaggatgacggcaatgggtcaatttattatggagtaaagattcagaccaacgagtctcacgttaccctttcactccattacaaaaccctcgggagcaacgctacctacatcgctaagaccactgtcatgaagtatttagaggagagcgtgtggctgcacctgttgattatcctcgaggatggcatcattgagttctacctggatggaaacgctatgcctagaggtatcaaaagcctaaaaggcgaggcaataaccgatgggccgggcattctgcggataggcgccggcattaacgggaacgaccgttttacaggactgatgcaggacgtgcgcagctatgagaggaaactgaccctggaagagatttacgagctgcatgccatgcctgccaagtctgatttacacccaatctcaggatacttggaatttcgccagggcgaaactaataagagcttcatcatttctgcacgagacgataatgatgaggaaggggaggagctgtttatactcaaactggtgtccgtctatggtggcgcgagaatctccgaggagaacactacagccaggctgacaatccaaaagagtgataacgccaatgggctattcgggtttacaggcgcatgcatccctgagatcgctgaagagggctctaccatttcatgcgttgttgagcgcactcggggcgcactggattatgttcacgttttctacaccatttcacagatcgaaaccgatggtattaactatctcgtggacgatttcgccaatgcctcaggtactatcacattcctgccctggcaacgctcagaagttctgaacatatacgtgctcgacgatgacatacctgaactgaacgaatactttcgggtcaccctagtatcagccatacctggagacggcaaattgggatccacccccacaagtggcgcaagtattgaccccgagaaggagaccacggatataaccatcaaagcgtcggatcacccctatggcctcctgcaattttccactgggctccctcctcagcctaaggatgccatgacactgcccgcgagttcagtgccacacatcacagttgaagaagaagatggcgaaatcagactcctcgtgattcgtgcccagggtttgcttggtagggtcaccgccgaatttcggaccgtgagcttaactgccttcagccctgaggactaccagaatgtggccggaactctggaatttcagcccggtgagagatacaagtacatctttatcaacataactgataatagtattccagaactggagaagtcctttaaagtggagctgcttaacttggagggcggggtggcggagctgttccgcgtggacggttctggtagcggtgatggtgacatggaattctttctcccaactattcacaagcgcgcatcactgggtgttgcatcccagatcctggtgactatagccgccagcgaccacgcccatggcgtctttgagttcagtcccgagtccctgtttgtgagtggcaccgagcctgaagacggttattctacggtcacccttaatgtcattagacaccacggcactcttagcccagtaactctacactggaatattgactctgatccagatggagatcttgctttcacttccggaaatatcaccttcgagataggccagactagtgccaatatcacagtggaaatactgcccgacgaagatcccgagcttgataaggccttctcggtctcagttctgtcagtttccagcggctcattaggggcacacattaatgcaactcttactgtgctggcctcggatgacccgtacggcatcttcattttttccgagaagaatcgcccagtgaaagttgaggaagccacccagaacatcactctttccataatcaggctgaaggggctgatgggcaaggtcttagtctcctacgccactctggatgatatggagaaacctccgtattttcctccgaacttggctcgcgccacacagggccgggattacatccctgcctccgggttcgctttgtttggagcaaatcaatccgaagcaaccatagctatatctatcctcgacgacgacgagcctgagcggtctgagtctgttttcatcgaactgctcaactccactctcgtcgcgaaggtacagtcacgaagtatcccaaatagccctcgcttagggcccaaagtcgagactatcgcccagctgataattatcgctaacgacgacgcgtttggaaccttacaactgagcgccccgatcgttcgcgtggccgagaaccacgtcggtcccatcattaacgtcacgcgaaccgggggcgccttcgctgatgtgagcgtgaagtttaaagcagtgccaataaccgccattgcgggtgaggattattcgattgcatccagcgatgttgtgttgctagagggagaaacgagtaaggctgtaccaatttacgtgataaacgacatctacccagagctggaagaatcctttcttgtgcaactgatgaatgagaccacaggtggagctagactcggcgcactgactgaagctgtcataatcattgaagcgagcgatgatccatatggcttgttcgggttccagatcacaaagctgatagtggaggaacccgagttcaattccgtaaaggtgaatctcccgattattagaaactctggcaccctaggaaacgtgactgtccagtgggttgccactataaacggtcagttggcaaccggggatcttcgtgttgtctctgggaatgtgacatttgcgccgggtgagacaatacagactctgctgctcgaggtcctggccgacgacgttccagaaatcgaagaagtgatccaggtacagctgactgacgcctccggaggagggaccataggcctcgacagaatagccaacatcatcatcccagccaacgacgacccctatgggacagttgcatttgcgcagatggtgtaccgggtgcaggagcctctcgagaggtctagctgcgctaacattactgtcaggcgctcagggggccattttgggcgcttgctgctgttctatagcaccagcgacatagatgtggtggcacttgctatggaggaggggcaagatttgctgtcctattacgagtcccccattcagggcgtgcctgatcctttatggcgcacctggatgaacgtgtccgccgtgggcgaaccgctttacacatgcgctacactgtgcttgaaggagcaggcctgctctgccttctcttttttctctgcttctgaagggccacagtgcttctggatgacatcatggatcagcccggcggtgaacaactcagacttttggacatacagaaagaacatgacgagggtggccagcctgtttagcgggcaagctgtggccggctctgactacgagccagtgacccgccagtgggctattatgcaggagggagatgaattcgcaaatctgactgtgtcaattttacctgatgactttccagagatggatgagagcttcctcatttctctcctagaggtgcacctgatgaatataagcgcctcactcaagaatcagccgaccattggccagcccaacataagcactgtggtgatcgctttaaacggggacgcattcggagtttttgtgatatacaacatttccccgaacacttccgaggacggcttattcgttgaagttcaggagcagccccagacgcttgtcgagctgatgattcatcgtacaggtggctccctcggccaggtcgccgtcgaatggagggtggttgggggcacagccaccgaggggctcgactttatcggggccggggagattcttaccttcgctgaaggggagaccaaaaagaccgtgattctgactattcttgacgactccgagcccgaggacgacgagtccattattgtctcgctggtctataccgaaggaggttctagaatcctcccctcttccgacaccgtccgggtcaacattcttgctaatgacaacgtcgcaggaatcgtttccttccaaactgctagtcgatctgtgattggtcacgaaggcgaaatcctgcaattccacgttattcgcacctttccaggtagaggtaatgtgaccgtcaactggaaaatcataggccagaacttggaactcaatttcgcaaatttctccgggcagctatttttcccagagggcagccttaacaccactctcttcgtgcacctcttggacgacaacattcccgaggagaaggaggtgtatcaagttatattatacgacgtgagaacacaaggcgtacctcctgcaggcattgccctgcttgacgcccagggctatgctgctgtgctgacagtggaagcttccgatgaaccccacggcgttctgaatttcgcgttgtccagccggttcgtgcttctgcaagaagcaaatattacaatacaattgtttatcaatcgggaatttggctcccttggtgccatcaatgtgacctacacaacggtgcccgggatgctctcgctgaagaaccagacagtgggcaacctcgcagaacccgaagtggatttcgtgcctatcatcggctttttaatcttggaagaaggggagacggccgccgccatcaatataaccattctggaagatgacgtaccggaattggaagaatatttcctcgtaaatctaacatatgtcggattgacaatggccgctagcacctcttttcccccgcggctcgactctgaggggctgacagctcaggtcataatagatgctaatgacggcgcaagaggggtcattgagtggcagcagagcaggtttgaagtgaacgaaacccacggttccttgactctggtcgcccagcgttccagggaacccttgggacatgtgtccctctttgtctacgcgcaaaacttggaggcacaagttggcctcgattacattttcaccccgatgatcctccatttcgctgatggcgaaaggtacaagaacgtgaatataatgatcttggacgatgacatccccgagggagatgagaagtttcagttgattctaaccaacccaagccccggtctggagttaggtaagaacactatcgccctcattatagtgttggctaacgatgatggaccgggcgtcctatcattcaataacagcgagcacttcttcctgagagaacccaccgcattgtacgtgcaagagtctgtcgccgttttatatatcgtacgtgagcccgcccagggtctcttcggtactgtcacggtacagtttatcgttactgaggtaaattctagtaatgagtccaaggatctgaccccctccaagggctatattgtactggaagagggagtgcgatttaaagctctgcagatctcagccatcctggacaccgagccagagatggatgagtacttcgtgtgtaccctgtttaatccaaccggtggggcaagactgggcgttcacgtccaaaccctgatcacagtccttcaaaatcaggctcctcttggactgttctcaatatcggccgtggagaatcgagctacaagcatcgacatcgaggaggcaaaccgaacagtgtatttgaacgtgagccggacaaacggcattgaccttgctgtctccgtgcagtgggagactgtcagtgagacagcattcggcatgagaggaatggatgttgtcttttcagtgtttcagtcctttttggatgagtccgcaagcggctggtgcttctttaccctggaaaacttaatctatggtatcatgctgaggaagtcctccgtgacagtgtacagatggcaaggcatatttattccagtggaagatctgaacatagagaaccctaagacatgtgaggcctttaatatcggctttagcccatactttgtgatcacccacgaggagcggaatgaggagaaacctagcctcaacagtgtgtttacattcacatctggatttaagctttttttagttcagacgataatcattttagagtcctctcaagtgcggtatttcacctctgatagtcaggattaccttattatcgccagccagcgggacgacagtgagttgacccaggtgtttcgctggaatgggggatcatttgtgctccaccagaagctgcctgtgaggggcgtgctgaccgtggctttgttcaataaaggaggcagtgtctttctagcaatctctcaggctaatgcaaggttaaacagcttactcttccgctggagtggaagcgggttcattaactttcaggaagtgcccgtgagtggcaccactgaggtggaagccctcagctcagctaacgacatttatctgatttttgcggaaaacgtattcctgggagatcagaacagcatcgacatcttcatctgggaaatgggtcagagctccttcagatatttccagtcagtggatttcgccgccgtgaatcggattcacagttttactccggcatccggaattgcacatattctcttgatcggacaggatatgtccgcactgtactgctggaacagtgagcgaaatcagttcagttttgtactggaagttcccagtgcttatgacgtggcctctgtgaccgtgaaaagcttgaactctagtaaaaacctgatcgcactggtaggggcacatagtcacatctacgaattagcttacatcagttcacacagtgactttatcccaagctccggtgaactcatatttgagcctggggaacgggaggccacaatcgcagtgaacatactggatgacaccgtgcctgaaaaggaagaatctttcaaagtgcagctgaagaacccaaaggggggcgccgagatcgggattaacgacagcgtcacgattactattctttcaaacgatgacgcgtacgggatcgtggccttcgcccaaaactccctctacaaacaggtggaggagatggaacaggacagcctagtcactctcaacgtggaacgtttgaagggaacctatggccgcatcaccatcgcttgggaagctgatggatccatcagtgacatctttcctacaagcggtgtaatcttatttacagagggacaggtcctcagcactataaccttaactattctggctgacaatattccggaactatccgaggtagtaatcgtgactctaacacgcataaccaccgaaggtgtcgaagattcctataagggagccaccattgatcaggatcgcagcaagtccgtgattaccactctgcccaatgatagtccattcggcctagttggatggagagccgctagcgtattcatccgggtcgccgagcctaaagaaaacaccaccacactacagctacaaattgcgcgcgataagggactgctaggggacattgccatccaccttcgggcccagcccaactttctcttgcacgtcgacaaccaggctactgagaatgaggattatgttcttcaggagacaatcataatcatgaaagagaatataaaagaggcacacgcagaggtgagtattttaccagatgacctcccagagcttgaagagggcttcatcgtgactatcaccgaagtcaatttagtgaactccgattttagtacagggcagccttcagtccggcgtccaggtatggagattgcggaaattatgattgaggaaaatgatgatccacggggaatcttcatgttccacgtgacaaggggggcgggggaagtaattaccgcttatgaagttcctcccccactcaacgtccttcaggtcccagtggtgaggctcgctgggagctttggtgctgtcaacgtgtattggaaggcaagtcccgactcagccggactcgaagactttaaaccctcgcacggtattcttgagtttgcagataaacaggtgaccgcgatgatcgaaattacaatcatcgacgacgccgagtttgagctgacagagacatttaacatcagcctcatttctgttgcaggaggaggacgcctcggggatgatgtcgtggttacggtcgtcatacctcagaacgattctccctttggtgtgtttggctttgaggagaagacggtgatgatcgacgagtcgctgtccagcgacgaccctgattcttacgtcaccctgacggtggttaggtctcctggtggaaaaggcacagtgcgacttgaatggacaatagacgagaaggctaaacataacctttctccactaaacggaacgttgcacttcgacgaaactgaatctcaaaaaactatagtactgcacaccctgcaggatacagtattggaagaggaccgccggttcactatccagttaatctctatcgatgaagtggagatatcacccgtcaaaggctctgctagtataattattcggggtgataagagagccagcggagaggttggcatcgcgccatcttcaagacatatcctgattggggaaccttccgctaagtacaacggcactgcaatcatttctttagtgcgaggccctggtattctcggggaggtgaccgtgttctggagaatatttccaccgagcgtaggggagtttgcagagacaagtggtaaactgaccatgagggacgaacagagcgcagtgatcgtagtcatccaagctctcaacgatgacatccccgaagagaaatcattctatgaattccagctgacagcagtctcagagggaggggtgctgtcagagtcttcatccactgctaatatcaccgtggtcgccagcgactcaccctatggtcggtttgccttctctcatgagcagctgcgagtgagcgaggcccaaagggtgaacatcacaatcatccggagttccggcgactttgggcacgtccggctctggtacaagactatgtcagggactgcagaggctggattggattttgtcccggcagctggggagttgctcttcgaagccggggaaatgcgcaagtccctgcacgtggagattcttgatgacgattaccccgagggacccgaagagttctctttgacgataactaaagtcgagctacaaggccgagggtacgactttactatccaagagaacggactccagatcgaccagcccccggaaattggaaatatttctatcgtgcgaataattataatgaaaaacgacaatgctgaagggattatcgagttcgatccaaaatacacagcattcgaggtggaggaggatgtaggcctgatcatgatccctgtagtgaggcttcacggaacatatggttacgtgaccgccgactttatcagccagtcaagttctgctagtcccggcggggtggattacatactgcatgggtcaacggtcacgttccagcatggacaaaatttatcattcatcaacatctctatcatcgatgacaacgagtccgagttcgaagaacctattgagattttactcacgggggctactggaggtgcagtcctggggagacacctagtgtctagaattatcatagcaaaaagcgactcaccctttggcgtcattcgatttcttaatcagtccaagatctcaattgcgaatccaaattcaacgatgatcctgagccttgttctggaacgaacagggggactcctgggcgagatccaggtgaattgggaaacagtgggccccaacagccaggaagctctgctgcctcagaatagggatatagcagacccagtttctgggctgttctactttggggaaggggagggtggcgttcgcaccataatcctaacaatctacccccacgaggaaatagaagtagaggaaacgtttatcattaaacttcatcttgtgaaaggtgaggccaagttggacagccgggccaaggacgtgactttgactatccaggagtttggggaccctaatggggtggtgcaatttgctcctgagaccttgagtaaaaaaacgtacagcgagcctctggctctggagggacccctgttaatcacattcttcgtgaggagggtcaagggtacgttcggtgaaatcatggtctactgggaattaagctctgagtttgacattacagaagactttttgtccacctcaggattttttaccattgccgacggtgagtccgaagcctcctttgacgttcatctgcttccagacgaagtgccagagattgaggaggactacgtgatacagttggtgtccgtggaaggcggcgctgagcttgacctggagaagtcaatcacctggttctcagtttatgccaacgatgacccacacggcgtcttcgctttgtactctgatcgccagtccattctgataggtcagaatctcatcagaagcattcagataaacataacacgcctcgccgggacatttggggatgtagcggtgggtctgcgcattagcagtgaccacaaggagcagcccattgtgacagagaatgccgagaggcagctggtggtgaaggacggggcaacatacaaggtggacgtcgtgcctataaagaaccaggtgtttctgtctttggggtctaattttacgctgcaactggtcacggtcatgctcgtagggggccggttctacgggatgccaacgatcctgcaggaggccaagtcagctgtgctgccggtgtctgaaaaggctgcaaactctcaagtgggtttcgagtctaccgcctttcagctgatgaacatcaccgctggtacttcacacgtgatgattagcagaagaggcacctatggggccctcagcgtcgcctggacaaccggctacgctccgggcctcgaaatccctgaatttatagtagtcggtaacatgacacccacgcttggaagcctttcttttagccacggcgagcaacgaaagggcgtattcctgtggacctttccaagccccggctggcccgaagcctttgttctgcacttgtcaggagtccagtcgagtgctcccggcggagcccaactgaggagcgggttcatcgttgctgaaatcgaacccatgggagtttttcagttttccacatcctcccgtaacattatcgtgtcggaggacacccaaatgatacgactgcacgttcagcgcctcttcggattccattctgatttaatcaaggtcagttaccaaacaacagccggaagcgcaaaaccactggaggacttcgagccagtacaaaacggcgaacttttcttccaaaaatttcagaccgaagtagacttcgagataacaatcattaatgatcagctctcagaaatcgaggaatttttttacattaatctaacttctgtcgaaatccggggtttgcagaagtttgacgtcaactggtcaccccggctgaacctggatttctctgtggctgtaattaccatcttggacaacgatgacctcgcaggaatggatataagcttcccagaaaccacagttgctgtggcggtcgataccacattaatccctgtagagactgaatccacaacttacctgtccactagtaaaacaactacgatacttcagcctacaaatgtagtcgcaattgtaacggaagctacaggggtcagtgccatcccagagaagcttgtgacgcttcacggtacccccgctgtatcagagaagcccgatgtcgccactgtcactgctaatgtttccattcacggcacattttcgctggggccatcgatcgtctacattgaagaggagatgaaaaatgggactttcaatactgccgaagtcctaatacgccgcaccggagggtttaccgggaacgtgtctattaccgtcaaaactttcggcgaacgctgcgcccaaatggagccaaacgccctcccatttcggggtatctacggcatttctaatctgacatgggccgttgaggaggaggactttgaagagcagacccttaccctgatatttctggatggagagcgagagcgcaaagtatcagtgcagatcttggatgatgacgagcctgaaggtcaggaattcttttacgtgttcttgacaaacccccagggaggcgcccagattgtggaagagaaggatgatactggctttgcagctttcgctatggttatcataacaggatctgatctccacaacggtattattggcttcagcgaggagtcgcagtctggtttagagcttcgcgaaggggccgtgatgcgcagactccacctcatagtaacacgccagccgaatagagcctttgaggacgtgaaggttttctggagggttactctcaacaagaccgtggtagttttacagaaggatggcgtcaaccttgtggaggagctgcagagcgtctctggcaccacaacttgtaccatgggccaaactaaatgttttatatccattgagttgaaacccgagaaggtgccgcaggtcgaagtgtacttcttcgtagagctctacgaggctactgctggcgctgcgattaataattcagcgcgctttgcgcagatcaaaatcttggagtccgatgaaagccagagcctagtatacttctcagtcggttcacgcctggccgtcgcccataaaaaggccacacttatctctcttcaagttgcgcgggactctggcacaggcctcatgatgtctgtgaacttttcaacacaggaactgcgatccgcagagacaatcggaaggactattatatctccagctatatcaggaaaagacttcgtgataacagagggcacactggtgtttgaacctggtcagagatccaccgtgttagatgttattctcactccagagacgggttcactcaattcattcccaaagaggtttcagattgtgctgtttgaccccaagggcggcgcacggatagacaaagtgtatggcaccgccaacataaccctagtgagcgacgccgattctcaggctatctggggcctcgcagatcaactgcaccagccagtaaatgacgatattctcaatagggtgctccatactatctccatgaaggtggccacagagaataccgatgaacagctgtctgccatgatgcatttaatagaaaagataactacagaggggaagatccaggcctttagcgtggccagtcggactttgttttacgaaattctgtgctccctgatcaatcctaagcgcaaagatacccgcggtttttctcacttcgccgaggtaacagaaaactttgcattcagtctgttaaccaatgtcacctgtggcagcccaggcgagaaatctaagacaatcctcgatagctgcccatacctcagtatattagccctgcactggtatccacagcaaataaacgggcacaagttcgaaggcaaggagggcgactatatcaggatcccggagagactcctggatgtgcaggacgccgagatcatggccgggaagagcacatgcaaactcgtgcagttcacagagtactccagtcagcagtggttcatctccggtaacaatctacccaccttgaagaataaggtcctgtctctttctgtaaaggggcagagctcccagctgctcactaatgacaatgaagtgctgtacagaatctacgcagccgaaccccgcattataccacagaccagcttgtgcctcctgtggaaccaagccgccgcatcttggctctccgattcacagttttgcaaggttgtggaagagactgcagattatgtggaatgtgcgtgttcacatatgtctgtgtatgcagtgtatgcgcgtaccgacaatctgtcatcttacaacgaagccttctttacctctgggttcatctgcatatccggcctctgtctggccgtcctctcacacatcttctgtgcacgatactctatgtttgccgccaaacttttgacccacatgatggcagcatcgctcggcacgcaaattcttttcctggcctctgcgtatgcttcgccacagctcgccgaggagtcgtgcagcgctatggcagctgtgacccactacctgtatctttgtcaattctcctggatgctgattcagagcgttaatttttggtacgtgctggtcatgaatgatgagcacacggaaaggagatacctccttttttttctcctttcgtggggtcttccagccttcgtcgttatcctgctgatcgttattctgaaaggtatctatcatcagagcatgagccagatctatggcctgatccacggcgatctatgcttcatccccaatgtgtatgctgcgcttttcactgccgctctggtgccgttaacttgcctggtggtcgtcttcgtggttttcattcatgcctatcaagttaaaccccagtggaaggcctacgatgacgtttttcgcggcaggacaaatgccgctgaaataccgcttatcttgtatctttttgcccttatttctgtcacttggctatgggggggcctgcacatggcgtatcgtcacttttggatgctggtgctctttgtgatctttaattccctgcagggactttacgtcttcatggtgtatttcatcctgcataaccagatgtgctgccctatgaaggccagctacactgtggagatgaacggacatccgggtccctccaccgcattcttcacccctggcagtggcatgcccccggccgggggcgagatctcgaaaagtacgcaaaaccttatcggcgccatggaagaggtgccacctgactgggaacgggccagcttccaacagggctctcaggcttctccagatttaaagccgtctccccaaaatggagctacttttccctcaagcggcggctacggacagggatccctaatcgccgacgaagaatctcaagagtttgacgatcttattttcgccctgaaaactggcgctggtctgagcgtctccgacaatgaatccggacagggttcacaggagggagggaccctgactgacagccagattgtcgagcttaggaggatccccatcgctgatacacatctgtag

SEQ ID NO: 188708 - DNA, 6921 bp, Artificial Sequence
  Description of Artificial Sequence: Synthetic coding sequence
gtggacgtgttcatgttcctgggcatgcccagcgccagcctgctggtaaatttattgtcggcactcctcattctcttcgtgtttggggaaactgagatcagatttaccggccaaaccgagttcgtggtgaacgagacctcaactaccgtcatccgattgatcatagagcggatcggtgagccagccaacgtcactgctatcgtctcactgtatggggaggacgcaggcgatttcttcgatacctacgcagcagccttcatcccggccggtgaaacaaatagaactgtgtacattgcagtatgcgacgacgacctcccagaaccagacgaaactttcatcttccaccttacattacagaagccatccgcaaatgtgaagctcggttggccgcgaactgtgacagtcacgatcttgagcaacgataacgcctttggtataatcagtttcaacatgctgccctcgatcgctgtttccgagcctaagggccgaaacgagagcatgccgctgaccctgatcagggaaaagggcacgtatgggatggtgatggtcaccttcgaggtggagggtggacccaacccccccgacgaggacctctctcccgtcaaggggaacatcaccttcccgcccggccgcgccaccgtgatatacaacctgaccgttttagatgatgaagtgccggagaatgacgaaatctttttaatccagttaaaaagtgtggaaggcggtgcggagattaacacaagccggaacagcatcgaaataatcataaaaaagaatgattcaccagtaagatttctgcagtctatatacctcgtccctgaagaagatcatatcctcatcatacctgtcgtccgcggcaaggacaataatggcaacctcataggcagcgatgagtacgaagtttccatctcttacgccgtgactacggggaattctacagcacacgcgcagcaaaatttggacttcatcgacctgcagcctaacaccacggtcgtctttcccccttttatacacgagagccacctaaagtttcagatagttgatgacacaatcccagagattgcggagtcttttcacattatgctgctgaaggacacactccagggggacgcggttctcatttccccaagcgtggtgcaagtgaccataaagcctaacgacaaaccatacggggtcctatccttcaattctgtactatttgagcggacggtgattatagacgaagatagaatctcccgctatgaagagataacagtggtacgcaacggtggtacacacggcaacgtgagtgcaaactgggtgttaaccagaaacagtaccgacccttctcccgtgactgccgacattcgcccgtccagcggagtgctccatttcgctcagggtcaaatgttggcaaccattcccttaaccgtcgtggatgacgacctgcctgaagaagcggaggcttatcttctccaaatcctcccccacactattcgggggggggctgaggtgagcgaaccagcagagttgctgttttatatacaggactccgacgacgtctatggcctgattactttcttccctatggagaatcagaaaatagaatcatctccgggcgaaaggtatctttcactgagctttactaggttgggaggtaccaaaggcgacgtgcgtttactgtatagcgttctttacatacccgctggtgccgtggatcctctccaagctaaagagggcattcttaacatctccagaagaaatgacctgatctttcccgagcagaagacccaggtaaccacaaagctgccaatacgtaacgatgcttttctccagaacggagctcacttcctcgtgcagttggaaactgtggaattgctcaacatcattcctcttatcccaccaatcagcccgagattcggcgaaatttgcaatatcagtctgctcgtgacaccagccatcgctaatggggaaattgggtttctgtcaaatttaccaatcattctccatgaacccgaggatttcgccgccgaagtggtgtacattcctctgcatcgggacggcacggatgggcaggcaacagtctactggtctctcaaaccttcaggcttcaactcaaaagctgtgacacctgatgacatagggccttttaacgggagcgttcttttcttgtccgggcagtctgacacgacaattaatataaccatcaaaggagacgatatccccgaaatgaatgagactgtgactctttcacttgatagagtgaacgtagaaaaccaggtcctcaagagcggctacaccagccgggatctcattattctcgaaaatgacgacccaggcggggtctttgagttctcacccgctagtagggggccatatgtcatcaaagaaggagagtcagtggaactgcatatcataaggagtagaggaagcctcgtgaagcaattcttgcattatagggtagaaccaagggacagcaatgaattctacgggaacacaggagtgctggaattcaaaccaggcgaaagggagatagtcattaccctcttagcaagactcgacggtatacccgaactcgacgagcactattgggttgtactgtcctcgcacggcgaacgggagtctaaactcggcagcgccaccatcgttaacataaccattttgaagaacgacgacccgcacggtatcatcgagtttgtttctgacggactgatagtcatgattaatgagtcaaagggcgacgctatttatagtgcggtctatgacgtcgtccgcaatagaggcaatttcggagacgtttctgtgtcatgggtggtgagcccagactttactcaggacgtatttccagtccaaggcactgtcgtcttcggagaccaggagttcagcaaaaacataaccatctactctctcccggacgagattccagaagagatggaggagttcacagttattctgctcaacggaacaggtggcgccaaggttggaaataggacaaccgccactcttaggattcgccggaacgacgatcctatatactttgcagagcctcgggttgtcagagtgcaggagggcgagaccgcgaacttcacagtgctcaggaatggttctgtagacgtgacatgcatggtccagtatgccaccaaagatgggaaagctacggctcgagaacgggattttattcccgtggagaaaggcgagaccctaatattcgaagtgggatctagacagcagagtatctctatcttcgtcaatgaagacgggattccagaaaccgatgaacccttttatattatccttctgaacagcaccggtgatactgttgtttatcaatacggggttgcaaccgtgattattgaggccaatgatgaccccaacggtatattttccttggagccaatcgacaaagctgtcgaggaaggaaaaaccaacgccttttggatcctcagacatcggggttattttgggtctgtgtctgtgtcttggcaactctttcagaatgactcagcactccagcccggacaggaattctacgaaacatctggaaccgttaatttcatggatggggaagaggccaagcctatcatcctgcacgctttcccagataagatcccagaattcaatgagttttatttcctgaagctggtgaacatttcaggcggctcacctggtccagggggccagctagccgaaactaacctgcaggttaccgttatggtcccttttaatgatgatccttttggtgtcttcatcctggaccccgaatgtctggagcgcgaagtggcagaagacgtgcttagcgaggacgatatgtcgtatattaccaacttcaccatcctgcgacagcagggggtgtttggggatgtgcagctgggctgggaaatcctatcctcagagtttcccgctggtcttccgcctatgatcgactttctcctggtcggtatattcccaaccaccgtgcatctccagcagcacatgcgaaggcaccattcaggaaccgatgctctttacttcactggtctggaaggagcttttggaactgttaatccgaaataccatcctagcagaaacaataccatcgccaatttcaccttctctgcctgggtaatgcccaacgcaaacaccaatggttttataatagccaaggatgacgggaatggcagtatctactacggcgtcaagatacagacaaatgagtcgcatgttaccctgagcttgcactacaagacgctggggagtaatgctacatacatcgcaaaaacaacagtgatgaaatacctggaagagtccgtttggctccaccttctcattattctggaggacgggattattgaattctacctggatgggaatgctatgcctcgcgggattaagtctctcaaaggagaggccattactgacggccccggcatcctgagaataggcgcaggaatcaacggcaacgatcgattcacggggctgatgcaggatgtacgcagctatgaacgcaagcttacacttgaggagatctatgaactacacgccatgcctgccaagtctgacctccatcctatatccgggtatctggagtttcggcagggtgaaactaataagagttttatcatctccgcgcgggatgacaatgatgaggaaggtgaagaactatttatcctgaagctcgtgtcagtatacggtggcgccaggatctcggaggagaacacaactgctcggctgaccatccagaagagcgataatgccaacggacttttcggttttactggggcgtgcattccagagatagccgaggagggaagtaccataagctgtgtggtcgaaaggactcgcggcgctctcgattacgtacatgtcttttacaccatctcccagatcgaaactgacggaattaattacctggtagatgactttgcaaatgcttctggaaccatcacctttctgccatggcagcgctctgaagtgctgaacatctacgtcttggacgacgatatccctgaacttaacgagtattttcgtgtgactttagtgtcagctatccccggtgatggcaagttgggtagtacacccacttcgggggcctctattgatccagagaaagaaacaaccgacataacaatcaaagcctctgaccatccatacggacttctccaattctctaccgggctgcccccacagcctaaagacgcaatgaccctcccggcatcatcagttccacacattactgtggaagaggaggatggggagatccggctgctggtaatccgcgcacagggtctattaggccgtgtgaccgcagagtttcgaaccgtgtcgctcacggccttttcacctgaagactaccagaatgtggctggcacactagagtttcagcctggagaaagatataagtatatctttattaatattactgacaacagcatccctgaattggagaagtcatttaaagtggagctgctgaacttagaaggcggagtcgcggaactctttcgggtagacggaagcggatctggggatggggatatggagttcttcctgccaaccattcataagcgtgccagtttgggtgtcgctagtcaaattctggttactatcgctgcctctgaccacgcccacggtgtcttcgagttttctccggagagtctcttcgttagcggcaccgagccagaagacggctactccactgtaacgcttaacgtgatccggcatcacggcactctgtccccagtgaccctgcattggaatatcgacagcgatcccgatggggatcttgccttcacctctggaaatattacttttgagatagggcagaccagtgccaacataaccgtggaaattttgcccgacgaggatcctgaactggataaagccttttccgtgagcgtgttgagtgtgtcctcaggctctctgggcgctcatataaacgctaccttaaccgtcctcgcttcagatgatccatatggcatttttatattcagcgagaagaaccgtcctgtgaaggtcgaagaggctacgcagaacattactttaagcatcataaggctcaaggggctgatgggcaaggtgttggtgtcctatgctacccttgatgatatggaaaaaccaccatatttcccgcccaacttggcgagggccacgcagggccgggactacataccagccagcgggttcgccttattcggggccaaccagagcgaagccactatcgcgatatctattcttgatgatgatgagcctgaacgatcagagagcgtgtttatcgaacttcttaactccactcttgtggccaaggtgcagtcccgatctatcccaaacagcccccggctgggacccaaggtcgaaaccatagctcaactgataattatcgccaacgacgacgccttcggcacgctccaactatccgcccccattgtccgcgtcgcggaaaaccatgttggacccatcattaacgtcactaggactgggggagcatttgccgatgtctcagtcaagttcaaggccgtccccattacagccattgctggtgaagactactcaatcgcttcttcagacgttgttcttctcgaaggtgaaacctcaaaggcagtcccaatctacgtaataaacgacatctaccccgaattggaagagtccttcttggtgcaattgatgaatgaaaccaccggcggtgctcggctaggcgccttaaccgaagcagttattatcatcgaggctagcgatgatccgtacgggttgttcgggtttcaaatcaccaagttgattgtggaagagcctgagttcaattcagttaaggttaatttgcccatcatcaggaattcaggaactctcggcaatgtcactgtgcagtgggtcgccaccatcaacggccagttggccactggggatttacgagttgttagtggcaatgtgactttcgcccccggcatgtcctcatatccttctgctactaactag

SEQ ID NO: 188709 - DNA, 18921 bp, Artificial Sequence
  Description of Artificial Sequence: Synthetic coding sequence
atgagcgtgttcctgggccccggcatgcccagcgccagcctgctggtgaacctcctttccgcactgctgatcctgtttgtcttcggcgaaacagagatccgtttcaccgggcagaccgagttcgtggtgaacgaaacaagcacaacagttatacggttgattatcgaaaggataggcgagccagcaaacgtgacagccatagtgtccctgtatggggaagacgcaggcgacttcttcgatacttatgccgccgcttttatccctgctggcgaaacaaatagaaccgtttacattgccgtgtgtgacgacgacctgcccgagccagacgaaaccttcatctttcacctgacgttacagaaaccttccgccaacgtcaagctgggatggccccgcacagtaacagtgactatcctgtcaaacgacaacgctttcggtattattagtttcaatatgttgcctagcatcgccgtgagcgagcccaagggccgtaacgagagcatgcctctgacgctaatccgtgaaaagggcacatatggaatggtgatggtgactttcgaggttgaagggggcccaaatccgcccgatgaagatctaagtcctgtcaaggggaatatcacttttcctccaggtcgcgccacggtgatctataacctcacggtgctagatgatgaagtgcccgagaacgatgagatcttcctgatccagttgaagagcgtggaggggggggctgagatcaacacctccagaaactccatcgaaatcattattaagaagaacgacagcccagtacgattcctgcagagcatttacttagtccccgaagaggatcacatcctaatcataccagtggtgcgaggaaaagataacaatggcaacctcataggctccgatgaatacgaggttagtatctcttacgcagtgacaacggggaactcgacagcacacgcccagcagaacctcgatttcattgacttgcaaccaaatactactgttgtatttcctcccttcattcatgagtctcacctgaaatttcagatcgtggacgatacaattcctgaaatcgctgaatctttccacatcatgcttttgaaggacacactgcagggcgacgccgtcctgatttcacccagtgtggtacaggtcaccattaagcctaacgacaagccatacggagtgctctctttcaactccgttttatttgaaagaacagtgattatcgacgaggaccgcattagccgatacgaagaaatcaccgtggtgagaaacggcgggacgcacgggaacgtgtctgccaattgggtactgactcggaattctacagatccttctcctgtgacagccgacattcggccctccagcggcgtccttcacttcgcacagggacagatgctcgcaaccattcccttgacagttgtggacgacgatctgcccgaggaggccgaggcttacctgctacagatacttcctcacactatccgtggcggcgcggaggttagcgaacctgcagagttgctcttttacattcaggatagcgacgacgtgtacgggttgattacgttttttccaatggaaaatcaaaaaatcgaaagttctcccggggagaggtatctgtccctgagctttacacgtttgggcgggactaagggggatgttagactcctatatagcgtgctctacattccagctggtgccgttgacccattgcaggccaaagagggcatcctcaacatttctcgccggaatgatctcatttttcctgagcaaaagactcaggtcactacaaaattgccaattcggaatgacgcttttcttcaaaacggggcccacttcctggtgcagctggaaaccgtggagctgctaaatattattcccctcatcccaccaatctccccgcgtttcggtgaaatctgcaatattagtctgcttgtaacacccgccatcgccaacggcgagattgggtttcttagcaatctgcccatcatactgcacgaacctgaagacttcgccgccgaagttgtctacatccctttgcatcgggacggcaccgacggtcaggccaccgtgtactggtccctgaaaccctcaggcttcaactccaaagccgtgacacctgatgatattggacctttcaacggttcagttctgtttctgtctgggcagagcgacaccaccattaatattaccattaagggtgacgacattcccgaaatgaacgagacagtgaccctttcgcttgatcgggtaaatgtcgaaaatcaagtattgaaatctggatacacaagtagggacctcataatactggaaaatgacgatccaggaggggtattcgagttctcacctgcaagcagaggaccctacgtgattaaggaaggcgaaagcgtggagctccacatcatccgcagccggggatcactagtgaaacaatttctgcactaccgtgttgaacctcgagacagcaacgaattctatgggaatacaggcgtcttggaatttaaacccggggagcgcgagattgtgatcaccctgttagcccggctagatgggatcccggagttggacgaacactattgggtcgtattatcgtctcatggcgagcgggagagcaagctggggtcagctacaattgtaaatattactattttaaagaatgacgacccccatgggatcattgagttcgtgagcgacggactaattgtgatgatcaatgaatcgaagggcgacgccatctatagcgccgtgtatgatgtggtgaggaatcgcggaaacttcggcgacgtgagtgtaagttgggtggtgagtcctgactttacccaagacgtgtttccagtccaaggaaccgtcgtatttggtgaccaagagttttccaagaacatcactatctacagtttgcctgacgagatccctgaagagatggaggagtttacagtgatccttctcaatggcaccggaggcgcgaaagtgggcaaccgcactactgctactctgcggatcagaaggaatgatgaccccatctatttcgcagagccccgcgtggtgcgtgtccaggaaggtgagactgctaatttcaccgttctgcgcaacggctctgtcgacgttacatgcatggtccagtatgccactaaagatggaaaggcgaccgccagagagagagactttattcccgttgagaaaggggaaaccctgatctttgaagtggggagtcggcagcaatcaatcagcatcttcgtgaacgaagacggcatcccagaaactgatgaaccgttttacattatactgcttaattccaccggagatacagtcgtgtaccagtatggcgtcgctacagtgatcattgaagcaaatgatgaccccaacggaatattcagtttggaacccatcgataaagccgttgaggagggaaagactaatgctttctggatcctgcggcaccgaggttacttcggctcagtatcagttagctggcaactcttccagaacgatagcgcattgcagcccgggcaggagttttacgaaacatcaggtaccgtgaatttcatggatggcgaagaagctaagcctatcatcctgcacgcctttcctgataaaatcccggagtttaatgagttctatttcctgaaattggtgaacatctcaggtgggagccccggccccggaggccagctggccgaaacaaacctgcaggtgacagtgatggtgcccttcaacgacgaccctttcggcgtcttcattctggaccctgagtgcctcgagcgggaagtggccgaagatgtgctgtctgaagacgatatgtcctatattacaaattttacaatcctgcgacagcagggagtcttcggcgatgttcagctgggttgggagatcctttcatccgaatttcccgctggtctccctcccatgattgattttcttctcgttggaatcttccccactacggtccatctccaacagcatatgcggcggcaccactccggaactgatgctctgtattttaccggtctggagggcgcatttgggactgtcaatcccaaataccatccgtctaggaacaacacaatcgctaattttaccttcagcgcttgggtcatgcccaatgcaaacaccaacgggtttattatcgccaaagacgacggaaacggatccatttattatggcgtcaagatacagacaaacgagagccacgtgaccctctctctgcattataagactctgggctcaaacgctacctacatcgcgaagaccacggtgatgaagtacttggaagagagcgtttggctccacctgcttataattctggaggatggaatcatcgagttctacctcgatggcaacgccatgccaaggggcattaagtccctcaaaggcgaagcgatcaccgacggtccaggcattcttcgaattggggccgggatcaatggtaacgacaggttcactggactgatgcaggacgttaggagctatgagaggaaactcaccctggaagagatttacgagcttcatgctatgccagcaaaaagcgacctgcaccctatcagcggctatctggaatttcgacagggagagactaataagagcttcataatctctgcaagagatgacaacgacgaagagggcgaggaacttttcatcctgaagttagtcagtgtatatggcggtgcccgtatttcggaggagaacaccaccgcccggcttactatccagaagagcgataatgcaaacgggctttttgggtttacaggtgcatgcattccagagatcgcagaggagggaagcacaatatcatgtgtcgtggagcggactagaggcgccctggactatgtccatgtgttctacactatatcacagattgagaccgacggcatcaattatctcgtggacgactttgccaacgcttctggaaccatcacttttctcccctggcaaagatcagaggtcttgaacatctacgtgctggacgacgatatccctgagctgaacgagtacttccgagtcactcttgtgtcagcaattcctggtgatggaaagctgggaagcacaccaacatctggtgcatcgattgaccctgaaaaggaaactactgatatcacgatcaaggcctctgatcacccctacggactcttgcagttttccactggacttcctccacagccaaaggatgctatgacgttacctgcttcatccgtgcctcacatcacagtggaggaggaggacggagaaatccgactcctggtgatcagagcacaggggttgttaggtagggtgacggcagaattccgcacagttagtttgaccgcattcagtcccgaggattatcagaatgtagcaggtactctggaatttcaacccggagagcgttacaaatacattttcatcaacataactgacaactccatccctgagctggagaaaagtttcaaagtggaactcctgaacctggaaggcggggtggccgagctattccgagttgatggttctgggagtggggatggcgatatggaatttttcctgccgaccatccataaacgggcttccctgggcgtggcctcccagattctggtaacaatcgcggcaagcgaccatgctcacggggtgtttgagttctcacccgagtctctgttcgtctccggcaccgagcccgaagacggctatagtacggtaaccttaaacgtaattcggcaccatgggacactttccccagtgactctacattggaatatcgattcagatccggacggtgatttggcattcacttccggaaacatcactttcgagattggccagacttctgctaacattactgtggagatcctacccgacgaggatcctgagcttgataaagcgttctccgtctctgtgctcagcgtttccagtggaagcctgggcgcccatatcaacgcaaccttgacagtgctggcctccgacgacccgtacggaatttttatattcagcgagaagaacaggcctgtaaaggtggaggaggccacccaaaacatcaccctgagcatcatccgactgaagggcctgatggggaaggtcctcgtaagctatgcaacattagacgacatggaaaaacccccttattttcctcccaacctggccagggcaacacaaggtagggactatattcccgcctctgggtttgcactttttggcgctaaccagtccgaggcaacaattgccatctctatccttgacgatgatgagcctgaaaggagtgaaagcgtgtttattgagctgctgaattctacgttagtggccaaggtacagtcacgaagcatcccaaatagcccaagacttggtccaaaagtggaaacaatagcacagttgattatcatcgctaacgatgatgccttcggcacgctgcagctgtcagcgcctatcgtcagagtggcagagaatcacgtgggtcctattatcaacgtcaccaggactggcggcgcctttgcagatgtgagcgtgaagttcaaggcagttcccataaccgccatcgctggagaagactacagtatcgcctcttctgatgtggtgttactggagggagagacctcaaaagccgtgcctatctatgttattaacgatatatacccagaactggaggagagcttccttgtccagctcatgaacgagacaaccggcggcgctaggttaggtgcgttaacagaggccgtcatcattatagaagcctcagacgatccatacggattatttggcttccagattactaaattgatcgtcgaggagcccgagtttaacagcgtcaaggtcaatctgcctattatccggaacagcggaacactgggcaatgtcactgtgcagtgggtggctactattaatggacaactggccactggggacctgagggtagtgagcgggaatgtcacattcgctcccggagagacgatacaaacactactcttagaggtgctcgcagatgatgtgcccgaaatcgaagaggtaattcaggtccagctcacagatgcaagtggcggaggaacaattggcctcgatcggatcgctaacataatcattcctgccaatgacgacccctatggaactgtggcttttgcacagatggtttacagggtgcaggaacccctcgaacggtcctcttgcgctaacattactgtgaggcgaagcggggggcatttcgggagactgctgctgttttatagtacctcagacattgacgtcgttgccttagcgatggaggagggacaggatctcctttcatactatgagtcaccaatccagggagtgccagaccctctgtggaggacctggatgaacgtaagcgccgtgggcgagcctttatacacatgtgccaccctatgtctgaaggaacaggcatgttctgctttttcatttttctctgccagcgaaggcccacaatgtttttggatgacaagctggattagtccagccgttaataattccgatttctggacctaccgcaagaacatgacccgcgtggcatccttattctcagggcaagctgtggctggttctgattatgagccagtgacgcgacaatgggcaatcatgcaagagggcgacgagtttgctaacctcactgtcagtatcctgccagacgacttccctgagatggatgaatccttcctcatttcactgttggaggtgcacttgatgaacatcagcgcttcactgaagaaccagcctacaatcgggcagccgaacatctctaccgtggtgatcgctctgaatggagatgccttcggcgtttttgtgatatataacatttccccaaataccagcgaggacggactctttgtcgaggtgcaggagcaaccgcagacactggtggagctgatgatacatcgcacggggggttctctggggcaggtcgctgtcgaatggcgggtggtaggtgggaccgccaccgaaggtcttgatttcatcggagcaggggaaattctgacctttgctgagggtgaaacaaaaaagacggtgattctcacaattctcgatgacagtgagcctgaagacgacgaatcgatcatcgtgtcattagtctacacagaggggggatccaggatcttacccagcagcgacacagtcagggtgaacatactcgctaacgacaacgtggccgggatagtctctttccagacagcttccaggtccgtcatcgggcacgaaggcgaaatactgcagttccacgtcattagaactttcccaggacgtggtaatgttaccgtgaattggaagattatcggtcagaatcttgagctcaacttcgccaatttttcggggcaattattttttccagaggggtcactgaatactacgctgttcgtacacttgctcgatgacaacattcctgaagaaaaggaagtgtatcaagtgatactatatgacgtgagaacacagggggtgcctcctgccggaatcgcgctgctggacgctcaggggtatgcggcagtcctgaccgtcgaggccagcgatgaaccccatggagtattgaactttgctttgagtagtagatttgtgctgcttcaggaagcgaacatcactattcagctgttcatcaaccgagagttcggctccctgggggccatcaatgttacatataccaccgtccctgggatgctttcactgaaaaaccagacagtagggaatctcgctgaaccagaagtcgattttgtacctatcattggcttcttgatcctggaggaaggcgaaaccgctgccgccattaatattaccatactcgaggatgacgtcccggaactggaagaatactttcttgtgaaccttacatacgtggggctcacaatggccgcgtcaacgtctttcccaccacgactggattctgagggactgacagcccaggtcattattgatgctaatgacggggcccgcggtgttatagagtggcaacaatccagattcgaggttaatgagacccacggttccctgacactggttgctcaaaggtccagggagccgttggggcatgttagcctgtttgtgtacgcccagaacctggaggcgcaggttggacttgattacattttcacccccatgattcttcattttgcagacggcgagcgatacaagaacgttaacatcatgatactggacgatgacatacccgaaggtgacgaaaagtttcaactgattctcacaaacccctcacctggcctggagctcgggaagaacacaatagccctgattatagtgctcgccaacgatgacgggcccggcgttttatcatttaataatagcgaacacttcttcctaagggaaccgaccgcactgtatgtccaggagtcggttgcagtgctgtatattgtaagagagcccgcccagggtctgttcgggaccgtaacagtccagtttatcgtgacggaagtcaactcttccaatgagtccaaggatctaacaccgagtaaagggtatatcgttctggaggaaggggtgcgtttcaaggctctgcagatttccgctatcctggacaccgagcccgaaatggatgagtacttcgtttgcaccctcttcaatccaacgggcggagcacgactcggcgtccacgtgcagaccttgattactgtcctgcagaatcaggccccactcggcctcttcagtatatccgcagttgagaatcgagcgacctctatcgatatagaggaggccaaccgaacagtatatctcaatgtatctcggactaatgggatcgatctggccgtctctgtgcagtgggagacagtttctgagactgctttcggaatgcgcgggatggatgtcgtgttcagcgtgtttcagtcattcctggatgaatcagcttctggatggtgctttttcactttggagaacttaatctacggaatcatgctgcgtaagagctccgtaaccgtgtatcgatggcagggcattttcatacccgtggaggacctaaacatcgaaaatcctaagacgtgcgaagcttttaacatcgggttcagtccctatttcgtgatcacccacgaggaaagaaacgaagaaaaaccctccctgaattccgtctttacattcacatcggggtttaaattgttcctcgtccaaacaatcattatcctggagagcagtcaggtcagatactttacatccgatagccaagactatctgatcatcgcaagccagcgagatgattccgagctgacccaggtcttccgatggaatgggggaagcttcgtactgcatcagaagttgccagtccgtggagtcctgaccgtggccttgtttaacaaaggaggatctgttttcttggctattagccaggccaacgcccggctgaacagcctcctctttcgctggtccgggtccggattcatcaactttcaagaagtacccgtctccggaaccactgaggttgaagcactgtcaagcgctaatgacatatatctgatttttgcagagaatgtgtttcttggggatcaaaatagtatcgatattttcatttgggagatgggccaaagctccttcagatacttccagagcgtggactttgccgcagtcaatcgcattcactccttcacaccagccagtggcattgcccacatcctcctaatcggacaggacatgagtgccctttactgttggaattctgaacgaaatcaattttcttttgtgctggaggtcccttccgcatacgacgtggccagcgtcacagtgaaatccctgaatagttccaaaaatttaatcgccttggtgggagcgcatagtcatatttatgagttagcatacatctcctcacacagcgatttcattcctagctctggggagcttatttttgagccaggcgagcgcgaagccactattgctgtgaatatactcgatgacaccgttcctgagaaagaggagtcctttaaagtgcagctgaagaatcctaagggaggagctgagatcggaattaatgactcagtcacgatcactattctatccaacgacgacgcctacgggattgtggctttcgcacaaaacagtctgtacaaacaggtggaggagatggaacaagattctctggttaccttgaatgtagagcggctcaagggcacctacgggaggatcacaatagcctgggaggccgacggatcaatcagcgatatttttcctactagcggagtgatcctctttactgagggccaggttctctccaccattaccctgacaatcctcgccgataatataccagaactgtcagaggtagtaattgttactctcaccagaattacaactgaaggagtggaggatagttataaaggcgcaactatagaccaggatcgttccaagtcggtgatcacaacccttcccaacgactctccgtttggactggtgggctggcgggccgcttctgtgttcatccgggtggccgaaccaaaagaaaataccaccactttacagctgcagattgccagagataagggtctgctcggagatattgcaatccaccttcgtgcacagcctaatttcctgctgcacgtcgacaaccaggcaactgaaaatgaagactatgtccttcaggagacgattatcattatgaaagagaatattaaagaggctcacgcggaagtgtcgattctccctgacgatctgcccgaactggaagaagggtttattgtaacgatcaccgaagtaaatctggtcaattcggacttcagcacagggcagccatcagtacggaggcctggcatggaaattgcagagatcatgatcgaagaaaatgatgatccaaggggaatcttcatgtttcatgttacccggggtgccggagaagtgatcaccgcatatgaggtgccccctccactgaatgtattgcaagtgcccgtagtgaggctagccggtagcttcggggctgttaacgtctactggaaagcatctcccgattctgccggtctggaagactttaagcctagccacggcatactggaatttgccgataaacaggtgactgccatgattgaaatcaccattattgacgacgcagagtttgagctaaccgagacatttaacatctccttaatttctgtcgctggcgggggcagactgggcgacgacgtggttgtgaccgtggtgattcctcagaacgacagcccctttggggtgtttgggttcgaggaaaaaactgtgatgattgacgaaagcctctccagtgatgaccctgacagctatgtcaccctgacagttgtgaggtccccaggtgggaaggggacagtccgcctggagtggacgatcgacgagaaggcaaaacacaatctctcccccctgaatggcactctgcattttgacgagacagaatctcaaaaaaccatagtactgcacacactacaggacaccgtgcttgaagaggataggcggtttaccatccagctgatctccatagacgaggtggagatctctccagtgaaaggcagcgcttcaataattatccggggcgataaacgcgcctctggagaggtcggtattgctccgagtagtcgtcatatcctgatcggcgagcctagcgccaaatacaatggcacggctattatctcgcttgtccgggggcccggtatcttaggtgaagtcaccgtgttctggcgcattttcccgccatctgtgggggaattcgcagagacatccggaaagctgaccatgcgggatgagcagagcgctgtgatagtggtgattcaggctctgaatgacgacattccagaagagaagagtttctatgagttccagctgactgcagtgtctgaaggcggcgtgttgtcagagtccagttctactgctaacattacggtggtggcctccgattcaccctatggccgattcgcattcagccatgaacagttacgtgttagcgaggcgcagcgagtgaatattaccataattaggtcctccggtgactttgggcacgttcgactctggtacaaaaccatgagtgggaccgccgaagctggcttagacttcgtcccggccgctggcgaactcctttttgaggctggcgagatgcgtaagagccttcatgtcgagattttggatgacgactacccagaaggacccgaggagttcagtctaactataaccaaggtcgagctccaagggagggggtacgattttactattcaggagaacggactgcagatcgatcaacctcccgagatcggaaacatctcaattgttcggattatcataatgaagaatgacaacgctgagggcataatcgaatttgaccccaagtatacagctttcgaggtcgaggaggatgtgggactgattatgattcccgtagtgagacttcatggaacgtacggctatgttacagccgacttcatcagtcagtctagcagcgcctcacctggaggagtggattatatccttcacggctccacagtgacatttcaacatgggcagaacctgtcttttatcaatattagtattattgatgataatgagtccgaatttgaagagcctatagaaatcctgttgacaggcgcaactggtggagctgtgctaggccggcacctcgtctccagaataatcattgccaaatccgactcccctttcggcgtgatacgattcctgaatcagtctaagatcagcatagctaatcccaactccaccatgatcctcagcctggtccttgagagaacagggggtcttcttggggaaatccaggtgaattgggaaacagtcggacccaactcccaggaggccctcctcccacagaatcgggacatcgcagaccccgtgagcggtttattctatttcggagaaggggaaggtggcgtgcgcactattatcctcacaatttaccctcatgaggaaatcgaggtggaagaaacctttatcatcaaattgcacctcgtcaaaggggaagctaagcttgactcacgtgcaaaggacgtgactcttaccattcaagagttcggagatcctaacggggtagtgcagttcgcacccgagacactgtccaagaaaacctactcagagccactggccctggaaggccctcttctcattacatttttcgtcaggagagtaaagggtacctttggggaaattatggtttattgggaactatcgtccgagtttgatatcactgaggatttcttgagtacatctgggttctttaccatagctgacggggaaagcgaagctagtttcgacgtgcacctcctgcctgacgaggtcccagaaatcgaggaggactatgttatccagctggtctcggtggaggggggcgccgagcttgacctggagaagtccatcacctggttttcagtatacgccaatgacgaccctcacggtgtctttgccttgtacagcgatcgtcaatctattctgatcggccagaacctgattagatcaatacaaatcaacataactagactggctggaacctttggagacgtggcagtgggcctgcggattagctctgatcataaagagcagcccatcgtcacggagaacgccgaacggcagctagtggtgaaagacggcgcaacatataaagtagacgttgtgcctatcaaaaaccaggtgttcctgtcacttggcagtaatttcacgctccagttggttaccgtcatgcttgtgggtggacgtttctatggcatgcctaccattctgcaggaagccaaatctgccgtgctgcccgtatcagagaaggccgcaaactcacaggtgggattcgaatccactgcctttcagttgatgaacattaccgctggaacgagtcacgtgatgattagtcgcagaggcacatacggggccctcagtgtcgcttggacaaccgggtacgcccctggcttggagattcccgaatttatcgttgtggggaacatgacgcctacattgggctctctcagcttttcccacggcgaacaacggaaaggtgtgttcctttggacattccctagcccagggtggccagaagcttttgtactgcatctatcgggggtacagtccagcgctccagggggagcccagttgcggagtgggttcatcgtcgccgaaattgagcccatgggtgtattccaattcagcacgtcctccaggaatatcatcgtatccgaggatactcagatgattagactgcacgtgcagcgcctgtttggatttcactccgacctgatcaaagtctcataccagactactgctggcagtgccaaaccgttagaggatttcgaaccagtgcagaacggtgagctgttttttcagaagttccagacggaagtggacttcgagatcactatcatcaatgaccaactgagcgagatagaggaattcttttacatcaacctgacaagcgtggagattcggggcctccagaaattcgacgtaaattggtcaccccgcttgaacctggactttagcgtcgccgtgattaccatccttgacaatgatgacctagccggaatggatattagcttccccgaaacaactgttgccgtggccgttgataccacactaattcccgtcgaaactgagagcacaacttacctgtctactagtaaaactaccaccatcctgcaaccgaccaatgttgtcgctatcgtgaccgaggccacaggcgtgtcagcaatcccggaaaaactggtgactctgcatggaacacctgctgtaagtgaaaagcccgacgtggccacagtcacggcgaatgtgtctatccatggcactttttccctcgggccttccatcgtgtacattgaagaggagatgaaaaatggcacctttaacaccgccgaagtcctgatccggcggactggcgggtttacagggaacgtgagcataaccgtcaagacctttggagaaagatgcgcgcagatggagccaaatgccttgccatttcgagggatctacggtatctctaaccttacatgggcagtggaagaggaggatttcgaggaacagaccctaacactcatctttctggacggggagagggaacgcaaggtcagcgtccaaatcctagacgacgacgaacccgaaggacaagaatttttctatgtgttccttacaaatccacagggtggagcccagattgttgaggaaaaggacgacactgggttcgcggcctttgcaatggtcatcattacaggcagcgacctgcataacggtattatcggtttctccgaagaaagtcagagtggcttagaactgcgggagggcgctgtgatgagacggttacacctaatcgttacccggcaaccaaacagggcttttgaagatgtgaaggttttttggagggtcacattaaataagacagtggtggttctgcagaaagacggagtgaacctggttgaagagctgcagagcgtgagcggaacaaccacatgcactatgggccagaccaagtgtttcatctcaatagaacttaaacccgagaaggttccgcaggtagaggtctattttttcgtggagctctatgaagccaccgccggtgcagctattaataactcagctcggttcgcgcagatcaaaatactggagtccgacgaaagccagtccctggtgtactttagcgtcggttccaggctcgctgtcgcccacaagaaggctacattgatcagtctccaggtggctcgtgattccggaactggtttaatgatgtcagtgaacttcagcactcaggaactgcgatccgccgaaaccattggaagaaccatcatttcacccgcaatctccggaaaagattttgttataacggaaggcactctggtgttcgaacccggacagagatccactgtgctcgacgtgatcctgaccccagagactggctccctgaactcattccctaaaagatttcagatcgtgctcttcgacccaaagggcggggcgcggatcgacaaggtgtatggtaccgcaaacattactcttgtttctgacgcagattcccaggcgatttgggggctagcagatcagcttcaccagccagtcaatgacgatatcctaaatagggtgcttcatacaatcagtatgaaggtggccaccgaaaatacagatgagcagctctctgccatgatgcatctcattgagaagattaccactgagggcaaaatccaggccttttctgtggcatctcgcaccctattttatgagatactgtgctcactgatcaatcctaagaggaaagatactaggggcttttcgcactttgctgaggtgactgagaactttgcattttctctcttaacgaatgttacatgtggatctcctggcgagaaatcaaagaccatacttgatagctgcccatacctgagcatattagccctccattggtatccgcagcaaatcaatggccacaagttcgagggtaaagaaggtgattatatccggatcccagaacgtctgctggatgtgcaggacgctgagatcatggccggcaagagcacgtgcaaactcgtgcagttcaccgagtattcgagccagcaatggtttatttctgggaacaacctgccaactctgaaaaataaagtcctgtcattgagtgtgaaaggtcaatcttctcagctactgacgaacgacaatgaggttctgtaccggatctacgccgccgagccccgcatcatcccgcagacatcgctttgtctgttgtggaatcaagccgcagcttcctggctgtcggattcccagttctgcaaggtcgtggaggagactgctgattacgtcgagtgtgcctgttcacacatgtcggtatatgctgtctacgcaagaacagataatctaagcagttacaacgaggctttcttcacctccgggtttatctgcatctcagggctgtgcttagccgtgctatcccacatattctgtgctaggtacagtatgtttgccgccaaactcctcacccatatgatggccgcgagtctggggacccagatcctctttctggcgtccgcctatgctagccctcaactggctgaggaatcttgttcggcgatggccgctgtgacacactatctttacctgtgccagttctcgtggatgctcatacagtcagtcaacttctggtatgttctggtgatgaacgacgaacatactgagagacggtacttactgttctttctgctctcctggggcctcccggctttcgttgtgatcctgttgatcgtgatactaaaaggaatctaccaccaatccatgtcgcaaatttacggcctcatacacggcgatctgtgttttattccgaatgtgtacgcggcgctctttaccgcggcattggtccccctcacgtgcttggtagtcgtatttgtggttttcatacatgcctaccaggtcaagccacaatggaaggcctacgacgacgtatttcgcggaaggactaacgccgccgaaattccgctcatcttgtatctttttgctctgatatcagtaacctggctatggggcggccttcacatggcatatcggcatttctggatgcttgtcttgtttgtcatttttaactcccttcagggactctatgtgttcatggtctattttattctccacaaccaaatgtgttgccccatgaaggcttcctacacggttgagatgaacggccatccggggccgtctaccgcatttttcacgcctggcagtggaatgccccctgccggtggcgaaatttctaaaagtacacagaacctgataggggccatggaggaagtcccccctgattgggagagggcttcctttcagcaaggctctcaagcctcacccgacctcaagcccagcccacagaacggggcgacatttccatcaagcggaggatatggacagggctccctcatcgcggatgaggaatcgcaggagtttgatgacttaatctttgcgctgaagacgggagcaggcctcagtgtaagcgacaacgaatccggccaaggcagccaggaagggggcacactgaccgacagtcagatcgtcgaactgaggaggattcctatcgcggatacacatctctag

SEQ ID NO: 188710 - DNA, 4188 bp, Artificial Sequence
  Description of Artificial Sequence: Synthetic coding sequence
atgaccggcgccgagatcgagagcggcgcccaggtgaagcccgagaagaagccaggagaggaggtcgtcggcggcgccgagatcgaaaatgacgtaccactggttgtgcgccccaaagtccggactcaagcacagattatgccaggcgctaggccgaagaacaagtcaaaggtgatgcctggcgctagcactaaagtagagaccagcgccgtgggtggggcacggccgaagtccaaggcgaaagcaattccagtgtctaggtttaaggaggaggcccagatgtgggctcagcctaggttcggggccgaaagactttctaagacagagagaaacagccagaccaatatcatagcctcccctcttgtctcgacagacagcgtgctggtggcgaagacaaagtacttgagtgaggatagggagttggtcaacactgatacagaatccttccctagaaggaaagcccattaccaggccggctttcagccttcctttagatctaaggaggagacgaacatgggaagctggtgctgcccccgacccacctccaagcaggaagcgagtccgaattctgatttcaaatgggtcgataaatcggttagcagcctgttttggtcaggcgatgaagtcacagctaaattccaccctggaaacagagtaaaagattccaatcggagtatgcatatggctaatcaggaagccaacacaatgtccaggtctcagaccaatcaggaactgtatattgcatcttctagcggcagcgaggatgaatcagtgaagacaccgtggttctgggctagggacaaaacgaatacctggagtgggcctcgcgaagacccaaacagtcggtctcggttcagatccaagaaggaggtttacgtggagtccagctcagggtccgaacatgaggatcacctagagtcctggttcggcgctgggaaagaggccaaatttaggagtaagatgcgagccggcaaagaggcgaataacagggcgaggcacagggccaagagagaggcctgtattgacttcatgcccggatctatcgacgtgatcaaaaaagagtcatgcttttggcccgaagagaatgctaacaccttttccagacctatgataaagaaagaggcgcgagctcgcgctatgacaaaggaggaggctaaaaccaaagcaagagctagggccaaacaggaagcccgatctgaagaagaagcattgatcggcacatggttttgggctacagacgaatcatctatggccgatgaggcttccattgaaagcagtttacaggttgaggacgagagtatcataggctcctggttctggactgaggaagaagccagcatgggtactggcgcgtcttctaagagcagacccaggaccgacggggagaggataggggatagcctcttcggcgcccgggaaaaaacgtctatgaaaacaggagcagaggctacatcagaatccatccttgcagctgatgatgagcaagtaattataggctcctggttctgggccggcgaagaggtgaaccaggaagctgaagaagaaactatttttggatcttggttctgggttatcgatgctgcatcggtggagagtggcgttggcgtatcatgtgagagtcggactcgcagtgaagaagaggaggttataggaccctggttttggtctggcgaacaggtggacatcgaggcgggaattggcgaggaggctaggcctggagcggaggaagagactatctttggctcttggttttgggcagagaaccaaacctacatggattgcagagcggaaacatcctgcgacacaatgcagggggccgaggaggaggagcccattatcggcagttggttctggacacgagtggaggcctgtgtcgagggcgacgtgaattcaaaatcttctctggaggataaagaggaagccatgataccttgctttggggcgaaagaagaggtgtcgatgaaacatggcaccggggtcagatgcagattcatggcaggcgcagaagaaacaaacaataagtcctgcttttgggccgagaaagaaccatgcatgtaccccgccggcgggggctcctggaagtctagacctgaggaggaagaagatatcgttaactcctggttttggtcccggaaatacacaaagccagaggccatcatcggttcctggctgtgggctactgaggagtctaacattgacggcaccggggaaaaagctaagttgctgacagaagaagagacaataatcaacagctggttctggaaggaagacgaggctatatccgaagccaccgatagagaggagagccgtcccgaagccgaggagggagacataattggcagttggttctgggcaggggaagaggatagactcgagcccgcagcagagacaagagaggaggaccggctcgccgccgagaaagagggcatcgtggggtcctggttcggtgctcgcgaggagaccattcggcgagaagctggctcatgtagcaagtcctctccaaaggcggaggaagaagaggtcatcataggttcatggttttgggaagaggaagccagccccgaagccgttgctggagtaggattcgaaagcaagccagggactgaggaggaagagataactgttggtagttggttctggcctgaggaggaggctagtatccaggccgggtctcaggccgtcgaggaaatggaatcggaaacagaggaggagacaatatttggctcctggttctgggacggaaaggaagtttcagaagaggccggcccctgttgcgtaagcaaaccggaagacgatgaggaaatgattgtggaatcctggttctggtcacgtgacaaagccattaaagagactggcaccgtggccacatgcgagtccaagccagagaatgaggagggagctatagtcggctcctggttcgaggccgaggacgaggtcgacaaccggactgacaatggaagcaattgcggctctaggaccctcgctgacgaggacgaggcaattgtcgggagctggttttgggcaggcgacgaggctcactttgagtccaatcctagtcctgtcttccgagcaatatgccgtagcacgtgctccgtggaacaggagcccgacccctcccgcagaccccaatcatgggaagaagtgactgtacaattcaaacctgggccatggggacgagtggggttcccgagcatttcccccttcaggttccctaaggaagctgcgagcctgttctgtgagatgttcggaggaaagccgcggaacatggtcctgagcccagagggagaggatcaggagtccctcctacagcctgaccagcctagtcccgaatttccattccaatacgaccctagttatagatccgttcaagaaattcgtgagcatctcagagcgaaagagtcaactgagccagagtccagcagttgtaactgtatccaatgcgagctaaagatcggcagtgaggagtttgaagagcttctcctcctgatggaaaagattcgggacccattcatccacgagatttctaaaattgccatgggtatgagatctgcttctcagttcacacgtgatttcatcagggattctggtgttgtatcgcttattgaaaccctcctcaattacccttcatccagggtccgtacttcattcctggagaacatgatccgcatggcgcccccatacccaaatctcaatatcattcagacatatatctgcaaagtgtgcgaggaaaccctagcctatagcgtggatagtccagaacagctgtccggcatacgcatgattaggcacctgacaactaccacagattatcacactttggtcgctaattacatgagtgggttcctgagtctgctagcaactgggaatgcgaaaacaagattccacgtgctcaaaatgctcttgaaccttagcgagaatttgtttatgacaaaagagctgctcagcgctgaggccgtgtctgaattcatcgggctgtttaaccgggaggagacgaatgacaatatacagatcgttcttgcaatctttgagaacattggaaacaatattaagaaagaaacagtcttttcggacgacgacttcaatatcgagcctttgatctctgcctttcacaaggtggaaaaattcgccaaggaactgcagggcaaaaccgataatcaaaatgaccccgaaggggaccaagaaaactag

SEQ ID NO: 188711 - DNA, 4188 bp, Artificial Sequence
  Description of Artificial Sequence: Synthetic coding sequence
atgaccggcgccgagatcgagagcggcgcccaggtgaagcccgagaagaagccaggtgaggaggttgtcggtggcgccgaaattgagaacgacgtgcctttggtcgtaaggcccaaggtacggacgcaagctcaaattatgcctggagccagacctaaaaacaagtctaaggtgatgcctggtgctagtactaaggtggagacatccgctgtggggggggcacgcccaaagtctaaagccaaggcaatccccgtatcacgttttaaagaggaggctcagatgtgggcccaaccccgattcggagcagagagattatctaagaccgagaggaatagccagaccaatattattgctagtcctttggtgtccacggactcagtcctggtggctaaaactaaatacctttctgaagacagagagctggtgaacaccgataccgaaagtttcccccggaggaaagctcactatcaggccggtttccaaccctcctttaggtctaaggaggagaccaatatgggtagttggtgttgtccaagaccgacctctaagcaggaagccagtcctaattctgacttcaagtgggtagataaaagcgtatctagccttttttggtctggagacgaagtgaccgctaagttccatccaggaaacagggtgaaagactctaacagatcaatgcacatggcgaaccaagaggcgaacactatgagccgaagccagaccaaccaggaactctacatcgctagttccagtggtagcgaggacgaaagtgtcaagacaccatggttctgggctcgcgataagacgaatacttggtcaggcccccgggaggatcccaattccaggagcaggtttagatcaaagaaagaagtatacgttgagagtagtagtggatccgagcacgaggatcacctggagagctggttcggcgcaggcaaggaagccaagttccgctcaaaaatgcgggccggaaaggaagcaaataaccgggctaggcatcgcgcaaaacgggaagcctgtatagactttatgccaggaagtatagatgtcatcaaaaaggagagctgcttctggcctgaggaaaatgcaaacaccttcagccgccctatgatcaaaaaagaggccagagcaagagcgatgacgaaagaagaggccaagaccaaagctagggcaagggcaaagcaggaggcccgctctgaagaggaagcacttataggaacatggttctgggctaccgacgagtccagcatggccgatgaagcctctatcgagtcttcccttcaggtcgaggacgagtctatcattggctcctggttttggaccgaagaagaggcatcaatggggaccggggcctcatcaaagtcaagaccccgaacagatggtgaacgcatcggggactccctctttggggctagagaaaaaacctcgatgaagaccggcgcagaggctacatccgagtccatactggccgcagatgacgagcaggtaatcatcgggtcttggttctgggctggggaagaagtaaaccaggaagcagaagaggagacaatctttggatcatggttctgggtcattgacgcagcttctgtggaatctggcgtaggagtttcctgcgaatcaagaactcgcagtgaagaggaagaagtgatcggcccttggttttggagcggtgagcaggttgatatcgaagccggaatcggagaagaggcgaggcctggcgcagaggaagagacaatattcggcagctggttctgggccgagaaccagacatatatggattgccgcgccgaaacttcctgcgacactatgcaaggtgcagaagaagaggagccaataattggcagctggttctggacacgggttgaggcctgcgtcgagggagatgtcaacagtaagtccagcttagaggataaggaggaggccatgattccttgttttggggccaaggaagaagtctcaatgaagcacggcaccggcgttagatgccggtttatggctggagccgaggagactaacaataagtcttgcttctgggctgagaaagagccctgcatgtatccggccggcggtggatcttggaagtctaggcccgaagaagaggaggatatagttaatagctggttctggagtagaaagtacacaaagccagaggccatcatcggttcatggctgtgggctacggaagagtctaacattgatgggaccggcgagaaggcaaaattactaacggaggaggaaacaatcatcaactcgtggttctggaaagaggatgaggcaattagcgaggctacggaccgagaggagtccaggcccgaagccgaggagggggacatcatcggcagttggttctgggcgggggaagaagaccgtctggagccagccgcagagaccagagaggaagatagacttgctgctgagaaagaaggcatcgtgggttcctggttcggtgcacgtgaagaaaccatcagacgggaagcaggctcatgctctaagtctagtcccaaggcagaggaggaagaggtgataataggatcatggttttgggaggaagaagctagccctgaggccgtcgctggagtgggattcgagagcaaaccaggaactgaggaggaagagattactgtcggttcctggttctggcccgaggaggaggctagtatacaggcaggctcccaggcagttgaagaaatggagagcgagaccgaggaggagaccatttttggcagctggttctgggacggcaaagaggtctctgaagaagctgggccctgctgcgttagcaagcccgaggacgatgaggaaatgatagtcgagagctggttttggagccgggacaaggccatcaaggagacaggaactgtggccacctgcgagagcaagcccgagaacgaggagggggcaattgtcggttcctggttcgaggcagaagatgaagtggacaataggaccgataatgggagcaattgcggatctcgtacactcgccgacgaagatgaggcgattgtgggtagctggttctgggcaggggatgaagcccattttgagtccaacccttcaccagtattccgggcgatttgccggagcacatgctctgtcgagcaggagccagatccctcgcgacgcccacagagttgggaggaggtcactgtgcaattcaaaccaggaccatggggccgagtgggcttccccagcatttccccattccgatttccaaaagaggctgcatccctattttgcgagatgtttgggggcaagccacgaaacatggtgctgtcaccagagggtgaggaccaagagagcttattgcagcccgaccagccctcccccgaatttcccttccagtatgacccatcttaccgctctgtccaggaaatccgcgaacatcttagagccaaggagtccaccgagcctgagagctcaagttgcaattgcattcagtgcgagctgaaaattggatcagaggaatttgaggagctgctgctcctgatggagaagatcagggacccattcatccacgagatcagcaagatcgccatgggcatgagatctgcatcccagtttacaagagatttcatacgggactctggcgtggttagcttgatagaaacccttctgaactatcctagcagtagagtccgaacgtcctttctagagaatatgatccgaatggcccctccgtaccctaatctgaacatcatccagacctatatttgtaaggtgtgcgaggagaccctcgcatattctgtggattcccctgaacagcttagcggtatccggatgatcagacacctgaccaccaccaccgattaccacaccctggtcgcaaattacatgtccggattcctgtccctgctggctacaggcaacgccaaaacccggttccatgttttaaaaatgttgctgaatctgagcgagaacctcttcatgacgaaggagctgctgtcagcagaggccgtgtccgaatttatcggactcttcaatcgagaggaaacaaacgataacattcagatcgtccttgctatttttgagaatatagggaacaatatcaagaaggagaccgtgttttcagatgatgatttcaacattgaaccgttaattagcgcattccataaagtcgagaagtttgcgaaggaattacagggcaagaccgacaaccagaacgacccagagggcgatcaggagaactag

SEQ ID NO: 188712 - DNA, 4188 bp, Artificial Sequence
  Description of Artificial Sequence: Synthetic coding sequence
atgaccggcgccgagatcgagagcggcgcccaggtgaagcccgagaaaaaacctggcgaggaggtagttgggggggccgaaattgagaacgatgtgcctttagttgtgaggcccaaagtgcgcactcaggcccagatcatgcccggcgctagacccaaaaacaagagcaaggtgatgccgggtgcctcaaccaaggttgaaacgtcagcagtcggaggggctcgccccaagtccaaggctaaagctatcccagtctctagattcaaagaggaggctcagatgtgggcacaaccacgcttcggtgcagagagattaagcaagacagaacgcaattcccaaactaacattatcgcctctcctttggtgagtactgacagcgttctagtcgccaagacaaaatatctatccgaggacagggagctggtgaatacagacacagagagtttcccccgacgcaaagcacactaccaggccgggttccagcccagcttcagaagcaaggaggagacgaacatgggctcatggtgttgtccccgaccaacaagtaaacaggaagcgtcacctaactcggattttaagtgggttgacaagtcggtgagttcattgttttggtccggcgacgaagtgacagccaagtttcatcccggcaatagggtgaaagactcaaacaggtcgatgcacatggccaatcaggaggcaaacacaatgagtcgatcacaaacgaatcaggagttgtacattgcttcatccagtggcagcgaggatgaatcggtgaagacaccatggttttgggcaagagacaagactaatacctggtctggccccagggaggaccccaactccagatcaaggtttcggagcaagaaggaagtgtacgtggaatcgtcttccggaagtgagcacgaggatcatttggaaagctggttcggtgcgggcaaagaggcaaaatttagatctaagatgagagctgggaaggaagcaaacaatagggctaggcatcgggccaaacgcgaggcttgtatcgactttatgcctggatccattgacgtgatcaaaaaagaaagctgcttctggccggaggagaacgctaatacatttagtcgtccaatgatcaagaaagaggctcgggctagggctatgacaaaagaggaggctaagacaaaggccagggcgagagctaagcaggaagccagaagtgaagaagaagctttgattggcacatggttttgggcgaccgacgaatcatctatggctgatgaagcctctattgaatcttccctgcaggtagaggatgaatccattatcggcagctggttctggacagaggaggaggcgagcatgggcaccggcgcttcttccaagtcacggcccaggaccgacggagagaggatcggagattccctgttcggggctagagagaaaactagtatgaaaaccggggctgaggcgacatccgaatccattttagccgcagatgacgaacaagtcattataggttcttggttctgggccggtgaggaggtaaaccaggaggctgaggaagagacgatctttggatcatggttttgggttattgacgcagcttcagttgaatccggtgtgggcgtatcgtgcgagagccgcacaagatctgaggaggaagaggtaatcggaccatggttttggtctggtgaacaagtagatatcgaagctggcataggcgaagaagcgcggcccggcgctgaggaagagaccatctttggctcatggttttgggcagagaaccaaacctatatggattgccgggcagaaacttcctgtgataccatgcaaggggccgaggaagaggaaccgattattgggagctggttttggacacgggttgaggcgtgcgttgagggggatgtgaatagcaagagcagtctggaggacaaggaggaggccatgattccttgcttcggtgcgaaagaggaagtttccatgaagcacggcaccggtgtgagatgtcggtttatggccggcgctgaggagaccaataataagtcttgtttctgggccgagaaagaaccctgcatgtatcccgccgggggggggagctggaagagtaggcccgaagaagaagaggacatagttaattcctggttttggagcagaaaatacaccaagcccgaagcgatcattggttcctggttatgggcaacggaggagtctaacattgacggcactggtgaaaaagccaaactgttaacggaagaagaaacaatcattaatagctggttctggaaggaagatgaggctatttcggaggcgacagatcgtgaggaatcgagaccagaagccgaagaaggcgacataatcggatcttggttttgggcgggcgaggaggatagacttgaaccagccgccgagaccagggaggaagacaggctggcagccgaaaaggagggcatcgtaggatcatggttcggcgcccgggaagaaactataaggcgtgaagccggtagctgcagtaaaagcagtcctaaagccgaagaagaggaggtcataatcggcagttggttttgggaggaggaggccagccccgaggcagtcgcaggagtaggctttgaatcaaagccaggaaccgaagaggaggagatcactgtcggatcctggttctggcctgaagaggaggccagcattcaggccggaagccaagctgtggaggaaatggagtcagaaaccgaggaagagacgatctttggctcttggttctgggatggtaaagaagtgagcgaagaggctggaccttgttgcgtctccaagcccgaagacgatgaggaaatgatcgttgaaagttggttctggtctcgggataaggcgatcaaggagacgggcaccgtggctacttgcgaatccaaacctgaaaatgaagagggcgccatcgttggctcctggtttgaagccgaagacgaggtcgacaatcggacagacaatggaagtaattgcggtagccgcacattggctgacgaggacgaggcgatcgtgggttcctggttttgggcaggagatgaggcacactttgaatctaatccaagccctgtatttcgcgcgatttgccgctccacttgctctgttgagcaggagcccgatccaagtcggaggccacagtcatgggaagaagtgaccgtacagttcaagcctgggccctggggcagagtgggatttccctccatctcccctttccgcttcccaaaggaggcagcatctctgttctgtgagatgtttggaggtaagccccgcaatatggtgctctcgccagagggagaggaccaggaaagcctgctgcagcctgaccagccaagtcctgaatttccttttcagtatgacccttcatataggagcgtgcaggaaatacgggagcatcttagggcaaaggagtcgactgaacccgagagcagctcctgtaactgtattcaatgtgagctgaaaattggctcggaagagttcgaagagcttctgctgctcatggaaaaaatccgggatccattcatccacgagatctctaagatcgccatgggcatgagatccgcatcacagtttacacgggacttcatccgtgatagtggagtggtgtccctcattgaaacactgctgaactacccatcttcccgagtcagaacctcctttttggagaacatgatacgaatggccccaccctacccaaacctgaacattattcaaacctatatctgcaaagtgtgcgaggagaccctcgcgtatagcgtggattcaccggagcagttgagtggtatcagaatgattagacacctgaccaccaccactgattatcacaccctcgttgcaaactatatgtctggattcctgtccttgttggccaccggcaatgcaaaaactaggttccacgtcctcaagatgttactgaatctctctgaaaacttattcatgactaaagaacttctttccgccgaggctgtgtcggagttcatcggtttatttaaccgtgaggagacaaacgacaatatccagatagtcctggccatatttgagaacatcgggaacaacatcaagaaggagacggtattttcggatgacgacttcaacatagaacctttgatttccgcatttcataaggttgaaaagtttgctaaagaattacaaggcaagacagacaaccagaacgaccctgagggggatcaggagaattag

SEQ ID NO: 188713 - DNA, 4188 bp, Artificial Sequence
  Description of Artificial Sequence: Synthetic coding sequence
atgaccggcgccgagatcgagagcggcgcccaggtgaagcccgagaagaagcccggagaagaggttgtgggcggtgcagagattgagaacgacgtgcctctcgtggtccggcccaaggttaggacccaggcccagattatgcccggagcccgacccaagaacaaaagtaaggtgatgcctggggctagcacaaaagtggaaaccagcgctgtcgggggcgcccgccctaagtccaaggctaaggctataccagtttcacggtttaaagaggaggctcagatgtgggcacaacccagatttggggccgaaagactgtcaaaaaccgagagaaattcacagacaaatattatcgcttcacctttagtctccaccgattctgtgcttgtcgccaagacaaagtacctctccgaggaccgggaactggtgaacacagataccgaatccttcccccgcaggaaggcgcattaccaggccgggtttcagccttcctttcgatctaaagaggaaaccaacatgggcagctggtgttgcccaaggcctacaagcaaacaggaggcatcacctaactccgatttcaagtgggtggataagtctgttagctctctcttttggagcggagacgaagtcaccgccaagtttcatccaggaaatcgagtgaaggactccaaccgcagtatgcacatggccaaccaggaggcaaacaccatgtccaggagccagacaaaccaggagctgtacattgccagctcctcaggatcagaggatgagagcgtgaagacaccatggttctgggcccgggacaaaactaacacctggagcggcccccgagaagaccccaattctcgttcgaggtttcgttcaaaaaaagaggtgtatgtagaaagtagtagcgggagtgaacacgaggaccatttagaaagctggttcggcgccggaaaagaagccaaattcaggagtaaaatgagagccggtaaagaggccaataacagggcaagacatcgggcgaagagggaagcatgcatcgatttcatgccgggcagtatagacgtaatcaagaaggagtcttgcttttggccagaagagaatgctaatacctttagtaggcctatgataaaaaaggaggcaagagcccgcgctatgaccaaggaagaagcaaagacaaaggcccgagctcgggcgaaacaggaggcccggagtgaagaagaggcccttattgggacctggttctgggctaccgatgaaagtagcatggctgatgaggcctctatagagtcttctttgcaggttgaagacgaatctattatcggcagctggttctggactgaggaggaggcctctatgggcacgggcgctagctccaagtcacggcccagaacagacggcgaacggatcggagacagcctgtttggtgcgcgcgagaagacctctatgaagacgggcgcagaggccacaagcgagagcattctagccgcagacgatgaacaggtgatcatcggctcttggttctgggccggcgaggaagtaaatcaggaagctgaagaagaaactattttcggcagttggttttgggtcatagacgccgccagcgttgaaagcggcgtgggcgtcagctgcgagtccagaacgcgctctgaggaagaggaggtcattggaccatggttttggtctggagaacaagtggacatcgaggccggaatcggagaggaggcaagacctggcgccgaagaggagactatcttcgggtcttggttttgggccgagaaccagacttacatggactgcagggcggaaaccagctgtgacaccatgcaaggagccgaggaggaagaaccgatcattggatcttggttttggacccgcgttgaggcctgtgtggaaggtgatgtaaactccaaatcatcccttgaagacaaggaagaggccatgataccttgcttcggggcaaaagaggaagtgtcgatgaagcatggcacaggcgtgagatgccggttcatggccggcgctgaagaaactaacaataagtcttgcttttgggcagagaaagagccgtgtatgtatccagccggggggggctcttggaaatcacggcctgaggaggaggaggacatcgtcaattcttggttttggtccaggaagtacacaaagcccgaggcaataatagggtcatggctttgggctaccgaggagtcaaatatcgacggtaccggcgagaaagccaaactactgactgaggaggaaaccattatcaacagctggttctggaaagaggatgaggccatctctgaggccactgatcgggaagaatcgagacctgaggctgaggaaggggacatcattggctcctggttctgggctggagaggaggatagactggaaccagcagcagagactcgagaagaagatcgcctcgccgcagaaaaggaaggcatcgtggggtcatggtttggtgcgcgggaggaaacaatcagacgtgaagctggctcatgctcaaagtcgtctccaaaggcagaagaggaggaggtcataatcggctcctggttctgggaggaggaagcctccccagaggcagtggccggagtcggtttcgaaagcaagccaggcactgaggaagaagagatcacagtgggatcatggttctggccagaggaagaggcatccatccaagcagggtcacaggctgtcgaagagatggaatccgagactgaggaagagactatctttggaagttggttctgggatggcaaggaggtttctgaggaagctggcccatgctgcgtgtccaaacctgaggacgacgaagagatgatcgtggaatcatggttctggtctagagacaaggccattaaggagactggcaccgtagcgacctgtgaatcaaagccagaaaacgaggagggcgcgatcgtcggttcttggtttgaggctgaagatgaggtcgataacagaactgacaatggatccaactgcggcagtcgtaccctggccgacgaagacgaagccattgtgggttcatggttttgggctggagatgaggctcacttcgaatcgaatccgagcccggtcttccgcgctatttgtaggtccacgtgtagtgtggagcaagagccagacccttccagaaggcctcagtcatgggaggaggtgacagtgcagtttaaacccggtccctgggggcgcgtaggctttccatcgatttcccccttccgatttcccaaggaggctgccagcttgttctgtgaaatgttcggaggcaaaccccgcaatatggtgctttctcccgagggcgaggatcaggagtccctcttgcagcctgatcagccatcccccgagtttcctttccagtatgacccctcctataggtctgtccaagagatccgggaacaccttagggcgaaagagagcacagaacctgaaagtagctcttgtaactgtattcaatgcgagctaaagatagggagcgaagaattcgaggaactgctgctgctcatggagaaaatccgggatccgttcattcacgagatctccaaaatcgcaatgggtatgcggagtgcctcacagtttactcgcgatttcatcagagattctggcgtcgtgtcactcatagaaactcttctaaattatccgtcaagtagggtcagaacgtctttcctagagaatatgatacgcatggcaccaccctatcccaatttaaacatcatccaaacatacatctgcaaggtatgtgaagagactcttgcctactcagttgatagccccgagcagctatccgggatcagaatgatccggcatctgacaaccacaactgactatcatacattagttgccaattacatgagcggattcctttccttactggcaacaggcaacgctaaaacacgattccatgtactgaaaatgctgctcaacctgtccgaaaatttatttatgacgaaagaactgttgagtgccgaggctgtctccgagtttatcggactattcaaccgggaggagactaacgacaacatccagatcgtgctggctattttcgagaatattggaaataatatcaagaaggagaccgttttctctgacgatgactttaatatagaaccgcttatctccgcttttcacaaggtggaaaagttcgcaaaggaattgcagggcaagacagacaaccagaacgacccagagggagatcaggaaaactag

SEQ ID NO: 188714 - DNA, 1692 bp, Artificial Sequence
  Description of Artificial Sequence: Synthetic coding sequence
atggacttcggcagcctggagaccgtggtggccaacagcgccttcatcgctgcaagggggagtttcgacgggtcttcatcacaaccaagccgagataagaaatacctggctaagctgaagttgcccccgctgagcaagtgcgagtctctgagagacagcctttctctggagttcgagtccgtctgtctggaacaacccattgggaagaaattgtttcaacagtttctacagagcgctgaaaagcatctacctgctctagagctctggaaggatattgaagactatgataccgctgacaatgacctgcaaccgcagaaagctcaaaccattttggcccaataccttgatccacaggccaagctgttctgctctttcctggatgagggtatcgtcgcgaagttcaaagagggcccagtcgaaatccaggatggtctgttccagcccctgctgcaggccacgctcgcacatcttgggcaagcccccttccaagagtacctgggctccttatactttcttcgcttcctgcagtggaagtggctggaagcccagcctatgggagaggactggttccttgatttcagggtactcggaaaaggcgggtttggagaagtctccgcgtgccaaatgaaggcaactggaaaactttacgcctgcaaaaagttaaataaaaaacgactgaagaaacgcaagggataccaaggtgcgatggtggagaaaaagattctaatgaaggtacatagcaggtttatcgtttccctcgcctacgctttcgaaacaaaggcagatctctgtcttgtcatgacaattatgaacggcggagacatccggtaccacatctacaatgtaaacgaggagaatccggggtttcctgagccccgtgctctgttctatacggcacagatcatttgcggacttgaacacctgcaccagcgaagaatcgtttaccgtgaccttaaaccggagaacgtcttgttagataacgacggaaacgtgcggatttcagacctagggctggccgtcgagctgttagatggccagtctaaaaccaagggctacgccgggacccctggcttcatggcaccggaactgttgcagggtgaggagtatgatttctctgtcgactacttcgcacttggcgtgaccctatacgagatgatagcagcacgaggaccgtttcgggcacgcggcgagaaagtcgaaaataaggaactgaaacatcggatcatctcagagcccgttaagtaccctgataaattttcgcaggcaagtaaggatttctgcgaagcactgctggaaaaggacccagaaaaacgattgggcttcagggatgaaacctgcgataaattgagggcacacccactgttcaaagatctgaactggcgccagttggaagccggaatgctcatgcccccctttatcccggacagcaagacagtgtacgccaaggacattcaagatgtgggggcgtttagtacggtgaagggagttgcctttgacaagacagacactgagttctttcaggaattcgcgaccgggaactgccccatcccttggcaagaagagatgatcgagacaggcatcttcggagagctgaacgtctggcggagcgatggacaaatgcctgacgacatgaagggcatcagtggcgggtccagttcatcctccaagagtggcatgtgtctggtttcctag

SEQ ID NO: 188715 - DNA, 285 bp, Artificial Sequence
  Description of Artificial Sequence: Synthetic coding sequence
atgatcgccgcccggggccccttccgggcccggggcgagaaggtggaaaacaaggagctgaaacatcgtattatctccgagcctgtgaagtatccagataagttctcccaggcttccaaggacttttgtgaggcgttgcttgagaaggaccctgagaagagattgggatttagggacgagacctgcgacaagttgcgcgcgcacccccttttcaaagacctcaattggcgccagcttgaagccggaatgttgatgccccccttcatcccagactctaaaacttag

SEQ ID NO: 188716 - DNA, 228 bp, Artificial Sequence
  Description of Artificial Sequence: Synthetic coding sequence
atggagctggagaacatcgtggccaacaccgtgctgctgaaggccagggagggaggagggggtaaaagaaagggaaagtctaaaaaatggaaagagatattgaagttcccccacatatcacagtgcgaagacctccgtcgcacgatcggtgaactctcgggatcactcatctcttggtcaagtagcacaaaagaacatggacggccgacagagattaaaatgcgctag

SEQ ID NO: 188717 - DNA, 1458 bp, Artificial Sequence
  Description of Artificial Sequence: Synthetic coding sequence
atgaccaagtacctgacccccaagagccccgtgttcatcgcccaggtgggccaggacctggtatctcagacggaggagaaacttttacagaaaccttgcaaagaactgttttctgcctgtgcccagagcgttcatgagtatctgcgcggagagccattccatgagtatctcgactcgatgttctttgaccggtttctccagtggaaatggttggagcgccagcccgtgacaaaaaatacttttcggcagtaccgcgtgcttgggaagggcggattcggtgaagtgtgtgcatgccaggttcgggcgactggaaaaatgtatgcctgtaagaggctggagaaaaagaggattaaaaagcgcaaaggcgagtcgatggcgttgaatgagaaacagatattagagaaagttaacagtcagttcgtcgttaacctcgcatacgcctatgagacgaaagacgcattatgtttggttctcacaatcatgaatggcggcgacctgaagttccatatatacaacatgggcaaccccgggtttgaagaggagagggccctgttttacgccgctgaaatactgtgtggcctcgaggatcttcatagggagaatacagtctatagggacttaaagcccgagaacatcctgctggacgactacggacatatccgcattagtgacctgggacttgctgtgaaaattccggaaggcgacctcatacggggacgagtgggcacggtgggctatatggctcctgaggtcttaaataatcaacgctacgggctctctccagactattggggcctaggctgcctaatttatgagatgatcgaggggcagtctcccttcagggggcgcaaagagaaggtcaaaagagaagaagttgataggcgagtactcgagacagaggaggtgtacagccacaagttcagtgaggaggcgaagagtatatgtaagatgctgctgaccaaggacgccaagcagcgtctgggctgccaggaggaaggcgccgcagaagttaagaggcatcccttctttagaaatatgaactttaagaggctggaggctggcatgctcgatcccccatttgttcccgacccccgtgccgtgtactgtaaggacgtattggacatcgagcaattcagtaccgtgaagggtgttaatctggaccacaccgatgatgatttctacagtaagtttagcaccggaagcgtgagcattccttggcaaaatgaaatgatcgagactgagtgtttcaaggagcttaatgtgttcggtccgaacggcacgctcccccccgatttgaacaggaaccatccaccagagccaccgaagaagggattgttgcaacgactgttcaaacgccagcatcaaaacaattcgaagagctcgccctcctccaaaacctcatttaatcaccatatcaacagcaaccacgtgagcagcaatagcacagggtctagctag

SEQ ID NO: 188718 - DNA, 1773 bp, Artificial Sequence
  Description of Artificial Sequence: Synthetic coding sequence
atggagctggagaacatcgtggccaacaccgtgctgctgaaggccagagaaggcggaggaggtaagcgtaaagggaagtcgaagaagtggaaagaaatcctcaagttcccacatatttcacagtgcgaggacctccgaaggactattgaccgcgactactgctcactctgcgataaacagcctatcggtagactgctatttcggcagttttgtgagaccaggccaggattggagtgttacatacaattcctggactcagtggccgagtacgaggttacccccgacgagaaattgggtgaaaagggcaaagaaatcatgactaagtatcttacacccaaatcaccagtgtttattgcccaggtgggccaagacctagttagccaaaccgaagaaaagctgcttcagaaaccctgcaaagaactttttagtgcctgtgcgcagagcgttcatgagtacctccggggggagccattccatgagtacctggattccatgttctttgaccggttcctccagtggaagtggctggaaagacagccggttacaaagaacaccttccgtcagtatagggtcctgggtaagggcggctttggcgaagtctgcgcttgccaggttagagcaactggcaagatgtatgcctgcaagagactcgaaaaaaaacgtattaagaaacggaagggggagagtatggccttgaatgagaagcaaatcctcgaaaaggtcaactcacagttcgtggttaacctggcatacgcatacgagaccaaggacgccctctgcctcgtgctcacaataatgaatgggggcgacttaaaatttcatatctacaatatggggaacccaggctttgaggaagagagggctttgttctatgcggcagagattctttgtggcctcgaggaccttcatcgggagaataccgtgtatcgagacctcaagccagaaaacatacttttggacgactatgggcacatcagaatttcagacctgggcctcgctgttaaaattcctgaaggcgacttgatccggggcagagtgggtactgtcggatatatggctcctgaggtgctcaataatcaaagatacggcttgagccccgactattggggactgggttgcctaatctacgagatgatcgagggccagtctccatttaggggcaggaaggaaaaagttaaaagggaggaagtagacagaagagtactggagacagaggaggtgtattcccacaagttcagtgaagaagctaagtccatttgtaagatgctgctcacaaaggatgccaagcagcgcctggggtgccaggaggagggggcagcagaggtgaagcggcatccgttttttcgaaacatgaatttcaagcgcctggaagccggaatgctagacccgccgtttgtgcccgacccccgagcggtctactgcaaagatgtcctggatatcgaacaattctcaaccgtcaagggtgtgaatcttgaccataccgacgacgatttctatagtaagttcagtacaggcagcgtaagcattccctggcagaacgagatgatcgaaacagagtgcttcaaggaactgaacgtatttggtccgaacggtacactgccgcctgacttgaatcggaatcatcctcctgagcccccaaagaagggactcttacagcgcctctttaaacgacaacatcaaaacaatagtaagtcgagtccatcctcaaagactagcttcaaccaccacattaactccaaccacgtcagttccaattcgaccggcagctcctag

SEQ ID NO: 188719 - DNA, 1200 bp, Artificial Sequence
  Description of Artificial Sequence: Synthetic coding sequence
atgaccaagtacctgacccccaagagccccgtgttcatcgcccaggttggccaagatttggttagtcagacagaagagaaactgctacagaaaccatgcaaagagctctttagtgcttgcgcgcaaagcgtgcatgagtatctgaggggcgaaccttttcatgagtacctcgattctatgttcttcgacagatttttacagtggaaatggctcgagaggcagccagttacgaagaacacattcaggcagtaccgtgtgctggggaagggcggatttggagaggtatgtgcctgtcaggttcgcgccaccggaaagatgtacgcttgtaagcgtcttgagaagaagcgaatcaaaaagagaaagggagagtctatggccttgaacgaaaagcagattttggagaaagttaacagccagtttgtggtgaatctggcatacgcttatgagaccaaggatgccctgtgcctggtgttgacgattatgaatggaggagacttgaaattccatatttacaacatggggaacccaggatttgaggagggggccgcagaggtaaagagacatcctttctttcggaacatgaactttaaaagattggaggccggtatgctggaccctccgttcgttccagacccaagagcggtctactgcaaagatgtactggatatagaacaattttctacagtcaagggtgtgaatcttgatcacacggatgatgacttttactctaagttcagtacaggctccgtgtctatcccttggcaaaatgagatgatcgagacagagtgctttaaagaattgaatgtcttcggaccaaacggaaccctcccccctgatctaaatcggaatcaccctcctgagccgcccaaaaagggcttactacagaggttgttcaaaaggcaacatcagaacaattcgaagtcctccccttccagcaagtccaccgtggaacccgcacaaacactgctgcttagatctgggtcatccggggcacctgcacttgtaggcctgcctggcgaaacgcctggagccggggagggaggccgaccgtctcgacggaggcggacatcaagatttcttaaggagatctccacccaggtgtgcttccccagacggcccaggccaggttggattggctttgtcttcggggagcactgtaatcgcaatcctataggttacgacaatctacatgtattttag

SEQ ID NO: 188720 - DNA, 1731 bp, Artificial Sequence
  Description of Artificial Sequence: Synthetic coding sequence
atggagctggagaacatcgtggccaacaccgtgctgctgaaggcccgggaaggaggcggcggcaacaggaaaggcaagtccaagaagtggcgtcaaatgctgcaattccctcatatttctcaatgtgaggaactgaggctgagtctggaaagggattaccacagcctctgtgagcgccagcctatcggacgtctcctctttcgggagttctgtgctacaaggcctgagctaagcaggtgtgtcgcattcttagacggcgtcgccgagtacgaggtgacccctgacgacaaaaggaaagcatgtgggcgacagttaacccagaacttcctttcacacaccggacccgaccttataccagaagtgccccgacaactcgtaaccaattgtacacaacgcctggagcaggggccttgcaaggacctgtttcaggaactcactcgccttacccacgagtacctgtctgttgctcccttcgccgattacctagactctatttattttaacagattcctgcagtggaagtggcttgagcggcagccggtcactaaaaatacattccggcagtatagagttttagggaaaggtggtttcggggaagtttgcgcctgtcaggttcgcgccacaggcaagatgtacgcctgtaaaaagttagagaaaaaacggatcaaaaagcgaaaaggggaggctatggccctcaacgaaaagcagatcctagagaaagtcaactctcggtttgtggtcagccttgcctatgcgtacgagacaaaggacgctctctgtctggtactgactctgatgaacgggggtgacctcaaattccacatctaccatatggggcaggccggcttcccggaagctagagctgtgttctacgctgcagagatctgctgtggtctagaagatctgcaccgggaacgaattgtctaccgagatcttaagcctgaaaatattctgttggacgatcatgggcacataagaattagtgacttgggcctcgccgtgcacgtccctgaaggccagactatcaaaggcagagtgggaaccgtcgggtacatggctcctgaagtagtgaagaatgaacgatacacgttctcgccggactggtgggccctgggttgcttgctgtatgagatgatagctggacaatcacccttccagcagagaaagaagaaaatcaagcgcgaagaggttgagaggctagtgaaggaggtgccagaagaatacagcgagagattttcaccgcaggcaaggagcctgtgtagtcaactgctatgcaaagatccagcagaacgcctggggtgccgtggcggaagcgccagggaagtgaaagaacaccccttattcaagaagctcaacttcaaacggctaggggctggtatgctggaaccccctttcaaacctgatccacaggctatttactgcaaggatgtcctcgacatcgaacagttttcaactgtgaagggggtcgaattagaacccacggatcaggacttttaccaaaaattcgcaacagggtctgtacctattccctggcagaacgagatggtggagacggagtgtttccaggagctgaatgtgtttggcttggacggaagtgtaccgccggacctggactggaaaggccagcctccagctccgcccaagaagggactgttgcaaaggctctttagtcgacaggactgctgcggtaactgtagcgatagcgaggaggagctgccgacacggctgtag

SEQ ID NO: 188721 - DNA, 1683 bp, Artificial Sequence
  Description of Artificial Sequence: Synthetic coding sequence
atggagctggagaacatcgtggccaacaccgtgctgctgaaggcccgtgagggcggggggggtaacagaaagggcaaatctaaaaagtggagacagatgttacagttcccccacatcagccagtgcgaagagctacggcttagtttggaacgggattatcatagcttatgtgagcgccagcctattggtaggcttttattcagagaattttgtgcgacacgtcctgaactgtctcgttgtgtggcctttttggatggagttgcagagtacgaggtcactccggacgataaacgcaaggcttgcggccggcagctcacacaaaacttcctatctcacacggggccggacctcatcccagaggtgcccagacaattggtcaccaattgcacccagcgccttgaacaaggaccctgcaaagatttattccaggaattgacgcggctgacccacgaatatctttctgtcgccccgtttgctgactacctggattccatctatttcaaccggtttctgcagtggaaatggctcgaacggcagcctgttaccaaaaatacctttcggcaatatcgagtgttagggaaggggggcttcggagaagtgtgtgcctgccaggttagagctaccggcaagatgtatgcctgcaaaaagctggagaagaagagaatcaagaagcggaagggtgaggcgatggcattgaatgagaaacagatcttggaaaaggttaactctaggttcgtggtgagcttggcgtacgcatacgagactaaggatgccttgtgtctggtgctcacactgatgaatggcggagatctgaaattccacatatatcacatgggccaagctggttttcccgaggccagagcggtcttctacgccgcagaaatatgttgtggcctcgaagacctacaccgtgagcgcatcgtgtatagggatctgaagccggagaatatactcctggacgatcatggacacattcggatttctgacctaggactcgccgtgcacgttcctgagggccagactataaaaggacgcgtgggcacagtgggctatatggctcccgaggtcgtaaaaaatgagcgatacacattctcccctgactggtgggcccttgggtgtctgctgtacgaaatgatagctggtcagagcccatttcagcaacgcaaaaagaaaatcaaacgtgaagaggtggaacgcctggtcaaggaggtccctgaagagtatagcgaacggttttccccgcaagccagaagtttgtgcagtcagctgctgtgcaaggaccctgctgaacggctgggatgtagaggcgggtccgcgcgggaagttaaagagcacccactgtttaaaaagctaaatttcaagagacttggcgcgggcatgttggagccaccattcaagcctgatccgcaggccatctattgtaaggatgtgctggacatcgagcagttctccactgtgaaaggcgtagaattggagccgactgaccaggacttttatcaaaagtttgcaaccggatcggttccaattccgtggcagaatgaaatggtcgagacagagtgcttccaggagttgaacgtatttggcttagacgggagtgtgcccccagacctcgattggaaggggcagcccccagctcctccaaagaaaggtcttctgcagcgtctgttcagcagacagcgctag

SEQ ID NO: 188722 - DNA, 1770 bp, Artificial Sequence
  Description of Artificial Sequence: Synthetic coding sequence
atggagctggagaacatcgtggccaacaccgtgctgctgaaggcccgggagggcggtgggggaaaccgcaaaggcaagtcaaaaaagtggcgccaaatgctgcaattcccccacatcagccaatgcgaggaactcagactaagtttggaaagagattaccactcattatgcgaaagacaacctatcggccgcctgctgttccgcgagttctgcgccacaaggcctgaactgtcccggtgtgtggctttcctcgatggggtagccgaatatgaggtcacccccgatgacaagagaaaagcatgtggccgacagttgacgcagaacttcctgagtcacacaggcccagatctgatacccgaggtaccacgtcagctagtgacaaactgcacacaacggctggaacaggggccctgcaaggacttgtttcaggaactcacccgactcactcacgagtacctcagcgtcgctccatttgcagactacctggacagcatatacttcaaccgctttcttcaatggaagtggctggagcggcagcctgtaaccaaaaatactttcagacagtaccgggtgttgggtaaagggggtttcggggaggtgtgcgcatgccaggtgagggcgacgggaaagatgtacgcttgcaaaaaactcgaaaaaaagcgcattaagaaaagaaagggggaggctatggccctaaacgagaagcagatattagagaaagtgaatagccggttcgtcgtgtcccttgcttatgcctacgaaactaaggacgccttatgcttggtgctgaccctgatgaacggtggtgacttaaagtttcatatataccacatgggccaggccgggttccccgaggctagagcagtattctacgccgcggaaatctgttgcggccttgaggatctccaccgggaacggatcgtctaccgggatctcaagcctgaaaacatcctcctggacgaccatggacacattagaatttcagacctcggcctggcggtgcacgtcccggaagggcagaccattaaaggaagagtgggaacagtggggtacatggccccagaggtagtcaaaaacgagcgatacactttttccccggactggtgggccttagggtgtctcctatacgaaatgatcgcaggccagagtccctttcaacagcggaagaagaagatcaaaagagaggaagtagagcgattggtgaaagaagtgcctgaggaatattctgagcgtttctcaccccaggcacggtctctctgtagtcagctgctctgtaaggaccctgctgaacggctgggatgccggggagggtcagccagggaggtgaaggagcaccccttgtttaaaaaactgaacttcaagcggctgggggcgggaatgttagagccaccctttaagcctgatccacaggcaatctactgtaaggatgtgcttgatatagagcaatttagcacagtgaaaggtgtggagttggagcctacggatcaggatttttaccagaaatttgcaacaggctccgtacccatcccatggcagaatgagatggtggaaacagaatgcttccaagagttgaacgttttcggattagatggctccgttcctccagacctcgactggaaaggtcagccgccagccccacccaaaaagggcctgttgcagagacttttttcacgacagaggatagccgtggagaccgcagcaactgctagaaagtctagcccaccggccagctccccccaaccagaggcccccacctcatcctggagatag

SEQ ID NO: 188723 - DNA, 1662 bp, Artificial Sequence
  Description of Artificial Sequence: Synthetic coding sequence
atggtggacatgggcgccctggacaacctgatcgccaacaccgcctatctccaggcaaggaaacctagtgactgcgatagtaaagagctacagagaaggcgaagatccctggcgctacccggacttcaggggtgtgccgaactgcgacagaaactctcactaaatttccactctctgtgtgagcagcagccaatcggacgcaggctttttagagatttcctggctacagtgccaactttcaggaaggctgcgacctttctggaggatgtgcagaactgggagctggcagaggaagggcctaccaaggacagcgctttgcagggattagtcgccacatgcgcgtcggcccccgcacccggtaacccccagccgttcctgtcacaagcggtcgctacaaagtgccaggccgcaacgactgaggaagagagagtggccgcagtgacgttggcgaaggctgaagccatggcctttttgcaggagcagcctttcaaagacttcgtaacctcggcattttacgataagttcctgcagtggaaattgttcgaaatgcaaccagtgtccgacaaatactttacagagtttcgcgttttgggaaagggcggctttggagaggtgtgtgcggtccaggttaagaataccgggaaaatgtacgcctgtaagaaattggacaaaaaaagattaaagaaaaaaggtggagaaaagatggcactgctggagaaggagatcctggagaaggtatcctctccatttatagtgtctctggcttatgcttttgaatctaagacgcatttgtgcttagtgatgtccctcatgaatgggggcgacctaaagttccacatctacaacgtcggtacccggggcttggacatgtcaagggtgattttctatagcgcacagatagcgtgtggaatgctgcacctgcacgaactgggcatagtgtacagagatatgaaacctgagaacgtgcttctggacgatcttggtaattgccggttgagtgacctcggtcttgcagtcgagatgaagggcggtaagcccataactcagagggccggcacgaacggatatatggctccagaaatcctgatggaaaaagtttcttattcttaccctgtggattggttcgccatgggttgcagcatttatgagatggtcgctgggcgcacccctttcaaggactacaaggagaaagttagcaaggaagacctcaagcagcgcaccctccaggatgaagtcaaatttcagcatgacaatttcaccgaggaggccaaggacatctgccggctcttcctggcaaaaaagcctgaacagcggcttggctcacgagaaaaaagtgatgacccaagaaaacaccacttcttcaaaacaatcaatttccctagactggaggcaggcctcattgaacctcctttcgttcctgatcctagcgtggtctacgccaaggacattgccgaaattgacgactttagtgaagtgcgaggggtcgaattcgatgataaggacaaacagttctttaaaaattttgccaccggggcggtgccaattgcatggcaagaggaaattatcgagaccggactctttgaggagctgaacgatccaaaccgaccgaccggctgtgaagaagggaacagctccaaaagtggggtatgccttctgctgtag

SEQ ID NO: 188724 - DNA, 2088 bp, Artificial Sequence
  Description of Artificial Sequence: Synthetic coding sequence
atggaggagaagcccggccagccccagccccagcaccaccacagccaccatcacccacatcatcatccacagcaacaacagcagcagccacatcaccaccatcattattacttttacaatcacagccacaatcaccaccaccatcaccaccaccagcagccccaccagtacctccagcacggggcagagggctcacccaaagctcagcccaaacctctgaaacacgagcagaagcacactcttcagcaacaccaggagacaccaaagaaaaaaactggatatggggagctgaacggaaacgctggcgagagggaaattagtctcaagaatttgtcctccgacgaggccaccaaccccataagccgagtgctgaacgggaatcagcaggtggtggacaccagtttaaaacagaccgtgaaggccaatacattcggcaaagccgggataaagacaaagaattttattcagaaaaatagtatggataagaagaacgggaaatcttacgagaataagagcggcgagaaccaatctgtggacaagtccgataccatccctatccccaacggagtggtcacaaacaacagcggttatattaccaatggttacatgggtaagggcgccgataacgatggtagtggctcagagtctggctatacgactcccaagaaaaggaaggcccgacggaatagcgcgaaaggttgcgaaaacctgaatattgtccaggataaaatcatgcagcaggagacatctgtgcccacactgaaacaggggttggaaacatttaagccagattacagcgagcaaaaggggaacagggtcgatgggtctaaacctatttggaagtatgagacaggcccgggcggaaccagtcgcggtaagcccgcggtgggagacatgttacgcaaaagcagtgacagcaaacccggtgtctcaagtaaaaagtttgacgaccgaccaaaaggcaaacatgcttctgccgtcgccagtaaagaagactcctggaccctgttcaagccccctccagttttcccagtggacaatagtagcgccaagatagttccaaagattagctatgcaagcaaagtcaaggaaaacctgaataagacaatccagaattctagtgtgtcccctacttccagttcctcctcctccagttccaccggcgaaacacagacgcagagttcttcccgactttcccaggttcctatgagcgcgctaaaaagcgtaaccagtgccaatttttccaatgggcctgtactggctgggacagacggcaacgtgtatcctcccggtgggcagccactcttgactacagcggccaatactttgacgccaatctcctccggaaccgacagtgtgcttcaggacatgtctttaaccagtgctgcagtcgagcagattaagactagtctgttcatctatccttccaacatgcaaactatgttgctcagtactgctcaagtggacctaccatcacagactgatcagcaaaatctcggggatattttccagaatcaatgggggctatcctttattaatgaaccatccgcagggcctgagactgtgactggtaaatcctcagagcacaaagtcatggaagtcacgtttcagggtgaataccccgctacactcgtttcgcagggcgccgaaatcatcccaagtggtactgaacacccagtgttccccaaggcttacgaactcgagaaacgcacatccccacaagtgcttggttctattctaaaatccggaacaacgagtgaatccggagccttgtccctcgaacccagtcatatcggcgacttgcaaaaggcagataccagttcccagggagccctagtgtttctttctaaagactatgagatcgaaagccagaatcccctcgcttcacctaccaacacccttctgggatcggcgaaagaacagcgttatcaacgaggactggagcggaacgattcctgggggtcctttgacctcagggctgctatcgtgtaccacactaaagagatggagtccatctggaacctccagaagcaggatcctaagaggattataacatataatgaagccatggactctccagatcagtag

SEQ ID NO: 188725 - DNA, 534 bp, Artificial Sequence
  Description of Artificial Sequence: Synthetic coding sequence
atgagccggaagggcccccgggccgaggtgtgcgccgactgcagcgctcctgatcccggctgggccagcatcagccgcggagtgctggtatgtgacgagtgttgctcggttcatcggtctctaggtagacatatcagcatcgtgaaacatctgcggcactcagcctggcctccaacccttcttcagatggtacacacccttgccagcaacggcgctaattctatctgggagcattccttgctcgatccagcacaggtccagagcggtagaagaaaagccaatccacaagataaagttcacccgataaagagcgaattcatccgcgccaaatatcagatgctggcatttgtgcacaaacttccatgtagggatgatgacggcgtcacagccaaagatgacctaacaggacacaggtcttgggccacacctgacattaaccctcacccgaaccgagccactgggacttcagctttgtccgcggcaacacttccgggttcgcaggtcccctggtgcccgccactgagttccccctag

SEQ ID NO: 188726 - DNA, 2313 bp, Artificial Sequence
  Description of Artificial Sequence: Synthetic coding sequence
atgagccggaagggcccccgggccgaggtgtgcgccgactgcagcgcaccggatcccggctgggcgtctataagtaggggcgttctcgtatgcgatgagtgttgttctgtgcaccgatccctgggccgacatatctccatagtgaagcacctgcgccactcggcatggccgcccaccttgctgcagatggtgcatactcttgcctccaacggcgctaactctatttgggagcatagtctactcgatcctgcccaggtccagagtgggcgaagaaaggccaatccccaggataaggtgcaccctataaaaagcgaattcattagggctaaataccagatgttggcattcgttcacaaattaccttgtagagacgatgacggcgtcactgccaaagatctcagcaagcagttacacagcagcgtgcgtacagggaatctcgaaacttgcctgcgcctgctgtcgctgggcgctcaagccaacttctttcatccagagaagggtacgactccacttcatgtggcagctaaagctggccagacactgcaggcggagctcttagttgtttacggggctgatccaggtagtcccgacgtcaatggaaggacaccaatcgactacgcaaggcaggctggccaccacgagttggccgaacggctggtcgagtgtcagtacgagcttaccgaccgcctagcgttctacttatgcggacggaagcccgatcataagaacgggcattacatcatccctcagatggccgatcggtccaggcagaagtgcatgagccagagtctagatctcagcgagttggctaaggctgctaaaaagaaactacaggccctgagcaataggctgttcgaggaacttgcaatggatgtttacgacgaggttgaccggagggaaaacgatgccgtctggctcgccacccagaaccattcaacactagttacggaacgcagcgccgttccctttctgccggtgaacccggagtattccgccacccgaaaccaaggtcggcagaagctggcccggtttaatgcccgcgaatttgctacacttatcatcgacattctctccgaagccaagagaaggcagcagggaaagtctctgagctcaccaactgataatctcgagttatcattgcggtcacagagtgaccttgatgatcaacatgattacgactctgttgcaagcgatgaagatactgatcaggagcccctgcgatcaaccggagcgacccgctccaacagagctcgttcgatggatagctccgatctctccgatggggctgtgacattgcaggaatacctcgaattaaaaaaggcgctcgccacatcagaggctaaggtgcagcagttgatgaaagttaacagttctctgtcagacgagctacggcgactgcaaagagaaatccacaagctgcaggccgagaatctacaactgcggcaaccacccgggccggtccctacaccaccattgccctcggagcgcgctgaacacacaccgatggcgcccgggggttcaacgcaccggagagatagacaagctttctccatgtacgagcccggcagtgccctcaagccgtttggtggcccaccaggcgacgaactgaccactcggctgcaaccgtttcattcaacggagctggaagatgatgccatctacagtgtgcacgtcccggcgggtctgtaccgtataaggaagggagtgtctgcctcagctgtgccgttcacaccctcttctcccctcctcagctgttcccaagaagggagccgacatacatccaaacttagcaggcatggctccggcgcagactcggactatgagaatacccaatccggagatcccctcctgggccttgagggaaagagatttctggaactggggaaagaggaggatttccaccctgaactggaatccctggatggggatctcgacccaggacttccatcgacagaggacgttatcctgaaaacggagcaggtaacaaaaaacatccaggaattgttaagagctgcccaggagtttaaacatgattctttcgtgccttgttcggagaaaatccacctcgcagtcaccgaaatggcctctctgtttcctaagaggccagcactcgagcccgtccggtcgagccttagacttctgaacgcgtcagcatacagactacaaagtgagtgtagaaaaaccgtccctcctgagcctggtgcccctgtagatttccagctcctgacccagcaggtgatccagtgcgcatatgatattgcaaaggcagcgaaacagctggttaccattaccacgagagagaagaaacaatag

SEQ ID NO: 188727 - DNA, 1212 bp, Artificial Sequence
  Description of Artificial Sequence: Synthetic coding sequence
atgttcgtggccagcgagcggaagatgcgggcccaccaggtgctgaccttcctgctattattcgtaatcacctccgtggcaagtgagaatgccagtaccagccggggctgcgggctggacctcctcccccagtacgttagcctctgtgatctggacgctatctggggaattgttgtggaagccgtcgcgggggcaggagccctaatcaccctgttgctgatgctgattcttttagtgcgactgcctttcattaaagaaaaggagaagaagagtccagtcgggctccactttttattcctgttaggaacgctcggactttttggccttaccttcgcttttataattcaggaagacgagactatatgctctgtccgacgtttcttgtggggcgttctcttcgcactttgcttctcttgtctgctgagccaagcttggcgggtgagacgtctcgtacgccacggcaccgggccggccgggtggcaactagtgggtctggccttgtgcctaatgctggtgcaggtgataattgccgtggagtggctcgtcctgactgttctccgtgatacccggcccgcttgcgcttatgaacctatggacttcgtaatggcactaatttatgatatggttttacttgtggttacacttggattggcactctttacgctgtgtggaaaatttaagcggtggaagctgaatggcgcattcttgttgatcacagctttcttaagcgtacttatttgggtcgcatggatgactatgtacctatttggcaatgtgaagctgcagcagggggatgcatggaacgaccctacactggccatcactctcgctgcaagtggctgggtgttcgtgatatttcatgctatacctgagattcattgtactctcctgccagctctccaggagaacacccctaattattttgacacctctcaaccacgaatgagagagacagcttttgaggaagatgtgcagctccctcgcgcctatatggaaaacaaagccttcagcatggacgagcataacgccgctctcagaaccgccggattcccaaatggctccctcggaaagagaccatctggatcgctcggaaagcgcccctcagcacccttcagatcgaacgtgtaccagcccacggaaatggcagtcgtgctgaacgggggtacaattcctacagccccaccgagccatacaggcaggcacctgtggtag

SEQ ID NO: 188728 - DNA, 1215 bp, Artificial Sequence
  Description of Artificial Sequence: Synthetic coding sequence
atgttcgtggccagcgagcggaagatgcgggcccaccaggtgctgacatttcttctactcttcgtgattacatcagttgcaagtgagaacgcaagcacgagccgcgggtgtgggctcgatcttcttccacagtacgtcagcttgtgtgatctggatgctatctggggtattgttgtcgaagccgtggctggcgccggggctcttatcacacttttgctcatgttaattctcctagtgcggctgcctttcataaaagagaaagaaaaaaaaagccctgtggggttacactttttgtttctcctggggacattaggcttgttcgggctaacctttgccttcataatccaggaagacgaaacgatttgtagtgtccgccggtttctgtggggcgttcttttcgctctgtgttttagttgcttgctctcacaggcatggagggtcagacgtctggtgagacacggaactggcccagccggctggcagctggtaggcctggcactttgcctgatgctcgtccaggttataatagccgtggaatggttggtgctgaccgtgctacgggatactcgccccgcgtgcgcgtacgaaccaatggatttcgttatggccctaatctatgatatggttctgctggtcgtcactctcggccttgccctattcaccctctgcggaaaatttaagagatggaagttaaatggcgccttcctgctcattacggcctttctgtccgtactcatctgggtggcctggatgacaatgtatctctttggcaacgtcaagctccagcagggggatgcctggaacgatcctacactggccattaccctggcagccagtggctgggtctttgtgatatttcacgcaatcccagagattcattgcacgcttctgcccgccctgcaggagaacacgccaaactactttgataccagccagccgcgcatgagggaaacggctttcgaagaagatgtgcagctgcctagagcgtacatggagaacaaggctttctcaatggacgagcataatgctgccctcaggacggccggttttcccaacggttcactgggcaaaagaccctccggatcactgggaaaaagacccagtgctccatttcggtcaaacgtgtaccagccaacagagatggcggtggtcttgaacggcggcaccgaaatggtgactcatccgcgcagcctggagagtttcggcgctttctag

SEQ ID NO: 188729 - DNA, 1290 bp, Artificial Sequence
  Description of Artificial Sequence: Synthetic coding sequence
atgaaccccccctggagcgtggcctggggccaggagggcttccgggctgggactccggggtctcgctacctgccgaggatgtttgtagcctcagagcggaaaatgagggcccaccaagttctaacttttttactgttgttcgtcatcacaagtgttgcatctgagaatgcatccacatccagggggtgtgggttggatctgctcccgcagtacgtgagtctctgtgatttggatgccatctgggggattgtggttgaggccgttgctggtgccggagctctcattacacttcttttgatgctaatcctgttggtgcgcctgcccttcatcaaggaaaaggaaaagaagtctcctgtggggctgcattttctcttcctgctggggactctcggcttattcggactgaccttcgccttcattattcaggaggatgaaacaatatgcagcgttagaagatttctgtggggagtgttgttcgccctgtgctttagctgtctcctgtcccaggcctggcgagtgcgcagattagtgagacatggcaccgggcccgccggatggcagcttgtgggccttgctctctgcctaatgttagtccaggtgatcatcgccgtggagtggcttgtcctgaccgttctgagggacactcgtcctgcatgtgcgtatgaacccatggactttgttatggctcttatttacgacatggtgctgctggtggtgactcttggactcgcattgttcacactatgcgggaaatttaaaagatggaagctcaatggtgccttcctgttgatcactgccttcctctccgtacttatctgggtcgcatggatgactatgtacctttttggcaacgtgaaactccagcagggagatgcatggaacgatcccaccttggccattacactggccgcctctgggtgggttttcgtgattttccacgcaattcctgagatccattgcactttgctgccagcactgcaagagaacacgcctaactactttgacacaagccaacctcggatgcgggaaactgcatttgaagaggacgtccagctcccccgagcttacatggagaataaggcattttctatggacgagcataatgcagctctgagaaccgccggctttcccaacggttcattgggcaaaagacctagcggcagcctcggcaaacggccttcagccccttttcggtcaaacgtgtatcagccaactgaaatggctgtcgtccttaacggagggactatccccacagcgccaccgtcacataccgggcgccatttgtggtag

SEQ ID NO: 188730 - DNA, 759 bp, Artificial Sequence
  Description of Artificial Sequence: Synthetic coding sequence
atgttcgtggccagcgagcggaagatgcgggcccaccaggtgctgactttccttcttcttttcgtcatcaccagcgttgccagtgagaacgcctctacttcacggggctgcggtttggacctgctgccccagtacgtgtctctgtgtgacctagatgccatttgggggattgtggtggaggccgtggccggcgcgggggcactgataaccctgctcctcatgcttatactattggttcggttgccatttttcctgctcataactgcattcttatcagtcctgatctgggtggcttggatgacaatgtacctcttcgggaacgtcaagctccagcagggcgatgcttggaatgacccaacattagctattactttggctgcaagcggttgggtcttcgttatttttcatgctatcccagagatacactgcactttgcttcctgccttgcaggaaaacacacctaactattttgacactagtcagcctcggatgcgagaaactgcctttgaggaagatgtccagctgccgagagcctacatggagaataaggctttctcaatggacgagcacaatgccgccctgaggacagctggattccccaatgggtctctgggcaagagaccgtccgggtcactgggaaaaaggcccagtgcgccctttagaagcaatgtgtaccagccgacagaaatggccgtggtgctcaatggtggaactatccccaccgccccccccagccacaccgggagacacctgtggtag

SEQ ID NO: 188731 - DNA, 489 bp, Artificial Sequence
  Description of Artificial Sequence: Synthetic coding sequence
atggccatccacaaggccctggtgatgtgcctgggcctgcccctgtttctgttccccgaacaaagctaccaaggcgatatgtatcccacccggggcgtgggttacgagaccattctcaaggagcagaagggtcagagcatgtttgtcgagaataaagcttttagtatggacgaaccagtggccgcgaagagaccggttagcccctacagtggctacaatggacagttattgacgtccgtgtatcaacccacagaaatggccctcatgcataaggtcccaagtgagggagcctacgatatcattttacctcgggctaccgcgaacagccaggtaatgggatccgctaatagcacactgcgtgccgaagatatgtattcagctcagagccatcaggccgccactccccccaaggatggtaagaactcacaggtgtctgagctgacacagaggggccaggccaacactaaccaggtgtttttaagactttag

SEQ ID NO: 188732 - DNA, 1461 bp, Artificial Sequence
  Description of Artificial Sequence: Synthetic coding sequence
atgcggggccggggcagccagcagcagcagcccacccggcggcagggtcagaaactgccatcaccaagccctgcagggaaatacgagtctgcacagcccgggggcactcagccagaacccggactaggcgcccggatggctattcataaagccctggtgatgtgtctcggacttccgctgttcttgttcccaggtgcatgggcgcaaggacacgtgcctcccggttgtagccaggggttaaacccactgtactacaatctgtgcgacagatccggggcatggggcatcgtgctggaagcagtagccggagctggtatcgtcaccactttcgttctcaccatcattctggtggcttcactgccgtttgtgcaggatactaagaagcggtctttgttaggaacacaggttttttttctccttggcacactcggcctgttctgtctagtcttcgcctgtgtggtgaaacccgacttctctacttgtgcctcacgtaggttcctgtttggcgttctcttcgccatttgttttagttgcttggccgcccacgttttcgctctgaactttctggcgagaaaaaaccacggccccagggggtgggtgatttttactgtggccttactccttactttggtggaggttattatcaacaccgagtggcttatcatcacactggtgcgggggagcggcgagggcgggccacagggaaacagttctgccggctgggctgtggcatctccctgtgcaatagcaaacatggattttgtgatggccctgatttatgtgatgcttctgttattaggggctttcctaggcgcatggcctgcgctttgtgggagatataaacgctggcggaagcacggagtgtttgtgctgcttactaccgccacatccgtcgccatctgggtggtctggatcgtgatgtatacttacgggaataaacagcacaacagtccaacttgggacgaccctacccttgccattgcccttgctgctaacgcttgggcgttcgtactgttctacgtgattccagaagtgagtcaagtcactaagagcagcccggaacagagctatcagggcgacatgtacccaacacggggtgtcgggtacgagactatcctcaaggagcaaaagggtcagagcatgtttgttgaaaacaaggcctttagcatggacgagccagtggcagctaagcggccagtatccccatacagtggatataatggccagctcttgacctctgtgtaccagcccacagagatggctttaatgcataaagtcccttctgagggcgcatatgacatcatcctaccccgggccacagcaaattcacaagtgatgggaagtgccaatagcacactccgggcggaggatatgtattcggctcagagccaccaagccgcaacccctccaaaggacggcaagaactctcaggtcttcaggaatccatacgtctgggattag

SEQ ID NO: 188733 - DNA, 1326 bp, Artificial Sequence
  Description of Artificial Sequence: Synthetic coding sequence
atggccatccacaaggccctggtgatgtgcctgggcctgcccctgtttctttttcccggagcttgggcccagggtcacgtaccccctggctgtagccagggactgaatccactgtactacaatctgtgtgaccgaagtggtgcttggggcatcgtcctcgaggcagtagccggtgccggaatcgtaaccactttcgtgttaacaatcattctcgtggccagcctcccattcgttcaggataccaagaagaggtctcttctggggacccaggtgttcttcctgctcggcaccttggggctcttttgcttggtcttcgcatgtgtcgtcaaacctgacttcagtacttgtgcatcaaggaggtttctgttcggtgttctctttgccatctgtttctcttgtttggcggcccatgtgtttgcattgaatttccttgccagaaaaaaccatggcccccggggatgggtgatcttcaccgtggctcttcttctgactctggtggaggtgataatcaataccgagtggctcatcattacactggtccgaggatctggagaaggtggacctcaaggtaattccagcgccgggtgggccgtcgcttccccttgtgcaatagccaatatggatttcgtcatggcactcatatacgtgatgctattgctgctcggagcattcctcggcgcctggcctgccctctgcggaagatacaaaaggtggagaaaacatggggtgttcgtcctgctgactacagccaccagcgtcgctatatgggtggtatggatcgtgatgtacacctatggtaataaacagcacaactcacctacatgggacgatccaaccttggccatcgccctggcagcgaatgcatgggcgtttgtgctcttttatgttatacctgaagttagccaagtgactaagtcttccccagaacagtcctaccagggggatatgtatcctacccgtggagtcgggtacgaaaccattcttaaagaacagaaggggcagtcaatgtttgtggaaaataaggcgttttcaatggacgaaccagtcgccgctaaacgccctgtgagcccctattctgggtataatggacaactgctgacatctgtttaccagcccacggagatggctctgatgcataaagtgcccagtgagggggcgtatgacatcatcctcccacgcgcaacagccaacagccaggtgatgggttccgccaattcgacattgagagcggaagacatgtattcagctcagagccatcaggccgctacccctccaaaagatgggaaaaattcacaggtatttcgcaacccctacgtgtgggattag

SEQ ID NO: 188734 - DNA, 1329 bp, Artificial Sequence
  Description of Artificial Sequence: Synthetic coding sequence
atggccatccacaaggccctggtgatgtgcctgggcctgcccctgtttctgtttcctggagcctgggcacagggtcacgtccctccgggatgtagtcaggggctgaatcccctctattataacctctgtgacagaagtggtgcttggggaattgttctggaggcagttgccggagccggtatcgtgacaacatttgtgctcacaattatacttgttgcctctctccctttcgtgcaggacacaaagaaacggtcactgctggggacccaggtgtttttcctcctgggaacactgggacttttctgtcttgtcttcgcttgtgtcgtaaagcccgatttcagtacctgtgcgagtcgcagattcttatttggggttctgttcgctatatgcttttcctgtcttgccgcccatgtgtttgccctcaatttcctggcgcgcaagaaccacggccctcgagggtgggtgatatttactgttgcgctgctgctgactcttgtcgaggtgattatcaacacggagtggctcataatcaccctcgtgagggggagcggtgaggggggaccacagggaaacagctccgccggctgggcagtggcttcgccgtgcgccattgctaacatggattttgttatggctcttatatacgtcatgttactgctgctcggcgcctttctcggggcatggcccgccctttgcggccggtataaacggtggcgcaagcacggtgtctttgtgttactgactaccgcaacttcagtcgcaatttgggtggtttggattgtcatgtatacctacggaaacaagcagcataatagtccgacttgggatgaccctactctggcaattgccctcgctgcaaacgcatgggctttcgtccttttctatgtgattcctgaagttagccaggtcaccaagtccagccctgagcaatcctaccaaggtgatatgtacccaactaggggcgttggctacgagactattctgaaagaacagaagggacagtccatgtttgtagaaaataaggctttctccatggatgaacctgtggccgctaagcgtcctgtgagtccatatagcgggtacaacggccaacttttgacgagtgtctatcagccaaccgagatggctctgatgcacaaggtgccgagtgagggagcctacgacattatcttaccccgcgccacagccaacagtcaggtgatgggctcagcaaattccaccctgcgggctgaagatatgtactccgcacagtcacaccaggccgcaaccccaccaaaagatgggaagaatagtcaagctcagtcccctcagtctaaaacccgatggtag

SEQ ID NO: 188735 - DNA, 1362 bp, Artificial Sequence
  Description of Artificial Sequence: Synthetic coding sequence
atgggcacccagcccgagcccggcctgggcgcccggatggccatccataaggctctggttatgtgcctcgggcttcctctctttctgtttccaggagcttgggcccagggacatgtgcccccggggtgctcacagggactaaaccctttgtactataatctgtgcgacagatccggggcctggggcatagttcttgaggccgtggcgggagcaggtatcgtgacaacttttgtgctcacgatcattctggttgccagcctgccttttgtgcaggacaccaagaaacgaagcctactcggaacgcaggtgttctttttgttaggcactctggggctattttgtctagtttttgcatgtgtggtgaagcctgactttagcacctgcgccagccggcggttcctgtttggagttctgttcgcaatctgcttttcttgtttggcagcgcacgtctttgcacttaattttctcgcccggaaaaaccatggaccccgcgggtgggtgattttcacagtagcactcctgttaactctcgtagaggtcataattaacactgagtggctgattattaccctggtgagaggctccggcgagggagggccacaaggaaacagcagcgcaggatgggccgtagctagcccctgtgccatcgccaacatggacttcgtcatggctctgatctatgtaatgctgcttctgctgggggcctttttgggtgcctggcccgctttatgtggacgttacaaacgctggcgcaagcacggtgtgtttgtccttctgacgaccgcgacttcagtggccatctgggttgtgtggattgtgatgtatacatacggcaacaaacagcacaattctccaacatgggatgaccccacacttgccatcgctctggcggcgaacgcatgggctttcgtcctgttctacgtgattcccgaagtctctcaagtgacaaagagtagcccagaacagtcatatcaaggggatatgtaccccacccggggggttggatacgaaaccattctcaaagagcagaaggggcaatccatgtttgtggaaaataaagccttttctatggatgagcctgtagctgctaagcggccagtttcgccgtactctggatacaacgggcagttgctgactagcgtgtaccaacctacggagatggcgctaatgcataaagtgccgtcagagggagcatatgatatcattttacctcgcgcgacagctaactcccaagttatgggcagcgcaaacagcacactgcgtgccgaggatatgtacagcgcacagagtcaccaagctgctacacccccaaaggatggtaaaaactcccaggtgttcagaaatccatatgtgtgggactag

SEQ ID NO: 188736 - DNA, 597 bp, Artificial Sequence
  Description of Artificial Sequence: Synthetic coding sequence
atgagcaacgtgcgggtgagcaacggcagccccagcctggagcggatggatgctcgccaagctgagcatccaaagcccagcgcttgtcgaaacctcttcggccccgtcgaccacgaggagttgacccgcgatctggaaaagcattgtcgcgacatggaagaggcttcccagcgtaagtggaacttcgattttcagaatcacaaacccctggagggaaaatacgagtggcaggaagtcgagaagggcagcctgccagaattctactaccgccccccgaggccaccgaaaggcgcttgcaaagtgccggctcaggagtctcaggacgtgtctggctcgaggcccgcagctccgttgattggtgcacccgctaacagtgaagacacgcacctggtggatccaaagactgacccaagcgactcccagaccggcttggctgaacagtgtgccggcatccgaaaacgacctgcaactgatgatagttccacccaaaataaaagggccaatcggaccgaagagaatgtctcagacggatcccccaatgcgggcagcgtcgagcagactccaaagaagcctgggctaaggagaagacagacatag

SEQ ID NO: 188737 - DNA, 903 bp, Artificial Sequence
  Description of Artificial Sequence: Synthetic coding sequence
atgtacaaggactgcatcgagagcaccggcgactacttcctgctgtgtgatgccgaggggccctgggggatcatactcgagtccttagcaatcttgggcattgttgttactatcctgctgctgctggcatttctgtttcttatgaggaagatccaggattgtagtcagtggaacgtactgcccactcagctcttgtttctcctatccgtcctcggattgtttggactcgcattcgccttcatcattgagctcaaccaacagacagctcccgtccgctacttcctgtttggagtcctgttcgcattgtgcttcagttgcctgcttgcccacgcaagtaacctcgtgaaactggttcgaggctgcgtgtccttctcctggacaaccatcctgtgtattgccattgggtgtagcttactgcagatcatcatagctacagaatacgtgacactgattatgacccgcggcatgatgtttgtgaacatgacgccgtgtcagctgaacgtggacttcgtggtgctgctcgtttatgtcctcttccttatggccttgacttttttcgtatcaaaagcaacgttttgtggcccttgcgagaattggaagcaacacggacggttgatattcattaccgtgctgttctcgatcattatctgggtggtgtggatcagcatgctcctgaggggcaatcctcagttccaaaggcagccacagtgggacgaccccgtcgtgtgtatcgccctcgtcaccaacgcctgggtattcctgctgctttatattgtgcccgaattgtgcatattgtataggtcctgtcgccaagaatgtccactccagggtaacgcctgtccagtgactgcttaccagcattcattccaggttgaaaatcaagaactgtcaagggattgctag

SEQ ID NO: 188738 - DNA, 363 bp, Artificial Sequence
  Description of Artificial Sequence: Synthetic coding sequence
atgtacaaggactgcatcgagagcaccggcgactacttcctgctgtgcgacgcagagggaccctgggggatcattcttgagtctctggcgatcttgggtattgttgtgaccatactgctgttgctggcctttcttttcctaatgcgaaaaattcaggactgtagtcagtggaacgttcttccgacacagctgctgtttctgctctctgtgctgggcctgttcggactcgcctttgcctttatcatcgagcttaatcagcaaacggcaccagtccggtattttctatttggtgttctgtttgccctgtgctttagctgcctccttgcccacgccagtaacttagtcaaactggtgcgaggatag

SEQ ID NO: 188739 - DNA, 312 bp, Artificial Sequence
  Description of Artificial Sequence: Synthetic coding sequence
atggagaccgtgcaggagctgatccccctggccaaggagatgatggcccagaaacgtaaaggaaagatggtgaagctgtatgtattaggcagcgtgctcgcactcttcggtgtggtgctcggcctgatggaaactgtttgttcaccctttacagccgctcgcagactgagagaccaagaggctgctgtggccgagttacaggccgccctggagcgccaggcactccaaaaacaagcgctccaggagaagggcaagcagcaggataccgtgctgggaggacgcgcactctccaacagacagcatgccagttag

SEQ ID NO: 188740 - DNA, 1500 bp, Artificial Sequence
  Description of Artificial Sequence: Synthetic coding sequence
atggagctgagcgagcccatcgtggagaacggcgagaccgagatgtcccccgaggagtcttgggaacataaggaggagatttcagaggccgagccgggtggaggaagcctcggggatggcaggccacccgaggaatctgcgcacgaaatgatggaggaagaggaggaaatcccaaagcctaagtcagttgtggccccacctggcgcacctaaaaaggagcacgtgaatgtggtcttcattggccatgtggacgctggcaagtcaaccattgggggacagatcatgtatctcacgggtatggttgataaacggacacttgagaaatatgaaagagaggcgaaggaaaaaaatcgggaaacttggtatctatcatgggcattagacacaaatcaagaggagagagacaagggaaaaaccgtcgaggtagggcgggcatacttcgagacagaaaagaaacattttaccattttagatgccccgggccacaagtcctttgttcccaacatgataggtggcgccagtcaggccgacttggccgtgctcgtcatatccgcgaggaagggagagtttgagacgggcttcgagaaggggggacagaccagggagcatgcgatgttggccaaaaccgctggcgtaaagcatctgatcgtgctgatcaacaaaatggatgatcctacagtgaactggagcaacgagcgatacgaagagtgcaaagagaagctggtcccatttctcaagaaagtcgggttcaatcccaaaaaggatattcattttatgccctgttcagggctgaccggcgccaaccttaaagagcagtccgatttttgtccatggtatattggtctcccgttcataccctatcttgacaatctgcccaattttaatcggagtgttgacgggcctatacgtctgccaattgtcgataagtacaaagacatgggaaccgtggtgctggggaagcttgaatctggttctatctgtaaaggacagcagttggtgatgatgccaaataagcacaacgtggaagtgctgggtatcctgagtgacgatgtggaaaccgacaccgtagcccccggagagaacctcaagattagactgaagggtatcgaggaagaagagattctcccgggcttcatcctttgtgaccccaataacttatgtcatagcgggaggacattcgacgcccaaatcgtgatcatagagcacaagagtataatatgtcccggctataacgccgtcctgcacattcacacctgcatcgaggaggtggaaatcactgcgctgatttgcttggttgacaagaagagcggagagaagtctaagactagacctcgattcgttaagcaggaccaggtttgcatcgcacgcctgcggaccgccggaaccatctgtcttgagactttcaaggattttccccagatgggacggtttacacttagggacgaagggaagacgattgcaattggtaaggtgctgaagctggttccagagaaagattag

SEQ ID NO: 188741 - DNA, 1914 bp, Artificial Sequence
  Description of Artificial Sequence: Synthetic coding sequence
atggaccccggcagcggcggcggcggcggcggcggcggcggcggcggaagcagcagcggctctagctcttctgactccgcaccagactgctgggatcaagccgacatggaggcccccgggccagggccatgtggcggtgggggaagtttggcagctgcggccgaagcacaacgcgagaacctcagcgccgctttctcacgacagctgaatgtgaatgccaaacctttcgtgccaaatgtgcacgctgctgagtttgtcccgtcgttcctgagggggccggcagctcctcctcctccagtggggggggccgctaataatcacggtgctggatctggagcaggaggaagagccgcgcctgtcgagagtagccaagaggagcaaagcctttgcgaaggttcaaattctgcagtcagcatggaactgagcgagcccattgtggaaaacggtgaaaccgaaatgtctcccgaggagtcctgggaacataaggaggagatctccgaagcggaaccaggtggcggaagcctaggggacgggcggccaccggaggaatctgcgcacgagatgatggaggaggaggaggaaataccaaaaccgaagagcgtggttgctcctccaggcgcacccaaaaaggaacatgtaaatgtcgtcttcatcgggcatgtggacgccggcaaaagcaccataggtgggcaaataatgtatctcacaggaatggtggacaaacgtactctggagaagtatgagagggaagcaaaagagaaaaatagagaaacctggtacttgtcatgggccctggacaccaaccaagaagagcgggacaaaggcaagaccgtggaggtcggaagagcctactttgagactgagaagaagcatttcactatccttgatgccccaggccacaaatcgttcgtgcctaacatgataggtggcgccagccaagctgacctggctgtacttgtgatcagtgctcggaaaggggagttcgaaaccgggtttgaaaaagggggacaaacaagagaacacgccatgctcgcaaagactgccggagtcaaacatctgattgtgctgattaataagatggatgatcccaccgttaattggtcgaacgaaaggtacgaggaatgcaaggagaagcttgttcctttcttaaaaaaggtaggtttcaacccaaagaaggacatccatttcatgccctgttcaggcttgacgggcgcgaacctcaaggaacagtcggatttctgcccctggtatattggacttccattcattccctatttagataatcttcctaattttaataggtccgtggacggcccaattagactgccaatcgtcgacaagtacaaggacatgggcacagtggtattgggaaagttggaatccggctctatttgcaagggtcagcaactggtgatgatgccaaataaacataatgtcgaggtactgggaatcctgagtgatgacgtcgagaccgacaccgtggcccctggagaaaacctcaagatacgcctgaagggcattgaggaggaggaaattctgcctggcttcatactctgtgacccaaacaatctctgccacagcggacgaacattcgacgctcagatcgtgattatcgagcataagtctattatttgccccgggtacaacgccgtgttgcacattcacacttgcatagaggaggtggaaataaccgcacttatctgcctggtggataaaaagagtggagaaaagagtaaaaccagacctcgttttgtaaagcaggaccaggtatgtatcgcacgtctgagaaccgccgggaccatctgtttggagaccttcaaggattttccacagatggggcgcttcactcttcgcgacgaggggaagacaattgctattgggaaagtccttaaactggtgcctgagaaggattag

SEQ ID NO: 188742 - DNA, 1911 bp, Artificial Sequence
  Description of Artificial Sequence: Synthetic coding sequence
atggaccccggcagcggcggcggcggcggcggcggcggcggcggcggctctagctcaggctcatcaagtagcgatagcgcccccgactgctgggaccaggccgacatggaagctccgggtcccggaccctgcggaggcggtggttctctcgccgccgccgctgaagcacagagggagaacctgtctgctgcatttagtcgccagctcaatgtgaatgctaagccgttcgttcccaatgtacatgctgctgagtttgtccccagctttctgcggggacctgctgcaccccctcctccagttggcggcgctgctaacaaccacggagcgggctccggtgccggagggagagccgcgccagtggagtcatcacaagaagaacaatcactgtgcgagggatcaaattctgccgtctccatggagcttagcgagcccattgagaatggagagacagagatgagtcctgaagagagctgggagcacaaggaggagattagcgaagccgaacccggggggggctccctcggcgatggaagaccgcctgaggagtccgcccatgagatgatggaagaggaggaggaaataccaaagcccaaaagtgtggttgcaccacctggcgcgcctaaaaaggagcacgtcaacgtcgtcttcatcggacatgtggatgccgggaagtctacgatcggcgggcagattatgtaccttaccggcatggtggacaagcgaactctggagaaatacgagcgggaagctaaggagaagaaccgagaaacttggtatctgtcctgggctcttgacacgaatcaggaggagcgtgataagggaaagactgtggaagtcggtcgggcctatttcgaaaccgagaaaaaacacttcaccattctcgatgcacccggacacaagtccttcgtccctaatatgataggcggggcgtctcaggccgaccttgctgttttggtaatctcagccaggaagggcgagtttgagactggatttgaaaaaggtggacagacacgggagcacgcaatgctggccaaaactgccggagtgaagcatctgattgtgctcatcaataagatggacgaccctaccgtgaattggtctaacgagagatacgaagagtgtaaagaaaaactcgtcccctttctcaaaaaagtgggctttaatccgaaaaaggatatccattttatgccctgctcagggctgacgggggctaacctcaaggagcagtcagacttctgcccatggtatataggcctcccttttatcccttatcttgataacttaccaaacttcaacaggagtgtggatggccccattaggctgcccatcgtggataagtataaggatatgggcacagtggttctgggcaaactcgagagtggtagtatctgcaaaggccagcagcttgtcatgatgcctaataagcacaacgtagaagtccttggaatactcagcgacgacgtggaaaccgatactgtggcccccggagagaatttaaagatcaggctgaagggcattgaagaggaggagatactgcctggattcattctctgcgacccaaacaatttatgccacagtggaagaaccttcgacgcccaaatcgtaatcatagagcataagtcaataatatgccctggttataatgcagtgctccacattcacacttgcatagaagaggtggaaattacagctcttatctgcctcgttgataaaaaatctggtgagaagtctaaaacccggccccggttcgtaaagcaggaccaggtatgtatcgcccgcctacgcaccgccggcacaatctgtttggagaccttcaaggacttcccccagatgggccgtttcacactgcgagacgaaggaaaaaccatcgccatcggaaaggtgcttaagctggtgcctgagaaagactag

SEQ ID NO: 188743 - DNA, 1887 bp, Artificial Sequence
  Description of Artificial Sequence: Synthetic coding sequence
atggacagcggcagcagcagcagcgacagcgcccccgactgctgggatcaagtggatatggagtcaccggggtctgccccgtccggcgacggcgtgtcaagcgcagtcgcggaagcccagcgcgagccattaagctctgctttcagccggaaattgaatgtcaatgctaaaccctttgtgcccaatgtccatgcagcagaattcgtgccctcttttttgaggggacccacccaaccgccaacattgccagcaggatccggtagtaatgatgaaacatgtacaggggcaggctatccacaggggaagcggatggggcgcggcgctccggtcgagccttcacgcgaggaaccactcgtgagcctagagggctcaaacagtgccgtaaccatggaactgagcgaacccgtggtggaaaatggggaagtggagatggcattggaggaatcttgggagcacagtaaggaggtttcggaagccgagcctggcggagggtccagcggggactctggcccgccagaggagagtggccaggagatgatggaagaaaaggaagagatccggaagtcaaagagcgtgattgtaccctccggcgccccgaagaaggagcatgtgaacgtcgtcttcatcggccacgtcgatgctgggaagagcaccatcggcggccagatcatgtttctcacaggcatggtagataagagaacactggagaaatatgagagggaagctaaagagaagaaccgtgaaacatggtacttgtcatgggcccttgatactaaccaggaggagagagacaaaggcaagacagttgaggtgggccgcgcctacttcgagacagagcgcaaacactttacaatcctcgatgctccaggccataaaagtttcgtacctaatatgataggaggagcatcccaggcagatctcgccgtgctggttattagtgcgagaaagggcgagttcgaaacaggctttgaaaagggcgggcagactcgcgagcacgccatgcttgccaaaacagctggagtcaaacatctgatcgtcctaataaataagatggatgacccaacagtgaattggtccattgagcgctacgaggaatgcaaagaaaagttagtcccctttctcaaaaaggtgggattctcgcctaaaaaggatatccattttatgccatgctccggacttacaggtgcgaatattaaagaacaaagcgatttttgcccatggtacacgggcctccctttcatcccctacctggataacctgcctaactttaacaggagcatcgacgggccaattcgactgcctattgtcgacaaatacaaggatatgggcaccgtagtgttggggaagctcgagtctgggtccatctttaaggggcagcagttggtgatgatgcctaacaaacataatgtcgaggtgctggggatactgtctgacgacacagaaaccgatttcgtcgcaccaggcgagaacctgaagattcggctgaaggggatagaggaagaggagatcctgcccggctttatcctttgcgaccccagcaacctgtgccatagcgggaggacgttcgatgttcagattgtcattatcgagcacaaatccattatttgccctggctacaatgcagttctgcacatccacacgtgcattgaagaggtggagattactgctctcatctccctcgtcgacaagaaaagtggagaaaagtccaaaacccggccacgcttcgtaaaacaagatcaggtctgcattgctcgattgcgcacagccggcacaatttgcctcgagactttcaaggatttccctcaaatgggcaggttcaccctgcgcgacgaaggcaagacaatcgctatagggaaggtcctcaagttggttcccgaaaaggactag

SEQ ID NO: 188744 - DNA, 1638 bp, Artificial Sequence
  Description of Artificial Sequence: Synthetic coding sequence
atggacagcggcagcaacgacgagacctgcaccggcgccggctacccacaggggaagcgtatgggccggggcgccccagtggagccttctagagaggaacctctggtgagcttggaaggttccaattctgcagtgactatggagctgtctgagccagtagtggaaaacggtgaggtggaaatggcactggaggagtcttgggaacactctaaggaagtatcagaagcggaaccggggggcgggagcagcggtgatagcggcccccccgaagaaagcgggcaggagatgatggaagagaaggaagagattcgaaagtccaaatccgtgattgtgccatcaggtgccccgaaaaaggagcacgtgaatgtggtgtttattggacacgtggatgctgggaaatcaaccatcggaggacaaatcatgtttttgactgggatggtcgataagcggactttggagaaatacgaacgcgaagctaaagagaaaaatcgggaaacatggtatctttcgtgggcactggatactaaccaagaagaaagggataaaggcaagaccgtggaagtcggtagggcttatttcgagacagagagaaagcactttaccatcttggacgcacccgggcacaagtcttttgtgcccaacatgattggcggcgcctcacaggccgacctggctgttctggtgatttctgcacgaaagggagaatttgaaacaggatttgaaaaaggaggccaaacaagggaacacgccatgcttgccaaaacagccggagttaaacatctcatcgtgctgattaataagatggacgatcctactgtaaattggtccattgagcgttacgaagagtgcaaggaaaagctcgtgccgttcctgaaaaaagtcggcttcagtcccaaaaaggatattcatttcatgccgtgctctggcctgacgggcgccaatataaaagagcaaagcgatttttgtccatggtatacaggccttccctttatcccatatcttgataatctccccaatttcaacaggagtatcgacggccctattagattgcctatagtagacaagtataaagatatgggtaccgtggttctcggaaagcttgagtcaggaagcattttcaaaggccaacagttggtgatgatgccgaataagcataatgtcgaagtactcggcatcctaagtgacgacaccgaaaccgactttgttgctccaggggagaatcttaagatcaggttgaaaggcatcgaagaggaggaaatcctgcctggttttattctgtgtgatccttcaaacctgtgtcactccggtcgtacgtttgacgtgcagatagtgatcatagaacacaaatcaatcatatgtcccggctacaatgcagtactgcacatacacacatgcattgaggaggtggaaattaccgcgctgatttcactcgtggacaagaagagcggtgagaagtctaaaacacgccctcgcttcgtaaagcaggaccaggtatgtatagccaggctacgcactgccggaaccatctgtttagaaacatttaaagattttccccagatgggacgcttcaccctgagggatgaaggcaaaacaatcgccatcgggaaagtccttaaactggtgcccgaaaaagactag

SEQ ID NO: 188745 - DNA, 1365 bp, Artificial Sequence
  Description of Artificial Sequence: Synthetic coding sequence
atgaccaagcgggaggccgaggagctgatcgagatcgagatcgacggcacggagaaggctgagtgtaccgaagaatccatcgtagaacaaacgtacgcccctgccgaatgtgtgagtcaggctatcgacattaatgagccgattggcaatctcaagaaacttctggaacctagactccagtgtagccttgacgcccatgagatatgtttgcaggatatccaactggatccagaacggtctctgtttgatcagggagtgaaaacagatgggacagttcaactctcggttcaggttatatcctatcagggcatcgaaccaaagctgaatattcttgaaatcgttaaacctgctgatacagttgaagtggtgattgacccggacgcacaccacgccgagtccgaggctcacctggtcgaggaggcacaggtgatcaccttggacggaacgaagcacattacgaccatctctgatgaaacatccgaacaggtgacgcggtgggcagctgcactagaagggtataggaaagagcaggagaggttaggtatcccctacgatcccattcagtggtctaccgatcaagtgcttcactgggtagtgtgggttatgaaagaattcagcatgacagatatcgacctgactacactgaacatctctggtagggagttatgcagtttaaaccaagaagacttttttcagagggtgccaaggggtgaaattttgtggtcccaccttgagctgctgcgtaaatacgtccttgcctctcaagaacagcagatgaatgagatcgtgaccattgaccagcctgtccagatcatccccgctagcgttcaatccgcaacccctactacaataaaagtgatcaacagcagtgcaaaggctgcaaaggttcagcgggcaccacgcatctctggcgaagataggtcgagtccgggaaacagaacaggaaacaatggccagatccagctgtggcagttcctgctagagctgttgaccgataaggatgctcgcgactgcatttcctgggtaggcgacgagggcgagttcaaattgaaccagcccgaactcgtggcccagaagtggggtcaaaggaagaacaaaccaacgatgaattatgaaaaattgagccgagccctccggtactattacgacggagatatgatatgcaaagtgcagggaaagagattcgtctataagtttgtttgcgatctcaagaccctgattggttattccgcagcagagctcaatagactcgtgacagagtgtgaacagaaaaagctggcaaagatgcaacttcatgggatcgcccagcccgtcaccgctgtagccctggctactgcatcactgcagacggagaaggataactag

SEQ ID NO: 188746 - DNA, 1365 bp, Artificial Sequence
  Description of Artificial Sequence: Synthetic coding sequence
atgaccaagcgggaggccgaggagctgatcgagatcgagatcgacggtacagaaaaagccgagtgtacagaagagtctatagtggaacagacttatgcgccagccgagtgcgtgtcccaggctatcgatatcaacgagccgatcggcaatcttaaaaagctcttggagcctagactgcagtgctctttagatgcccacgaaatctgtctacaggatatccagctcgaccctgaacgtagtctctttgatcagggcgttaaaaccgacgggacagtgcaacttagcgtccaggtcatcagttaccagggcattgaacctaaactgaacatcctcgaaattgtgaagcccgccgacacagtagaggtggtcattgacccagacgcccaccatgcagagtctgaggctcacctcgtcgaagaggcacaagtcatcaccctggacggaactaagcacatcacgacaataagcgatgagacaagtgaacaggtcaccagatgggcggccgcactggagggctatcgcaaagagcaggagaggttggggatcccttatgatcccatacaatggagcaccgaccaggttctccactgggtagtttgggtaatgaaagaattcagcatgactgacatagacctgaccaccctgaatataagcggtcgcgaactctgcagcctgaatcaagaggatttcttccaacgggtgccacgtggtgaaattctgtggtcacacctcgaactattgaggaaatatgtccttgcctcccaagaacaacagatgaacgagatcgttacgattgaccagcctgtccagattatccccgcatcagtgcaaagtgctacgccaacaaccatcaaagtcataaattccagcgcaaaggccgcaaaggtgcagagggctccgcgtatttcaggcgaggaccggtccagcccaggaaaccgtaccggaaacaacggccagatccaactctggcagttccttcttgagctgctgacagacaaggatgctagagactgtatttcatgggtgggcgatgagggtgagtttaagctaaaccagccggagttagttgcacagaagtggggccaaaggaaaaataagccaactatgaattatgagaagctgtcacgtgccctgagatactattatgatggtgacatgatttgcaaggtgcagggcaagagatttgtttataaatttgtttgcgacctcaagacactaattggctatagcgctgccgaactgaataggctggttaccgaatgcgagcaaaagaagctcgcaaaaatgcaactgcacggaatcgcccagcctgtaactgctgtggcactggctaccgcttccctgcagaccgagaaagacaactag

SEQ ID NO: 188747 - DNA, 2163 bp, Artificial Sequence
  Description of Artificial Sequence: Synthetic coding sequence
atggcccagggcctggaggtggccctgaccgacctgcagagcagcagaaacaatgtgcgccatcacaccgaggaaataacggtggatcatctgttagtgaggagaggccaggctttcaatttgaccctgtatttccgaaatagaagtttccagccaggtctcgacaacatcatattcgtggtcgagactggaccactgcctgatctggcgctgggtactagagccgtcttttctctagcaagacaccattccccgtctccctggattgcctggctggaaacgaatggagccacaagcacggaagtcagcctctgcgcgcccccaaccgctgcagtcgggcggtatctccttaagatccacattgattcatttcaagggagtgtcactgcataccagctgggggagttcattctgctattcaatccatggtgccctgaagacgcagtttaccttgacagtgaaccacagagacaagagtacgtgatgaatgactacggtttcatttaccagggatccaaaaactggatcaggccatgtccatggaattatggtcagtttgaggacaaaatcattgacatttgtcttaagttgcttgataaaagcctgcattttcagacggatccagccacagactgtgccctaagggggtctcccgtctacgtgagtagggttgtgtgtgccatgattaactctaacgacgacaatggggtgctaaatggtaactggtcagaaaactacaccgatggcgccaatcccgccgagtggaccggatccgttgctatcctcaaacaatggaatgcgactgggtgtcagccggtgcgctacgggcagtgttgggtattcgccgcagtaatgtgtaccgtaatgagatgtcttggcattccgactagagtgattaccaacttcgactcaggccacgacactgacggcaaccttatcatcgatgagtactacgacaatacaggacgcatcctgggaaataaaaaaaaggataccatttggaatttccatgtctggaacgaatgttggatggctaggaaggacttgcctcctgcctatgggggttggcaggtgctggatgccacacctcaagaaatgagtaacggcgtctattgttgtggtccggccagcgttcgcgccataaaagagggcgaagtggacctgaactatgatacaccttttgtgttcagcatggtgaatgcagactgcatgagctggctggtacaggggggaaaagaacagaagctgcaccaggatacctcctcagtgggtaactttatctcgacaaaatcaatccagagtgatgaacgcgacgacataacagagaattataaatacgaggagggttccttgcaggaacgccaggtgtttctgaaggctctgcaaaaacttaaggcaagatcctttcatggttctcaacgcggcgcagagctgcagcccagccgtcctaccagcctctcacaagacagtccgagatccttgcacaccccaagtcttagacctagcgatgtcgtgcaagtgagtctcaagttcaagttactcgatcctccaaatatgggacaagatatttgtttcgtgctgctagctctcaacatgtcatcgcagttcaaggatctgaaggtgaatctgtcagcacagagcttgctgcacgatggttcaccactgagtccattctggcaggacacggccttcataactttgagccccaaagaggctaagacctacccctgtaaaatatcttattctcagtactcccagtacttaagcaccgacaagctgatcagaatttccgccttgggcgaagagaaatcttcacctgaaaagatcctggttaacaaaattataaccctctcttatccttccatcaccatcaacgtgctgggcgccgccgtcgtcaaccagccactgagcatccaggtgatttttagcaaccccctgagtgaacaggtcgaggactgtgtccttacagtggaaggaagcgggctgttcaaaaagcagcagaaagtgtttctgggcgtgctgaaaccccagcaccaggcatccatcattttggaaacagtgccttttaagtctgggcaacgacaaattcaggccaacatgagatccaacaaattcaaggatatcaaaggctaccggaacgtatacgtcgactttgcactgtag

SEQ ID NO: 188748 - DNA, 1047 bp, Artificial Sequence
  Description of Artificial Sequence: Synthetic coding sequence
atgagcctggtggacctgggcaagaagctgctggaggccgcccgggcagggcaggacgatgaggttcgcatcctcatggccaacggagccccctttacaacagattggctgggaacgagccctctgcacctggcagcacagtatggacactactccactaccgaagtcctgctccgcgccggagtttcccgagacgccagaactaaggtggaccggacccccctgcacatggcagcctctgagggccatgcatcgatcgtcgaagtgctgctaaaacacggtgctgatgttaatgccaaagacatgctcaaaatgaccgcactgcattgggctactgaacataatcaccaggaggtggttgagctgctgataaaatacggggccgacgtgcatacccaaagcaagttctgcaaaaccgctttcgacatttctattgataacggcaatgaagatttggcagagattctgcagatagctatgcagaaccagattaacaccaacccggaaagtcctgacacagtgacaatccacgccgctaccccccagtttattatcggccccggtggggtcgtcaacctgaccgacgaaacgggcgtgagcgctgtccagtttggcaactcgtcaacctccgtactagcgacacttgctgcacttgccgaggccagcgcccctttatctaacagctctgaaacaccagttgtcgcgaccgaagaggtagtgaccgccgagtcggtggacggggccatccagcaggttgtctcctccggggggcaacaggtgatcacaatagtcacagacgggatccagctcggcaatcttcatagtatccccaccagtggaatagggcaacctattatcgtgactatgccagatggccagcaagttctgactgtccccgccaccgatatcgccgaggagacggtcatcagcgaggagcctcccgccaaacgccagtgcattgagataatcgagaacagagttgagtctgcggaaattgaggtaaggtcccttctccccggagtactgtgccgcagtcatcccaagtag

SEQ ID NO: 188749 - DNA, 1152 bp, Artificial Sequence
  Description of Artificial Sequence: Synthetic coding sequence
atgagcctggtggacctgggcaagaagctgctggaggccgcccgggcagggcaggacgatgaagtgagaattctgatggcaaacggtgcccccttcacaacggactggttgggcacttcacctctccaccttgccgctcagtacggccactactcaacgactgaggttctgctgcgcgcaggtgttagtcgcgacgcacggactaaagtggatagaacaccgcttcacatggcggcttctgagggccacgcctccattgtcgaggtgctgcttaaacacggtgcagacgtgaatgccaaggatatgctgaaaatgacagctttgcactgggccacggaacacaatcaccaggaggtggtcgagcttttgatcaaatacggcgcagatgttcatacccagtcaaaattttgtaagacagcgtttgacatctctatagacaatggcaacgaggatctggcagagatcctccaaatagccatgcagaatcaaatcaataccaaccccgagagccccgatactgttaccatccatgctgccaccccccaatttatcattggcccaggtggagtagttaacctgaccgacgagacgggtgtgtctgccgtccagttcgggaactctagcacatccgtgctagccaccctggccgctctagccgaggcgagtgcacccctgtctaacagctctgagaccccagtggtcgcaaccgaggaagtcgtaacagctgagagcgtagacggcgcgattcaacaagtggtgtcgtctggaggacagcaggtgattaccatcgttacggacggaattcagctgggaaaccttcactctattccaacctctggaatagggcagccgatcattgtgacgatgcccgatggtcagcaggtgctcacagtgccagctacggacatcgctgaggaaacagttataagcgaagagccaccagccaagagacagtgtatcgaaatcatcgagaacagggtcgagtctgcagagatcgaagagagagaagcacttcaaaagcagttagacgaggcaaatcgggaagcacagaagtaccggcagcaactgctaaaaaaggagcaggaagccgaggcctacagacaaaaactcgaagcgatgacgagactgcagacgaataaggaagccgtgtag

SEQ ID NO: 188750 - DNA, 1047 bp, Artificial Sequence
  Description of Artificial Sequence: Synthetic coding sequence
atgagcctggtggacctgggcaagaagctgctggaggccgcccgggccggccaggatgacgaggtgagaattctgatggccaatggtgcgcccttcaccactgactggttgggcacaagtcccctgcacctggccgcacagtacgggcattattctacaaccgaagtactcttgcgtgctggggtctccagagacgccaggacgaaagttgatcgcaccccactgcacatggcggccagtgaaggtcacgccagcattgtggaagtgctgctgaaacatggtgcagatgtcaacgcaaaggatatgctcaagatgaccgccctgcactgggccacagagcataaccatcaggaggtcgtggagctgcttataaagtacggagcggacgtccacacgcagagcaagttttgtaagaccgcctttgacattagtattgacaatggcaatgaggatcttgctgagattctccagattgcaatgcagaatcagataaacaccaacccggaaagtcccgatactgtgactattcatgcggccacccctcagtttatcatcggaccaggcggagttgtgaacctgacggatgagaccggtgtatctgcggtgcagttcggaaacagcagtacatctgtgctcgccacactcgcagcacttgctgaagcgtctgcaccactgtctaattcaagcgaaactcctgtggtggcaacggaggaggttgtcaccgccgaaagcgtcgatggcgcaatacagcaggtagtatctagtggaggacagcaagtaatcaccatcgtgacggatgggatacagttgggaaacctgcattctatccctacctcgggaattggccagcctataatcgtgactatgcctgatgggcagcaagtgctcacggtccccgccacggatatagctgaagagaccgtgataagcgaagaacctcccgccaagcgacagtgcatcgagatcatcgagaatagggtggaatcagcagaaattgaagttaggtctttactgccgggggtgctgtgcaggtcccatcccaaatag

SEQ ID NO: 188751 - DNA, 1083 bp, Artificial Sequence
  Description of Artificial Sequence: Synthetic coding sequence
atgagcctggtggacctgggcaagaagctgctggaggccgcccgggccggacaagatgatgaggtgagaatcctcatggccaatggggcgccattcaccacggactggcttggtaccagccctctgcatctggcagctcagtacggccactatagcacaactgaagtactcttgcgtgcaggcgtgtccagggacgcgaggactaaagttgacaggacgccgttacacatggccgcgagtgaggggcacgcttcgattgtagaggtcctcctgaaacacggcgcagacgtcaacgccaaggatatgctcaaaatgaccgcgctgcactgggccactgagcataatcaccaggaggtggtggagttactgattaagtatggagccgacgtccatacacagagtaaattctgtaagacagcattcgacatctctattgataacgggaacgaggacttagctgagattctgcagattgccatgcagaaccagatcaacaccaatccagaaagccccgatacagtaacaatccacgcagcgacaccccagtttatcataggccctggcggagtggttaatctcacagggctggttagttcggagaactctagcaaggccactgatgagaccggcgtctcagctgtccaattcggcaactcgagcacatcagttctggctacgttggccgcactggcggaggcgagcgcaccactgtccaattcaagtgaaacccctgtagtagccactgaagaagtggtcactgctgaatctgtggacggcgccatacaacaggtcgtgagctccggaggtcagcaggttattactattgtcaccgacgggatccagctgggcaacctgcactccattcccaccagcggcataggccaacccatcatcgtgacaatgcctgatggtcagcaagtcctcacggtgccagccacagacatcgccgaagagacggtgattagcgaggagccaccagccaagcgacagtgcatcgagataatagaaaatagagttgagtctgcggagattgaggttcgaagcctgctgcccggggtgctgtgccggagccaccccaagtag

SEQ ID NO: 188752 - DNA, 270 bp, Artificial Sequence
  Description of Artificial Sequence: Synthetic coding sequence
atgagcctggtggacctgggcaagaagctgctggaggccgcccgggcagggcaggacgatgaggtccggatactcatggcgaatggagccccctttactacagattggctgggcacttcccccttgcatctggcagctcagtatgggcactattccaccaccgaggtgctgcttagggcaggtgtgtcccgagacgctagaacgaaggttgatcgcacgccacttcatatggcagctagtgaagggcacgcctcaatcgtggaagtgtag

SEQ ID NO: 188753 - DNA, 270 bp, Artificial Sequence
  Description of Artificial Sequence: Synthetic coding sequence
atgagcctggtggacctgggcaagaagctgctggaggccgcccgggccggccaggatgatgaagtgcggatattgatggccaacggtgccccttttactactgactggctgggcacatcccccttgcaccttgcagctcagtatggccactactctaccactgaggtcctgctacgggcaggggtctcaagggacgcaagaacgaaggtagatagaactccactccacatggccgccagcgagggccacgcttcaatcgtcgaggtatag

SEQ ID NO: 188754 - DNA, 354 bp, Artificial Sequence
  Description of Artificial Sequence: Synthetic coding sequence
atgaagttcgtgtacaaggaggagcaccccttcgagaagcggcggagcgagggggaaaagatacggaagaagtaccccgatagagtccctgttattgtggaaaaggcacccaaggcccggatcggagatctggataagaaaaagtacctggtcccttcagacctcaccgtcggacagttttattttttgattagaaaaagaattcatctgcgggcggaagacgccttgttcttcttcgtcaacaacgtaattccacccacctcagcgacgatggggcagctctaccaagaacaccacgaagaggattttttcctgtatatcgcctattccgacgaatcggtgtacggcctgtag

SEQ ID NO: 188755 - DNA, 354 bp, Artificial Sequence
  Description of Artificial Sequence: Synthetic coding sequence
atgaagttccagtacaaggaggaccaccccttcgagtaccggaagaaagaaggggagaaaattcgtaaaaagtacccagaccgggtcccagtaatcgtggaaaaggctcccaaggctcgagtgcctgatttggacaaaagaaaatacttagtgccgtcggacttgaccgttgggcagttttattttttgatcaggaagaggattcatttgcggccagaggatgccctgtttttttttgtgaacaacacaataccaccgacttccgctacaatgggacagctttacgaagacaaccacgaggaagattatttcctttacgtcgcgtactccgatgaatctgtgtatggtaagtag

SEQ ID NO: 188756 - DNA, 441 bp, Artificial Sequence
  Description of Artificial Sequence: Synthetic coding sequence
atgaagttccagtacaaggaggaccaccccttcgagtaccggaagaaagagggcgaaaagatcaggaaaaagtatcccgatcgggtgccggtgattgttgaaaaagctcccaaggcacgggttccagacctggacaaacgcaagtaccttgttccctctgatctgacggtgggacagttctatttcttgatacgcaaacgcattcacctgcgtcctgaggatgctctgttctttttcgtcaacaataccattccgccgacatccgctaccatggggcaactttacgaagtcatggtacttgtcgcccagtactggatgcctagttccgccgtgtggcatcctttggccttggtgctcgatgccctgattacccatttaaggtccggcgctgaaggcgtgatctaccccgacccattgacttacggctcggttaggctctag

SEQ ID NO: 188757 - DNA, 441 bp, Artificial Sequence
  Description of Artificial Sequence: Synthetic coding sequence
atgaagttccagtacaaggaggaccaccccttcgagtaccggaagaaagagggagaaaagatccgcaagaaatacccagatcgggtcccggtcattgtggagaaggcccctaaggctagggtcccagacctggataaaaggaagtacttggtaccatcagatctgacagtggggcagttttatttcctgattaggaaacgcattcatttgcgccctgaagacgcactgttttttttcgtcaataatacgattccccctacaagcgctactatgggccagctgtacgaggtcatggtcctggtcgcccagtattggatgccctcatcagcggtgtggcatccacttgctctggttttggatgctttgatcactcacctgcgatccggggcagaaggtgtgatctatccagatccgttaacctacgggtccgtgagactgtag

SEQ ID NO: 188758 - DNA, 213 bp, Artificial Sequence
  Description of Artificial Sequence: Synthetic coding sequence
atgaagttccagtacaaggaggaccaccccttcgagtaccggaagaaagagggggagaagatccgaaaaaaatatcccgacagggtgccggtgatagtcgagaaggctccaaaggcacgagtgccagacctcgataaaaggaaatatctggtcccctcggatcttacggtggggcagttctatttcttgatcagaaagcgaattcatctctag

SEQ ID NO: 188759 - DNA, 354 bp, Artificial Sequence
  Description of Artificial Sequence: Synthetic coding sequence
atgaagttccagtacaaggaggaccaccccttcgagtaccggaagaaggagggcgagaagattcggaagaagtaccctgatagggtgcctgtgattgtggagaaggctcccaaagctcgggtaccagacctggataaacggaagtaccttgtacctagtgatctgacagtgggccagttttatttcttgatacgaaagcggattcacctacggcctgaggatgccctgtttttttttgttaacaatactatccctcccacctccgccactatgggccaactttacgaagacaaccacgaggaggattactttctttacgtggcctattctgacgaaagtgtgtacggtaagtag

SEQ ID NO: 188760 - DNA, 354 bp, Artificial Sequence
  Description of Artificial Sequence: Synthetic coding sequence
atgaagtggatgttcaaggaggaccacagcctggagcaccggtgcgttgaatcagctaaaatcagggccaaatacccggaccgggtacccgttatcgtcgaaaaggtctctggttcccagatcgtcgatatcgacaaacgcaagtaccttgtgccctccgatatcacggtggcacagtttatgtggattattaggaaacgcattcagcttccttctgagaaagcgattttccttttcgtcgataaaaccgtgccacaatcttcactgaccatgggtcagctgtatgaaaaggagaaggacgaggacggctttctgtacgtggcctacagtggtgagaatacatttggcttctag

SEQ ID NO: 188761 - DNA, 1344 bp, Artificial Sequence
  Description of Artificial Sequence: Synthetic coding sequence
atgcccgtgctgtacgaccggctgctgaagctgaaggagatgttcaactccaagttcggaagtattccaaagttctatgtccgcgcacctgggcgcgtgaacattattggggaacacatcgattactgcggatacagtgtcttgcccatggctgtggaacaagacgtgttgattgcggtggaaccggtgaagacctatgcactccagttggcgaacactaatccattgtatcccgactttagcacgagcgccaacaatattcagatcgacaagaccaaaccactatggcacaattattttctttgcgggttgaaaggaatccaggagcacttcggactgagcaacctcactggcatgaactgtctcgttgatggcaacatccctccgagtagtggtttgtctagctcttcagctttagtctgttgtgcagggctcgtgactctaacagtgctgggcaggaacttgtctaaggttgagctcgcggagatctgtgccaaatccgagcggtacattgggaccgaaggcgggggaatggatcagagcatttctttcctggcagaggaaggaactgctaagttgatagagttctctccgttacgggctaccgacgtgaagcttccttctggcgccgtctttgtcatcgctaactcatgtgtagaaatgaataaggccgcaacttctcactttaatattagagtgatggagtgtcgcctggccgccaagctccttgctaagtacaaatccctccagtgggataaggtccttcgactggaagaagtgcaggcaaaactgggaattagtctggaagaaatgctcctggtgactgaagacgcgctccaccctgagccttataatcctgaagagatatgccgttgcctcgggatctcgttagaagaactcaggacccagatccttagtcccaatacccaggatgttctcatcttcaaattatatcagcgggcgaagcatgtgtacagcgaggcggcgagagtactccagtttaagaaaatttgcgaagaagcccctgagaacatggtccagctgttgggagagctcatgaatcagtctcatatgtcttgccgcgatatgtatgaatgctcatgcccagagttagatcaactggtcgacatttgccggaagtttggcgcccagggatccagactcacaggcgccgggtggggtggttgcaccgtgtcaatggttcctgctgacaagctccctagcttcctcgctaatgtccacaaggcgtattaccagagaagtgacgggagcttggcacccgaaaagcagagtctattcgcaaccaaacccggcggaggggcccttgtgctgctggaggcatag

SEQ ID NO: 188762 - DNA, 1305 bp, Artificial Sequence
  Description of Artificial Sequence: Synthetic coding sequence
atgttcaacagcaagttcggcagcatccccaagttctacgtgcgggcgccagggcgtgttaatattatcggtgaacatatcgattattgcgggtactcggtgctgcccatggctgtcgagcaggacgtgctaattgcagtagaacccgtcaaaacctatgcattgcagctcgccaacaccaacccgctgtatccggacttctctacctccgctaataacattcaaatcgacaagacgaagccgctttggcacaattattttctgtgtgggctgaagggtatccaggagcacttcggcctgtcaaatttaacagggatgaactgtctggtggatgggaacattccgcctagtagcggactgtcctcctccagcgccttagtttgttgtgcgggattggtgacgctcactgtgctcggccggaacctatcaaaggtagagctggctgaaatttgcgccaaaagcgagagatatattggcaccgaaggcggtggcatggaccagagtatctctttcctcgcggaggaggggaccgcgaagctgattgaattctcaccactgcgcgccaccgacgtcaagctgccttctggggccgtgttcgtgattgcgaacagttgcgtggaaatgaataaggccgcgaccagtcactttaacattcgagtgatggagtgtcgcctggctgccaaactccttgcgaagtacaaatctttgcagtgggacaaagtactgagactggaggaagtccaagccaaacttggtattagcctcgaggagatgcttcttgtgaccgaagacgcactgcaccctgaaccatacaaccccgaggagatttgtcggtgtctaggtatcagcctggaggagctccggactcagatactgagcccgaatacacaggacgtcctgatcttcaagctgtaccagagagctaagcacgtctactcagaagctgccagggtactgcagtttaaaaaaatttgtgaagaagccccagaaaatatggtgcagcttctgggagaactgatgaaccagtcacacatgtcctgtcgggacatgtatgagtgcagctgccctgagttggaccagctcgtggatatttgccgcaagtttggcgctcagggttctcgcctcaccggagccgggtggggcggatgcaccgtgagtatggttcctgcagacaaattgccatctttcctggctaacgtgcacaaggcctattaccagcggtcagatgggagccttgccccggagaagcaatctttattcgccacaaaacccggcggcggcgctttggtgctcctcgaggcctag

SEQ ID NO: 188763 - DNA, 624 bp, Artificial Sequence
  Description of Artificial Sequence: Synthetic coding sequence
atgaactgcctggtggacggcaacatcccccccagcagcggcctgtcaagctctagcgccttagtgtgttgcgccgggttggtaactctgaccgttcttggacgcaacttgtctaaagtggagttggccgagatctgtgccaaatcagaacggtatatcggcacggagggcgggggtatggaccagagtatcagcttcctggctgaagagggaactgccaagctcatcgaattttcgccactgcgcgccaccgatgtgaagctgccctcaggagccgtttttgtcattgcaaactcctgtgtggagatgaataaagccgccacttcgcactttaatattagagtgatggagtgtcgcctggcagccaaactgctggctaaatacaagtctctacaatgggataaagttctgagactggaggaagtccaggctaagctaggcatcagcttagaggaaatgctactcgttactgaggacgcactccatccagagccatacaatccagaggaaatctgccgctgccttgggatttcactggaagaactgaggactcagatcctgagcccaaacacacaagatgacggggttgtcctttaccgccctgggtggagtgctactgcgtag

SEQ ID NO: 188764 - DNA, 1305 bp, Artificial Sequence
  Description of Artificial Sequence: Synthetic coding sequence
atgttcaacagcaagttcggcagcatccccaagttctacgtgcgggctcccgggagagttaatatcattggtgaacacattgactattgtggctacagtgtccttccaatggcagttgaacaggacgtcttgattgcagtggaacccgtaaaaacttacgcattgcaactcgctaacaccaatcctctgtaccccgactttagcactagtgcgaacaatattcagattgacaagactaagcctctatggcataactatttcttgtgtggcctaaagggcatacaagagcacttcggtttgagcaatcttaccggaatgaactgcctcgtggacggaaacatcccaccctctagcgggctttcctctagtagcgccctggtgtgctgcgccggtcttgtgacacttacagtgctcggacgcaacctaagtaaggttgaacttgctgagatctgcgccaaaagcgagcgttatatcggaactgaggggggaggcatggatcagagcatctcttttctggccgaagaggggaccgccaaactaatagaattttcacctctgcgcgcaaccgatgtcaaactccccagcggagccgtcttcgttatcgccaattcctgcgtggaaatgaataaagccgctacatcacattttaacatccgggtcatggaatgtcgactggctgccaagttactggcgaagtataaaagtctccagtgggataaggtactacggctcgaagaggtccaggccaaattgggaatctccttggaggaaatgctgctcgtgaccgaggacgcattgcatccagagccatacaacccagaggagatttgtagatgtttggggatctctctagaggagctgagaacccagatattgtccccgaatacccaggacgtattgatttttaagctgtaccagcgcgccaagcacgtgtactctgaggctgccagggttcttcagttcaagaaaatctgcgaggaagctcctgaaaacatggtacagctacttggggaactgatgaaccagagccatatgtcgtgtagggatatgtacgagtgcagctgtccagagctggatcagttggtcgacatctgcagaaagtttggagcacagggtagtcggctgaccggtgctggctggggagggtgtaccgtgtctatggtcccagccgacaagctgccctcattcctagccaatgtgcacaaagcatattaccaacggtccgacgggtcattagctcctgagaagcagagcctgttcgcaaccaaaccaggcggcggggcactggtcttgcttgaagcctag

SEQ ID NO: 188765 - DNA, 1305 bp, Artificial Sequence
  Description of Artificial Sequence: Synthetic coding sequence
atgttcaacagcaagttcggcagcatccccaagttctacgtgcgggcacctggacgcgtcaatatcattggggaacatatagactattgtgggtactctgtcctgccaatggccgtcgaacaagacgtgttgatcgcagtggaacctgtgaagacgtatgctctacaacttgcgaatacaaaccctttgtatcctgatttctcgaccagcgccaataatatccagatagacaaaaccaagcccctgtggcataattactttctatgcggacttaaaggtatccaggaacattttggacttagcaatctgactggaatgaattgcctggtcgacgggaacatcccacccagcagcgggctgagcagcagttctgccctcgtgtgctgcgctggcctcgtcacgctaactgtgcttggacgcaacctttcgaaggtggagctagctgagatttgtgctaaatcagagcgttatatcggaacggagggaggcggtatggaccaatctatcagttttctagctgaagaggggactgctaagctcatcgagttcagcccgctaagggctaccgacgtgaagctgccctccggagctgtttttgtgatcgccaacagctgcgtggaaatgaataaggccgctacatcacattttaatatcagagttatggaatgtcgcttggccgccaagctgttagctaagtacaagagtttgcagtgggacaaagtgcttcgcctcgaagaagtgcaggcaaagctgggaatctcacttgaggagatgctgcttgtcaccgaggacgctcttcacccagagccctataacccagaagagatatgtcgatgcctcggcattagtttagaggaactgcgaacgcaaatactatcccccaatactcaggacgtcttaatctttaagctgtatcagagagccaagcacgtttactctgaagctgctagggtgctccagttcaagaagatctgtgaagaggccccagagaacatggtgcagctgctcggcgaactgatgaaccaatcccacatgtcctgcagggatatgtatgagtgtagttgcccggaactcgaccaacttgtggacatttgccgtaaatttggcgcacaaggctccagactaactggcgcgggatggggaggctgtaccgttagtatggtccccgccgacaagctgcccagcttccttgcaaacgtgcataaagcctattatcaaagaagcgacggatcactggctcccgaaaagcagagcctatttgccactaagcccggcggaggagctctagtgctgctcgaggcctag

SEQ ID NO: 188766 - DNA, 1377 bp, Artificial Sequence
  Description of Artificial Sequence: Synthetic coding sequence
atggccaccgagagccccgccacccggcgggtgcaggtggccgagcaccctcgcctcctgaagctgaaagagatgtttaattcaaagtttggttccatcccaaagttttacgttcgggcccctggtcgagtgaatatcatcggggagcacattgattattgtggatactccgttctgccaatggctgttgaacaggacgtgctgattgcagtggaacctgtgaaaacatatgccttgcagctcgctaatacaaatccactctatcccgattttagcacatccgctaataacatacagattgacaaaacaaagcccttgtggcacaactatttcttgtgtgggctgaagggaatccaggaacatttcggcctaagtaatctgaccgggatgaactgtttagtggacgggaacattccaccatcgtccgggctgagctcatcatcagctctggtgtgctgcgcaggattagtgacgttaaccgttctgggccgcaacctcagcaaagttgagctcgcagagatttgcgctaaatccgaaagatatataggtacggagggaggggggatggaccaatctatctcattcttggcagaggaagggaccgctaaattgatagagtttagccccctacgggccaccgacgtgaaactgccctcaggagccgtgttcgtgatcgcaaattcctgcgttgagatgaacaaggcagccacctcccactttaacatcagggtgatggagtgcaggctcgcggctaagctcctggccaagtacaaatcactgcagtgggacaaggtactgcgcctggaagaagtgcaggccaagttgggcatttctctagaggagatgctccttgtgacagaagacgctcttcatcccgagccatataaccccgaggaaatttgtagatgccttgggatttccttggaagagcttaggacccagatactgtcacccaatacccaggatgttctgatttttaaactctatcaaagggccaagcatgtgtattcggaggctgcacgggtgctccagttcaagaagatctgcgaagaagctcctgaaaatatggtgcagctcctgggggaactgatgaaccaatctcatatgtcctgccgcgatatgtatgaatgctcatgtcctgagttagaccaactggtggacatatgccgcaaatttggggctcagggaagtaggttaacaggagccggctggggcggatgtactgtttcgatggttccagctgacaagctgcccagcttcctggccaacgtgcataaggcctactaccagaggagtgatggaagtctcgcgcctgagaaacagtcattgttcgccaccaagcctggtggcggtgcccttgtcctcttagaagcgtag

SEQ ID NO: 188767 - DNA, 1272 bp, Artificial Sequence
  Description of Artificial Sequence: Synthetic coding sequence
atgctgcccccccagaagaagccctgggagagcatggccaagggcctcgtgttaggggccctcttcactagcttcctgctgctggtctattcatatgctgttcctcctctgcatgcaggtctggcctcaacaacaccagaggccgcagcctcttgcagtccgccggccctggaacccgaggccgttataagagctaacggatccgcgggcgagtgccagcctagacgcaatatcgtgtttctaaaaacccacaaaactgccagctcgacactgctcaacatcctatttcggttcggacagaagcatagacttaaattcgcgtttccaaatgggaggaacgattttgactatccaacgttctttgcccggagccttgtgcaggactatagacccggcgcgtgtttcaatattatttgcaaccatatgagatttcactatgatgaggtgagagggctggtgccaactaacgccatattcataacagtacttagagaccctgctcgcctgtttgaatcctcattccactatttcgggccagtggtaccgctgacctggaaattgagcgctggcgacaagttgactgaatttcttcaggatccggatagatactacgatccaaatggtttcaacgcccactacttacgaaacctgctgttctttgatctcgggtatgacaactccctggatccatcatctccccaggttcaggaacacatcctggaagtggagcggcgttttcacctcgtgttgttgcaggagtatttcgacgaaagtcttgtgctactgaaggaccttctgtgttgggaactggaggacgtcctgtacttcaaattgaacgctagaagagattctcctgtgccacgactctctggcgaactgtacggacgggccaccgcttggaacatgctggactcccacttgtaccggcatttcaacgcctctttttggcgcaaagtggaagccttcgggcgggaacgcatggcacgcgaggtcgccgctctcagacacgctaacgagcggatgcggactatttgcatcgatggtggacacgctgttgacgccgccgccatccaggacgaagctatgcagccctggcagccattagggactaagtcaatcctagggtacaatctgaaaaagtcaatcggtcaacgccatgctcagctgtgccggcgcatgctaacacccgagattcagtaccttatggacctaggcgccaacctgtgggttaccaagttgtggaagttcatcagggatttcctgcggtggtag

SEQ ID NO: 188768 - DNA, 1272 bp, Artificial Sequence
  Description of Artificial Sequence: Synthetic coding sequence
atgctgcccccccagaagaagccctgggagagcatggccaagggcctggtgttgggagctctcttcaccagcttcctgctgttggtctactcatatgcagttccgcctctgcatgctggtctggctagcaccaccccggaggctgccgccagttgctctcctcctgctctcgaaccagaggccgttattcgggctaatgggtccgcaggtgagtgtcagccaaggaggaacattgtttttcttaaaacccacaaaactgcgagttcaacgttactgaatattctcttccgctttggacagaagcatcgactgaaattcgcattccccaacggcaggaatgactttgattaccctaccttcttcgctagatccctggtgcaagattatagacctggagcatgtttcaacataatctgcaatcacatgaggtttcattatgatgaagtgaggggcctagttcccactaatgccatattcatcaccgtactgcgggacccagcccgtctattcgaaagtagcttccattacttcggaccagtcgtgccccttacttggaagctctcagctggggataaattgaccgagttcctgcaggatcccgataggtactacgatcctaacggctttaacgcccactatctccggaatctgttgttttttgatcttggctacgataactccctcgatccatcgtcaccacaagtgcaggaacacatcttggaagttgagaggcggtttcaccttgtccttctgcaagaatacttcgacgaaagtctggtgctactgaaggacctcctgtgctgggaactagaggatgtgctgtactttaagctgaacgccagacgggactcaccggtccccagactgtcgggcgaactatacggaagggccactgcctggaatatgctggattcacatttgtacagacacttcaatgcctctttttggagaaaagtggaggcattcggtagggaacggatggcccgtgaggtggccgcccttcggcatgctaatgagagaatgaggacaatttgtatcgatgggggacacgccgtggatgctgcagctatccaggatgaggcgatgcaaccctggcagcccctgggcaccaagtccatcctgggatacaacctgaagaagtctatcgggcagcgccacgcacagctgtgtcgtcgcatgctcaccccagaaattcagtatctgatggacctcggggcaaatctgtgggtgactaagctctggaaatttatccgggacttcctccggtggtag

SEQ ID NO: 188769 - DNA, 1272 bp, Artificial Sequence
  Description of Artificial Sequence: Synthetic coding sequence
atgctgcccccccagaagaagccctgggagagcatggccaagggcctggtgctaggagcactctttacttcttttcttctgctcgtgtatagttacgctgtgccgccgttgcatgctggattagcctccacaacgcccgaagccgctgcaagctgctccccacctgccctggagccagaagcagtcatccgcgccaatggttctgcaggagagtgccagccgagacgaaacattgtgttcctgaagacgcataaaacagcatcatctacgcttctgaatatcctcttccgttttggccagaagcatagactcaagtttgcgttcccaaacggtagaaatgatttcgattatccgacgtttttcgccaggtccctcgtgcaggattatcgaccaggcgcctgctttaatatcatatgtaaccacatgagatttcactatgatgaagtcagaggactcgtcccaactaacgcgatctttatcactgtccttcgggatcccgccaggctgtttgagtcttcattccattactttgggccagtggtcccactcacatggaaactcagcgctggggataagctgacggagttccttcaggatcccgacaggtattacgaccctaatggatttaacgcccattacctgcggaacctcttgttcttcgaccttggttacgataatagcctggatcccagttcaccccaggtgcaggagcatatcctggaagtggaaaggcggttccacctggtgcttttgcaggagtattttgatgagtccttggtcctgttaaaggacctcctttgttgggagctcgaggacgtgttgtacttcaagctcaatgcacgccgggattcccctgttccaagactgagtggagaactttatggccgtgctacggcgtggaacatgcttgactcacacctctataggcacttcaacgcctccttttggagaaaagttgaagcattcgggagggagcgcatggccagagaggtcgcagctctacggcacgctaatgaaaggatgcgaacaatatgcatcgacggcggccacgcagtggacgcagctgccatacaggacgaggcgatgcaaccctggcagccactcggtaccaagagcatcctcggatacaacttaaagaagtcaatcggccagcggcacgctcagctgtgtcggcgaatgctaacccctgaaattcagtacctgatggatctgggagcaaacctgtgggtgaccaagctgtggaaatttattcgcgactttctgcggtggtag

SEQ ID NO: 188770 - DNA, 1272 bp, Artificial Sequence
  Description of Artificial Sequence: Synthetic coding sequence
atgctgcccccccagaagaagccctgggagagcatggccaagggcttggttcttggcgccttatttaccagctttctgctcctcgtatatagctatgccgtgcctccactccacgcgggtctggcatcaaccacccccgaagcagccgcatcttgtagtccaccagcactggagcctgaagctgtcattagggcaaacggttcagccggcgagtgccagcctcgccgcaatatcgttttcttgaagacccacaaaactgcgagcagcaccttgctcaatatcctgtttagatttggtcagaaacatagattaaagttcgcttttcccaacggtcggaacgattttgactaccccacattctttgccagatcgctagtacaagactacagaccgggagcttgtttcaacattatctgcaatcacatgcgctttcactacgatgaggtccgaggccttgtgcccactaatgccatattcatcacggtcctgagggacccagctcgcttatttgagtcttctttccactactttgggcccgttgtcccactaacttggaagctgtccgccggcgataaattgacggaatttttacaagatcctgacaggtactatgacccaaacgggtttaacgctcactatctccgaaacttgctgttcttcgacttaggctacgacaattctctggacccgtctagtccgcaagtacaggagcacattctggaagttgaacggaggttccacctggtgctcctccaggagtatttcgatgaaagccttgtactattaaaagacctactttgttgggagcttgaggacgtgctttattttaagctcaatgcccggagggacagcccagtgcctaggttgtctggcgagttgtatggcagagctaccgcatggaatatgcttgactcacacctgtatcggcattttaacgccagcttttggagaaaggtggaagcattcggaagagagaggatggctcgcgaagtcgcagcactcaggcacgcaaatgagagaatgcgcaccatctgtatagacgggggacacgccgtagacgccgccgcaatccaagatgaggctatgcagccatggcaaccgctgggaactaaatctatccttggttataatctgaagaaaagtattggacaacgtcatgcccagctgtgcagacgcatgttgacacctgaaatccagtatctgatggacttgggtgccaacctttgggtgacaaagctgtggaaatttatccgagactttttgcgctggtag

SEQ ID NO: 188771 - DNA, 1272 bp, Artificial Sequence
  Description of Artificial Sequence: Synthetic coding sequence
atgctgcccccccagaagaagccctgggagagcatggccaagggcctggtattaggtgcactcttcacatcctttctgctgctggtctattcttatgcagtgccccctctgcatgccggcttggcctctactacccccgaggccgcagctagctgctctccacccgctctggagccagaagcagtgatcagggcaaacggctccgcaggggagtgtcaaccaaggagaaatatagtttttctcaaaacacacaaaacagcctcatccaccctcctaaatatcttgtttaggtttggccagaagcatcgcctcaagtttgcgttcccgaatgggcgcaatgattttgactatcccactttctttgcacgcagtctggttcaggattataggcccggtgcctgcttcaatatcatctgcaatcatatgagattccactacgacgaggtccggggattggtgcccactaacgcgatcttcattactgtgctccgggatccggccagactgttcgagtcgagctttcactattttggaccagtagtgcccctgacctggaaactctctgctggcgataagcttaccgagttcttacaggaccctgaccgctactacgatccaaatggatttaatgcacactatctgcgtaatttactgttttttgatctgggctacgacaatagcttggaccccagttcgccacaggtgcaggagcacattttggaagttgagaggagatttcatttggtcctgctccaggagtattttgacgagtcactggtcctgctgaaggacttactctgctgggaactcgaagatgtcctctatttcaagttgaatgcacgcagagactcccctgtgcctcgactgagcggcgagctctacggaagggccacagcatggaatatgttagacagccatctttatagacacttcaatgcaagcttctggcggaaagtcgaggcctttgggcgtgagcgcatggcacgggaagtcgcggcgctgagacacgcaaatgaacggatgaggactatttgcattgacggagggcacgcagtggatgccgctgcaatccaggatgaggctatgcagccatggcagcccctggggacgaaatctatcctggggtataacctgaagaaaagcatcggccaaagacacgcacaactgtgcagacggatgctaacgccggaaattcagtatctaatggatctgggcgcgaatctatgggtgactaaactatggaaatttatccgcgacttcttaagatggtag

SEQ ID NO: 188772 - DNA, 1272 bp, Artificial Sequence
  Description of Artificial Sequence: Synthetic coding sequence
atgctgcccccccagaagaagccctgggagagcatggccaagggcctggtcctcggcgccctgtttacgtcattcttgttactggtctatagctacgctgtccctcccctgcatgccggactcgcgtcaacaacaccagaggccgcagcaagctgcagcccccccgcactggaaccagaggccgtgattcgggctaatggtagcgccggggaatgccagcctcgccgaaatatcgtgttcttgaaaacacataaaactgcaagttccaccctgttgaatattttattccggttcgggcaaaaacatagactgaagtttgccttcccaaatggacgcaacgattttgactacccgacgttcttcgcccgcagcctggtgcaggactatagacccggtgcctgcttcaatatcatttgcaatcatatgcggtttcactatgatgaagttcgtggccttgtgccaaccaacgcgatatttatcacagtgttgcgggaccccgctaggcttttcgaaagtagctttcactacttcggaccagtggtgccactgacgtggaaattgtcagctggagacaagctgaccgagtttctgcaagatccggaccgctactacgaccccaacggctttaacgcacattacctacgcaatctgctcttttttgacctagggtatgacaacagtctggatcccagttcacctcaggttcaagagcacatcctagaggttgagaggcggttccaccttgttctattgcaagaatactttgacgaaagtctggtgctgttaaaagatttactgtgttgggagctggaagacgtcctatacttcaaactgaacgcaagacgcgactcaccagtgcccagacttagcggagaattgtatggtagagccaccgcctggaacatgctcgactcccacttgtacagacacttcaacgcatccttttggagaaaggttgaggcatttggccgagagcggatggccagagaggtcgcagcgctgcgacacgcaaatgagaggatgcgaactatttgtatcgatggcgggcatgcggttgatgccgcggcaattcaggacgaggccatgcaaccatggcaaccactgggcacgaagtccatcctcggctacaatctgaagaaatcgatcggccagagacacgcccagttgtgtcgcagaatgcttacacctgagatccagtatctgatggatcttggcgctaatttgtgggtaaccaagttatggaagttcattagggacttcctccggtggtag

SEQ ID NO: 188773 - DNA, 258 bp, Artificial Sequence
  Description of Artificial Sequence: Synthetic coding sequence
atgctgcccccccagaagaagccctgggagagcatggccaagggcctagttttaggcgctctttttacttctttcttgctgctggtttactcctatgctgtcccacccctgcacgctggccttgccagcaccacccctgaagctgcagctagctgcagccccccggctctagagccggaggccgttatcagagctaatggtagtgccggcgagtgtcagcccagacgcaacatcgtttttctgaagacccataagtag

SEQ ID NO: 188774 - DNA, 513 bp, Artificial Sequence
  Description of Artificial Sequence: Synthetic coding sequence
atgctgcccccccagaagaagccctgggagagcatggccaagggccttgtgctgggtgccctgttcacaagttttcttttgctggtctattcttacgcagttccgcccctgcacgccggtctagcctccaccacacccgaggcggcagcatcttgcagcccccctgcgctggagcccgaagccgttattcgagccaatggatccgctggagagtgtcagcctcgtcgaaacattgtgtttctgaaaactcataagactgcaagttctactctcctgaacatcttgtttagattcggccagaagcaccgactgaagtttgccttccccaatgggcggaatgacttcgactacccaacatttttcgctcgttccctggtgcaggattaccggcccggcgcctgtttcaatatcatttgtaaccacatgagattccactacgatgaggtgagggggctggttcccacgaacgccatctttatcactgtgctgagggatccagcccgcctattttag

SEQ ID NO: 188775 - DNA, 450 bp, Artificial Sequence
  Description of Artificial Sequence: Synthetic coding sequence
atgctgcccccccagaagaagccctgggagagcatggccaagggcctcgtcctgggcgcgttattcacttcattcctgttgctggtgtatagttacgccgtccctccattacatgccggtttggcttcaacaacaccggaagccgcagccagctgttctccacctgcactggaacctgaggccgtgattcgagccaacggctccgccggcgagtgtcagcctcgcagaaacattgtctttctcaagacccacaagacagcctcgagcacacttttgaatatattattccgcttcggccaaaagcatagactgaaatttgcatttcccaatggccggaatgactttgactatcccacgttcttcgcccggtccctggttcaggattaccgccctggggcctgtttcaacattatctgcaaccatatgcgctttcattacgatgaggtgtag

SEQ ID NO: 188776 - DNA, 300 bp, Artificial Sequence
  Description of Artificial Sequence: Synthetic coding sequence
atgctgcccccccagaagaagccctgggagagcatggccaagggcctggtacttggagccctcttcacatccttcttgttgctcgtctatagctacgcagtccccccactgcatgccggcctagcctctactactccagaggcagccgctagctgctcacccccagctctggagccagaggcagttatccgagctaacggaagtgccggcgagtgccagcctagacgaaacatcgtgtttctgaagacccataagaccgcgagctccactctgctgaatatcctgtttagattcgggtag

SEQ ID NO: 188777 - DNA, 312 bp, Artificial Sequence
  Description of Artificial Sequence: Synthetic coding sequence
atgctgcccccccagaagaagccctgggagagcatggccaagggccttgtgttgggagctctgttcacctccttcctcctgcttgtgtattcctacgccgtgccgcccttgcacgcaggcctcgcatcaacaacccctgaggcagccgcgtcttgttctcctccagctctcgaacccgaggctgtcattagggccaatggtagcgcaggcgaatgccagcctcggcggaacatcgtattcctgaaaacacacaagaccgcgtcatccaccttactcaatattctcttccgcttcggccagaagcaccgctag

SEQ ID NO: 188778 - DNA, 600 bp, Artificial Sequence
  Description of Artificial Sequence: Synthetic coding sequence
atgctgcccccccagaagaagccctgggagagcatggccaagggcctggtgttgggtgcactatttacttccttcctcctccttgtgtacagttatgcagtcccaccccttcacgcaggtctggcttcaactacccctgaggcagcggctagctgctcaccacccgccctggagccagaggcagtcattagggccaacggaagcgccggggagtgccaaccccgccgcaacatcgttttcttgaaaacgcacaaaacagcctcatctactttactgaacatcttgttccgctttggtcagaaacaccgtctgaaattcgccttcccaaacggacggaatgacttcgattaccctactttctttgcacggtctctggtgcaggattaccggcctggagcatgcttcaacattatctgcaatcacatgcgctttcattacgacgaagttcgcggcttggttcccacaaacgccatatttataaccgtgctgcgcgacccagccagacttttcgaatcctcctttcattactttggtcccgtcgtacctcttacatggaagctgagcgcaggcgacaaactgaccgagtttttacaggattag

SEQ ID NO: 188779 - DNA, 840 bp, Artificial Sequence
  Description of Artificial Sequence: Synthetic coding sequence
atgctgcccccccagaagaagccctgggagagcatggccaagggcctggtgcttggcgccttgttcacatcctttcttctcttggtttacagttatgctgtgccgccgctccacgcaggtctggcctcgaccacacctgaggccgcagcctcttgttctccgcccgcactggaaccagaagcagtgattcgcgccaatgggtctgcgggggagtgccagcctaggcgaaacatcgtcttcctgaagacgcataaaaccgccagttccacactactgaacatcctattcagatttggccagaaacataggttgaagttcgccttcccgaatggccgtaatgactttgactatcctacatttttcgcccggtctctggtgcaggattacagacctggtgcctgtttcaatatcatatgtaaccacatgcgattccattatgacgaggtacgggggctggtccccaccaacgccatatttattaccgtgctgcgggatcctgccagactgttcgagagctctttccactactttggccccgtcgtgcccttaacatggaagctgtcagccggagacaaactaacagagtttctccaagaccctgatagatactacgatcccaacggattcaacgcccactacctgcggaaccttctcttctttgacctgggctacgataacagtctagatccctctagtcctcaggtgcaggaacacattctggaagttgagcgccgctttcacttggtgttactacaggaatactttgacgagagcctggtgttgttgaaggatctcctgtgctgggagctagaagatgtgctgtattttaaactcaattag

SEQ ID NO: 188780 - DNA, 1272 bp, Artificial Sequence
  Description of Artificial Sequence: Synthetic coding sequence
atgctgcccccccagaagaagccctgggagagcatggccaagggcctggttcttggggccctttttacgagctttttgttgcttgtgtactcttatgcagtgccacccttacacgctgggttggcttccaccacaccagaagcggcagcctcttgttcaccccctgccttagagcctgaggctgtgatcagggctaatgggtcagctggggagtgccagcctaggagaaatattgtgttccttaaaacccataaaaccgctagctcgactctcctgaacattctgttccgcttcggccagaaacatcggttgaaattcgctttccccaatggtcgcaacgacttcgactaccccaccttcttcgcaaggtctcttgtgcaggattaccgaccaggggcctgcttcaatatcatctgcaatcacatgcgcttccactacgatgaagtacgaggattggtgcccacaaatgccatcttcattacggttctccgtgacccagctaggctgttcgagagcagtttccactatttcggacccgttgttccactcacgtggaaattgagcgcgggtgacaaactcacagagttcctgcaagaccccgacagatactatgatcccaatggatttaatgcccactatctgcgaaacttactgttcttcgatcttggctacgataattccctcgatccatcatctccacaagtgcaggaacacattttggaggtagaacgacggtttcacctcgtgttactccaggagtactttgatgaaagtctcgtgctactgaaggatctgctctgttgggaactcgaggatgtactctattttaaattgaacgcccgcagagatagtcccgttcctcggctctctggagagctgtacggcagggccactgcatggaatatgctcgactctcacctgtatcgacatttcaatgccagtttttggcgcaaggtggaggcttttgggagagaaagaatggcaagagaagtggctgccctgaggcacgcaaatgaacgaatgaggactatatgcattgacgggggacacgctgtggacgccgccgccatccaggatgaggccatgcagccctggcagcctctggggactaaatccatcctcggctacaatcttaaaaagtccatcgggcagcggcacgcccagctgtgccggcgcatgcttacaccagaaatccagtaccttatggatctgggcgctaatctatgggtgaccaaattgtggaaatttatcagggacttcctgaggtggtag

SEQ ID NO: 188781 - DNA, 432 bp, Artificial Sequence
  Description of Artificial Sequence: Synthetic coding sequence
atgctgcccccccagaagaagccctgggagagcatggccaagggcctagtgctgggcgctctgttcacgagctttttgttattagtttactcgtacgccgttccaccactacacgcaggtctcgcatctaccactccagaagccgctgctagctgttcgcctccggctctggagcccgaggcggtcattcgagctaatggttccgctggagagtgccagccccgtcgtaacatagtgtttctcaagacccacaaaaccgcaagcagtacactgctgaatatcctattccggttcggacagaagcacaggcttaagttcgcctttccaaacggccgaaatgattttgactacccaacctttttcgcgaggtctcttgtgcaggattataggcctggggcatgtttcaacatcatctgcaaccatatgcgctag

SEQ ID NO: 188782 - DNA, 231 bp, Artificial Sequence
  Description of Artificial Sequence: Synthetic coding sequence
atgctgcccccccagaagaagccctgggagagcatggccaagggcctggtgctgggagctctgttcacatcctttcttcttctcgtttattcatacgctgtacctccgctgcacgcgggactcgccagcacgactccagaggctgcagcatcctgtagtcctccagctctagaacctgaagccgtgatacgcgccaatggtagcgccggcgagtgtcagcccagacgctag

SEQ ID NO: 188783 - DNA, 288 bp, Artificial Sequence
  Description of Artificial Sequence: Synthetic coding sequence
atgctgcccccccagaagaagccctgggagagcatggccaagggcttagtcttgggggccttgtttaccagcttcctgctcttagtgtattcctatgccgtacctcccctgcacgcgggattggcctcgaccactcccgaagcagccgcatcttgcagccctcccgcgctggagccagaggcggtgataagagctaatggctctgccggcgaatgccaaccgagaagaaacatagtcttcttgaaaacccacaagacagccagttctacgctactcaatattctgtag

SEQ ID NO: 188784 - DNA, 216 bp, Artificial Sequence
  Description of Artificial Sequence: Synthetic coding sequence
atgctgcccccccagaagaagccctgggagagcatggccaagggcttggttcttggggctttgtttacgtcattcctactgctggtctacagttacgctgtaccaccactgcatgcaggacttgcctccaccacccctgaagccgccgcatcctgttctccgcccgcactcgagcctgaggcagtgatacgggccaatggttcagctggtgaatag

SEQ ID NO: 188785 - DNA, 729 bp, Artificial Sequence
  Description of Artificial Sequence: Synthetic coding sequence
atgctgcccccccagaagaagccctgggagagcatggccaagggcctcgtgctaggagcgctctttaccagctttctcctccttgtctatagctacgctgtgccccccctgcacgccggtctcgctagcaccacaccggaagctgctgcctcttgctcgcctcccgccctcgagcccgaggccgtgatccgggccaacggatctgcaggagagtgccagcctagaaggaacatcgtgttcttgaaaactcataagaccgcttcaagtacactgttaaacatcctgtttcggttcgggcagaaacatagactcaagtttgcctttccgaatggtaggaatgatttcgactatcctacattctttgcccggtcgctggtgcaggactaccgacccggcgcttgcttcaacataatctgtaaccacatgcggttccattacgatgaggtaagggggctggtgcctaccaacgctatcttcattactgttttgcgtgatcccgcccgcttgttcgaatctagcttccactattttgggcccgttgttccacttacctggaaactctctgctggggataagcttacagaatttctgcaggaccccgatcggtattacgaccccaatgggttcaacgcccattacttgaggaaccttctgtttttcgacctggggtacgataacagcttggatccatcgtcaccccaggtccaggagcatattcttgaggtatag

SEQ ID NO: 188786 - DNA, 303 bp, Artificial Sequence
  Description of Artificial Sequence: Synthetic coding sequence
atgctgcccccccagaagaagccctgggagagcatggccaagggccttgtgctcggagcactttttacttcttttctgttattggtttactcgtacgctgtgccgcctctccatgcgggcctcgcctcaactacccctgaggctgctgcgtcctgcagccctcctgccctggagcccgaagcagttattagagccaatggatccgccggcgagtgccagcccaggcgcaatatcgtgtttctcaagacacacaagacggcatcatcaactttgttgaacatcctcttcagattcggacaatag

SEQ ID NO: 188787 - DNA, 1197 bp, Artificial Sequence
  Description of Artificial Sequence: Synthetic coding sequence
atgatgagcatgctgggcggcctgcagcggtacttccgggtgatcctgttactccttttggctctgaccctcctgcttttagcaggattcttgcacagtgaccttgaactggacactcctcttttcgggggccaggctgaaggtcctccggtaaccaacatcatgtttctgaagacgcacaaaacggcatccagtaccgttctgaacatcctgtatagattcgccgaaactcacaacctgagtgtggcgcttcccgccggctctcgagtccatctcggctatccctggctattcctcgctaggtacgttgagggtgtaggatcccagcagcgctttaacatcatgtgcaatcacttacgctttaatctgccccaggtgcaaaaggttatgccaaatgacactttctatttttcaatcctgcggaatccagtgttccagctggagagcagctttatctattacaaaacctacgcccctgcctttagaggcgctcccagcctggatgccttcctggcctccccaaggactttttacaacgactctcggcacctacggaacgtttacgctaagaacaatatgtggttcgatttcggatttgatcccaacgctcagtgtgaagaggggtacgtccgggcacgtattgctgaggtggaacgccgctttagactagtccttatcgccgaacaccttgacgagagcctggtgctgttacgaagacgcctcaggtgggcactggacgatgtggtggcatttaggctgaattcacggagcgctcggtccgtggctcgccttagccccgagacccgcgagagggcgaggagctggtgtgcattagactggaggctgtatgagcactttaacagaactctgtgggctcagcttcgcgctgaactcggtccaagaaggctgaggggagaagttgaacgcctaagggcacggaggagagaattggctagcctctgtctacaggacggaggtgcgttgaaaaaccatacacagattagggaccccagactccgcccttatcaatctgggaaggccgatattttagggtacaacctgcggcctggactggacaaccagacacttggcgtatgtcagagactggtgatgccagagctccaatatatggctcggttgtacgccttgcagtttccggaaaagccgttaaagaacatcccctttcttggcgcttag

SEQ ID NO: 188788 - DNA, 1296 bp, Artificial Sequence
  Description of Artificial Sequence: Synthetic coding sequence
atgccccccatcctgcagcggctgcagcaggccaccaagatgatgagcagaagaaaaatcctcctactcgtgctcggctgttccaccgtgtcactgctcatccaccagggtgctcagctcagctggtatccaaaactgtttcccttgtcgtgcccaccgctgaggaattcccccccacgaccaaagcatatgactgtggcatttctcaaaacgcataaaacagccggtactaccgttcagaatatcctgtttaggtttgccgagagacataatttaacagtggcactccctcatccttcttgcgaacatcagttctgttatccgcggaacttctccgcccattttgtgcacccagcaacccgccctccacacgtactggccagtcacctacgctttgaccgcgctgagcttgagcgtctgatgcctccaagtaccgtgtatgtcactattctgagggagccggccgcaatgttcgagagtcttttttcatattataaccagtactgtccggcatttcggagggtccctaacgcctcacttgaggcattcttacgtgccccagaagcttattacagggctggcgagcacttcgctatgttcgcacataatactctggcctatgatctagggggcgataatgagaggtcgcctagggacgacgcagcctacctggcagggctgatccgccaggtggaggaagtgttcagcctagtcatgattgcagagtactttgatgagtcactggtattactgaggaggctgctggcgtgggacctcgatgatgtcctctatgccaagctcaatgcccgggcggcatccagcaggctcgctgcgattcccgccgcactcgccagggccgctcggacctggaacgcgctggacgccggtctgtatgaccacttcaatgccacgttctggcggcatgttgcgcgcgccggtagagcctgcgtggagcgagaagcacgggaattgagggaggcacggcagcgtctcctgaggcgctgtttcggggacgagcccttgctgaggccagctgcccagattcggacaaagcaattacagccctggcaaccaagccggaaggtggacatcatgggctatgatctaccagggggcggcgcaggaccagctacggaggcctgcctaaaactggccatgcccgaggtccagtattcaaattaccttctccgcaagcaaaagcggagaggcggcgctcgtgcacgtcctgagccagtcttagataatccccctcctcggcctattcgagtcctgccaagagggcctcagggaccatag

SEQ ID NO: 188789 - DNA, 1296 bp, Artificial Sequence
  Description of Artificial Sequence: Synthetic coding sequence
atgccccccatcctgcagcggctgcagcaggccaccaagatgatgtctcggcgcaagatattgctacttgtgctcggatgtagtactgtgtctcttctgatccaccaaggcgcgcaactatcctggtatcccaagctgttccccctgagttgcccgccactccggaatagccctccgaggcccaagcatatgactgtcgcctttctgaaaacccataaaacggcggggacaactgttcagaatatcctctttcggttcgcagaacgccataacttaacggtcgctctgccccacccctcctgcgaacatcaattctgttatccacgcaacttctccgcgcacttcgttcatcccgccactcgccctccacacgtactggcatcccacctccgcttcgatagagccgagctcgagagactgatgccaccatctactgtgtacgtcacgatactcagagagcctgcagccatgttcgaaagccttttttcgtattacaatcagtactgtcccgcctttcgtagggtccccaatgcctctctcgaggcattcttgagggcccctgaggcctactacagagccggggaacactttgcaatgttcgcgcataatactctcgcttatgatctgggcggagataacgaaagaagcccgagagatgatgcagcttacctggcaggcctaattaggcaggttgaagaagtattctccctggtgatgattgccgagtacttcgacgagtcgcttgttctcctgaggaggctcctcgcttgggacctggacgacgtcctgtacgctaagctaaatgcccgagccgccagctctagattggctgcaatcccagctgccctcgcgagggccgccaggacctggaacgcgttagacgccggtctgtacgatcattttaatgcgacgttctggcgccatgtagctcgggccggccgagcctgtgtggagagggaggcccgcgagctacgggaagcgaggcagcgcctcctacgccggtgcttcggggatgagccccttctgcgccctgctgcccaaataagaacaaagcagctgcagccctggcagccttcaaggaaggttgacatcatgggctatgacttgcccgggggcggagctggccctgcaactgaggcctgcctgaaattggccatgcctgaggtccagtacagtaactatttgcttcggaagcagaaacgaaggggcggcgctagagcgcgacccgagcccgtgctggataacccaccaccgaggccaattagggtcttgccacggggtccccagggtccttag

SEQ ID NO: 188790 - DNA, 1461 bp, Artificial Sequence
  Description of Artificial Sequence: Synthetic coding sequence
atgggccccctgagccccgcccggaccctgcggctgtggggcccccggagcctcggcgttgccttaggcgtgtttatgaccatcggctttgcactgcagttattaggaggaccttttcagcggcgcctaccaggattgcagctgcgccaaccaagcgctcctagtcttaggccagctttgccgtcatgccctcctcgtcaacggctggttttcctcaagactcacaagtccggcagctcgagcgtactctctttgctacacagatacggcgaccagcacggactaagatttgcgctacccgccaggtaccagttcgggtatccaaagctcttccaggcttcccgggtgaagggttaccgacctcagggaggggggacgcaactgccctttcacattctgtgtcatcacatgagattcaatttgaaggaggtactgcaggtcatgccttccgattctttttttttctccatagtaagagaccccgcagctctggccagaagtgctttttcttactacaaatccacttcgtccgctttcagaaagtctccatccctggcagcgtttctggccaatccgcgggggttctacagaccaggcgccaggggagaccactacgctcgcaatcttttgtggtttgactttgggttgcccttcccgccggagaaacgggccaagcgagggaacatccacccccctagggatccaaacccaccacaactgcaggtgcttccctccggggccgggcctcgggcacagaccttgaatcccaacgccttgatccaccccgtctctacggtcactgaccacaggagccagatttccagtcctgcgagtttcgaccttggtagcagcagctttatccaatggggtctggcctggctggactctgtgttcgacctagtgatggtcgctgaatacttcgacgaaagcctcgtgctcctggcggatgccctgtgttggggcctagatgacgtggttggtttcatgcacaacgcacaggcgggtcacaaacagggactgtctactgtatccaattctggattaactgctgaggatagacagctcacagcccgtgcacgcgcttggaacaacctagactgggcgttgtatgtgcattttaatcgaagtctctgggctaggatcgagaaatacgggcagggaaggctgcaaacagcggtggctgaactgcgcgcccgtcgcgaagccctggcgaagcattgcctcgtcggcggggaagcatccgaccctaagtacattaccgacaggcgatttcgtcccttccagtttggctctgcgaaggtgctgggatacatcctgcggagcgggctgtcacctcaggatcaggaggagtgtgagaggctggcaacacctgagctgcagtacaaagataaactggatgcaaaacagtttcctccgacagtctctctacccttaaaaaccagcaggcctctctctccttag

SEQ ID NO: 188791 - DNA, 1461 bp, Artificial Sequence
  Description of Artificial Sequence: Synthetic coding sequence
atgggccccctgagccccgcccggaccctgcggctgtggggcccccgatctctgggtgtagcactgggggtctttatgactattggatttgccctgcagctcctagggggcccatttcagcgcagactccccggactgcagctgagacagccctctgcgccaagcctgagaccagctctgccttcttgtcctccacgtcagcggctggtctttcttaagacccataagagcggctcttcctcagttctcagtcttctgcaccggtatggtgaccagcacgggctccgctttgccctgccagcaagatatcagtttggatatcctaagctgttccaggcttctcgcgtgaagggctaccgccctcagggcgggggtacccagttacctttccacatcctgtgccaccatatgcgcttcaacctcaaagaggtgttacaagttatgccatccgactcattttttttctccatagtgcgcgatcccgctgctttggccaggtctgcattttcctactacaagtccactagttccgcttttaggaaatcaccaagtctcgcggccttcctagcaaacccccgcggtttttaccgaccgggcgcaagaggcgaccactacgcaagaaacctactctggtttgatttcggcttaccattcccacctgagaaacgggccaaaagaggtaacattcacccccctcgagatcccaatcccccacagttgcaggtacttccttctggcgcgggtcctcgcgcccagacactgaatccaaatgccctgatacacccagtgagcaccgtaacagatcaccgatcccagatttcctctcccgcatcgttcgacctgggcagctcaagcttcatccaatggggcctcgcttggctcgatagtgtgttcgacctcgtgatggtggctgaatacttcgacgaatcattggtgctgctggccgacgcactatgctggggactggacgatgtggttggctttatgcacaatgctcaggcaggacataagcaggggctgagcacggtcagtaattcaggtcttacggccgaggacagacagctcaccgcacgggcgagggcttggaacaatctggattgggcactctacgtacattttaaccgctcgctgtgggcgcgaatcgaaaaatacggccagggcaggctccagacagctgtcgccgaacttcgcgccaggcgagaggccttagccaaacactgccttgtgggaggggaagcctcggatcccaagtacatcaccgatcgtcgcttccgaccattccagttcgggagtgccaaagttctgggttatattctgcggtcaggcctgtccccccaggatcaagaagagtgcgaacgactcgctacacctgagctgcagtacaaggacaagctggatgccaagcagttcccccctactgtatctctccctctgaagacaagtagaccgctttcgccctag

SEQ ID NO: 188792 - DNA, 1275 bp, Artificial Sequence
  Description of Artificial Sequence: Synthetic coding sequence
atgaccccccggagccccaccagcgccttccggagctgcaccgccgtatcgagctgcctctgcccctcgtcctggccctggctgcatctgagcgtgacatcacccttcccagttccccatggcccatctctcagctgtcaggatgcagcagctttggggaccagcgagccaggggggggatcaggctctctgcatgaccattggctgtgcaccccggcgctcggtagggcgcttcccgaagaggtcttgcaggtaatgccaagcgatagtttttttttctctattgttagggatcccgctgcacttgctcgttccgcgttcagctactataaatcaacatcttcggctttccgcaagagccctagtttagctgcattcctggcaaaccccaggggcttttataggcccggagccagaggagaccattatgcacgtaacctattatggtttgattttggactacccttccctcctgagaagcgcgctaagcggggaaacatacaccctccccgggatcctaatcccccacagctgcaagtcctgccctcgggggccggcccccgggcccagactctgaatccaaatgcactcatacatccagtatcaacagtgacagatcacagatcacagatttcatcaccagcatccttcgatctggggtccagtagctttattcagtggggcctagcttggctggactcagttttcgacttggtgatggtggctgagtactttgatgaaagtctggtcttactcgctgatgctttgtgttggggactggacgatgtcgttggcttcatgcacaatgcacaagccgggcacaaacaaggcctctcaacggtgtcaaactcgggcctgaccgcagaggatcgccagctcaccgccagggccagagcctggaataatttggattgggccctatatgtacattttaatagatccttgtgggctagaatcgagaagtacggacaggggaggctgcagacagcagtggccgagctacgagcccgccgcgaggccctggctaaacactgtctggttggaggcgaggccagtgacccaaagtatatcactgaccgaaggtttcgtccgttccaattcggtagcgctaaagtgttgggctacatactgaggtccggtctgagcccacaggaccaggaggagtgcgagcgcttagcaacaccagaattgcagtacaaggacaaactggatgccaagcagtttcctcccactgtctctttacccctgaagacctcgcgccccctctccccatag

SEQ ID NO: 188793 - DNA, 1641 bp, Artificial Sequence
  Description of Artificial Sequence: Synthetic coding sequence
atgcccggcttcctggtgcggatcctgcccctgctgctggtgctgctcctcctcggtcccaccagaggtctgagaaacgccacgcagagaatgtttgagatagactactctagagactctttcctgaaggatggacaaccgtttcggtacatatcggggagcatacactattcccgcgtgccgaggttctactggaaagatcggctgctaaagatgaaaatggccggcctgaacgcaatccagactctcccgggctcctgtggacaagtggtgggctctccctcagcacaggacgaggcttcgcctctgtccgagtggagagcttcttacaattctgctggctcaaatatcacagacgcattcctgtcccagaggaaatgcgaacctaagggacccctcatcaactcagagttctacacaggctggcttgaccactgggggcaaccccattcaacaattaagacagaagcagtggccagtagtctttacgacattctcgcaagaggcgctagcgttaatctttatatgtttatcggtggcactaattttgcctattggaatggggcaaattctccctacgcagcccagcccacctcttacgattacgacgctcccttgtcagaagctggtgatctgaccgagaaatatttcgccctgcggaatatcatccagaagttcgagaaggtgcccgagggaccaatccctccttcaacccccaaattcgcctacgggaaagtgaccctggagaaactgaaaactgtaggggctgcactggacatactgtgtccctcaggtcccattaaaagcctttatccactgacttttattcaggtcaaacagcattacgggttcgtcctctaccgaactactctacctcaggactgttcgaatcctgcccccttaagcagccctctaaacggggttcatgaccgcgcctacgtggcggttgatggcattcctcagggcgtgctggaacggaataatgtcatcacactgaacatcacagggaaggccggcgctacacttgatctcctggtcgaaaacatgggacgggtcaattacggcgcatatatcaacgattttaagggtctcgtctccaacctaaccctgagctccaacattctcactgactggacaatcttcccattagacactgaagacgccgtctgcagccatctcggggggtggggacaccgagacagcggccatcacgatgaggcctgggctcacaactcaagcaactacaccctgccggccttttacatgggaaacttcagcataccatctggaatccctgacctgcctcaggatacatttatccagtttcccggatggaccaaggggcaggtgtggattaacggattcaatctgggccgttactggcccgctcgcggacctcagctgacactgttcgtgccacaacacatcctgatgacatccgcccctaatactatcactgtgcttgagctagagtgggcaccttgttcatctgacgaccctgaactttgtgctgtgacctttgttgatagacctgtcattgggtcatctgtaacgtatgaccatccctccaagcctgtggaaaagcgacttatgcctcctcctccacagaaaaacaaggattcctggctcgaccatgtttag

SEQ ID NO: 188794 - DNA, 1944 bp, Artificial Sequence
  Description of Artificial Sequence: Synthetic coding sequence
atgttcgagatcgactacagccgggacagcttcctgaaggacggccagcccttccgctatatcagtggttccatccactatagtcgggtcccccggttttattggaaggatagacttcttaagatgaaaatggccggactcaatgctattcagacctacgttccctggaatttccatgaaccatggccaggacagtaccagttctcggaggaccacgacgtcgagtactttctgcggctggctcacgagcttggacttctcgtgatcttacgccccggcccatatatctgtgccgaatgggaaatgggcggcttacctgcgtggctcctggagaaggagtcaattctcctgcgctctagcgaccccgattaccttgcagcggtcgacaaatggctgggtgtcctgttaccaaaaatgaagcccctgctatatcagaacggcgggccagtaataaccgtccaagtcgagaacgagtacggcagctacttcgcttgcgactttgattaccttagattcctccagaagcgctttcgccaccaccttggggatgatgtggtcctcttcaccactgatggggcccacaagacattcctgaagtgcggggctttgcaaggactctataccacagtcgattttggaaccgggagtaatatcactgacgcgttcctgagtcagcggaaatgtgaacccaaggggccattaatcaatagtgagttttatactgggtggttggatcactggggacagccacactctacgattaagacggaagccgtagcctcctctctttacgacatcctggcgaggggagcttccgtgaatttgtacatgttcatcggtggcaccaatttcgcttactggaacggggccaattcaccatacgccgcacaaccaacgtcctacgactacgacgccccactttcagaagccggcgacttgaccgagaaatatttcgccctgcgtaatattattcagaagtttgagaaggttcctgagggtccaatcccacctagcacccctaagttcgcctatggaaaagtcaccctcgaaaagctcaaaacagtaggtgccgcgctggacatcctatgtccgagcggaccaatcaagtctttgtatccccttacctttatccaagtgaaacagcattacggctttgtgctgtaccgtacaactctgcctcaggactgctccaatccagcccctctgagcagcccactaaatggagtgcacgatcgggcgtatgtcgctgtcgatgggataccacagggagtccttgaacggaacaatgtgatcactctcaatatcaccggcaaggccggagccacactggatctgctggtggagaacatgggccgggtaaattacggggcttacatcaatgatttcaaagggttagtgtcaaacctaactctgagcagcaacatcctgactgactggactatttttccgcttgacacagaggacgccgtgtgcagccacctgggtggctggggccaccgcgatagtggtcaccacgacgaggcttgggcccataacagcagcaactatacgctgccagccttctacatgggcaacttttccattccaagtggaatccccgatctgcctcaggacacctttatccagtttccaggctggactaaaggccaggtctggatcaacggctttaatctgggccgatactggccagctcgcgggcctcagctcaccctattcgttccccaacacattttgatgacgtcggccccaaataccataacagttcttgaactcgaatgggctccctgtagttccgatgaccctgagctgtgcgccgtgacctttgtggatcgaccggtgatcggaagctccgttacctacgaccatccctccaaaccagtggagaagcgacttatgccaccaccaccccagaagaataaagattcctggcttgaccacgtctag

SEQ ID NO: 188795 - DNA, 2034 bp, Artificial Sequence
  Description of Artificial Sequence: Synthetic coding sequence
atgcccggcttcctggtgcggatcctgcccctgctgctggtgctgttactcttgggaccaacccgcgggttgcggaatgccacccaaaggatgttcgagatcgattacagccgcgactcatttcttaaggacggccagcctttcagatacataagtggttcaatacattactccagggtgccaaggttctactggaaagacagactcctgaaaatgaagatggccggccttaatgctattcagacatatgtgccttggaattttcatgaaccttggcctggtcagtatcagttcagcgaagatcacgatgtcgagtactttctccgactggcacacgagttgggccttctggtgatcttaagacctgggccttacatctgcgccgagtgggaaatgggaggactgccggcctggctgctggagaaagagtcaatcctacttagaagctcagatccagattatctggcggctgtggacaagtggctgggggtgcttttgccaaagatgaaaccactgctatatcagaacggtgggcccgtcatcactgtccaagtagaaaatgagtatggatcatatttcgcctgcgatttcgattatctgagatttctccaaaagcgctttcgacaccaccttggggatgatgtcgtgctgtttactaccgacggggctcacaagacatttttaaagtgcggagccctgcaggggttgtacacgaccgttgattttggaaccggctcaaatataacggatgcgtttctgtctcaacggaaatgcgaacctaaaggcccacttatcaactctgagttttataccggatggctggaccactggggccagccccacagcacaattaagacggaggcagtagcctcaagcctttacgatatcttagccaggggagcttccgtcaacttgtatatgttcatagggggaactaattttgcatactggaacggggcaaactccccttatgccgcacaacctaccagctatgattatgatgcccctttgtcagaggccggtgacctcacggagaagtatttcgccttgcgaaatatcatacaaaagtttgaaaaggttcctgagggacctatccctccgtccacacccaagttcgcttacggcaaggtgaccctggaaaaactaaagaccgtcggcgctgcgctcgacattttatgtccatcaggcccgatcaagagcctttaccctctgacttttattcaggtgaagcagcactatgggtttgtcctgtataggacaacgctcccccaagactgctctaatcccgctcctttgagcagccccctgaacggcgtccacgatcgggcttatgtcgccgtggacgggataccgcagggtgttcttgagaggaacaatgtaattaccctgaatattaccggaaaggctggcgccaccctcgacctgctggtggagaacatgggcagagtgaactatggggcttacatcaacgattttaaaggactggtctccaacctgacattgagttccaatatcctgactgattggactatttttccattggacacggaagatgcggtgtgtagtcacctcggaggctggggacacagggatagtggacatcacgatgaagcttgggcccacaattctagcaactacaccctacccgccttctatatgggcaacttcagcatcccttcgggaatacctgatctccctcaggacacatttatccagttcccagggtggaccaaggggcaggtctggatcaacggcttcaatctcgggagatactggcccgcgcgtgggccacagctaactttgttcgtcccccagcacatcctgatgacaagcgctccgaatacgattaccgtgctcgagttggaatgggctccatgttccagtgacgatccggagctctgtgcggtcactttcgtggacagaccggttattggtagtagcgtcacatatgaccatcctagcaaacccgtagagaaacgtctgatgcctccacccccacaaaagaacaaggatagttggttagaccatgtctag

SEQ ID NO: 188796 - DNA, 2178 bp, Artificial Sequence
  Description of Artificial Sequence: Synthetic coding sequence
atgcccggcttcctggtgcggatcctgcccctgctgctggtgctgcttctactcggaccaacaagaggcctgaggagtcggttcttgccatgggctttccacctacctcgtcaggccccaaagagccagcttcctttgcacaaacgcggaaccaaaacagcgcccaacgagcacgctagttccaaccgcagtgggcgcaggcgacgacggcagcagtggaatgctacacagaggatgttcgaaattgactacagccgcgactcttttctgaaagatgggcagccgtttcggtacatttccgggtccatacactatagccgcgtgcctcggttctactggaaagatcgcctcctcaaaatgaagatggctggcctaaacgccatccaaacatatgtgccctggaacttccacgaaccttggcccggccaataccagttcagcgaagaccatgacgtggagtatttcctgcgcctggctcacgagttgggcctgttagtaatcctccggcctgggccctacatctgtgctgagtgggaaatgggcgggctgcctgcgtggctactggagaaagagagcatactcttgcggagttctgatcctgattacttagctgccgtcgacaagtggctaggtgtgctgctcccaaaaatgaagccgcttttataccaaaacggcgggccagtgattacagttcaggttgagaatgaatatgggtcctatttcgcctgcgattttgattacctgcggttcttgcagaagcgtttcaggcaccacctgggtgatgatgttgtgttatttacaaccgatggagcccataaaacttttctgaagtgcggggctctccagggactgtacaccaccgttgacttcggcacagggagcaatatcaccgatgctttcctgtcgcaacgcaagtgcgaacctaagggtcccctcataaacagcgaattttataccggctggctggaccactggggtcagccccattccaccataaaaaccgaggcggtcgcctctagcttatacgacattctggcgagaggcgcaagcgtcaatttgtacatgtttattgggggtacgaattttgcgtactggaatggcgcaaattctccctatgctgcccagcccacctcatatgattatgacgcacccctttccgaggccggagacctgacagagaaatacttcgctctgcgcaatataattcaaaaatttgagaaggttcctgagggtcctattcctccaagcacaccgaaattcgcatatggaaaggtaacactcgaaaagctgaaaaccgtcggcgctgctctcgatatcctgtgtccttcaggcccaatcaaaagcctgtatccactgaccttcatacaggtgaagcagcactatggctttgttctctatcgtacgacgctgccacaggattgcagtaatccggcaccactcagttctcctcttaacggtgtacatgatcgtgcatacgtcgctgtggacggcattccccagggggtccttgagcgcaacaatgtgattaccttgaatatcacaggcaaagccggggcgaccttagacctcctggtggagaatatgggacgtgtgaattacggagcatatatcaacgacttcaaaggactggtctctaatctgacacttagctcaaatattctcacagattggacaatctttccccttgataccgaggacgctgtgtgcagccacctcgggggatgggggcaccgcgatagcggccaccatgacgaagcttgggcccataacagtagcaactatacgttgcctgcattttacatgggaaacttctcaattccaagcggcattccggatcttccgcaggataccttcatccagtttcccggctggactaaaggccaagtctggatcaacggattcaatttgggccgatattggccggccaggggccctcagcttactctttttgtcccacagcatatactgatgacttctgccccgaacacaatcaccgtccttgaactcgaatgggccccgtgtagctcggatgatccagagctctgcgctgtgacattcgtggatcggcccgtgattggctcttcagtcacctacgaccacccctctaagcccgtcgagaaacgactgatgcctccaccccctcagaaaaacaaggattcttggttagatcatgtttag

SEQ ID NO: 188797 - DNA, 2058 bp, Artificial Sequence
  Description of Artificial Sequence: Synthetic coding sequence
atggccgagtggctgctgagcgccagctggcagcggcgggccaaggccatgaccgccgcggccgggagcgccggtcgagccgcagttcctctgctgctgtgcgcactcctggctcccggcggagcctacgttctggatgattctgacggtctaggaagggagtttgatgggatcggcgccgtgtccgggggtggagctacatcccgactgttggtcaactacccagagccatatagatctcagatactcgattacttgttcaagcccaatttcggagccagtctgcacatactgaaagtcgagattggcggggacggtcaaactacagatgggacagaaccgtctcacatgcactacgctctcgatgagaactatttccgaggctacgagtggtggctgatgaaggaggcaaagaaacggaaccctaatattacattgattggcctgccatggtcatttcctggttggcttgggaaaggttttgactggccatacgttaaccttcaactgaccgcatactacgtggtaacatggatcgtgggggctaagcgttaccacgacttggacattgactacattggcatctggaacgaacgcagttataatgccaattacatcaaaattctcagaaagatgttaaactatcagggactgcagcgggtcaagattattgcaagtgataatctgtgggaaagcataagtgcttccatgctacttgatgcggaattgttcaaggtggtggatgtgatcggcgcacactacccaggtactcatagcgcgaaggatgcgaagcttactggcaaaaaactgtggtccagtgaggacttttcgactctgaacagtgacatgggtgcgggctgttggggccgcatattaaaccagaactacataaacggatatatgacttctaccatcgcctggaatttggttgcctcctactacgagcagctgccatacggaagatgtggactgatgactgctcaggagccctggtccggacattatgtggtcgaatcacccgtttgggtgagtgctcacacgacacagttcactcagccagggtggtactatttaaagacagtaggacatctggaaaagggcggcagctacgtcgcgcttactgacggtctcggtaacttaaccatcatcatagaaaccatgagtcataaacattcgaagtgtatccggccattcttaccatattttaacgtcagccagcagttcgcaaccttcgtcctgaaggggagtttcagcgagattccggagctgcaggtctggtacaccaagctcggcaagacctctgagaggttcctgttcaagcagctagacagcctttggttacttgatagcgatggctcattcactctgagtctgcatgaggatgagcttttcacgctgactactctcaccacaggaagaaaaggatcctacccattgccacccaaatcccaaccttttccaagcacatacaaggacgacttcaacgtcgattaccctttttttagtgaggcgcctaattttgctgaccagaccggggtatttgaatactttactaacatcgaggaccccggcgaacatcattttaccctccgacaggtactgaatcagcggcccattacttgggcggcggatgcgagtaataccatatcaatcattggggattataactggacaaacctcactattaaatgtgacgtctatattgaaacacctgacaccggcggggttttcatcgcagggcgcgtgaacaaaggagggatcctcattcgatctgcaaggggcattttcttttggatatttgcaaatggatcttatcgcgtgaccggcgatctagctgggtggataatatatgccctcggtagagttgaggttacagcgaagaaatggtataccctgaccctcaccattaagggtcacttcacctctggtatgctgaacgacaagtctctctggactgacatccctgttaattttccaaagaatggctgggctgccattgggacgcattctttcgaattcgcccagttcgacaacttcttggttgaagccacacggtag

SEQ ID NO: 188798 - DNA, 1989 bp, Artificial Sequence
  Description of Artificial Sequence: Synthetic coding sequence
atggccgagtggctgctgagcgccagctggcagcggcgggccaaggctatgaccgcagccgccggctcagcaggacgagctgcagttcccttactgctgtgcgcccttctcgctcccgggggagcatacgtgcttgatgacagtgacggtctggggcgggagttcgacggaattggcgccgtaagtggcggaggccctaatttcggcgcaagccttcacatactgaaagtggagatcgggggtgatggccagacaactgatggaacagagccaagtcatatgcattacgctttggacgaaaattatttcagagggtatgaatggtggctgatgaaggaagcaaaaaaacgaaacccaaatattacactgattggattaccttggagcttccccgggtggttgggaaagggatttgattggccttacgtcaatctgcagcttacagcttattacgtggtgacctggatcgtgggagctaaaaggtaccacgatctggatatcgattacatcgggatttggaatgagcggtcatacaacgccaactatatcaaaatactaagaaagatgctcaactatcaaggcttgcagagagtgaagattatagcgtctgataatctctgggaaagcatctccgccagtatgctgttagacgctgaactgtttaaagttgtcgacgtgattggtgctcactatcccgggacccacagcgctaaggatgctaaacttacagggaaaaaattgtggtccagcgaggattttagcactttgaattctgacatgggtgctggctgttgggggagaattctgaatcagaactatataaacggctatatgacgagcaccatcgcttggaatctcgtagcatcatactatgagcaactcccctatggccgctgcgggcttatgacagctcaggagccctggtccggccattatgttgtcgaaagcccagtgtgggtctctgcacatacaacccagttcacacagccaggatggtactatctcaagaccgtgggccacctggagaaagggggatcctatgtggccttaactgacggcctcggtaacctcacaataatcattgagaccatgtctcacaaacattcaaaatgtattcggcctttcctgccctactttaacgtatcgcaacaatttgccactttcgtgctgaaaggatcattctctgaaatccctgagctgcaagtatggtacacaaagctgggaaaaacgagcgaaaggttcctcttcaagcagctcgattctctgtggctgctagattcagacggtagctttacattgtcactgcatgaagacgaactgttcaccctgaccaccctcaccacaggacgaaagggatcctatcccttgccaccaaaatcgcagccattcccctccacctacaaggacgactttaacgtggactacccattcttctcagaagcaccaaactttgctgaccagacaggtgtgtttgaatattttaccaacatcgaggaccccggagagcaccacttcacacttcgccaggtgctgaatcagcgcccaataacctgggcagcagacgctagtaataccatatcaatcatcggagactacaactggacaaacttgacgatcaagtgtgatgtgtatattgaaactccagataccggtggcgtgtttatagcaggtagggtgaacaagggaggcattctgatccggtccgctcgaggcatatttttctggattttcgctaacgggagctatcgggtaaccggagacctggcaggctggatcatctatgcgctaggacgagtagaggtaactgccaaaaaatggtacactctcacactgacaatcaaggggcactttactagcggtatgctgaatgacaaatctctgtggacagatataccagttaatttccctaaaaatgggtgggcggccattggcacccattctttcgaatttgctcaatttgataatttcctcgtagaagcgactcgctag

SEQ ID NO: 188799 - DNA, 1980 bp, Artificial Sequence
  Description of Artificial Sequence: Synthetic coding sequence
atgctgggcaagagccacggccgggccacccacggccccctgcccttggcggatctgggtatccacctgccctgcgtcaaagtgttacatcaggttactcccgaagaaaaaccagctgccacctcgcggctgctcgtgaactaccccgaaccttatcggagtcagattctggattacctctttaaacccaacttcggcgccagtttacacattctgaaagtggaaattggcggggatggacagacaactgatgggacagaaccgtctcacatgcactacgctctggacgagaactactttcgaggatatgagtggtggctgatgaaggaagcgaagaagagaaacccgaatatcactctcattggactgccatggagctttcctggatggctgggtaaaggattcgattggccgtacgtcaatctgcagctgactgcctattacgtggtgacatggatcgtcggcgccaagcggtatcacgatctggatatcgactacattgggatctggaacgaaaggagctataacgcaaactacataaagatcctgaggaagatgctaaactaccagggcctccaacgcgtgaagatcatcgcatcagacaacctctgggagagcatttcagcctccatgctgctcgatgccgagctgttcaaggtggtggacgtaattggtgcccattaccccggcactcacagcgccaaggacgcgaaactaactgggaaaaagctgtggtcctccgaagattttagtactctcaacagcgacatgggagccgggtgttggggtcgaatactgaaccagaactacattaatggctatatgacctctacaatcgcctggaacctcgtcgcttcttactacgagcagctcccatacggccgctgcggcctcatgacagcgcaagagccttggtcgggacattatgttgtggagtccccagtgtgggtgtctgcccacaccactcagttcacgcagccaggctggtactatttaaagacagtcggccacctcgagaagggagggtcttatgtcgcgctcacagatgggctcggtaatctaaccattataattgagactatgagtcataagcacagcaaatgcatacgtccttttctgccctattttaacgtttcccaacaattcgccacgttcgttcttaagggcagcttttccgaaattcccgaactgcaggtgtggtataccaagctgggcaaaacctccgagcggttcctttttaagcagttagacagcctttggttgcttgattccgatggctcttttacgctctctctgcacgaggatgagctgttcacgctgactactttgacaacgggcaggaagggcagttaccctctgccgcctaagtcacagccctttccttccacctataaggatgacttcaacgttgattatccattcttcagtgaagccccaaatttcgcagaccagactggcgtctttgaatatttcaccaacatcgaggatccaggtgaacatcacttcaccctccggcaggttttgaaccagaggcccatcacctgggctgctgacgcgagtaacacaatctctattatcggcgattataactggactaacttgaccatcaagtgtgatgtgtatattgagactccagataccggtggcgtcttcatagccggccgggtgaacaaaggtggcatcttgattcggagcgctcgcgggatctttttttggatttttgccaacgggtcatatagagtcaccggggatttggctggctggatcatctatgctctgggtagagtcgaggtgactgccaagaaatggtacactctgacattgactattaaaggccactttacaagcggtatgctgaatgacaaaagcctctggaccgacattccagtaaatttccccaagaacggttgggcggcaattgggacgcatagttttgagttcgcacagttcgataattttcttgtagaggctacgcgctag

SEQ ID NO: 188800 - DNA, 1425 bp, Artificial Sequence
  Description of Artificial Sequence: Synthetic coding sequence
atgctgaactaccagggcctgcagcgggtgaagatcatcgccagcgacaacctttgggaaagtattagcgcatccatgctgttggacgcggagctgtttaaggtcgtcgacgtgattggagcccattatcccggtacacattctgccaaggacgcaaaactgacaggaaagaaattgtggtccagcgaggatttctctaccctgaatagtgatatgggcgctggttgctggggaaggatcctgaatcaaaattatatcaatggctacatgaccagcaccatcgcctggaatctggtcgcaagttattacgagcaactgccttatggccgctgtgggctcatgactgctcaggagccctggtctgggcattacgtggtagaatcacccgtctgggtttctgcacacacaacccagttcacccagccaggctggtactatttaaaaaccgttgggcatctcgaaaagggtggatcgtatgtagctttgaccgatggccttggtaacttgacaataatcatcgagaccatgtctcacaaacattccaagtgcatccgaccttttcttccctatttcaacgtcagccagcagtttgccacatttgtcctgaagggcagcttctccgaaattcccgagttacaggtgtggtacacgaaactgggcaagacgtcggaaaggttcctctttaaacaacttgactccctctggctgctggatagcgacggaagtttcacattatcactgcatgaagacgagctgttcactttaaccacattgaccaccggccggaagggaagctaccccctaccgcctaagtctcaaccattccccagcacatataaggatgattttaacgtagattatccctttttctcggaggccccaaacttcgcagatcagacaggtgtgttcgaatattttacaaacatcgaagatcctggagagcatcatttcaccctgcgacaggtcctgaaccagcgacccatcacctgggccgcagacgcatcaaacactattagtatcattggtgattataattggaccaatctcaccattaaatgtgacgtgtacatcgagacaccagacactggaggggtctttatcgccggccgcgtgaataaaggggggattcttatacgttccgcccgcggtatttttttctggatatttgctaacggctcatacagggtcacgggcgacctcgctggttggatcatctatgctctaggacgggtggaggtgacggctaaaaagtggtacacgctcacactcacaattaaaggccatttcacgtctggtatgttgaacgacaaatcactttggacagacatccccgtcaactttcctaagaacgggtgggccgctatcggcactcattccttcgagtttgcccaatttgataactttctggttgaagccactagatag

SEQ ID NO: 188801 - DNA, 1770 bp, Artificial Sequence
  Description of Artificial Sequence: Synthetic coding sequence
atgggcttcatggtggccgacctgtgggccaccagccggctgctggtcaattacccggagccgtacagatcgcagatcctggactacctgtttaagcctaacttcggggcgagcctgcatatcctgaaggtggagatcgggggagatggccaaactaccgatggaaccgagcccagtcatatgcattacgcgctggatgagaactatttccgcggatatgagtggtggctgatgaaggaggccaaaaagcggaatccgaacattactctcatcggcctgccctggtcctttccaggttggctaggcaaaggttttgattggccttacgttaacctccaactcaccgcctattatgtcgtgacatggattgtcggagccaagagatatcatgatttagatatcgactacatagggatttggaacgaacgaagctataacgctaactacatcaagatcctgcgaaagatgttaaattatcaaggtcttcaacgggtaaaaattatcgcgagtgataatttatgggagtccattagcgcctcaatgttgctcgatgctgaactgttcaaagtcgtggacgtgataggggcccattacccgggcacacatagcgccaaggatgcaaagctcacaggaaagaagctgtggtcttccgaagattttagtaccctgaattctgacatgggagctggatgctggggacggattttgaaccagaactacattaatggatacatgacttcaactatcgcatggaacctcgtggccagctactacgaacagctgccctacggccggtgtggcctgatgaccgcccaagaaccctggagtggacactatgtggtggagtcccccgtgtgggttagcgctcatactacacagttcacacagcctgggtggtactacttaaagacagtgggccacctggagaaggggggctcttatgtggctctgaccgatggactgggaaatctgaccatcattatcgaaaccatgagccataagcacagtaagtgcatacgaccatttttgccatacttcaacgtaagtcagcagtttgctacatttgtcctcaaaggttctttcagcgaaattccagaactccaggtgtggtacacaaaactgggaaagacgtctgagaggttcctcttcaagcagctcgacagcctctggttgctggactccgatggcagttttaccctgtcgctccatgaggacgagctgttcacgctgactactctaactaccggcagaaagggatcctaccccttgcccccaaaatctcaaccctttcccagcacatataaggatgactttaacgtggactacccattcttcagcgaggcccctaacttcgcggaccagaccggagtgttcgaatacttcacgaacatagaagacccgggcgagcaccacttcaccttaaggcaggtactgaatcagagaccaattacatgggccgctgacgcctcaaacactatttcaattatcggcgactataattggaccaatttgacgattaagtgcgacgtgtacattgaaactcccgacaccggcggcgtctttatcgctggacgcgtcaataaggggggtatactgattcgttcagcacggggcatcttcttctggatttttgctaatgggtcatacagagtgacaggcgacttagcagggtggattatctatgcccttgggcgggtggaggtaaccgccaagaagtggtacacgcttaccctcaccatcaaagtggccggccggaggaaaaaaacctag

SEQ ID NO: 188802 - DNA, 372 bp, Artificial Sequence
  Description of Artificial Sequence: Synthetic coding sequence
atggcccggggcagcgccctgctgctggccagcctgctgctggccgcggccctaagcgccagcgccggactgtggtcccctgccaaggaaaaaagagggtggaccctgaactctgctggctatttactggggccccatgcagtaggaaaccaccgtagctttagtgataaaaacggtctgacaagcaagagagaactacgcccggaggacgacatgaaacccggatcattcgatagaagcatccctgagaacaacatcatgcgcacaataattgagtttctgtctttcttacatcttaaagaagccggagccctggataggctgcttgatttgcctgccgcggcgtcaagtgaggacattgaacgtagttag

SEQ ID NO: 188803 - DNA, 1050 bp, Artificial Sequence
  Description of Artificial Sequence: Synthetic coding sequence
atggagctggccgtgggcaacctgagcgagggcaacgccagctggccagagcctcctgcgccagagccgggacccttattcggcattggtgttgagaactttgttaccctggtcgtatttggactaatttttgctttaggagttttgggcaattccctcgtgatcaccgtattagcccgcagcaaacctgggaagccaagatctactacaaacttgttcatcctaaatctttcgatcgccgatttggcgtatctgctcttctgcattccgtttcaggcgaccgtatacgctctgcctacctgggtcttaggagctttcatttgtaagtttatccattactttttcaccgtgtccatgctcgttagtatcttcaccttggccgccatgtccgtggacaggtatgttgcgatcgtgcactccaggagaagttcttccctgcgggtgtcccgaaatgcactgctaggtgtcggatgcatttgggcgctgtctattgcaatggcctcacctgtcgcctatcaccaaggcctttttcaccctcgcgcttccaatcagaccttttgctgggagcagtggcccgacccaaggcacaaaaaggcttatgtagtctgcaccttcgttttcggctatctgctgccactcctcctgatttgcttctgctacgctaaagtcctgaaccatttacataagaaactcaaaaatatgtccaagaaatcagaggcctccaaaaagaaaactgcgcaaaccgtgctagtcgtcgtagtcgttttcggcatttcttggttgccccatcatatcattcatttgtgggccgagtttggggtgtttcccttgacccctgcgtcctttctgtttaggataactgctcactgccttgcgtacagcaactcttccgttaacccaattatatatgctttcctaagtgagaacttccgaaaagcttacaagcaggtgtttaaatgtcatatccgtaaggactcccatctgtctgatacaaaagaaagcaaatctagaatcgatactccaccctcaaccaactgcacccacgtttag

SEQ ID NO: 188804 - DNA, 1164 bp, Artificial Sequence
  Description of Artificial Sequence: Synthetic coding sequence
atgaacgtgagcggctgccccggcgccggcaacgccagccaggccggggggggaggaggctggcaccctgaggccgtgatcgtgcccctgttatttgcgctaatttttctcgtcggtaccgtaggcaatactctggtcctggccgtattgttgaggggcggacaggccgtgtcaactacaaacttgttcatactgaacctcggcgtggccgatctgtgtttcattctgtgctgtgtaccttttcaggccacaatctataccctggatggatgggtgtttggatccctgctgtgcaaagcagtccattttctcatcttcctgacaatgcatgcttcgagcttcaccctggccgcggtatcactagatcgttatctggccattcgctatcccctgcactctcgcgaacttcgcacaccccgaaacgcgcttgcggcaatagggctaatttggggtttgagcctcctttttagtggcccatacctgagttactatcggcagtcccaactggctaaccttacagtctgtcaccctgcttggtcggccccacgtagaagagccatggatatttgtaccttcgtgttcagctatctcttgcctgtgttggtcctcgggctgacctacgccagaacactcaggtatctctggagagccgttgacccagtagccgcggggtctggagctcgacgagccaagcgcaaagttacacgcatgatcctgatcgttgctgctctattttgtctgtgttggatgcctcatcatgccctgattctttgcgtctggttcggtcagtttccattaactagagctacttacgccctgaggatcctgtcccatctggttagttatgccaatagttgcgtaaacccaattgtttacgcactcgtttccaaacacttcagaaagggatttagaaccatttgcgccgggctacttggaagagctccggggcgggcaagtgggagagtctgcgccgcagccagggggacgcacagcggtagtgtactggagcgagagagcagcgacctcttacatatgtccgaagccgcaggcgctcttaggccgtgccctggggccagccaaccctgtattctggaaccttgcccggggccatcttggcagggtcccaaggcaggcgactcgattcttaccgtggacgtcgcttag

SEQ ID NO: 188805 - DNA, 1107 bp, Artificial Sequence
  Description of Artificial Sequence: Synthetic coding sequence
atggccgacgcccagaacatcagcctggacagccccggcagcgtgggcgctgtcgcagtgccagtggtctttgctctcatttttctgctcggtacagtaggtaatgggctggtcctcgctgtactgttgcagcccgggccttccgcttggcaggagcccggaagcaccaccgatttgttcatcttaaacctggcagtggcggacctatgcttcatattgtgctgcgtccccttccaggccacgatctacactctggatgcctggcttttcggagcgcttgtttgcaaagccgtacatttgttaatttatctgaccatgtacgcttcaagcttcaccctggccgccgttagtgtggacaggtatctggcagtacggcatcccctcagaagcagagcacttcgcacaccacgcaacgcaagagccgctgtagggctggtgtggttacttgcggccttgttcagtgccccttaccttagttattacggaacggtgcgctacggagcattagagttgtgtgttcccgcctgggaggacgcccggcgccgggcacttgacgttgctacatttgcggcgggctatttgctgcccgtggctgtcgtctctctggcctatggacgtacactaagatttctgtgggctgctgtaggacctgctggtgccgccgccgccgaggctcgaaggcgcgcgaccggtagggcaggtcgggctatgctggcagtcgctgcactatacgctttgtgctgggggcctcaccatgccctcatattatgcttctggtacggcagattcgccttcagcccggctacttacgcttgtaggctggcatctcattgtttggcctatgccaatagctgcctgaatcctctcgtttacgctctggcctccagacatttccgtgcaagattcaggagactgtggccttgcggtcgcaggaggaggcatcgcgccaggcgcgccctcagacgggtacgacccgcttcatcaggtcccccaggctgtcccggtgatgctaggccgtctggcaggctgctggctgggggcggccaggggcctgagccacgggagggccccgtgcacggcggggaggcagccagaggcccagagtag

SEQ ID NO: 188806 - DNA, 1959 bp, Artificial Sequence
  Description of Artificial Sequence: Synthetic coding sequence
atgggcaacctgcagagcgagcccagcgccggcggcggcagccggaaggtacagccatccgatcgagcccctgacagtcgacgtaccagcctggttgaaccagagatgacaagccaggctatgcgtctgaccaggggactgggcgtgtggtttccgggcagtgctacgccgccgggcctgatggtgccgcgggaacctcaggcctccccttccacactcccgctcacactggagcgaccaagccccgtaatgccccctccagaggaggccgctgcggtgtctgcaccccctcccgctcctgccgggacgctgctccccgggccttccaagtggcagaaacctgcaggaactcctgtcccacgcattagacggttgctcgaagcctctcataggggacaaggcgaccccccttcgctgaggcccttaaagccgcctccccccccacgacagctgtcagtcaaagatacagtacctagggctccttcacaattccccccccctcttgaaacatggaagcccccacctcccttacccagcgagcgccagccagccgaccgacgaattaccccagccttggcaactccagcttctccccctacagagtcccaggcggggccaaggaatcagggccaaaccgccggacgcgcacggggcggagcacccccccatgccggcgagggggaaatggcccagcccgccgattccgaaagtggcctctcattactctgcaaaattactttcaaaagccgacctagcctggctccccccgccgctagctcctcattggctgccaaggcatcactgggaggcggaggaggtggcggactgtttgccgcttctggagctatctcctacgccgaggtcctgaaacagggccccctgccgcccggagccgccagacctttaggcgaggtatctcgtggagctcaggaagccgagggcggcgacggcgacggagagggctgcagtgggcctcccagcgcccccgcatcgcaagctagagcgcttccgccacctccttataccacgtttccgggttccaagcctaagtttgattgggtgtccgctccagacggccctgaacgtcatttccgcttcaatggggccggaggcggcatcggggctcctcgacgcagggcggcggctctgtccggaccctggggcagtcctcccccaccgcctgagcagattcacagcgcacccggacccagacggcctgcccccgctctgctggcgccccccaccttcatctttcccgcccctacaaacggcgagcctatgcgcccaggcccccccgggctgcaggaactgccaccgttgccgcctcctaccccacctcccaccctccagcctccggctcttcaacccactccactccctgtcgccccccccctaacccctggtctgggacacaaagaatctgccctggctccaaccgccgcacctgccctccctccagctctggccgcggaccaggccccagcaccgagccctgctccagcacctaccgtggctgaacccagccccccagtgtccgcgccggccccagctgccgctcccataaaaacccggacccgtcgcaataaaggatcaagagccgcaaggggcgcgacacgaaaggacggactgcacggagatggcccacgtgagcgtgcgaccgctaccgttcctgactctagcgggggaggcgggggaggttcgggtgcctcccaaacaggtgctgccaatacacgggcggcgcgccactggctgccattccaagtactgaacagctgcccttgcaaatgctattgccatcaccaacccagacaccgccggctgcctcgcaatgtgtccgcctggttgtctacctcgactaatcacctcggcgagccaccatgggtggcaactatcaagctgtcagggtctcttgtggccaaactggagcactatgatctccaggccacacactccaattag

SEQ ID NO: 188807 - DNA, 675 bp, Artificial Sequence
  Description of Artificial Sequence: Synthetic coding sequence
atgggcaacctgcagagcgagcccagcgccggcggcggcagccggaaggtccaaccttctgacagagctcccgactcccgtcggacttcactcgtagaacccgaaatgactagccaggccatgcgcttgacgaggggtctcggcgtgtggtttccaggaagcgcaacccctcctggattgatggtgccccgtgagcctcaggccagcccttccacattgcccctgaccctcgagcggcctagccccgttatgcccccaccagaggaagccgccgccgttagtgctccccctccggcaccagctggtacccttctgcctgggcctagcaagtggcaaaagcctgcagggacacctgtgcccaggatcaggcggttgcttgaagcaagccaccgcggacagggtgaccctccatcgttacgtcctctgaaaccacctcctccgcctaggcagctcagcgtgaaagacaccgtcccacgtgcgccaagccaattccctcctcccttggaaacatggaagcccccacctcccctgccaagcgagcggcagcctgccgatcggaggattacacccgccctcgcgacccctgcttgcgttagggcaaggacacggggctgtgcccaccaagacccccatgcccaggaacagggtttcccctgttctcccggcagggactag

SEQ ID NO: 188808 - DNA, 2094 bp, Artificial Sequence
  Description of Artificial Sequence: Synthetic coding sequence
atggcccggctggtggccgtgtgccgggacggcgaggaggagttcccgttcgagcgcaggcagatccccctatacatcgacgacacgctaaccatggtgatggagtttcctgacaatgtgctgaacctggacggtcatcaaaataacggcgcgcaactaaagcaatttattcaacgccacgggatgctgaagcagcaagacctttctattgcaatggtggtcacttctcgggaggtgctgtcggctctgagccagctggtcccatgcgtcgggtgtcggagatccgtggagaggcttttttcacagttagttgagagtggcaaccctgctcttgagcccctgaccgtgggccctaagggcgtgctgagcgttacgagatcttgtatgactgatgcaaagaagctttacaccctgttctatgtccacgggtccaaactgaacgatatgatcgatgcaattccaaagagcaaaaaaaacaagcgctgtcagctgcatagcctggatactcacaagcctaaaccactgggcggttgctggatggacgtctgggagttgatgtctcaggagtgcagagatgaagttgttctgatcgattccagttgtctgttggagacgttggagacctatctgcgaaagcaccggttttgtacagactgcaaaaataaggtgctgagagcttacaatatcttaattggagaactggactgcagcaaagaaaagggatactgtgctgccctgtacgaggggctgcgttgttgcccccacgaacgccatatccatgtttgctgcgagactgattttatcgcccacttattggggagagccgagccagagtttgctggaggacgcagggaacggcacgccaagacgatagatattgcacaggaggaggttctgacgtgcctgggaatacacctgtacgaacggctgcaccggatctggcagaagttgagagcagaagaacagacatggcagatgttattctatttaggcgtggacgctctaagaaaatcatttgaaatgacagtcgagaaagtgcagggtatttctagactagagcaattgtgcgaagaattttcagaagaagagagggttagggaattgaagcaagagaagaagcgacagaagcggaagaatagaagaaagaataagtgtgtttgtgatattcccactcccttgcaaaccgctgatgagaaagaggtgagtcaggagaaagaaaccgacttcatcgagaactccagctgtaaggcatgcggctccactgaagacgggaacacgtgtgttgaggtaatcgtgacgaacgaaaacaccagctgtacctgtccctcatccggaaatctcctcggctctccgaagataaagaaaggccttagccctcattgcaacggctcggactgcgggtacagttcgtctatggaaggctcagagacaggaagtcgtgaggggtccgatgtggcctgtacagagggtatctgcaaccacgacgaacacggggacgactcgtgcgttcaccactgtgaggataaagaagacgacggtgactcgtgcgtggaatgttgggctaatagcgaggagaacgacacgaagggcaaaaacaagaagaaaaaaaagaaatccaagatcctgaaatgtgacgaacacattcagaagctcggatcatgtatcacagatcctggaaatcgggaaacgtcaggaaataccatgcacaccgtgttccatcgggacaagactaaagacactcatcctgagtcttgctgctctagcgagaagggaggacaacccctgccgtggttcgagcaccgaaagaatgtgccgcagtttgctgaaccaaccgagaccctgtttggtcctgactcaggaaaaggggctaagtccttggtggaacttctggacgagagtgagtgcacctccgatgaggaaattttcatctcacaggacgagattcagagtttcatggccaataatcagagcttctacagtaaccgagagcagtacagacagcacctgaaggagaaatttaataagtactgccgactgaacgaccacaaaagaccaatttgcagtggttggctgaccacagctggcgcaaattag

SEQ ID NO: 188809 - DNA, 1548 bp, Artificial Sequence
  Description of Artificial Sequence: Synthetic coding sequence
atgagcagccccaacatctggagcaccggcagcagcgtgtacagcactccagtttttagccagaagatgacagtatggattttactccttttgtccctgtacccaggatttacttcacagaaatctgacgatgattatgaggattacgcgtctaacaagacatgggtgctgacacccaaagttccggagggcgatgtgaccgtgatccttaataacctgttagaggggtatgacaataaattaagacctgacatcggggttaaacctacactcatccacacagacatgtacgtcaacagtattggcccggtgaacgccatcaatatggagtacacaattgacatcttcttcgcccaaacctggtacgatagaaggctaaagttcaatagcaccatcaaagtattgcgccttaattctaatatggttggtaagatttggattcccgacaccttcttccgcaattcaaagaaggccgatgcacattggatcaccaccccgaatcgtatgctccgtatctggaacgacgggagggttctatatacgctgcgactcacgatcgacgcggaatgtcagctccagttgcataacttccccatggatgagcactcctgtccgctggagttctcatcatggtcccggtcaatcgcccaggcaggaatgtgtagcggcgtaatcagtgctcactacagtctgcgcttttggggctcgaccgatccacccactctggctagccgtgtggccggcatatccgacggctatccacgcgaggaaatcgtgtaccaatggaaacgttccagcgttgaggtcggcgacaccagatcttggaggctgtaccaattcagtttcgtggggctaagaaatacaaccgaagttgtcaagactacgtcaggtgattacgtagtgatgtctgtgtatttcgatctctcaagaaggatgggttacttcacaattcaaacttatattccctgcaccctgatagtcgtcctatcttgggtgtccttttggataaacaaagacgccgtccccgcccgtacctctttggggattactaccgttctcaccatgaccacgctgtctacgattgccagaaaatctcttcctaaggtgtcttacgtgaccgcaatggacctctttgtctccgtctgcttcatctttgttttctctgccttggtggagtacggaaccctacattatttcgtgtctaataggaagccctctaaggataaagacaaaaaaaaaaagaatccactccttcggatgttctcattcaaggctccaacaatcgacatcaggcctcgctccgccaccattcaaatgaacaatgcaacgcatctccaggaacgggacgaggagtatggatatgagtgccttgacggaaaagactgtgcctcgtttttttgttgcttcgaagattgccggacgggcgcatggcggcacggaaggatccatatcaggatcgctaagatggactcctatgcaagaattttttttccgactgcgttttgtttgtttaacttagtctattgggtgagttacctgtatctatag

SEQ ID NO: 188810 - DNA, 762 bp, Artificial Sequence
  Description of Artificial Sequence: Synthetic coding sequence
atggcccccaagctgctgctgctgctgtgcctgttcagcggcctgcatgcaaggagtcgcaaggtcgaggaagatgaatatgaagatagcagttccaatcaaaaatgggttctcgcccccaagtctcaggacaccgacgttacgttgatcttgaataagctgctaagagagtatgacaagaaacttagacccgatatcggcattaaacctacagttattgacgtcgacatttacgtaaatagcatcggccccgtgtccagtatcaacatggagtaccaaattgacatctttttcgctcagacatggaccgactctaggcttaggtttaatagtaccatgaaaatactgacactcaatagtaatatggtggggctcatctggattccggataccatctttcgaaacagcaagactgccgaggctcattggattacgacaccaaatcagttgctgcgaatatggaatgatggcaaaattttatatacccttagactcaccatcaatgctgaatgccagctccagcttcacaacttccctatggatgagcactcctgcccgctgatcttctcaagctacggttaccctaaggaagagatgatatataggtggcgaaaaaattcagttgaggccgctgaccagaaaagctggcggttgtaccagttcgatttcatgggccttaggaatactactgaaattgtgactacatcagccggcaggaatctgcttaaggaggctcaactgtctaaagcacgggaagcttag

SEQ ID NO: 188811 - DNA, 1371 bp, Artificial Sequence
  Description of Artificial Sequence: Synthetic coding sequence
atgcggaagagccccggcctgagcgactgcctgtgggcctggatcctcttgcttagcaccctgacagggcggtcgtatgggcagcctagcttacaggatgagctgaaggataataccacagtttttacgcggatccttgaccgcctccttgacggttatgataacagacttagaccgggcctaggagagcgcgtgaccgaagttaaaacggatatcttcgtaacttctttcggccctgtgtcagatcacgacatggagtataccatcgatgtgttctttcgacagtcttggaaggatgaacgcctgaaatttaagggtccaatgaccgtcctgcgtctcaacaaccttatggctagcaagatctggactccagacacattcttccacaatggaaagaagagcgtggcccacaacatgaccatgcctaacaaactcctgcggattactgaggacggaactctgctctacacaatgcggttgacagtccgcgccgaatgcccaatgcacttggaagactttcccatggacgcccacgcgtgtccactaaaattcggcagttatgcttatactagggcggaggtcgtgtacgagtggacaagggagcccgcaagatctgtggtggtggccgaagatggctcacgactgaatcaatatgacctgttggggcagactgtcgactctgggatcgtgcagtcctcaactggagaatatgtggtcatgacaacacacttccatcttaagcgaaagatcggttacttcgttatccaaacgtatcttccatgcatcatgactgttattctctcacaggtcagcttttggttgaaccgcgagtccgtccctgcccgcaccgtgttcggcgtaacaacagtcctgactatgacaactctgagtatatccgcccgaaactctttgccgaaggtggcgtatgctacagcaatggattggtttatagcggtctgctacgcctttgtgttttctgcactcatagaatttgctaccgtgaactactttacaaaacgtgggtacgcatgggatggaaagtcagtggtgccagagaagccaaagaaagtgaaggaccctcttattaagaaaaataatacctatgccccgaccgctacatcatacacgccaaatctggcgcgtggtgacccaggcctcgcaacaatcgcgaagagtgcgacaatcgagcccaaagaggtcaagcccgaaactaaacctcccgaaccgaagaaaacgttcaactccgtctctaagattgataggttgtctcgcatagcatttcccctgctgtttgggatatttaatctcgtctattgggccacttatttaaatcgggaaccacaattgaaagctccaaccccccatcagtag

SEQ ID NO: 188812 - DNA, 1371 bp, Artificial Sequence
  Description of Artificial Sequence: Synthetic coding sequence
atgcggaagagccccggcctgagcgactgcctgtgggcctggatcttgttactgtcaacattaactgggcgcagctatgggcagccaagcctccaggacgaactgaaagataacaccaccgtcttcacacggatcctggaccgcctactggacggctacgacaatcgcctgcgacctggcttgggcgaaagagtgaccgaggttaaaaccgatatcttcgttacttctttcggtccagtctctgaccatgatatggaatacactattgacgtcttcttccgccagtcatggaaggatgagcgcctgaagtttaagggtccgatgacagtactaaggctgaacaatttgatggcgagcaagatttggacccccgatacatttttccacaacggcaaaaagtcagtggcacacaacatgaccatgcctaataagctgctgaggattacggaagacgggacacttctgtacactatgcggctaacagtgcgtgccgagtgtcctatgcatctggaagatttccccatggatgcccatgcctgccccctgaaattcggcagctacgcttacactcgggcagaagtggtgtacgagtggacaagggaaccggcacgatcagtcgtcgttgcagaagacggttcccggcttaaccaatacgacctcctagggcagacagtagattcagggatagtgcaatcatcaactggggagtatgtggtgatgacaacccattttcacctgaagagaaaaataggatatttcgtcattcagacctacctaccatgcattatgacagtcatcctttcacaggttagcttttggctgaaccgcgaatctgtccctgctcgcaccgtcttcggagtcacaactgtgctgaccatgactactttgtccatttcagctcgcaactctctgcctaaggtggcttacgcaacggccatggattggtttattgccgtatgttacgcctttgtcttcagtgctctgattgaatttgctactgtgaattacttcacaaagcgggggtacgcgtgggacggcaaatccgtggtgcctgaaaagcctaagaaggtgaaagacccccttatcaagaagaacaacacctatgcccccaccgctacgtcctatactcccaacctggctcggggcgatccaggactggcaaccattgcgaaatccgctactatcgagccaaaagaggttaaaccagagactaagcccccggaacctaaaaaaacattcaacagtgtatctaagatagatcgactgtccagaatcgccttcccactcttgttcggcatcttcaaccttgtgtactgggcaacctacttgaaccgggaaccccagctgaaagctccaaccccgcaccagtag

SEQ ID NO: 188813 - DNA, 1371 bp, Artificial Sequence
  Description of Artificial Sequence: Synthetic coding sequence
atgcggaagagccccggcctgagcgactgcctgtgggcctggatcctgctcctgagcaccttgactggccgcagttacggtcagccttcgctgcaggatgaattaaaagataatactacagtcttcactaggattctggacaggctcttggacggctacgataacagactgcgacctgggctgggggagcgggttactgaggtcaaaacggatatttttgtgactagcttcggaccagtttcggaccatgatatggagtatacaatcgacgtgttctttagacagagctggaaagacgaaagattgaagttcaagggaccaatgaccgtgcttcggctgaacaacctgatggcttcaaagatttggacaccagatacatttttccacaacggtaagaagagcgttgctcacaacatgacgatgccaaataagctgttgcggataaccgaagacgggacactgctctataccatgagacttaccgtgagagccgagtgtccgatgcacctggaagattttccaatggacgctcacgcatgccctctgaagtttgggtcgtacgcatatacccgggccgaagtcgtgtacgagtggaccagggagcccgctcgtagcgtggttgtggctgaagatggtagccggctcaaccagtacgatctactgggtcagacggtggacagcggcatagtccaaagttcaaccggtgaatacgtggtaatgaccacacatttccatctcaagagaaagattggctacttcgtcattcagacctatctgccttgtattatgacggttattttgagccaggtgagtttctggcttaatagagagtctgttcccgctcgcacagttttcggggtgacaaccgtattgaccatgaccaccctgtccatctcagcccgcaattccctgcctaaggtagcgtatgcgaccgcgatggattggttcatagctgtttgttatgcctttgtgttctctgctttgattgagttcgcgaccgtcaactacttcacaaaacggggatatgcatgggacgggaaatccgtcgtaccagaaaagcctaagaaggttaaagatcctctgatcaagaagaataacacctacgccccgaccgctacatcgtacacgccaaatcttgcgaggggcgaccccgggctcgccacgatagccaagtccgctacaatcgaaccaaaagaggtgaagcctgagactaagcctccagaacccaagaaaaccttcaacagtgtgtccaaaattgacaggctgtccaggatagctttcccattgttgtttggaatcttcaacttggtctattgggcaacatatctgaatagagaaccccaacttaaggctccaacacctcatcaatag

SEQ ID NO: 188814 - DNA, 1371 bp, Artificial Sequence
  Description of Artificial Sequence: Synthetic coding sequence
atgcggaagagccccggcctgagcgactgcctgtgggcctggatcctgcttctgtccacactgacaggccgctcttacggtcaaccctctctccaggatgagctgaaagacaacaccaccgtatttacacggatactcgaccgattgctggatggctacgacaatcggcttcggccgggcttgggcgaacgggtgacagaagtgaagactgacatttttgttacttcttttggccccgtgtctgaccacgatatggagtacactattgatgtgttcttccgacaatcttggaaggacgaacgattaaagtttaagggaccaatgacagttttgagacttaacaatctaatggcctctaagatctggactcctgacactttcttccacaacgggaagaaatcagtagcccataatatgacaatgccgaataagctgttgaggataaccgaggacgggacactgctgtatacaatgcgattgacagtgagggctgagtgcccaatgcatctggaagacttcccgatggacgcacacgcctgtccactcaagtttggctcttatgcctatactagggccgaggtcgtgtacgagtggacacgcgaacctgcacgctctgtcgtggtggcagaggatgggtctagactcaaccaatatgacctcctggggcagacagtggattccggcatcgtgcagtcaagcacaggggagtacgtcgtcatgaccactcacttccacctgaagcgaaagattggttattttgttatacagacatacttaccatgcatcatgactgtgattttaagccaggtttcgttctggttgaatcgggagagcgtgcccgcccggaccgtgttcggggtgaccaccgtcctaaccatgactacgctgtcaatctctgctcggaattctctacccaaggtcgcgtacgccacagcaatggactggtttattgcagtatgttacgctttcgtcttttccgcgctcatagaatttgcaacagtgaattattttacgaaacgagggtacgcatgggacggcaagtctgtcgtccccgagaaaccaaagaaggtgaaggatcccctgatcaagaaaaacaatacttatgccccaacagccacttcgtacacccctaacctcgccagaggcgaccctggtctggctacaattgccaaatctgccacaatcgagcctaaggaggtgaaacctgaaacgaaacccccagagccaaaaaaaacatttaactcagtgagcaagattgatcgcttgagcagaatcgctttccctttgcttttcggcattttcaatctggtgtactgggcaacatacctcaaccgggagccacaactcaaagccccaaccccgcaccaatag

SEQ ID NO: 188815 - DNA, 1371 bp, Artificial Sequence
  Description of Artificial Sequence: Synthetic coding sequence
atgcggaagagccccggcctgagcgactgcctgtgggcctggatcctgcttttgagcaccctaaccgggaggtcatatggccagcccagcctccaggatgaattgaaggacaatactacggttttcacacgtatcttggaccggcttctcgacgggtatgacaaccgactgcgacctggactgggtgagcgcgtgaccgaggtgaaaactgacatcttcgtcacgagttttggccctgtgagcgatcatgatatggagtacacaatcgatgtatttttcaggcagtcttggaaagatgagcgactgaaattcaagggaccaatgacagtgctgcgcctgaacaatctcatggccagcaaaatttggacccctgatacctttttccacaacggaaagaagtccgtagcccataatatgactatgcccaataaactcctgaggattaccgaggatggcacattattgtacacaatgaggctgaccgtaagagctgagtgtcccatgcacctcgaggactttcctatggatgcccacgcttgccctctgaagtttggaagctatgcatacacccgcgcagaggtcgtctacgaatggacccgagagccagcgcgttccgtggtggtcgcggaagacgggagtcggcttaatcagtacgatctgctgggacagacagtcgactcggggattgtgcagagttcaaccggcgaatacgtggtgatgaccacacattttcatttaaagcgcaagatcggatactttgtgatccagacttacctaccttgtatcatgaccgtcatcttgtcacaggtctctttctggctgaatagggagtctgttcctgccagaacagtctttggcgtaaccactgtactgacgatgaccactctgagcatttccgccagaaactcactaccgaaggtggcctatgcgaccgcgatggattggtttattgcagtgtgttacgccttcgttttttcagctctcattgaattcgccacagtcaactattttactaagagaggctatgcctgggatggcaagagtgtcgtaccagagaaacccaagaaagttaaagaccctctgattaaaaaaaacaacacatacgcacctacagccacttcatacacccctaatctggctcgcggcgacccaggtctcgctacaatcgccaagtctgcaaccatcgagcccaaagaggtaaaacccgaaacaaaacctccagaacccaagaaaacattcaactctgtgtcaaagattgatagactgagtaggatcgcttttcccctgctgttcggcatttttaacctcgtgtactgggcaacgtacctgaaccgggaaccacaactgaaggcccccaccccacatcagtag

SEQ ID NO: 188816 - DNA, 1371 bp, Artificial Sequence
  Description of Artificial Sequence: Synthetic coding sequence
atgcggaagagccccggcctgagcgactgcctgtgggcctggatcctcctgctctccaccctgacagggcgctcatatggtcaaccttccctgcaggatgagctcaaagacaacacaactgttttcacaagaattctcgataggctgttggatggatatgataatcgattgaggcccggtctgggagagcgtgttaccgaagtgaaaacggacattttcgtaacatctttcggaccagtgtcagaccacgacatggagtacacaatcgatgtattctttcgccaaagctggaaggacgaacgccttaaattcaaggggccaatgactgtgctaagactgaataatctaatggctagtaagatttggacccctgacacattctttcataatggcaaaaaaagcgtcgcccataatatgacaatgccgaacaagctgttaagaataaccgaagacggtaccctcttgtataccatgagactgacggtgcgtgccgaatgtccgatgcacctcgaagacttccctatggacgcccacgcatgtcccctcaagttcggatcttacgcctatacacgcgccgaagtagtgtatgagtggacgagggaaccggcccggtccgtggtggttgccgaggacggcagtagactgaaccaatacgatttgttgggacaaaccgtcgattcagggatagtgcagtcgtccactggagagtatgtggtgatgaccacccattttcatcttaaaagaaagattggatacttcgtgatccagacatacctcccttgtataatgaccgtgattctcagccaggtgagcttttggctgaacagagaatcagtaccagccaggacagtcttcggagtcacgacagtgttgacaatgactaccctgtcaatttcagccaggaatagtttaccaaaggtggcctatgcaaccgcaatggactggtttattgccgtttgttacgcatttgttttctctgcgttgatcgagtttgcaactgtgaactattttacgaagagggggtatgcttgggacgggaaaagcgtcgtccccgagaagccaaaaaaggttaaggacccactgatcaagaagaataatacgtatgcccctaccgctacctcctacacaccaaacttggcccgcggagatccgggtctggcaaccatcgctaagagcgctaccatcgaacctaaagaggtcaaaccagagacgaagccccctgaacctaagaaaacctttaattccgtttctaagatagacaggttgagtagaattgccttccccctcctttttgggatattcaatctcgtttattgggccacctaccttaatcgggaaccccaactcaaggcacctaccccgcaccaatag

SEQ ID NO: 188817 - DNA, 372 bp, Artificial Sequence
  Description of Artificial Sequence: Synthetic coding sequence
atgcggaagagccccggcctgagcgactgcctgtgggcctggatcctgctcctgagcacgctaactggtagatcctatggacaaccttctctgcaagacgaattgaaggataacaccaccgtgtttactcggatcctcgatcgcttactcgatgggtacgataataggctaagacccggcctgggcgaaagagtgaccgaagtgaaaactgatatcttcgtcacatctttcggccccgtgagtgaccatgacatggagtatacaatagacgtgttcttccggcagtcctggaaagatgagaggctgaaattcaaggggccgatgaccgtcttgcgcctgaataatctcatggcctccaagatctggacttag

SEQ ID NO: 188818 - DNA, 1356 bp, Artificial Sequence
  Description of Artificial Sequence: Synthetic coding sequence
atgaagaccaagctgaacatctacaacatgcagttcctgctgttcgtttttctcgtgtgggatccagccaggttagtcctggcaaacatccaagaggacgaagccaaaaataacataacgatttttacgcggatcctcgataggctgctggatggatatgataaccgcttgagacctggtctaggggacagtatcactgaggtgttcacaaacatatacgtgacgagttttggccctgtaagcgacactgatatggaatacaccatcgacgtttttttccggcagaaatggaaggacgaacggctgaaatttaaaggacccatgaatatacttaggcttaacaatttgatggccagcaaaatctggactcccgacaccttttttcacaatggaaaaaaaagtgtggcccataatatgacaatgcctaataagctcctgcgcattcaggacgacgggacactgctgtacactatgcgcctgactgtgcaggccgaatgcccgatgcaccttgaggactttcctatggacgcgcatagctgtccactgaaattcgggtcatacgcctacacgacgagtgaggttacttatatctggacctacaacgcgagcgacagcgtgcaagtggccccggacggaagccggctaaatcagtacgatctgttggggcagagcatcggcaaagaaaccattaagtctagtactggcgaatacaccgtcatgaccgcccattttcatctgaagcgcaaaattgggtatttcgtgattcagacatacctgccttgtattatgacagtcattttatcccaggtgtccttttggcttaaccgggaatctgttcctgcgcgaacggtgttcggcgtgacaaccgtattaactatgactaccttatctattagcgcacgtaatagcctgccaaaggtcgcttacgctaccgctatggattggttcattgccgtctgttatgccttcgtgttctctgccctcatcgagttcgctacggtgaattattttactaagaggggttgggcatgggatggcaaatccgttgttaacgataagaagaaagaaaaagcctctgtcatgattcaaaacaacgcctatgccgtggcagttgctaattatgctcctaatttgtccaaggacccagtgctctcgacgatctctaagtccgcgaccactccagagccgaataagaagccagaaaataagccagccgaagcgaagaagacattcaattcagtatcaaagattgacagaatgagcaggatagtgttcccagtgctattcgggacgttcaacctcgtgtactgggccacctatcttaaccgggagcccgttttaggggtatctccttag

SEQ ID NO: 188819 - DNA, 1356 bp, Artificial Sequence
  Description of Artificial Sequence: Synthetic coding sequence
atgaagaccaagctgaacatctacaacatgcagttcctgctgttcgtttttctcgtttgggatccagcgcgcctagtgttggctaatattcaagaggacgaagctaaaaataacattacaatttttacacgaatcctcgaccggctcctggacggctacgataatcgcctcagacctggtttaggagactctataacagaagtgttcacaaatatatatgtgacatccttcgggcccgttagcgataccgacatggagtatactatcgacgtgtttttccggcagaagtggaaggatgagagacttaaatttaagggccctatgaatattctgcggttgaacaacctcatggcttccaaaatatggacaccagacacattttttcacaacggcaaaaaaagcgtggcgcataatatgactatgcccaataaactgctacgcatacaagacgacggtactctcctgtacacaatgcgcctgaccgtacaggctgagtgtccaatgcaccttgaagatttccctatggacgctcatagttgtccgttgaagtttggcagttacgcctacacaactagcgaagtgacctacatttggacatacaatgcctctgactcagtccaagtggctcctgacggttctcgcctgaaccagtacgacctgctggggcaatccattggtaaagaaacaataaaatcatctaccggagagtacactgtgatgacagcacactttcatctgaaacggaaaattgggtattttgtgatacaaacctatctgccgtgtattatgacagtgatcctatcccaagtgtcgttttggctgaacagggaaagtgttcccgctcgaacagtcttcggcgttaccacagtgctgacaatgacaacactgtctatctctgcccggaatagtctgccgaaagttgcttatgcaactgctatggattggtttatcgctgtgtgctacgcttttgtattcagcgccttgattgagtttgcaacagtgaactactttacaaaacgaggttgggcctgggatgggaagagtgtggtgaatgataaaaagaaggaaaaggctagcgtcatgatccagaacaatgcctacgctgtcgcggtcgcgaattacgcccccaatttgagcaaggacccagtgctctctactatatcaaaatctgcaacaacgccagagccaaataagaaacctgagaataagcccgcggaagcaaagaagaccttcaattccgtttccaagattgatcggatgtcacgcattgtgttcccggttctatttggaacattcaacctggtgtactgggctacatatctcaaccgcgagcccgtactcggggtgagcccctag

SEQ ID NO: 188820 - DNA, 459 bp, Artificial Sequence
  Description of Artificial Sequence: Synthetic coding sequence
atgaagaccaagctgaacatctacaacatgcagttcctgctgttcgttttcctggtgtgggatccagcaagattggtcttagctaacattcaggaagatgaagcaaaaaacaatataaccatcttcacccggatcctcgacaggctgctcgacggttatgacaaccgcctgcgccccggcttgggcgattcaattacagaggtgttcactaatatctacgttacaagtttcgggccggtgtccgacaccgacatggagtataccatcgacgtgttttttcgccaaaagtggaaggacgagcgactgaagtttaaaggtcctatgaatattttgcggctgaataatttgatggcatcaaaaatctggaccccagatacctttttccacaacggtaaaaaaagtgtcgcgcataatatgacgatgcccaataaactactccgcatacaagatgatggatag

SEQ ID NO: 188821 - DNA, 414 bp, Artificial Sequence
  Description of Artificial Sequence: Synthetic coding sequence
atgaagaccaagctgaacatctacaacatgcagttcctgctgttcgtgttccttgtgtgggatcctgctaggctcgtgttggcaaatattcaggaagacgaagcaaagaataacattaccattttcacaagaattttggaccgcctcctggatggttatgacaacaggttgcgcccaggtctgggggactctattactgaggtctttactaatatttacgtaaccagcttcggccctgtttcggacaccgacatggagtatactatagatgtcttcttccgccagaagtggaaagacgagcgactgaagttcaaggggcctatgaacatcctgcgtctgaataacctcatggcaagtaagatctggacaccagacacgttctttcacaacggcaaaaagtcggtggctcactag

SEQ ID NO: 188822 - DNA, 1536 bp, Artificial Sequence
  Description of Artificial Sequence: Synthetic coding sequence
atgaagaccaagctgaacatctacaacatgcagttcctgctgttcgtgtttctggtctgggatcctgcaagattggttctagccaacattcaggaagatgaagccaagaataacatcacgatttttactagaatcctggatcgacttctggatggctatgataatcgtctcagaccggggctgggcgatagcatcacggaggtatttactaacatttatgttacaagcttcgggcccgttagcgacactgacatggagtacaccatagatgttttcttccggcagaagtggaaagatgagaggctcaaattcaaaggtcccatgaatatccttagactcaataatctgatggcctccaagatctggacccctgatacctttttccataacggtaagaagagtgttgctcacaacatgactatgcccaataaactcctcagaatccaggacgacggcactttgctttacaccatgcggctgacggtccaggccgagtgtcctatgcatctggaagactttcctatggatgcacacagctgtccgttaaagtttggcagctacgcttataccacttctgaggtgacttacatatggacatacaacgcctccgacagcgttcaggtggcccctgatgggtcccgtctcaaccagtatgatctgctgggtcagagtatcgggaaggagacaattaagagctctaccggagagtataccgtgatgacagcacattttcatctcaagcggaaaatcggatactttgtgatccagacgtacctgccatgcattatgacagtgatcctgtcccaggttagcttctggctcaacagggagagtgtgcccgcgaggacagtgtttggcgttactacagtgttgacaatgacaaccctctcaatctctgcacgcaactccctgccgaaggttgcttatgctactgctatggattggtttattgctgtttgttacgcgttcgtgttcagtgccctgattgaatttgccacggtcaattatttcaccaagcgagggtgggcatgggacggcaagagcgtcgttaatgacaagtccccatctattaaggcagagggcatcactcttacttacaatagtgtcaaggctattctgcagggggctaagctgatctggagcaaatatatagccttctcatggcccagcctgttccaggagaaaaccctagaatacctggaaaagtggatggattgcctcacctttaagcagagtagtaaaaaagagaaagccagcgtgatgatacagaacaacgcctacgctgtggccgtggcaaactacgctcccaatctgtcgaaagatcctgtcctgagtaccattagcaagtcagctactacacctgagcccaataaaaaacctgagaataagcctgctgaggcaaagaagactttcaattcggtctcgaagatcgaccgcatgagccgcatcgtgtttcccgtgcttttcggcacttttaatttggtgtactgggccacatacttgaatcgggagccagtcctgggggtgtctccttag

SEQ ID NO: 188823 - DNA, 1356 bp, Artificial Sequence
  Description of Artificial Sequence: Synthetic coding sequence
atgaagaccaagctgaacatctacaacatgcagttcctgctgttcgtgttcctggtatgggacccagcaaggcttgtactggccaatatacaggaggacgaggccaagaacaacattaccatctttacaaggattctggatcggttattggacggttatgataaccgcctgcgacccggcctgggagatagtatcactgaagtcttcactaacatttacgtgacaagctttggaccagtgagcgataccgatatggaatatactatcgatgttttctttaggcaaaagtggaaggacgaaaggttgaagttcaagggtcccatgaacatacttagactaaacaatctgatggcaagcaagatctggacaccagatacattttttcataacggcaagaagtctgtagcacataatatgacgatgccgaataaacttttgcgcatacaggacgacggcactctgctgtacacgatgaggctcaccgttcaagcagagtgtccaatgcatctggaagattttcctatggatgcacatagctgtcctctgaagtttggctcctacgcatacactacatctgaagtgacttatatctggacgtataacgcctctgactccgtacaggtggcgccagacggttctcggctgaatcagtatgacctactgggacagtctattgggaaggagaccatcaagagctcaaccggagaatatacagtgatgacggctcactttcatctgaaaaggaagatcggatatttcgtgattcagacatacttgccttgcattatgaccgttatccttagccaagtgtccttttggcttaacagagagagcgtgccggctagaaccgtgttcggcgtgactacggtcctgacaatgaccaccctgtccatctctgcaagaaacagcctgcctaaggtggcatacgccacggccatggactggttcatagcagtgtgttatgcatttgtctttagcgcgctcatagagttcgctacagtcaactatttcaccaagagagggtgggcttgggacggcaagagcgtggtaaatgacaaaaagaaggagaaggccagcgtgatgatccaaaacaacgcttacgctgtcgccgtggccaactatgctcccaatctgtcaaaggaccccgtcctgtccactatctccaaatctgccaccacaccagaacccaataaaaagccagagaacaagccggccgaagccaaaaagacctttaattcagtgtcaaagatcgaccgaatgagccggatcgtgtttcccgtcctgttcggaacattcaacctggtgtactgggccacttacttgaatcgcgaaccggtgttaggcgtgtctccttag

SEQ ID NO: 188824 - DNA, 1356 bp, Artificial Sequence
  Description of Artificial Sequence: Synthetic coding sequence
atgaagaccaagctgaacatctacaacatgcagttcctgctgttcgtattcctggtctgggacccagcccgtcttgtcctggccaacattcaggaggacgaggcaaagaacaatatcactatctttacacgtatacttgatagactcttggatggctatgacaatcggttacggcccgggctgggagatagcatcactgaagtttttaccaatatctacgtgacaagtttcggtccagtctctgacaccgacatggaatatactatcgatgtgttctttagacagaagtggaaggacgagaggctcaaatttaaaggccccatgaacatcctccggctgaacaacctcatggcctctaagatctggacccccgatacattttttcacaatggaaagaaaagcgtggctcacaatatgaccatgccaaacaagcttttacgcatccaggacgacggcacactgctgtacactatgcggctgaccgtgcaggctgagtgtcccatgcacctcgaggacttcccaatggacgcccacagctgccctcttaaatttggatcatatgcatacactaccagtgaagtgacatacatctggacctacaacgcttccgactcagtccaggttgccccagatggaagtcgcttaaaccagtacgacttactggggcagagcatcggcaaggagacaattaagtcaagcacaggtgaatatactgtgatgacagcgcattttcacctaaagcggaaaatcggctactttgtcatccagacgtacctgccctgtattatgacggtgattctgagccaggtcagcttctggctgaatagggaatcggtgcctgctaggactgtgtttggggttacaacagtgttgaccatgaccactctgtccatctcagccaggaatagtctacccaaggtggcatacgccacagccatggattggtttatcgccgtctgctacgccttcgtattcagcgccctgatcgaatttgctaccgtaaattattttaccaagcgcggttgggcctgggacggcaagtcagtagtgaatgataagaagaaagaaaaagcctctgtgatgatccaaaacaatgcttacgccgtcgctgttgctaactacgcacctaacctgtctaaggatcccgtgctgtccaccatctcaaaaagcgcgaccaccccagaacctaataagaagcctgagaataagccagcagaggctaaaaagactttcaatagcgttagtaagatcgaccggatgtctaggatcgtatttcccgtcttattcggtacttttaatctggtttactgggcaacttacctgaaccgggagccggtcttgggagtcagcccatag

SEQ ID NO: 188825 - DNA, 1104 bp, Artificial Sequence
  Description of Artificial Sequence: Synthetic coding sequence
atgaagaccaagctgaacatctacaacatgcagttcctgctgttcgtctttctagtctgggaccctgcccggcttgtgctggccaatatccaggaagacgaggccaagaacaacattaccattttcactagaatcctcgatagattgttggacgggtatgacaacaggttgaggcccggactaggcgatagcataactgaggtgttcacgaacatctatgttacatcctttggacctgtcagcgatacggacatggagtacactatagatgtgttctttcgacagaaatggaaggatgagcgactgaaatttaaaggacctatgaatatcctcaggctgaataaccttatggcttcaaagatatggacacctgacacatttttccacaacggaaagaaatcggtggcacacaatatgacaatgcccaacaagctgttgagaattcaagacgatggcaccctcctgtataccatgcgcttaaccgtgcaggctgagtgtcctatgcacctggaagattttcctatggatgcccattcatgccctctgaagttcggaagttatgcttatacaacaagcgaggtgacatacatttggacttacaatgcttcagattcggtacaggtggcacccgatggatccagactgaaccaatatgatttgcttggccagtcaattggaaaggagaccattaagagttcaaccggagagtatacagtaatgacggcccacttccatctaaagcgcaagattggctatttcgtcattcaaacttacctgccatgcattatgacggtaattcttagccaagtgtctttctggctgaaccgcgagtcagtccctgctagaacagtcttcggtgttacaactgtgttaactatgaccacgctatctattagcgcaaggaattcccttcccaaagtcgcttatgctaccgcaatggattggtttatcgccgtgtgctacgccttcgtgttttccgccctcattgagttcgccaccgtgaactatttcacaaaaagaggatgggcttgggatggtaaatcagttgtcaatgataaggtgagtgagagcttccgtgtcatcataatcaaaaagattccatag

SEQ ID NO: 188826 - DNA, 1371 bp, Artificial Sequence
  Description of Artificial Sequence: Synthetic coding sequence
atgcggctgaagatcaccctgcccagcctgcgggagttcctgaccgatttctggatggtgaccatcattgggcttgaccaggactgggaggaatacacaattgacgtcttctttcgccagaaatggaaggatgaacgcttaaagttcaaaggaccgatgaatattttacggctaaataacctcatggcaagtaaaatttggacgccagacaccttctttcacaatgggaagaaatccgtggcacacaacatgacaatgcccaataagctactgcgcatccaggatgatggcacattgctgtacactatgcggcttaccgtgcaggcagaatgtccaatgcacctggaagattttccaatggacgcccacagctgtcctttgaagtttggctcatatgcgtataccacctcagaagtgacatatatctggacgtacaacgcaagcgattcagttcaggtagcccccgatggctctaggctgaatcagtatgacctcttagggcagagtatcggtaaagagactatcaagtcttccaccggtgaatacacagtgatgacggcccactttcacctgaaacggaagattgggtacttcgtgatccagacgtatctgccttgcataatgaccgtgatcctgagtcaagtgtcattctggctgaaccgcgagagcgttccggcccgaaccgtctttggcgtcaccacagtactgacaatgaccaccctttctatttcagcgcgcaactctctgccgaaggtggcttatgccaccgcaatggattggttcattgctgtgtgctacgcattcgtcttctccgccctcatagagtttgcgacagtgaactatttcaccaaaaggggctgggcttgggatgggaaatccgtggttaacgataaaagccccagcattaaggccgagggcatcacgttgacctacaattccgtgaaagcaatcctgcagggtgctaagctcatttggtctaaatacatcgctttcagttggcccagcctgtttcaagagaagaccctggaatacctcgagaaatggatggattgcttaacattcaagcagtcttccaaaaaggagaaagcctccgttatgatccaaaacaacgcctatgctgtcgcagtggccaattacgcacctaatctgtccaaagatcccgtcctgtctacaatttccaagtctgcgacaaccccagagccaaacaagaagccagagaacaaacctgccgaagcaaagaaaacatttaacagtgttagcaagatcgaccgtatgtctcggatcgtgtttccagtccttttcggcacattcaacttggtgtactgggctacctatctgaatcgcgagcctgtccttggtgtgtctccctag

SEQ ID NO: 188827 - DNA, 1479 bp, Artificial Sequence
  Description of Artificial Sequence: Synthetic coding sequence
atgatcatcacccagaccagccactgctacatgaccagcctgggcatcttgtttctaataaacatactgccaggaactacagggcagggagagagccgacgacaggaacctggagattttgtaaaacaggatataggggggctctccccaaagcatgcgccagacattccagatgatagcactgataatatcactatatttacccgaatcctggaccggttgctcgacggctatgacaaccgcctgagaccaggcctcggagatgcggtcacagaagtgaaaacagacatatatgtgacctcttttggtcccgtgagtgacaccgacatggagtacactatcgatgttttttttagacaaacttggcatgacgagaggttaaaatttgacggcccaatgaagatcctgcccctcaacaatctgctggccagcaagatctggacacctgataccttcttccacaatggcaagaagagtgtagcccataacatgaccacgccaaacaagctcttaagactcgtcgataacggcacccttctgtacacaatgaggttaaccattcacgcggagtgtccaatgcacctggaagacttccctatggatgtgcatgcctgtcctctgaaattcggtagttacgcctataccactgccgaagtggtgtacagctggaccctagggaagaacaagagcgttgaagtggctcaggacggctcgcggctgaaccagtacgacttactcggacacgtggtgggtacggagataattcggagttctactggcgaatatgtagtgatgacgacccactttcacctgaagcgaaagattggatattttgtgatccaaacgtatctcccttgtatcatgacagtcatcctttcgcaggtgagcttctggctgaacagagagagtgtgccagccagaaccgtattcggggtcacaaccgttctgactatgactactctatcaatttctgcccgcaactcgctgccgaaagtggcttacgccacagcaatggattggtttatcgcagtttgctacgcatttgtcttttctgctttgatcgagtttgcaacagtgaattactttacgaagagatcctgggcatgggagggaaaaaaggtgcctgaagctctagaaatgaagaaaaagaccccggccgcaccagccaaaaagacaagcaccacgtttaatattgtaggaacgacctacccaataaacctggcgaaggataccgaattttctactattagcaagggggccgccccatctgctagcagcacacccaccatcatcgcaagcccaaaagctacatacgtgcaggactctcctaccgagactaaaacttataattctgtgtctaaggttgacaagatctccaggatcatatttccagttctctttgccatcttcaatctggtgtactgggcaacctacgtgaacagggaatctgcaattaagggcatgatcagaaagcaatag

SEQ ID NO: 188828 - DNA, 1479 bp, Artificial Sequence
  Description of Artificial Sequence: Synthetic coding sequence
atgatcatcacccagaccagccactgctacatgaccagcctgggcatactgtttcttatcaatattctgcctgggaccacgggccagggcgagagcagacgtcaagagcctggcgacttcgtcaagcaggacattggcggtctttcgccaaagcacgccccggatatccctgacgattccacagataacattacaatcttcacacggatactggacaggctgttggacggttatgacaataggctgcgccctggtctgggagacgctgtgactgaggtaaaaaccgacatttacgtgaccagcttcggtcctgtctcagacactgatatggaatacaccatcgacgtgtttttcaggcagacatggcacgatgaacgcttaaagtttgatggacctatgaagatcttaccactcaacaatctgttggccagtaaaatttggacgcctgacactttcttccacaatggaaaaaaaagtgtggctcacaatatgaccacacccaataaattactccggctggtggacaatggaaccctgctgtacactatgcgtctcacaattcacgctgaatgccccatgcacctcgaagactttcccatggatgtgcacgcttgcccgctcaagttcggttcttatgcttataccaccgctgaagtggtatacagttggaccctgggaaagaacaagtcagtcgaagtcgcgcaggacggttcccggttaaatcagtatgaccttctgggccatgttgttgggactgaaatcatccgttcctctacaggcgagtatgtagtgatgaccacccacttccaccttaagcggaagattgggtacttcgtgatccagacctaccttccttgcattatgacggtgatcctttcccaggtcagtttctggctgaacagggagtccgttccagcaaggacagtgtttggagtcacaactgttttgacaatgacgaccctatccatttctgcgcgcaactcactgcccaaagttgcctacgctacagctatggattggtttatcgccgtgtgttatgccttcgtgttctctgcccttattgagtttgcaacagtcaactattttaccaaacgcagctgggcttgggaagggaaaaaagtgcctgaggctctggaaatgaagaaaaaaacccctgcagcacctgccaagaagacaagcaccacgttcaatatcgtgggcacaacctaccccattaatctcgcaaaggacaccgaattctctacgatctcaaaaggtgccgccccctctgccagctccacaccaaccattattgctagtcccaaagccacctacgtgcaggactccccgacagagacaaagacctacaactctgtcagtaaggtcgacaagataagccggattatcttcccggtgctgtttgccatctttaacttagtgtattgggccacgtacgttaatagagaaagcgctattaaaggcatgatccggaaacagtag

SEQ ID NO: 188829 - DNA, 339 bp, Artificial Sequence
  Description of Artificial Sequence: Synthetic coding sequence
gagtacaccatcgacgtgttcttccggcagacctggcacgacgagagactgaaattcgatggcccaatgaaaatactgcccctgaataatctcctggcgtctaaaatatggacccccgacacattctttcacaacggcaagaagtccgttgctcacaacatgaccacccccaacaagttacttcgacttgtagataatggtactctgctttacaccatgcgaatcgaggaggtgcagaaacaccgttccatgatgaagcctagtgtgagctacacggtggctccctggatccaagaggggggcccaggaggcaggcatcgcttgaaaatggagaagtag

SEQ ID NO: 188830 - DNA, 1479 bp, Artificial Sequence
  Description of Artificial Sequence: Synthetic coding sequence
atgatcatcacccagaccagccactgctacatgaccagcctgggcatcctgttcctgatcaacattctgccggggaccaccggtcagggggagtcgcggcgacaggagcctggcgatttcgttaaacaagacatcggagggttgtccccaaagcatgccccggacatcccagatgattctactgataatataactatcttcacccggatcttggacagattgttagatggctacgataatagactccggcctggcctgggggatgcagtcaccgaggttaaaaccgacatctatgtgacaagctttggtccagtttctgacaccgacatggagtacactatcgatgtgttcttcaggcagacatggcacgacgagcggctgaaattcgacgggccaatgaaaattctgccactgaacaatctgctagctagtaaaatatggacccctgacacgttcttccacaatggcaagaaaagtgtcgcgcataacatgacaacccccaacaagttgctgaggctggtcgacaatgggaccctgctgtataccatgcgcctgaccattcatgccgagtgtccgatgcatctcgaagacttccccatggacgtccatgcttgtcccctgaaatttggatcttacgcttacactacagccgaggttgtgtacagttggacacttggcaaaaataagagcgtagaggtcgcgcaggacggctctcgcttgaaccagtatgatctgctgggtcatgtggtgggcactgagataatcagatcctccactggagagtatgtcgtgatgactactcactttcatcttaaacggaagataggatacttcgtgatccagacttatttaccttgcattatgacagtcattcttagtcaggtgagtttctggcttaacagggaaagcgtcccagcaagaacagtattcggagtgacaactgtgcttacaatgacgaccctgagtatttcagctcggaattccctgccgaaggtagcttacgccaccgcgatggactggttcattgcagtttgttatgcatttgtattcagcgccctgatcgagtttgcaactgtgaactacttcacgaaacgctcttgggcatgggagggaaagaaagtcccagaagcactggaaatgaagaaaaagacacccgccgcgccggccaaaaagacctcgacaaccttcaacattgtcggaaccacctatcccattaacctcgccaaagacaccgaattcagtaccatatccaaaggagccgctcccagcgctagctcaactcccacaattatcgcatctccaaaggccacatatgtacaggacagtcctaccgagactaagacttataattcggtgtctaaagtggataaaattagccgcataatcttccccgtgcttttcgcaatctttaatctggtgtattgggcaacctatgtgaatcgagagagtgccatcaagggcatgattagaaagcagtag

SEQ ID NO: 188831 - DNA, 1665 bp, Artificial Sequence
  Description of Artificial Sequence: Synthetic coding sequence
atggtgagcgccaagaaggtgcccgccatcgccctgagcgccggcgtctcttttgctctgctgaggtttctctgcctcgcggtatgcctgaatgagtcccccggccagaaccaaaaagaagaaaaactgtgtacagaaaatttcaccaggatcctggattctttactggacggttatgataaccggctgcgcccgggtttcggcgggcccgtaaccgaagtgaagaccgatatttacgtgacaagtttcggaccggtttccgacgtggagatggagtacaccatggacgtttttttccggcagacatggatagataagagactgaaatacgatgggcccatcgagattctgcgcctcaacaacatgatggtgaccaaggtttggacacctgacaccttcttcaggaacggtaaaaaatctgtgtcacataatatgaccgcacccaataagctatttcggattatgcggaatggcaccattctttacaccatgagacttaccatctccgctgaatgcccgatgcgcctggtcgattttccaatggacgggcacgcctgtccactcaagtttggcagctatgcttacccgaaaagcgagatgatctacacctggacaaagggccccgagaagtccgtcgaagtgccaaaggagtcttcctctctggttcagtacgacctgataggacaaacggtgtcaagcgagacaatcaagtcaattaccggggagtatatcgtgatgacagtctacttccatcttagacgcaagatgggatattttatgatccagacatatatcccttgtattatgaccgtgatcctcagccaggtcagcttctggatcaataaagagtcagtccccgcgagaactgtttttggtattactactgtgttaaccatgaccacactgtccatcagtgccagacactccttgcctaaggtgtcttacgccactgccatggattggtttatcgccgtttgctttgcgttcgtgttctctgcgttgatcgagttcgccgccgtgaactacttcaccaatattcaaatggaaaaggcgaagaggaagacctcaaaaccaccccaggaagtccccgctgctcccgtgcaacgcgaaaagcatcccgaagctcccctgcagaacactaatgctaatctgaatatgcggaagcggaccaatgctctggtccactccgagagcgatgtgggcaaccgtaccgaggttggcaaccactcttccaagagttccacggttgtgcaagagtccagcaaaggaacaccaagatcctatctggctagtagcccaaaccccttttccagagcaaacgccgctgaaaccatttctgccgcccgagcactaccaagcgcatctcctacaagcatccggactggctatatgccgcgaaaggcgtccgtgggctctgcttcgaccagacacgtattcggctcgcggctacaacgcatcaaaacgacagtcaataccatcggcgccaccggaaagctgtcggccacccccccgccatcggccccccctccatcaggtagcggcactagtaagatcgacaaatacgcacgtattctgttcccggttacttttggggccttcaatatggtgtattgggtagtgtacctctctaaggatacaatggagaagtccgaatcactgatgtag

SEQ ID NO: 188832 - DNA, 1389 bp, Artificial Sequence
  Description of Artificial Sequence: Synthetic coding sequence
atggacaacggcatgttcagcggcttcatcatgatcaagaacctgctgctcttttgtatctccatgaacctgtcaagccacttcggattctctcaaatgccaaccagcagcgtcaaggacgagacgaatgataacattacaattttcactcgaattctagatgggctgctagacgggtatgataacagattgagacctgggctcggagagcgtatcacgcaggtccgtacagatatctatgtgactagttttggccccgtgagtgacaccgagatggagtacactatagatgtgttcttccggcagagctggaaagacgagaggcttaggtttaagggccccatgcaaagactgcccttaaataacctgctcgcttcaaaaatttggacgcctgatacctttttccacaatgggaaaaagtccatcgcacacaatatgaccaccccgaacaaattgcttcggttggaggacgacgggactcttctgtacactatgcgactgaccatatctgccgaatgtcctatgcagttggaagatttcccaatggacgcccatgcgtgtcctctcaagttcggatcttatgcctaccccaacagtgaggtcgtctatgtgtggactaacggatccacgaagtctgttgtggtggccgaggacggatcacgtctgaaccagtaccacctgatggggcaaaccgtaggtactgaaaacatttcaacctccacgggggagtacaccattatgacggcccacttccatctcaagcgcaagatcgggtatttcgtgatacagacatacctcccgtgtattatgacagtcatcctgtcgcaagtatctttctggcttaacagagaatcagtaccggccagaaccgtattcggagtgacaacggttctgaccatgactaccctaagcatctctgccaggaactccttgccgaaagttgcctacgccactgcgatggactggttcattgcagtttgctatgcatttgttttctcggcacttatagagttcgctacagtcaattacttcactaagcgcgggtgggcttgggacgggaaaaaggctctcgaagccgccaaaataaaaaaaaaaagagaagtaatccttaacaaaagcaccaacgcttttactacgggaaaaatgagtcacccgcccaacatccctaaagagcagacacctgccggcaccagcaacaccacgtccgtatcagtcaagcctagcgaggagaagacctcggagagtaaaaagacctacaattctatttctaaaattgataagatgtcacgcatcgtgttcccggtcttgttcggcaccttcaacctcgtatactgggctacctatctgaatcgagagccggtgatcaagggggccgctagccccaaatag

SEQ ID NO: 188833 - DNA, 1389 bp, Artificial Sequence
  Description of Artificial Sequence: Synthetic coding sequence
atggacaacggcatgttcagcggcttcatcatgatcaagaacctgctgctgttttgtataagtatgaatctgtcaagccactttggcttcagccagatgccaaccagtagtgtcaaagacgagaccaatgataacattaccatctttacccgcattttagatggactgttggacggttacgataaccgcctaaggccaggactaggggagcgtattacgcaggttagaactgacatttacgttaccagttttggccccgtgagcgacaccgagatggagtacacgatcgacgtgttcttcaggcagtcctggaaggacgaacggctacggttcaaaggtccaatgcagcgactgccattgaacaacctcttagcctccaagatctggactccggacacattttttcacaacgggaaaaaatctattgctcataacatgacgacccctaacaagcttctgagactggaagacgatgggacccttctctacaccatgagactgaccatcagcgctgaatgtccaatgcagctggaggattttcccatggacgcccacgcttgtccgctgaaatttggatcctatgcataccctaactcagaagtagtgtacgtctggactaacggctctaccaagtctgttgtggtcgctgaggatggctctagactgaatcagtatcatcttatgggacagacggtcggcaccgaaaatatatctacgtcaactggcgagtataccatcatgactgcccacttccacctgaagcgcaaaattggctatttcgtcattcagacataccttccctgcatcatgacggtgatcctcagccaggtgagtttttggctgaaccgcgagagcgttcccgcacggactgtctttggtgtgacaacagtattaacaatgaccactctctcaatttccgcgagaaactccctgccgaaggtggcctatgcgaccgccatggactggttcattgccgtttgctacgccttcgtgttttccgctcttatcgagtttgcgactgtgaactacttcacaaaacgcggatgggcctgggacggaaagaaagcgttagaagctgccaaaataaaaaagaagcgggaagtcatactgaataaatctacgaatgcctttactacgggcaagatgagccatcccccgaacataccaaaggaacagactcctgctggtacctccaacacgactagtgtttctgtgaagcctagcgaggaaaagaccagcgaatccaagaagacatacaacagcatctcaaaaatcgacaagatgagcaggatcgtcttcccggtgctcttcgggacattcaacttggtgtactgggctacctatctgaatagagagccagtaataaagggcgctgcctctccaaaatag

SEQ ID NO: 188834 - DNA, 1389 bp, Artificial Sequence
  Description of Artificial Sequence: Synthetic coding sequence
atggacaacggcatgttcagcggcttcatcatgatcaagaacctgctccttttctgtatctcgatgaatttgagttcccacttcggcttttcacagatgccaaccagtagcgtgaaggatgaaaccaacgacaatatcaccatctttacaaggatcttggacggcctgctcgatggatatgataaccggcttagaccgggattgggagaacggatcacccaggtcaggactgacatctacgtgaccagttttggacccgtgtccgatacagagatggagtacactatcgacgtatttttccgtcaatcgtggaaggacgagcgcctgcggtttaaggggcctatgcagcgcctgccccttaacaacctgttggctagcaaaatctggaccccggacactttcttccacaatgggaagaaaagtatcgctcataatatgactacacctaacaagttacttcgcttagaggacgatggtactctactttacaccatgaggttgacaatttctgcggagtgccctatgcaactggaagacttcccgatggatgcgcacgcatgtcctctgaagttcggcagttacgcctacccaaactccgaggtagtatacgtgtggacgaacggatccaccaaatccgtggtcgtggcggaggacggctcccggctcaatcagtatcacctgatgggacaaacagtgggaaccgagaatattagcacatccacaggcgaatacacgattatgaccgctcacttccacctgaagaggaagattgggtatttcgtcatccaaacttatcttccttgcattatgaccgtgatcctgtcccaagtgtcgttttggttgaatagggaaagtgttcccgcccgcacagtgttcggtgtgacaacagtcttaaccatgactactctgtcaatatcggcaagaaattccctgcctaaggttgcttacgcaacggcgatggattggttcatcgccgtctgttatgcattcgtgttcagcgcactgatcgagttcgctacggtaaactatttcaccaagagaggctgggcttgggatggaaagaaagcgctagaggcggcaaaaatcaaaaaaaagcgggaggtgatccttaataagagcactaacgcgttcaccaccggcaagatgagtcacccacccaacatccctaaggagcagacacccgccgggacctctaacactacctcagtctccgtcaagcccagcgaagagaaaacttctgaatccaaaaagacctataatagcatatccaagatcgataagatgagtcggattgtctttcctgtgctttttggcactttcaacctggtttactgggctacatatcttaaccgtgaacccgtgattaaaggggctgcatcgccgaagtag

SEQ ID NO: 188835 - DNA, 261 bp, Artificial Sequence
  Description of Artificial Sequence: Synthetic coding sequence
atggacaacggcatgttcagcggcttcatcatgatcaagaacctgctcctgttctgcatttcaatgaacctcagcagtcatttcggattctcccagatgcctactagttccgtcaaggatgaaaccaacgataacatcactattttcacgaggatacttgacgggttgctggatggctatgacaaccggttgcggcccggactgggcgagagaatcacacaggtcagaactgatatttatgtgacatcttttggtccctag

SEQ ID NO: 188836 - DNA, 450 bp, Artificial Sequence
  Description of Artificial Sequence: Synthetic coding sequence
atggacaacggcatgttcagcggcttcatcatgatcaagaacctgctcctgttttgtatatctatgaatctgtcgtctcacttcggatttagccaaatgccgactagctcagtaaaggatgagactaatgacaatattaccatctttaccagaatcctggacggactgctagatgggtatgacaacaggctgcgtccaggccttggagagcgcataacacaggtgcggacggatatctacgttacctcctttggcccagtgtctgacacagaaatggaatacaccatcgacgtgttttttagacagtcgtggaaggatgagcgactacggtttaagggccccatgcagcgactacctctgaacaatctcctcgcttctaaaatctggactcccgacacttttttccacaacggcaaaaagtcaattgctcacaacatgacgactccttag

SEQ ID NO: 188837 - DNA, 501 bp, Artificial Sequence
  Description of Artificial Sequence: Synthetic coding sequence
atggacaacggcatgttcagcggcttcatcatgatcaagaacctgttgctgttttgtatctccatgaatctttcctctcatttcggcttttctcagatgccgactagctccgtcaaagacgagaccaacgacaatatcaccatttttacccggatcctcgatggcttgttggacggatacgacaataggcttcgacctggtttgggcgagcgtattacacaggtgaggaccgacatctatgtaaccagctttggcccagtgtccgacactgaaatggaatatacaatagacgtgttctttcggcaatcctggaaagacgagcggctgaggttcaaagggccaatgcagaggctacccttaaataacctgctggcctccaaaatatggactcccgataccttctttcacaatggaaagaagtctatagcccacaatatgactacaccaaacaagcttcttaggctggaggacgacggcacgcttttgtacaccatgaggtag

SEQ ID NO: 188838 - DNA, 51 bp, Artificial Sequence; identical to SEQ ID NO: 82644
  Description of Artificial Sequence: Synthetic coding sequence

SEQ ID NO: 188839 - DNA, 1362 bp, Artificial Sequence
  Description of Artificial Sequence: Synthetic coding sequence
atggccagcagcctgccctggctgtgcatcatcctgtggctggagaacgccctcggcaaactggaggttgagggaaatttctactcagagaatgtatctcggattttagacaatctcttggaagggtacgacaataggcttagaccaggcttcgggggcgctgtgacagaagtgaagaccgacatctatgtaacttctttcggccccgtctcggatgtggaaatggagtacaccatggacgtgttctttcggcaaacctggaccgacgagcgcctcaagttcggaggtcctacagagatcttgtccctgaataatctgatggtgtctaaaatatggacccccgacacatttttcaggaatggtaagaagtcgatagcccataacatgacaacacctaacaaactcttccgaatcatgcagaatggaaccatcttgtatacgatgcgcctgaccattaacgctgattgccccatgagactggtgaatttccctatggatgggcacgcttgccccctcaagttcggctcttacgcataccctaaaagcgagataatctatacgtggaagaagggcccactctattccgttgaagtgcctgaggaatctagctctctgctgcagtatgacctcatcgggcagaccgtgtcgtctgaaactatcaagtcaaacacaggcgagtatgttatcatgacagtgtattttcacctacagagaaaaatggggtacttcatgatacagatttacacaccctgcatcatgacagtcattctgtcgcaggtgtccttctggattaacaaggaatccgtgcccgccagaactgtcttcgggataactaccgtgttgactatgactactctttcaattagcgcccgccactccctccctaaggtgagctatgctacagcaatggattggtttatcgccgtttgtttcgcctttgtcttttcagccctgatagagtttgctgccgtgaattacttcactaaccttcagactcaaaaagccaaacggaaggctcaatttgctgccccccccactgtgactatttccaaggctacagagcctctggaggcggaaatcgttcttcacccagacagcaagtaccatctaaagaaaagaataacctccctgagtttgcctattgtgtcctcatcagaagcaaacaaagtgctgacacgtgccccaattctacaatctacacccgtgacacccccccccttaagcccggcattcggcggcacttccaagattgaccagtatagccgtatattgttcccagtcgcattcgccggctttaatctggtgtattgggtggtctatcttagcaaagatacaatggaagtgtcatccagtgtcgagtag

SEQ ID NO: 188840 - DNA, 1332 bp, Artificial Sequence
  Description of Artificial Sequence: Synthetic coding sequence
atggccagcagcctgccctggctgtgcatcatcctgtggctggagaacgcgctgggcaagctggaagtggaagggaacttctattccgaaaacgtttccaggatcctcgacaacctcctcgaggggtatgataataggttaagacctggttttggaggagccgtaacggaagtcaaaacagacatttatgtaacttcttttgggcccgtgagtgacgttgagatgacgtggaccgatgagcgcctaaaattcggtggtcctacagaaattctgtcactgaataacttaatggtgagcaagatttggacgccagacacattttttagaaacggaaagaagagcatcgcacacaacatgacaacccctaacaagcttttcagaataatgcagaacggtacgatattgtacacaatgagactgacaattaatgccgactgccctatgcgcttagtcaacttcccgatggacggacacgcctgcccacttaagtttggctcctacgcgtacccaaaaagcgaaattatatacacctggaaaaaggggcccctttactcagtggaggtgccagaggaaagtagcagcctgctgcagtacgatctgatcggccagaccgtgtccagcgagactataaagagcaacaccggggaatacgtcatcatgactgtgtatttccatcttcaacgcaagatgggctattttatgatacagatttatactccctgtataatgactgtcattttaagccaagtatctttttggatcaataaagagtcggtgccggcgcgtacagtatttggaattaccaccgtactcacgatgactaccctgtccatttccgccaggcactctctgcccaaagtgtcgtacgcaaccgcaatggattggtttatcgcggtctgtttcgcttttgttttttccgctctgatcgagtttgctgccgtcaattatttcaccaacctgcagacccagaaggctaaaaggaaagcccaatttgctgcccctcccaccgttactatctcaaaggccaccgaacccctggaggctgaaattgttctccacccggacagtaagtatcatcttaaaaagcgcatcacatccctatctctgcccattgtttcttcttccgaagctaacaaggttttaacccgagcccccatcctgcaatcaacccccgtcacacctccacctctgagcccagcgttcgggggcacatccaagatcgatcaatattccagaattctgtttcccgtagcgttcgctggttttaatctggtgtattgggtggtgtatttgtccaaggacactatggaagtgagttctagcgttgagtag

SEQ ID NO: 188841 - DNA, 1425 bp, Artificial Sequence
  Description of Artificial Sequence: Synthetic coding sequence
atgtggaccgtgcagaaccgggagagcctgggcctgctgagcttccctgtgatgatcacaatggtttgttgtgcccatagtactaacgagccttcaaatatgtcttacgtgaaagaaaccgtcgatagactgctaaaaggctatgacattcgtctccggcctgacttcggaggacctccagttgacgtgggaatgaggatagacgtagcatccatcgacatggtttcagaagtgaatatggactatactctaaccatgtactttcagcagtcttggaaggacaagcgactcagttattctgggatccccttgaatcttaccctcgacaatcgggtggccgatcagctgtgggtgcccgatacctattttttaaacgataagaaaagctttgttcacggcgtgaccgtcaaaaatcgcatgataaggcttcatccagacgggactgtgttgtatggattgagaatcacaacaaccgcggcatgcatgatggatctaagacgatatccactggatgagcagaactgcaccctggagatcgaatcatatggctatactaccgacgatatcgagttctattggaacggcggggaaggagctgttacgggcgtcaacaagattgaacttcctcagttttccatcgtggactataaaatggtgtctaagaaagtggagttcaccacaggcgcatacccgaggctcagtctgagcttccgactgaagaggaatatcggctacttcatcctgcagacttatatgcccagcacccttataaccatactatcttgggtttctttttggatcaattatgacgcgtctgcggcgcgcgtagctctcggaattaccaccgtgctcaccatgacaactataagtacccacctgcgggagacgctgcctaagattccttatgtgaaagctatagacatctatttaatgggatgttttgtcttcgtattccttgcactcctggagtacgcattcgtgaattatatctttttcggcaaggggccacagaagaaaggagcatccaaacaggatcagtcagcaaacgaaaaaaataagttggagatgaacaaggtgcaggtggacgctcatggcaacatcctcctgagcacactcgagatccggaacgagacctcaggatctgaagtgctgactagcgtaagtgatcctaaggccacaatgtacagctatgattccgcctctatccagtacaggaagcctctgtctagccgggaggcatacgggcgggccctcgatcgccacggcgttccaagtaagggaagaatcaggcggagagcgagtcaattaaaggtgaaaatccctgaccttaccgacgttaactccatcgacaagtggtccagaatgttcttcccgatcacatttagtctgttcaacgtggtgtactggctgtactacgtgcactag

SEQ ID NO: 188842 - DNA, 1215 bp, Artificial Sequence
  Description of Artificial Sequence: Synthetic coding sequence
atgaccttcgcctgcggccggaccagcgaggactacaccctgaccatgtactttcagcagtcttggaaagacaaaaggctgtcctacagcggcatccctctcaatttgaccctcgataacagagtggcagatcagctgtgggttcccgatacgtacttcctcaatgacaaaaaatctttcgtacatggggtcacggtgaagaataggatgatacgactgcatcccgacggtactgtcctctacggccttagaattacaaccacagccgcctgcatgatggatttgagacggtacccactcgacgaacagaactgtacattggagattgaatcatatggctatactactgatgatattgagttttattggaacggcggtgagggcgctgtcaccggcgtcaacaaaatcgagctgcctcagttttctattgttgattataagatggtgtccaagaaggtagaattcacaacgggagcttacccacgcctttccctgagttttagactgaagagaaatattggatactttattctccagacctacatgccaagtactttgattacgatcttatcctgggtgtctttttggatcaattatgacgcttctgccgcaagggttgcactgggaattactaccgtgcttacaatgacgaccatatcgacacacttgcgggagaccctccccaaaataccctatgtgaaggccatagacatatatttgatgggctgttttgtcttcgtgttcctcgcactcctggagtatgcattcgttaactatattttttttggaaaaggccctcaaaaaaagggtgcttccaagcaggaccagagcgcaaatgaaaagaataagttagagatgaacaaggtgcaggtggatgcccacggaaacattcttcttagcaccctggaaatccgaaacgaaacaagtggaagcgaagtcttgacatcggtaagtgatccgaaagctaccatgtacagctacgatagcgcttccatccagtacaggaaaccactgagttctcgagaagcctacggtagggcccttgacagacatggcgtgccctcgaaggggaggatccgacggcgcgcctcacagctgaaggtcaagatcccagatctcacagatgtgaattccatcgacaagtggtcccgcatgttcttccccatcaccttctctcttttcaatgtcgtctattggctgtactatgttcactag

SEQ ID NO: 188843 - DNA, 1539 bp, Artificial Sequence
  Description of Artificial Sequence: Synthetic coding sequence
atgtggcgggtgcggaagcggggctacttcggcatctggagcttccccctgatcatcgccgccgtctgcgcacagagcgtgaatgacccttctaacatgagcctggtaaaagaaacggtggataggcttctcaaaggctatgacattagactccgcccagacttcggtgggccacccgttgctgttggaatgaatatagacatcgcatctatcgacatggtaagcgaggtaaatatggattacacactaacaatgtattttcagcaggcatggcgggacaagcggctctcctataatgttatccctctgaatctaacccttgacaatcgggtggccgaccaactgtgggttccagatacatattttctaaatgacaaaaaatcttttgtgcacggggtcaccgtgaaaaacaggatgattaggctgcacccagatgggaccgtactgtacgggttgaggatcacaactaccgccgcctgcatgatggatctgcgccggtatcccctggacgagcaaaattgcaccctggagattgaaagctacggatataccaccgatgacatcgaattctattggaggggggacgacaatgctgtgactggggtgacaaaaattgaacttccccagttcagcatagtggactacaagctgatcacgaaaaaagtggtattcagtacaggctcttatcctcggctcagcctgtctttcaagttgaagcgcaacatcgggtacttcattctgcagacctatatgccctccatcctcatcaccatcctctcttgggtcagcttctggattaattatgatgcgagtgctgccagagtcgccctggggataaccacagtgctcacaatgaccactattaacacacatttacgtgagactctacctaagatcccgtacgtaaaggcaatcgatatgtacttgatgggatgcttcgtgttcgttttcatggcattgctagagtatgccttggtgaactacatattcttcggtaggggtccacaacgtcagaagaaggcagccgagaaagcagcctccgccaataacgaaaagatgcgattggacgtcaataagattttctacaaggacatcaagcagaatgggacacagtatcgttctctttgggaccccaccggaaacctgtcacctacgaggagaacgacaaactatgacttttctttgtacactatggatccacacgagaacatcttgctgtccaccttggaaattaaaaacgagatggctacctctgaggctgtgatgggcttaggcgatccaagatctaccatgttggcttacgatgcttcctccattcagtacagaaaggcaggtctgccccgccattcctttggacggaacgctttggagaggcacgtggctcaaaagaagagccgtttgcggcgcagggcctcacagctaaagatcacaattccggacctgaccgacgtgaacgctatcgacagatggtctaggattttcttccctgtggtgttctccttcttcaatattgtgtactggctgtattacgtcaactag

SEQ ID NO: 188844 - DNA, 1425 bp, Artificial Sequence
  Description of Artificial Sequence: Synthetic coding sequence
atgtggcgggtgcggaagcggggctacttcggcatctggagcttcccactgatcatcgcggcagtctgcgctcagagcgtcaacgacccgtcaaatatgagtctggtcaaggaaaccgtagatagacttctgaaaggctacgatatccgacttcgcccagatttcggcggcccaccagttgccgtggggatgaacattgatattgcttctattgacatggtaagcgaggtcaatatggattatacccttaccatgtattttcagcaggcatggcgcgacaagcggttgtcctacaacgtgataccactgaatttgacgctggacaacagagtggctgaccagttgtgggtcccagacacttacttcttgaacgataaaaaaagtttcgtccatggcgtaactgttaagaaccgcatgataagactccatccagacgggaccgtcctgtacgggcttcggattaccacaaccgctgcttgtatgatggatctccggcggtacccactcgacgagcaaaattgtaccctggagatcgaatcttatggatacaccacagacgatattgaattctattggaggggagatgacaatgccgttactggagttaccaaaatcgagctgccccagttcagcatcgtggactacaagcttatcaccaagaaggtcgtgttcagcaccggatcatacccccgtctgtcgctgagtttcaagctgaaaaggaatattggctattttatcctccagacatatatgccaagtattcttatcaccattttatcttgggtatctttttggatcaattacgacgccagcgccgctagagtggccctcgggataactacagttctgacaatgaccacaattaatacccatctccgggagactcttcctaagattccttatgtaaaggcgatagacatgtacctcatgggctgcttcgtattcgtcttcatggcgctcctggagtacgcacttgtgaattatatatttttcgggaggggtccacaacgacaaaaaaaagcggccgagaaggctgcctcagcaaacaatgaaaaaatgagactggatgtgaacaagatggacccccacgagaacatacttctgtccaccctcgagatcaagaatgagatggccacatcggaggcggtcatgggcctgggcgatcctcggtcaactatgctcgcctatgatgctagttccatccagtacaggaaggccggccttcctagacattctttcgggagaaacgcgttggaaaggcacgttgcccaaaagaaatcaaggctccggaggagagcttcccagctcaagatcaccattcctgacctgaccgacgtgaatgctattgatagatggagtcgaatcttctttcccgttgtgttctctttttttaatatcgtttattggctgtattacgtcaactag

SEQ ID NO: 188845 - DNA, 1539 bp, Artificial Sequence
  Description of Artificial Sequence: Synthetic coding sequence
atgtggcgggtgcggaagcggggctacttcggcatctggagcttccccttgatcattgctgccgtgtgtgcccagtctgtcaatgatccaagcaatatgagccttgtcaaggagactgtggacaggctcctgaaagggtatgacatcagattgcggcccgatttcggtggacccccggtggccgtaggtatgaatattgacatcgccagcatcgatatggtttccgaggttaacatggattacaccttgaccatgtactttcagcaagcttggagagataagcggctgagctacaacgtgattccactgaatctgacactggataaccgcgtagcagatcagctgtgggtgcccgatacttacttcctgaatgacaaaaaaagtttcgtgcatggagttaccgtgaaaaaccgaatgatcaggttgcaccctgatgggacagtcctgtacggtctaagaattactaccacggccgcgtgcatgatggacttgcggcggtacccccttgatgaacagaattgcaccctcgaaatcgaaagctacggctacacgaccgatgacattgagttctactggcgaggagatgataacgcggttacaggtgtaaccaaaattgagctgccccagttctcgatcgtggattataagctgattactaagaaggtcgtgttttctacgggatcctatccacgattgagcttatcctttaaactcaagcgaaatatagggtatttcattttgcagacatacatgccatcaattctgatcaccatactctcatgggtgtccttctggattaattatgacgccagcgccgcccgtgtcgccctcgggattacaacagtgttgactatgacgaccataaacactcacctccgtgaaactttaccaaaaatcccgtatgtgaaagcgatcgatatgtacctcatgggttgttttgtgtttgtgttcatggctttactagaatacgcactagtcaactacatcttcttcggtcgcgggccacagcggcagaaaaaggccgccgagaaggctgccagtgctaataatgagaagatgaggttggacgtgaacaaaatcttttataaggacatcaagcaaaatgggactcaatatcggagtctctgggacccaaccggcaacttgtcccctacacgcagaactacgaactacgacttttctctgtataccatggacccgcatgaaaacattttactgtcaacattagagattaaaaacgagatggcgacctctgaggccgttatggggctgggtgacccacggtcaaccatgttggcgtacgacgcatcaagcattcagtataggaaggctggtttacctaggcatagttttggtcgtaatgcgctcgagcgtcatgtagcccagaagaaaagccgcctcaggaggcgggcatcccagctgaaaatcacaattcccgacctgacagacgtgaacgcaatcgataggtggagccgtattttctttcctgttgtcttctctttcttcaacatcgtgtattggctgtattatgtcaattag

SEQ ID NO: 188846 - DNA, 945 bp, Artificial Sequence
  Description of Artificial Sequence: Synthetic coding sequence
atgatggacctgcggcggtaccccctggacgagcagaactgcaccctagagatagaaagttacggatataccacagatgacattgagttttactggcgaggggacgacaatgcggtcaccggcgtgacaaaaatcgagctgcctcaattcagtattgtcgactacaaacttattacgaagaaagtggtattttctacaggttcttaccccagattgtctctcagttttaagctgaagagaaacattgggtattttattctccagacctacatgccctcaattctcatcacgatattaagttgggtttccttctggatcaattatgatgctagcgccgccagggtagccctcggcattacaacggtcctgacaatgacgactatcaatacacacctcagggagactctgcccaagattccttacgttaaggctatcgatatgtatctgatgggttgttttgtgttcgttttcatggccctgctcgagtacgctcttgtgaactatatattttttggccgcggccctcagaggcagaagaaggctgccgagaaagccgcatctgcaaacaatgagaagatgcgccttgatgttaacaagatggaccctcacgaaaatatcctcctgagcactcttgagatcaaaaacgagatggcaacgagtgaagcagtgatggggctgggggacccaaggtctacaatgctggcatatgacgcttcttccatccaatataggaaggccgggcttccccggcatagctttggccgcaatgcactcgagagacacgtggcccagaagaaatcaagactacgcagaagagcttctcaactgaaaatcaccattcccgatcttaccgacgtgaacgctatcgatcgctggtctagaatcttctttccagtggtgttcagtttctttaacatcgtatactggttgtattatgtgaactag

SEQ ID NO: 188847 - DNA, 1236 bp, Artificial Sequence
  Description of Artificial Sequence: Synthetic coding sequence
atgaacatcgacatcgccagcatcgacatggtgagcgaggtgaacatggactataccctgacaatgtactttcagcaggcatggcgcgacaaaagactgtcctacaatgtgattcctcttaatcttactctggacaatagagtagctgatcagctttgggtccctgatacgtacttcttgaatgacaagaaatcatttgttcacggcgttacagtgaagaacagaatgatcagactgcaccctgacgggacagtgctgtacggtcttagaattaccacgactgccgcctgtatgatggatttgaggcgctatcccctggatgagcagaattgtacgcttgagattgaatcatacggctacactacagatgacatcgaattctactggcggggagacgataatgcagtgacaggcgtcactaagattgaactgccacaattttctatagtcgactacaagttaattaccaagaaggtcgtgttctcaaccggttcttacccaaggttgtctctttccttcaaattgaaaagaaacataggctacttcattctccagacgtatatgccctccattttgatcaccattctcagctgggtatctttttggattaattatgatgccagtgcagcccgcgttgccctcggcatcaccacagtgttaacgatgaccactatcaacacacacttacgtgagactttgccaaagattccctatgttaaggccatagacatgtacctgatgggctgtttcgtgtttgtgtttatggccctgctggaatatgctctagttaattatattttcttcggccggggacctcagagacagaagaaagccgccgagaaagctgcctctgctaataacgagaaaatgcgcctggacgtgaataagatggaccctcacgagaacatcctgcttagcaccctggagattaaaaatgagatggccacaagcgaggcagttatgggtcttggcgaccctcggagcactatgctcgcatacgatgcgtcaagcattcaataccgcaaagccggcttgccacgacactcttttggtcggaatgctttagagcgccacgtagcacagaagaagtctaggctccgtcgaagagcgtcacaactgaaaatcactatcccagaccttaccgacgtgaacgccatcgatcggtggtcacgaatcttttttccggttgtgttcagtttttttaacatagtgtattggttgtattacgtaaattag

SEQ ID NO: 188848 - DNA, 1425 bp, Artificial Sequence
  Description of Artificial Sequence: Synthetic coding sequence
atgtggcgggtgcggaagcggggctacttcggcatctggagcttcccactaatcattgccgcggtttgtgctcagtccgtgaacgaccccagcaatatgagcctcgtgaaggaaacagttgacaggctcctgaaaggctatgatatccggctgcgaccagactttggggggccacctgtggcagtgggcatgaatatcgatatagccagcatcgatatggtttccgaagtgaacatggattacacactgactatgtatttccagcaggcctggcgggacaagaggctgtcatacaatgtcatacctctgaacttaacgctcgataacagggttgccgaccaactttgggtgcccgacacatactttctcaacgacaagaagagctttgtgcatggcgttactgtgaagaatcggatgattcggctgcaccctgacggaactgttctttacgggctgaggatcactaccactgctgcctgcatgatggatttgcgccgatatccactggacgagcagaactgcacactggagatagagtcatatgggtacactaccgacgatatcgaattttactggagaggtgatgataacgctgtaaccggggtcactaaaattgaacttccccagttttccatcgtcgattacaagctcattactaaaaaagtggtctttagcactgggtcttatccacgcctttcactcagcttcaaacttaaacgcaatatcggttacttcattctgcagacatacatgcctagcatcttaataaccattctgagttgggtgtccttttggataaactatgacgcgagcgctgcccgtgtggcactgggaatcaccacagttcttaccatgaccaccatcaatacgcacctgcgggaaacacttccaaaaatcccttatgtcaaagccatagacatgtatcttatgggttgtttcgtgtttgtgttcatggcactgctggaatacgccttggtcaattacattttctttggacggggtccgcagaggcaaaaaaaggcagccgagaaggcagccagcgcaaataacgagaaaatgagactcgacgtgaacaagatggatccccatgagaacatcctgctgagcaccctggagatcaagaatgagatggccacttccgaggcagtgatgggactcggagatcctcggtctactatgctcgcttatgacgctagctctatccagtacagaaaggccggcctaccccgccactctttcggaagaaacgctctagagcggcatgtggctcagaagaagtcacggctgcgtcgcagagcctcgcagctgaaaattacaatccctgatttgacagatgttaatgccattgacaggtggtcaaggatattctttcctgtcgtgttttcgttctttaacatagtgtattggctctattatgtgaactag

SEQ ID NO: 188849 - DNA, 1422 bp, Artificial Sequence
  Description of Artificial Sequence: Synthetic coding sequence
atgtgcagcggcctgctggagctgctgctgcccatctggctgagctggactttgggcaccagaggcagcgaaccccggtccgtgaacgatccaggaaacatgtcattcgtcaaagagacagtggataagctgctgaagggctacgatatcagactgcgccccgatttcggaggcccccccgtctgcgttggcatgaatatcgatatcgcgagcattgatatggtgagcgaggtgaatatggattatacactcacgatgtacttccagcaatattggcgggacaagaggctcgcgtacagcggaatacctctgaatctcaccttggataacagggtcgctgaccagctgtgggtccctgatacctactttttgaacgataaaaaaagcttcgttcatggggtgactgttaaaaaccggatgatccgcctgcaccctgacgggacggttctttacggtcttcgtataactactacagcagcatgcatgatggacttgcggcgttaccctcttgatgaacagaactgtactctggagatcgagagctacgggtacaccaccgacgatattgaattctattggagaggcggggacaaggcggtgacaggtgtggagcggatcgaattgccccagttcagtatagtggagcacagactggtgtcacgtaacgttgtgttcgctaccggcgcttatcctaggttgagcctctccttcaggttgaaaaggaatataggatatttcatcctacaaacttatatgccgtcaattctgattacgatcttgtcatgggtatctttctggatcaattatgatgcaagtgcggcccgcgtcgccctgggtataacgactgtcctcaccatgaccaccataaacactcacctgcgagagacactcccaaagatcccctatgtcaaggcaatcgacatgtatcttatggggtgtttcgtatttgtgttccttgccctcctggagtatgcctttgtgaattatattttctttggaagaggaccccagcggcagaagaaactggccgagaagacggccaaggccaaaaacgacaggtcgaagtccgaaagcaacagagttgatgcccatggtaatattctgctcacgagcctggaagtgcacaatgaaatgaacgaggtgagcggaggcatcggggatacacggaattcagccatttcctttgacaacagtggaatccagtaccggaagcagtccatgccgcgtgagggccatgggcgctttcttggagatagaagtttacctcataagaaaacccatttgcgcaggagatcttcacagcttaagatcaagatccctgatctgaccgacgtgaatgcaatcgaccgatggagcagaattgtgttccctttcacattctcacttttcaacctggtgtattggctatactacgtgaactag

SEQ ID NO: 188850 - DNA, 1422 bp, Artificial Sequence
  Description of Artificial Sequence: Synthetic coding sequence
atgtggggcctggccggcggccggctgttcggcatcttcagcgcccccgtactggtcgcagtggtgtgctgcgcacagagtgtgaacgacccaggaaacatgagctttgttaaagagacagtagacaaactcctgaaaggctacgacattcggctcaggcccgactttggtggcccaccagtttgcgttgggatgaacatcgacatagccagcatcgacatggtcagtgaagttaatatggactacacattgacaatgtatttccagcagtactggagggataagagattagcctactccggaattccactgaacttgaccttggacaaccgtgtggctgaccagctgtgggtgccagacacctattttctcaacgacaaaaaatctttcgttcacggagtcaccgtaaaaaaccggatgattcggttgcatccagacggcactgtgctgtacgggttgagaatcaccacaacagccgcgtgtatgatggatcttcgtaggtacccactggatgaacagaattgtacgctcgaaattgaatcttacgggtatacaactgacgacatcgagttctattggcggggtggagataaggccgtgacgggcgttgaaagaattgagcttccccagttctccatcgtggaacaccgcctggtgtcccgaaacgttgttttcgcaactggagcgtatccaagactgagcctgagctttcgcttgaaaaggaacatagggtatttcatcctgcagacttacatgcctagcattttaatcacgatcctgtcttgggtttcattttggattaactacgatgcatctgccgctcgcgtcgctcttggaatcacaaccgtactgaccatgactactattaatacacatctgcgcgagaccctgcctaaaataccatatgtgaaggccattgacatgtacttgatgggctgtttcgtcttcgtgtttctagctttattggagtacgccttcgtcaactacatttttttcggccggggaccccagcgtcagaaaaagctggcagagaaaaccgctaaggctaagaatgatcggtccaaatcggagtctaaccgggtggacgctcatggcaatatcctcctgacctccctggaggttcacaacgaaatgaacgaggtctccgggggcatcggcgatactagaaactcagcgataagctttgacaactcagggatccaataccggaaacaatccatgccccgcgagggtcacgggcgattccttggtgacaggagcctgccccataagaaaactcacttgcggcgacggagctctcagttgaagatcaaaatcccagacctcactgacgtaaacgcgattgatcggtggtcacgtatagtattcccttttactttttcgctgtttaatttggtgtactggctgtactacgtgaactag

SEQ ID NO: 188851 - DNA, 1209 bp, Artificial Sequence
  Description of Artificial Sequence: Synthetic coding sequence
atgtgggccacctaccagaccgaggaggactacaccctgaccatgtacttccagcagtactggagggacaaacgacttgcttacagtggcatccctttaaacctcaccctcgacaatagggtggccgaccaactgtgggttccagacacttatttcttgaatgacaagaagagttttgtgcatggtgtcacagtgaaaaatcgcatgatacgcctccaccccgacggcaccgtattatacggacttcgaatcaccaccacagctgcctgcatgatggacctgcgaaggtacccacttgacgagcaaaactgcaccctagagattgagtcctatggctacactaccgacgatatcgagttttactggcgtggaggtgataaagctgttaccggagtggagcggatcgaactacctcagttttcaattgtcgaacatagactggtgagtcgcaacgtcgtgttcgcaaccggcgcgtatcctcggctgtctctctctttcaggctgaaacggaacatcggctacttcattctccagacttacatgccaagcatccttattactatactcagttgggtgagtttctggatcaactacgatgccagcgcagctcgggtcgctctagggattaccacggtcctcacgatgaccactataaacacgcacctgagagagaccctaccaaagattccctatgtcaaggccatcgatatgtacctgatgggctgtttcgtgtttgtgtttttagcactcctggagtacgccttcgtgaactatatattttttggccgaggaccacagaggcagaaaaaacttgccgagaaaacagcgaaagcaaagaatgaccggtctaagtctgagtccaatagagttgacgctcacggtaacatcctgcttacctctcttgaagtccataatgagatgaacgaggtatccggggggataggtgacacacggaactccgccatatctttcgacaattcgggaatacagtaccgcaaacagagtatgccccgcgaggggcacggaagatttctgggggatagatcacttccacacaagaagacgcatctgcgacggcgtagctctcagctgaaaattaagattcccgatcttaccgacgtcaatgccattgacaggtggagtcggatagttttcccgtttacattctctttattcaatcttgtgtattggctctattatgtcaactag

SEQ ID NO: 188852 - DNA, 1167 bp, Artificial Sequence
  Description of Artificial Sequence: Synthetic coding sequence
atgtacttccagcagtactggcgggacaagcggctggcctacagcggaattcccctaaacctgacgttagacaatagggtggccgatcagctctgggtacctgacacctactttttgaatgacaagaaaagctttgtccatggcgtcacagtaaaaaaccggatgatacgtctacatccagacggcaccgttctctatggcctacgtatcaccactacggccgcatgtatgatggacctccggaggtatccgctcgacgagcaaaattgtaccctcgagattgaatcttacggatacaccacagacgatattgaattctactggcgggggggcgacaaggccgtgactggagtggaacgcattgagctccctcagtttagtattgtggagcatcggctagtatcaaggaatgttgtgttcgcgaccggtgcttacccccggctgagcctcagtttccgactaaagcgaaacataggctacttcatcttgcagacgtacatgcctagcatactcatcacaattttgtcctgggtttcgttctggatcaactacgacgccagcgccgcccgcgtggctctcggcatcaccaccgtgcttactatgactaccattaatactcatcttagagagacactccctaaaatcccgtatgttaaggctatcgacatgtatctcatgggctgcttcgtgtttgtgtttctcgctctgttagaatatgcctttgttaactacatttttttcgggcggggaccgcagcggcaaaagaagttggcagagaagacagcgaaagcgaagaatgatcgctccaagagcgagagcaaccgggtggatgctcacgggaatatcctgctcacctccctggaggtccacaacgagatgaacgaagtctctggtgggatcggggatacgcgaaattctgctatcagctttgacaatagcgggattcaataccgcaaacagagcatgcctagggaaggccatggacggtttttaggcgacaggagtctcccacataagaagacccacctgaggagacgctcatcccaactgaagatcaaaatcccagatcttactgacgtcaatgccattgaccgttggagccgtatcgtgttccccttcacattttccctctttaacctagtgtactggttgtactatgtgaactag

SEQ ID NO: 188853 - DNA, 417 bp, Artificial Sequence
  Description of Artificial Sequence: Synthetic coding sequence
atgtacttccagcagtactggcgggacaagcggctggcctacagcgggatccccctcaatctcacattggataaccgcgtcgccgatcagctgtgggtgcctgacacctactttctgaatgacaaaaaaagtttcgtgcacggcgtaactgtgaagaacaggatgatccggctgcacccggatggtaccgtcctctacggactccggatcactactacagccgcctgcatgatggacctgcggcggtatcccctggacgagcagaattgcaccctggagatcgagagctatgggtatacaacagacgatatcgagttctactggcgggggggggacaaagccgtcacgggtgtcgagagaatcgagctgccccaattcagtattgtggagcataggctcgtcagccgaaatgtatag

SEQ ID NO: 188854 - DNA, 1359 bp, Artificial Sequence
  Description of Artificial Sequence: Synthetic coding sequence
atggacgcccccgcccggctgctggcccccctgctgctgctgtgcgcccagcagcttcgcggcacaagagcaatgaacgacattggagactacgtcggctctaacctcgagatctcgtggctcccgaatttggacggtctgattgccgggtatgccagaaactttagaccaggcattggtgggccacccgtgaacgtggctttggccctggaagtcgcatccatcgaccacatttcagaggccaatatggaatataccatgaccgtgtttctccatcagtcctggagggatagcaggctgtcttacaatcacactaacgagacactggggctagattcccgcttcgtagacaaactgtggttgccagatacctttatcgttaacgctaagagtgcctggttccacgatgttaccgtggaaaataaactcatcagactacaacccgacggagtgatcttatattcaatccggattacttcaacagttgcatgcgatatggacctggccaaatatccaatggatgagcaggagtgcatgcttgatttagagtcttatggatacagcagtgaagatatcgtgtactactggagcgagagccaggaacatattcatgggctggataagttacagttagcccagtttaccattacatcctacagatttaccacggaactgatgaacttcaaaagcgccggtcagttcccaaggttgtcgctacatttccatttaagaagaaatcgaggagtgtatatcattcagtcgtatatgcctagtgttttgctggtggctatgtcttgggtctctttttggataagccaggccgctgtgccagccagagtgtcactgggaatcaccaccgtgcttacaatgacaactcttatggtatctgcacggtcatcactgccccgagcctccgccattaaggcattagacgtgtacttctggatctgctatgtgtttgtcttcgctgccctggtagaatacgcattcgcacatttcaacgccgactacagaaagaagcaaaaagctaaggtgaaagtgagcaggcctagagccgaaatggatgtcaggaatgcgatcgtgctattctccttatccgccgcaggggttacccaggagctggccatttcacgaaggcagcgcagagtcccaggtaatctaatggggagctataggtctgttggtgtggagactggcgaaaccaaaaaagagggtgctgcccgctcaggaggccaaggcgggatccgggcacgattgagaccaatcgatgctgacacgattgacatatatgcccgcgctgttttcccagcggcatttgcggcagtcaatgtaatctactgggcagcctacgcaatgtag

SEQ ID NO: 188855 - DNA, 1521 bp, Artificial Sequence
  Description of Artificial Sequence: Synthetic coding sequence
atgctgagcaaggtgctgcccgtgctgctgggcatcctgctgatcttgcagtctagagttgaaggcccgcagaccgagtcaaagaatgaagcatcgtcacgggacgtggtctatggccctcaaccacagcctctggaaaaccagctcctgtctgaggaaacgaagtcgactgaaaccgaaactggatccagagtgggaaagctgcctgaggcttctagaattctgaacaccatcttgagtaactatgatcacaagcttaggccaggaattggtgagaaaccaacagtggtgaccgtggaaatatccgttaattccctagggccactctctatcctggatatggagtacaccattgacatcattttctcacagacctggtacgatgagcgtttgtgttataatgatacctttgagagcctggtgcttaacggaaatgtcgtgtcccaactgtggattcctgacacctttttccgtaattctaaacggactcatgaacatgaaataactatgcctaaccagatggtcaggatctataaggacgggaaggtactctacacaataagaatgactatcgatgcagggtgctccctgcacatgcttagattcccaatggattctcattcctgtccgctttccttctcaagcttctcgtaccccgagaatgagatgatatataagtgggaaaattttaagttggaaataaacgaaaaaaacagctggaagctgtttcagttcgatttcacgggcgtttccaacaagacagagattattaccacgcccgtcggggatttcatggtaatgacaatcttcttcaatgtgtcccgcagatttggatatgtagctttccagaattacgtaccttctagtgtgactactatgctctcctgggtgtctttctggatcaaaaccgagagtgcccctgctcggacctccttaggtattacatcagttctcacgatgacgacattgggcaccttctctaggaagaacttcccgcgggtgtcttacattaccgcactcgatttctacatagctatttgtttcgttttttgcttttgcgcactgctagagtttgcagtgctgaattttctgatctacaaccaaacaaaggcccacgcttcccctaagttgagacaccctcgtattaattccagagcacatgcgcgtacacgcgccagatcccgtgcgtgtgccaggcagcaccaggaggcgttcgtgtgccagatcgttacaacagaaggcagcgacggggaagagcgtcctagctgctcggcgcagcaaccaccatctcccggaagccctgaggggcccagatctttatgctctaaactggcatgttgcgaatggtgtaaaaggttcaagaagtatttctgtatggtgcctgattgcgaaggttctacttggcagcaggggaggctgtgtatacacgtctaccgactcgacaactattcgcgcgtggttttcccagtcacgttctttttcttcaacgttctctactggctagtgtgcctgaatctgtag

SEQ ID NO: 188856 - DNA, 420 bp, Artificial Sequence
  Description of Artificial Sequence: Synthetic coding sequence
atgcggagcccctgccccacccggtggagcgccagcacccggatggcacgatgttgcacccagttggtttcctacccggaaaatgagatgatttacaaatgggagaactttaagcttgaaattaatgagaagaattcttggaaacttttccaattcgattttacaggagttagcaataaaacagaaattattactacacctgtaggcgatctgaacgaagaaccgcgtgacttaccaagggtggctccacgggcaactcttgagaccttgttcactcatcccgatcaggtacagggatctgagggaactgctcttatcgtgagtaggatgtggatggaacccgtcacccaacccgcgatctgcagggaacggcacctcgtccttttacccttcaagatccctagacaagaagacttctag

SEQ ID NO: 188857 - DNA, 1398 bp, Artificial Sequence
  Description of Artificial Sequence: Synthetic coding sequence
atgggccccctgaaggccttcctgttcagccccttcctgctgcggtcccaaagtagaggcgttcgcctggtgttccttttgctgacactccatctggggaactgtgttgacaaggcagatgatgaagacgacgaagatctgacagtcaataagacctgggttctcgctcctaagatccacgaaggcgacatcacacagatcttgaattccctactccaaggctacgacaataagctgcggcccgacattggtgtgcgaccgaccgttattgagacagatgtttatgttaactccattggccccgtagatcctatcaacatggaatataccatcgatattattttcgcccagacttggtttgatagccgactgaaattcaactccacgatgaaggtactcatgctgaactcaaacatggtgggtaagatttggatccccgataccttctttcgcaactccagaaagtcagacgcgcactggatcaccacaccaaaccgcctgctgcggatttggaacgacggcagagtactctatactctgaggctgacaatcaatgccgagtgctatttgcagctgcacaatttcccaatggacgagcactcctgtccgcttgagtttagcagctatggataccctaagaacgagatcgaatacaaatggaagaagcctagtgtggaagtggccgacccgaaatactggaggctatatcaattcgcgtttgtcggcctgaggaatagtacagagatcactcacaccatttccggggactacgtgatcatgacaatctttttcgatttgagcaggcgcatgggctacttcaccattcaaacctacatcccatgtatacttaccgttgtgttgtcttgggtgtctttttggattaataaggatgcagtcccggctagaactagtctcggcatcacgacagtgctcacaatgactacactgagcactattgcccggaaaagtttgcccaaggtgagttacgtgacggccatggatctcttcgtgagcgtttgcttcatcttcgtattcgccgcgctcatggagtatggcacattgcattacttcacatccaaccagaagggtaaaacagcgactaaagacagaaagctgaagaacaaggcctctatgaccccgggcttacaccccggctcgacactgatcccgatgaacaatatctctgtcccccaggaggatgattacgggtatcaatgtctggagggcaaagactgtgcttccttcttttgctgttttgaggattgcaggaccggaagttggcgggaaggcagaatccatattcggatcgccaaaatcgatagttatagccgtatttttttccccacagccttcgccctatttaacttggtctattgggtgggctatctgtacctgtag

SEQ ID NO: 188858 - DNA, 1260 bp, Artificial Sequence
  Description of Artificial Sequence: Synthetic coding sequence
atgggccccctgaaggccttcctgttcagccccttcctgctgcggagccaatcccggggggtccgtctggtctttcttcttctcacactccatctcgggaactgtgttgataaagcagatgacgaggacgatgaggatctgactgtaaacaagacctgggtcctggcaccaaaaattcacgaaggcgatattacccaaatcctcaacagcctcttgcagggttacgacaataaactccgtcccgacatcggcgtcaggcctactgtgattgagactgatgtgtacgtgaacagtattggacccgtggatcccatcaatatggagtatacaatcgacataatctttgcacaaacctggtttgactccaggctgaaattcaatagtaccatgaaagtattgatgctgaattccaatatggtgggcaaaatctggatccccgataccttcttccggaatagcaggaagtcggatgctcactggatcactacccccaacaggttgctgcgcatttggaacgacggaagggtgctctatactctccggctgactatcaacgccgaatgctacctacagctccacaacttccccatggacgaacactcatgtcctctggaattcagctcatacggatatcccaagaacgaaatcgaatataagtggaagaagccatcggttgaagtggcagaccccaaatactggcgcctataccaattcgcattcgtgggtctgcggaattctactgagattacccacaccattagcggagactacgttataatgactatattctttgatctatcaagacggatgggctattttacaatccagacatatatcccatgcatccttacagtcgtgctgtcttgggtgtccttttggataaataaggacgctgtacccgctcggacctctttgggcatcaccaccgtgctgactatgacaaccctgtcaactattgcaagaaaatccctgccaaaggtgagttatgttacggccatggacctttttgtgagtgtatgcttcatcttcgtgttcgctgctttgatggagtacggcacactccactattttaccagcaatcagaaagggaaaactgctacaaaggacagaaagctcaaaaacaaggcttcaatgactccaggcctgcacccgggatcaaccctaattcctatgaacaatatcagcgtcccccaggaagatgactacggttatcaatgtctggaaggtaggaaggacacccatacccactgtcagaattag

SEQ ID NO: 188859 - DNA, 1428 bp, Artificial Sequence
  Description of Artificial Sequence: Synthetic coding sequence
atgagcagccccaacatctggagcaccggcagcagcgtgtacagcacaccggtgttttcccagaaaatgactgtatggattctattattactgagcctctatccaggttttacctctcagaagagtgacgatgactacgaagactatgccagtaataaaacttgggttttgactccaaaggtcccagaaggcgacgtcaccgtgattctgaataatctgttggagggctacgataacaaactgaggccagatatcggagtgaaacccacccttattcatacggacatgtatgttaatagcattggacctgttaatgcaatcaatatggaatacactatagacatcttcttcgctcagacatggtatgatcgccgtctcaaatttaacagtactattaaagtgctgcggcttaactcaaatatggttggaaaaatttggatacctgatactttcttccgcaacagcaaaaaagcagatgctcactggatcaccacgccaaatcgcatgctgcgcatatggaacgatggcagggttttgtacacccttcgtctgactattgatgccgaatgtcagctgcaattacacaattttcccatggatgaacattcttgcccgcttgaattcagctcctacgggtatccccgcgaggaaatagtttaccagtggaagcggtcttccgtggaggttggcgatacaaggagctggaggctttatcaattttcgttcgtgggcctccgtaacacaactgaggtggtgaaaacaacatctggcgactacgtcgtcatgtcagtgtactttgaccttagtcgccgaatgggatacttcactattcagacttacattccctgcacccttatcgtggtgctgtcatgggtgtcattttggatcaacaaagacgctgtgcctgccaggacctcactgggcataacaacagtacttaccatgacgactcttagtacaattgcccgcaagtctctgccaaaggtctcttacgtcacggccatggacctctttgtttcagtctgtttcattttcgtgttctcagccctggtggagtacggaacactccattactttgtgtccaataggaagccctcaaaggataaagacaaaaagaagaaaaatcctctcctccgcatgttttcttttaaggccccaaccatcgacatcagaccgaggagcgccacgattcagatgaataacgcaacacaccttcaggaaagagacgaggagtacgggtacgagtgtctggacggtaaggactgtgcctctttcttttgttgtttcgaggattgccgtaccggcgcatggaggcatggtaggattcatatccgcatcgcaaagatggacagctatgcccggattttttttcccaccgcgttttgtctctttaatctggtgtactgggttagctatttatacctgtag

SEQ ID NO: 188860 - DNA, 1404 bp, Artificial Sequence
  Description of Artificial Sequence: Synthetic coding sequence
atgagcagccccaacatctggagcaccggcagcagcgtgtacagcacccccgtcttcagtcaaaaaatgacagtctggattttgttactcttatccttgtaccctggctttactagtcaaaagagcgatgatgactatgaggattatgcctctaataagacatgggtactcacccctaaagtcccggaaggagatgtgaccgttatactgaacaacttactggagggctacgacaataaattacgccctgatatcggagtgaagccaacactgatccatacagacatgtacgtgaatagtatcgggccagttaatgccatcaatatggaatacactatcgacatcttctttgcccaaacatggtacgatagaagactcaaattcaattcaacaatcaaagtactccgcctcaactctaacatggtgggaaaaatctggattccggacaccttttttcgcaactccaaaaaggccgatgcccattggataaccacacccaatagaatgctccgcatctggaacgatggccgggtactttacactctccggctgaccatcgacgccgagtgtcaattacaattacacaactttccaatggacgagcactcctgtccactcgagttctctagctacggataccctagagaagagattgtgtatcagtggaagcgttcctctgtggaggtgggggacacaagaagctggcgcttataccagttctcctttgtgggtctgagaaataccacggaggtcgtgaagaccactagtggagattatgtggtgatgagtgtctactttgacctgagccggagaatgggatactttactatccagacttacataccttgcactctgattgtagtcctgtcttgggtaagcttttggatcaataaggacgctgttcctgcccgcacctcactcggaatcactactgtgttaactatgaccactctctccacaatcgcccgaaagtcactgccaaaagtttcctacgtgacagccatggacctgtttgtttctgtttgctttatttttgttttttctgcattggtggagtatggtactctgcactattttgtatccaatcgcaagccgagcaaggacaaagataagaaaaagaaaaatccggcccctaccattgacatccgaccccgctctgcgactattcagatgaataatgccacacacctgcaggaaagagacgaagaatacggatacgaatgcctcgatggaaaagactgtgccagcttcttttgttgttttgaagattgcagaactggggcctggcgtcatggccggattcatatacggattgccaaaatggacagctatgccaggatatttttccccactgccttctgtctattcaatctggtgtactgggtttcctacctgtacttgtag

SEQ ID NO: 188861 - DNA, 1119 bp, Artificial Sequence
  Description of Artificial Sequence: Synthetic coding sequence
atgtacgtgaacagcatcggccccgtgaacgccatcaacatggagtacactatcgacattttttttgcacagacatggtatgaccgtaggctcaagtttaactctacaatcaaggtgctcagactaaactctaatatggtcgggaagatctggattcccgatacctttttccgaaattctaaaaaggcagatgcgcactggattacaactccaaacaggatgttgcgcatttggaatgatggacgtgtcttgtacaccctcaggcttactattgacgccgagtgccaattacaactccataacttccccatggacgaacacagttgccccctcgaatttagctcctacgggtatccccgcgaagagatagtgtatcagtggaagcggtcgagtgtggaagtgggcgacacccgctcttggaggctttatcagttcagcttcgttggtcttagaaacaccactgaagttgtgaagaccacctccggcgactacgtcgtgatgagcgtgtactttgacctgtccaggagaatgggttatttcaccatccagacctatattccttgcactcttattgtggtcctgtcatgggtgtcattctggattaacaaggatgccgtgcccgccagaacctccctcggaattaccacagtgttgactatgactacactgtccacgatcgctcgtaagagcctccctaaagtaagttacgtgaccgctatggacctgtttgtatccgtgtgttttatctttgtctttagtgccctagtggaatatggcacacttcactacttcgtctcgaaccgcaaaccatctaaagacaaagacaagaaaaaaaaaaatcctgcacctacaattgacatccgccctaggtctgctaccatccagatgaataacgcaacccacttgcaagagcgggatgaggagtacggctacgaatgccttgatggcaaggattgcgctagcttcttctgctgttttgaagattgcagaaccggggcctggcgccacggacggattcatattcgaatcgcaaaaatggattcttatgctagaatcttcttccctacggccttttgcctgttcaatttggtgtactgggtctcctatctctacctctag

SEQ ID NO: 188862 - DNA, 1404 bp, Artificial Sequence
  Description of Artificial Sequence: Synthetic coding sequence
atggcccccaagctgctgctgctgctgtgcctgttcagcggcctgcacgctagatcccgtaaagtagaagaggatgagtacgaagattctagcagcaaccaaaaatgggtgctagccccaaagtcccaagacaccgacgtgaccctcatcctgaacaagctgttaagggagtacgataaaaaacttcgacctgatataggcatcaaaccgactgttattgacgttgatatttatgtgaactccattggcccggtgtcgtcaataaacatggagtatcagattgatattttttttgcccagacatggacagatagccgcctgcgctttaacagtactatgaaaatactgactttgaattcgaatatggtgggtcttatctggattcccgacactatctttcgaaacagcaaaacagcagaggctcactggatcacaacacctaaccaactgttgcggatttggaatgatgggaagatcctttatacccttcgcctgacgattaacgctgaatgccagctgcaactccataacttcccaatggatgaacactcctgcccccttatcttttcgagctacggatatcccaaggaagagatgatttaccggtggcggaagaactccgtggaagcggctgaccagaaaagctggaggctctatcaatttgattttatgggattgcgtaatacgaccgagattgtgacaacaagtgccggcgactacgtggtgatgacaatttactttgagctctctcgccgaatggggtacttcaccatccagacctacatcccatgcatattaaccgtggtgttgtcttgggtgagcttttggatcaagaaagatgcaacaccagcacgcacggcgctgggaataactacagttctcaccatgacgaccttgtccaccatagcacgtaagagtctccctcgagtgtcatatgtcactgccatggacctgttcgttactgtctgttttttatttgtgttcgccgccctgatggagtatgccacactcaattactattcctcatgtagaaagccaacaactaccaagaagacgacctcgctgttgcaccctgactctagcaggtggatcccagagcgcatttctctgcaagctccctccaactactccctgctagatatgaggcccccccctacagcaatgatcacgttgaacaactccgtatattggcaggaattcgaggacacatgtgtgtatgaatgtttggatggtaaggactgccagagctttttctgttgttacgaggagtgtaaatccggcagctggcgcaagggccggattcacattgatattctcgaactggactcctactcacgagtctttttccccacctcatttttgctttttaatctcgtttattgggtgggctatctttacctttag

SEQ ID NO: 188863 - DNA, 1323 bp, Artificial Sequence
  Description of Artificial Sequence: Synthetic coding sequence
atgaactacagcctgcacctggccttcgtgtgcctgagcctgttcaccgagagaatgtgcatccaggggtcccagttcaatgtcgaggtgggacggtccgacaaactctctcttcctggctttgaaaacctgactgcaggttacaacaagttcctgaggcctaacttcgggggcgagcctgtacagatcgctctgacccttgacattgcttctattagttcgatatccgaatctaacatggactacacagcaactatatacctccgtcagcgatggatggaccagcgactcgtgttcgagggcaacaaatcatttaccctggatgctcggctggtcgagttcctttgggtgcctgatacctatattgtggagtcaaagaagagcttcctgcacgaagttacagtcggaaacagactgataaggctattttcaaacggtactgtgctctacgctctgcggatcacgacaactgtcgcctgtaacatggatctcagtaagtatcccatggatacccagacttgcaagctgcaactggaaagctggggctatgacggcaatgacgtcgaatttacctggctacgcggaaatgacagtgtaaggggactggaacacctgaggctggcacagtacaccatagaacgctactttacgctcgtaacaaggtcccagcaggagacaggcaattacacccgtctcgtgcttcaatttgagctcaggaggaacgtgctatatttcatactagagacctacgttccaagcactttccttgtagtgctgagttgggtctcattttggatcagtcttgacagcgtccccgcgagaacttgcattggtgtgacgaccgttctctccatgactactcttatgatcggatctaggacctccctccccaacactaactgctttatcaaagctatcgatgtgtatcttggcatttgtttttctttcgtgtttggggctctcctggagtacgcagtggctcattacagctccctgcagcagatggccgcgaaagacaggggaactacaaaagaggtagaggaagtctcaataacgaacatcatcaattcttcgatctcttcctttaagcgcaagatttccttcgccagtatcgagatcagttctgataacgtagactactctgaccttaccatgaaaacctccgacaagtttaagttcgtgtttcgcgagaaaatgggccgcatagtggattatttcacgatacagaatccatctaacgtagaccactactcaaaattgctgttccctctgatctttatgctggctaacgtcttttactgggcttattatatgtacttttag

SEQ ID NO: 188864 - DNA, 159 bp, Artificial Sequence
  Description of Artificial Sequence: Synthetic coding sequence
atgaactacagcctgcacctggccttcgtgtgcctgagcctgttcaccgaaaggatgtgtattcagggatcacagttcaacgttgaagtgggcaggagcgataagctttcattgccaggcttcgaaaacctgactgctgggtataacaagttcctctag

SEQ ID NO: 188865 - DNA, 1323 bp, Artificial Sequence
  Description of Artificial Sequence: Synthetic coding sequence
atgaactacagcctgcacctggccttcgtgtgcctgagcctgttcaccgagcgcatgtgcatccagggaagccagtttaatgtggaagtggggaggagtgataaactgtcgctcccaggatttgagaatctcactgccggttacaacaaattcctgcgcccaaactttggcggcgaacccgtgcaaatcgcacttaccctggacattgctagcattagctccatcagcgaatcaaatatggactatacagccacgatatatttacgacaacggtggatggatcagaggcttgtgtttgagggcaacaagagttttacgttggatgcccgactggttgaatttctgtgggtgcccgatacttacatcgtggaatccaaaaagtcctttctacacgaagttaccgtgggaaacaggctcattcgccttttcagcaacggcactgtgctttacgctttgcgtatcactacaaccgtggcttgtaacatggatctgagcaagtaccccatggatacacagacatgcaaactccagctggagtcatggggatacgacggcaatgacgtcgagttcacttggctcagaggaaacgactcagtgcgcggtctggaacacctgaggctcgctcagtacactatcgaaaggtattttactcttgtcactcgatctcagcaggaaactggaaactatactcggctggtgctgcaattcgagctgaggcgcaatgtactgtactttattctagagacttacgtgccttccacctttttggtggttttgtcttgggtttctttctggatttccctggacagtgtgccggccaggacgtgtatcggagttaccacagtgctgtcgatgactactctgatgatcggctccaggacctcacttcccaacaccaactgcttcattaaggcgatcgatgtgtacttaggcatttgtttttctttcgtttttggcgccctattggaatatgctgtggcacactacagtagccttcagcaaatggccgctaaagatcgagggactactaaggaggttgaggaggtgtcaattaccaacattattaattcttctatcagttcattcaaacgaaagatttcttttgcaagcattgagatatcaagcgataacgtggattatagtgacctcacaatgaaaacatctgacaagttcaaattcgtgttcagggaaaaaatgggcaggatcgttgactatttcacgatacagaacccctctaacgtggatcactacagcaagctgctgttccctctgattttcatgttggctaacgttttctattgggcgtattacatgtacttctag

SEQ ID NO: 188866 - DNA, 180 bp, Artificial Sequence
  Description of Artificial Sequence: Synthetic coding sequence
atgaactacagcctgcacctggccttcgtgtgcctgagcctgttcacagaacggatgtgcatccagggctcccagtttaacgtagaggtgggtcggtcagacaaattgtcactccccggatttgaaaaccttacggcaggatataacaagttcctccgccccaactttgggggcgaatag

SEQ ID NO: 188867 - DNA, 279 bp, Artificial Sequence
  Description of Artificial Sequence: Synthetic coding sequence
atgaactacagcctgcacctggccttcgtgtgcctgagcctgttcacagagaggatgtgtattcagggctctcagttcaatgtggaggtaggtcgttcggataaactgtcacttcccggcttcgagaacttgaccgcaggttacaacaagttcctcagacctaattttggcggggaacctgtccagatcgcactgacgctcgatatcgcctcgattagctcaatttcagagagcaacatggattacaccgctactatctacctgaggcagaggtggtag

SEQ ID NO: 188868 - DNA, 516 bp, Artificial Sequence
  Description of Artificial Sequence: Synthetic coding sequence
atgaactacagcctgcacctggccttcgtgtgcctgagcctgttcaccgaacgtatgtgcatccagggatcccagttcaacgtcgaggttggaaggagtgacaaactgagtcttccaggttttgagaatctgactgcgggctataacaagttcctgcggcccaatttcggtggggagcctgtgcagattgctctcactctcgatattgctagcatcagcagcatctccgagtctaacatggactacaccgccactatctacctgcgacagagatggatggaccaaagactggtgtttgaagggaataaaagttttactctggacgctcgactggtcgagtttctctgggttccagatacatacattgtggagagcaagaaaagctttctgcacgaggttacggttggcaacagactgattcgcctctttagcaatggcacagtcctctatgccctcagaatcacaaccacagtggcgtgtaatatggacctcagcaagtaccctatggatacatag

SEQ ID NO: 188869 - DNA, 570 bp, Artificial Sequence
  Description of Artificial Sequence: Synthetic coding sequence
atgaactacagcctgcacctggccttcgtgtgcctgagcctgttcacagaacggatgtgtatccagggatcccagtttaatgtggaagttggccgttccgacaaactgtccctccccgggtttgagaatttgacggccgggtataacaaattccttcgtccgaactttggaggcgaacccgttcaaatcgcactgacactcgacattgcttctatttcctcgatttcagagtcaaatatggactataccgccaccatctacttgagacagcgctggatggatcaacgactggtttttgaaggcaacaaatccttcactcttgatgcccgcttggtagagtttttatgggttcccgacacttacattgtagaaagtaagaaaagcttcctacacgaggtgacggtaggtaaccgtctgattcgtctttttagcaacggcactgtcttgtacgcactacgaattaccaccacagtggcctgcaatatggatctgtcaaagtacccgatggatacccagacttgtaagctccagctcgaatcatggggttatgatggcaatgatgttgaatag

SEQ ID NO: 188870 - DNA, 564 bp, Artificial Sequence
  Description of Artificial Sequence: Synthetic coding sequence
atggactacaccgccaccatctacctgcggcagcggtggatggaccagaggcttgtttttgagggaaataagtccttcacactagatgaggtcaccgtgggcaaccgactgatccgcttatttagcaatggcaccgtcctttacgcccttaggatcacgactactgtggcctgcaatatggatcttagcaaatatccaatggatacacagacctgcaagctccagctcgagtcttgggggtacgacgggaatgatgtcgaatttacctggctgagaggtaatgatagcgtgagagggctagaacacctgcgtctcgctcagtacaccattgagcggtacttcacacttgtgactaggagtcaacaagaaaccggtaattatactagattagtactgcagttcgaactccggaggaacgtcctttacttcatcctcgagacttatgtccccagcacatttcttgtggtgctatcctgggtatccttctggatcagtttagacagtgtgcccgctcggacctgcatcggagacaacaagggaagtaggaggtcacagtattactag

SEQ ID NO: 188871 - DNA, 2826 bp, Artificial Sequence
  Description of Artificial Sequence: Synthetic coding sequence
atggccagcccccggagcagcggccagcccggcccccccccccccccccccccacctcccgctagactactgctgcttctgctgctgcccctgttactgcccctcgcccccggggcatggggctgggcccgaggggcaccacggcctcctccctcatctcctcccctatcaatcatgggccttatgcctttaacaaaggaggtcgcaaaggggagtatcgggcgtggtgtgctgcctgccgtcgaactcgcgatagagcagatccggaacgaatcgttgcttaggccgtatttcctggacctgaggttatacgacactgagtgcgataatgccaaaggcctgaaggccttctatgatgccatcaagtacggaccgaaccatctgatggtgttcgggggagtctgtcccagtgttaccagcattatagcagaatccctgcaaggttggaacctcgtgcagttgtccttcgcggctacaaccccagtgttagccgacaaaaagaaatatccttatttttttagaaccgttccaagtgataatgcggtgaaccctgcgattctaaagttgctgaaacactatcagtggaagcgggtgggcactttgacccaggatgttcagcggttctctgaagttagaaacgacctgactggcgtgttgtacggtgaggacatcgaaatctctgataccgaaagtttctctaatgacccttgcacttcagtcaaaaagctcaagggcaatgacgttcgcataatactcgggcaattcgatcagaacatggccgcaaaggtgttttgctgtgcttatgaagagaatatgtatggctccaaataccagtggattatccccggatggtatgagccctcctggtgggagcaagtgcacactgaagctaattctagtcgatgtttgcggaaaaatctgctagcagccatggagggctacattggcgtagactttgagcctctgagttccaaacagattaaaactataagcggcaagacgccgcagcagtacgagagggagtacaacaacaagcggtccggagtgggaccttcaaaattccacggctacgcttacgacggcatttgggtgatcgccaagactctgcagagggccatggagacactgcatgcttcgtcccgacatcagagaattcaggatttcaattataccgaccatactctcggcaggattattctgaacgccatgaatgagaccaacttctttggagtaactgggcaagttgtttttcgaaacggggagaggatgggaaccataaagttcacccaattccaggacagtagagaagtcaaggtgggagagtacaacgcagtggccgatactctggagataatcaatgacacaattagatttcagggatcagagccaccaaaagataagaccatcattctggagcaattgaggaaaattagcctccctctgtacagcatcttatctgctttgaccattctcggcatgattatggccagcgcattccttttcttcaacattaagaatcgtaaccagaaactgattaagatgtctagtccctatatgaacaacctcattatcttggggggaatgctgtcctacgcatctatattcttatttggtttagatggctcctttgtgagcgagaagacatttgagactctgtgtaccgttagaacctggatattgaccgtggggtacacaactgcatttggtgcaatgttcgccaagacatggcgagttcacgccatctttaaaaacgtcaagatgaaaaagaagatcatcaaggatcagaaactgctggtgatagtaggtggcatgctgttgattgatctctgtattctgatctgttggcaagccgtggaccccctgcggcgcaccgtggagaagtattccatggaacctgatcccgccggtagagatattagcatccgccccctgctcgaacactgtgagaatacgcacatgactatctggctcggaatcgtgtatgcttataagggcctgctgatgctgtttggctgcttcctcgcttgggaaacgagaaatgtgtccatccctgccctcaacgactccaagtacatcggaatgagcgtttacaatgtgggaatcatgtgcattattggtgccgctgtatcttttctcactcgcgaccagccaaacgtgcagttttgcattgtagctctggtcattatcttctgctcaaccatcaccttgtgcttggtgttcgtgcccaagctgatcacactgcgcactaacccagatgctgctacccagaataggaggttccagttcacgcagaaccagaagaaggaagattcaaagacatccacatccgttacctccgtgaatcaggcttctaccagtcggctggagggccttcagagtgaaaaccatcgtctgcgtatgaagatcaccgagctggacaaggatttggaggaggtaacaatgcagcttcaggacacccccgagaagactacatacattaaacagaaccattatcaagagctgaacgatatcctgaacctcggaaacttcactgaaagcacagacggagggaaggcaatccttaagaatcacttggatcagaatcctcagctgcagtggaacacaacagagcctagccgtacttgcaaggatcccattgaggacattaactcgcccgaacacattcagagacgactctctcttcaactccctatactacatcacgcttacctgccttctatcggaggagtcgatgcatcctgtgtttccccttgtgtgagccctacagctagccctagacataggcatgtccccccttcgtttcgggtcatggttagcggactgtag

SEQ ID NO: 188872 - DNA, 1179 bp, Artificial Sequence
  Description of Artificial Sequence: Synthetic coding sequence
atgcggcccggcttcggcggccccgccatccccgtgggcgtggacgtgcaagttgagtctctcgattcaatcagcgaggtggatatggatttcacgatgactctctatctccggcattattggaaggatgagcggctgtccttcccgagcaccaataacctgagtatgactttcgatggcagactggtcaagaaaatttgggtgcctgatatgttcttcgttcacagcaaaagatcctttatccatgacaccaccactgacaacgttatgcttagggtgcagcctgacggcaaagtgttgtactcactgagggttacggtgacagccatgtgcaacatggactttagccgcttcccgctagacacgcaaacatgttctctggagatcgaaagttacgcctacaccgaagacgatctgatgctctactggaaaaaaggaaacgatagcttaaagaccgatgaacggatttcactgtctcagttcctgattcaggaatttcatactactaccaagctcgcattttactcctccactggttggtacaaccggctctacatcaactttacactcaggcgccacatattcttcttcttgttacaaacttactttcccgccacactaatggtgatgctgagctgggtgtcattttggatcgaccggcgcgcagttccagctagagtccctctcggtatcacaacagtcctcaccatgagtaccatcataaccggcgttaatgcgagtatgccacgcgttagctatataaaggccgtggatatctacctgtgggtctcttttgtgtttgtctttctttcagtattggaatacgccgcggtgaactaccttaccactgtgcaggagagaaaagagcaaaaactgagggaaaaattgccttgtacttcaggcctccccccacctcggacagcaatgctggatggcaattacagcgatggggaagtgaacgacctcgacaactatatgcctgagaatggcgagaaacctgatcgcatgatggtacagctgacccttgcctccgaacgatcatcaccccagaggaaatcacagaggtccagctatgtttctatgaggatcgatacacatgcgatcgacaagtactctcggattatctttccagcggcatacatcctcttcaatttgatttactggtctatattttcttag

SEQ ID NO: 188873 - DNA, 1389 bp, Artificial Sequence
  Description of Artificial Sequence: Synthetic coding sequence
atgctggccgtgcccaacatgcggttcggcatcttcctgctgtggtggggctgggtcttagctactgagtctagaatgcattggccagggagggaggtgcatgagatgtctaagaagggatcacccatattgcgcagaagcccggacattacaaaaagtcctctgaccaaatcagagcagctgcttagaatcgatgaccatgacttcagcatgcgcccgggctttggagggcctgcgatccctgtgggcgtcgatgtgcaagtggagagtctcgatagcatctcagaggtcgatatggattttaccatgaccctttatctcaggcattattggaaggacgaacgtctatctttcccatctacaaataacctcagtatgacgtttgacggaagactggtcaagaaaatttgggtgcccgacatgttcttcgttcactccaaaaggtccttcattcatgatacaactactgataacgttatgctgcgagtccagcctgatggtaaggttctgtactcactcagggttactgtaaccgccatgtgcaatatggatttctcaaggtttccactggatacgcagacttgctcacttgaaatcgagagttatgcatacaccgaggacgatctcatgctgtattggaagaaaggcaatgactccctgaagacagacgaaaggatcagcctgtcgcagtttctgattcaggagttccatacaacaacaaaactcgctttctattcaagtactgggtggtacaacagattgtacataaacttcactcttagaagacacatcttcttctttttactgcaaacctattttccagctaccctgatggtaatgctgagctgggtcagtttttggatcgaccgccgcgccgttcccgcaagggtgcctctcggcataaccaccgtcctcactatgagcacaatcattactggagtgaacgcctccatgccacgggtctcttacatcaaggccgtcgatatctatctctgggttagtttcgtgttcgtgttcttgtctgtcctggagtatgcagcagtcaattatctgacaactgtgcaggagcgaaaagagcagaagctcagagaaaagctcccctgtacaagcggactcccacctcctcggacggctatgctcgacggaaactatagcgacggggaagtaaacgatctcgataactacatgcccgaaaacggcgagaaaccagacagaatgatggtacagctaaccctggcttccgaacgatcctccccacagcgcaagtcgcagagaagctcgtatgttagcatgcgcattgacactcacgcaattgacaagtattccaggataattttccctgccgcgtacatactgttcaatctgatatattggtcgatattctcatag

SEQ ID NO: 188874 - DNA, 1179 bp, Artificial Sequence
  Description of Artificial Sequence: Synthetic coding sequence
atgcggcccggcttcggcggccccgccatccccgtgggcgtggacgtacaggtggaatctcttgattctatttcggaagtcgacatggattttacgatgacgctctacctgcgccattattggaaagatgagcgactgagctttcctagtacaaacaacctgtccatgactttcgacgggaggctcgttaaaaaaatttgggtgccggacatgtttttcgtgcacagtaaacgcagcttcattcatgacaccacgactgacaatgtgatgttacgcgtgcagcctgatggcaaggttctgtactccctcagggtgactgtgaccgctatgtgtaacatggactttagccggttccccctggacacacagacttgttccctcgaaatcgagtcctacgcttatactgaggatgatctgatgctttactggaaaaagggaaacgacagtctgaaaaccgacgagcgcatcagcctgagccagttccttattcaggaatttcacacaacgacaaaactcgccttctatagctctacgggatggtacaaccggctatacatcaacttcacacttaggcggcatatcttctttttcctcttacaaacctacttccctgctacattaatggtgatgttgtcctgggtctcgttctggattgatcggagagcggtccctgcccgcgtacccctaggcataacaacggtgctgaccatgtctactataatcactggagtcaatgccagtatgcctcgggtcagctacatcaaggccgtcgacatctatctgtgggtatcgttcgtctttgtgttcctgtccgtgctggagtatgcggcagtgaactatctgactaccgtgcaggagagaaaagagcagaagctcagggaaaaattgccatgtacttccgggctgccccctccacgaacagccatgcttgatggtaattactctgatggcgaggtgaatgacctagataattacatgcccgaaaatggagaaaagcctgatcgcatgatggtgcagctgacactggctagcgaacgctcaagtcctcagaggaagagtcaacggagcagctatgtctcaatgcgaatcgacactcacgccatcgacaagtattccaggattattttccccgcagcttatattctgttcaatctgatatattggagcatcttttcttag

SEQ ID NO: 188875 - DNA, 1440 bp, Artificial Sequence
  Description of Artificial Sequence: Synthetic coding sequence
atgctggccgtgcccaacatgcggttcggcatcttcctgctgtggtgggggtgggtactcgccaccgagtctcgtatgcattggccagggcgcgaggtccacgaaatgagcaagaaaggtcggccgcaaagacagcgccgagaggttcatgaagatgcccataagcaggtgagccccatcctccgtaggtcacctgatatcacaaagagcccactcaccaaaagtgaacagctgctacgaattgatgatcatgatttctcgatgcgccctggattcggaggaccggcaatcccggtgggcgtggatgtccaggtggagagcctggatagcatttcggaggttgacatggactttaccatgacactgtaccttcggcactattggaaggatgaacgactgtctttccctagcacaaataatcttagtatgactttcgatggacggctcgtaaagaaaatttgggtccccgacatgttctttgtgcatagtaagagaagcttcattcatgatacaaccactgacaatgtgatgctacgggtccagcccgatggcaaggttttgtattcactaagggttacagtaaccgctatgtgtaatatggacttttccaggtttccgctagatactcagacctgctccctggagatcgagtcctacgcctacaccgaagatgacttaatgttgtactggaagaaggggaacgattccctgaaaactgatgagcgcattagcctgtcccagtttctgatccaagagttccacaccaccacaaaactggccttctactcctccacgggatggtataacaggctgtatatcaatttcacccttaggcggcacatattcttttttctgctgcaaacctactttccagctactctaatggttatgctgtcctgggtgtccttctggatcgacagacgggccgttccagccagggtgccattgggcataacaacggtactgactatgtctaccattataaccggggtgaatgcctctatgccaagggtgtcttatattaaggccgtggacatctatctgtgggtctcttttgtgttcgtcttcctgtccgtgctggagtatgccgctgtgaactatctcacaactgttcaagaaagaaaggagcagaaacttagggagaagctcccttgcacaagcgggctgcccccccctcgtactgccatgcttgacgggaattattcagatggggaggtgaatgatcttgataactacatgccagagaacggggagaagccagaccggatgatggtgcagttaacactagcctcagaacgaagctcaccccagaggaagagccaaaggagttcgtatgtctccatgcgtatagatacacacgctatcgacaaatacagccgcataatttttcccgccgcctacattttattcaatttaatctattggtcaattttttcgtag

SEQ ID NO: 188876 - DNA, 1473 bp, Artificial Sequence
  Description of Artificial Sequence: Synthetic coding sequence
atggtgaagcccggcggcatctgcagcgccaccggctactggaaggcagcattctgccttaccgatgtgcacaaaatgccctattttacccgtctgattctgtttttgttctgcttgatggtgcttgtcgagagccgcaagcctaaacggaagcgttggactggtcaggtagagatgccaaaaccctcgcatctgtacaagaaaaatctcgatgttactaaaataagaaagggaaaaccacagcaactactccgcgtcgacgagcatgacttttcaatgaggcccgccttcggtggaccggcgatccctgtcggggtggacgtccaggtggagtcactggactccatcagcgaggtcgatatggattttactatgaccctttatctgcggcactactggaaggatgagcgcctcgctttcagctctgcgtcaaacaagtctatgacatttgacggacgactggttaagaagatctgggtccctgatgttttctttgtgcacagtaagcgatcgttcacgcacgacaccacgacagacaatattatgcttcgtgtttttccagatggccacgtgctctacagcatgcggattactgtgactgccatgtgcaacatggacttttctcattttcctttggactctcagacatgcagtctggaactggagagctacgcctacacggacgaggatctcatgctctactggaagaatggggacgaatccctgaagaccgacgaaaagatttccctgtcccaatttttaattcagaagtttcatacaacaagcaggttggcattttatagtagtacaggttggtataatcggttatacattaatttcacccttagacgccacatatttttttttctattacaaacttactttcccgcaacactcatggtgatgctgtcctgggtcagcttttggatagaccggcgagcagtgccggctcgcgtgtctcttgggattactacagtcttgacaatgaccacaatcatcacaggggtcaatgcttcgatgcccagagttagctatgttaaggccgtggacatctacctgtgggtttcttttgtgttcgtgtttctgtctgtcttagaatatgcagccgtgaactatctcaccaccgttcaggaacgaaaggagcgtaagcttagggagaagtttccatgtatgtgcgggatgttacacagcaagaccatgatgttagatggttcctatagcgaatccgaagctaactctctcgctggttaccctagaagccacatcctcaccgaggaagaacggcaagataagattgttgtgcatttgggcttatcaggcgaggccaatgcagccagaaagaagggactgctgaaaggacagaccggcttcaggatctttcagaatacgcacgccatcgataaatactcacggctcattttccccgcgagttacatcttcttcaacctaatttattggagtgtgttctcctag

SEQ ID NO: 188877 - DNA, 453 bp, Artificial Sequence
  Description of Artificial Sequence: Synthetic coding sequence
atgctgcgggccgccgtgatcctgctgctgatccggacctggctggccgaaggcaactatcccagtcctattcctaagttccatttcgagttctcttctgccgtccctgaggtggttctgaacctgttcaactgtaagaattgtgccaatgaggcagtagttcagaaaattctggatagagtactttctcgatatgatgtccgcctcagacccaattttggtggcgtcctggagacaaatagcacttggggcctgaacgatgatgaactgatggctcacggccaggaaaaggactcatctagcgaatccgaggactcttgcccgccttcaccagggtgttcgtttactgagggtttctcatttgacctgttcaaccccgactatgtgccaaaggtggataaatggtccaggtttttattcccactggccttcggcctttttaatattgtgtag

SEQ ID NO: 188878 - DNA, 1899 bp, Artificial Sequence
  Description of Artificial Sequence: Synthetic coding sequence
atgggcatccggggcatgctgcgggccgccgtgatcctgctgctgataagaacctggttagcagaaggtaactacccttctccaataccaaagttccattttgagtttagctccgctgtccctgaggttgtgctgaacctgtttaactgtaaaaattgtgcaaatgaagctgtcgtgcagaaaatcctcgatcgtgttcttagccgttatgatgtgcgacttaggccaaattttggaggagctcctgttcctgtacgaatcagtatctacgtaactagtatcgaacaaatctcagaaatgaatatggactatacgattaccatgttctttcaccaaacgtggaaagatagtcgtctcgcctattacgagactactctgaacctcaccctggactacagaatgcacgagaaactgtgggtgcctgactgttactttcttaattccaaggatgccttcgtgcacgacgttacagttgaaaacagagtattccagttacacccggatgggaccgtgcgctacggtatacggctgacaaccacagccgcatgctccctcgatctccacaagtttcctatggacaagcaggcctgtaatctggtggtggagagttatgggtacaccgtcgaggatatcatactgttttgggatgataacgggaatgcaatccacatgacagaagaactgcatatcccacagtttacttttttaggcagaaccattaccagtaaagaagtgtacttctataccggaagctacattcgcctaatcctcaaattccaagtgcagcgagaggttaattcataccttgtgcaggtttactggccaactgtgctcaccactatcacgagctggatcagcttctggatgaattatgacagttcagccgctagagtcactatcgggcttacgtccatgctcatcctcaccacaatcgacagtcacctgagagataagttgcctaatatcagctgcatcaaggcaatcgatatctatatcctggtctgtctattctttgtgttcctgagtctgcttgaatatgtctatattaattatttattctactctcggggccccaggcgacaaccacgtcgccaccggagacctcgcagggtcatcgctagatacagataccaacaggtagtcgtcggcaacgtgcaagatggtttgatcaatgtggaggacggggtgtcttccttgcctatcacgcccgcacaggctcccctggcctcaccagagtccttggggtcactgacaagcaccagtgagcaggcacaactggccacttccgaaagcctctcccctctgacctctttgtcagggcaggcgccgctggccacaggcgaatccctttccgatctgccaagcacgagcgaacaggcacgccatagttatggggtgcgatttaacggctttcaggccgacgactccatcttccccacagagattagaaatagggtcgaggctcacggtcatggtgtgacccatgaccacgaggactccaatgaatctctgagcagcgatgaaagacatgggcatgggccctccggtaagcctatgctgcaccatggagaaaaaggtgtacaggaggcaggttgggatctcgatgacaataacgataagagcgactgcctggccattaaggaacaattcaaatgtgacactaattctacctggggactcaacgacgacgaactcatggcccacggacaagagaaggactcctccagcgagtccgaggattcctgcccacccagcccaggatgtagctttaccgaaggcttctcattcgatctctttaatcccgactacgtgcccaaggtggacaagtggtctagattcctgtttcccttagctttcggtctctttaatatcgtgtattgggtgtaccacatgtattag

SEQ ID NO: 188879 - DNA, 1083 bp, Artificial Sequence
  Description of Artificial Sequence: Synthetic coding sequence
atggacagcagcaactgcaaggtgatcgcccccctgctgagccagaggtaccgccgaatggtgactaaagacgggcatagtacgctgcagatggacggcgcccagagggggcttgcttatttgagggacgcttggggtatccttatggatatgcgctggagatggatgatgcttgtctttagcgcttctttcgtggtccactggttggtgttcgctgtgctctggtacgtcctggccgaaatgaatggagatctcgagctggaccacgacgccccgcctgaaaaccatacgatttgcgtcaagtacatcactagtttcaccgcggctttctcattcagcctcgaaactcagttgaccattgggtacggaaccatgttcccatcgggcgattgtccctctgcaattgcactgctagctatccagatgctgctgggactgatgctcgaagctttcatcactggtgctttcgtggctaagattgcacgtcctaagaaccgcgcattcagcataaggttcacagacaccgccgttgtcgcacatatggacgggaagccaaatctgatattccaggtggcaaacacccgcccctcccctctgacatctgttcgggttagcgccgtgttgtaccaggagcgtgagaacgggaaactctaccaaacctccgttgatttccatctggatggcatcagcagcgacgaatgccctttttttattttcccactgacatactaccacagtatcacgcctagctctccgttggccaccctccttcagcatgagaatcctagccactttgagctggtggtttttctatccgctatgcaggagggaacgggcgagatttgccagaggcgcacctcctacttgccgtccgagatcatgctgcaccactgctttgcttcactgctcaccaggggctcaaaaggggaataccaaattaaaatggaaaatttcgacaagaccgtcccggaattcccaacacccctcgtttctaagtctccaaatcgcaccgacttagacattcacattaacggacagtcaatcgataacttccaaatatctgaaaccggcctaactgagtag

SEQ ID NO: 188880 - DNA, 2106 bp, Artificial Sequence
  Description of Artificial Sequence: Synthetic coding sequence
atggccgtgagcgccggcagcgcccggaccagccccagcagcggctttcttatggtcctagacattccacaggaacgcggccttagcagtctggacagaaagtacctcgatggcctggacgtgtgccgtttccctctcctcgatgctctgaggccgctacccctggattggatgtacctcgtttacaccatcatgttcctgggtgctctgggaatgatgctgggcctgtgctacaggatcagttgtgttctgttcctgctgccctactggtatgtcttcctgttagataaaacctcatggaataatcactcttatctgtacgggttactggccttccagcttacctttatggacgccaatcactactggagcgttgacgggcttctgaatgctcaccggcgcaacgctcacgtgccgttatggaattatgcggtgttacgtggccaaattttcatcgtgtactttattgcaggcgtgaagaagctggacgccgactgggttgaggggtacagcatggagtatttatccagacactggctcttttcacccttcaaactgcttcttagtgaggagcttacatctctcttagttgtacactgggggggtttactgctggacctctccgccgggttcctgttgtttttcgatgtgtctagaagcatcggcctgttctttgtgtcctatttccattgtatgaactcgcaattattctccataggaatgttctcttatgtcatgttggcatcaagccccctcttttgctcccctgagtggcctagaaagttggtaagctactgccctagacgattacagcagctgcttccactcaaagcagcccctcaacccagcgtgagctgtgtgtacaaaaggagccgcggaaaatctggccagaaacctggccttcgtcatcagttaggtgccgcgtttactttgctctacttgctcgaacaactgttcctgccctacagtcattttctgacccaggggtacaacaattggacaaacggcctgtacggatatagttgggatatgatggtgcactcacggagtcatcagcacgtcaaaatcacctacagagatggccggaccggcgagctgggatacctgaacccaggagtctttacacagtcacggaggtggaaagaccatgctgacatgctgaagcagtatgccacctgtttgtccagactgttgccaaaatacaatgttaccgagcctcagatttattttgatatttgggtgtcaatcaatgataggtttcagcagaggatattcgatcctagagtagacatagtacaagctgcatggagcccatttcaacgcacttcctgggtacagccccttttgatggacctgtctccctggagggcaaagttacaagagatcaaatcgagccttgacaaccacacagaggtggtcttcatagcagattttcccggcctacacctggaaaacttcgtgtctgaagatctcggaaacacaagcattcagctactccagggggaggtaactgtcgaacttgttgcagagcagaagaatcagaccctaagggaaggggagaagatgcagctgcccgcaggggagtaccacaaggtatacaccacatctccgtctccctcctgctatatgtatgtgtacgttaacaccactgaactcgccctggagcaggatttggcatacctacaggagctgaaggagaaggtagaaaacgggagcgagaccggcccactgcctcccgaattacaacctctgctcgaaggagaagtcaaaggcggccccgagcccactcctcttgtgcaaaccttcctgcgacgacagcaacggttgcaggagattgaacgaagaaggaatacgcccttccatgagcgtttcttccgatttctgttaagaaagctgtacgtctttcggaggtccttcctgatgacctgtattagtctgcgcaatttgatcctcggccgaccatcgttggaacagctagctcaagaggtcacatacgcaaacctacggcctttcgaggctgtaggagagctcaatccctcaaacaccgacagctcccacagtaatccccccgagtcaaatccggaccccgtgcatagcgagttctag

SEQ ID NO: 188881 - DNA, 957 bp, Artificial Sequence
  Description of Artificial Sequence: Synthetic coding sequence
atggccagccccggctgcctgctgtgcgtgctgggcctgctgctgtgtggcgctgcatcactcgagttgtcacgccctcatggagatacagcgaagaagcccattattggcatactcatgcagaagtgcagaaacaaggtgatgaaaaactatggtcgctactatatcgccgcaagctatgtgaagtacctcgagagcgctggtgcccgcgtggtacccgtgaggcttgatcttacagagaaggattatgagattctcttcaagtcgatcaacgggatactgttccctggagggtcggtggatttgcggcgatcagactatgcgaaagtagcgaaaattttctataatctgtccattcaatccttcgatgatggcgactatttcccagtatggggtacctgtttaggcttcgaagagctctcattgctgatttctggagaatgtttgttaacagccactgatactgtcgatgtcgcgatgccccttaattttaccggcggccagctccacagccgaatgtttcagaacttccccacagaactattgctgtccctagccgttgaaccactgacagccaactttcataagtggtctctgtctgttaaaaatttcacaatgaacgaaaagctcaaaaaattcttcaacgttttgaccactaacacagacggcaagatcgagttcatatcaactatggagggttataaataccccgtgtatggtgtgcaatggcatccggagaaggctccttatgagtggaagaacctagatggcatcagtcacgctcctaatgcagtgaaaactgccttctacttggccgagtttttcgtgaacgaggccaggaagaataatcaccatttcaaaagtgaaagtgaggaggagaaagccttgatctatcagttttcgcccatctatactggaaacatctcgtcattccagcagtgttatatctttgactag

SEQ ID NO: 188882 - DNA, 345 bp, Artificial Sequence
  Description of Artificial Sequence: Synthetic coding sequence
atggccaacagcggctgcaaggacgtgaccggccccgacgaggagtcctttctgtactttgcgtatggcagtaatctattgacagagcgcatccatctacggaatccgtccgccgccttcttctgtgtagctagacttcaagattttaagttagattttggcaacagccaaggcaaaactagtcagacctggcacggcggaatcgcaaccattttccagtctcctggagatgaggtctggggcgtcgtgtggaagatgaacaagtctaacttgaatagcctggatgaactctttgcttgggtgcagaaaaaaatggtgtgcaggtggtccatcaagagaagctag

SEQ ID NO: 188883 - DNA, 567 bp, Artificial Sequence
  Description of Artificial Sequence: Synthetic coding sequence
atggccaacagcggctgcaaggacgtgaccggccccgacgaggagagctttctgtacttcgcctacggttctaatctcctcacagaacgaattcacctgaggaatcctagcgcagcctttttttgcgtcgctcgcctgcaagatttcaagcttgattttggaaactctcaggggaagacaagtcaaacctggcacggtggaattgcaacaatattccagagcccaggggatgaggtgtggggcgtggtctggaaaatgaataagagtaatctgaattcacttgacgaacaggaaggcgtgaaaagcgggatgtacgtcgtgattgaagttaaggtcgccacccaggaggggaaagagataacctgccgatcctatctgatgacaaattacgaatccgcgccccccagcccacagtacaagaaaattatctgtatgggggctaaagagaatggcttgcctctggagtatcaggaaaagctcaaggcgattgagcccaacgattataccggcaaggtgtctgaagaaattgaagatattattaagaaaggagagacccagactctttag

SEQ ID NO: 188884 - DNA, 384 bp, Artificial Sequence
  Description of Artificial Sequence: Synthetic coding sequence
atgttcaaccccatccaccacctggactactacaagaagaccctgccctcagagttgaattggctcggccagatgtggttgaagtttgggtgttcgggctttaggcaggagggtgtgaagagtgggatgtacgttgtcattgaagttaaagtggcaactcaggaaggcaaagagatcacatgtcgctcctacctgatgacaaattatgagtccgcacccccttccccacagtacaagaagataatttgcatgggagctaaggaaaacggcctgccactggaataccaggagaaactcaaagccattgaacccaacgactacacaggaaaggtatcagaagagatcgaggacattattaaaaaaggcgagacccagaccctgtag

SEQ ID NO: 188885 - DNA, 285 bp, Artificial Sequence
  Description of Artificial Sequence: Synthetic coding sequence
atggccaacagcggctgcaaggacgtgaccggccccgacgaggagagtttcctttacttcgcctacggaagtaatctcttaacagagcgcatccatctgcggaatccatccgccgctttcttttgtgtggcgcgcctacagataatctgtatgggtgccaaagaaaacggcctacccctcgaataccaggagaaactgaaagccatcgaacccaacgactatactggtaaagtgtcagaggagatcgaggacattataaagaagggagagacccaaacactttag

SEQ ID NO: 188886 - DNA, 501 bp, Artificial Sequence
  Description of Artificial Sequence: Synthetic coding sequence
atggccaacagcggctgcaaggacgtgaccggccccgacgaggagtcctttctctacttcgcgtatggaagtaatctgttgacagaacgaattcatctgagaaacccaagtgccgctttcttttgcgtcgcacgtctgcaggactttaaacttgactttgggaatagccagggcaagacgtcccaaacttggcatggaggaattgccacgatctttcagtctcctggagatgaagtgtggggggttgtgtggaagatgaataaaagtaacctgaattccctagacgaatggcgtaaaaaaagacacactgccttccaaaatcaaggcaatcatccatgcaagcataagacgcggatgtgggatagagaccccaagatacccgtgcaaaatctgtcattggccctatgttggcaagcccagtcgggccacgggacctgtaaccgcctgttcgcttgggtgcagaaaaaaatggtctgcaggtggagcatcaaacgcagttag

SEQ ID NO: 188887 - DNA, 1710 bp, Artificial Sequence
  Description of Artificial Sequence: Synthetic coding sequence
atgaagaagaagctggtggtgctgggcctgctggccgtggtgctggtactggtaattgttggactctgtctgtggttaccctcagcgagcaaggagccagacaatcacgtatacactcgagccgccgtcgccgctgatgccaaacaatgcagcaagatcgggagggacgccctccgagacggggggagcgctgtggacgccgccattgccgcattgctctgcgttggcctaatgaacgctcactctatgggcattggcggtggactgttcctgacgatctacaactcgactacacgcaaggccgaggtcatcaacgctagagaagttgcgcctcggctcgctttcgcaaccatgtttaactcctctgagcaatcccaaaagggtggcctgtcagtcgccgtcccaggggaaataaggggctacgagttggcccatcagagacacggccgcctgccttgggccagactgttccagcccagtatccaattagccagacaaggatttccagttggaaagggtcttgctgccgcattagaaaataaaaggaccgtgattgagcaacagcccgtcctgtgcgaggtcttttgcagggataggaaggtgctgagggagggagaacgcctgaccctcccacagctggccgacacgtacgaaactctagccatagagggcgctcaggctttttacaacggctcacttactgcacagatcgtgaaggatatacaggcagccggaggaattgtcactgcggaggacttgaataactatcgtgctgaactcatcgagcatccattgaatatctcacttggggacgtagtgttatatatgccctcggctccattaagcgggcctgtgcttgcgcttatcttgaacattctgaaggggtataacttttccagggagagtgtcgagagtcccgagcaaaagggactgacctatcacagaattgttgaagcttttcgcttcgcctatgctaaaaggacactgctgggagatcctaagtttgtcgacgtgaccgaggtcgtgcgtaatatgacttccgagttcttcgcagcccagctccgggcacaaatcagcgatgataccacacacccaattagctattacaagccagagttctatacccctgacgacggcggcacagcccacttaagtgtcgttgcagaggatggaagcgctgtatccgctaccagtacaataaacctttactttgggtcaaaggttagatctcctgtgagtggaatacttttcaataatgaaatggacgactttagctccccctccataacgaatgagttcggtgtccctccatcacctgcgaacttcatccaacctggcaagcagcccctctcaagtatgtgccccaccatcatggtggggcaggacggtcaggtccggatggttgtgggggcagctggtggaacccagatcactaccgcaacagcacttgccatcatctataacctttggttcggctatgatgtcaagagggcggtggaggaacctcgcctacataaccagcttctgccaaacgtaaccactgtcgaacggaatatcgatcaggccgtaacagctgcactggagacacgccaccaccatacccagattgcttctacctttattgcggtggtacaggccatagttcgcaccgctggtgggtgggctgcggcgtctgacagcaggaagggaggtgagcctgctggttattag

SEQ ID NO: 188888 - DNA, 1710 bp, Artificial Sequence
  Description of Artificial Sequence: Synthetic coding sequence
atgaagaagaagctggtggtgctgggcctgctggccgtggtgctggtacttgttatcgtaggattatgcctatggctgccatcagcgagcaaggaacccgacaatcacgtctacactcgagccgcagtggcagctgacgctaagcagtgctccaagatcggcagggacgccctgcgagacggcggatcagccgttgacgccgcaattgcagccctgctgtgcgtaggcctgatgaacgctcacagtatgggcatcggaggtggcctcttcctgacgatttataactctaccacaaggaaggcagaagtgatcaacgcccgcgaagtagccccccggctcgcatttgctacaatgttcaacagttctgagcagtcccagaaggggggcctctccgtagctgtgccaggggaaatcagggggtatgagttggcacaccagaggcatgggcggctcccttgggccagactgttccaaccatcaattcagctagccagacaaggatttccagtcggaaaggggctggctgcagctctcgaaaacaaaagaacagtgattgaacagcaacccgtgttgtgcgaagtgttttgtcgagataggaaagtgttgcgggagggtgagcgcctcacactccctcagctggcagatacctacgaaaccttggcgattgaaggtgcccaggctttctacaacggatccttgactgcccagatcgtgaaagatatccaggctgctgggggaatagtgacggctgaggacctgaataattaccgagcagagttgatcgagcacccactcaacatatcacttggcgatgtggtgttgtatatgccatctgcccctctgagcggacccgtgcttgctctgattctgaatattctgaaaggttacaactttagtcgcgaaagcgtagagtcccctgagcagaagggattaacctaccacagaatcgtggaagcttttcgctttgcatatgcaaaaaggaccttgctgggagatcccaaatttgtagatgttactgaggtcgtaaggaatatgactagcgaattttttgctgctcagctacgggcacaaatcagcgacgacactactcatccaattagttactacaaaccggagttttacaccccagacgatggcgggaccgctcacctcagcgtggtcgcggaggatgggtccgccgttagtgctacaagtacaatcaacctgtattttggtagtaaggtccgctcccccgtatctgggatactgtttaataacgagatggacgacttctcatctccgtctatcacaaatgaattcggtgttcctccctcccctgccaactttattcagcccggaaaacaacccttgagtagcatgtgtcctacaatcatggtgggccaagatgggcaggtgcgcatggtggtcggtgccgccggcggaacccagattacaactgccactgccctcgcgatcatctacaatctatggttcggctatgacgtcaaacgagccgtagaagagccacgactacacaatcagctgctgccaaatgtgactaccgtggagagaaacattgaccaagccgtgacagccgctctggaaacccgccaccaccatactcaaatagcaagtacttttattgctgtggtccaggcaattgtgagaactgcaggtggatgggcagccgcaagcgactcaagaaaggggggggagcctgccgggtattag

SEQ ID NO: 188889 - DNA, 1710 bp, Artificial Sequence
  Description of Artificial Sequence: Synthetic coding sequence
atgaagaagaagctggtggtgctgggcctgctggccgtggtgctggtgctcgttattgtgggtctgtgtctgtggctcccgagtgcaagcaaggagcccgacaatcacgtgtatacacgtgccgctgtggctgccgatgctaaacagtgctcaaagatcggcagagatgccttgcgcgacggtggtagtgccgttgacgctgctatcgcagcattgctgtgcgttggtctcatgaacgcacattcgatgggcattggaggcggactgttcttgaccatatacaactcaactaccagaaaggcagaagtcataaacgcccgagaagtggccccacgcctagcctttgctaccatgttcaactcatcagagcagagccagaagggcggcctgtctgtggctgtgccaggagagatacggggctatgagctggctcatcagcgacatgggcggctgccctgggcgagactgttccagccaagtatacagctggcacgccagggttttcctgttggaaaagggctcgctgccgccttggagaataagcggacagtgatcgaacagcaacccgttctctgtgaggtcttctgcagggacagaaaggtgttgagggagggtgaaaggctcacgctccctcagctcgctgacacctacgagacactcgcaatcgagggcgctcaggcattctacaacggctccctcactgcacagattgtcaaggacatacaggccgccggcggtatcgttacggctgaggacctgaacaattaccgcgccgagctcattgaacatccacttaacatttcgttgggcgacgttgtgctgtatatgccatccgctccccttagtggacccgtgctggcactcattctaaatatcctcaaaggctacaacttttcccgggagtctgtggaaagcccagagcaaaagggactgacctaccatagaatcgtggaggccttccgattcgcttatgctaagaggactctcctgggagatccaaaatttgtcgatgtgacagaggtcgtgcgcaacatgacctctgagttctttgccgcccagttgagagcccagatctccgatgacaccacccatccgatttcctactacaaacccgagttttacacacctgatgacggcgggactgcccacttaagtgtcgtcgcagaagatggatctgccgtgtccgctacatctaccatcaacttgtactttgggagcaaggtgcgcagcccggtgtcggggatcctgttcaacaatgaaatggatgatttctcaagcccttccattactaatgagttcggcgtacccccgtcccctgccaacttcatccagcctgggaaacaaccgctttcttcgatgtgccccactataatggtgggccaagacgggcaggttcggatggtggttggagcagcaggcgggacgcaaatcacaactgcaacggctttggctattatctacaacctgtggttcggatatgacgtgaaacgcgcagtcgaagaacctaggctccacaaccagcttcttccaaatgtgacaactgtagagagaaatatcgaccaggcggtgacagccgcactcgagactaggcaccaccatacacagatcgccagcactttcattgctgtggtgcaagccatagtgcgcaccgccggtggatgggccgccgcaagtgactcccggaagggtggcgaaccagccggttattag

SEQ ID NO: 188890 - DNA, 1710 bp, Artificial Sequence
  Description of Artificial Sequence: Synthetic coding sequence
atgaagaagaagctggtggtgctgggcctgctggccgtggtgctggtactcgtaatcgttggtctttgcctttggctgccctcagcatcgaaggaacctgataaccacgtttacacccgagccgccgttgcagccgacgcaaagcaatgtagtaagattggacgggatgcattgcgagatggaggatccgcagtcgatgctgccattgcggccctcctgtgcgtcggcctcatgaacgcccacagtatggggatcggcggcgggctcttccttacgatctacaattcaactacccgcaaagccgaagtgatcaatgcgcgcgaggtggctccccggttagcctttgcaaccatgttcaactctagtgaacagtctcagaaagggggtctgtcagtggccgttccaggcgagatcaggggctatgaattggcccaccaacgacacgggagactgccctgggccaggctgtttcagccctccatccagctggcaagacaaggctttcccgtaggtaaagggctggctgcggccctcgaaaacaagcggacggtaatagaacaacagcctgttctgtgcgaagtattctgccgagataggaaggtgctccgagaaggcgaacggttgacactgccgcaattggccgacacttacgaaactctagccattgaaggggcccaggcattctataacggtagcctcacagcacaaatcgtgaaggacattcaggctgctggggggatagtgacggcagaggacctgaacaactaccgagcagaactgatcgagcatcctttaaatatcagtctgggcgacgtggtgctatacatgccttctgctccattgtccggccccgtcctggccctgatccttaacatcctaaaagggtataacttcagcagagagtcagtggaatcacccgagcagaagggactgacttatcatcgaatcgtcgaggccttccggtttgcttatgccaagcggaccctcctcggcgatccaaaattcgtagacgtgacagaagtcgtccgcaacatgacctctgagttttttgctgctcagcttcgcgcccaaatctcagacgatactacgcatccaatctcatactataagcccgaattttatacccctgatgatggtggtaccgcacatctgtctgttgtcgctgaggatggatcggctgtatctgcgacctcaaccatcaatctctactttggttcaaaagtgcgatcgcccgtgtccggtatcctgtttaataatgaaatggacgacttctccagcccaagcattacgaacgaatttggcgtcccacccagcccagctaactttatccagccaggaaaacaacctctgtccagtatgtgccctaccattatggtcggacaggatggccaagtcagaatggtggtcggggccgctggtgggacgcagataaccacagcgacagctctggcgatcatctataatctttggtttggctatgacgtgaaaagagcggtggaggaaccccgtttgcacaaccaacttttgccgaatgttaccaccgtagaacgcaacatcgaccaggccgtcaccgccgcgttagaaacaaggcaccaccacacccagattgcaagcacttttattgcagtggtacaggccatcgtccgcaccgcaggggggtgggcggctgctagcgactcgcgcaagggcggtgaacctgccggatactag

SEQ ID NO: 188891 - DNA, 678 bp, Artificial Sequence
  Description of Artificial Sequence: Synthetic coding sequence
atgaccagcgagttcttcgccgcccagctgcgggcccagatcagcgacgacacaactcatcccatctcctactataaacccgagttctacacccccgatgacggggggacagctcacctaagcgtggtcgcggaggatggttccgccgtctcagctaccagcactattaacctttatttcgggtcaaaggttcgcagtccagtgtcgggaattcttttcaacaacgaaatggatgactttagtagtccttccataaccaacgaatttggcgtgcctccatctcccgccaatttcattcagcccgggaagcagccacttagctccatgtgcccgaccataatggtgggccaggatggacaggtccgtatggtggtgggcgcagcaggcgggacgcagattaccactgccactgctctggccatcatctacaatttgtggttcggatatgacgtgaaaagggctgttgaagagcccaggctgcacaaccagctgctgcccaatgtcaccactgtggagcggaatatcgaccaagcggtaaccgccgctctggagacacgccaccatcatacccagatcgcctctaccttcattgctgttgttcaggccattgtgcgcaccgcgggtggttgggccgcagcctcagacagccgtaagggcggtgagcccgcgggatattag

SEQ ID NO: 188892 - DNA, 678 bp, Artificial Sequence
  Description of Artificial Sequence: Synthetic coding sequence
atgaccagcgagttcttcgccgcccagctgcgggcccagatcagcgacgataccacccatcctatttcatactataagcccgaattttacacccctgacgatggaggaaccgcccacctatcagtggtagctgaggacggctccgccgtgtcagccacatctactattaacttgtattttgggtccaaggttagatcacccgtaagcggaatcctctttaataacgaaatggatgacttcagcagcccaagcatcacaaatgagttcggcgtccctcccagcccagcgaattttatccagcctggcaagcaaccactgtcctcaatgtgcccaactatcatggtgggacaggacggtcaggttcgtatggtggttggagctgccggcggcacccagattacgaccgccacagctctggccatcatatacaatctctggtttgggtacgatgtcaagcgggctgtcgaggaaccaaggctgcataatcaactgttaccaaacgtgactacagtggaaaggaatattgatcaagctgtgacagcagccttggaaacaaggcaccaccacacgcaaatcgcctccacgttcatcgccgtggtccaggctatcgtgcggactgctggcggttgggccgccgcatctgattctagaaaagggggagaaccagccggatactag

SEQ ID NO: 188893 - DNA, 678 bp, Artificial Sequence
  Description of Artificial Sequence: Synthetic coding sequence
atgaccagcgagttcttcgccgcccagctgcgggcccagatcagcgatgacaccacgcaccccatttcgtattacaaacccgaattctacacacccgatgacgggggcactgcacatttgtccgtggtcgctgaggatggttccgcggtaagcgctacgagtaccattaacctatattttggatccaaggttcgatcccccgtcagcgggattctgtttaacaatgagatggacgacttctcctcacctagcatcacaaacgagttcggtgtcccaccatcccctgccaacttcatccaacccggcaagcaaccactgtcgtcaatgtgcccgacaatcatggttgggcaggatggccaggtgcggatggttgtcggagcagccggtggtacacaaattacaaccgcaaccgctctggctatcatctacaacctgtggtttggctacgacgtcaaacgggccgtagaagagccccgtctccataaccaactcctgccgaatgtgaccaccgtggaacggaatatcgatcaggccgttacagcagccctggagacccgacaccaccatacacagattgcgagcacttttatcgctgtagtgcaggcgattgtgaggacagccggcggatgggctgccgcatctgactctcggaaggggggcgaaccggctggctactag

SEQ ID NO: 188894 - DNA, 1710 bp, Artificial Sequence
  Description of Artificial Sequence: Synthetic coding sequence
atgaagaagaagctggtggtgctgggcctgctggccgtggtgctggtcttggttatcgtgggcctctgtctctggctcccaagtgcatcgaaggagcccgacaaccacgtatatacccgcgctgctgtggctgccgacgccaaacagtgtagtaagatcggtcgggacgccttgagggacggaggctctgcggtggacgctgcaattgccgcactgctctgtgtcggtttgatgaacgcccattcgatgggtatcggcgggggcttgttcctgactatttacaatagtacgacaaggaaagctgaagttatcaacgcccgcgaagtggcccccagactcgcctttgcaactatgttcaactcttccgagcagagccagaaagggggcttgtctgtagctgtgcctggggagatacggggatatgagctcgcccaccaacggcatggccggctgccctgggcgcggttgttccaacccagtatccagctcgccagacaggggtttcctgtgggaaaaggcctggctgccgctctcgagaacaagcgaaccgtaatcgagcaacagccagtgctctgcgaggtgttctgtcgggataggaaagttctgcgagaaggagaaaggctcactcttccccaactcgccgacacatatgaaacattggccattgaaggtgcccaggccttctacaacggcagtcttacagctcaaatagttaaggatattcaagctgctggtggcatcgtgaccgcagaggacctgaacaattatcgcgcagaactgatcgaacacccgctcaacattagtctcggcgacgtggtgctgtacatgccttctgctcccctgagtggccccgtcctggctttaatcctgaatattttgaaaggctataatttcagccgcgagtccgttgagtctccagagcaaaaagggctgacttaccatcgcatagtggaagcctttaggttcgcctacgccaaacggacactgctgggcgatcccaagttcgtggacgtgacagaagttgtgaggaacatgacgtccgaattcttcgccgcacagttgagggcgcaaatttccgatgacacaacacaccccatctcttactataaaccagagttctacacacctgatgatggcgggactgcacatctcagtgtggtggccgaggacggaagcgccgtgagcgccacaagtaccatcaacctctatttcggatcaaaggttagatcacccgtgtcaggaattctgtttaacaacgagatggatgatttctcgagtccttctatcaccaacgaattcggtgtccccccttcacccgccaattttatccagcctgggaagcaacccctcagctcaatgtgcccgactatcatggtagggcaggatggtcaagttagaatggttgtcggggctgcaggaggcactcagatcacaacagccacagccctcgccatcatttacaacctctggtttggatatgacgtgaagagagccgttgaggaaccacgcctgcataaccagctgctgccaaacgtgaccaccgtggagcgaaatatcgaccaggctgtgaccgccgccctcgagacgaggcaccaccatacgcaaattgcatcaactttcatcgctgtcgtacaagctatagttagaacagccggaggatgggccgcagcctctgattctcgtaaggggggcgagccggccgggtactag

SEQ ID NO: 188895 - DNA, 363 bp, Artificial Sequence
  Description of Artificial Sequence: Synthetic coding sequence
atgaagaagaagctggtggtgctgggcctgctggccgtggtgctggttctcgtgatcgtcgggctctgtctctggctgccctctgcctctaaagagcccgacaatcatgtctacacaagagctgcagtggccgccgacgcaaaacagtgttcaaagatcggtcgagatgcgttaagagacgggggcagtgcagtggacgccgccatagctgccctcctttgtgtggggttaatgaatgcccattctatgggcatcgggggtgggctgtttctgacgatttacaatagtacgacacgaaaggccgaagtgattaacgctcgagaggtcgcccctcggttggcctttgcgaccatgtttaattag

SEQ ID NO: 188896 - DNA, 1392 bp, Artificial Sequence
  Description of Artificial Sequence: Synthetic coding sequence
atgaagaagaagctggtggtgctgggcctgctggccgtggtgctggtgttggtgattgtggggttatgtctctggctcccttcggccagcaaagagcctgataatcatgtgtacacccgtgcagccgtggcagcagatgcgaagcagtgctcaaagatagggcgcgacgccctcagagatggcggcagtgctgtggacgccgcaatcgcagctttactgtgcgtaggcctgatgaacgcacacagtatggggatcggcgggggtttgttcttaactatctacaatagcaccacccgaaaagccgaagtcattaacgctagagaggtagccccccggctggcttttgccaccatgttcaacagctctgagcagtctcagaaaggcggcctgtcggtggccgtgcctggggagattcgaggttatgaactcgcgcaccagaggcacggacggctgccctgggcaagattgtttcagccgtccatccaactggcccgacagggctttccggtgggaaaaggcttggctgcagctttggaaaacaagaggacagtgatcgaacaacagcccgtgctgtgtgaagtgttctgtagagaccgaaaagtgcttcgtgagggagaacgacttactttgccacagcttgcagacacatatgagaccctggctatagagggcgcgcaagctttctataatggaagtctgacagcccaaatcgtgaaggacatccaggccgccggtgggattgtgacggcggaggatctgaacaattacagagcggagctgatcgagcacccgttgaatatatctctgggtgacgtagtgctgtacatgccctccgcgcccctcagcggtcccgttctcgctcttatattaaacatacttaaagggtacaacttcagtcgggagagcgtggagtcaccagagcagaagggcctgacataccataggatcgtagaggctttccggttcgcatacgccaagagaactctgctcggcgaccccaagttcgtggacgtaactgaggtggtaagaaatatgacctctgagttcttcgccgcccaattgcgagctcaaattagcgatgacaccacacaccccatcagctattataagcccgagttttacacgccggacgacggcgggaccgcccatctttccgtcgtggcggaagacggctctgcagtctcggccacgtccacaattaacctgtacttcggaagcaaggtgaggtcccctgtcagcgggatccttttcaataacgagatggatgacttctcatccccttccatcacaaacgagttcggcgtcccgccctctccagccaatttcatccagcctgggaaacagccactgtcttcaatgtgtccaaccatcatggtgggtcaggacggttag

SEQ ID NO: 188897 - DNA, 243 bp, Artificial Sequence
  Description of Artificial Sequence: Synthetic coding sequence
atgaagaagaagctggtggtgctgggcctgctggccgtggtgctggttctggtgatcgtcgggttatgcctgtggctgccttcagccagcaaggagccggacaaccacgtatatactagagccgccgttgctgccgatgcaaagcagtgtagcaaaattggtcgcgacgcactgcgtgacggcgggagtgccgtggatgccgctattgcggccctgctgtgcgtgggtttaatgaatgcctag

SEQ ID NO: 188898 - DNA, 525 bp, Artificial Sequence
  Description of Artificial Sequence: Synthetic coding sequence
atgaagaagaagctggtggtgctgggcctgctggccgtggtgctggttctcgttatcgtggggctatgcctgtggttaccttccgctagcaaagagcctgacaaccacgtctatacccgcgcagcagtagcggccgatgctaaacaatgctcgaaaatcggacgagacgccctgagggacggcggctcggccgtggatgctgccattgctgcactcctgtgcgttgggttgatgaacgcccactccatgggcattggtggcggcctgtttctcacaatctacaactccacaaccaggaaagcagaggtgataaacgctcgcgaggtggccccccgacttgcctttgccaccatgttcaacagttcagagcaatcccagaagggaggattatccgtcgcggtcccgggcgaaatccgggggtacgagctggcgcaccaacgccacgggcgcctgccctgggcccgcctttttcaacctagcatccagctggctagacagggcttccccgttggcaagggcttatag

SEQ ID NO: 188899 - DNA, 381 bp, Artificial Sequence
  Description of Artificial Sequence: Synthetic coding sequence
atgaagaagaagctggtggtgctgggcctgctggccgtggtgctggtgctagtcattgtagggctgtgcctttggctgccaagcgcttcaaaagagcctgataaccatgtttacacgcgcgctgccgtggcagccgacgccaaacaatgcagtaagatcgggagggacgccctccgagatggaggttctgccgtggacgccgctattgccgcactgctctgcgtgggtctgatgaatgctcacagcatgggcatcggcggaggcctattcttgacaatatataactcaaccacacggaaagctgaagtgattaacgctcgagaggtcgcacccaggttggcttttgcaactatgttcaacagctccgaacagagccaatag

SEQ ID NO: 188900 - DNA, 330 bp, Artificial Sequence
  Description of Artificial Sequence: Synthetic coding sequence
atgaagaagaagctggtggtgctgggcctgctggccgtggtgctggttttggtgattgtaggactgtgtctatggctgccgtctgcgtctaaggaacccgacaatcatgtgtacacaagagctgctgtcgccgccgacgcaaagcagtgctcaaaaataggccgagatgctctgcgagacggcggctctgctgttgatgccgccattgccgcactgctatgtgttggtctgatgaacgcccacagcatggggatcggcggcggactgttcctcaccatttacaattctaccacacggaaggctgaagtgattaatgcacgggaagtgtag

SEQ ID NO: 188901 - DNA, 336 bp, Artificial Sequence
  Description of Artificial Sequence: Synthetic coding sequence
atgaagaagaagctggtggtgctgggcctgctggccgtggtgctggtactggtcatcgtcggattgtgtctctggctgccttccgcttcaaaagagcctgacaaccacgtctacaccagggctgccgtagccgccgacgccaaacaatgcagcaaaataggacgtgacgctcttagagacggaggatccgccgtggatgctgctatagcagctttgctctgcgtagggctgatgaacgcacattcaatgggaataggcgggggtctgttcttaacgatatataatagcaccacgagaaaggccgaagttattaatgctcgggaagttgcaccttag

SEQ ID NO: 188902 - DNA, 114 bp, Artificial Sequence
  Description of Artificial Sequence: Synthetic coding sequence
atgaagaagaagctggtggtgctgggcctgctggccgtggtgctggtgctcgtcattgtgggcctctgtctgtggctcccaagtgcctctaaagaacccgacaaccatgtctag

SEQ ID NO: 188903 - DNA, 207 bp, Artificial Sequence
  Description of Artificial Sequence: Synthetic coding sequence
atgaagaagaagctggtggtgctgggcctgctggccgtggtgctggtgctggtgattgtgggcctatgtctgtggctcccctcagcatctaaagaaccagacaatcatgtctacactcgggcagctgttgcagccgatgctaaacaatgcagcaagatcggccgcgacgcactacgggacggaggatccgcggtggacgccgcatag

SEQ ID NO: 188904 - DNA, 381 bp, Artificial Sequence
  Description of Artificial Sequence: Synthetic coding sequence
atgaagaagaagctggtggtgctgggcctgctggccgtggtgctggtgttggtgattgtgggactttgcctgtggctgccatctgctagcaaggagcctgacaaccacgtctatactagggccgccgtagctgctgatgcaaaacagtgctcaaagattggtcgcgacgctctgcgcgacgggggctccgctgttgacgctgccatcgccgccctgctttgtgtaggccttatgaacgcccactctatggggatcggcggtgggttgtttttaaccatttataacagcaccactcgaaaagctgaggtgattaacgcacgggaagtggcccccagacttgcgttcgccaccatgtttaattcctccgaacaatcacaatag

SEQ ID NO: 188905 - DNA, 351 bp, Artificial Sequence
  Description of Artificial Sequence: Synthetic coding sequence
atgaagaagaagctggtggtgctgggcctgctggccgtggtgctggttttggtgattgtaggactctgtctctggttgccaagcgcgagtaaggagccggataatcacgtgtatactagagctgcggtagcagccgatgcaaagcagtgttctaagatcggtagggatgctttgcgggatgggggaagtgcagtggatgctgccatcgcggcgctcctgtgtgtgggcctgatgaatgctcatagtatggggattggcggcggactgtttctcactatatacaactctacaacaaggaaggcggaggtcataaacgcccgcgaagtagcccctcgactcgccttcgcctag

SEQ ID NO: 188906 - DNA, 384 bp, Artificial Sequence
  Description of Artificial Sequence: Synthetic coding sequence
atgaagaagaagctggtggtgctgggcctgctggccgtggtgctggtgctggtgattgtgggcctttgcctgtggttgccatcggcttctaaagagcccgacaatcacgtgtatactagagcagccgtggcggctgacgccaaacagtgttccaaaattggccgggacgcgctgcgggacggcggctctgcagtggatgcagctatagctgcccttttatgtgttggcctcatgaatgcccactccatgggcatcgggggcggtttgttccttactatctacaattccactaccaggaaagctgaggttattaatgcccgcgaagtggcccctaggctagcattcgcaaccatgtttaacagctccgagcagtcgcaaaaatag

SEQ ID NO: 188907 - DNA, 297 bp, Artificial Sequence
  Description of Artificial Sequence: Synthetic coding sequence
atgaagaagaagctggtggtgctgggcctgctggccgtggtgctggtgttggtcattgttggactgtgtctgtggttgccctcagcgtccaaagaacctgataatcatgtctatacgcgtgctgctgtcgctgctgatgctaagcagtgcagtaagattggtcgggacgctctaagagatggtggatctgctgttgatgctgcgattgcggcattactgtgcgtggggctgatgaatgcacatagcatgggtattgggggcggcctgttccttactatctataactctacaacatag

SEQ ID NO: 188908 - DNA, 93 bp, Artificial Sequence
  Description of Artificial Sequence: Synthetic coding sequence
atgaagaagaagctggtggtgctgggcctgctggccgtggtgctggtgctcgtgatcgtgggattgtgtttgtggttgccgtccgcatcatag

SEQ ID NO: 188909 - DNA, 1710 bp, Artificial Sequence
  Description of Artificial Sequence: Synthetic coding sequence
atgaagaagaagctggtggtgctgggcctgctggccgtggtgctggtgctggtgatagtaggcctttgtttgtggctgccgtcggcatctaaggagcctgataaccacgtgtataccagagcagccatggctgctgatgcgaagcaatgcctggagattggacgggacactctgagggacggcggaagcgccgtggacgcggctatagcggcccttctgtgtgttggtctcatgaacgcccatagtatgggcattggagtcggtttattcctcactatatataatagcacaaccaggaaggcagaggtcattaacgccagggaagtcgctccaaggctcgcgtttgcctctatgtttaattcctccgagcagtcacaaaagggtggacttagcgtagctgtaccaggagaaattcggggctacgagcttgcacaccagcgacacggacgccttccttgggcccgcctcttccagcctagcatacagcttgcaaggcagggttttcctgtgggaaaggggctagcagccgtcctggaaaacaaacgtacggtgatcgaacagcagcctgttctgtggtatgtcttttgcagagatcggaaagttctgagagaaggggagcgactgacacttcccaggctagcggacacatacgaaatgttagccattgagggagcccaggcgttctataatggctctcttatggctcagattgtcaaagacatccaagccgcaggcggcattgtgaccgccgaggacctgaacaattatcgggcggagcttattgaacatcctttgaatatttcactgggggacgccgtcctgtatatgccctcagccaggctttcaggtcctgttctggccctcattctcaacattctaaagggttacaacttcagcagagaaagcgttgagacccctgaacagaagggtctaacataccatagaattgtggaagcctttcgcttcgcatacgctaaaagaacactactgggggaccctaagtttgtggatgtaaccgaggtggtcaggaacatgacttcagagttcttcgctgcccagctgagaagccagatcagtgaccacacaactcatcctattagctattacaaacctgagttctacacaccagacgacggaggtaccgctcacctgtctgttgtggcagaggatggatctgctgtgtcggccacatccacgatcaacctctacttcggaagcaaagtgtgttctcccgtgagcggcattttgttcaacaacgagtggactacatccgcccttccagcattcaccaatgagttcggcgcaccaccttctcctgctaacttcattcaaccgggcaagcagcctctgttatccatgtgcctcacaattatggtcggccaggacgggcaggttcgcatggtcgttggggccgctggggggacacagataaccacagatactgccctcgccataatttataatctctggttcggttacgacgtgaaacgggcagtggaagaaccccgtctgcataacaaacttctccccaatgtcaccacagttgagcgcaacatcgaccaggctgttactgccgcgttggagactcgacaccaccatacacagatcgcttcaacctttatcgcggtggtgcaggcaattgttcgcactgcaggcggatgggcagcggccagtgattcccggaagggtggcgaacctgcaggctactag

SEQ ID NO: 188910 - DNA, 1680 bp, Artificial Sequence
  Description of Artificial Sequence: Synthetic coding sequence
atgaagaagaagctggtggtgctgggcctgctggccgtggtgctggtccttgtgatcgtagggctctgtttgtggctgccatcagctagcaaggaacctgacaaccatgtgtacacacgggcagccatggctgcagacgccaagcagtgcctcgagatcggacgtgatactctccgagacggagggtccgctgtcgacgccgctattgcggccctactgtgtgttggcttgatgaatgcacatagtatgggcattggggtagggttgtttctgacgatttacaatagcaccacgcgaaaggcggaagtgattaacgcccgcgaggtggctcccagactggctttcgccagcatgttcaattcctccgaacagagccagaagggcggcctcagtgtggctgtacctggagagattagaggctacgaactggcacatcagcggcacggaaggttgccgtgggcaagactattccaaccctccattcagcttgccaggcagggttttccagtgggaaaagggttggctgcagtgctggaaaacaagcgaacagttatcgaacagcagcctgtcttgtggtatgtcttttgccgcgatcggaaagtgctcagggaaggagaacgacttaccttaccacgactggctgatacctatgaaatgctagccattgagggagcacaggccttctacaacgggagcctgatggcccagatcgtgaaggacattcaagccgccggaggtatcgtgactgcagaagatctcaataattatcgagccgagttaatcgaacatccgttaaacatcagcctgggggacgcagttctgtacatgccatccgctcgcttatccggtcctgtgcttgctctgatcctcaatatattgaaggggtataatttcagccgcgagagcgtggagacgccagaacagaagggacttacttatcatagaatcgttgaggccttcaggtttgcatacgcaaagcggacccttctcggcgatcccaagttcgttgatgtaacagaagtggtccggaacatgaccagcgaattttttgctgcccagcttcgcagtcagatctctgaccatactacacaccccatctcttattacaagccagagttctatactcctgatgacggtggcaccgcccatttgtctgtggtggccgaggacgggtctgctgtctctgcgaccagtaccattaacctctacggcatactcttcaacaacgaatggactactagcgctttacccgcatttactaatgagttcggtgctccccccagcccagcaaatttcatccaaccaggtaaacaacccctgctttccatgtgtctgactatcatggtgggccaagacggacaggttagaatggttgtgggggcagctgggggtacgcagataaccacagacacagcactggcgattatttataacttatggttcggctacgatgtgaaaagagcagtggaagaaccaaggctccataacaaattgctgcctaacgtgaccacggtcgagcgaaatatcgatcaggcagtcactgccgcacttgagacaagacaccatcacacccaaattgccagcacttttattgccgtcgtacaggctatagtgcgtaccgccggcggctgggctgccgcctcagacagccgcaaaggcggtgaaccggcagggtactag

SEQ ID NO: 188911 - DNA, 1710 bp, Artificial Sequence
  Description of Artificial Sequence: Synthetic coding sequence
atgaagaagaagctggtggtgctgggcctgctggccgtggtgctggtcttggtcatcgtcgggttgtgtctgtggctgccttccgctagcaaagagccagataaccacgtctacacacgtgcagcaatggcagctgatgccaagcagtgcttagagatcgggagggatacacttagagatggcggaagtgccgtggacgccgcaatcgctgctttgctgtgtgtgggtctcatgaacgcacattctatgggcataggagttggcctatttctgactatttacaactcaaccactaggaaggcggaagtgattaacgcccgggaagtcgccccacggctcgccttcgctagtatgttcaactcttccgagcagagccaaaagggcgggctgagtgtggcggtgcctggcgagatccgtgggtacgagttagcccatcagcgtcacggccgcctcccatgggcgaggcttttccaaccatctatccaattggcgagacaagggttcccggttggaaagggactggccgccgtacttgagaacaagaggacagtaatcgagcagcagcctgttctctggtacgttttctgccgcgataggaaggttctcagggagggggagcggttgacactgcctcgtctcgcggacacatatgagatgctggcaatcgaaggggcacaggcattttacaacgggtcacttatggcccagatagtgaaggacattcaagctgctgggggtattgtgactgctgaagacctgaacaattaccgggccgaattgattgagcacccactaaacataagtctcggagatgccgtattgtacatgccttccgcaagattgtcagggcctgtgctggccctgatcctcaatattttaaaggggtacaacttttccagggaaagtgttgagacaccggaacagaagggattgacataccataggatcgtggaggcttttaggtttgcgtacgccaagcggacccttcttggtgatccaaaattcgtcgacgtcactgaagttgtgaggaatatgacttctgaattctttgccgcccagttacgctctcagatctctgatcacaccacccacccaatctcttactacaagcctgaattctacacccccgatgatggcggtacggcacacctgtccgtcgtggcagaggatggtagtgcagtctctgcaacttctactataaacctctatttcggttctaaagtttgttcccctgtgagtggtattctctttaacaatgaatggacaacttctgcgctccccgccttcaccaatgaatttggtgcccctccgagccccgccaattttattcagccagggaaacagcccctgctctcgatgtgcctcaccattatggtgggacaggacgggcaggttagaatggtagttggggccgccggcggtactcagattacaacagacacagcgcttgctattatatataacctgtggtttggatacgacgtgaaaagggcagttgaggagccccgtctgcacaataagctgctgccaaatgttactactgtggagaggaatattgaccaagccgtgaccgccgccctggaaactagacaccaccacacgcagattgcttcaaccttcatcgcggtggtccaggctatcgtgcgcaccgccggaggctgggcagcggcttccgatagtcggaaagggggcgaaccagccggatattag

SEQ ID NO: 188912 - DNA, 1665 bp, Artificial Sequence
  Description of Artificial Sequence: Synthetic coding sequence
atggcccggggctacggcgccaccgtgagcctggtgctgctgggcctgggtctggcattggccgtgatagttttagcagtggtgcttagtagacatcaggctccctgtggcccacaggcttttgcccacgccgccgtagctgccgatagtaaggtctgttccgacattggacgcgcaattctgcaacagcagggctctcctgtcgatgcgaccatcgccgccctcgtctgtacatccgtcgtcaatcctcagtccatggggttgggtggcggagtaatattcaccatatacaacgttaccactggggcccagtggatcggagtgccaggcgaattgagaggctatgctgaggctcatagacggcacggccgcctcccctgggcacagctcttccagcctacaattgctctgcttcgaggcggacacgtggttgcccctgtcctgtcgcgcttcctccacaatagcattctacgaccgagcctgcaggcctctactctaagacagctgttctttaacggaaccgagccactccggccccaagacccactcccctggcctgctctggccaccactctggagacagtagccacagaaggggtggaggtcttctacaccggaaggctgggccagatgctggttgaggacattgctaaggaggggagccagttaaccttacaagacttggccaagttccaacctgaagtcgtggacgccctggaggtacctttaggagactatacactgtactctcctccacccccggctgggggcgcgatcctgtcttttattcttaacgtgctccgtggattcaattttagcacagagtccatggctagaccggagggcagagtgaacgtgtatcatcaccttgtagaaacactcaaattcgccaagggccaaagatggcgattgggcgacccacggtcccatcctaagttgcaaaacgcatcccgggacctgctcggggaaacactcgctcagctaatcagacagcaaatcgatggccggggggaccatcagcttagccattacagtctggccgaagcctggggtcacggaacgggcaccagccatgtttccgtgctaggcgaagatggctcggccgtggccgctacgtcaacaatcaacacccccttcggagctatggtgtattctccgcgaacgggcataatcctgaataatgaattgctggacctgtgcgagcgctgtccgagggggtctgggacgaccccttccccagtctctggggatcgagtgggcggggcaccaggacgatgttggccgcccgtgcccggcgagagatccccgtcatctatggtgccaagcatacttatcaataaagcgcaggggtccaagttggtcatcggaggggcgggaggtgagctcatcatcagcgctgtggcacaggccataatgtccaaactgtggctgggattcgatttgcgggctgccatcgccgctcccattcttcacgttaattctaaagggtgtgttgaatatgaaccaaatttttcgcaggaggtgcagaggggtcttcaagacagaggacagaaccagacacagagacctttctttttgaatgtggtccaggcagtctctcaggagggtgcatgcgtgtacgcagttagtgatttgcggaagagcggggaggcagcaggctactag

SEQ ID NO: 188913 - DNA, 1761 bp, Artificial Sequence
  Description of Artificial Sequence: Synthetic coding sequence
atggcccggggctacggcgccaccgtgagcctggtgctgctgggcctgggtctggccctagcagtcatcgtgctagccgtggtgctgagcaggcatcaggccccctgtggaccccaggccttcgcccacgccgcagtggctgctgacagcaaggtgtgcagcgacattggccgggcaatcctccagcaacaagggagtccggtagacgccactattgctgctctagtctgcacttctgtggtcaatccccagtccatgggactgggcgggggagtgatttttactatctacaatgtaaccacggggaaggtggaagtcattaatgccagagagactgtccccgccagccatgccccaagtctcctggaccagtgtgctcaggctctgcccctgggaaccggagctcagtggattggagtgcccggagagctacggggatacgctgaagcccacaggcggcacggtaggctcccttgggctcagctattccagcccactatcgccctactgcgcggtgggcatgtcgtggcccccgtgttgagcagattcctgcataacagtatcctgcgcccgtccctacaggcatccacgcttcgccagctcttcttcaatggaactgagcctctgcgcccacaagaccccctgccctggcctgcgctagccacaaccctggagacagtcgcaacggagggagtggaagtgttctatacaggcagactaggccagatgctggtggaagatattgcaaaggaaggctcccagctaacgcttcaggatctcgccaagtttcagcccgaggtggtcgatgcgctcgaggtaccactcggcgactacaccctctattcacctccccccccagccggaggcgcgatcctgagctttatactaaatgtgctgcggggtttcaacttttcaaccgagtcaatggctcgccccgagggacgcgtgaatgtgtatcatcatcttgtcgaaacactcaagttcgctaagggccagagatggagactaggggatcctcgctcccacccaaagctgcagaacgcctccagggacctcctgggagagactctggcccaattgatcaggcagcaaattgacggcagaggcgaccaccagttatcccactactctctggctgaagcgtggggccacggcacaggtacctctcacgtgagcgtgctcggagaggatggttctgctgtggcagcaacatccaccattaatacccctttcggtgccatggtctactctccgcgaactggcattatcctcaataatgagctattggacctgtgcgagagatgcccgcgcggttcgggcactactccatccccagtttctggagatcgtgttgggggggctcccggtcgctgctggccacctgtacccggtgagagaagtccctcctccatggtgccgagcatcttgatcaacaaagcgcagggctccaagctcgtcatcggcggagccggtggtgaactgatcatatctgcagttgcacaggccatcatgtcgaagctgtggcttggcttcgacctccgtgccgcaatcgctgcaccgatcctgcacgtgaactccaaaggatgcgttgagtacgagcccaatttcagtcaggaagttcaaagagggttgcaagaccgaggtcaaaaccagacacagcggccattcttccttaacgtcgtgcaggccgtttctcaggagggtgcatgcgtgtatgccgtgagcgacctcagaaagagtggtgaggcagcaggatattag

SEQ ID NO: 188914 - DNA, 1764 bp, Artificial Sequence
  Description of Artificial Sequence: Synthetic coding sequence
atggcccggggctacggcgccaccgtgagcctggtgctgctgggcctcgggctggctctagccgtcatcgtcctcgctgtagtgctgtctagacaccaggccccttgcgggccccaggcctttgcccatgctgctgttgccgcagatagcaaggtctgcagcgacatcggccgggcaattctacaacaacagggaagtccagttgatgccaccatcgcagcactagtgtgcacctccgtcgtgaacccacagagtatgggcctggggggcggggtgatctttactatttataacgtaacgacaggaaaagttgaagtgataaatgcccgcgagactgtgcccgcctcccatgcaccctcacttcttgatcagtgcgctcaggcactgccgctgggcacaggggcccagtggatcggagtccctggcgaattacggggctacgcggaggcccacaggagacacggacgccttccctgggcacagctatttcagcccactattgcacttctcagggggggtcatgtcgttgccccagtgctcagccgatttctgcacaatagcattctgagacccagcctgcaggctagtactttacgtcagttgttttttaacggcaccgagcctctaaggccccaggaccctcttccctggccggcactggctacaacactggagacagttgctactgaaggcgtggaggtgttttataccggacggctcggacagatgctggtggaagacattgccaaagaaggcagccagctgacacttcaggatctggctaagtttcagcctgaggtcgtcgacgcccttgaagttcctcttggcgattacaccctatattcaccgccgccccctgctgggggcgccatcctcagtttcatcctgaatgtcctgcgcgggtttaacttcagcacagagtccatggctcggcccgagggtcgggtaaacgtttaccatcacttggtggagacattgaagttcgccaaagggcaacgctggaggctgggcgaccctcgcagccaccctaagctgcaaaacgcctcccgcgatttgctcggcgagactctggcccagctaattcggcagcaaatcgacgggaggggggatcaccaactgtcccattacagcctggcagaagcttggggacatgggactggcacgagccatgtatctgtcctgggagaggatggatctgcggtggcggccacctctaccataaataccccattcggggccatggtctatagccctcgaacaggtattatcctcaacaacgagctgctggacctgtgtgaacgttgcccaaggggcagcgggacaacaccatcacctgccgtaagcggcgacagagttggtggagcccctgggaggtgttggcctcctgtgccgggcgagagaagcccttctagtatggtgcctagcatcctgatcaacaaggctcagggtagcaaattagtaatagggggcgccgggggagagctgatcatatcagccgtcgctcaggctattatgagtaaattgtggctcggcttcgatctgcgggctgcaattgccgcgcctatcctacatgtgaactccaaggggtgtgtagagtacgaaccaaatttctcccaggaggtgcagcgaggcctacaggatagaggccaaaaccaaacacagcgccctttttttttgaatgtggtgcaggccgtgtcccaagaaggcgcttgcgtttatgccgtttcagacttacggaaaagcggcgaggcagccggctactag

SEQ ID NO: 188915 - DNA, 1533 bp, Artificial Sequence
  Description of Artificial Sequence: Synthetic coding sequence
atggcccggggctacggcgccaccgtgagcctggtgctgctgggcctgggtctggccctggccgtgattgtgctggccgtggtgcttagcagacaccaagccccctgcgggccccaggctttcgcccacgccgccgtcgcagcagatagcaaagtctgtagcgacataggcagaggaccagtggaccgaggagctagaggcgcgccttggctgtgccggggaccccctcccccatggccgcccgccctaggtgccgctgtaccggctcatcacagagctgcccctaggggagcctgcggggggccgtgtccccagccttttccagcacagcaacacccggccgcattccttgctggggttaaccccgcccttttttttaacggcacagaaccactgcgtccccaagatccattaccttggcccgcccttgcaactacattggagactgttgcaaccgaaggggttgaggttttttataccggcaggctgggccagatgttggtggaggacattgcaaaagagggctcgcagctgactctgcaggatctggctaagttccagccagaagtagtcgatgctttggaggtcccgctgggcgactacactttgtactcccctccacctcctgcaggaggagccattctttccttcatcctgaacgtgctgcgcggtttcaactttagcacggagtccatggccagacctgagggtagagtgaatgtttatcatcacttagtggagactctcaaattcgcgaagggccagaggtggcggctcggagatcctcggtcccacccgaaattacaaaatgcaagcagggatcttctcggcgaaacattggctcaacttattaggcagcagatcgacggtaggggtgaccaccaattatcacattattcgctggctgaagcctgggggcacggcaccgggacatcacacgtcagtgtcctcggagaagacggatccgctgtagccgcgacttccactattaatactccgttcggcgcaatggtgtatagtccgaggaccggcattattctgaataacgagttgctcgatttatgcgagcgctgccccaggggttccggaacaacgccaagcccagccgtcagcggtgacagggttgggggggcccctgggagatgctggccccccgtgcctggagaacgctcgccctccagcatggtgccctcaatcctgattaataaggcccaagggtcaaagctcgtgattggtggggccggcggtgagttgattattagcgctgtcgcacaggccatcatgagcaagctgtggctgggatttgatttaagggccgccatagccgctcccatccttcatgttaatagcaaaggctgcgtggagtacgaaccaaacttttcccaggaagttcaaagaggcctgcaagatagaggacagaaccagacccagcgccctttttttctgaacgtcgtgcaagccgtgagtcaggaaggtgcttgcgtgtacgccgttagcgatctaaggaagtcaggagaagcggccgggtattag

SEQ ID NO: 188916 - DNA, 1506 bp, Artificial Sequence
  Description of Artificial Sequence: Synthetic coding sequence
atgggcctgggcggcggcgtgatcttcaccatctacaacgtgaccactggaaaggttgaggtaattaatgcacgtgagaccgtgccggcctcccatgcaccgagcctcctggaccagtgtgcgcaagctctccccctcggcaccggggctcagtggatcggagtaccgggggaactcaggggttatgcagaagctcatcggagacatggccggctcccatgggcccagcttttccagccaaccatcgccctgcttagaggtggacacgtggtcgccccggtgctgtcccggttccttcataactctatcctccgcccgtctcttcaggcgtctacattaagacagctgtttttcaacggcaccgagccattaagaccccaagatcccctgccttggcctgccctcgcaaccacgctggagaccgttgcgacagaaggggtggaggttttctacactggcaggctcggtcagatgctggttgaggatatcgccaaagagggttcacagctgaccctgcaagacctcgccaagtttcagccggaagtggtagatgcgctagaggtcccgctcggagactacaccttatactcccccccgccacccgccggcggagctattttgtcgttcatcctcaacgttctgcgagggttcaactttagtactgaatccatggcccgcccggagggtcgtgtaaacgtttatcaccacctggtggagaccctcaaattcgcaaaaggtcaacgctggaggttgggagacccgcggagccatccaaagctgcagaatgctagcagggacctgctgggcgagacactcgcccagctgatacgccagcagattgatgggcggggtgaccaccaactaagtcattatagcctggctgaagcttggggacacggcactggcacaagtcacgtttccgtcctgggcgaggacgggtccgcagtggccgccacttcaactataaatacaccttttggcgctatggtctactctccacggactgggattatactgaacaacgaactgctggacttgtgtgagcggtgtcctagaggaagcggcacgacgccttcccctgttagtggagatcgagtgggtggggcccctggaagatgctggcccccggtgccgggcgagcggagcccgagttcaatggtgccttccatacttattaataaagcccagggcagtaagctggtaattggaggcgccggaggcgaacttattatctcagctgtcgctcaggcgatcatgtcaaagctatggctgggcttcgatctgagagccgccatcgcagcaccaatcctgcacgtcaactctaagggatgcgtggaatacgaacccaatttttcacaggaggtgcagcggggcctgcaagaccgcggccagaatcagacccagaggccattctttctgaatgttgtgcaagcagtcagccaggaaggcgcgtgcgtgtacgctgtatccgatctgcggaaatccggagaggccgccggttactag

SEQ ID NO: 188917 - DNA, 1386 bp, Artificial Sequence
  Description of Artificial Sequence: Synthetic coding sequence
atggagcgggccgaggagcccgtggtgtaccagaagctgctgccctgggagccgtctctggagtcagaagaagaagtggaggaggaggagacctccgaggctctggtgctgaatccccggcgccatcaggactcaagtaggaataaggctggcggactccctgggacttgggctagggtggtggccgccctcttgctgttggcagtcggctgttccctggctgtgaggcagttgcagaaccaaggccgctcgacagggtcgcttggctctgtcgcaccaccccctgggggccatagccacgggcctggagtctaccaccacggcgcaattatctccccagccggggctatgttctggggactcttccacgactcgtccagtggcaactctactgctttgaccagtggcccggctcaaactctcgctcctgggcttggccttcctgccgcactgcctacattgcatcttctgcatgctagattcggtcgactcccctggcctaggttgctagtaggcccaactactcttgcacaggagggcttcctggttgacacccctcttgctagagccctggtggccagagggactgaaggcctctgtcctttgctgtgccacgctgatggaacacctctaggagccggcgcccgggcaaccaaccctcagctggctgccgtcttgcggtctgccgcgttagcccccacgtccgacctcgcaggcgatgccctcttgagtctgttggctggggatctaggagtggaggtacccagcgccgtgcctagaccaacactggagccagcagagcaactcccagtccctcagggcatcctcttcactaccccttctcccagcgctgggcctgaacttctggctttattggaggccgccctgagaagcggggcgcctattcccgatccatgtccgcccttcctgcagacggcagtgtccccagaaagcagcgctctggctgccgtggacagttctggtagcgtcctgctgctgaccagttcactgaattgtagtttcggctccgctcacctgagtccatccacgggggtgctgctttcgaacttagtcgccaaatccacaacttcagcttgggcctgcccactgattctgagaggctcactggacgataccgaggcggatgtactcggcctggttgcctctgggacccccgatgtagctagggctatgacgcacaccttgttaagacacttggcggctagaccaccaactcaggcccagcaccaacaccagggacagcaggagcctacagaacatcccagcacgtgtggccagggaactctcctgcaagtagcggcacataccgagcacgctcatgtgagctcagtaccgcacgcttgctgcccattccagggcttttag

SEQ ID NO: 188918 - DNA, 1482 bp, Artificial Sequence
  Description of Artificial Sequence: Synthetic coding sequence
atggagcgggccgaggagcccgtggtgtaccagaagctgctgccctgggagccttcgctcgaatctgaggaggaggtggaagaggaggagacaagcgaggctctggtactgaatcctcggcgtcaccaggatagttcccgaaacaaggcgggtggcttaccaggcacctgggcccgcgtggtggcagcactgttgctgctggccgtgggctgctccctcgccgtgcgccagctgcaaaatcagggacgctccacaggctcactgggcagtgtagccccgcctcctggtggtcatagccatggtcccggcgtatatcatcacggagccattatttcccccgcaggcagagaactcctggttgcagggggaaatgtggtggatgcaggggtgggagcagcactctgtttggccgtcgtccatcctcacgctaccgggctgggagctatgttttggggtctgttccatgattccagcagtggtaattcgactgccctcacaagcggacctgcccagacgctggcacctggtctcgggctgcctgcagctctgccaacgctccatctgctccacgcacgattcgggagattaccctggcccagactgctggttggtcccacaacactcgcccaggaaggcttccttgtggatacccccctggcaagggccttagttgcaagaggtacagagggactctgcccgctactctgtcacgccgatggcactcccctcggagctggtgcgagagcgaccaatccgcaactggccgcagtactgcggtctgcagcgctcgccccaacatccgatctggcaggagatgccctgcttagtctgctagcaggggacctcggcgtcgaggtgccctccgctgtcccccggcccaccctggaacccgctgaacagctgcctgtaccccaaggcatccttttcaccaccccctcaccaagcgctggccctgaactgctggcactcctggaagccgctcttagatctggtgctccaattccagatccctgtccaccattcctgcaaacggccgtgtcaccagagtcaagtgcgctggccgccgttgatagcagcggcagcgtgctgctcctgactagcagcctgaattgcagcttcggctccgctcacctgtctccttctactggggtactgcttagtaatctggtcgccaaatcgacaacctctgcttgggcatgcccattgattctccgaggaagtcttgacgacaccgaggctgatgtgcttgggctggtggcctcaggcacaccagacgtggctagggccatgacgcatacgttgttacgccatttagccgctaggccccccacccaagctcagcatcagcaccaaggccagcaggagccaacagagcatccgtcaacctgcggccagggaacgctgttgcaagtggcggcccacactgagcacgcacacgtttccagtgtgccccacgcgtgttgtccgttccaaggattctag

SEQ ID NO: 188919 - DNA, 1038 bp, Artificial Sequence
  Description of Artificial Sequence: Synthetic coding sequence
atgttctggggcctgttccacgacagcagcagcggcaacagcaccgcccttacttcaggccctgcacaaactctcgcccccggactcggcctgccagccgccctgccaacactgcacctcctgcacgcgcgtttcggacgcctgccctggccccgtcttctcgtaggacctactacccttgctcaggaaggctttctggtggatactcccctcgctcgggccctggtagcccgcggtactgaggggctgtgtccactgctctgccacgccgatggtacccctctcggcgcaggagctcgggccacaaaccctcagctcgccgcggtgctgcgctcagctgctctggctccgacgagcgacctggccggcgatgcactgctttctctgctggccggtgacctgggtgtggaggtcccgtcagccgtgccaagacccaccctcgaacctgccgaacagctgcccgtaccccagggaatccttttcaccacccccagcccgtcagccggccctgaattactggctctgctggaagcagcactgagatcaggcgcccccatcccggacccatgcccgcccttcctgcagaccgctgtctctccagagtccagcgccctggctgcagtggactcatcgggatctgtcctgctcctgacatcaagcctgaactgttccttcggttcggctcacctatccccttccacgggggtgctcttaagtaacttggttgcaaagtccacaacgtctgcctgggcatgtccccttattctgcgaggttctctcgatgacacagaggccgacgtgctgggactggtggcgagcggtacgccagatgtggcacgggctatgactcacacacttctcaggcacttggcagcccggcctcctacgcaagcccaacaccagcaccaggggcagcaggagcccaccgagcacccctccacatgcggacagggaaccctgctgcaggtggccgcgcatacggaacacgctcacgtctcaagtgtcccacatgcatgttgcccctttcagggattctag

SEQ ID NO: 188920 - DNA, 1482 bp, Artificial Sequence
  Description of Artificial Sequence: Synthetic coding sequence
atggagcgggccgaggagcccgtggtgtaccagaagctgctgccctgggagccatctctggaaagcgaagaggaggttgaggaggaggagaccagcgaagcccttgttctcaatcctagaaggcatcaggatagctctcgcaacaaggcaggaggcctgccaggcacctgggctcgcgttgtggccgccctgctcttgctggccgtgggctgctccctagcagtccgacagttacaaaaccaagggagaagcaccgggagcctaggatcagttgcccccccacctggcgggcacagccatggtcctggtgtgtaccaccatggcgccatcattagccctgccgggcgcgagttactagttgcaggcggcaacgtcgtggatgccggggtcggcgctgccctgtgtctcgctgttgttcacccccatgccactgggctcggtgcaatgttttggggtctttttcatgactcctctagcggaaactcaacagctctcacatccggccccgcccagacactggcacctggcctggggctccctgctgccctcccgactcttcacttgttgcatgctcggtttggcaggcttccatggcctcgccttctagtcggcccgaccaccctggcacaagagggattccttgtcgacacccccctggctagggctctagtagctcgcgggaccgaaggtttgtgccccctgttatgtcacgccgacggcaccccattgggagcaggggcccgagcgacaaaccctcagctggcggcagtgctgaggagcgcagctctcgctcccacttcggatctcgccggcgacgctctactctccttgttagcaggtgacctcggcgtggaagtaccgtccgcagtgccacggcccaccctggaacctgccgaacagctgccggtacctcagggcatactattcacgacccctagcccctccgctggtcccgaactccttgccttacttgaggctgcactccggtccggagcccccattcccgatccatgcccgccattccttcagactgctgtgagccctgaatcctctgccctcgctgccgttgattcttcagggtcggtgctgctcttgacctccagcctcaactgctctttcggctctgctcatctcagcccatcaactggggtacttctcagcaacctggtggccaagtcaacgacctctgcgtgggcttgtccattgatcctgagaggctccctggacgatacggaagcagacgttctggggcttgtagcgtcaggtaccccggatgtggccagggcaatgactcacactctcttgaggcatctggcagcacggccgcccacacaggcccagcatcaacaccagggccaacaggagccaaccgaacatccttcaacctgtggtcagggtaccctgctccaggtggcagcccatacggaacatgctcatgtatcctccgtacctcatgcttgttgtccatttcagggtttttag

SEQ ID NO: 188921 - DNA, 678 bp, Artificial Sequence
  Description of Artificial Sequence: Synthetic coding sequence
atgaccagcgagttcttcagcgcccagctgcgggcccagatcagcgatgatactacccatccaataagttattataaaccagaattttacatgcccgatgacggaggtaccgctcacctgtccgtcgtcgcggaggacgggtccgccgtttccgctacatccacaattaacctttacttcggtagcaaggtcaggagccctgttagtgggatacttctgaataatgagatggatgatttttccagcacttccatcaccaacgaattcggtgtacctccatcaccggccaacttcatccaaccagggaagcaaccactgagcagtatgtgccctactattatggtcggccaggacggccaggtgcgaatggtggtcggagcagctgggggaacacagattactatggcaacagcgctcgcaattatatataacctgtggttcgggtatgacgtaaaatgggccgtcgaggagccacggcttcataatcagctgctgcccaacgttacgacggttgagagaaatatcgatcaagaggttaccgccgccttagagaccaggcaccatcatacacaaataacttccacattcattgccgttgtacaggctattgtccgtatggccggcgggtgggcggcggctagcgattccagaaagggtggggaaccggctggctactag

SEQ ID NO: 188922 - DNA, 678 bp, Artificial Sequence
  Description of Artificial Sequence: Synthetic coding sequence
atgaccagcgagttcttcagcgcccagctgcgggcccagatcagcgacgataccacccatccaatttcctattacaaacccgagttctatatgccagatgacggcggaacagctcatctttctgtcgttgccgaggatggaagtgccgtcagcgcaaccagcaccatcaatctatacttcggctccaaggtgaggtctcctgtgtcggggatccttctcaacaacgaaatggatgattttagcagcacatcaattaccaacgaattcggcgtcccgccaagccccgctaatttcattcagcctggcaaacagcctctgtcgagcatgtgcccaaccataatggtggggcaagacggccaggtcagaatggtcgtgggggctgctggtggaacccagattacgatggccacagctttagcgataatctacaatctgtggttcggctatgacgtcaaatgggcggtcgaagaaccacggctgcataaccagttgctgccaaatgtcacaactgtggaaaggaacatcgatcaggaagtcacggccgccctggagactaggcatcaccacacacaaatcacgagcacctttattgcagttgtccaggctatcgtacgtatggccggaggctgggcagctgcctctgactcccggaaaggcggggaaccagccggatattag

SEQ ID NO: 188923 - DNA, 678 bp, Artificial Sequence
  Description of Artificial Sequence: Synthetic coding sequence
atgaccagcgagttcttcagcgcccagctgcgggcccagatcagcgatgatacgacgcaccctatctcgtactataaacctgagttctatatgcccgacgacggcggcactgcacacctaagcgtggttgctgaagacggttcggcagtgagtgccaccagtacaatcaacctctactttggctcgaaggtccggagcccagtttccggcatactacttaataacgagatggatgatttcagctcaacgagtatcacaaatgagtttggcgtgcctccatcaccagcaaacttcattcagcccggaaaacaaccactgagcagcatgtgtccaaccatcatggtcgggcaggacgggcaggtgcggatggtcgtgggcgctgccggcggcacacagatcaccatggccactgcactggcaatcatctacaacctatggttcggatatgatgttaagtgggctgtggaggagccccgcctccacaaccaactcttacccaacgtaacaacggttgaacgaaacatcgaccaggaggttaccgctgcactcgagacacgtcaccaccacactcagattacctcgacctttatcgccgtcgtgcaagcaatcgtgcgtatggctgggggctgggccgcagcaagcgatagcaggaagggaggggaacctgctggttactag

SEQ ID NO: 188924 - DNA, 678 bp, Artificial Sequence
  Description of Artificial Sequence: Synthetic coding sequence
atgaccagcgagttcttcgccgcccagctgcgggcccagatcagcgacgacactacacatccaatcagttattataaaccggagttttatacccccgttgatggcggaaccgcacacttgtctgtagtcgcagaggacggctctgccgtgagcgctactagtactatcaatttatacttcgggtccaaggtaaggtctcccgtttctgaaatcctgttcaatgatgagatggacgatttctctagcccaaacatcaccaacgaattcggggttccgccctctcctgctaattttatccagcccggaaaacagcctctgtcttccatgtgtcctactattatggttggacaggacggacaagtcagaatggtagtgggggccgcgggaggcacccagatcaccacagctaccgccctggccatcatttataacctatggttcgggtacgatgtgaaaagggcggtggaagagcctcgcctgcacaatcagcttctcccaaatgtaaccactgtggagaggaacattgaccaagccgtgactgccgctctggaaactcggcaccatcacacacagattgcctccactttcatcgccgtggttcaggctatagtacggacagccggagggtgggccgccgcaagtgattccaggaaaggcggcgagccagcaggttattag

SEQ ID NO: 188925 - DNA, 657 bp, Artificial Sequence
  Description of Artificial Sequence: Synthetic coding sequence
atgaccagcgagttcttcgccgcccagctgcgggcccagatcagcgatgacaccacccatccaatcagttattataagccagaattctatactccagttgatggggggaccgctcatctgtccgtcgtggcagaggatgggagcgcagtgtcggctacttccacaatcaacttgtactttggaagcaaggtgcgcagcccagtgtccgagattctcttcaacgacgagatggatgacttcagctccccaaacattacaaatgagtttggagtcccaccgtctcccgcaaactttattcagccagggaaacagcccttgtccagtatgtgtcccacaatcatggtgggtcaggatggacagcccccaagccatgccgaccacactcccatgccccaggccataatctataacctgtggttcgggtacgatgtgaagagggccgtggaggaaccaaggctgcacaaccagctcctgcccaacgtcactacagttgaaagaaacattgatcaggcagtcactgcggcactggagacccgccaccaccatacgcaaatcgcgtctacttttatcgccgttgttcaggccatcgtaagaaccgcaggaggctgggcggctgcttccgattccagaaagggaggcgaacctgccgggtattag

SEQ ID NO: 188926 - DNA, 678 bp, Artificial Sequence
  Description of Artificial Sequence: Synthetic coding sequence
atgaccagcgagttcttcgccgcccagctgcggagccagatcagcgaccacaccactcatccaattagctattataagcccgaattttacacccccgacgatggcggaaccgctcatctgtccgttgtcgcagaggacggcagtgccgtcagtgccacctccacaataaatctgtacttcggctccaaagtgtgttctccggtatctggtatcctgtttaataacgaatggactaccagtgccctacccgcattcacaaacgaattcggtgcacccccaagcccagccaacttcatccagcctgggaaacagcctttgctgtcaatgtgccccacaattatggtaggccaagatgggcaggtcagaatggtggtcggcgcagctggcgggactcagattactactgatacagccctggctataatatacaatctttggtttggttacgatgtcaagcgagcagtcgaggagccgcggcttcacaacaaactcctgcccaatgtcaccaccgtcgagagaaacatcgaccaggctgtgaccgctgcgttggagacaaggcaccatcacacacagattgccagcacatttatcgccgtggtccaggccatcgtgcgtactgccgggggttgggccgcagccagcgatagcagaaaagggggcgagcccgctgggtattag

SEQ ID NO: 188927 - DNA, 711 bp, Artificial Sequence
  Description of Artificial Sequence: Synthetic coding sequence
cccgccctgggcagccagcaggtggtgcggaacatgaccagcgagttcttcgccgcccagcttaggagtcagatttccgaccacaccacacaccccatcagttactacaagcctgaattttatacccccgacgacggtggaacagctcacctgagcgttgtggcagaagacggcagtgcagtaagtgctacttccacaataaacctgtattttggaagcaaggtctgctcacccgtcagtggcatattatttaacaacgagtggacaaccagtgccttaccggcgttcaccaacgagtttggcgctcccccttcccccgccaatttcatccaacccgggaagcagccgttactgagtatgtgtcctacaattatggtggggcaggacggtcaggtgcggatggtcgtgggcgcagcaggcgggacgcagatcactaccgacaccgctctcgccatcatttataacctctggtttggctacgacgtcaagagagccgttgaagaacctcgtctgcataataagcttttgccaaacgtcaccacggtggagcggaacattgaccaggctgttaccgcggctttggagacgcggcaccaccacactcagatcgcctccacattcattgctgtagtgcaggcaattgttagaacagccggaggttgggcagccgcatcggacagtaggaaggggggtgagcccgccgggtactag

SEQ ID NO: 188928 - DNA, 675 bp, Artificial Sequence
  Description of Artificial Sequence: Synthetic coding sequence
atggtggccgccgtgctgctgggcctgagctggctgtgcagccccctcggtgccctggtgctagacttcaacaatatcaggtctagcgctgatttacatggggcccggaagggctctcaatgtctttcagatacagattgtaatacgcgaaaattctgcttacagccccgggatgagaaacccttctgtgccacatgccggggactccgtcggcgctgccagagggatgccatgtgctgccccggtacactgtgcgtgaacgacgtatgtactacaatggaagatgctacacccatcctggaacgccaactggatgaacaggacgggacccacgcagaagggacaaccggccacccagtgcaggagaaccagcccaagcggaaaccctctatcaaaaaatcacagggcagaaaaggtcaagagggcgagtcttgcttgaggaccttcgactgtggacctgggctgtgttgcgccagacacttctggaccaaaatttgtaaaccagttcttcttgaaggtcaggtatgttctagaagggggcacaaggacaccgctcaggctccagagatcttccagcgctgcgattgtggccctggcctgctgtgtcggtcccagttaaccagcaaccgccagcatgcccgcctccgggtgtgtcagaagatagaaaagctatag

SEQ ID NO: 188929 - DNA, 873 bp, Artificial Sequence
  Description of Artificial Sequence: Synthetic coding sequence
atgcggctgaacagcaccggcgaggtgcccgtgctgatccacggcgaaaacattatttgtgaagccacccagatcatcgactatcttgagcagaccttcctagacgagagaacccctcggcttatgcctgacaaggagagcatgtattaccctagggtgcagcattaccgcgagttgctcgatagtttgccaatggacgcgtatacacacgggtgcattctgcaccccgagcttaccgttgatagcatgatccctgcgtatgctactacccggattaggagtcagattgggaacaccgaatctgaactgaagaagctcgctgaggagaatcctgatctgcaagaagcatatatcgccaagcagaaacgacttaagtccaaactcttagaccacgataacgtgaagtacctcaaaaagatactcgacgaactggagaaggtgcttgatcaggttgagactgagctgcagcgcaggaacgaggagacgcccgaggaagggcagcaaccctggctatgtggtgagtcgttcaccctcgccgatgtctcactagcggttacactgcacagacttaaatttctcggcttcgcaaggcgtaactggggaaatggcaaacggccaaacttggaaacctattacgagcgcgtactcaaacgcaaaacttttaataaagttttaggccacgtaaacaacatcctgatatcggcagtcctgcctacggcctttagggtggcgaagaagcgcgcccctaaagtcctcggaactactctcgtcgtgggtctccttgcaggtgtgggttactttgcctttatgctgtttaggaagagattgggtagcatgatactcgcgttcagaccaaggcctaattatttttag

SEQ ID NO: 188930 - DNA, 1632 bp, Artificial Sequence
  Description of Artificial Sequence: Synthetic coding sequence
atgggcgactggaacctgctgggcggcatcctggaggaggtgcactctcacagcaccattgttggtaagatatggctgactattttgttcattttccgcatgttagtgttgagggttgccgctgaggacgtctgggacgacgaacaatccgcctttgcctgtaatacccgccagccaggatgtaataatatctgctacgacgacgccttcccgatcagcctcatcagattctgggtccttcaaatcatttttgtctccagcccgtccttggtctacatgggccatgcgctgtacaggctacgggcgtttgaaaaggataggcaacgaaagaagagccatcttcgtgcccagatggaaaatcctgatctcgatttagaagaacagcagaggattgatagggagcttcgacggctcgaagagcaaaaacgaatccacaaagtaccattgaaggggtgcttacttagaacgtatgtcctacatatactcacccgctctgtcttggaagtgggatttatgattgggcagtacatcctgtatggttttcagatgcacccattatataagtgcactcagcccccatgtccaaatgctgtggattgcttcgtgtctcggccaactgaaaagactatctttatgctgtttatgcacagcatcgccgcaatctccctcctgctgaatatcttggaaatatttcacttgggtattaggaaaatcatgcgcacgctctacaagaaatcaagctccgagggcatcgaggacgagaccggccccccatttcacttgaaaaaatactcagtagctcagcagtgtatgatctgcagtagtttgccagagcgcatttcacccctgcaggccaataaccaacagcaagtcatccgagttaacgttcccaagtcaaagacaatgtggcagatccctcagcccaggcaactggaagtggaccccagcaatggcaagaaagactggagtgagaaggaccaacattctgggcagctgcacgtgcacagcccctgcccctgggccggctcagccggtaaccaacatttgggccagcagtcggatcatagctcattcggactacagaatactatgagtcagtcctggctcggtacaaccacagccccccgaaactgcccatcattcgcggtgggcacatgggagcaaagtcaggacccagaacctagcggcgaacctctgactgacctgcactcacactgtagagattccgagggaagcatgagggaatcgggggtgtggattgaccgcagcaggcccggctccaggaaagcgagcttcctctcaaggctcctatccgagaagcgacaccttcattcagacagtggcagctccggatcgagaaactcgtcttgtctcgatttcccgcactgggagaactctccgtcacctttgccttcagtgactgggcatcgcacttcgatggttaggcaggcagctttaccaattatggagctgtcgcaggagctgtttcacagcggctgctttttattccccttctttctccccggtgtctgcatgtatgtgtgtgtggacagagaagctgatggcgggggcgattacctctggcgtgacaaaattattcatagtatccatagcgtgaaattcaacagttag

SEQ ID NO: 188931 - DNA, 1308 bp, Artificial Sequence
  Description of Artificial Sequence: Synthetic coding sequence
atgggcgactggagcttcctgggccggctgctggagaacgcccaggaacactcgactgtcattggtaaggtttggctgacagtattattcatattccgcatcctcgtgctcggcgccgcagctgaggacgtctggggagatgaacagagcgacttcacctgtaacacccagcagccggggtgcgagaacgtgtgctatgacagggcattcccgatctcccatatccgattttgggctctccaaatcatcttcgtgtcaacccctaccctcatctacctgggacacgtcctgcacatcgtgcggatggaagaaaagaagaaggaacgcgaggaggaggagcagctgaagcgtgaatccccctcaccaaaagaaccaccccaggataatccttcctctcgcgatgacagagggagggtgagaatggccggtgcgcttctgcggacgtatgtgtttaacattatattcaagaccctgttcgaggtggggttcatcgcggggcagtattttctgtatggctttgagctgaaacctctctaccgctgcgatcgctggccatgcccaaatacagtagattgtttcatttctagacccaccgagaagacgatcttcatcatttttatgctggcagtagcttgcgcatctctcctgttaaatatgctggagatctaccacctagggtggaagaagctgaagcagggcgtgacaagcagactcgggcccgacgcctcagaggctcctttgggtaccgccgacccgcctcccttacctccatccagtcggccgccggccgtcgccatcgggttccctccgtattacgctcataccgccgcaccccttggacaggccagagctgtgggatacccaggcgcacccccgcctgccgcagacttcaagctccttgccctgacagaagcacggggcaagggacaaagtgccaagttgtacaatggacatcaccatcttctcatgacagagcaaaattgggctaatcaggccgctgagcgtcagccccccgcacttaaggcataccccgcggcaagtacaccagccgctccaagtccagtcggcagctcatcccccccactggctcacgaagccgaagcgggggccgcccctctgctcctggatgggtccggatcatccctagaaggtagcgccctcgcaggaacccccgaggaggaggaacaggctgttactacagccgcccagatgcatcagcctccattgccacttggagaccccgggagagcatctaaagcctcgagggcttcatccggcagagctagacctgaggacttagccatatag

SEQ ID NO: 188932 - DNA, 1002 bp, Artificial Sequence
  Description of Artificial Sequence: Synthetic coding sequence
atgggcgactggggcttcctggagaagctgctggaccaggtgcaggagcatagcacagtggtaggcaaaatttggctgacagtgctgttcatcttccgtattcttatcctcggtctggccggcgagtcagtttggggagacgaacagtcagactttgaatgcaataccgcccagcctgggtgcaccaatgtctgttatgaccaggccttcccgatctctcacatccgctactgggttctgcagttcctgttcgtttcgaccccaacacttgtgtacctgggccatgtgatttacttgtcacggagggaggaacgactgcggcaaaaagaaggcgaacttagggctttgccagcaaaagacccacaagtggagagggcactggcggctgtggagaggcagatggcaaagatcagcgtggcggaggatgggcgacttaggatcaggggcgccttgatgggaacctatgtagcttcagtcctctgcaaatccgtcctagaggcaggcttcttgtatggtcaatggagattgtacgggtggaccatggagcctgtgttcgtgtgccaacgagccccatgtccttatctggtcgactgctttgtctctcgcccgacagaaaagaccatctttatcatttttatgctcgtggtgggtttgatatcactggtcctgaacctgcttgaactggttcacctcctttgtcggtgcttgagccggggaatgcgggcgaggcagggtcaggacgctcctcctacccagggtacatcttccgatccctacacagaccaggtgtttttttatctgcctgttggccagggcccatcctcgcccccgtgccctacatacaatggtctgtcatccagcgagcagaattgggccaatttaacgactgaagagaggctagccagttcaaggccccctctctttttagatccacccccccagaatggacagaaaccaccctcccgcccttcgtcatctgccagcaagaagcagtatgtatag

SEQ ID NO: 188933 - DNA, 879 bp, Artificial Sequence
  Description of Artificial Sequence: Synthetic coding sequence
atgggcgactggggcttcctggagaagctgctggaccaggtgcaggagcactcaacggtggtgggcaagatttggctgaccgtcctgttcatcttccgcatcctgatccttggtctggcaggagagtccgtgtggggggacgagcagagcgacttcgaatgcaatactgcacagcctggctgcacaaacgtgtgttacgaccaggctttcccaatttcccacattcggtattgggtgctgcagtttctttttgtatccactccgaccctcgtctacctgggccacgttatatacttgtcccgacgggaagagaggttgaggcagaaagaaggcgaactcagggctctgccagcaaaggacccacaggtggagcgggcgctggctgccgtggagcgtcagatggctaagatttctgtcgcagaggatgggcgcctgcggataagaggtgccttgatgggtacctatgtagcctctgtcttatgtaaatccgtgctggaggctggttttttatacggccagtggagattgtacggttggaccatggagcctgtgttcgtatgtcagcgtgccccctgcccttacttggtggactgttttgtgagccgcccaacagagaagacaatttttattattttcatgctggtggttggactaattagcctggtgctcaatctgttagagctcgtgcacctgttgtgcagatgcttgtcccggggtatgcgggcccggcaagggcaggacgcccctccgacccaggggactagcagtgacccctatactgaccaggtctttttctacctaccagttggacagggaccttcatcacccccatgcccgacatacaacggactgagttctagtgagcaaaattgggcatag

SEQ ID NO: 188934 - DNA, 882 bp, Artificial Sequence
  Description of Artificial Sequence: Synthetic coding sequence
atgggcgactggggcttcctggagaagctgctggaccaggtgcaggagcattctactgttgttggcaaaatctggctgacagtgctctttattttccgaatcctgatcttgggcctcgccggtgaatcagtgtggggagacgagcagtccgatttcgagtgcaacacggcacagcccggctgcacaaacgtgtgctacgatcaggctttccctatcagccatataagatattgggtattgcaattcctgttcgtgtctactccaacactggtataccttggtcacgtgatatacctttcacgcagagaagagcgcctaaggcaaaaggaaggggaactccgggctcttcccgctaaggacccacaagtggaacgtgctctcgccgccgtggaaaggcagatggctaaaatttccgtggccgaggatggtagattgcgtattagaggagcattgatgggaacatacgtagcttctgtgttgtgtaagtctgtactcgaggcaggattcttatatggacagtggcgtttatatgggtggaccatggagccggtgtttgtatgtcagcgcgcaccatgtccctacctggtggactgttttgtctctaggcctactgagaaaaccatcttcatcatctttatgctggtggtgggcttgatttctttagtccttaatttacttgagctggtgcatttgttgtgtcggtgtttgtctcgcggaatgagagcccggcaaggtcaggatgcaccacctacccagggcacaccccagaccctaaccagaactaggagctcttccactagtccttgggcacgcggaccacatcctcaccatgccccccctacaatgggaagtcacccggtttcgagaacagggccgacatag

SEQ ID NO: 188935 - DNA, 1077 bp, Artificial Sequence
  Description of Artificial Sequence: Synthetic coding sequence
atgggcgactggagcttcctgggcaacttcctggaggaggtgcacaagcactctacagtggtggggaaggtctggctgacagttttattcatattccgcatgctagttctgggcacggcagccgaatcatcatggggtgatgagcaggctgactttaggtgcgacaccatccagccagggtgtcagaacgtatgttacgatcaggctttcccaatctcccatatccggtattgggtgctgcagataatctttgtgtctactccctctttagtgtatatgggccacgccatgcataccgttcgcatgcaagaaaagcggaaactgagggaggctgagagggcgaaggaggtgagagggagcggcagctatgagtaccctgtagctgagaaggcggagctttcttgttgggaagaaggtaacgggcgcatcgcccttcagggtactttgctgaacacatatgtttgctcgatcctgatcagaaccaccatggaggtggggttcattgtagggcagtatttcatctacggaatctttctgacaaccctgcacgtgtgtaggagatccccctgcccacaccccgttaactgctacgtctccagaccaaccgagaaaaatgtctttattgtattcatgctggctgtcgctgccctgagtctgctgctgagtctggccgagctataccaccttgggtggaagaaaattaggcagcgattcgtgaagccacgtcagcacatggcaaagtgccagctgtctggaccctcggtagggattgtgcagagctgcactccaccccctgacttcaatcagtgcctggagaacggacccggtggcaaattctttaaccctttcagcaacaatatggcttctcagcaaaacaccgacaaccttgtgaccgaacaggttcgaggccaggaacagacgccaggcgaagggttcattcaggtacgatatggccagaagcccgaagtacccaacggagtgtctccgggccataggcttccacatggatatcatagcgacaagcgccgcttgagtaaggcctcgtccaaagcccgctcggatgatttaagtgtgtag

SEQ ID NO: 188936 - DNA, 1077 bp, Artificial Sequence
  Description of Artificial Sequence: Synthetic coding sequence
atgggcgactggagcttcctgggcaacttcctggaggaggtgcacaagcatagcaccgttgttggcaaagtctggctaacggtgttatttatatttcggatgcttgtgctgggtacagcagcagagtcctcctggggagacgagcaggccgattttagatgcgacactatacagccagggtgccaaaacgtttgctacgatcaggccttccctatatcacacattagatattgggtcctacaaattattttcgtttccactccatctctggtctacatgggccacgcaatgcatactgtgcggatgcaagaaaagcggaagctgcgggaggccgaacgagcaaaggaagttagagggagtggctcctacgagtaccccgtggctgagaaagccgaactgtcctgctgggaggagggcaacggccgaatcgcccttcaggggaccttactgaatacatatgtgtgctcaatcctgatcaggactaccatggaggtggggttcatcgtgggacagtatttcatctatgggattttccttacaacactgcatgtctgtcgccgatccccttgtccacaccccgtcaattgttatgtcagcagacccactgaaaagaatgtgtttatcgtgttcatgttggcggtggcagctctgagtctcctcctgagtctggcggaactgtaccacctgggttggaagaagatccgacagaggtttgtgaagccgcgacaacatatggcaaagtgtcagctaagtggcccctcagtcggtatcgtgcaatcatgcacaccaccacccgactttaaccagtgcctagagaatggaccgggaggtaagtttttcaatcctttcagcaataacatggcctcacagcagaacacagacaatttggttaccgagcaggttcgagggcaagaacagacccccggggaaggcttcattcaggtgcgatatgggcagaaaccagaagtcccaaatggcgtgtctcctggtcaccgcctgccgcacgggtaccattccgacaaaaggcgcctcagcaaggcgtcatctaaggcaagatccgacgatctgtccgtttag

SEQ ID NO: 188937 - DNA, 759 bp, Artificial Sequence
  Description of Artificial Sequence: Synthetic coding sequence
atgggcgactggagcttcctgggcaacttcctggaggaggtgcacaagcatagcactgtggtgggaaaggtgtggcttacagtccttttcatctttcgaatgctggttttagggaccgccgctgaaagctcctggggtgatgaacaagccgacttcaggtgcgacacgattcaaccggggtgccagaatgtctgttacgaccaggccttccccatatcacacatcaggtattgggtcctacaaattatcttcgtatccacaccatcgctggtttacatgggtcatgctatgcacacagttcggatgcaggaaaagaggaaacttcgcgaggcagaaagagctaaagaggttagaggaagcggctcatacgaataccctgtcgctgagaaggccgagctatcctgttgggaagaaggcaacggacggattgccctccaggggacgctgttgaacacctatgtctgtagtatcctgatcaggacaacgatggaagtgggctttattgttggacagtattttatctacggcatctttctcacaaccctgcatgtgtgtaggaggagtccatgtccgcatcctgttaactgctacgtgtctagacctacggagaagaatgtattcattgtgttcatgctcgctgtggccgcactctccctcttgctctcactagccgagctgtatcaccttggttggaagaagatccgccagcgctttgttaagcctcggcagcatatggccaagtgccagttatcagggtag

SEQ ID NO: 188938 - DNA, 1302 bp, Artificial Sequence
  Description of Artificial Sequence: Synthetic coding sequence
atgggcgactggagcttcctgggcaacatcctggaggaggtgaacgagcacagcacggtgatcgggcgggtttggctgaccgtgctgttcatctttcgaattctcatactcgggacagcggctgagttcgtttggggagacgagcaaagtgacttcgtttgcaacacacaacagcctggatgtgaaaacgtttgttatgatgaggctttccctatctctcacatcagactgtgggtgctgcagattattttcgtgtctaccccgtcccttatgtatgtcggccatgctgtccactatgtgagaatggaggaaaagaggaagagccgcgaggctgaagaactgggtcagcaggctgggaccaacggcggtcccgatcaaggcagcgtaaagaagagcagtggcagtaaaggcaccaagaagtttcgcctggaggggactctgttacgtacttatatctgccacatcatttttaagactctcttcgaagtgggatttatcgtggggcactattttctgtacggatttcgcatcctccctctctacagatgctccaggtggccttgccctaatgtcgtcgactgctttgtgagccgacccacagagaagacaattttcatcctgtttatgttaagtgtggcatcagtgagcctcttcctcaacgtgatggagctcggtcacctgggcctgaagggcattcgatcggcactgaaacgcccagtggagcagcccttgggcgaaatcccggaaaaatctctacactccattgcggtgtctagcatccagaaagctaagggctatcaactgctggaagaagaaaagatcgtttcccactattttccactgacagaggtcggcatggtggaaacctctcctctgcccgccaagccattcaatcagttcgaggagaaaattagtactggacctcttggggacctcagcagaggctaccaggagactctgccatcttatgcccaggttggcgcgcaggaggtggaaggagaagggccgcccgccgaggagggagcagaacccgaagtgggagagaaaaaagaggaggctgaaaggctcaccacggaggaacaggagaaggttgccgtgccagaaggcgagaaggtggaaacacccggcgtcgacaaagagggagaaaaagaagaacctcaatctgaaaaagtctccaaacaggggctgcctgctgagaagacgccttcattgtgtcccgaactgacaactgacgatgcccgtcctctttctcggctgagcaaggccagcagccgcgctcgctcggacgacctcacagtctag

SEQ ID NO: 188939 - DNA, 1302 bp, Artificial Sequence
  Description of Artificial Sequence: Synthetic coding sequence
atgggcgactggagcttcctgggcaacatcctggaggaggtgaacgagcattcgactgtgatcggccgcgtgtggctgaccgtcttgtttatcttccgcatactaatcctgggaaccgccgccgagtttgtgtggggcgatgaacagtccgacttcgtgtgtaatacacagcagccaggttgcgaaaatgtctgttacgatgaggcttttcccatcagccatattaggttgtgggtgctccagattattttcgtgagtacacctagtctgatgtatgttggacatgccgtgcactacgttcgaatggaggaaaagaggaagagccgcgaagcagaagaactcgggcaacaagccgggactaatgggggcccggatcagggctcagtgaaaaaatccagcgggtctaagggtaccaagaagttcaggctagaagggaccctcctacgcacctacatttgtcacatcatcttcaagaccctgtttgaagtgggctttatcgtgggccactatttcctgtatggcttcaggatccttcccctgtaccgctgttcccggtggccatgccccaacgtcgttgactgttttgtgagccggcccacggaaaaaaccatctttattctcttcatgctttctgtggctagtgtgagcctgttcctcaatgtgatggaattggggcacttaggtcttaagggaattagaagcgccctgaagcgtcccgtggaacaaccgctgggtgaaatcccagaaaaaagcctccactcaatcgccgttagcagtatacagaaggctaaaggatatcaactgttggaggaagagaagatcgtatcacactatttccctctgacagaagttggtatggtcgagactagtccattacccgctaagccattcaatcaattcgaagagaaaatcagcaccgggccgctgggcgatctcagcaggggataccaggagactctgcccagctatgctcaggttggagcccaagaagtcgaaggcgaggggcctccagccgaggaaggagcagaacccgaggttggcgaaaaaaaagaagaggccgagcggctgaccactgaggaacaggagaaagtggctgttccagagggagagaaggttgagacgccaggcgtagacaaggaaggtgagaaggaggaacctcagagcgaaaaagtttcaaagcagggactgcccgccgaaaaaacgccaagcttatgcccagaactgaccacagatgatgcgcggcctctgtcccgattgagcaaggcctcaagcagggccaggagtgatgacctgaccgtttag

SEQ ID NO: 188940 - DNA, 1548 bp, Artificial Sequence
  Description of Artificial Sequence: Synthetic coding sequence
atgggcgactggaacctgctgggcgacaccctggaggaggtgcacatacactccacaatgatcgggaaaatctggctgacgattctgttcatcttccgcatgctcgttctaggcgtagctgccgaggacgtgtggaacgacgagcagtcaggcttcatctgtaacaccgaacaacccggctgcaggaatgtatgctacgaccaggcctttcccatttcactgatccggtattgggtgttacaggtgattttcgtgtcaagtccatccctggtatatatggggcacgccttgtatcggctcagagtccttgaagaggaacggcagaggatgaaggcccagctgcgcgtggagctggaggaagtggagttcgagatgcctcgtgatcgccggagactggaacaggagctatgccagctggaaaaaaggaagctgaataaggcccccctgcgcggcacactgctttgtacgtacgtaattcacattttcacacgctctgtagtagaggtgggctttatgattggccaatatttactgtacggcttccatctagagccattgttcaaatgtcacggacatccttgtccgaacataatagattgcttcgtcagccggccaacggaaaagacgatctttctgttgttcatgcagagcatcgcaaccatctccctgtttctcaacattctggagatcttccatttaggcttcaaaaaaataaaacggggcctttgggggaagtataagctgaaaaaggagcacaatgagtttcacgccaacaaggctaagcaaaatgtagcaaagtaccaatcaacatccgctaattcactgaagaggctgcccagcgcccctgattataatctattggtggagaagcagacccacacagccgtttacccttccctcaactctagctcagtgttccaaccgaatcctgataaccatagtgtaaatgacgagaaatgtatcttagatgaacaggaaactgtactgagtaacgagatttccaccctatcaacaagctgctcccactttcagcacattagcagcaataataataaagatactcataagatttttggtaaggagctaaacggtaatcaattgatggaaaaacgagagactgaggggaaggattccaaacggaattattatagccgcggccacagaagcatccctggggtggcgattgatggggagaacaatatgcgtcaatccccgcagaccgtcttctccttgccagccaactgcgactggaagccccggtggctgagagctacttggggttccagcacagagcatgagaacagaggctccccccccaaagggaatttaaagggacagtttaggaaaggcaccgtcagaaccctgcccccctcccaaggagattctcaaagtcttgacattccaaacaccgcggactccttgggtgggctctcatttgagccaggtctggtcagaacttgtaacaaccccgtgtgcccaccgaaccacgtcgtgtctctcacaaataacctaataggtaggagggtccctactgatttacagatctag

SEQ ID NO: 188941 - DNA, 1548 bp, Artificial Sequence
  Description of Artificial Sequence: Synthetic coding sequence
atgggcgactggaacctgctgggcgacaccctggaggaggtgcacatccattcaacgatgattggaaaaatctggctgaccatcctcttcatcttcaggatgctggtactgggcgtggccgccgaggacgtttggaacgatgaacagagtggctttatttgtaatactgagcagccaggttgcagaaatgtgtgctacgaccaggcatttcccatatccttaattagatactgggtgctccaagtaattttcgtgtcctccccttccctggtatacatgggccacgcactgtatagactcagggtgctggaagaggagaggcagcgtatgaaagcacagctgcgagtggagctggaggaagtcgaatttgaaatgcctagggacaggaggcggcttgagcaggagctttgtcaactggaaaagaggaagttgaacaaagctcctctgagggggaccctattgtgtacttacgtgattcatatctttacacgcagtgttgtggaggtcggctttatgattggacagtatctgctctacggattccacctggaaccattgtttaagtgccatggacatccttgtcccaacatcatcgactgtttcgtgtcaagaccaactgagaagacgattttcttactgttcatgcagtccattgctacaatatcgcttttccttaatatactggaaatctttcatctgggctttaaaaagattaaacggggactgtggggcaagtataaactcaagaaggagcacaacgaattccatgcgaacaaagccaagcagaacgtagccaaatatcagtctacgtccgcgaattcgctgaaacgactgccgtctgccccggactataatttactcgtagaaaaacaaacccataccgctgtttatccatctttgaatagcagtagcgtgtttcaacccaaccctgacaatcacagtgtcaatgacgagaaatgcatcttggatgagcaggagaccgtgctgtctaatgaaatcagcaccctgtcaacgtcctgtagtcatttccagcacattagttcgaacaataataaagacacacataaaattttcgggaaagagctgaacggaaatcaacttatggaaaagcgagaaactgagggaaaagatagcaagcggaattactattcccgcgggcacagaagcatccccggggtcgccattgatggggagaataacatgagacagagccctcagaccgtcttttctttgcccgccaattgcgattggaagccacgatggctgagagcaacctgggggtcaagtacagagcacgagaacaggggaagccctccaaagggaaatctaaagggccaatttaggaagggaacggtccgaacgcttcctcccagccagggggatagccagtcactggacatccccaacacggcagatagtctcgggggactgtctttcgaacccgggctggtccgaacctgtaataacccagtgtgccccccaaatcacgtggtgagcttgacaaataacttgattgggcgcagggtgccgacagacctccagatttag

SEQ ID NO: 188942 - DNA, 1545 bp, Artificial Sequence
  Description of Artificial Sequence: Synthetic coding sequence
atgggcgactggaacctgctgggcgacaccctggaggaggtgcacatacatagtacaatgattggcaagatctggctcacgatccttttcatctttcggatgctagtgctcggagtggccgccgaggacgtgtggaatgacgaacagagtggcttcatttgcaacactgaacagcccgggtgccgcaatgtgtgctatgatcaggcctttccaatctccctgattcgctactgggtcctacaagtgatctttgtttcaagtcctagtctggtgtatatgggacatgccttgtacagactacgcgtccttgaagaagagcgccagaggatgaaggcacagctgcgcgttgagctggaagaggtggagtttgagatgccaagagacaggagacggcttgagcaggagttgtgccagctcgagaagcggaagttgaataaggcccccctgcgtggcaccctactgtgcacttatgtgattcacatttttacacgctccgtagttgaagtcgggttcatgatcggacagtatctgttatacggtttccatctcgagccactttttaagtgccacggacacccttgccctaacatcatcgactgcttcgtgtcacgcccaaccgagaagacaatatttctcctcttcatgcaaagtattgccacaatctctttgtttctgaacatcttagagatctttcatttgggattcaagaaaattaaacgggggctatggggcaagtacaaattgaagaaagaacataatgagttccacgccaataaggctaaacagaacgtcgcgaaataccaaagtacgagcgctaacagcctcaaacgcctgccctcagcccccgactacaacttgctggtggaaaagcagacccacactgccgtttacccatcgctgaactctagcagcgtttttcaacccaacccggataaccactctgtgaacgatgaaaagtgcatactggatgagcaggaaacagtgttgtccaacgagatcagtactttgagcacctcctgctcccactttcagcacatctcgtctaacaacaataaagacacgcacaagatatttggcaaggaactgaatgggaatcagcttatggaaaaacgggagacggaggggaaagatagcaaacggaattactactccagagggcatagaagcataccgggagtggccattgatggtgagaacaatatgcgacagtccccacagacagtgtttagcctgccagcgaactgtgactggaagccacgttggctcagagcaacctgggggtccagtactgagcatgagaataggggctccccccccaaggtcccaggcagtaaggcaacagctagcagtcttctcctgattctgcaacgccccacttcctcacaacctagattgaaggaaactccgaagattaaggccgaggctaagatctacgattctaagcaccctcctcgactcctgcagtcgactgtctctacatttagcgggcgagagcctaggtcgccagccccaatgggccaccattccttccgaggtccccggtag

SEQ ID NO: 188943 - DNA, 852 bp, Artificial Sequence
  Description of Artificial Sequence: Synthetic coding sequence
atgaactggaccggcctgtacaccctgctgagcggcgtgaaccggcacagtactgctattggaagggtttggctgtccgtgatattcattttccggatcatggtgctagtggtggcggccgagtctgtctggggtgatgagaagagtagcttcatttgtaacaccctccagcctggatgtaattccgtatgttatgaccagttcttccctatctcccacgtccggctgtggtcattgcagttgatcctggtgagtactccggccctgctggtcgccatgcatgtggcccaccagcagcatattgagaaaaaaatgttacggctggagggccacggcgatcctctgcacctggaagaggtcaagcgtcataaagtgcacatctctggcacactgtggtggacctacgttatttctgtggtgttcaggctgctctttgaggcagtgtttatgtatgttttctatctgctgtatcccgggtacgccatggttcggctggtcaagtgcgatgtatacccttgcccaaatacggtggattgtttcgtctcgaggcctacagaaaagactgtgttcacagttttcatgctggcagcttctgggatatgcatcatattgaatgtggcagaggtagtatatctgatcatccgggcttgtgcccggcgggcccagaggagatcaaatcctccaagtagaaagggctctggattcggccataggctatcacctgaatacaagcagaatgagatcaacaaactcctatccgaacaggatggttcactgaaagatatcctacgccgctctccaggaaccggggcaggtctcgccgaaaagtccgaccgatgtagtgcatgctag

SEQ ID NO: 188944 - DNA, 852 bp, Artificial Sequence
  Description of Artificial Sequence: Synthetic coding sequence
atgaactggaccggcctgtacaccctgctgagcggcgtgaaccggcactctactgccatcggcagagtctggctttccgtgattttcatctttaggatcatggtattggttgtggcagccgagtcagtttggggggacgaaaaatctagtttcatctgtaacacgcttcaaccaggatgtaactccgtctgttatgatcaattctttccaatctctcacgtgaggctgtggagcctgcagttaattcttgtgagtacccctgccctcctggtcgccatgcacgtcgcacatcagcagcacatcgagaagaaaatgcttcgattagagggccacggcgatcctctccaccttgaggaggtgaaacgtcataaagtccacatcagtggaacgctgtggtggacttacgttatttccgtagtctttaggcttttgttcgaagcagtgttcatgtacgtattctatttgctatatccgggctacgcgatggtgcggttagtgaagtgcgatgtgtatccatgccccaataccgttgattgctttgtcagtaggccgacggagaagactgtctttacagtttttatgttggccgcaagcgggatttgcatcattctgaacgttgctgaggtagtctatctcattattcgggcgtgtgctcggcgggcacaacgaaggtcaaaccccccttcgagaaagggatcagggtttggtcacaggctatctccagagtataagcagaacgagatcaacaagttgcttagcgagcaagacggctccctgaaggatatccttcggagatctccagggaccggcgctggccttgccgaaaagtctgatagatgttctgcctgttag

SEQ ID NO: 188945 - DNA, 852 bp, Artificial Sequence
  Description of Artificial Sequence: Synthetic coding sequence
atgaactggaccggcctgtacaccctgctgagcggcgtgaaccggcattccaccgctattgggcgtgtgtggctatccgtgatcttcatctttcggattatggttcttgtagtggccgccgaatccgtgtggggcgacgagaaaagctctttcatctgtaataccctccaacctggttgtaacagcgtctgttatgatcagtttttccccatttcacatgtgcgcctgtggagtctccaactgatcctggtgtctacaccagcgcttctggtggcaatgcacgtcgcgcaccagcagcacatcgagaaaaagatgctacgactggaggggcacggcgaccccctacacttggaggaggtgaagcggcataaagtgcatatctcaggcactttgtggtggacctacgtgataagtgtcgtgtttcgcttgctatttgaggcagtgttcatgtacgtattttatctgctgtaccctggttacgctatggtcaggctggttaagtgtgacgtgtacccctgccccaacaccgtggattgctttgtttctaggcccacggaaaaaacagtgttcacagttttcatgctggctgctagcggaatctgtatcatcctgaatgtggccgaggtagtctacctgattatacgcgcttgtgctcgccgggcccagcgaaggtccaatcccccctcacgcaagggatccggtttcggacacagactgagtcctgagtataagcaaaacgaaatcaacaagctcttgtccgaacaggacggtagcctcaaggacattctaagacgctctcccgggactggcgcaggtttggctgaaaagtcggatcgctgttccgcgtgttag

SEQ ID NO: 188946 - DNA, 255 bp, Artificial Sequence
  Description of Artificial Sequence: Synthetic coding sequence
atgaactggaccggcctgtacaccctgctgagcggcgtgaaccggcacagtaccgccattggaagggtctggctgagtgtgatcttcatctttaggatcatggttctggttgtggctgccgaatcagtgtggggagatgagaaatcctcttttatttgtaacaccctccagcccggttgtaactctgtgtgctacgatcagttttttcccatttcccatgttaggctgtggagcttgcaactgattttggtgtag

SEQ ID NO: 188947 - DNA, 681 bp, Artificial Sequence
  Description of Artificial Sequence: Synthetic coding sequence
atggactggggcaccctgcagaccatcctgggcggcgtgaacaagcactctacctctattggtaagatatggctgacagtcctctttattttccgcatcatgattcttgtggtggctgctaaggaggtctggggagatgagcaggctgatttcgtttgcaatacgctgcagccgggatgtaagaacgtgtgttatgaccactactttcccatttcccacatccggttatgggcactgcagctgatctttgtaagcaccccagctttgcttgtagctatgcacgtggcatataggaggcacgaaaaaaagcgcaaattcatcaaaggcgagatcaagagcgagtttaaggacatagaggaaatcaagacgcagaaggtgagaattgaaggttccctgtggtggacttacacaagttctatttttttcagagttatattcgaggcggccttcatgtacgtcttctacgtcatgtatgacggtttcagcatgcagcgtctcgtcaaatgcaatgcctggccgtgtcccaatactgtggactgtttcgttagcagacccacggaaaaaactgtgttcactgtgtttatgatcgcggtgtcagggatctgtatactgctaaacgttacagagttatgctacctcctgatccgctattgcagcggtaagtctaagaagcccgtgtag

SEQ ID NO: 188948 - DNA, 681 bp, Artificial Sequence
  Description of Artificial Sequence: Synthetic coding sequence
atggactggggcaccctgcagaccatcctgggcggcgtgaacaagcattcaacaagcattggcaagatctggttaaccgttttatttatctttaggattatgattctggttgtggcagctaaggaagtgtggggggacgagcaagctgacttcgtctgtaataccttacagccggggtgtaaaaatgtgtgctatgatcactactttccgatcagccacattcggctttgggctttacagctcatattcgtgtcgactcctgcattactcgtggccatgcacgtagcgtacaggagacacgaaaaaaagaggaaatttatcaaaggcgaaattaaaagcgaatttaaggacatcgaggaaatcaagacgcagaaggtgcggattgaaggtagtctatggtggacatacacatcctcgattttcttccgcgttattttcgaggcagccttcatgtacgtcttttatgtgatgtatgatggattttctatgcagaggctcgtcaagtgtaacgcttggccctgccctaacaccgtagactgcttcgtgtcaagacctaccgagaaaacagttttcaccgtctttatgattgcagtctcaggcatttgcattttgctgaatgtcaccgagttgtgctatcttctgattcggtattgctctgggaagtccaaaaagcccgtgtag

SEQ ID NO: 188949 - DNA, 813 bp, Artificial Sequence
  Description of Artificial Sequence: Synthetic coding sequence
atggactggaagaccctgcaggccctgctgagcggcgtgaacaagtacagtaccgcattcgggcgaatctggctgtcagtggtcttcgtgttcagggtcctggtgtacgtcgtggccgctgagcgggtgtggggcgacgaacagaaagacttcgactgcaatacgaagcagcccggttgcacaaatgtctgttacgacaactactttcctatatctaatatccggctgtgggctctccagctgatctttgtcacctgcccgtcactgctggtgatcttacacgtggcatacagggaggagagggaaaggagacaccggcaaaagcatggagaccagtgcgccaaattgtatgacaatgccggcaagaagcatggcggcctttggtggacgtatctcttcagcctgatcttcaagctaatcatcgagtttttatttctgtacttgttgcacacactgtggcacggattcaacatgcctcgactcgttcagtgtgcgaatgttgccccctgtccgaacattgtagactgctacatcgcacgccccaccgagaaaaaaatctttacatattttatggtgggcgctagcgcggtttgtattgtcttgacaatatgtgaactgtgttatctgatctgccatagggtgctgaggggccttcacaaagacaagccacggggaggctgctctcccagctccagtgcgtcaagggcaagcacttgtcgctgccaccacaagctggtggaggccggggaggttgacccagatccaggaaacaacaagctgcaggccagcgcacccaatctgacaccaatatag

SEQ ID NO: 188950 - DNA, 813 bp, Artificial Sequence
  Description of Artificial Sequence: Synthetic coding sequence
atggactggaagaccctgcaggccctgctgagcggcgtgaacaagtattctactgcctttgggagaatatggctgtcagtggtttttgtttttcgtgttctggtgtatgtggttgcagccgaaagggtgtggggtgacgaacagaaagactttgactgcaataccaagcagccaggctgtacaaacgtctgttatgacaattatttccccattagtaacattaggctgtgggctcttcaactgatttttgtcacctgcccttctctgctagtaatcctgcacgttgcatatagagaagagcgggaaaggcggcacaggcagaagcacggcgaccagtgcgctaagctgtatgataacgctgggaaaaaacacggcggcctctggtggacctacctattcagcttgatttttaaactgatcattgaatttttgttcctgtacttactgcacacactgtggcatggcttcaatatgccacggctggttcagtgcgcaaacgtcgcaccctgtcccaatattgtggattgttacatagctaggccgaccgagaagaaaatttttacttatttcatggtaggagctagtgccgtgtgtattgtactgacaatctgtgaactatgttacctgatatgtcatcgggttctgaggggtctacataaagacaaacctcgcgggggatgtagcccgtcctccagtgcatcaagggcttcaacttgtaggtgtcaccataaactggttgaagcaggagaggtcgatcctgatccggggaacaacaaactgcaggcttcggccccaaatctgactcccatctag

SEQ ID NO: 188951 - DNA, 765 bp, Artificial Sequence
  Description of Artificial Sequence: Synthetic coding sequence
atggactggaagaccctgcaggccctgctgagcggcgtgaacaagtatagcaccgccttcggcaggatttggctatctgtggtgtttgttttcagggtacttgtttatgtggtagcggcagaacgagtttggggcgatgaacagaaagacttcgactgcaacaccaagcaacctgggtgcacaaacgtatgttacgataactactttccaatatcgaacatccggctgtgggccctgcagttaatctttgtgacctgcccgagtctgctcgtaattctgcacgtcgcctatcgcgaggagagggagcgcagacaccgccagaagcatggggatcagtgcgcaaaactttacgacaacgctggcaagaaacatggcgggctctggtggacctatctgcttcacaccttatggcacggctttaatatgccgagattggtgcagtgtgcgaatgtggcaccttgcccaaatatcgtcgactgttacatcgcgcgccctactgagaaaaagatattcacatatttcatggtgggagcctccgcagtctgtatcgttctgaccatttgtgaactgtgttacctaatttgtcaccgcgtgctgcgagggttacacaaggataagccacgaggaggatgttctccttcaagctccgctagccgagccagcacctgcagatgccatcataaactagtagaggcaggcgaggtcgaccccgaccctgggaataacaagctgcaggctagtgccccaaacctcacaccaatctag

SEQ ID NO: 188952 - DNA, 801 bp, Artificial Sequence
  Description of Artificial Sequence: Synthetic coding sequence
atgaactgggccttcctgcagggcctgctgagcggcgtgaacaagtactccactgtgctgtccagaatttggttgtctgtcgtgtttattttcagagtactcgtctatgtggtggctgccgaggaagtatgggatgacgagcagaaggatttcgtgtgtaacaccaagcagcctgggtgcccaaacgtgtgctatgacgagtttttccctgttagccacgtgcgactttgggcattgcaacttatcctggtaacgtgccctagcctgctggtggtgatgcatgtcgcctaccgtgaggagagagagagaaaacaccatctgaagcacggtcctaatgcaccctcactttacgataacctgtccaaaaagcgaggggggctgtggtggacctatcttctgtccctaatctttaaagcagcagtggatgcaggcttcttatacatttttcaccgattgtacaaggactatgacatgccgcgggttgtggcatgcagcgttgaaccctgtccacatacggtggattgttatatttcgaggcccaccgagaagaaggtgtttacatacttcatggtgaccactgccgctatctgcatcctgctgaatttatccgaggtattttacctcgtgggaaagagatgcatggagatcttcggacctcgccataggagacccaggtgtcgcgagtgcctgcctgatacctgtccaccatatgtactcagccaaggcggacatcctgaggacggcaattcggttctgatgaaggcgggctcggccccagttgacgccgggggctatccttag

SEQ ID NO: 188953 - DNA, 822 bp, Artificial Sequence
  Description of Artificial Sequence: Synthetic coding sequence
atgaactggagcatcttcgagggcctgctgagcggcgtgaacaagtattctaccgctttcggtagaatttggctatcgctggttttcatttttcgggtcctggtgtacctggtgacagcagaacgggtgtggtccgatgaccacaaggactttgactgcaatacacggcagcccggatgctccaatgtttgttttgacgagtttttccccgtgagtcacgtccggttgtgggctcttcagctgatcttggtgacgtgtccatccctactggtcgtgatgcacgttgcgtatagggaagtgcaggagaaacggcatagggaggctcacggagagaactctggacgcctgtacttgaatcctggcaaaaagcggggcgggctttggtggacatacgtgtgctccctcgtcttcaaggcttccgtggatattgcgtttctgtacgtatttcattcattctacccaaaatacatcctgccccctgtggtaaagtgccacgcagatccatgcccgaatattgtggactgcttcatttctaaaccgagtgaaaagaacatctttacgctatttatggtggcaactgccgccatttgtatcttactgaaccttgtggagctgatctacctagttagtaagcgctgtcacgaatgtctggccgccaggaaagcacaggcaatgtgcaccggccatcatccccacggaactacatcctcatgcaaacaggatgacctgctctcaggcgacttgattttcttagggtcagattcccatcctcccctcctgcctgaccgtccgcgggaccatgtgaaaaagaccatcctgtag

SEQ ID NO: 188954 - DNA, 786 bp, Artificial Sequence
  Description of Artificial Sequence: Synthetic coding sequence
atggactggggcaccctgcacaccttcatcggcggcgtgaacaagcatagcacctctatcgggaaggtgtggattaccgtaatatttatcttcagggttatgatcttagtggtggctgcccaggaagtatggggagatgaacaggaggactttgtctgtaatacccttcagcctggatgtaaaaatgtttgttacgaccacttcttcccggtgagtcacattcgtctctgggccctccagctgatcttcgtctctacgcccgctctcctcgtggctatgcacgttgcctactaccgccatgagactactcgaaagtttcgaaggggggagaagcgcaacgactttaaagacatcgaggatatcaagaagcaaaaagttaggatagagggctctttgtggtggacatatacgtccagcatattctttagaattatcttcgaggccgcattcatgtacgtcttttacttcctgtacaacggctaccacttaccatgggttctgaaatgcggaatcgatccctgccccaatttggtggattgttttatctctcgccctaccgagaagactgtgtttactatattcatgatctcagctagtgtgatctgcatgctcctcaacgtcgccgagctgtgctatctgttactaaaagtttgctttagacggtcaaaacgagctcagacccagaagaatcacccgaaccacgccctgaaggaaagcaaacaaaacgagatgaatgaactgatctcagactcaggacaaaacgctatcactggcttcccctcatag

SEQ ID NO: 188955 - DNA, 786 bp, Artificial Sequence
  Description of Artificial Sequence: Synthetic coding sequence
atggactggggcaccctgcacaccttcatcggcggcgtgaacaagcattctacatcaatcggaaaggtttggattaccgtcatcttcatttttagagtgatgattttggttgtggccgctcaggaggtctggggcgacgagcaggaggactttgtctgtaacaccctccagccaggttgtaagaacgtgtgttacgaccatttcttcccggtctctcatatacgactgtgggctctgcagctgatcttcgtgtccacccccgccctcctggttgctatgcatgtggcctattataggcacgagactacacgcaagtttcgacggggggagaaaaggaacgactttaaggacattgaggacatcaaaaagcagaaggtgaggatcgagggctcattgtggtggacatatacgtcatccatctttttccgtatcatcttcgaggccgcctttatgtatgtcttttacttcctgtacaatggatatcacttgccgtgggtgttaaagtgtggaatcgacccctgccccaatcttgtcgactgtttcatctcaagacccaccgaaaagacagtgtttacgatatttatgatctccgcatccgttatctgcatgcttctgaacgtggccgagctgtgttatctgttactaaaagtgtgctttcgcagaagtaagcgcgcccagacacagaaaaaccatccaaatcacgccttgaaagagagtaaacagaatgagatgaacgagttgatcagtgacagcggccagaacgccattactggtttcccctcctag

SEQ ID NO: 188956 - DNA, 786 bp, Artificial Sequence
  Description of Artificial Sequence: Synthetic coding sequence
atggactggggcaccctgcacaccttcatcggcggcgtgaacaagcatagtactagcatcggaaaagtctggatcacagtgatcttcatcttccgtgtgatgattttggtggtggcagcacaagaagtgtggggcgatgagcaggaagattttgtgtgcaacacactgcagcctggatgtaagaacgtttgttatgatcactttttccccgtgtcacacattcgcctttgggccttgcagttaatcttcgtgtctaccccagcactactggttgctatgcatgtggcctattaccgccatgaaaccacacgaaagtttaggcgcggggagaagaggaacgactttaaggacattgaggatataaagaaacaaaaggttcggattgaaggatcactctggtggacctacacctccagcatcttttttaggatcattttcgaggctgccttcatgtatgtgttttattttctctataatggttatcaccttccttgggtgctgaaatgtggaatcgacccctgtcctaatttggtcgactgctttattagcagaccgacagagaagactgtgttcacgatatttatgatctcagcttccgttatttgcatgctactgaacgttgccgagctatgttacttgctgttaaaagtttgctttaggagaagtaaacgtgcccagacccagaagaatcaccctaaccacgctttgaaggagagtaaacaaaatgaaatgaacgagttaattagtgacagcggtcagaacgctattacaggcttcccaagttag

SEQ ID NO: 188957 - DNA, 786 bp, Artificial Sequence
  Description of Artificial Sequence: Synthetic coding sequence
atggactggggcaccctgcacaccttcatcggcggcgtgaacaagcacagcacgtctatcgggaaagtctggattacagtaattttcatctttcgagtgatgatacttgtcgttgcagctcaagaggtgtggggggacgagcaagaagactttgtgtgcaatacactgcaaccaggatgcaagaacgtgtgttacgaccacttttttcctgtgtcccacattcgcctctgggcgcttcagctgatatttgtgtcaacccccgcgcttctcgttgccatgcacgtggcctactaccgtcacgaaaccacccgaaaattcagaaggggcgagaagaggaacgattttaaggatattgaggacatcaagaaacaaaaggtgcgtattgaaggatctctgtggtggacatatacatcgagtatattctttcggatcatttttgaggccgcctttatgtacgtgttctacttcctgtacaacggttatcatcttccatgggtgctgaaatgcggaattgatccttgtccgaatctggtcgattgcttcattagcagaccaacagagaagacagtgttcacaatcttcatgattagtgcctctgtcatctgcatgctcctaaatgtggccgagctctgttatttactgcttaaagtttgctttagaaggtctaaacgagcccagacacagaaaaaccatcccaaccacgccctcaaggagtccaagcaaaatgagatgaacgaactgatttctgactccggacaaaacgccataacaggttttccatcctag

SEQ ID NO: 188958 - DNA, 672 bp, Artificial Sequence
  Description of Artificial Sequence: Synthetic coding sequence
atgagctggatgttcctgcgggacctgctgagcggcgtgaacaagtattcaactgggacaggctggatctggctggcagtggtctttgtctttcgtctgttggtttacatggtggccgcggaacatgtttggaaggacgagcagaaggaatttgagtgtaactcaagacagcccggttgcaagaacgtctgtttcgatgacttcttccctatctcccaagtaagactctgggctttgcagctaattatggtgtctaccccctctctgctggtggtcttacatgtagcctaccacgaaggccgagagaagcggcataggaagaagctatatgtctctcccgggactatggacggtggactctggtatgcataccttatctcgctgattgtaaagactgggtttgaaatcggatttcttgtcctgttctacaagctgtacgacggtttttctgttccctacctgatcaagtgcgacttaaagccctgccccaacaccgttgactgcttcattagcaagcctacggagaagactatcttcattctttttctcgtgattacctcctgtttgtgtattgtgctcaatttcatcgaactgtcttttctggtgttaaaatgcttcataaaatgttgcctgcaaaagtatctgaagaaacctcaggtgctgtctgtctag

SEQ ID NO: 188959 - DNA, 492 bp, Artificial Sequence
  Description of Artificial Sequence: Synthetic coding sequence
atgagctggatgttcctgcgggacctgctgagcggcgtgaacaagtactctacagggacgggctggatctggctggctgttgtcttcgtgttcaggcttctggtgtacatggtggccgctgagcatgtgtggaaagatgaacagaaagagttcgaatgtaattctcgacagccaggttgtaaaaacgtctgttttgatgattttttccctatttctcaggtaaggctatgggcccttcagctgataatggtgtctacacccagtcttctagttgtacttcacgtggcctaccacgaaggccgggagaagaggcaccgtaagaagctgtatgtgagtcccgggacgatggatggggggttgtggtacgcctacttgatcagcctgatcgtgaagaccggcttcgagattggattcctggtccttttttataagctatacgatggttttagcgtcccctatttaatcaagtgcgatctgaagccatgcccatag

SEQ ID NO: 188960 - DNA, 672 bp, Artificial Sequence
  Description of Artificial Sequence: Synthetic coding sequence
atgagctggatgttcctgcgggacctgctgagcggcgtgaacaagtacagcacaggaaccgggtggatttggcttgcagtagttttcgtattccgcctactagtctacatggtggccgctgaacacgtttggaaggatgagcaaaaggagtttgaatgcaactctcgacagcctggctgtaaaaatgtatgttttgacgattttttcccaatttcccaggttcgcctatgggcactccaacttattatggtttcaactccatccctgctagtcgtccttcatgttgcctaccacgaaggtcgcgaaaagcggcaccggaaaaagctgtacgtgagtccaggaactatggatgggggactctggtacgcctacctaatctcactgattgtgaaaaccggattcgagatcgggttcctagtgctcttctacaaattatatgacggattttcagtgccctacctgataaaatgcgatctgaagccctgtcccaacacagtggattgtttcatcagcaagccgaccgagaagactatcttcattttattcttagtgatcaccagctgtctgtgcatcgtgctaaactttattgaactgagtttcctggttttaaagtgtttcatcaagtgttgtctccagaaatatctcaagaagccacaggtgctgagcgtgtag

SEQ ID NO: 188961 - DNA, 966 bp, Artificial Sequence
  Description of Artificial Sequence: Synthetic coding sequence
atgggcgagtggaccatcctggagcggctgctggaggccgccgtgcaacagcactcaaccatgatcggacgtatcttactgacggtggtcgtgatctttagaatactaattgttgccattgttggggaaactgtatatgatgacgaacaaactatgttcgtgtgtaatacattgcagcccgggtgtaaccaggcctgctatgatcgggctttccccatctcgcacatccgctactgggtgttccagatcatcatggtttgcacgccaagcctgtgtttcattacttactccgtgcatcagtctgctaagcagcgcgagaggcggtactcgactgtgtttttagcgctggatagggatccaccagagtcgatcggagggcctggtggaacagggggaggaggatccggaggaggcaaaagagaggacaagaagctgcagaatgccatcgtcaacggagtgttacagaataccgagaacacttccaaggagaccgaacctgactgtttggaagttaaagaactcacgccccatccctctggattgcgaactgcctctaagtccaaactgcgccggcaggaagggattagcaggttctacatcatccaagtcgtgtttcggaacgccttggaaataggatttctcgtgggccagtactttctgtacggttttagtgtccctggattgtatgagtgtaatcgctacccctgcatcaaagaggtcgagtgttacgtgtctcgcccaaccgagaagactgttttcctcgtgttcatgtttgctgtatctggcatctgtgtggtcctaaacctagctgaattgaatcacctgggctggagaaagattaagctcgccgtgcgaggagcacaagcgaagcgcaagtcgatctacgagatccgcaacaaggacctcccacgagtcagtgtgcctaactttggaagaacacagagctcagattctgcatacgtttag

SEQ ID NO: 188962 - DNA, 891 bp, Artificial Sequence
  Description of Artificial Sequence: Synthetic coding sequence
atgggcgagtgggccttcctgggcagcctgctggacgccgtgcagctgcaatcgccacttgttggaagactatggctggtcgtgatgctgattttccggatcctggtgttggcaaccgtaggcggggcagtgtttgaggacgagcaggaggagttcgtctgtaataccctccagcccggctgtcggcagacttgttatgatcgagctttcccagtgtcccattatcgcttctggctatttcacatcctgcttttaagcgcgcctcctgtgctgtttgtggtgtactcaatgcatagagctggaaaagaagcaggaggcgccgaggcagccgctcagtgtgcaccgggcctgccggaggcccagtgcgccccatgcgccttacgggcaagacgcgccagaagatgctacctgctaagtgtagcgctaaggctgcttgcggaattgacattccttggagggcaagcgctgttgtacggcttccgcgtggctccccactttgcctgcgcaggccccccctgcccccataccgtggattgcttcgtctcccgacctacagagaaaaccgttttcgtgttgttctattttgccgtggggttgctgtctgccctcctgtcagtagccgaactcggtcacctgctttggaaggggcggccgcgggctggggagcgggataaccggtgcaatagggcccacgaggaagctcagaaactactaccacccccccccccaccaccgcccattgtggtgacttgggaggagaaccggcatcttcagggggagggttcccctggcagcccacaccctaagactgaactggacgctcctcgcttcagacgcgaaagcacatctcccgcaggttggcactgttctcttcctttccacgggacttag

SEQ ID NO: 188963 - DNA, 1113 bp, Artificial Sequence
  Description of Artificial Sequence: Synthetic coding sequence
atggagggcgtggacctgctgggcttcctgatcatcaccctgaactgtaacgtcacaatggtgggcaaactctggtttgtgttgacgatgttgttgcggatgcttgtgatcgtgctagcaggtaggccggtctaccaggatgagcaggagagattcgtctgcaatacattgcagccgggctgcgctaatgtttgttacgatgtttttagccctgtgtcccatctgagattctggctgatacagggcgtttgtgttttgcttcctagtgctgtcttctcagtgtacgtgctgcatcggggggcaacactggctgctttgggcccaagaaggtgtcctgatccccgggagcccgcttccggccagcggaggtgtccccgccccttcggagagcgagggggcttgcaggtgcccgactttagtgccggatatatcattcacctcttgctccggacccttctcgaagcagcttttggcgcgttacattatttcctgtttgggttcctggctccaaagaaatttccatgcaccaggcctccatgtacaggagtggtcgattgctacgtatcaagacccacagagaagtctctcctcatgttgtttctttgggcagtatccgctctctctttcctgctcggattagccgatctggtgtgtagcctgaggcgtagaatgcgaaggcggcctggcccacccacatctccttctatccgcaaacagtccggcgcatcaggtcacgcagaaggtaggcgcaccgatgaggagggcggacgcgaggaggaaggcgctcctgcaccgcccggggcacgggcgggaggtgagggcgcaggatctcctagaagaacttctagagtgtcagggcacaccaagatacccgatgaggatgaatctgaggtcacttcctctgcgtccgaaaagctgggccgccagcctcgcggtagaccacacagagaggccgctcaggatccccgtggcagcggctccgaggaacagccatcggccgctccaagccgcttagccgctccaccttcctgctctagcctgcagccacctgatcctccggcgtcctcctcaggtgcaccccacctgcgagctaggaaaagcgagtgggtctag

SEQ ID NO: 188964 - DNA, 1191 bp, Artificial Sequence
  Description of Artificial Sequence: Synthetic coding sequence
atgagctggagcttcctgacccggctgctggaggagatccacaaccactccacctttgtagggaagatttggctgaccgttttgatagtctttcggatcgtgctgactgccgtgggtggagagtccatatattatgacgagcagagtaaatttgtgtgcaataccgaacagccgggttgtgaaaacgtctgctatgatgctttcgccccccttagccatgtccggttttgggtgtttcagatcatcctcgtagccactccatcagtgatgtatcttggttatgctattcacaagattgcaaagatggagcatggggaggcagacaagaaagcagctaggagtaagccttacgcaatgcggtggaaacagcaccgggccctcgaggaaaccgaggaggataacgaggaggatccaatgatgtatcccgaaatggagcttgagagcgacaaggagaataaggagcagtctcaacctaagccaaagcatgacggacgcaggaggatccgcgaggacgggcttatgaaaatctacgtactgcagcttctcgctagaaccgtgtttgaggttggttttcttataggacaatactttttgtacggttttcaggtgcacccattctacgtctgtagtcgcctgccctgccctcataaaatcgactgcttcatctcacgaccaactgagaagaccatctttttgttgatcatgtacggagtgaccggcctctgcctgctgctcaatatttgggaaatgttgcacctcggtttcggcacaatccgcgacagcctcaattcaaagcgaagagagctcgaggatccaggcgcatacaattatcccttcacatggaatacccctagcgccccaccaggctacaacatcgcggtgaagcctgaccagatacaatacacggagctgtccaacgcaaaaatcgcctacaagcagaataaagctaacaccgcccaagagcagcagtacggatctcacgaggagaacctcccagctgaccttgaggccttacaaagggaaatccggatggcccaggagcgcttggacttagcagtgcaggcgtactcccaccagaacaatccccacggcccaagagagaagaaggccaaggtgggctccaaggccggctctaacaaaagtacggccagttctaaaagcggcgacgggaaaacgtctgtttggatctag

SEQ ID NO: 188965 - DNA, 1191 bp, Artificial Sequence
  Description of Artificial Sequence: Synthetic coding sequence
atgagctggagcttcctgacccggctgctggaggagatccacaaccactccacatttgtggggaagatttggctaaccgtgttgatcgtgttccgcatagtgctgacagcagtgggaggtgaatccatttactatgacgagcaatcgaagttcgtgtgcaataccgagcagcctgggtgtgaaaatgtctgctatgacgcattcgccccattgagtcacgtgagattttgggtattccagataattctcgttgctacgcccagtgtcatgtatctggggtatgcaatccacaagatcgccaagatggaacacggagaagccgataagaaagccgctcgcagcaagccgtatgctatgcggtggaagcagcaccgggcactggaggaaactgaagaagacaacgaagaggatccgatgatgtaccccgaaatggagcttgagagcgacaaggagaacaaggagcagtctcagcctaagcctaaacacgacggtcggaggagaatcagagaggatggccttatgaaaatctacgtgttgcagctgttagcacgaactgttttcgaggttggctttttaatcgggcaatatttcttgtacgggttccaagtccacccgttctatgtttgcagcagactgccatgtccccacaaaattgactgtttcattagcagacctaccgaaaaaaccatcttcctattgataatgtatggtgtgaccggattatgtttgttactcaatatttgggagatgctgcacctcgggttcggcaccattagagactcactcaacagtaaacgccgcgaacttgaggatcccggcgcctacaattacccctttacatggaatacaccaagcgctcctcccgggtacaatatcgcggttaagcctgaccagattcaatacaccgaactttctaatgccaagatcgcctataagcaaaacaaggccaacacagctcaggagcagcagtacggatcccatgaggaaaacctacctgcagatctcgaagccctgcagcgggagatccgcatggctcaggagcggctggatctcgctgtgcaggcttacagccaccagaataatcctcacggcccaagagaaaaaaaggctaaggtcgggagtaaggccggatctaataagagcactgcctcgagtaagtctggcgatggcaaaacatccgtgtggatctag

SEQ ID NO: 188966 - DNA, 1320 bp, Artificial Sequence
  Description of Artificial Sequence: Synthetic coding sequence
atgaccaacatgagctggagcttcctgacccggctgctggaggagattcataatcactctaccttcgttggaaaagtgtggctcactgtgctcgtcgtcttcagaatcgtgctgaccgcagtcggaggggaggcaatttattcagacgaacaggcaaagtttacctgcaacacccgccagccgggctgcgacaatgtttgttatgacgcttttgcccccctgtcccatgtgagattctgggtctttcagatagttgtgatctcaacacctagcgtgatgtacttgggctatgccgtacaccggctcgccagagctagcgaacaggaacgtcggcgggccttgagacgaaggcctggcccaaggcgagcgccacgtgctcaccttccccctccccacgccggatggcccgaacccgccgacctgggagaagaagagccgatgctgggcctgggcgaggaggaggaagaggaagaaacaggagctgccgaaggggccggcgaggaggccgaagaggctggtgccgaagaggcttgtaccaaagccgttggggccgatggaaaagccgctggaacacccggcccaactgggcagcatgacgggcgccgacgcatacaaagagagggattgatgagggtttacgtggctcagctggtggcccgagccgcttttgaggtcgcctttttggtcggccagtatctgttgtacggctttgaagtgcggcctttctttccgtgttcgcgccagccctgcccgcacgtcgtggattgtttcgtctcacggccaaccgagaaaacagtcttcttattagtaatgtacgtcgtgtcgtgtctttgcctgcttctgaacttgtgcgaaatggcccacctgggtcttgggtctgcccaggatgctgtgcgcgggcggcgcggacctcccgccagtgcacctgcacccgctcctcgaccgccaccttgtgcctttcctgccgccgcagcaggcctggcttgccccccagactacagcttagtggtccgggccgcagaacgggccagggctcacgatcagaacctggccaaccttgccctgcaggcactgagagacggcgctgccgccggcgatcgggatcgggattcaagcccatgtgtgggcctgccggccgcatctagggggccccctcgggctggggctcctgccagccgaactgggtcagccacgagcgctgggacagttggggagcagggccgacccgggacgcacgaaagacccggcgccaaacctcgcgccggctcagagaagggcagtgcctcctcccgggacggcaagacaacagtttggatatag

SEQ ID NO: 188967 - DNA, 840 bp, Artificial Sequence
  Description of Artificial Sequence: Synthetic coding sequence
atgtgcggccggttcctgcggcggctgctggccgaggagagccggcgatctaccccagtaggtaggctgcttcttcctgtgttattgggatttagactggtgctgctcgctgcaagcggtcccggcgtgtacggtgatgaacagtccgaatttgtgtgccacacccagcagcccggctgcaaggccgcttgcttcgacgcttttcacccccttagtcccctcaggttctgggtgttccaggttattctcgttgccgtgccgtccgctctctacatgggcttcacactgtaccacgtaatttggcactgggagctgtccggcaaagggaaagaggaggaaaccctcattcagggccgcgaagggaacacagacgtaccgggcgcgggatctctgagactgctgtgggcttacgtggcccagttaggtgccagattggtgctggagggtgcagctttggggctgcagtaccacctgtatgggttccaaatgccaagcagttttgcttgtcgccgggagccttgtctgggcagcattacgtgcaatctgagtcgaccctccgagaagacaatcttcctgaaaaccatgttcggagtgtcgggcttctgtctgctgtttacgtttctggagcttgtgttattgggcctcggcagatggtggcggacctggaagcataaatcaagttcttccaagtattttctgacgagtgaaagcactaggaggcacaagaaggccaccgatagtttgcccgtagtagagacaaaggagcagttccaggaggcagtgccaggccgatccctcgcccaggagaaacagaggccagttggcccacgggacgcttag

SEQ ID NO: 188968 - DNA, 1338 bp, Artificial Sequence
  Description of Artificial Sequence: Synthetic coding sequence
atgaccatgttcgagaacgtgacccgggccctggcccggcagctgaacccgagaggagacctcacccctctggattcactgatcgatttcaagagattccacccattttgtcttgttctccgcaagaggaagtcaaccttattctggggggccaggtatgtgaggacagattacacattgctcgacgtgttggagcccgggagttctccctcagatccaaccgataccggaaatttcggatttaagaacatgctagatactagagtggagggggatgtggatgtgccaaaaaccgtcaaagtcaaaggcacagctggtcttagtcagaatagtacattggaggtgcagacacttagcgtggccccaaaggctcttgagacagtccaagaacgaaaattggcggctgaccacccattcctcaaggagatgcaggatcagggagagaacttatacgtcgtcatggaggttgtcgagactgtgcaagaggtcactcttgagagggcgggcaaagcagaggcttgcttcagtcttcccttctttgctcccctcgggctccagggaagtattaatcataaagaagccgtgactatcccgaagggctgtgttctcgcatttagggttagacagctgatggtgaagggtaaggatgagtgggacatcccccacatctgtaacgacaatatgcagacatttccacctggggaaaaatctggagaggagaaggttattttgatccaggcatctgacgtcggtgacgtgcacgagggtttcagaaccttaaaggaagaagtccaaagggaaacgcaacaagtcgagaaactgagtcgcgtcggacaatcttccttgttgtcctctcttagcaaacttctcggaaagaaaaaggagctacaggacctggaattggccttagaaggggccctggacaaaggccatgaggtcacattggaggccctccctaaagacgttctgctgtccaaggaagccgtaggcgccatcctctactttgtgggggccttgacagagttatccgaagcccagcagaagcttctggtaaagagcatggagaagaagattctcccagttcagctgaaactggtggagagcactatggaacagaatttcctgctggataaggagggggtgtttccccttcagccagaattactctcatccctcggggatgaggagctaacactaaccgaagcccttgtgggactctcagggttagaagtgcagaggagcggccctcaatacatgtgggatccagatacactcccaagactgtgtgctttgtatgctggactttcattgctacaacaattgaccaaggccagttag

SEQ ID NO: 188969 - DNA, 1212 bp, Artificial Sequence
  Description of Artificial Sequence: Synthetic coding sequence
atgttcagcgtgttcgaggagatcacccggatcgtggtgaaggagatggacgccgggggagatatgatagccgtgcgctccctggtggacgcagataggtttcggtgcttccacctggtgggcgagaaacgcacttttttcggctgtcgacattatacaacaggcttgacattgatggatatcctggacactgatggtgacaaatggctcgacgaactcgactcaggtttacagggccaaaaagcggagttccagatacttgacaacgtggactcaaccggggaactgatcgtcagactgcctaaggagatcaccattagtgggagctttcagggctttcatcatcagaaaattaaaatttcggaaaacagaattagccagcagtatctcgccactctggaaaatcggaagctcaagcgggaactcccattctccttccgaagcattaacacccgggagaacctctatttggtgactgagacgctggaaactgtgaaggaggagaccctgaaaagtgacagacaatataaattttggagccagatcagccaaggccatctgagctataaacacaaagggcaacgggaagtaacgataccccccaaccgagttctctcttatagggtaaaacaactggtcttccccaataaggaaactatgaagaaggatggtgcttctagctgcttaggcaagtcattgggctcagaggacagtcgcaatatgaaggagaagctggaagatatggaatctgtgctgaaggacctgacagaggagaaaagaaaagacgtgcttaattctctcgccaaatgcctgggcaaggaggatatcagacaggacttggagcaacgggtgagcgaggtcttgatctccggtgagcttcacatggaagaccctgataagccactgctgtctagtttgtttaacgccgcaggcgtcctggtcgaagcccgtgctaaagctatcttggactttttagatgcactacttgaactgtccgaagagcaacagtttgtagcggaggccttggagaagggaacactcccgttacttaaagatcaagtgaagtccgtgatggaacagaattgggacgagctcgcaagctcccccccagatatggattacgatcctgaagcgaggattttgtgtgccctctacgttgtagttagcatactcctggagctggctgaaggtcccacatcagtctcatcgtag

SEQ ID NO: 188970 - DNA, 1236 bp, Artificial Sequence
  Description of Artificial Sequence: Synthetic coding sequence
atgttcagcgtgttcgaggagatcacccggatcgtggtgaaggagatggacgctggtggtgacatgatcgcggttcggtctctcgtggacgcggaccggtttcggtgcttccatttggtgggggagaagcggaccttttttggctgtcggcactatacaaccggcctcacactcatggacatcttagatacagacggggataagtggcttgacgagttagactctggcttacagggacagaaagccgaatttcaaatcctggataacgtggatagcacaggagagctgattgtgcgccttcccaaggaaatcactattagcggttcctttcagggctttcaccaccaaaagatcaagatctccgagaaccggatctctcagcaatacctggctactctggagaatcggaagctcaaacgcgagctgccattcagtttccgatcgattaatacacgggaaaatttgtacctggtcactgaaaccctggagacagtgaaggaagaaacgctgaagtcagatcggcagtataagttttggagccagataagtcaggggcacctgagctataaacacaaggggcagcgtgaggttactattcccccaaacagggtcctttcataccgggtgaagcagctggttttccccaataaagagacaatgtcagctggcctggatatccacttcagaggaaaaactaagtctttccccgaaggaaaaagcctgggctcagaggacagtcgaaacatgaaagagaaactcgaagatatggagtcagtcttgaaggaccttactgaggaaaaacgaaaggatgttctcaacagcctcgccaagtgcctcgggaaagaggatatcaggcaggatctggagcagcgcgtgtctgaggtgctaatctccggcgagctccacatggaagacccagataagccactcttgtcatctctgtttaatgcggcaggggtccttgtggaggccagggccaaggcgatcctggatttcctcgacgctcttcttgagctcagcgaagaacagcaatttgtcgcagaagcattagaaaaaggcactctccctctgctcaaggaccaggtcaaaagtgtgatggagcagaactgggacgagttggccagcagcccccccgacatggactacgatcccgaggcccggattctctgcgccctgtatgtggtagtaagcatcctcctggagctagccgaagggccaacctcagtgtcttcatag

SEQ ID NO: 188971 - DNA, 1185 bp, Artificial Sequence
  Description of Artificial Sequence: Synthetic coding sequence
atgttcagcgtgttcgaggagatcacccggatcgtggtgaaggagatggacgccggaggggacatgattgcagtgaggtctctcgttgacgccgatcgattccgctgcttccatttggtgggtgagaagcgtacattctttggctgcagacactataccaccggtctgactctaatggacatcctcgatacagatggggacaaatggctggacgagttggactcggggttacagggtcagaaagccgagttccagattttagataacgtcgattctactggcgagctcattgtgcggctccctaaagaaattacgatcagcggaagtttccagggctttcaccatcagaagatcaaaattagcgagaaccggatctcgcagcagtatctggcaaccctcgaaaataggaagctgaagcgtgagttaccatttagttttcgcagcatcaacactcgcgagaacctttacctggtaacggagacattggagacagtgaaagaggaaactctgaaaagcgatcggcagtacaagttttggtcccagatatctcagggacatctgtcatacaaacataaggggcaaagggaagtcactataccccctaacagggtgctctcttaccgggtcaaacagctggtatttcccaacaaggagacgatgaggaaatccctcgggtctgaagattctcgaaacatgaaagaaaagcttgaagatatggagtcggtcttgaaagatctcaccgaggaaaagagaaaggacgtcctcaactctttagccaagtgtctgggaaaggaggacatccgacaagatctggagcaacgagtgtcagaagtgctcatcagtggggaactgcacatggaggaccccgataagcctctactgtcatccttgtttaatgccgctggtgtgctggtggaggccagagctaaggctatcctcgatttcctcgatgctcttctcgaactgagcgaggagcaacaattcgtggccgaggcactcgaaaagggtaccctgcccttgctcaaggatcaggtcaaatctgtgatggagcagaactgggatgagctagcctcctctccaccagacatggactatgatcctgaagctcgcatcctctgcgctctatacgtggtcgttagcatactcctggaacttgcagagggaccaaccagcgtctcaagctag

SEQ ID NO: 188972 - DNA, 1236 bp, Artificial Sequence
  Description of Artificial Sequence: Synthetic coding sequence
atgttcagcgtgttcgaggagatcacccggatcgtggtgaaggagatggatgcaggaggcgatatgatcgcggtccggtctctggtagacgcagaccgttttcggtgcttccacctagtgggggagaagcggaccttctttggatgtaggcattacaccacagggttgaccctgatggacatcctcgatacagatggggataagtggttagacgaactcgacagcggcctgcaggggcaaaaagctgagtttcaaatactggacaatgtggactctacaggagagctcatcgtcaggctgccaaaggaaatcacgatttccggcagttttcaggggttccaccatcagaaaataaaaatttctgaaaataggatctctcaacagtatctggctaccctggaaaatcgcaagctgaagcgagaactccccttctcattccgcagtattaataccagagaaaacctgtaccttgtgactgaaacactcgaaaccgtgaaggaagagaccctcaaaagtgataggcagtacaagttctggtcgcaaataagccagggccatttaagctacaaacataaggggcagagagaagtaacaattccacctaatagggttctgtcttaccgggtcaagcagctagtctttcccaataaggagaccatgtcagctggattggatattcacttccgcggcaaaacaaagtccttcccagagggcaaatccttgggatcagaagactcaaggaacatgaaggagaagctggaggacatggagagtgtcctgaaagatctaacggaggaaaagcggaaggatgttttgaatagcctcgccaaatgtctgggcaaagaggacatccgccaggacctagagcagcgggtaagtgaggtgctgatttccggcgagctccacatggaagatccggataaaccgctcttatcctcactgtttaatgctgcaggcgtgttagtggaagcaagagctaaggctatcctcgatttcctggatgcactgcttgaactgtctgaagaacagcagttcgtcgctgaagcccttgagaagggtaccctgcccctcctcaaggaccaagtgaaatcagtgatggagcagaactgggatgagctggcaagttccccacccgacatggactatgatcctgaggcgcgaattctgtgcgccctttacgtggtcgtgagcattctcctggagctggcagagggaccaacaagcgtgagctcatag

SEQ ID NO: 188973 - DNA, 1251 bp, Artificial Sequence
  Description of Artificial Sequence: Synthetic coding sequence
atgttcagcgtgttcgaggagatcacccggatcgtggtgaaggagatggatgccgggggagatatgatcgccgtcaggtccctggtagatgccgatcgtttcaggtgtttccatctggtgggggaaaaacgcacatttttcggctgtcggcactacaccaccgggcttacattgatggacatcctcgatactgacggtgataagtggctggacgagctggatagcggtctgcaggggcagaaagcggagttccagatcctggacaatgtcgacagcacaggtgaactgatagtgaggctgcctaaagaaattactatctctggaagcttccagggattccatcatcagaagatcaagatctccgagaatcggatctcccagcagtaccttgctaccttggagaaccgtaagctgaagagggagctgcccttctctttcaggtcaattaatacacgagagaatctctacctggtaacagaaaccttggagactgtcaaggaagagacactaaaaagtgacaggcagtacaaattctggtctcaaatctcccaagggcatctgtcttataaacataagggccagagggaggtgacaatcccccccaatagggtcctttcttatcgggtgaagcagcttgtcttccccaataaggagactatgaacattcactttcgtgggaagactaagagcttccctgaagaaaaggacggggcctcctcatgtttgggaaaatccctgggatcggaagatagcagaaacatgaaagagaaactggaggatatggaaagtgtcctaaaggatctgacagaggaaaaacgcaaggacgtgctcaattccttggcaaagtgtctcgggaaagaagacatccgccaggacctcgagcagagagtctcggaagttcttatcagcggcgaacttcacatggaagatccagataagcctttattatctagcctcttcaacgcggcgggcgtccttgtagaggcccgggccaaagcgatccttgacttccttgacgcactgctggagctctctgaggaacaacaatttgtggctgaagccttagaaaagggaacactccccctgctgaaagatcaagtaaaaagcgtcatggagcaaaactgggacgagctcgcctccagccccccagacatggattacgacccagaagctcggatattgtgtgctttgtacgttgtggtctccattctgttagaacttgccgaaggacctacatctgttagtagttag

SEQ ID NO: 188974 - DNA, 1047 bp, Artificial Sequence
  Description of Artificial Sequence: Synthetic coding sequence
tgactggacgagctggacagcggcctgcagggccagaaggccgagttccagattctggataacgtcgactcaactggcgagctcattgttaggctccccaaggagatcactatctccgggagcttccagggctttcaccaccaaaagatcaaaatttctgagaacagaatctcccagcagtatctggctacactcgagaacaggaaactgaagagagagctacccttcagctttcggtccattaacaccagggaaaacctttatctggtgacggagacacttgagacagttaaagaagagacactaaagagcgaccgtcagtacaagttttggtcacagatttctcaagggcacctctcttacaagcacaagggacagcgggaagttactatccctccaaatcgcgtactctcttatcgggtcaagcagctcgtgtttcccaacaaggaaactatgaacatccacttcaggggaaagacaaaatccttccccgaagaaaaggacggagcatcatcttgtctgggaaaaagcttgggaagcgaagattctaggaacatgaaagaaaagttagaggatatggagagcgtgttaaaggacctgacggaagaaaagcggaaagacgtcctgaacagtctggcaaaatgcctcgggaaagaagacattcgacaggacttggaacagcgggtttctgaggttctgatttccggcgaactgcacatggaggatcccgacaagcctcttcttagctcgctctttaacgctgctggagtcctggtcgaagcgagggctaaggcgatcttggactttctagacgcactgctcgaactgtccgaagagcagcaatttgtggcggaggcgctggagaaaggaactctgcccttacttaaagatcaagtgaaatctgtgatggagcagaactgggacgaactggcctcctcacctcctgatatggactatgaccccgaagcacgaattctgtgcgccctgtacgtcgtcgtctcaatcttacttgaacttgcagaaggacctacctcagttagctcttag

SEQ ID NO: 188975 - DNA, 1224 bp, Artificial Sequence
  Description of Artificial Sequence: Synthetic coding sequence
atgttcagcgtgttcgaggagatcacccggatcgtggtgaaggagatggatgcggggggagacatgatcgcagtgcgatccctggtcgacgctgatagatttagatgtttccatctcgttggagagaagcgaacattcttcgggtgtaggcattacacaacaggccttacactgatggacatcctggacacagatggagataaatggctggatgaacttgactcaggcctccaggggcaaaaggctgagttccaaatcttggataatgtcgattccaccggggagctcatcgtgcggttgccaaaggagattaccatatccggatctttccagggatttcaccaccagaagattaagatctcggagaatcgaatttcacagcagtatctggctaccctggaaaaccgcaaattgaagagggaactcccattcagttttcggtcaatcaacactagagagaacctgtaccttgtgaccgagacgctggagacggttaaggaggagacactgaagtccgatcgacaatataagttctggagccagatcagtcagggccacctttcttataaacataaggggcaaagggaggtgaccatccctcctaatcgcgtgcttagctatagagttaaacagctggtcttccctaataaggaaactatgaacatacattttaggggcaagactaaaagctttccagagggaaagagtttaggaagtgaagatagccggaatatgaaggaaaaattggaggatatggaatcagtactgaaggaccttaccgaggaaaaaaggaaagacgttctgaattccctggccaaatgtttgggaaaagaggacataagacaagacctggagcaacgagttagcgaggtgctgatctcaggagagcttcacatggaggatcccgacaaacctctgttaagcagcctcttcaacgccgccggcgtcttagtggaggcacgcgcaaaagctatcctggattttttggatgccttgcttgagctgtctgaagaacaacagtttgtcgcagaggctttggagaagggtactctccccttgctgaaggatcaggttaagtccgtcatggagcagaactgggatgaactggccagtagcccacctgatatggattatgatcccgaagcccgaatattgtgcgctctgtatgttgtggttagcattctcttagaactagccgaggggccaacttccgtgagcagttag

SEQ ID NO: 188976 - DNA, 1527 bp, Artificial Sequence
  Description of Artificial Sequence: Synthetic coding sequence
atgcccagcatgctggagcggatcagcaagaacctggtgaaggagatcggctcaaaggacttgaccccggttaagtacctgttatccgcaaccaaactaagacaattcgtgatactccggaagaagaaggactccagatcaagcttctgggaacagagcgactacgtgccggtcgaatttagcctcaatgatattctggagccaagtagtagtgtactggagactgtggtgacaggcccttttcacttttccgacataatgattcagaagcacaaggctgacatgggggttaacgtcggcattgaagtgagtgtgtcgggggaagcctcagtcgatcacggctgcagcctggaattccagatagtgactatcccatcacctaacctggaagactttcaaaaacggaagctcctggatccagagccatcattcctgaaggaatgtcgacgcaggggtgacaacctgtacgtcgtcaccgaagctgtcgagctgatcaacaacacagtgctgtatgacagtagctctgtgaatattttgggcaaaatcgctctctggatcacatatggcaaagggcagggacagggtgaatctctgcgggttaagaagaaggcgctgacgctgcaaaaaggcatggttatggcttataaaaggaaacaacttgtaataaaggagaaagcgatactgatttcggacgacgacgaacaaaggacctttcaggatgaatacgaaatcagcgaaatggttgggtattgcgctgccagatccgaaggcctccttccatccttccatacgatttcccccaccctgtttaatgctagttcaaatgatatgaaactgaagccggagctgtttctgacacagcagttcctgagcggacacctgcctaaatatgagcaggtgcatatactgccggttggacggatcgaggagcctttttggcagaatttcaaacacctgcaagaagaggtcttccagaagatcaaaaccttggcccagctgagcaaagatgtgcaggatgtgatgttctactccattctcgccatgctgcgtgataggggcgctctccaggatctgatgaatatgctggagcttgactcctctggccatctggatggccccggcggggctattctgaaaaaactgcagcaagattccaaccacgcgtggttcaatcccaaagaccccatcctgtacctcttggaggctatcatggtcttatctgacttccagcacgatcttctcgcatgtagcatggagaaacgtattttactgcaacagcaagagttggtgcggtcaatactcgagccaaacttccgttatccctggtccataccatttacactgaagccagagttgctggcgcctctgcaaagcgaggggttagccatcacatacggcctgcttgaggagtgtggtctgaggatggaactggataacccgagatctacatgggatgtggaggcaaagatgccactcagtgccctgtatggcacattgtcactgctccagcagctggctgaggcttag

SEQ ID NO: 188977 - DNA, 462 bp, Artificial Sequence
  Description of Artificial Sequence: Synthetic coding sequence
atggtggccaccaagaccttcgccctgctgctgctgagcctgttcctcgctgtaggtttaggggagaagaaggagggacacttctccgcactgcccagcctcccggtgggaagtcacgcaaaagtgagcagcccgcagcccaggggaccaaggtatgccgaggggacttttatcagcgattatagcatcgccatggacaaaattcaccagcaggatttcgttaactggttgctagcacagaagggcaagaaaaatgactggaagcacaacatcacacagcgcgaggcacgggccttagaactggctagccaagccaatcgaaaagaggaagaagctgtagagccgcagtccagccccgctaagaatcccagcgacgaggaccttctaagagacctcctaattcaggaactgttggcatgtttacttgaccagacgaacctctgcagattgcggtctagatag

SEQ ID NO: 188978 - DNA, 1401 bp, Artificial Sequence
  Description of Artificial Sequence: Synthetic coding sequence
atgaccaccagccccatcctgcagctgctgctgcggctgagcctgtgtggtctgctattgcagcgtgccgagactggcagtaagggtcagaccgcaggcgaactgtatcagaggtgggagaggtatagaagagaatgccaggagacactggctgccgcggaacccccttccggattggcgtgtaacggatccttcgacatgtatgtttgctgggactatgcagctccaaatgctaccgcgagggcgagttgtccatggtacctgccctggcaccaccatgtagcagctggctttgtcttgagacaatgcggatctgacggtcagtggggactgtggagagatcatacacagtgtgagaaccccgagaagaatgaggcctttctcgaccaacgactgatactagaaaggttgcaggtgatgtacaccgtgggttacagcttgagtcttgctaccctactactggcattattaatcctctctttgtttaggcgcctgcactgcaccaggaattacatccatattaacttattcacttctttcatgctcagggcagcggctatcctatcaagggaccgccttctacctaggccagggccttatctcggtgaccaagccttagccctgtggaaccaggcactggctgcctgtaggacagctcagatcgttacacaatactgcgtaggggccaactacacctggttactggtggagggtgtctacctgcatagcctcctggttctagttggtgggtctgaagagggacatttccgctactatctcttactcggatggggcgcccctgccttgttcgtcatcccttgggtgatagtgcggtatctgtacgagaatactcagtgttgggagcggaacgaggtcaaggccatctggtggatcatcagaactccaattctcatgacaatcttgattaacttcctgatctttatcagaattctagggattcttctctcgaagctgagaacacggcagatgagatgtcgcgattaccgcctccggttggcgcggagtacactgaccctcgtaccccttttaggagtgcacgaggtggttttcgcccccgttaccgaggagcaggcacggggggcacttagatttgccaagctcggcttcgagatatttctgtcttcattccaggggttcttagtgtccgttctctactgtttcattaataaggaagtgcagtcagagatccgaagagggtggcaccactgtcgtttacggcgctccctgggagaggaacagcggcaactccccgaacgggcattccgcgcccttccatcaggaagtggccccggggaagtgccaacttctcgcggactctctagcgggaccctacccggaccgggtaacgaggcttcacgcgaactggagtcctactgttag

SEQ ID NO: 188979 - DNA, 1293 bp, Artificial Sequence
  Description of Artificial Sequence: Synthetic coding sequence
atgaccaccagccccatcctgcagctgctgctgcggctgagcctgtgcgggctgctcctgcaaagggctgaaaccggatcgaaggggcaaaccgctggggagttataccagcgctgggagcgatataggcgcgaatgccaggagacactagccgccgcagagcctcctagcgtggcggctgggtttgttctgcggcaatgcggcagcgacggacagtggggcttgtggagagaccacacccagtgcgagaaccctgagaaaaacgaggctttcctggatcagaggctgatccttgagcggctgcaggtgatgtataccgtgggctactcactctctctggctaccttgttgttggcccttttgatcctgagcctgttccgccgcctgcactgcaccaggaactacatacatatcaacctgtttacatcatttatgctacgtgccgccgccatcctgtctagggaccggttgctaccacgaccaggcccttacttaggcgaccaagccctggccctctggaaccaggctctggccgcctgtcgcacggctcagatcgtcactcagtactgcgtgggagctaactacacctggttgctcgtggaaggcgtgtacctgcattccttactggttcttgtcggcgggtctgaggaagggcactttcgctactatctgctcctaggctggggggcaccagccttattcgttatcccttgggtgattgtgcggtacctatatgagaacacacagtgttgggaaagaaacgaagtcaaagcaatatggtggatcatacgaactcccattctaatgaccatcctcataaacttcttgatcttcatcagaattctcggtatccttctgtccaagctgaggacccggcagatgcgatgcagagactatagactgcggttggcacgctcaacgctgaccttagtgccgttgctgggagttcacgaagttgtattcgcaccagtgaccgaagagcaggccagaggcgcacttagatttgccaagctgggcttcgagatattcttatctagtttccaggggttcctggtcagcgtactctattgttttatcaacaaggaagttcagagtgaaattcggcgcggatggcatcattgtcggctccggcgtagcctcggcgaggagcagcgacagctccccgagcgtgcctttagggctctgcctagcggaagtggtcctggcgaggttcccaccagcagaggcctgtcctctgggacactgccgggtccaggaaacgaggcctcacgtgaactggagagctattgttag

SEQ ID NO: 188980 - DNA, 1401 bp, Artificial Sequence
  Description of Artificial Sequence: Synthetic coding sequence
atgaccaccagccccatcctgcagctgctgctgcggctgagcctgtgtggcctgctcctccagcgggctgagaccggaagtaaggggcagacagctggagaactgtaccagcggtgggagaggtaccgacgcgaatgtcaagagactcttgctgccgccgagccgccgagcggcctggcttgcaacggaagctttgatatgtacgtgtgctgggattacgccgcgcccaatgccacagcccgcgcttcttgcccctggtatttgccctggcaccaccatgttgcagcaggcttcgtgctccgccagtgcggcagcgacggacagtggggtctctggagagatcacacccagtgcgaaaatcccgagaaaaatgaggctttcctagatcagagactgattctcgagcggcttcaggtgatgtacaccgtggggtacagcctttccctcgcgaccctgctcttggccctgctcatactgagcctatttaggcgcctccattgtactcgtaactatatccacatcaatctgtttacatctttcatgctgcgcgctgctgccatcctgtcacgagacaggcttctgccacgtccaggtccttacttaggcgaccaagcactcgccttgtggaatcaggcgttagcagcctgccgtactgcgcagatagtgactcagtattgtgtgggtgccaactacacatggctgctagtggaaggcgtttacttgcactccctcctcgtacttgtgggaggtagcgaggagggtcatttcaggtactacctactcctcggatggggggcccccgctctgtttgttatcccgtgggttatcgtgcgttacctctatgaaaatacccagtgctgggagcggaacgaggtgaaagctatctggtggattattcgcacaccaattttaatgaccattctcatcaactttcttatttttatccgcatcctgggcatcctgctgtctaagttgcgtaccaggcaaatgcgctgtagggactataggctgcggctcgctaggagcacactgactttggtgcctctgctgggtgttcatgaagttgtgttcgcccctgtcaccgaagagcaggccaggggggccctgcggttcgccaaattaggctttgagatatttctgagtagctttcagggtttcctggtgtccgttctgtactgctttataaataaggaggttcaatctgaaatccgccgtggatggcaccactgtaggctgaggcgaagtcttggggaagaacagcggcagctccccgaacgtgcattcagagccttgccttctggatctggccctggggaggtccccacctctcgtggcctgtcctccggcaccctccccggcccgggcaatgaagccagccgggaactggagtcatattgctag

SEQ ID NO: 188981 - DNA, 1254 bp, Artificial Sequence
  Description of Artificial Sequence: Synthetic coding sequence
atggcctggttcgccctgtacctgctgagcctgctgtgggccaccgctgggacatcaacgcagacccagtcatcctgctcagtgccctccgcccaagagcccttagtgaacggaatccaggtcctaatggagaattcagttactagttccgcttacccgaacccatccatcctgatagccatgaacctggccggagcatataaccttaaagcccagaaactgctcacataccagttaatgagctcggataacaacgatctgactataggccagctcggtctgacgattatggccctcacctcttcatgtcgggaccccggggataaagttagtatcttgcagaggcagatggagaactgggccccctcctcccccaacgctgaggccagtgctttctatggcccatccctggcgatcctcgccctgtgtcagaagaactccgaggccacattgcctattgccgtaagatttgccaagacactgcttgctaatagctccccattcaatgtcgatactggagccatggccaccctagctctgacttgtatgtacaataaaattccggtgggcagcgaggaagggtatcggtccctgttcgggcaagttctcaaggatatcgtggagaaaatcagtatgaagatcaaggacaatggaatcattggagacatatacagcactggcctggccatgcaggctctatcagtgactccagagccctccaaaaaagagtggaattgtaaaaagactacggacatgatcttgaacgagataaaacaaggtaaattccacaatccaatgagcattgcacagatcctaccgagcctgaagggcaagacttaccttgacgtaccgcaggtgacttgtagtcccgaccacgaagtacagccgactctcccgagcaaccctggtcctggcccaacctctgcttcaaacataaccgtcatttacaccattaataatcagctcaggggggtggagctgctgttcaacgagacaatcaatgtgtcagtaaagagcggctctgttctccttgttgtgctggaggaggcccaaagaaaaaaccctatgtttaagtttgagacaactatgacctcatggggcctggtggtgagtagtattaataacattgctgagaatgtcaaccataagacatactggcagttcctttctggggtgacacctctaaatgagggggtggcagattacatcccttttaatcatgaacacatcacagccaatttcacccagtactag

SEQ ID NO: 188982 - DNA, 1179 bp, Artificial Sequence
  Description of Artificial Sequence: Synthetic coding sequence
atggccgtgcccagcgcccaggagcccctggtgaacggcatccaggtcctcatggaaaacagtgtcaccagctcagcctatcctaacccgagtatcttaatcgctatgaatctagctggtgcatataacttaaaggcccagaagctcttgacctaccagttgatgtcgtcggataataatgatctcaccattggccagctggggctgactatcatggcccttactagtagttgccgggatcctggcgataaagtatccattctccagaggcagatggaaaattgggccccatcttcccctaatgccgaggcatccgcgttctatggcccatccctggcaatactggccctgtgtcaaaagaattcggaagcaacactgccaatagccgtccgctttgctaagacactcctggctaattcttccccttttaacgtggataccggagccatggcaacacttgccttgacctgcatgtacaacaagattcccgttgggagcgaggaaggatacagatctttattcggccaggtgctcaaggacattgtcgagaaaatttcaatgaaaatcaaggacaatgggatcatcggcgatatttatagcacagggctcgccatgcaagctctgagcgtgactccagagccaagcaaaaaagagtggaactgcaaaaaaactacagacatgatcctcaacgagatcaaacagggcaagttccacaatcccatgtcaattgcccagatacttccgtcactgaaaggaaagacctacctagacgtaccacaggtgacgtgctcaccagatcacgaagtccagccaaccctgccttccaatcctggccccggccctactagcgctagcaacatcactgtcatatataccatcaataaccagcttcggggcgtagagctcctttttaatgaaactatcaatgtgtccgtgaagtccgggagcgtcctgctcgttgtgttagaagaggcccaaaggaaaaatccgatgtttaagttcgagactaccatgaccagctgggggctcgtggtgtcatccattaataatattgctgagaatgtcaaccacaaaacatactggcagtttctgagtggcgtgacgccactcaacgagggtgtagctgattacatcccctttaatcacgaacacatcacggcaaatttcacccagtactag

SEQ ID NO: 188983 - DNA, 306 bp, Artificial Sequence
  Description of Artificial Sequence: Synthetic coding sequence
atgcagcggctgtgcgtgtacgtgctgatcttcgccctggccctggctgccttcagtgaggctagctggaaaccaagatcgcagcagccagatgcccctctcggtaccggtgccaacagggatctcgaactcccatggctcgagcaacaggggcctgcttcacaccatcggcgtcaattggggcctcaaggcccgccccatctggttgccgatccttccaagaaacagggcccctggctcgaggaggaggaagaagcatacggatggatggattttggaagacgtagtgccgaagatgagaactag

SEQ ID NO: 188984 - DNA, 447 bp, Artificial Sequence
  Description of Artificial Sequence: Synthetic coding sequence
atgcggggccgggagctgcccctggtgctgctggccctggtgctgtgtttggctccgagaggtcgtgctgtgccgctccccgccgggggtgggacagttctcactaagatgtacccaagaggcaatcactgggccgtggggcacctcatggggaaaaagagcaccggcgagtcctcctcagtttccgagcgcgggtctcttaaacagcagctccgggagtatattcggtgggaagaggcagcacgtaacctgctgggtctcatcgaggccaaggagaacagaaaccaccagccccctcagcccaaggcactcggcaaccagcaaccatcgtgggacagtgaagatagctctaactttaaagacgttggctcaaaagggaaggtgggtcggctgagcgctcctgggtcacaacgcgagggccggaatccacagctcaaccaacagtag

SEQ ID NO: 188985 - DNA, 426 bp, Artificial Sequence
  Description of Artificial Sequence: Synthetic coding sequence
atgcggggccgggagctgcccctggtgctgctggccctggtgctgtgcctcgccccccggggtcgggcagtccccctgcccgccggcggcggcaccgtcctcacaaagatgtaccctaggggtaaccattgggccgttggacacctgatgggcaaaaaatcgactggagaatctagctcggtgagcgagcgcggctccctgaaacagcaattgagagaatatattcggtgggaggaagcagcccggaaccttctgggcctgatagaggccaaagagaaccggaaccatcagccaccacagcccaaggctctggggaatcagcagcccagctgggactctgaggattcttctaactttaaagatgtgggcagcaaagggaagggaagccagagggaaggccgaaatccccagctgaatcagcagtag

SEQ ID NO: 188986 - DNA, 417 bp, Artificial Sequence
  Description of Artificial Sequence: Synthetic coding sequence
atgcggggccgggagctgcccctggtgctgctggccctggtgctgtgcttggcccccaggggacgggcagtccccctgccagctggaggggggaccgtcctaaccaaaatgtaccccagaggtaaccattgggcagtgggccacctaatgggcaaaaaaagtaccggagaatcttccagcgtttcagaacgagggtccttgaaacagcaactgcgggaatacattaggtgggaagaggcagcccggaacttgctcggcttgatcgaagccaaggaaaacagaaatcaccagccaccacagcctaaggccctcggaaatcagcaaccctcctgggattcggaagattcctcgaacttcaaagatttggtagatagtctgctccaagtattaaatgtgaaagagggtacaccctcgtag

SEQ ID NO: 188987 - DNA, 1155 bp, Artificial Sequence
  Description of Artificial Sequence: Synthetic coding sequence
atggccctgaacgactgcttcctgctgaacctggaggtggaccactttatgcattgtaacataagcagccacagcgccgacctgccagtgaacgacgactggagtcatcctggaattctatacgtaatacccgcagtctatggcgttattatccttattggcctaatcggcaatattacgctgataaaaatattttgtacggtgaaatcaatgaggaacgtcccaaacctgtttattagttccctggcgttaggtgacctgctgctgctgattacctgtgcaccagtcgacgcatcccgctatctcgccgacagatggctcttcggtcgcattggatgtaagctgatcccattcatccagctcacgagtgtgggcgtgagcgtcttcacgctgactgccctctctgcagataggtacaaggctattgtccgccccatggatatacaggcttcgcacgcccttatgaagatttgtctgaaagcagcattcatctggatcatttccatgctgctcgcaattcccgaagccgtgttcagcgatttgcatccgtttcatgaggaatctactaatcaaactttcatctcttgtgcaccatatccccatagtaatgagctgcacccaaagattcatagtatggctagctttctagtgttctacgtcatacccttatccatcatctccgtctattattacttcattgctaagaatctgatccagtctgcttacaaccttccggtggaagggaatatccatgtaaaaaagcagatagaatcccggaaaaggctagcaaagaccgtccttgtgttcgtgggtttgttcgccttttgttggcttcctaaccacgttatctatctatatcgcagctatcactacagtgaagtggacacttcgatgttgcactttgttacatccatatgcgcccgcctcctggccttcaccaactcctgtgtgaatcctttcgcgctgtacctcctgtctaagagcttcagaaaacaattcaacacacagttactctgttgccagcctggactgatcattcgcagccatagcactgggaggtcaacgacttgtatgacttctctgaaatcaaccaacccttctgtggcaacgttctctctgatcaacggtaatatctgtcacgaaagatatgtgtag

SEQ ID NO: 188988 - DNA, 480 bp, Artificial Sequence
  Description of Artificial Sequence: Synthetic coding sequence
atggccagcttcctggtgttctacgtgatccccctgagcatcatcagcgtttactactattttatagccaagaacttaatacaatcagcttataacttgccagtggaaggaaacatccacgtgaagaaacaaatcgagtccagaaagcgactggctaaaacagtgttagtttttgtcggactctttgccttctgttggctgcccaaccacgttatctatctctatagatcatatcactatagtgaagtcgatacttctatgctgcacttcgttacctcaatctgtgccagactgctggccttcacaaatagttgcgtgaatccatttgccctttatctactgtcggaattccaggagacagtgcagcactcagccgccctgctccccgcttggcctgaccacccggtgagccagcattggaaggagtataacctgcacgatttgccacaggagtatcagcctctcagaggtcatctttag

SEQ ID NO: 188989 - DNA, 600 bp, Artificial Sequence
  Description of Artificial Sequence: Synthetic coding sequence
atgctggcctacagcagcgtgcactgcttccgggaggacaagatgaagtttacaatcgttttcgcgggattgctgggcgtgtttcttgccccagccttggcaaattacaacataaacgttaatgacgacaacaacaacgctggatccggccaacaaagcgtgagcgtgaataacgagcataacgtagctaatgttgataataacaacggctgggacagctggaactctatctgggactacgggaacggtttcgcagctaccagactgttccaaaagaagacttgtatagtacataagatgaataaggaggttatgccctcgattcagtctctggatgctttggtcaaggagaagaagctccagggaaaggggcccgggggaccgcctcctaagggcctcatgtactcagtgaacccaaacaaggtggacgatctttcaaagttcggcaagaacatcgctaatatgtgcaggggtattccgacatacatggctgaggaaatgcaggaagcaagtctcttcttctactctggtacctgctacactacaagtgttttgtggatagtcgatatttccttttgcggtgacaccgttgaaaactag

SEQ ID NO: 188990 - DNA, 1092 bp, Artificial Sequence
  Description of Artificial Sequence: Synthetic coding sequence
atgcagcgggccggcggcggcagcgcccccggcggcaacggcggcggcggaggcggcggaccaggtacagccttctcgattgacagcttgattggacctcccccccctcgcagcggacacctgctctacacaggttaccccatgtttatgccctataggcccctggttctcccacaggccctggctcctgctcctctcccagccggcctgccccccctcgctcctctggccagctttgccggaaggctgacgaacactttttgtgccggcctgggccaggctgtcccaagcatggtggcattgactacagccttgccttcctttgccgagcctcccgatgccttttatggcccccaggaactggccgccgctgcagccgccgccgccgccaccgccgctaggaacaatcctgagccgggggggcgccgacccgagggaggattggaggccgatgaactgctgcccgcccgcgaaaaggttgccgaaccgccacctccccctccaccacatttttcagagacatttccttccttgcccgccgagggtaaggtctacagcagcgacgaggaaaaactggaagcttctgctggtgatcccgcggggagtgagcaggaggaggaaggctctggtggagacagtgaagatgatggatttctggattcatccgctgggggcccaggtgcactgttgggcccaaaacccaaactaaagggaagcctaggaacaggtgctgaggaaggagccccggttactgcaggggttaccgctcccggcggcaagtcacgccgaagaaggaccgcttttactagtgagcagcttctggagcttgagaaagaatttcactgcaagaagtacctgagcctgacagaacggtcccagattgcgcacgccttgaaactcagcgaggtgcaggtgaaaatctggtttcagaacaggagggctaagtggaaaagaatcaaggccggcaacgtgagcagtaggtccggagagcctgttaggaatcccaaaattgtggtgcccattcctgttcacgtgaatcgattcgctgtacgtagccagcaccaacagatggagcagggggcgcgaccatag

SEQ ID NO: 188991 - DNA, 1047 bp, Artificial Sequence
  Description of Artificial Sequence: Synthetic coding sequence
atgagcgccgccttcccccccagcctgatgatgatgcagcggccccttggatccagcacagcgttctccattgactccctgatcggctctcctccacaaccaagtcccggacattttgtctataccgggtatcctatgttcatgccctacaggcctgtcgtgctgccaccccccccaccaccacctcccgctctgccacaggcagcccttcagcccgcattgcccccagcacatccacatcaccagatcccgagtctgcccaccggcttctgcagtagcctggcacaagggatggcactgaccagcacccttatggcaaccctgccaggcggttttagcgcatctccacagcatcaggaggccgccgcagccaggaaatttgcccctcagcctctcccaggcggcggaaactttgacaaggccgaggcgctgcaggccgatgccgaagatggaaagggtttcttagctaaggaggggtcattgctggcttttagtgccgctgaaactgtccaggcatccctggtgggcgcagtcagggggcagggcaaggatgaatccaaagtcgaagatgaccccaagggtaaggaagagtccttcagcctcgagtcagatgtcgattacagctccgatgataacctgacgggtcaagctgcccataaggaagaagatcctggccacgccctggaggaaacccctccatcctcaggagctgctggaagtacaaccagcacagggaagaatcgaagacgaaggactgctttcacctcagagcaacttttagagctggagaaagagttccattgcaagaagtacctcagcctaaccgaacgctcccagatcgctcacgcattaaaactgtccgaagttcaggtcaagatttggtttcaaaacagaagggccaagtggaagagagtaaaagctggaaacgcaaactcaaagactggcgagccatctagaaaccctaaaattgtcgtgcctatcccggtacatgtctcacgattcgcaatccggtcccagcaccaacagcttgagcaggcgcggccatag

SEQ ID NO: 188992 - DNA, 1443 bp, Artificial Sequence
  Description of Artificial Sequence: Synthetic coding sequence
atggaggtggcccccgagcagccccggtggatggcccaccccgccgttctgaacgctcaacatcccgactcgcaccaccccggcctggcacacaactacatggaaccagcccagctcctcccccctgacgaagtcgacgtgttcttcaatcacctggacagccagggcaacccatattatgccaaccctgcccacgcccgcgccagagtcagttattcccctgctcacgctcgtttgactggaggtcagatgtgccgtccccacctcttacattcacccggactcccttggttagacggcggtaaagccgccctgtcggccgccgccgctcaccaccacaacccctggactgtgtcaccttttagtaaaacacctttgcacccatccgccgcaggtggccctggtgggcccctgtcggtgtatccaggcgcggggggcggcagtggcggaggaagcggcagcagcgttgcctctttaacccccaccgccgcacactcgggttcacacttgtttggtttccccccaacaccccccaaggaggtgagcccagacccaagcacaaccggggcggctagcccagcgtcctcctcagcaggcgggtcagcagctaggggagaagataaggacggggtaaaataccaagtgtctttgactgagagcatgaagatggagtccgggagccctcttcggccgggcttggccactatgggcacgcaacctgcaacccaccaccctattcccacttaccctagctacgtgccagcggccgcacacgattactccagcgggttgttccatcccggagggtttctcggtggtcccgcctcttcattcactcctaaacagaggtccaaggcccgctcttgttccgagggaagggagtgcgtcaattgcggagccaccgcgacccccttatggcggagggacggcaccgggcactatctgtgtaatgcctgtggactgtaccacaaaatgaacggacaaaatagacctctcatcaaacccaaaagacggttatccgccgccagacgggcaggcacctgctgcgccaattgccagaccacaaccactactttgtggagaaggaacgctaacggcgaccccgtctgtaacgcctgcggcttgtattacaaactgcacaatgtaaataggccactgaccatgaaaaaagagggcatccagacaaggaataggaaaatgtccaataagagcaagaaatcaaaaaagggggcggaatgtttcgaggaattaagcaagtgtatgcaggagaaatcaagtcctttttccgctgccgctcttgctggccatatggcacctgtgggccatctgccaccattttcacattctggccacatcctcccaacccctacacctattcatccctccagctctctgtccttcggacacccgcatccaagcagcatggtcaccgctatgggctag

SEQ ID NO: 188993 - DNA, 1401 bp, Artificial Sequence
  Description of Artificial Sequence: Synthetic coding sequence
atggaggtggcccccgagcagccccggtggatggcccaccccgccgtgctaaatgctcagcaccctgacagtcatcatcccgggctcgcacataactacatggaacctgctcagctgctgccgccggacgaagtggatgtcttttttaaccacctcgactcacagggtaacccatattacgccaatcccgcccacgcccgcgctcgagtgtcttacagtccagcacacgcgcgcttgacagggggccagatgtgtcgccctcatctgctccattccccgggattgccctggctggatggcggtaaagctgcactgagcgcagccgcagcacatcaccacaatccgtggacggtaagcccatttagcaagacaccgctgcatcccagcgcagcaggggggccaggcgggccgctctcagtctacccaggcgccggcgggggctcaggcggtgggtctggaagctctgtagctagcctgacccctaccgccgcccactctggcagccacctgttcggctttccaccaacaccacccaaggaggtttcaccagacccgtccacaacaggtgcagcctcacccgcatcatcgtccgccgggggtagtgcagcaagaggcgaggacaaagacggggtgaagtaccaggtttctttgactgagtcaatgaaaatggaatctggatctcctctccgcccgggactagctactatggggacacagccagctacacatcaccccattccaacttacccaagctacgtcccagcagctgcacacgactactcgagtggactgtttcatcccggcggctttctaggtggtcctgccagcagttttacacccaagcagcgcagtaaagcacgctcatgttcagagggtagagagtgcgttaattgcggcgccactgccactccgctgtggcgtagggatggtaccgggcactacctctgtaacgcctgcgggctttaccataaaatgaatgggcagaaccgccctctcatcaagcccaaacggcggctcacaactaccaccacactgtggaggaggaacgctaacggcgacccggtgtgtaacgcctgtggcctgtattacaaactccataatgttaatcggcccctaactatgaaaaaagagggaattcagacccgaaaccgcaagatgtcaaataaatctaaaaaaagcaagaaaggcgctgagtgtttcgaagagctttctaaatgcatgcaggagaaatccagtcccttctctgctgcagctctagctgggcatatggctccagtggggcacctgcctcccttctcccatagcggacacatcctgccgaccccaacacctatccacccatcttcctcattatccttcgggcaccctcacccatcaagcatggtgaccgctatggggtag

SEQ ID NO: 188994 - DNA, 1443 bp, Artificial Sequence
  Description of Artificial Sequence: Synthetic coding sequence
atggaggtggcccccgagcagccccggtggatggcccaccccgccgttctgaacgcacagcatccagactcacaccacccaggcctggcgcataattatatggagccagctcagctcctgccccccgatgaggtagatgtgttcttcaatcatctggattcgcagggaaacccttactacgctaatcccgctcacgctagggcgagggtcagctactcacccgctcatgccaggctgactggaggacagatgtgccggccccatctgcttcattcccctggcttgccttggctggatggcgggaaggcagcacttagcgcagctgcagcccatcaccataatccatggaccgtgtccccgttttccaagactccgctgcacccatccgctgccggcggccctgggggtccactgtctgtttaccctggggccggaggaggttctggggggggatcggggagctccgtggcaagcttaacacccacggccgcccactctggcagccacctttttggctttcctcctactccccctaaagaggtgtcccctgacccttctacaacaggcgccgctagcccagcaagtagcagtgccggcggctcggctgcaaggggcgaggacaaggacggagtcaaataccaggttagcctcacggaatctatgaaaatggagtcgggatctcctctgcgaccaggcctggcaacaatgggcactcagccggccacccatcaccctatacctacataccccagctacgtgccggccgccgctcacgactattctagcggcctcttccacccgggagggttcctgggtggaccagcgtcttctttcaccccaaagcagcgcagtaaagctcgctcctgctccgagggtagggagtgcgttaactgcggcgccactgcaactcctctgtggcgccgcgatgggacgggtcactatctgtgcaatgcgtgtggactctaccacaagatgaacggccagaacaggcctttaataaaaccaaaaagacgattaagcgctgctcgcagggctggaacttgctgtgcaaattgccagactacaacaaccaccctgtggaggaggaacgcaaatggcgatcctgtgtgcaacgcttgcgggctgtattataaactacataatgtcaaccgtcccttgacgatgaaaaaagaaggtatacagaccaggaatcggaagatgtctaacaaaagcaaaaagtctaaaaagggcgccgaatgttttgaagaacttagcaagtgcatgcaagagaaaagctctcctttttccgcggccgcactcgcgggccatatggccccggtgggccaccttccaccgtttagccacagcggacatattctccccacccctacccctatccacccatcaagctctctttccttcggtcacccccatccttcttccatggtaacagcgatgggatag

SEQ ID NO: 188995 - DNA, 453 bp, Artificial Sequence
  Description of Artificial Sequence: Synthetic coding sequence
atggaggtggcccccgagcagccccggtggatggcccaccccgccgtgctcaacgcacagcacccagatagccaccacccaggactggctcataactacatggagccggcacagctgttaccccctgacgaagtggacgtgttttttaatcatttggatagccagggcaacccatactatgctaatcccgcacatgcccgggccagagtgtcttactctccagcccacgcaagattgaccgggggacagatgtgtcgtccccacctcttgcattctcccggtctgccgtggctggacgggggaaaggccgccctatcggcggccgcagcccaccaccataatccatggaccgtttcacccttttccaaaacgcccttgcatcctagcgcagccggtggcccaggaggacctctgtctgtttatccaggggcaggcggcggatcagggggatag

SEQ ID NO: 188996 - DNA, 27 bp, Artificial Sequence
  Description of Artificial Sequence: Synthetic coding sequence
atggaggtggcccccgagcagccctag

SEQ ID NO: 188997 - DNA, 1326 bp, Artificial Sequence
  Description of Artificial Sequence: Synthetic coding sequence
atgtaccagagcctgccctggccccccaccaccggccggccccccgtgccaactaggagagcagccccagccccttcatgtactgcccgggccccacgccccagacagtccacctgcccccacaggggggccctgctccgggcaggacctgtgctccctcccgggcggcgtcgggggttatgtgttaggcgggctagcggaggctccagcggtggtgcggcgtccggggcgggacccggcacgcaacagggcagtcccggatggtctcaggccggggccgatggggctgcttataccccgccacccgtgagcccccgcttttctttcccaggcaccactgggagtctggctgccgcagccgccgcagcggctgccagggaggcggctgcctacagcagtggtggaggcgccgcaggagccggcttagccggccgcgaacaatacgggcgagcaggttttgccgggagctacagtagtccatatcctgcctatatggcggatgtgggcgcctcatgggcggccgccgcggctgcaagcgccggccccttcgactccccagtgcttcactcactccccgggagagccaaccccgcggcacggcatcccaatctggacatgtttgatgatttttcagaaggccgcgagtgtgtcaattgtggagctatgagtacccccctgtggcggcgtgacggaaccgggcactatctgtgtaacgcctgcggtctgtatcataagatgaatggcatcaatcgccctctgatcaagccgcagcgtcgtctatccgctagtcgccgcgtaggattgtcctgtgctaattgtcaaaccactacgacaacactctggaggcgaaacgccgaaggggagcccgtctgcaacgcctgtgggctctatatgaagctgcacggagtgccgcggcctctcgccatgagaaaggagggcatacagacacgcaagcggaagccaaagaacttgaacaaatctaaaacccccgccgcaccctcaggaagcgaaagcctgcctcccgcaagtggggccagcagtaattccagcaacgctaccacgagctccagtgaggagatgcggcctatcaaaactgagccaggactgagctctcactatgggcactcttctagcgtctcccagacctttagtgttagtgcgatgagtggacacggaccctccatccatccagtgctgagcgccctcaagctgtcgccacaaggatacgcctctccagtgagccagagcccgcaaacttctagcaagcaggactcttggaattctctagtcctggctgattcccatggcgacatcataaccgcctag

SEQ ID NO: 188998 - DNA, 1329 bp, Artificial Sequence
  Description of Artificial Sequence: Synthetic coding sequence
atgtaccagagcctggccatggccgccaaccacggccccccccccggagcatatgaggcaggtggacctggcgcattcatgcatggagccggggccgctagctctccagtttacgtgccaaccccaagggtgccctcctcagtcctgggtttatcatatcttcaaggggggggtgccggctccgctagcggaggagctagtgggggatcctccggcggagccgcaagtggcgcagggccgggtactcagcaaggcagccccgggtggagccaggctggggccgatggcgccgcctacacccctccccctgtaagtcccaggttttcattccccggcacaacagggtccctggccgccgccgcagccgccgcagctgctagggaggccgccgcctatagtagcggcggtggagccgcaggtgctggcctggcaggccgggagcagtacgggagagccggatttgccgggagctactcgtccccctatccggcctacatggcggatgtgggcgcaagttgggctgccgctgcggcagctagtgctggccccttcgatagtcctgtactgcattctctgcccggtagagccaatccggctgctaggcatcccaatctggacatgtttgatgatttcagcgaaggccgagaatgcgtaaattgcggtgccatgagcacgcccctttggagacgcgacggcaccggccattacttatgcaacgcctgtggtctgtaccataaaatgaacgggattaaccggcctttaattaaaccgcagcgtcgcctctccgcaagcagaagggtggggctttcttgtgcgaattgccagacaacaacgaccacgctgtggcgccggaacgctgaaggggaacctgtatgcaacgcctgtggattgtacatgaaactgcacggtgtccccagacccctcgccatgcggaaagaggggattcagacccggaaaaggaagcctaagaaccttaacaagtcaaaaaccccagctgctccgagtggtagcgaaagcctcccacccgcttccggagcctcgtcaaattcatccaatgcaactacgtcttcctctgaggaaatgagaccgatcaaaaccgagcctggcctgagttcacactatggccattctagctccgtgagccaaaccttttcggtttctgccatgagtggccatgggccttcaatacaccctgtgctatctgcactcaaactgagcccacaaggatacgccagccctgtgtcccagtctcctcagactagcagcaaacaggacagctggaattctctggtgttggccgattcccacggggatattatcactgcttag

SEQ ID NO: 188999 - DNA, 528 bp, Artificial Sequence
  Description of Artificial Sequence: Synthetic coding sequence
atgttcgacgacttcagcgagggccgggagtgcgtgaactgcggcgccatgagcactcctctctggcggagggacgggaccggccattatctgtgtaatgcttgcgggctgtatcacaagatgaatgggattaatcgacctttgatcaagcctcagagacggttgagcgcctcacgccgcgttggtttgagttgtgccaactgtcagactactacgactactctgtggaggaggaatgctgagggtgaacccgtctgcaatgcgtgcggtctgtatatgaaactccacggtgttcctcggccacttgctatgcgtaaggaaggcatccagactcgcaagaggaagccaaagaacctcaacaaatccaagacaccggccgcaccaagcggcagcgaatctcttccacccgcatcaggagctagttctaattcctcaaatgcaacaactagtagttctgaagaaatgcgacccataaaaactgagcccgggctgtccagccactatggacactctagcagcgtttcatag

SEQ ID NO: 189000 - DNA, 354 bp, Artificial Sequence
  Description of Artificial Sequence: Synthetic coding sequence
atgtaccagagcctggccatggccgccaaccacggccccccccccggggcctacgaggctggcggacccggcgcatttatgcacggcgctggcgccgcctctagcccagtatacgtacctacaccaagggtcccaagcagcgttctgggcctctcatatctgcagggaggtggagccggtagcgccagcgggggcgcttccgggggtagcagtgggggagcggcgagtggggcaggtcccggaactcagcagggctcacccggatggtctcaggcgggggctgatggtgccgcgtacaccccacctcccgtttccccccggttctcatttccaggcacgacagggagcctgtag

SEQ ID NO: 189001 - DNA, 711 bp, Artificial Sequence
  Description of Artificial Sequence: Synthetic coding sequence
atgttcgacgacttcagcgagggccgggagtgcgtgaactgcggcgccatgtccactccgctgtggagacgggacgggacaggccattacctgtgcaatgcttgtgggctgtaccataagatgaatggtatcaataggccacttattaaaccacagagaagattgtcggcgtcgcggcgtgtcggcctgagttgtgccaactgtcagacaaccacaaccactttgtggaggcgaaatgctgaaggagaacctgtttgcaatgcttgcggcctctacatgaaactgcatggggtgccgcgccccctggctatgcgaaaggagggcattcaaacaaggaagcgtaagcctaagaatctgaataagtcaaaaaccccagcagcacccagcggcagtgagtcactgcccccggcctcaggcgcctcttctaacagctcaaatgctactactagctcttctgaagagatgcggcctatcaagacagagccagggctctccagtcactacgggcacagttcttcggtctcgcagaccttttcagtatcggccatgtcgggacatggtccttcaattcatcccgtgctcagtgcacttaagttaagccctcagggctacgccagccccgtgtcccagtccccgcaaacttcatccaaacaggatagctggaacagcctcgtacttgccgacagccatggtgatattatcactgcatag

SEQ ID NO: 189002 - DNA, 1332 bp, Artificial Sequence
  Description of Artificial Sequence: Synthetic coding sequence
atgtaccagagcctggccatggccgccaaccacggccccccccccggcgcttacgaagccggcggccctggagcctttatgcatggcgcgggtgccgcctcatccccagtgtacgttcctacaccccgcgtgcccagctccgtgctcggcctgagctacctccaggggggtggagctggatccgcttctggaggcgcgtcaggcgggtccagcggcggggcagccagcggggcagggcccggtacacagcaggggagccccggctggtcccaggccggggcggatggtgcagcctacacacccccaccagtgagcccacggttcagttttccaggcaccaccggttccctcgcagcagccgcggccgccgccgctgcaagagaagcagctgcctactcttcagggggaggggccgctggagcaggcctggcagggcgggaacagtatggcagagcaggtttcgccggaagttacagcagcccatatccagcatacatggcagacgtcggagcttcttgggccgctgcagctgctgccagtgccggtccattcgattctccagtgctgcatagcttgcccggccgagccaaccccgccgcccggcatcctaacctcgtggatatgtttgacgatttctcagaggggagggagtgtgtgaattgtggtgctatgtctacccctctttggcgccgggacgggacgggtcactatctctgtaacgcctgcggcttgtaccataagatgaacggtattaatcggccactcatcaagccacagagacgcctgagtgcaagcagacgagtcggcctgtcctgcgcgaactgccaaacgaccaccaccacactgtggaggcgcaatgccgaaggggaacctgtgtgcaatgcttgcggattatacatgaagctgcacggggtccccagaccactcgccatgaggaaagaaggaatacagactcggaagcgaaagcccaagaacttaaacaagtcaaaaacccctgcggctccatccggttccgagtctctgcctcctgcatctggagcttcctcgaacagttcaaatgcaacaacttcctcttctgaagaaatgaggccaattaagactgaacccgggctgagttctcactatggtcattcaagcagtgtgagtcaaaccttctctgtgagcgcgatgtcaggtcacgggccctcaatccaccccgtgctgagcgcacttaaactgtccccccaaggctatgcaagccccgtcagtcagagcccacagacctccagtaagcaggactcttggaacagcctcgtgctggctgacagccacggggatatcattacggcttag

SEQ ID NO: 189003 - DNA, 1194 bp, Artificial Sequence
  Description of Artificial Sequence: Synthetic coding sequence
atgtaccagagcctggccctggccgccagcccccggcaggccgcctatgctgattccggatcctttctgcatgcgcctggagctgggagccctatgtttgtcccacccgcgcgggtgcccagtatgttaagctatctctccggatgcgagccctccccgcagccccctgagcttgctgctaggccagggtgggcccagaccgccaccgcagattctagcgccttcggtccaggcagcccacatccaccggccgcacatccccctggcgcaactgcatttccatttgcccattcgccttccgggccagggtccggggggagcgctggcggccgagatgggtcggcctatcagggcgccttactgccccgtgagcagtttgccgccccactcgggcggcccgtgggtacgtcatactctgcgacttaccctgcttacgtgtcgcctgacgtggctcaatcctggactgccggtccattcgatgggtcagtccttcatggactccccggtcgacggccgacttttgtatcggatttcttggaggagtttcctggagaagggcgcgagtgcgtgaattgtggagctctgagtaccccattgtggcgccgggatggcacagggcactatctctgcaacgcctgcggactgtaccataaaatgaacggtgtcaatcgaccattggtgagaccacagaagaggctatctagctcgcgacgtgcaggcttgtgctgcacaaattgtcacactaccaataccacactctggcggcggaattcagagggcgagcctgtgtgtaacgcgtgcgggttgtacatgaagctgcacggggtgccacgaccattggctatgaagaaagagtccattcagactaggaaacggaagccaaagacaattgcaaaggcgaggggttctagcggcagcacacggaatgctagtgcatccccctccgccgtcgccagcaccgactcctctgccgcaacatccaaagctaagccttccctggcctccccagtctgcccaggcccctcgatggctcctcaagcatctggacaggaagacgacagcctagccccgggacacctggagtttaagtttgaacccgaggacttcgcgtttcctagcaccgcgccgtctccccaggccggcttgcggggcgccttgaggcaagaagcctggtgcgctctggccttggcttag

SEQ ID NO: 189004 - DNA, 1194 bp, Artificial Sequence
  Description of Artificial Sequence: Synthetic coding sequence
atgtaccagagcctggccctggccgccagcccccggcaggccgcctatgcagactccggtagttttcttcacgcccctggcgcgggctccccgatgtttgtacctcctgcccgagtgccttctatgctttcctacctctccggctgtgagccctctccccagccacctgaactcgccgccagacccggctgggcacagacagccacggccgactctagtgcttttggccctgggagcccccaccccccggcagctcaccctccaggagccactgcattccctttcgcccactccccttccgggcctggatcagggggatccgcagggggtcgggatgggtccgcttaccagggggctcttttgccaagagagcaattcgctgcaccactcggacggccagtgggtacctcctacagtgcaacatacccggcttatgtgtctcctgatgtggcccagtcatggacggccggacctttcgatggctccgtgctgcatggcttgcctggccgcagacctacttttgtatcagacttcctagaggagttcccaggtgaagggcgggagtgcgtcaattgcggtgccctctcaacccctctgtggcggcgggatggaactggccactacttatgtaacgcttgtggcctctatcacaagatgaacggggtcaatcgacctctagtacggccccagaagaggctctcctcaagtcgaagggccggactctgctgtacgaattgtcataccactaacacaacattgtggagacgcaacagtgagggtgaaccagtgtgcaatgcatgcgggttatacatgaagttgcatggcgtgccccgccccctggccatgaagaaggaaagtattcagacgcgcaagagaaaacctaaaacaatagccaaagcacgcggcagcagtgggtccacacgcaatgcaagcgcttctccctccgctgtcgcttcaacggatagcagcgctgccacatccaaggccaaaccgtcgctggctagtcccgtatgcccaggaccatccatggctcctcaggcttctggccaggaggacgactcgcttgcccctggccacttagaatttaagtttgagccagaggacttcgcctttccatctaccgcaccctcccctcaggctggtctcagaggtgccctcagacaggaggcctggtgtgcactcgctttagcttag

SEQ ID NO: 189005 - DNA, 1254 bp, Artificial Sequence
  Description of Artificial Sequence: Synthetic coding sequence
accgccaccgccgtgccctgccggcccccctgccccctggtgaagaccactcctggtcggatgtatcagagcctcgccctggctgccagcccccgccaggctgcctacgctgacagtggttcatttttacatgcaccaggcgctgggtcccccatgtttgtgccgccagcacgagtgccttccatgttgagctacctgtcgggatgtgaaccttccccacaaccccctgagctcgccgctagaccaggatgggcccagacagcgacagcggacagcagtgcgttcggacctgggtccccccacccccccgccgctcatccacctggtgctaccgccttcccgttcgctcactccccctctggtccaggtagcggcggttctgcgggagggcgcgacgggtctgcctaccagggggcgctcctgcctcgggagcaattcgccgcccctttaggacgtccagtcggaaccagctattccgccacctaccctgcatacgtttcacctgacgttgcccaaagttggacagctggaccattcgatggctctgtgctgcacggcctacccggacgccgccccaccttcgtgtctgacttcctggaggagttcccaggggaaggccgcgagtgtgtgaactgcggtgccctgtcgaccccgctgtggcgtcgggacggaactgggcattacctttgtaatgcgtgcggcctgtaccacaagatgaacggagtcaaccgcccccttgttaggcctcagaagcgacttagctcaagccgcagagctggcctgtgctgcacaaactgtcacaccaccaacacgaccctgtggcgacgaaatagcgagggagagcccgtgtgtaacgcctgcggtctatatatgaagcttcacggagtgcccaggccgctcgctatgaagaaagaatcaatccagacgcgcaaaagaaaacccaaaactattgctaaggctcgcggatccagcgggagcaccaggaatgctagcgcctccccaagtgctgttgcttctactgacagctctgccgctacctccaaagcaaaacctagcttggcttcccctgtatgcccaggaccttccatggccccacaggccagcggccaagaagacgattcgctggctcctggccatctcgagtttaagttcgagccagaggattttgctttccctagcaccgcaccatcccctcaggctggcctccgtggcgccttgcgtcaggaggcatggtgtgctcttgctctagcctag

SEQ ID NO: 189006 - DNA, 1788 bp, Artificial Sequence
  Description of Artificial Sequence: Synthetic coding sequence
atggccctgaccgacggcggctggtgcctgcccaagcggttcggcgccgcgggtgccgatgcttccgactcccgcgcgttccctgctcgcgagcccagcacgccaccctcaccaatctcatcctcctcttcctcttgctcacgcgggggcgagagggggccaggaggtgcttccaattgcgggaccccacaacttgatacagaagcggcagccggacctcccgccaggagcttactgctgagtagttacgcatcgcaccccttcggcgcgccacatgggccctctgccccgggagttgctggccctggcggaaatctaagttcttgggaagacctgctgttgtttacagatcttgatcaggctgccactgctagtaagcttctgtggagctctaggggcgctaaactgagtccttttgcccccgaacaacctgaagagatgtaccagacactggcagcgctgagcagtcaggggcctgccgcatacgatggagcacctggtggctttgtccatagcgctgcggcagcagccgcggccgcggccgccgctagttctccagtgtatgtaccgacaacacgagtgggaagcatgcttccggggctgccttatcatttgcagggttctggctcaggacccgcaaaccatgctggcggcgctggtgcccatcctggctggccacaggcatctgctgatagcccgccttatggcagtggggggggcgccgctgggggcggagccgcgggcccaggtggcgctggaagcgctgccgcacacgtcagcgcccgcttcccttactctccgagtcccccgatggccaacggagcagctcgagaacccggcggctatgccgctgctggcagcgggggcgcgggcggagtcagcggcgggggatctagcctcgccgcaatgggggggcgggaacctcagtattcatccttgagcgctgctagaccgttgaacggaacttaccaccatcatcaccatcaccatcaccaccaccctagcccttacagcccatacgtgggcgctcccctcactccggcctggcctgccgggcccttcgagactccggtcctgcattctctccagtcgcgcgccggagcccccctgcctgttccaagagggccaagcgccgatctgctggaggacttaagcgagagtagggagtgcgtgaactgcgggagcatacagacacctctttggaggagggacgggaccggccactatctatgtaatgcgtgtgggttatattctaagatgaacgggctctcaagaccactcataaagccccaaaagcgcgttccatcatccagacgacttggcctaagctgcgcgaactgccacactactacaactaccctctggcgaagaaatgcagagggggagccagtgtgtaacgcttgcggcttatacatgaaactccatggtgtgccgcggcctctggcgatgaagaaggagggcatccaaacaaggaagcggaagcccaagaatatcaacaaaagcaaaacctgcagcggcaattcaaacaacagtattcccatgactcctacgagcacatcctctaattcagatgattgctccaaaaacacctccccaaccacacagccaactgctagcggggccggcgccccggttatgaccggtgctggcgaaagcactaatccagaaaactcggagttaaagtactctggtcaggatggactgtatatcggagtatcactcgcctctcccgccgaagttacatccagcgttcggcctgacagctggtgtgcgctggccctcgcttag

SEQ ID NO: 189007 - DNA, 8016 bp, Artificial Sequence
  Description of Artificial Sequence: Synthetic coding sequence
atggccgccgacacccaggtgagcgagaccctgaagcggttcgccggcaaagtgaccactgcatctgttaaggaacggcgggaaatcctgagtgaactcgggaaatgtgtcgctggcaaggacctgcccgagggcgctgtgaagggcctttgtaagctgttctgccttaccctgcaccgataccgcgatgccgcttcccgaagggcactccaggcggccatccagcagcttgccgaagcccagcccgaggccacagccaagaatctgctacactcacttcagtcctctgggattggcagtaaagcgggcgttcctagtaagtcatccggatctgcagcattgctggccctcacctggacttgtttgctagtacgcatcgtatttccatcccgcgcaaagagacagggcgatatatggaacaaactcgtggaggtgcagtgcctgcttttgttggaggtcctcgggggcagtcataagcacgcagtggatggtgctgtgaagaaacttaccaagctctggaaggagaacccaggcttggtagagcaatatttgagtgccatcctgagtttggagccaaatcagaattacgccggaatgcttggcctgctagtgcaattttgcacatctcataaggagatggacgttgtaagccaacacaaatctgccttgctggacttttatatgaagaatatccttatgtcaaaggttaaaccacccaagtacctcctggatagctgtgctcctttactgagatacctaagtcatagcgaattcaaagacttaattctgccaaccattcagaagtccctgctgcggtctcctgaaaatgttattgagactatttctagcctgctggccagcgttaccctcgatttatcccagtacgccatggacatagtgaaaggcctagccggacacctgaagagcaattcaccgcgcctgatggacgaagctgtgttggctctaaggaatttagcccgccagtgtagtgatagctcagcgatggagagcctgaccaaacaccttttcgccattttaggcggctcagagggcaaactcaccgtggtcgcccagaagatgagtgtcttgtccggcattggcagcgtgagccaccacgtagtgtccgggccctcttcccaagtcctgaatggcattgtggctgaattgttcattcccttccttcaacaggaggtccatgagggaaccctggtacacgcagtgagcgtccttgctttgtggtgcaatcggttcaccatggaagtgcccaaaaagctgaccgaatggtttaagaaagctttttcactaaagacatcgacaagcgccgtgaggcacgcgtatttgcagtgcatgctcgcatcataccggggggatactttgctgcaggcgttagatctactccctctgctgattcagaccgttgagaaggccgcctcccagagcacacaagtgccaacgattactgagggagtcgcagctgcgctgctcctcctaaaactgtcggtggccgactcccaggctgaggccaagctatctagcttctggcagctgatagtcgatgagaagaagcaggtgtttacatccgagaaattcttggttatggcatccgaagatgcactatgcactgtgttacatttaaccgagcgcctgttcctcgaccaccctcacagactgaccgggaataaagtgcagcaataccacagagctctggttgcagtgctgcttagcagaacttggcatgttaggaggcaggctcagcagactgtgcgcaagcttctgtctagtctcgggggttttaagctggctcacgggctcctggaagaactgaagacagtgctctcaagccacaaagtgcttccactcgaggcactggtgaccgatgcaggagaagtgacagaagccggcaaagcctatgtgcctcctcgggttttgcaggaagccttgtgtgtgatatctggcgttcccggtctgaagggagacgtcaccgatactgagcagctggcccaagaaatgctgatcatatcgcaccatccttcccttgtggcagtccaaagcgggctgtggcccgcgctgctggctagaatgaaaatcgacccagaagcctttatcacaaggcacctggaccaaataataccaaggatgacaactcagtccccactgaaccagtcctctatgaatgccatgggatcactgtctgtactgtctcccgatagggtgttgccgcagctcatctccactattaccgccagtgtccaaaatcccgccttgcgtttagttaccagggaagagttcgccattatgcagaccccagcgggcgagctgtacgacaagagtatcatccagtccgcccagcaggactcgatcaagaaagctaacatgaaacgcgagaataaggcctacagtttcaaagagcagatcatcgaactggagctgaaggaggaaattaagaagaaaaagggaatcaaagaagaggtacaactgaccagtaagcagaaagaaatgctgcaggcccagctcgaccgtgaagctcaagttaggcgacgcctgcaggagctggacggagagcttgaagccgctctcggtctgttagatataatactcgccaaaaacccgagcggtctaacccagtacatccctgttttggtagattcctttctgcccctgttaaagtcgccactggctgcccccaggatcaagaacccatttttatctctcgccgcctgtgtgatgccatccagacttaaagcattgggaaccctggtctcccatgtaacgctccggctgctcaaacctgagtgtgtgcttgacaaaagctggtgccaagaagaactcagcgtggccgttaaacgggctgtgatgctgttgcatacccatactatcacatcacgcgtcggtaaaggagaacctggcgcagcaccactctctgcccccgccttttccctcgtttttcctttccttaagatggtgctgacagaaatgccgcatcattctgaagaggaagaagagtggatggcacaaatactgcagatcctgaccgtacaggcccaactcagggcctctccgaacacgccccccggacgggtcgatgaaaatggcccggagctgctgcctcgcgttgcaatgctccgactcctgacctgggtcattggaacgggttcccctagactgcaggtactggcctctgacacactgacaactctgtgcgcttcttcaagtggcgacgacggctgcgcttttgcggagcaggaagaggtggacgtgctgctttgcgctctgcagtccccctgtgcatccgtgcgggagacagtgctccgaggactcatggaattgcacatggtactccctgccccagataccgacgagaagaacggactgaacctgcttcgccgactttgggtggtcaaatttgacaaagaggaagagatacggaagttagctgagaggctttggtctatgatgggattggatctccagccagatctttgctctctcctgatcgacgatgtaatctaccacgaggcggctgtgcgacaggccggtgcagaagccctgtcccaggctgtggccagatatcagcggcaagccgcggaggtgatgggacggctgatggagatttatcaagaaaagctctaccgcccgccccctgtcttggatgctctcgggagggttatttccgaaagtccgcccgaccagtgggaagcgaggtgtgggcttgccctggccctgaataaactgagccaatatctggactccagtcaagtgaagcccttgttccagttttttgtcccagacgcactgaacgataggcacccagacgtgcgaaagtgtatgctggacgcagccctcgccactctcaatacacatggtaaagagaatgtgaacagtttgctaccagtcttcgaggagttcctgaaaaatgcacctaacgatgccagctatgatgctgtgcgccagtcagttgtggtgctgatgggctcactggccaaacacctggataaatccgatcctaaggtgaagccaatcgttgcaaaattaatcgcggctttgagcacacctagccagcaagtccaggagagcgtcgcgtcatgcctgccaccactggtgcctgccattaaggaggatgcgggcggaatgatacagcgattaatgcaacagttgctggagtcggacaaatacgctgaacgaaaaggtgcggcgtacggcttggccgggctggtaaagggactcgggatcttaagcctcaagcagcaagaaatgatggcggcgctaacggatgccattcaagacaaaaaaaacttccggagaagggagggcgccctgtttgccttcgaaatgctgtgcacgatgttaggcaaattatttgagccgtatgtggtgcacgtcctgccccacctgcttctgtgtttcggtgatggcaaccaatatgttcgggaggcggccgacgattgtgccaaggctgttatgtcaaatctgagcgcgcatggtgtgaagctggtgttgccctcgctgctggcagcgctcgaagaggagtcttggaggaccaaggccggttctgtggagttgctgggcgcgatggcatactgcgcacccaagcagctatccagctgtctgcccaatatcgtgcctaagctgactgaagtgttaacagatagtcatgtcaaagttcagaaggccgggcagcaagcattgaggcaaattggctcagtgatcagaaaccctgagatcttagcaatcgcgccagtactactggatgcgctgacggatccttctagaaaaacccagaagtgtctccagacactgcttgacacaaagtttgtccactttatcgacgctccttctctggctctaattatgcccatcgtccaacgagcgttccaggaccggtctaccgacacccgcaaaatggctgctcagatcataggcaacatgtatagcctgaccgatcagaaagatctggcaccataccttccttcagttacccccggattgaaagctagccttctcgaccctgtgccagaagttcggacagtgagcgcaaaggccctgggtgctatggtgaaggggatgggtgagtcgtgttttgaggatttattaccatggttgatggagactttgacttacgaacagtcttctgtggataggtcaggagctgcccaggggctagcagaggttatggcaggcctcggcgtggagaagctggaaaaactgatgccagagattgttgcaactgcctctaaggtagacatagctccacacgtaagggatgggtatattatgatgttcaactacctgcccattactttcggggacaagttcaccccatatgtcgggcccatcatcccatgtatcctgaaagctctggctgatgagaatgagtttgtgcgtgacaccgctctgcgagcaggccagagagtcatctctatgtatgcagagactgctatagctttgctcctgccacagcttgaacagggactcttcgatgacctgtggcgaatccggttcagtagcgtgcagttactcggagacttgctattccatattagcggggtaactggcaagatgactaccgagaccgcctctgaggacgataacttcgggaccgctcagtctaacaaggctatcattacggccctgggtgtggaaaggagaaaccgcgtattagccggcctgtacatggggagaagcgacacgcaactggtggtgcggcaggctagccttcacgtctggaagatagttgtgtcaaacacaccccgcacattacgtgagatcctgcctaccctctttgggctgctgttgggctttttagcctcaacttgcgccgataaaagaactattgcagcgcgtactctaggtgatctcgttagaaaactgggtgagaaaatattgccagagatcattcccatcttagaagaggggctgaggtctcagaaaagcgacgagagacaaggggtctgtatcgggctttctgagatcatgaagagtaccagccgcgatgccgttctgtatttctctgagtcccttgtgcctactgccaggaaagcattatgcgatcccttagaggaggtccgcgaggccgccgctaaaaccttcgagcagcttcattccaccattgggcaccaagcactggaagatatcctgccatttctgctgaaacagttagatgacgaggaagttagcgaatttgcactcgacgggctcaagcaggtaatggccatcaaaagtagggtagtgctgccctacctggtgccaaaactgaccactcccccagttaacacaagagtccttgcatttctctcttcggtggctggcgacgccttgacgaggcatcttggggtcatcctgcccgccgtcatgttagcactcaaagaaaagctgggaacccctgacgaacagcttgagatggctaactgtcaagctgtcatcctcagtgtggaagacgacacaggccacagaatcataattgagtatctcctggaggctacacgctccccggaagtgggtatgaggcaggcagcagccattatactcaacatctattgttctcgatcaaaggctgactacacctctcatcttcggagtctcgtgtcaggcttgattaggctgtttaacgactcatccccggttgtcctggaggagagctgggacgctcttaacgctattacgaagaaactggacgctggaaatcagctggcactaatcgaggagctgcacaaggagattaggcttatcggcaacgagagcaaaggggagcacgttccgggcttttgcctcccgaagaagggtgtgacctctattctccctgtgcttcgggaaggcgttctcactggctcgcctgaacaaaaggaagaggccgctaaggccctgggtttagtaatcagattgacatccgctgacgccctgagaccctcagtggtgtccatcactggacccctcatccggatattgggagataggttctcatggaatgtgaaagcagccctactcgagaccctgtcccttttgctcgccaaagttggtatagcactgaagccttttcttcctcagctgcagacaacatttaccaaagcactgcaggacagcaatcggggcgttaggcttaaagcggccgatgctctgggcaagctgatttcaattcacataaaagtggaccctctctttacggaactgttgaatgggataagagcaatggaggaccccggcgtaagggacactatgctccaggctctgcggttcgtgatccagggggccggagctaaggtggacgccgtgattcgcaaaaatattgtatctttgctcctgtctatgttaggacatgatgaggacaacacacggatttcaagcgctggttgtcttggcgagctgtgcgcattcctaacggaagaggaattgagcgctgtactgcagcagtgtctcttagccgacgtctcaggtatcgattggatggtaagacatggcaggtccctggcattgtcagtcgcagtgaacgtagcgccggggaggttgtgtgccggccgttattcttctgatgtgcaggaaatgatcttaagtagcgccactgctgaccgaatccccattgctgtaagtggagtcagagggatgggattccttatgcggcatcatatcgaaaccgggggaggtcagctccctgcgaagctgagttccctctttgtgaagtgtctccaaaatcccagctcagacatcaggctagtggccgagaagatgatctggtgggccaacaaggatccactgcctccgttggacccccaagctataaagccgattctaaaggcattactggataacactaaagataaaaacaccgtggttagagcctactcggaccaggccatcgtcaatctccttaaaatgagacagggggaggaggtgttccagtcgctcagcaagatcttggacgtggcgtccctggaagtgctaaatgaagtcaatcgaaggtctcttaaaaagctagcctcccaggctgactccacggagcaggtggatgacacaattttgacctag

SEQ ID NO: 189008 - DNA, 1443 bp, Artificial Sequence
  Description of Artificial Sequence: Synthetic coding sequence
atggcccagcacgacttcgcccccgcctggctgaacttccccaccccaccgtcgtccacaaaggtcttgacgagttcactgaagagctctcttaacttcgagaagcacagtgaaaactttgcctggacagaaaaccgttatgatgtgaacaggcgtcgacataacagtagcgatggctttgattctgctatcggaagacccaatggcgggaatttcggaaggaaagagaagaacggctggcgcacacatggcagaaatggcactgagaatattaaccaccgcggggggtaccatggaggatcctctcgttcaaggagctcaatattccacgccgggaagagccaggggctgcacgagaataatattcccgacaacgagacagggcgaaaggaagacaaaagagagaggaaacagtttgaggccgaggattttccctccctgaacccagaatatgaacgggaacctaatcacaacaagtccttggctgcaggggtgtgggagtatcctccgaatccaaagtccagggccccacgcatgttggtcattaaaaaaggaaacacgaaggaccttcaactgtccggattccccgttgtcggcaatctgccctctcagccggtcaagaatgggaccgggccttctgtgtacaaagggctggtgccaaagcctgcagcaccccccacaaagcctactcagtggaagtcgcagacaaaagagaacaaggtcggcaccagcttcccacacgagtcaacctttggggtagggaacttcaatgccttcaaatccacagcgaaaaattttagccccagtacgaacagtgtaaaggagtgcaacaggtcgaacagttcatcaccagttgataagcttaatcagcaaccgagactgacgaaactgacaaggatgcgaactgacaaaaaatcagagttccttaaagcccttaagagggaccgcgtggaggaggagcacgaggacgaatcgagagctgggtcagaaaaagatgatgacagcttcaatttgcacaactctaatagcactcaccaggaaagagacataaataggaactttgatgagaatgagatcccacaggagaacgggaacgctagcgtgatttcccagcaaatcattcggagttctactttccctcagaccgacgttctgtcttcctctctggaggccgaacacagactgcttaaggagatgggctggcaggaagatagtgagaacgacgagacatgcgctcctctaactgaagatgagatgagagaatttcaggttatctccgaacagctgcagaaaaacggcctgcgcaagaatggtattctcaaaaatggactgatttgtgattttaagttcgggccttggaaaaatagcacattcaaacccactactgagaatgatgataccgagacctcctcaagcgacacctccgatgacgacgatgtttag

SEQ ID NO: 189009 - DNA, 1482 bp, Artificial Sequence
  Description of Artificial Sequence: Synthetic coding sequence
atggcccagcacgacttcgcccccgcctggctgaacttccccaccccacctagcagcactaaaagcagtctcaactttgaaaaacattccgaaaatttcgcctggacagagaataggtatgatgttaacagacgtaggcataacagcagcgacggttttgactccgcaatcggcagacctaatggagggaacttcggccgaaaggagaagaacggctggcggactcatggacggaatggaaccgagaacataaaccaccggggcggctaccacggcggatcttcccggtcgcggtcgtcaatatttcatgcgggtaaatcacagggcctgcacgaaaacaatattcccgataatgagactggcaggaaagaggacaaacgcgagaggaaacaatttgaggccgaagactttccttccctcaatcccgagtacgagagagaacccaaccacaacaaatccttggctgcgggtgtctggggactgcatgcgcaaacccacacatacccgacaaagaaaatctctcaggcccctctgctggagtaccctccgaatccaaagtcccgggcccccagaatgctggtgattaaaaaaggcaacacgaaggacttacagctgagtggatttccggtggtgggaaacctgccgtcccaacctgtgaagaacggaaccgggcctagcgtgtacaaaggattagtgccaaaaccggcagccccacctacgaagcccacccaatggaaatcccagacgaaggagaataaggtagggacatcattcccgcacgagtcaactttcggggtgggcaatttcaatgcatttaagtcgacagctaagaatttttctccgagcacaaatagtgtcaaagagtgcaaccgctccaactcatccagccccgttgacaagcttaatcagcaacctcgcctcacaaaactgacacgcatgaggaccgacaagaagagtgagttcctgaaagccctcaagagagatcgagtcgaggaagagcacgaagatgagagccgggcaggcagcgagaaagacgatgactcattcaatttgcacaactccaacagcacccaccaggagagggacattaacagaaactttgacgagaacgagattcctcaggagaacggaaatgcttctgtgatatcacagcagatcattagatcatcaacatttccacagacagatgtcctgagcagtagtctggaagcagagcatcgcctcctgaaggagatgggttggcaggaggactcagagaacgacgagacttgtgcgcccctgaccgaagacgagatgagagaatttcaggtcatctccgagcagcttcagaagaacgggctcagaaagaatggcatccttaagaacggactgatctgcgactttaagtttggtccttggaagaactccaccttcaaaccgactaccgagaatgacgataccgagaccagctcatccgacacaagcgacgatgacgacgtctag

SEQ ID NO: 189010 - DNA, 1482 bp, Artificial Sequence
  Description of Artificial Sequence: Synthetic coding sequence
atggcccagcacgacttcgcccccgcctggctgaacttccccaccccgcctagcagcaccaaaagctctctgaattttgagaaacattctgagaacttcgcctggaccgaaaatcgttacgacgtcaaccgcaggagacacaactcttccgacgggttcgacagtgcaatcgggaggcccaacggcggaaatttcggccggaaggagaaaaatggatggagaacccatggcagaaacggtaccgaaaacattaaccaccgcggcggatatcatggaggaagctctagaagcaggtccagtatctttcatgcgggaaaatctcagggacttcacgaaaacaacattcctgacaatgagaccggcaggaaggaagacaagagggaacggaaacagttcgaagcagaagattttccatccttgaatcctgagtacgagagagagcctaaccataataagtctcttgccgccggcgtgtggggtttgcatgctcagacgcacacataccctacaaaaaagatcagccaggcaccgttattggagtatcctcctaatccgaaaagtcgcgcgcctcggatgctcgtgataaagaaggggaataccaaggatctgcaactgtccggatttcccgtggtgggaaacctgccttcgcagcccgtcaagaatggtactggtccttcagtgtacaagggcctggtaccaaagccagccgcccccccaaccaaacctacccagtggaagtcacagacaaaggagaataaggtgggtacctcctttccccatgagagtactttcggcgttggcaattttaacgcatttaagtctacagcaaaaaacttcagccctagtaccaacagcgtgaaagagtgcaatagaagcaactcctcctctcctgtggataagttgaatcaacagcctcggctgactaaacttacacggatgcggacagataagaaatccgaattcctcaaagcactgaaaagggatcgcgttgaagaagagcacgaagacgaatccagagccgggagcgagaaagacgatgacagcttcaacctccacaacagcaattcaacccaccaggagcgggacattaatcggaacttcgacgagaacgagattccccaggagaacggtaatgcatctgtgatttcccagcagatcatcaggagttccacttttccccaaaccgatgtgctgtcttcctctctggaagccgagcatagactcttaaaagagatgggttggcaagaggattccgaaaatgacgagacctgcgctccacttactgaagatgagatgcgcgaattccaggttataagtgagcagctccagaaaaacggattaaggaagaacgggatcctgaaaaacggcctgatttgcgactttaagttcgggccatggaagaactcaactttcaaacctacaactgagaacgacgataccgagacctcctcaagcgacacttccgatgatgatgatgtctag

SEQ ID NO: 189011 - DNA, 1422 bp, Artificial Sequence
  Description of Artificial Sequence: Synthetic coding sequence
atggcccagcacgacttcgcccccgcctggctgaacttccccacccccccgtcttctaccaagagcagtctgaactttgagaagcatagtgagaacttcgcgtggactgagaatcgatatgacgtgaacaggcgaaggcacaactccagtgatggctttgactcagcgatcggacgtccgaacggagggaacttcggaaggaaggaaaaaaatggatggcgcacgcacggcaggaacgggacggagaatatcaatcaccgcggggggtaccacggggggtccagtcgctctcgaagtagcatcttccacgccggtaaaagtcagggcttgcatgaaaataacatacctgataacgagacggggcggaaggaagacaagcgcgagaggaagcaattcgaggcagaggacttcccgtccctcaaccccgagtacgagcgcgaacctaatcacaacaagtccctggccgctggtgtctgggagtatccgcccaaccccaagtcacgagctcccaggatgctcgtgataaagaaggggaataccaaagacctccagctgtctggtttcccagtcgtcggcaatctgcccagtcagccagtgaagaatggcaccgggcccagcgtgtacaaggggctggtgcctaaaccagctgcccctcctacgaaaccaacccagtggaagagtcagaccaaggagaataaagtaggaaccagctttcctcacgaatcgacatttggtgtcggcaatttcaatgcttttaagagcacggcgaaaaatttttcccccagcaccaattcggtgaaggagtgcaatcgatcaaattcatcatcaccagtagacaagctgaatcagcaaccccgattgacaaaactgactagaatgcggactgacaaaaaatctgagttcctcaaggccctgaaacgcgatcgggtcgaggaagaacatgaggacgagtcaagagcggggagtgagaaggatgacgatagctttaatctgcataactccaacagtactcaccaggagcgagacatcaatcggaattttgacgagaatgaaatacctcaggagaacggcaacgcgagcgtgattagccagcagatcattagatcttcgacctttccacaaacagatgtgctatcttcttcactagaagccgagcaccggctgttgaaggagatgggctggcaggaggattcggagaatgatgaaacctgcgctcccctcacagaggacgaaatgagagaatttcaagttatcagcgagcagcttcagaaaaacggactccgaaagaatggaatattgaaaaatggcctgatctgcgacttcaagtttggaccctggaaaaattccacttttaagccgacaaccgagaacgacgataccgaaacttcttcgagtgacacctctgatgacgatgatgtctag

SEQ ID NO: 189012 - DNA, 1398 bp, Artificial Sequence
  Description of Artificial Sequence: Synthetic coding sequence
atggcccagcacgacttcgcccccgcctggctgaacttccccaccccaccgagtagtacaaaggtgctgacttccagtctgaaatcttcactaaactttgaaaagcactctgagaatttcgcctggaccgagaataggtatgatgttaaccgtagacgtcataatagctccgacggttttgacagtgccattggtcgtcccaatgggggcaatttcggccgaaaggaaaagaatggctggcgcacacatggtcgcaatggcaccgagaatataaatcaccgtgggggttatcatggaggttcttcccgctcacggtcttcgatttttcacgctggaaaaagtcagggcctacatgagaacaatattcctgataacgagactggccgcaaggaggataaacgggagcgaaagcaattcgaggccgaagactttcccagcctgaatcctgaatatgaacgggagccaaatcataataagtccctggcagctggagtatgggagtatccacccaatccaaaatcccgcgctcctcggatgctagtgattaagaaggggaacaccaaggacctccagctgagcggttttcccgtcgtgggtaacctgccttctcagcccgttaaaaacggcactggcccttcagtgtacaaaggcctcgtacctaagccagctgccccacctacgaaaccgacgcagtggaagagccagacaaaggagaacaaggttggcacatcttttccccacgagagtactttcggggtaggaaattttaacgcattcaagtctactgccaagaacttttccccttccactaattctgtgaaagaacagcctcggctaactaaacttacgcgcatgcggaccgataaaaaaagcgagtttctgaaagctctgaagagggatagggttgaagaggaacacgaggacgaaagtcgtgcagggagtgagaaggatgacgattcattcaatctgcataattctaattcgacacaccaggaaagagatatcaatcgaaactttgacgagaatgagattcctcaagagaacggtaacgcgagcgtgattagccaacagattatccgcagctctactttcccacagaccgatgtcctgagttccagcctggaggcggaacaccgattactgaaagagatggggtggcaggaggacagtgaaaacgatgaaacatgcgctcctctgaccgaagatgaaatgcgcgagtttcaagtgatttctgagcagctacaaaagaacggcctccgcaagaatggaatccttaaaaacggactgatctgcgatttcaaattcgggccctggaagaattcaacattcaaacctacaactgaaaacgacgatacggagacaagctcttctgacactagcgacgacgatgatgtttag

SEQ ID NO: 189013 - DNA, 909 bp, Artificial Sequence
  Description of Artificial Sequence: Synthetic coding sequence
atgctggtgatcaagaagggcaacaccaaggacctgcagctgagcggctttcccgtggtagggaatctcccgtctcagccggtgaagaacggaaccggcccaagcgtgtacaaggggctcgtgccaaagccggccgcacctcccactaagccaacccagtggaaaagtcagactaaggagaacaaggtggggaccagtttcccgcacgagagcacctttggcgttggcaatttcaatgccttcaaatctacggccaagaacttttctccaagtacaaactccgtgaaggagtgcaaccgcagtaactccagcagccctgtggataaactcaatcaacagccccgactgactaaattgacgcgcatgaggactgataaaaagtccgagttcttaaaggctctgaaacgcgaccgtgtggaggaagagcacgaggacgaatccagggcggggagtgagaaggacgacgactcattcaatttgcacaattccaacagtactcaccaagaaagggacatcaacagaaactttgatgagaatgaaatccctcaggaaaatggcaacgcctcagttatatctcagcagattatcaggagctctacattcccacagactgatgttctgtcctcaagcctggaggcggagcacaggctgttgaaagagatgggatggcaagaggattccgagaatgatgagacctgtgcccccctcactgaggacgagatgcgggagttccaagtgatcagcgagcagcttcagaaaaacggactgcggaagaacggcatattgaagaacggcttaatctgcgacttcaaattcggtccctggaagaattctacattcaaacctactaccgagaatgacgacacagaaacaagcagtagtgacacctcggacgatgacgacgtctag

SEQ ID NO: 189014 - DNA, 1443 bp, Artificial Sequence
  Description of Artificial Sequence: Synthetic coding sequence
atggcccagcacgacttcgcccccgcctggctgaacttccccacccccccttcctcaacgaaggtcttgtcaaatactctgaagagcagcctgaacttcgaaaagcactcagagaattttgcctggacagagaacagatatgatgtgaacagacgcagacacaacagcagcgatgggttcgattcagctatcggtagacctaacggtggtaacttcggtaggaaggaaaagaatgggtggcggactcacggtaggaatgggaccgaaaatataaaccaccgagggggatatcacggtggttcaagccgctcaagaagctcaatctttcatgcaggaaagagtcaaggacttcatgagaacaacatcccggacaacgagactgggcgaaaggaggacaaaagggaacgcaaacagttcgaggccgaggattttccctccctgaatcccgagtacgagcgagagccgaaccacaacaagtccttagccgcgggagtctgggagtacccccccaatccaaaaagccgcgccccacgaatgctcgtgatcaagaaagggaatacaaaggacttgcagctatctggatttcctgtagttgggaatctgcctagccagcccgtgaaaaatggtactggcccgtccgtctataaaggcctggtgcccaagcccgccgccccgccaactaagcctacccagtggaagagtcaaacaaaggaaaataaggttgggacctcctttccacacgaatcaacattcggcgtggggaacttcaatgcattcaagtcaacagccaaaaacttctctccaagtacaaattccgtcaaagagtgcaacagaagtaatagctcctcccctgtagataagctcaaccagcagccccggctcacaaaactgactagaatgaggactgacaagaaaagtgaattcctgaaagccctcaagcgcgaccgcgttgaggaggagcatgaggatgagtctagggccgggagtgagaaagatgacgacagcttcaatctacacaattctaattccacacatcaagagagagatattaatcgcaatttcgatgaaaacgaaatcccacaagagaatggcaatgcgtccgtcatcagccagcagattattcgcagcagcacctttcctcagactgatgtgctctctagctctctggaggccgagcataggctgctcaaggagatgggctggcaggaggatagtgagaatgacgagacgtgtgcaccgttaacagaagacgagatgcgagaatttcaggtgattagtgagcagctgcaaaagaatggcctgagaaaaaatggcattctgaaaaatgggctaatctgcgatttcaagttcggcccttggaaaaactcaacgttcaagccaaccaccgaaaacgatgacaccgagacctcgtcttcggatacttccgacgacgatgacgtgtag

SEQ ID NO: 189015 - DNA, 1383 bp, Artificial Sequence
  Description of Artificial Sequence: Synthetic coding sequence
atgttcctggccaccctgtacttcgccctgcccctgctggacctgctcctgtcggctgaggtcagcggaggcgataggctggactgtgtcaaggcctctgaccagtgtttgaaggagcaaagttgctccacgaaataccgcaccctcaggcagtgcgttgcaggaaaagaaacaaatttctctttggcttctggtctggaagctaaggacgagtgccgatctgcaatggaagctctgaagcaaaagagtttgtacaattgtaggtgtaaaagggggatgaagaaagaaaaaaattgccttaggatctactggagcatgtaccagagcctgcaaggaaacgatctcctcgaagactctccctacgagcccgttaattctagactctctgatatctttcgcgttgtaccgtttatttctgtcgagcacattcccaaaggtaacaactgcttagatgccgctaaggcttgtaatctcgatgatatctgcaagaagtaccggagcgcctatatcacaccgtgcactacatctgtgagcaacgacgtatgcaatcggagaaaatgtcataaagctctccgtcagtttttcgacaaggttccagctaagcactcctatggcatgttattctgcagctgcagggatattgcctgtacggagagaagaaggcagacaattgttcccgtgtgcagctacgaggaaagggagaagcctaattgtttgaatctacaagactcatgcaaaaccaattatatctgtcgatctcgcctggcagacttttttacaaactgccagcctgaaagtaggagcgtgtcctcatgtctcaaggagaattatgcagactgcctattagcctattccggcctgatcgggaccgtgatgacccccaattacattgacagctcttctctttccgtggccccctggtgcgactgctctaacagtggtaatgatctggaggaatgcctgaagttcctcaacttcttcaaagacaatacatgcctaaaaaacgcgatacaggcctttggtaacggcagcgatgtgacggtgtggcagccagcattcccagtccagaccaccacagccacgaccacaaccgcactaagggtgaagaataaacctctgggtccagccggcagtgaaaatgagattcccactcatgtgctccctccttgcgcaaatttgcaagctcagaagctgaagagcaacgtgtctggcaacacgcacctctgcatctcaaatgggaactacgaaaaagaggggcttggtgcatcttctcacatcaccaccaaatccatggccgctccaccatcatgtggactgtcacccttgctggtgctcgttgtgacagccctgtccacacttctgtccctcacagagacatcgtag

SEQ ID NO: 189016 - DNA, 1383 bp, Artificial Sequence
  Description of Artificial Sequence: Synthetic coding sequence
atgttcctggccaccctgtacttcgccctgcccctgctggacctgctcctgtccgcggaagtgtccgggggggaccggcttgactgcgtaaaagcgagtgatcagtgcctgaaggagcagagctgttctacaaagtatagaaccttgcgccagtgcgttgcggggaaagagaccaactttagcctggcctcgggtctggaagctaaggatgagtgccggagtgccatggaagccttgaaacagaagagtctttacaattgcagatgcaagagaggcatgaagaaggaaaagaactgcctcaggatatactggtcaatgtatcagagccttcaaggcaacgacctgctggaagacagcccttacgaacccgtgaacagccgcttaagcgacatctttcgcgtcgttcctttcatttccgtggagcacattcctaaaggaaacaactgtttagatgccgcaaaggcttgcaacctggatgacatatgcaaaaaataccgctccgcttatattaccccatgcactactagtgtatctaatgacgtgtgtaacagaaggaagtgccacaaagcccttcgacaatttttcgacaaggtccccgcaaaacactcctacgggatgttgttttgctcttgtcgagatatagcgtgtaccgagaggagacgtcagaccattgtgccagtgtgctcctatgaagagcgtgaaaaaccaaactgtttgaacctgcaggattcttgcaaaacgaattacatttgtagaagccggttggctgattttttcactaactgccagccagagtctcgttccgttagcagttgcctcaaagagaattacgctgactgcctcctcgcctatagcggcctcatcggcacggttatgacgcccaactatattgactccagctccctgagcgtggccccctggtgcgactgtagcaactcagggaatgatttggaggaatgcttaaaattcttgaattttttcaaggataacacatgcctcaaaaacgccatccaggcattcgggaatggatcggacgttacggtatggcagccagcatttcctgtacagacaacaacagccactactaccacggccttacgggtgaagaataagccactggggcctgcaggctcggaaaacgaaattcccacacacgtcttgcctccatgcgccaacttacaggcccagaagctcaagtctaatgtgagtggaaatacccacctatgtatatccaatggcaactacgagaaagagggactgggagcctcttctcacattactacaaagtctatggctgcaccgccgtcgtgcgggcttagtccactgctggtcctggtagtgactgcactgtctacgctactgtccctgacagagaccagctag

SEQ ID NO: 189017 - DNA, 1383 bp, Artificial Sequence
  Description of Artificial Sequence: Synthetic coding sequence
atgttcctggccaccctgtacttcgccctgcccctgctggacctgttgctgtcagccgaggtttctggaggagatagactggactgtgttaaggcttcagaccagtgcctcaaggaacagagctgtagtaccaagtataggacactcaggcagtgcgtggctggcaaggaaaccaatttctcacttgcgagcggactcgaagccaaggatgaatgtcgaagtgccatggaggctcttaaacaaaaaagcctttacaactgtcgatgtaagcggggcatgaaaaaggagaaaaactgcttacgtatttactggtctatgtatcaaagcctgcaggggaacgatctccttgaagactctccatacgagcctgtgaactcacggctcagtgatattttccgggtcgtcccattcattagtgtggaacatattccaaagggcaataactgtttagatgccgctaaagcttgcaaccttgatgatatatgcaaaaagtaccggtctgcctacataaccccgtgcaccacctccgtgagcaacgacgtgtgtaatagacggaaatgccacaaagccttacgccaattcttcgacaaggtccccgccaagcattcatacggcatgctcttttgctcatgcagggacattgcttgtaccgagcgaagaaggcagacaatcgtcccagtctgcagctacgaagagcgggagaaacccaactgcctcaatttacaggattcttgcaaaactaactatatctgcaggagtcggcttgcagacttcttcacaaactgtcagcccgaatcgcggtcggtctccagttgcctgaaggaaaattatgccgactgcttactggcctacagtggtctaatcggtacagtgatgactcccaactacatagatagtagttctctgtcggtggcaccctggtgcgactgtagtaatagtggcaatgacttagaagagtgcctcaaattcctcaacttttttaaggataatacgtgtctcaagaacgcaatacaggcctttggtaatggctcagatgttacagtctggcagccagctttccccgtgcagaccacaacagccactactaccaccgccctgagggtaaaaaacaaaccgcttggtcccgctggcagcgagaatgagatccctactcacgtgttgcccccctgcgccaatttacaggcgcagaagctcaagtctaatgtttcaggaaacacccatctgtgtataagcaacgggaattacgaaaaggagggcctgggcgcttcatcacacattacgacaaagtccatggcagctcctccctcctgtggcctttcacccctgcttgttctagtggttaccgccctgtctaccttgttgtctctgacagagaccagctag

SEQ ID NO: 189018 - DNA, 1398 bp, Artificial Sequence
  Description of Artificial Sequence: Synthetic coding sequence
atgttcctggccaccctgtacttcgccctgcccctgctggacctgctcctaagtgcagaggtcagcgggggagacagactggactgtgtgaaagcctcagaccagtgtctgaaagaacagtcttgcagtacaaagtaccgaacgctccgtcagtgtgtggcggggaaagaaaccaactttagcttggcctctggcttggaggcgaaggatgaatgtagaagcgcgatggaggctcttaagcagaagtcactttacaactgcagatgcaagcgaggaatgaaaaaggagaaaaactgcttgagaatctactggtcaatgtatcaatcgctgcaggggaatgatttacttgaagacagcccgtatgagcctgtcaatagcaggctcagcgatatcttccgggtggtgcctttcatctctgacgtattccagcaggtggagcatataccaaaaggcaacaactgtttagacgccgctaaagcgtgcaatttagatgacatctgcaagaagtatcgctcggcatatattactccgtgtactacatctgtgagtaacgacgtttgtaacagacgcaagtgtcacaaggctttgcgtcagttcttcgacaaagtaccagccaagcacagctatggcatgttgttctgcagttgtagagatattgcgtgcacagaacggagaaggcagactattgtgcccgtgtgttcctatgaggagagggagaagccaaattgtctgaatttgcaggattcttgcaagacaaactatatttgcagaagtagactagcagatttctttactaattgccagcctgagtcgcgcagtgtatccagctgtctgaaagagaactatgctgattgcctgctcgcttactccggacttattggaaccgtcatgaccccaaactacatcgatagtagtagtctcagcgtcgctccatggtgcgattgttccaattctggtaatgaccttgaggagtgcctaaagtttttaaactttttcaaggacaatacttgcctgaagaacgccatacaggcatttggcaatgggagcgatgtcacagtctggcagccggcttttcctgtgcagaccacgaccgccacaacaactacagctctaagggttaaaaacaagcctctgggccctgcaggatccgagaacgagatccctacccacgtgttacccccttgcgcaaatcttcaagcccagaaactgaaatccaacgtatctgggaatacacacctgtgtatctcaaatggcaattacgagaaggagggactcggggcaagtagccacattactaccaaatctatggctgctccacccagttgcggcttgtcacccttgctggttctggtcgtgactgccctgtcaaccttgctgtccttgacagagactagctag

SEQ ID NO: 189019 - DNA, 1035 bp, Artificial Sequence
  Description of Artificial Sequence: Synthetic coding sequence
atgcaggagggcaagttctggaagggcatggccgagaccggcatgtggggttgtggcgaatggatccctgtagagcatatccccaaaggaaacaactgtctagacgcagccaaggcctgtaacttagatgacatatgtaagaagtaccgatccgcctatataaccccctgcactacatcggtgagtaacgatgtgtgtaacagacgaaagtgccataaggcactgaggcagttttttgataaagttccggcaaaacacagttacggtatgctcttctgctcctgtcgggacatagcttgcaccgaacgacggagacaaaccatagtcccagtgtgcagttatgaagagcgagagaagccaaactgcctgaacctccaagacagttgtaaaaccaattatatctgcagaagtcgactagccgacttctttacaaattgccagcctgagtcccgctctgtttcaagctgtctgaaagaaaactatgcagattgcctgctggcttattctgggcttatcggcacagttatgacacccaattacattgatagttcttctctgagcgtggcgccctggtgcgactgttcaaactcgggcaatgaccttgaagagtgcctgaagtttttgaacttctttaaagataatacttgcctcaagaatgcgattcaggcgtttggcaacgggtcagatgtaacagtctggcaacctgctttccctgtgcagaccaccactgccaccaccaccacagccctgcgggttaagaataagccgctgggccccgcggggtccgaaaacgagattcctacgcacgttttgcccccttgcgccaatcttcaggctcagaagctgaagtccaatgtgtccggcaatacacacttatgcatcagcaatggcaactacgagaaggaaggtctaggagccagttctcacataacgacaaagagcatggcagcaccgccctcctgcgggttatcgcctctgctggtcctcgtcgtaacagccctgtcgaccctcctgtcactcactgagactagctag

SEQ ID NO: 189020 - DNA, 1080 bp, Artificial Sequence
  Description of Artificial Sequence: Synthetic coding sequence
atgatcctggccaacgtgttctgcctgttcttcttcctgggcgaggagttctacgaggcatctccatacgagcccgtcacaagccggctatcagatattttccggctcgcctctatattttcaggcaccggagccgatcccgtggtgtcagcaaagtccaatcactgtctggacgcagctaaagcctgtaacctgaacgacaattgtaagaagctccggagcagctatattagcatttgtaaccgggagatatcaccaacagagagatgcaaccggaggaaatgccataaagccctgcggcagtttttcgatcgggtgccaagcgaatatacatacagaatgctgttttgcagttgccaggatcaggcctgcgccgaacgaaggagacagacaattctcccttcctgctcctatgaagacaaagagaagcccaattgcctagatctgaggggagtctgtcggacagatcacctgtgtaggtctaggttagctgacttccatgcaaattgccgcgcctcatatcagaccgtcacatcgtgccccgccgataattaccaggcctgtctcggaagttatgccgggatgattggcttcgatatgactccaaactacgtggactcttcaccaacggggatagtcgtctctccctggtgcagttgtcgcggctcaggcaatatggaggaggagtgcgagaagttcctgagggattttaccgagaatccctgtctgagaaacgcaatccaggctttcgggaatggaaccgatgtcaatgtaagccccaaaggccctagcttccaggcaactcaagcaccccgggtggaaaaaaccccttcgctaccagacgacctttccgactccacttctctgggcacttcagttatcactacatgcactagcgtgcaagagcaggggcttaaggcaaataactccaaagagctgtcaatgtgttttaccgaactgacaacaaacatcatcccgggtagtaacaaggtcatcaagcccaattccgggccctcacgtgccagaccttccgcagccttaactgtcttatccgtcctgatgttgaagctcgccctctag

SEQ ID NO: 189021 - DNA, 1395 bp, Artificial Sequence
  Description of Artificial Sequence: Synthetic coding sequence
atgatcctggccaacgtgttctgcctgttcttcttcctggacgagacactacggagcttggcttcaccgtcaagtcttcaaggtcctgaattacatgggtggagacctcccgtagactgcgtaagagccaacgaactctgtgctgctgaatccaactgttcaagtcggtatcgcacactgcggcagtgcttggccggtcgagatcgcaacacaatgttagctaataaggagtgccaagctgcactggaggtcctgcaggagagcccgctgtatgattgcaggtgcaaacggggaatgaaaaaggagctgcagtgcttacagatatactggtccatccacctgggactcactgagggagaagaattttacgaggccagcccttatgaacccgtgacatcaaggctatcggatatcttcaggctggcttcaattttctccgggaccggtgccgatccagtggtgtcagccaagagcaaccactgcctggatgccgccaaagcctgtaacctgaatgacaactgcaaaaaactgcgaagctcgtatatttcgatatgcaacagagagatctcacctactgagcgatgcaatcggagaaaatgtcataaggccttgaggcagttctttgacagggtgccctccgagtatacatatcgcatgctattttgttcctgccaagaccaggcttgtgcagagagaagacgccaaaccatcctgccaagttgctcatacgaggacaaagagaaacctaactgtttggatttgagaggcgtctgcaggacagatcacttatgcaggtccaggctggccgactttcacgccaactgtagagcgtcttaccagacagttactagctgtccagcagacaattatcaggcctgtcttggaagctatgctgggatgatcggcttcgatatgaccccgaactacgtcgatagctccccgaccggtatcgtcgttagcccatggtgctcgtgtcgagggagcgggaatatggaggaggaatgcgagaagtttctccgtgactttaccgagaatccatgtctgcgcaacgccatccaggctttcggtaacggcactgacgtcaatgtgtcacccaagggcccttccttccaggctactcaggcacctagagtcgagaaaactccgagcttgcctgacgatttgtccgacagtacctcccttggtaccagcgtcattacaacttgcacaagtgtacaggagcagggccttaaagcaaacaactctaaggagctgtctatgtgctttactgagttgacaacaaacattatcccaggtagtaacaaggtgattaaaccaaattccggcccttcgcgagcccgaccaagcgctgccttgaccgtgctttccgtgctgatgctcaagttggctctgtag

SEQ ID NO: 189022 - DNA, 996 bp, Artificial Sequence
  Description of Artificial Sequence: Synthetic coding sequence
atgatcctggccaacgtgttctgcctgttcttcttcctgggcaccggcgctgatccagttgtgagcgctaagagtaaccactgcctggacgcagcaaaggcatgcaacttgaatgataactgtaaaaagctgaggtcctcctacattagcatatgcaaccgggagatctcccccaccgagaggtgcaaccggcgaaagtgccataaggccctgcgccagttctttgaccgtgtgccgtccgagtatacgtatagaatgctattctgttcgtgtcaggatcaagcatgtgcggaaaggaggagacagacaatcctgccttcatgttcttatgaagataaggagaaaccaaactgtctggacctacggggcgtgtgtaggactgaccacctgtgtagatccagactggcagattttcacgctaactgtcgagcatcctaccagacggtcaccagctgcccagccgacaactaccaagcatgcctgggcagttacgcaggtatgattggctttgatatgacccccaactatgttgattcctccccaaccggtatcgtcgtctctccctggtgtagctgccgcggaagcggcaatatggaggaagaatgcgagaaatttctccgcgactttactgagaacccttgtttacgaaacgcgattcaggcatttggcaacgggactgatgtcaacgtttctcccaaggggccgtcctttcaggccacccaggcccctcgcgtggaaaagaccccttctctgccagacgacctgtccgactccacctctctcggcacgtcagtgatcaccacttgcaccagcgtgcaggagcagggcctgaaggctaacaacagtaaagagctgagcatgtgtttcactgaattgaccaccaacattatccccggaagcaacaaggtaataaagcctaacagcggaccttctagggccaggccaagcgctgccctgaccgtgctaagtgttctcatgctaaaacttgcgctgtag

SEQ ID NO: 189023 - DNA, 798 bp, Artificial Sequence
  Description of Artificial Sequence: Synthetic coding sequence
atgatcctggccaacgtgttctgcctgttcttcttcctggacgagaccctgcgctcattagcctcccctagcagtctgcagggccccgagctgcatggatggcggccccctgtggactgcgtgcgggccaacgaactgtgcgctgcagaatcaaattgtagctccaggtataggactctccggcaatgcctcgccggaagggacaggaatacgatgctggcgaacaaggagtgccaggccgcgctggaagtcttgcaagagtctccactgtacgactgtagatgcaaaagagggatgaagaaggagctgcaatgtctgcagatctactggtccattcatctggggctaactgaaggcgaagagttctatgaagcgagtccctacgaacctgtgacctcacggctgagcgacatcttcaggctggcctcaattttttctggtacgggcgcagatccggtcgtcagtgcgaaatctaatcattgccttgatgccgctaaagcttgcaatttaaatgacaattgcaagaagctaaggtcgagctacatcagtatttgtaatcgtgagatctctcccacagaaaggtgtaatcgccggaaatgtcataaggctctcaggcaattttttgatagagttccttctgaatacacctatcgcatgctcttctgttcatgtcaggaccaagcgtgtgcggaaagacggcgccagactatcctgccctcctgcagctacgaagataaagaaaagccaaattgcctggacctccgcggtgtttgtagaaccgatcatttatgcaggtag

SEQ ID NO: 189024 - DNA, 1395 bp, Artificial Sequence
  Description of Artificial Sequence: Synthetic coding sequence
atgatcctggccaacgtgttctgcctgttcttcttcctggacgagacccttagaagcctggcgtccccctcatctctgcaggggccagagcttcacggctggcgccctccagtggactgtgtccgagccaacgaactctgtgctgccgagtctaattgttcttcacggtacagaaccctgaggcaatgtctggccggaagagacagaaataccatgctggccaacaaggagtgccaggcggctcttgaagtactccaggaatcaccattgtacgactgtagatgcaaacgcggcatgaagaaggaacttcagtgtctccagatctactggtccatacacctagggctgacggagggagaggagttctacgaagcctccccgtacgagcccgtaaccagcagactttcagacatcttccgtttggcttcaattttctcagggactggggctgacccagtagttagcgccaagagtaaccactgccttgacgccgcgaaggcctgcaatctgaatgacaactgtaagaaactgagaagctcttacatttctatttgcaatcgtgagatatcaccgaccgagaggtgcaaccggcggaagtgtcacaaagcgcttagacagttcttcgaccgagtccctagtgagtatacatacaggatgttattctgcagttgccaggaccaggcatgcgctgagcggaggcggcagaccattttaccatcttgttcatacgaggataaggagaagcccaattgtctcgacttacggggggtgtgtcggactgatcacctgtgtaggtcccggttggctgactttcacgccaattgcagagcgtcttaccaaacagtgacatcatgccccgcggacaactaccaggcctgccttgggtcctacgccgggatgattggctttgacatgacccccaattacgtcgattccagccctacaggcatcgtggtgagtccctggtgcagctgccgcggctccggaaacatggaagaagagtgcgaaaaattcctcagggactttacagaaaacccctgtctgcggaacgccatccaggcttttggcaacgggacagacgtcaacgtgtctccaaaagggccatccttccaggcgacccaagcacctagggtggagaagactccaagcttaccagacgacctcagcgattctacctcactgggaactagtgtgatcaccacctgtacatctgtccaggagcaaggcttgaaagctaacaactcaaaagagttgtctatgtgctttacagaacttaccactaatatcatacctggctctaataaggtgattaagccgaactccggaccttctagggccagaccctcagccgccctgacagtgctcagcgtgctcatgcttaaactcgcattatag

SEQ ID NO: 189025 - DNA, 1203 bp, Artificial Sequence
  Description of Artificial Sequence: Synthetic coding sequence
atggtgcggcccctgaacccccggcccctgccccccgtggtgctgatgttgttactactcttgccccccagcccattgcctctggccgcaggcgatccgctcccaactgaatctagattaatgaactcgtgcctgcaggctcgccggaagtgtcaggcagatcccacttgcagcgcagcttaccatcacctggactcatgtacctcttcgatctccactcctctgcccagcgaagagccttcggtcccagccgattgccttgaggcggcacaacagctcagaaactcctccctcatcggctgtatgtgccaccgcaggatgaaaaaccaagttgcatgtctggacatttactggacagttcatagggcacgatctctgggtaactatgagctggacgtgagtccctatgaggacacagtgacctcaaaaccttggaaaatgaacctttccaagttgaatatgctgaagccagatagcgacttgtgtctgaaatttgccatgctgtgtacgctcaatgataaatgtgatagactccgcaaggcgtacggggaggcctgtagtggtccccattgtcagcgacatgtttgcctcaggcagctactgacctttttcgagaaggctgctgagccacacgcccagggactgctgctgtgtccatgtgccccaaatgacaggggctgcggcgaaagacgcaggaatacaattgccccgaactgtgcgctacctccagtagcccccaactgtctcgagctgcggagactctgcttcagcgatcctttatgcaggtctagacttgttgatttccagacccattgtcatccaatggatattctgggcacatgtgcaactgagcaatctaggtgcctgcgagcttacctgggacttattgggacagcgatgacgcctaatttcgtgagcaacgtgaataccagcgtggccctgagctgcacatgtagaggttctggaaaccttcaagaggaatgcgagatgttggagggcttcttctcgcataacccctgtctgactgaagctattgcggccaagatgaggttccattcacaactgtttagtcaggactggccccatcccaccttcgctgtcatggcccaccagaatgaaaaccccgcggtaaggcctcagccctgggtacccagtctgttttcctgtacattgccattaatactgctgctatccttatggtag

SEQ ID NO: 189026 - DNA, 1110 bp, Artificial Sequence
  Description of Artificial Sequence: Synthetic coding sequence
atggtgcggcccctgaacccccggcccctgccccccgtggtgctgatgctcttactgcttttacccccctccccactccccttagcggccggcgatccactgccgactgagtccagactcatgaattcttgcctacaggcacgaaggaagtgccaggcagaccccacttgcagcgccgcttaccatcatctggactcatgcacctcctctataagtacacccctgccctctgaggaaccaagcgtgcctgccgattgtctggaggctgcccagcagcttcgcaattcctctctgatcggatgcatgtgtcataggaggatgaaaaaccaggtggcatgcctcgacatctactggacagttcatagagccaggagcctcgattctgacctgtgcctaaaattcgctatgctatgcacactgaatgacaaatgcgacagattacgtaaggcatacggcgaagcctgctccgggcctcattgtcagcgccatgtctgtctgcggcagctgctgacatttttcgaaaaggcagccgaaccccacgcacaaggcttattgctgtgtccatgcgcccccaacgatcgtgggtgcggcgaacggcgtcggaacactattgcccccaattgcgccctcccacccgtggcccccaattgtttggagcttcgaagactgtgcttctcagacccgctatgccgatctaggctcgtagatttccagacccactgccacccgatggatatccttggaacctgtgccaccgagcaatctcgctgtttacgcgcctatctcggcttgattgggactgccatgactccaaacttcgtcagcaatgttaacacatctgtggcactgtcatgcacctgcagaggcagtggaaaccttcaggaagaatgcgagatgctggaagggttctttagccacaatccttgcttgacggaagctattgcggctaagatgagattccacagccagttgttctcacaagattggccgcaccctacctttgcagtaatggctcaccagaacgaaaatcccgcagtgcggccacaaccatgggttccttccctattctcctgcacattacccctgattctcctgctgtccttgtggtag

SEQ ID NO: 189027 - DNA, 2136 bp, Artificial Sequence
  Description of Artificial Sequence: Synthetic coding sequence
atggagagcggcgccgtgctgctggagagcaagagcagccccttcaacctattacatgaaatgcatgaattgagattgctagggcatttgtgcgacgtgacagtcagcgtcgagtaccagggcgtgaggaaagacttcatggcacacaaagccgtattggcagcaacatcgaaattcttcaaggaggtttttttgaacgaaaagtctgtggacggcacaaggacaaacgtgtacctgaatgaggtgcaggtggcagatttcgcgagcttcctcgaatttgtgtataccgctaaggtacaggtggaagaggacagggttcagagaatgctggaagtggcggaaaaactgaaatgcctggatctctccgagacttgtttccagcttaagaaacagatgttagagtcagtgcttttggaactgcagaatttctcagaaagccaggaagtcgaggtgagctccgggtcacaagtttctgccgctcccgcaccacgtgcatctgtcgcgacagacgggccgcacccatccgggcttaccgactctttagactatcctggagagagagctagcaatgggatgtcaagtgatctaccaccaaaaaagtctaaggacaagctggataaaaagaaggaagtggtgaagcccccatatcctaaaattcgacgggcatccggtagacttgcgggcagaaaagtcttcgtggagattccaaaaaagaaatacacccgtaggctgagagagcagcagaagactgctgagggcgatgtcggcgactacaggtgtccgcaggaccagtcacctgaccgcgtgggcactgagatggagcaagtcagcaagaatgaggggtgccaggcaggcgccgaactggaagaactatctaaaaaagcaggccctgaggaagaagaggaggaagaagaagaagatgaggagggagaaaagaaaaagtccaatttcaaatgctcgatctgcgagaaggcatttctgtatgaaaagtcctttctcaaacattccaaacaccgccatggcgtggccactgaagtcgtgtaccgttgtgacacttgcggccagacctttgctaaccggtgtaatttaaagtctcaccagaggcacgtgcacagttctgaaaggcactttccttgtgaactgtgtggcaaaaaattcaagagaaaaaaggatgtcaagcgccacgtcttgcaggtacatgagggggggggggagaggcaccgatgcggacagtgcggaaaaggccttagttcaaagacagccttgcgtctgcacgagcgcacacacactggagacagaccgtacggctgtacagagtgtggcgcacggttttcccaacccagcgccctgaagacccacatgcgtatccacacaggcgagaagccatttgtctgcgacgaatgcggggcccgcttcacccagaaccacatgctgatctaccataagagatgccataccggcgaaagaccatttatgtgcgaaacatgtgggaagagctttgcaagcaaggaatatctcaagcaccacaatagaattcacaccgggtccaagcccttcaagtgcgaagtttgttttaggacatttgctcagaggaactcactttaccaacatattaaggtgcatacaggcgaaaggccatattgctgtgatcagtgcggaaagcagttcacacagctcaacgctctgcaacgtcatcgtcggatccacaccggcgaacgccccttcatgtgcaacgcatgtggccgtacattcaccgacaagtccaccctaagacggcatacttctatccatgataagaacacgccctggaagagtttcttagtgattgtagatggcagccctaagaatgacgatggccataagacagagcagccagacgaggagtacgtgagctccaagctaagcgataaattactctcgttcgctgagaacggccactttcataacctggctgccgtgcaagataccgttcccaccatgcaggagaattcctcagcagatacagcatgtaaggccgacgattccgtcgtcagccaagacaccctcctggcaactactataagcgagctgtctgaattaacgccccaaacagattctatgcctacccagttacatagtctgagcaacatggaatag

SEQ ID NO: 189028 - DNA, 2136 bp, Artificial Sequence
  Description of Artificial Sequence: Synthetic coding sequence
atggagagcggcgccgtgctgctggagagcaagagcagccccttcaacctgctgcacgaaatgcatgaactacgcctcctggggcacttatgcgacgtaacagtctccgtggaatatcaaggggtgagaaaagatttcatggctcacaaggccgttttagccgcaacttccaagttcttcaaagaggttttcctgaacgagaaatcagtcgatggaactcgtactaacgtgtatctgaacgaggtccaggtggcggactttgcttctttcctggagtttgtgtatacagccaaagtacaagtggaggaggaccgcgtccagcggatgcttgaggtggcagaaaaactgaaatgtctcgacctctccgaaacctgtttccaactaaaaaagcagatgcttgaaagcgtgctgctcgagctccagaacttttcagagagccaggaggttgaagttagtagtggatcgcaggttagcgccgcgcctgctccaagggccagtgtagccactgacgggccccacccatccggcttgacagactcattggattacccaggcgaacgcgcctcgaacggaatgtcgagcgatctgcccccgaagaaatcaaaggataaactagacaagaagaaggaagtggtaaagccaccttatcctaagattagaagggcatcaggacgactggccggccggaaagtgtttgtggagattccgaagaaaaaatacacacgccggttacgggaacagcaaaagaccgctgagggcgacgtcggtgattataggtgcccccaggatcagtcaccggatcgggtgggtacagaaatggagcaggtctccaaaaacgaaggttgtcaggccggggccgagctcgaagaactctctaagaaagccgggcctgaagaggaggaagaagaggaagaggaggatgaggagggcgaaaagaagaagtccaattttaaatgttccatctgcgagaaggcctttctgtacgagaaaagctttctcaagcatagtaagcacaggcacggggtcgctaccgaggtcgtctataggtgtgacacttgtggacagacgttcgcaaacagatgcaatctgaaatcccaccagcgacatgtccatagcagcgagcgacactttccctgcgagctttgtggcaaaaagtttaagaggaaaaaggacgtgaagcgacacgtgctccaggtgcacgagggaggaggcgagaggcatcgatgcggccagtgcggcaaggggctgagtagcaagaccgcacttcgcctgcatgagaggacccatactggagatcgcccatatggatgtaccgagtgcggggccaggttttctcagccgagcgccttaaagacccacatgcgcattcacacgggggagaaaccctttgtgtgcgatgaatgcggcgcacggttcacccaaaaccacatgctgatctatcataagagatgtcacacaggagagcgaccttttatgtgcgagacctgtggcaagtcgtttgcaagcaaggaatacctgaaacatcataatagaatccatacaggatcgaaaccattcaagtgcgaagtgtgtttcaggacgttcgctcagcgcaatagtttataccagcacatcaaagtgcacacaggcgagcgcccttactgttgcgaccagtgcggaaaacagtttacacagctgaacgcactccagcgccaccgccgcatccacacgggtgaaaggccattcatgtgcaacgcctgtggacggaccttcacagataagtcaacactgcgtagacacacttccattcacgacaagaatacaccctggaaatccttcctcgtcatagtggatgggtctcccaagaacgacgacggacataaaaccgagcagccagatgaggaatacgtctcgtccaaactttccgataagctgctgtcatttgccgaaaatggacattttcacaacctcgccgccgtgcaggataccgttcctacaatgcaagaaaatagctccgccgatacggcttgtaaggcggatgatagcgtcgtgtcgcaagacaccctgctggcgacaaccatttctgaacttagcgagctaaccccacaaaccgacagcatgcccactcagttacactccctaagcaacatggagtag

SEQ ID NO: 189029 - DNA, 147 bp, Artificial Sequence
  Description of Artificial Sequence: Synthetic coding sequence
atggagagcggcgccgtgctgctggagagcaagagcagccccttcaaccttctgcacgagatgcacgagcttagattgctgggccatctgtgcgatgtgactgtgagcgttgaataccagggggtcagaaaagacttcatggcttag

SEQ ID NO: 189030 - DNA, 663 bp, Artificial Sequence
  Description of Artificial Sequence: Synthetic coding sequence
atgtgcgagacctgcggcaagagcttcgccagcaaggagtacctgaagcatcataacaggatccacactgggagcaaaccctttaaatgcgaagtgtgttttcgtaccttcgcccaaagaaactctctctatcagcacataaaagttcataccggagagagaccctactgctgtgaccagtgcggtaagcaattcacccagctgaatgcattgcagcgacatcgcagaattcatactggtgagcggccttttatgtgtaacgcttgcggcagaaccttcaccgacaaatccacgctccgccggcacacttccattcatgataagaatacaccctggaaatctttcttggtcattgtcgacgggagccctaagaacgatgacggacataaaaccgaacagcccgatgaggagtacgtgtcttctaagctgagcgataagcttttatcttttgctgaaaacggccacttccacaatctggccgccgtccaggacacagttcctaccatgcaggaaaactcgtctgctgataccgcatgcaaggccgacgattcagtggtctctcaggacacactgctggctactactatctctgaactgagtgaactgacaccccagacagatagtatgccgacccagctgcactcactctccaatatggagtag

SEQ ID NO: 189031 - DNA, 708 bp, Artificial Sequence
  Description of Artificial Sequence: Synthetic coding sequence
atgctgatctaccacaagcggtgccacaccggcgagcggcccttcatgtgcgaaacatgcggaaagtctttcgcctccaaggagtacctaaaacatcacaaccggattcatacgggaagcaaaccgttcaaatgcgaggtctgcttccgaacctttgcacaacggaattcactataccaacatattaaggttcataccggcgaaaggccatactgttgtgaccaatgtggtaagcaattcacacagctgaacgccttgcagcggcaccgccggattcacactggagaacgccccttcatgtgtaacgcctgtggcaggaccttcaccgacaagtctaccctgcggcgacacactagcattcatgataagaatactccctggaagtcttttctggtgattgtggacggaagtccaaaaaatgatgatggacataagactgagcagcctgacgaggagtacgtgtcttctaagctgagcgacaaactgctgtcctttgctgaaaacggccacttccacaacttagctgccgtacaggatacggttcctacaatgcaggagaattctagtgccgataccgcatgtaaggccgacgactccgtggtgtctcaagatacattactggccacaacgatcagtgagctgagcgagttgaccccacagaccgactccatgcccacacaactgcacagtttaagcaacatggagtag

SEQ ID NO: 189032 - DNA, 1254 bp, Artificial Sequence
  Description of Artificial Sequence: Synthetic coding sequence
atggacgaggagtacgacgtgatcgtgctgggcaccggcctgaccgaatgtattctgtccggtatcatgtccgtgaacgggaagaaggtgctgcacatggacaggaatccatattatggcggggaatctagcagcattactccacttgaggagctttataagaggtttcagcttcttgagggcccccctgagtctatgggacggggtagggactggaacgtggatctgatccctaagttcctcatggccaatggccagctcgttaaaatgctgctttacaccgaagtcactagatatctggattttaaagtggtcgaggggtcttttgtgtataagggaggcaagatttataaagttccctccacagagaccgaggcacttgcttccaacctcatggggatgttcgagaacgacccgaagacatttgaaggcgttgatccccagaccacttcaatgcgggatgtttatcgaaaatttgaccttggacaggatgtgatagactttacaggccatgcacttgccctgtatagaaccgacgactacttagaccagccatgcctcgaaactgtaaacagaattaagctgtactctgagagccttgcccgatacggaaagagcccttacttgtaccctttgtacggcctcggagagctgccacagggctttgccagattgagtgccatctacgggggaacctatatgctcaataagccagtcgacgacattatcatggagaatggtaaggtggtcggagtcaagtccgaaggtgaggtggcaaggtgtaagcagctcatctgcgaccccagttacattccggaccgagttaggaaagccgggcaggtgatccggatcatttgtattctatctcatccaatcaaaaataccaacgacgctaattcatgtcagataattattccgcagaaccaggtgaacagaaagtccgatatctacgtgtgcatgatctcatacgcgcataatgttgccgctcaggggaagtacatcgctatcgcctcgaccacggtggagacaacagatccagagaaggaggtggagcccgcactagaactgctggagcctatcgatgacggctgtgagagccaagtgttttgttcctgctcatacgatgccaccacacactttgagaccacatgcaacgacataaaggacatctacaagcgcatggccggcacagcgtttgatttcgagaacatgaaacgaaagcaaaatgatgttttcggggaagctgagcagtag

SEQ ID NO: 189033 - DNA, 1344 bp, Artificial Sequence
  Description of Artificial Sequence: Synthetic coding sequence
atggacgaggagtacgacgtgatcgtgctgggcaccggcctgaccgagtgtatccttagtgggataatgagtgtcaatgggaagaaggtcctccacatggaccggaatccttactatggaggggagtccagcagtataactcccttggaagagctgtataagcgcttccagttattggaaggacctccggaaagcatggggagaggtcgtgactggaacgtggatttgataccaaaattcttgatggccaacggacagttagttaagatgctgctatacaccgaagtgaccaggtacctggactttaaggtcgtggagggtagcttcgtctataaggggggcaagatatataaggttccaagcactgaaacagaagcccttgcatcgaatcttatgggaatgtttgagaagcggcgcttcagaaagttcctggtttttgtggccaacttcgacgaaaacgacccaaagactttcgagggtgtggaccctcagaccacatccatgagagatgtctaccgcaagttcgaccttggccaagacgtgatcgacttcactggccacgctttggccctatacaggacggatgattatctggatcagccatgcctcgaaacggtgaatcggattaagctttactcagaatccctggctcgatacggcaagtccccctatctttaccctctgtatggcctcggcgaactgcctcagggatttgcccggctctccgccatttacggcggcacctacatgctcaataagccagtggacgacatcatcatggaaaatggaaaggtggtgggtgtaaaatctgaaggcgaagtagcaaggtgcaagcagctgatctgcgacccttcctatatcccggatcgagtgcggaaggccggtcaggtgattagaatcatctgtatcctgagccatcccatcaagaatactaacgatgccaactcatgccagatcataattcctcagaatcaggtgaatcgtaagagcgatatctacgtctgtatgataagctatgcccacaatgtggctgcccaggggaaatatatagcaatcgcttctacaacagtggaaaccaccgacccggagaaggaggtcgaacccgctcttgaattgcttgagccaattgaccagaagtttgtagctatctcggatctctacgagcccattgacgatggctgtgaatctcaggtgttctgctcgtgcagttacgatgccacaacacattttgaaactacatgtaacgatattaaagatatctataaacgcatggctggtactgccttcgacttcgagaacatgaaacggaagcagaatgatgtgtttggggaagccgaacagtag

SEQ ID NO: 189034 - DNA, 447 bp, Artificial Sequence
  Description of Artificial Sequence: Synthetic coding sequence
atgagcctgggcaagcggaagcccagcaacttctacctggccaactttctgggaaaggagtgcatacttagcggcattatgagcgtcaacggaaagaaggtgctccatatggatcgcaacccatattatggcggcgaaagcgccagtataaccccactggaagatctttataagcgctttaaaatccccggatctccgcctgaatccatgggccggggccgggattggaatgtcgacctgatccccaagttcctcatggctaatgggcagctggtcaagatgcttttgtatactgaagtcacccgatacctcgacttcaaagttacagaaggcagctttgtctacaaaggggggaagatctataaggtgccgagtactgaagccgaggccctggcctcgtccctcatgggcctcttcgaaaagcgaaggttcaggaaatttctatag

SEQ ID NO: 189035 - DNA, 1350 bp, Artificial Sequence
  Description of Artificial Sequence: Synthetic coding sequence
atgagcctgggcaagcggaagcccagcaacttctacctggccaactttttggggaaggaatgtattctctccggcataatgagcgtaaatggcaagaaggtgctgcacatggacagaaacccctattacggaggagaatctgcctccattactccactcgaagacctgtacaagcgattcaagatccctggaagtccccccgaatcgatgggacgcggacgggactggaacgtcgacctaatcccgaaattccttatggccaatggacagctcgtgaaaatgctgctgtacacagaagtgacccgatatcttgactttaaagtcactgagggcagcttcgtatacaaaggtggcaaaatttataaggttcctagcacagaggcggaagcactggcttcgtctctgatgggccttttcgagaagcggagattccgcaaattcctcgtctacgtagccaacttcgacgaaaaggaccccaggaccttcgaagggattgatcccaagaaaaccactatgcgcgacgtgtacaagaaattcgatctgggtcaggacgtcattgactttaccggacacgcgttggctttgtaccggacagatgattatctggaccagccttgctacgaaaccattaaccgcataaaactgtacagcgagtctctggctcgctacgggaagagcccctatttatatcctctgtatgggctgggtgagctgccccagggctttgcgcggttgagcgccatttacggcgggacttacatgttgaataaaccaatcgaagagatcatagttcagaacggtaaggtgattggtgttaagagtgaaggggaaatcgctaggtgtaaacagctaatttgcgatccgtcctacgtcaaagatcgtgtcgaaaaggtcggacaagtcattcgtgtgatctgtatcttgtcccacccaataaaaaacacaaacgacgcgaactcgtgccagattattattccccagaaccaagtgaaccgcaagtccgacatctatgtgtgcatgataagcttcgcacacaacgtggctgcccaggggaaatacattgcgatcgtgtctacaaccgttgaaacaaaagagccagaaaaagagattagaccggctctggagctcctcgagcccattgagcagaaattcgtaagtatttcagatctactggtgcccaaggacctggggactgagtcccagatcttcatcagccggacctatgacgcgacaactcacttcgaaaccacctgtgacgatattaaaaacatttataaacgaatgacaggtagtgaatttgacttcgaagaaatgaaacgaaaaaaaaacgacatctacggtgaggactag

SEQ ID NO: 189036 - DNA, 627 bp, Artificial Sequence
  Description of Artificial Sequence: Synthetic coding sequence
atgcgggacgtgtacaagaagttcgacctgggccaggacgtgatcgactttactgggcatgccttggcactgtaccgcacagatgattatttagaccagccatgctatgagactattaaccgtattaaattatattccgagagcttggctaggtatgggaagagcccgtacttgtacccactgtatggcttgggggaactgccccagggtttcgctcggctttccgccatctatgggggaacctatatgctgaacaaaccaatcgaggagataatagtgcagaacgggaaggtgatcggagtcaaaagcgaaggagaaattgccaggtgcaagcagttgatatgcgatcccagttatgtcaaggatagagtggagaaggtgggccaggttattcgggtgatctgcattttatcccaccctatcaaaaatacaaacgatgcgaacagctgccagatcataattccacaaaaccaggtaaatcggaagtctgatctgttagcatccgtcactagttggtaccagaaaacatgggaacagaaggccagatctttgtttcccgcgcacatgatgccaccactgatcctccgccagcgtgtgatgactctgaagacctctatcagggggtag

SEQ ID NO: 189037 - DNA, 1203 bp, Artificial Sequence
  Description of Artificial Sequence: Synthetic coding sequence
atgaacgaggagtacgacgtgatcgtgctgggcaccggcctgaccgagtgtattctgagcgggataatgtcagtaaacggaaaaaaagttctacatatggaccgcaacccttactatggcggcgagagtgcctctatcaccccactggaagacctgtacaaacgcttcaagatcccgggatcccctccagaatccatgggccgggggagggattggaacgtcgatctgattcctaagtttctgatggcaaacggcctgatgggactgtttgagaaaagacgctttcgcaaatttcttgtgtacgtagcgaactttgatgaaaaggacccaaggacttttgagggcattgatcctaaaaaaacaacaatgagggatgtctacaagaagttcgatttgggtcaggatgtgatagacttcacagggcacgccctggccttatataggactgatgattatctggatcagccatgctacgaaaccatcaacaggattaagctttattccgagtcactcgcccgctatggcaaaagcccctacctgtatccactgtacggtctcggggagcttcctcagggcttcgcccgactctccgcgatctacggaggtacctacatgctgaacaagcctatcgaagagattatcgtccagaatggcaaggtaatcggggtgaaatccgagggcgaaattgccagatgcaaacagcttatatgtgatccaagttacgttaaagaccgcgtggaaaaagtcggacaggtaatcagggtaatctgtatcctgagtcatcctattaaaaataccaatgacgcgaattcatgccaaatcataatcccccagaatcaggtgaatagaaagtctgatatctacgtgtgtatgatctcctttgcacacaacgtggctgcccaaggtaaatacatcgcaatcgtctcaaccactgtagagaccaaagagccggagaaggaaattcggccagcgctggaactcttggagcccatcgagcaaaaattcgtatccatatcagatctgctggtgcctaaggatcttggcacagaaagtcagatctttattagtaggacctatgatgctaccacccacttcgaaaccacctgcgacgatataaagaacatctacaagcggatgacggggtccgagttcgatttcgaggagatgaaacgaaagaagaatgatatttacggcgaagattag

SEQ ID NO: 189038 - DNA, 1338 bp, Artificial Sequence
  Description of Artificial Sequence: Synthetic coding sequence
atgaacgaggagtacgacgtgatcgtgctgggcaccggcctgaccgagtgtattttatctggcatcatgagtgttaacggcaaaaaggtgttacatatggacagaaacccttactacggaggagaatccgcctcaatcactcccctggaggacctgtataagcgcttcaagatcccggggtctccacctgagagtatggggcgcgggcgcgattggaacgtagatttaatacccaagtttctcatggccaacggacagcttgtgaagatgctgctctatactgaggttacacggtatctggactttaaggtgacagagggatcttttgtctacaagggcggcaaaatttacaaggtgccgtccactgaggcagaagcactggcatccagtttaatggggctgttcgagaagcgcaggttccgaaagttcttggtgtatgtggcaaatttcgatgagaaggacccacgcacatttgagggaattgaccctaaaaagaccaccatgcgggacgtatataaaaaatttgacctggggcaggacgttattgatttcacgggacatgcccttgctctataccgcactgacgactatctggatcagccgtgttatgaaactataaatcggattaaactgtacagcgaatccttggcacgctacggcaaatccccatatctgtatcccctgtacgggttgggggaactgcctcaagggttcgcccggctctccgctatatacggcggtacttatatgctgaataagcccatagaggaaattatcgtacagaatggaaaagtgataggagtaaaatccgagggggagatagcccggtgcaagcagctaatctgtgacccctcgtatgtgaaagatagggtggaaaaggttggacaagttattcgggttatttgcattctgagccaccctatcaagaacacgaacgatgcaaactcttgtcagatcattattccccaaaatcaggtcaatagaaagtcggacatttacgtctgtatgatatccttcgcccacaatgtggccgctcaggggaaatacatagctattgttagcacaaccgttgagaccaaagagcctgaaaaagagatccgtcctgcacttgaattactggaacccatagagcaaaagttcgtctctatttcagatctcctggtacccaaagatctcggaaccgagtcccagatcttcatttctcgaacgtatgacgccacgacacattttgagactacttgcgatgacattaagaacatttacaaacgtatgactggaagcgagtttgattttgaagaaatgaagcggaaaaaaaacgacatctacggggaggactag

SEQ ID NO: 189039 - DNA, 468 bp, Artificial Sequence
  Description of Artificial Sequence: Synthetic coding sequence
atgaacgaggagtacgacgtgatcgtgctgggcaccggcctgaccctgtataagaggttcaaaataccgggatccccgccagaaagtatgggacgggggagagattggaacgtagacctgatccctaaattcctgatggcaaatgggcagctggtgaagatgctgctgtacacggaggtcacacgctacctggacttcaaagtcacagaagggtcctttgtttataagggtggaaagatctacaaagtgccctccaccgaagcggaagctctggccagctcactcatgggcttgtttgaaaaacgcaggttccggaaattcctcgtatacgttgcaaacttcgacgagaaggaccctcggacctttgaaggcatcgatccaaagaagacgactatgagagatgtctataagaaatttgatctgggccaggatgtgattgatttcaccggtcatgcgctcgctctctag

SEQ ID NO: 189040 - DNA, 612 bp, Artificial Sequence
  Description of Artificial Sequence: Synthetic coding sequence
aagaagttcgacctgggccaggacgtgatcgacttcaccggccacgccctcgcattgtatcggacagatgactatcttgaccagccctgctacgagacgattaaccgcattaagctctattccgagtctctggcacgctacggcaaatccccgtacctctacccactttatggactgggagagttaccgcagggatttgcccgactaagtgccatctatggcggcacgtacatgttgaataagcctattgaagagatcatagtccagaatggaaaggtgataggcgttaaatctgagggagagattgctcgttgcaaacagcttatctgtgatccttcgtacgtcaaagacagggtagagaaggtgggacaagtaatcagggtgatctgtatcctgtcccatcctatcaagaacacaaacgatgcgaattcatgtcagatcatcatacctcaaaaccaggtgaacagaaagagcgacctgctggcttcagtgacttcctggtatcagaagacttgggagcagaaggcaaggagcctcttcccagctcacatgatgccaccgctgattctgcgccagcgggtcatgactttgaagacttccattcgaggttag

SEQ ID NO: 189041 - DNA, 792 bp, Artificial Sequence
  Description of Artificial Sequence: Synthetic coding sequence
atgaacgaggagtacgacgtgatcgtgctgggcaccggcctgaccgagtgtatcctgtcagggatcatgagcgttaacgggaagaaggttctgcatatggataggaacccatactacggaggagagtcggcatccatcaccccccttgaggatctctataagagattcaagatcccaggtagtccgcccgagtctatggggcggggaagggattggaacgtggacctgattccgaagttcctgatggcaaatgaggtgactcggtacctcgactttaaggttaccgaaggcagtttcgtatataagggaggcaagatttataaagttccatctacagaggctgaagctcttgcgagctcactgatggggctgttcgagaagcggaggtttcgtaaatttctggtatatgttgctaatttcgatgaaaaagatccgaggacattcgaggggatcgacccaaaaaagaccactatgcgggacgtctacaagaaattcgacctgggacaggatgtgatagatttcacgggtcacgccctggcattgtaccggacagacgattacctggaccagccttgttacgaaacaattaataggataaagttatattccgagagcctggctcgctatgggaagtcgccttacctctatccattgtacgggctcggcgaactccctcaaggattcgcgagactgagcgccatttatggaggtacctacatgcttaataagccaatcgaagagatcatcgtgcagaatggaaaagtaatcggagtgaagtccgaaggggaatag

SEQ ID NO: 189042 - DNA, 1119 bp, Artificial Sequence
  Description of Artificial Sequence: Synthetic coding sequence
atggcccacgcccccgcccggtgccccagcgcccggggcagcggcgacggcgaaatgggcaagccacgtaatgtggctctgattacagggatcacaggccaagacggaagctacctcgccgagttcttactcgagaagggctacgaggttcacgggatcgtccggagatcatctagtttcaacacgggtcgcattgaacacctgtataaaaacccccaagcccatatcgagggcaatatgaagctgcactacggcgatttaaccgacagcacttgcctggtgaagataataaatgaagtcaaacccaccgagatttacaatttaggggcacagagccacgtgaagatctctttcgacctggccgaatacacagcagacgtggacggcgttggaacactgcgcttactggacgcagtcaaaacgtgcgggctcattaatagtgttaagttttaccaggcatctactagcgaattatacgggaaagtgcaggagatccctcagaaggaaactacccccttctatcccagatcaccatacggggctgcaaaactttatgcatactggatcgtggtgaattttcgggaggcctataatcttttcgccgtgaacggcatcctgttcaaccatgagtctccccgccgcggagccaatttcgttacccgtaaaatttccagatcagtagctaaaatttacctcggccagttagagtgcttctcactcggcaatttggacgcaaagagggattggggtcatgccaaggactatgtggaagctatgtggctgatgctgcagaacgacgagcctgaagactttgtaattgctaccggggaggtccacagtgtgagggaattcgtggagaaaagcttcttgcacattggaaagacaatcgtttgggaaggtaaaaacgagaatgaagtgggccgctgtaaggaaaccggaaaggtgcatgttaccgttgatttaaagtattataggcctacagaagtggactttctgcaaggcgactgtacaaaagcgaagcaaaagctgaattggaagccacgagtcgccttcgacgaactggtccgtgaaatggtacacgcggatgtcgaattaatgcgaacaaacccaaatgcctag

SEQ ID NO: 189043 - DNA, 1029 bp, Artificial Sequence
  Description of Artificial Sequence: Synthetic coding sequence
atgtgcaagatggacggcagctacctggccgagttcctgctggagaaagggtacgaggttcacggcatagtgaggagatcatccagttttaacaccggaagaatcgagcacctatacaagaacccccaggctcacatcgaagggaatatgaagcttcattatggggatcttaccgactccacatgcctggtgaagatcattaacgaggtcaaacctacagaaatctacaacctcggggcccagtcacatgtcaaaataagtttcgatctggcagagtataccgccgatgtagacggtgtggggacccttaggctgctggacgcggtcaagacatgtgggctaattaatagcgtgaagttctatcaggcaagtacatccgaactgtatggcaaagtacaggaaattccgcagaaagagacaacaccattttacccaaggtcaccgtatggggccgctaaactgtacgcttactggatagtggtaaacttccgggaagcatacaatctgtttgctgttaacggcatcctgttcaaccacgagagcccaaggcgtggggccaatttcgtcacccggaagatctcccggagcgtggccaagatctatctcggccagctcgagtgcttcagcttgggtaatctggacgccaagagagattgggggcatgctaaagattatgtcgaggcgatgtggcttatgctccagaacgatgagccagaggattttgtgatcgcaacaggcgaggtccactccgtcagggagttcgtggaaaaatcctttctgcacatcggtaagaccatcgtttgggaaggaaaaaatgaaaatgaagtggggagatgtaaggaaaccggcaaagtgcacgtgacagttgatctgaaatactatcgcccaaccgaggtcgactttctccagggtgactgtacaaaggccaagcagaaactgaactggaaacctagagtcgccttcgatgaactcgtgcgagagatggtgcacgccgatgtcgagctgatgcggaccaaccctaacgcgtag

SEQ ID NO: 189044 - DNA, 2196 bp, Artificial Sequence
  Description of Artificial Sequence: Synthetic coding sequence
atggtggtggagcaccccgagttcctgaaggccggcaaggagcccgggctccagatatggcgcgtggagaaattcgacctcgtgcctgttcccaccaatttgtatggggatttttttacaggcgacgcttatgtaattctcaagacagtccagcttaggaatgggaacctccagtacgatcttcactattggctcggtaacgaatgctctcaagacgagtctggtgccgccgccatcttcaccgttcagctggatgactacctcaatgggcgagcagtgcagcacagggaagtacagggcttcgagtctgccacgtttctgggatactttaaaagtggcctgaaatacaagaaaggtggagttgccagtgggttcaagcacgtggtgcccaacgaagttgtcgtgcagaggttgttccaggtgaaagggcgtagagtcgtgagggccactgaagttcctgtgtcatgggaaagttttaataacggggactgtttcattctggacctgggcaataacattcatcagtggtgtggctccaatagtaatagatacgaacggctaaaagcgacccaagtcagcaaaggtatccgcgacaatgaaaggtctggccgcgccagggtccacgtaagtgaagaggggacggaacccgaggccatgctgcaggtgcttggacccaaacctgcgctacctgcgggaacagaggatacagcgaaagaggacgcagccaacaggaaactggccaagctttacaaagtgtctaacggggctgggacaatgagtgttagcttggtggctgacgagaatccctttgctcagggtgcccttaaatctgaggactgtttcatcctggatcacggaaaagatggcaagatctttgtatggaaaggaaagcaagcaaacactgaagagaggaaagctgctctcaagaccgctagcgacttcataacgaaaatggactacccaaagcagactcaggtttctgttctacccgaggggggagaaacgcctctcttcaaacagttttttaaaaactggcgtgaccccgaccagaccgatggcctaggtctgagctatctctcatctcacatcgccaatgtcgaaagagtgccattcgacgcagcaacattgcatacttcaacagccatggcagcccagcatggaatggacgatgacggtacaggacagaagcagatatggcgtatcgaaggctccaacaaggttcccgttgaccctgccacttacggacaattttacggcggtgactcttacattatcctctataattatcggcacggagggcgccaggggcagattatatacaactggcaaggtgcgcaaagcacccaagatgaggtagctgcttctgcaatcttgacggcccaactggatgaagagctgggcgggacaccagttcagagtagagttgttcaagggaaagagcctgctcacttgatgtccctcttcggaggaaaacccatgattatttataaggggggcacttcacgggaggggggtcagactgccccagcaagcacccgcctcttccaggtgcgcgcgaattccgcaggcgctacccgagctgtagaggtgctgccaaaagcaggagcattgaactctaacgacgcctttgtgctcaagacgccctcagctgcctatctgtgggtgggtacgggggcgtcggaagcagaaaaaacgggagcacaggagctgttgcgggtgctaagggcacaaccagttcaggtagctgagggcagtgaacccgacggattttgggaggcactggggggcaaggctgcttacagaacatctccacggctgaaggataaaaaaatggacgcacacccacccaggctgttcgcgtgctctaacaaaataggcagattcgttattgaggaggtgcccggagagctgatgcaggaggacctggcgaccgacgacgtgatgctgctggatacttgggaccaggtgttcgtctgggtgggaaaggattctcaggaggaggagaagacagaggcactcacatctgccaagagatacatcgaaaccgatcctgcaaacagggatagacgcacccctatcacagttgtgaagcaaggctttgagcccccctcgttcgtgggctggtttctggggtgggacgacgattactggtctgtcgatcccttagacagggctatggctgaactggcagcatag

SEQ ID NO: 189045 - DNA, 2196 bp, Artificial Sequence
  Description of Artificial Sequence: Synthetic coding sequence
atggtggtggagcaccccgagttcctgaaggccggcaaggagcccggactccagatctggcgcgttgagaagtttgatcttgttcccgtgcccacaaacctatatggcgacttctttacaggcgatgcttacgtgatattaaagaccgtgcaactgaggaatggaaatctacaatacgacctccattattggctgggtaatgaatgttctcaggacgagtcgggcgccgccgcgatcttcacggtgcagctcgacgattatctgaacggacgggctgtgcagcacagggaggtgcaggggttcgagtcagcaactttcctgggctacttcaaaagtgggctcaaatacaagaaaggtggggtggcaagtgggttcaaacacgtggtgcctaatgaggtcgttgtgcagagactgtttcaggtgaaaggtcgaagagttgtgcgggcaactgaggtccccgttagttgggaatcttttaataatggggactgcttcattctggacctgggaaacaacatccaccagtggtgtgggtctaacagtaaccggtacgaaagactgaaggcgactcaagtctccaaaggcattcgtgataacgaaagatctgggcgcgctcgcgtacatgttagcgaggaaggcacagagcccgaagctatgctgcaggttctcggaccaaagcctgctttgccagctggcacggaggacactgcaaaagaggacgccgccaatcgaaagctcgctaaattgtacaaggtctcaaatggggccggcactatgtcagtgagcctggtagccgacgagaatccatttgcccagggcgctctaaagagtgaggattgtttcatcctcgaccatggtaaggatgggaagatatttgtttggaaggggaagcaagcaaacacagaggaacgtaaggctgccttaaagaccgcatctgacttcattaccaagatggattacccgaagcagacccaggtctcagtcctccccgagggcggagagactcccctcttcaaacagttcttcaaaaattggcgggatcccgaccagacagatggattaggacttagctacctgagctcacacattgccaatgttgagcgcgtgcctttcgacgccgctaccctgcacacctccaccgctatggcagcacagcacggcatggacgacgacgggactggtcagaagcagatttggcgcatcgagggcagcaacaaagtgccggtggacccagcgacctacggacaattctatggtggagactcgtacataatcctttataactacagacatggtgggcgacaaggccaaatcatttacaactggcagggcgcccagtctacccaagatgaggtcgctgcttccgcaatcttaacagcacagctcgatgaggaactgggcggtacacctgtgcaaagtcgtgtcgtgcagggaaaagaacccgcacacctcatgtccctcttcggcgggaagccgatgatcatctacaaagggggcacaagccgggagggcgggcagaccgcccccgcctccacgaggctgttccaggtgcgcgcaaattcagccggggctaccagagccgttgaggtattgcctaaagctggagctctcaacagcaacgacgcattcgtgctcaagacgccctcagctgcctacctgtgggtgggaactggcgccagcgaggccgagaaaacgggagctcaggaacttttgagggtgctgagggcccagcccgtgcaggttgccgaagggtccgagcctgacggattctgggaggccctgggcggcaaagccgcttatcgcacttcgccgagactgaaagacaaaaagatggatgcccatcctccacgcttgtttgcctgctctaacaaaatcggcagattcgtgatcgaagaagtgcccggtgaactcatgcaggaagacttggcaaccgacgacgtgatgctgttagacacgtgggaccaggtcttcgtttgggtcggtaaagactcgcaagaggaggagaaaactgaggccttaacttctgcgaagcgttatatcgaaacagatcctgccaatagagacagaaggactccaattactgtggtcaagcagggtttcgagccaccctcatttgtgggctggttcctggggtgggatgatgactattggagcgtggatcctctggaccgtgccatggcagaacttgcagcctag

SEQ ID NO: 189046 - DNA, 2349 bp, Artificial Sequence
  Description of Artificial Sequence: Synthetic coding sequence
atggccccccaccggcccgcccccgccctgctgtgcgccctgagcctggcactctgtgctttatccctcccagttcgggcagccaccgccagcagaggcgcttcccaggccggcgcccctcaggggcgcgtaccggaggcccggcctaactctatggtggttgagcaccccgagtttctgaaggccggcaaggagccgggcctccagatctggcgggtcgagaagttcgacttggtgccagtccccaccaatctgtacggtgattttttcactggagacgcctatgtgatcctcaaaacagtacagttgaggaacggtaatttgcagtatgatcttcactactggctcggcaacgaatgttcccaggatgagtccggcgctgccgcgatttttacagtccagctggatgactatcttaacggacgcgcagtacagcacagggaggttcagggatttgagtctgctaccttcctgggctattttaagtccggtcttaaatacaagaaaggtggagtcgcctcgggtttcaaacatgtggtccccaatgaggtagtggtgcaaaggctgtttcaggtgaagggccgacgggttgtccgggccacagaggtcccagtgagttgggagagctttaataacggggattgtttcattcttgacctgggaaataatattcaccagtggtgcggctcaaactccaaccgttatgaacggctgaaagccacccaggtgtcgaaaggcattcgagataacgagaggtcaggcagggcccgcgtccacgtcagcgaggaaggcactgaacctgaagccatgctgcaagtcttgggccctaaacccgcgctacctgcaggcactgaggataccgccaaggaagacgcggctaaccgcaaattggccaaactgtacaaagtttctaatggggctggcacgatgagcgtatccttagtggccgatgagaaccccttcgcccagggtgcccttaagtcagaggactgtttcatcttggaccatggaaaagatggcaaaatctttgtatggaaggggaagcaagcgaacactgaagagcgtaaggccgcgcttaaaactgcctcagactttatcactaaaatggactacccaaagcaaacccaggtgtctgttctgcccgagggtggtgagactccacttttcaagcagtttttcaaaaattggcgcgaccctgaccagacagacgggctcgggctttcctacctatcttctcatattgccaacgtggaacgcgtcccctttgatgctgctactctgcacacttcaaccgccatggcagcgcagcacgggatggacgatgacggtacaggtcaaaaacagatctggaggatcgaaggctccaataaggttcctgtcgaccctgccacttatgggcagttctatggtggcgactcctatatcatcctttataattaccggcacgggggtcgccagggccagattatctataactggcagggggcccaatcaactcaggacgaggtcgctgcatcagccattctgactgcccagctcgatgaagaactgggagggactccagtacagtctagggtggtgcagggtaaagaaccagcccacctcatgagtctctttgggggaaaaccgatgatcatctacaagggtggcacttcacgcgagggaggccagacggccccagccagcacacgcctgttccaggtgagagctaattccgctggggcgactagagccgtggaggtactgcccaaggcaggcgccttgaatagcaacgatgcatttgtcttgaagactccatcagctgcctatctctgggtggggacaggcgcatcagaggccgaaaagacaggtgcccaggagctgctacgggtcctccgcgcccagccagttcaggtggcagagggatcagaacccgatgggttttgggaggccctcggtggtaaggccgcttacaggacttccccacgtctgaaagacaaaaagatggatgcgcacccccctaggctgttcgcctgcagcaacaaaattggacgatttgtgattgaggaggtcccaggtgagctgatgcaggaggacctggccaccgatgacgtcatgttattggacacatgggatcaagtctttgtgtgggtggggaaggattcccaagaagaagagaaaactgaggccctaacctctgctaagcgatatatcgagactgatcctgccaatagagataggaggacacctatcactgtcgttaagcaagggttcgaacctccttcctttgttggttggtttctcggctgggacgacgattattggagtgtggaccccttggacagggccatggccgagctggcagcgtag

SEQ ID NO: 189047 - DNA, 2196 bp, Artificial Sequence
  Description of Artificial Sequence: Synthetic coding sequence
atggtggtggagcaccccgagttcctgaaggccggcaaggagcccggacttcagatctggagagtggaaaaattcgatttagtaccagtgccgaccaatctgtatggagacttctttactggggacgcgtacgtgattcttaagaccgtacagctgagaaatggcaacctgcagtatgacctccactattggctgggcaatgaatgtagtcaggacgagagcggagccgctgcaatattcacggtccagttagatgactatcttaacgggagagctgtacaacatcgagaggttcagggcttcgagagcgctacttttttggggtactttaagagcggccttaagtacaagaaaggcggggtcgcttccggtttcaaacatgtggtgcctaacgaagtggtcgtacaaagattgtttcaggtgaaaggccgcagagtcgtcagggccaccgaagtgcctgtttcctgggaatcttttaacaatggtgattgttttattctggatctggggaataacatccatcagtggtgtggctcgaacagtaaccgatacgagcgcttaaaggccacccaggtgtccaagggcattcgtgataatgaacgttccggccgcgcgcgtgttcacgtgtctgaagaaggcacagaaccagaggctatgttgcaggtgctcggccccaaacccgccctgcccgcaggcacagaggacaccgcaaaagaagatgctgccaaccgcaaacttgccaaattgtataaggtgtccaacggcgctggtacaatgagtgttagcctcgtggcggacgagaacccatttgcacagggtgcgctcaaaagcgaagattgtttcatcctggaccacggaaaagacggcaaaatcttcgtgtggaagggcaagcaggccaatacagaggaacgtaaggccgctcttaagacagccagcgattttattaccaaaatggattaccccaagcagactcaggtttccgtcctcccagaaggcggcgaaacccctctctttaagcagttttttaagaactggcgggatcccgatcagacagacggcctcggactctcatacttgtccagtcacattgcgaatgtcgagagggtgcctttcgatgcggctacactgcacacttcaaccgccatggctgcccagcatggcatggacgacgacggcactgggcagaagcagatttggcggattgaggggagtaataaggttccggtggaccccgcaacttacgggcagttttacggaggggactcctacatcattctgtataactatcgccatgggggtcgtcagggtcaaatcatctacaactggcagggggcacagagcacacaggatgaagtcgctgcttctgctatacttaccgctcagttggacgaggagcttggcggtacacccgtgcagtcccgggtagtgcagggaaaagaacccgcccacctgatgagccttttcgggggtaaaccaatgatcatctataagggtggaacctcgcgcgaaggcggacagaccgccccagcttctaccagattgttccaagtccgcgcgaatagcgccggcgctaccagagccgtggaggtgttgccaaaggccggcgctctgaactccaacgacgcctttgtgctaaagactccctcagctgcctacctgtgggtaggaaccggggcctccgaggccgagaagaccggagcccaagaactgctgagggttctgcgcgcgcaaccggtccaggttgcagagggcagcgagcccgatggtttttgggaagctctaggcggcaaagccgcctaccggacctccccaagactgaaggataagaagatggatgcgcatccccccaggttattcgcatgttccaataaaattggtagattcgtcatcgaggaagtcccaggggagcttatgcaagaggacctggctacagacgatgtcatgctgctcgacacctgggatcaggtttttgtgtgggtgggtaaggacagtcaggaggaggaaaaaaccgaggcactcaccagtgcaaaacgatacatagagaccgaccctgccaatcgagatagacgtactcctatcacagtggtgaagcagggtttcgagccaccaagtttcgtcggctggtttctggggtgggacgacgattattggagcgtcgatccattggatagagcaatggcagaactggcagcatag

SEQ ID NO: 189048 - DNA, 2148 bp, Artificial Sequence
  Description of Artificial Sequence: Synthetic coding sequence
atggtggtggagcaccccgagttcctgaaggccggcaaggagcccgggctgcaaatttggagagtggagaagtttgatgcatacgtgatcctgaagactgtgcagctgagaaatggcaatctgcaatatgacttgcactactggctcggcaacgaatgtagccaggacgagagcggcgctgctgccatttttaccgtccagctggacgattacctaaatggccgggccgttcagcacagagaagtacaaggcttcgagtcggctaccttcctcggctacttcaagtccggcctgaaatacaaaaaggggggtgtggcctccggcttcaaacacgttgtgccaaatgaggttgttgttcagagactatttcaggtaaaagggcgacgcgtggttcgagctacagaagtgccagtgagctgggaatcctttaacaatggcgactgctttattctagatcttggaaataatatacaccagtggtgtggatctaattccaaccgctacgagcggttaaaggcaactcaggtgtccaagggcattagggataatgaacgaagcggcagagccagggtgcatgtgtccgaggagggaacagaaccagaggccatgttgcaggtgttgggaccgaaacctgcgctgcccgcaggcaccgaagatacagcaaaagaagatgccgccaacagaaagcttgcaaaactttacaaagtgtctaatggagccggaactatgagcgtatcgctggtcgccgatgagaacccatttgcacaaggcgcattgaagagcgaagactgttttatcctggaccatggaaaagacggcaagatctttgtctggaagggaaagcaagcgaatacagaggaacggaaagcggcactgaaaaccgcctctgattttatcactaagatggattatccgaagcagacccaggtgtccgtgctgcccgaaggaggagagactcccctgtttaaacagttttttaagaactggcgagatcccgaccagacggacggcctgggactgagctacctgagcagccatattgccaatgttgagagggtgcccttcgatgctgctacgctgcatacttctactgcaatggccgcccagcacggtatggacgacgacggaacaggacagaagcaaatctggagaatcgaaggaagcaataaggttcccgtggatccggcgacatatggtcagttttatgggggagatagttatattatactatacaattaccgccatggtggcaggcaggggcaaattatttacaattggcagggtgcacaatcaacgcaagacgaagtggcagctagcgctatcttaacagcccagttggacgaggagctgggcgggactccggtgcaatccagggtcgtgcaagggaaggagccagcccatctgatgagcttgttcggagggaagccgatgatcatatataaggggggaacatcaagagaaggcggccagaccgcccctgccagcacccgactttttcaggtccgcgccaactccgccggtgcaactcgggctgtggaagtgttacccaaagcaggagccctgaatagtaatgatgcgttcgtcttgaaaacacccagcgcagcctatctgtgggtgggaacaggggcttccgaggctgaaaaaactggcgcccaggagctgctacgtgtgctgcgcgcccagcccgtccaggtggccgaaggaagtgagcccgacggattttgggaggctcttggagggaaggccgcctataggacatcacctcggctgaaagacaaaaagatggatgcccatccccctcggctcttcgcctgctctaataaaatcggccgctttgtaatagaggaggttcctggtgagctgatgcaggaagatctggcaacggacgacgtcatgctccttgacacatgggaccaggttttcgtgtgggttggtaaggactcccaggaggaagagaagacagaggcactaacatcagccaagagatacatcgagacagaccctgccaatcgggacagacgaaccccaattactgtggtgaagcagggtttcgagcccccatcatttgttggctggttcctgggatgggacgatgattactggagcgtcgaccctctggacagggcaatggctgagttggctgcttag

SEQ ID NO: 189049 - DNA, 2229 bp, Artificial Sequence
  Description of Artificial Sequence: Synthetic coding sequence
atggagaagctgttctgctgcttccccaacagcatggtggtggagcaccccgagtttctgaaggctgggaaggagccagggctgcagatctggcgggttgagaagtttgacttggtgccagttcctaccaatctgtacggggattttttcaccggagatgcatacgtgatattgaagacggtgcagcttaggaatggaaacttgcaatatgacctccactattggctcgggaatgagtgtagccaggacgagtctggcgctgcagcgatctttacagttcagctggatgattatttgaatggtcgggctgtgcagcatcgtgaagttcagggctttgaatcggccacttttctgggatacttcaaatctggattaaagtacaagaaagggggcgtggccagcggcttcaaacatgtcgttcccaacgaagttgtggtccaaagactgttccaagttaagggaaggagggtcgttagagcaacagaagtccccgtttcctgggagtcttttaacaacggcgactgcttcatcttagacctcggcaacaacatccaccaatggtgcgggtctaatagcaaccggtacgaacgcttgaaagcaacacaagttagtaagggaattagagacaacgagagatccgggagggcccgcgtgcatgtttcagaggaaggcaccgaaccggaggctatgctacaggttctgggcccaaagcccgccctgcccgccggcaccgaagacacggcgaaagaggacgccgccaatagaaaactggccaaattatataaggtcagtaatggggccgggacgatgagcgtctctctcgtagccgacgagaatcctttcgcacaaggcgcgctgaagtccgaggactgctttattcttgaccacggcaaagacggaaagatcttcgtgtggaaagggaaacaggccaacactgaagaaaggaaagctgcactgaaaactgctagcgatttcatcaccaagatggattaccccaaacaaacccaggtgtctgtgcttcctgagggcggggaaacacctctctttaaacagttctttaaaaattggcgagacccggaccagaccgatggcctgggcctgtcgtatctgagttcgcacatcgccaatgtcgaaagagtaccattcgacgccgccacgctgcacacaagtaccgcaatggccgcacagcacggaatggatgacgatggaacagggcaaaaacagatctggcggatcgagggctctaataaggtcccagttgaccccgccacatatggccagttctacgggggcgattcctacatcatcttatacaattatagacacggcggtagacaaggccagatcatctacaattggcagggcgcacagtccacccaggatgaagtggccgcctccgccatcctgaccgcacaattagacgaagaactgggaggcacccctgtgcaatccagggtcgtccagggaaaggagcccgcccacctgatgtctctgttcggtggtaagccaatgataatatacaagggcggaacctcacgggaggggggacaaactgcccctgcaagcactcgattgtttcaggtgagggcaaattctgccggcgctacccgggccgtggaagtgctgccaaaagccggggcgttgaactccaacgatgcatttgtgctcaaaacacctagcgcagcatacttatgggttggcacaggcgcatccgaggccgagaagactggagctcaggaattgctgcgggttctgagagcacagcccgtgcaggtggcggaggggtccgagcccgatggtttctgggaggctcttggcggcaaggctgcctatcggacctcaccccgactgaaggacaagaagatggacgcacaccctcccagattgtttgcctgctctaacaaaatcggacggtttgtcatcgaggaagtgcccggagagctaatgcaagaagatttggccaccgatgatgtcatgctgctcgacacttgggatcaggttttcgtttgggtgggtaaggactctcaggaggaggaaaaaacagaagctctaacctccgctaaacggtatatagagactgatccagcaaacagggaccgaagaacacccattacagtcgtcaagcaggggtttgagccccccagtttcgtgggctggtttctaggttgggatgatgattactggtccgtcgatcccttggatagagcaatggcagaactcgcggcatag

SEQ ID NO: 189050 - DNA, 2196 bp, Artificial Sequence
  Description of Artificial Sequence: Synthetic coding sequence
atggtggtggagcaccccgagttcctgaaggccggcaaggagcccggcctgcagatatggcgcgttgaaaaattcgacctggtccctgtcccaacaaacctctacggagacttttttacaggggatgcatacgtcatcctcaagaccgtccagttaagaaacggcaacctgcagtatgacctccattattggctgggcaacgagtgctctcaggacgaatcgggcgcagcagcgattttcactgtacagctggacgactacctgaacggccgtgccgtgcaacaccgcgaagttcaggggttcgaaagcgctaccttcctcggctattttaaaagtggactcaaatataaaaaaggcggcgtcgcatccggtttcaagcatgtggtgccaaacgaagtcgtcgtgcagaggctctttcaagtcaagggaagaagagtggttagagcaacagaggttcctgtttcctgggaatcgttcaataatggcgattgttttatcctggatctggggaacaatatccatcaatggtgtgggagcaacagcaatcggtacgaaagactcaaggctacccaggtgtccaaaggtattagggataacgaaaggtctgggagagctcgggtgcatgtgagcgaggagggtaccgaaccagaggctatgttgcaggtcttaggcccaaagccagcactgccagctgggacagaggacacggctaaagaggacgcggctaaccgcaagctagccaagctctataaagtctcaaatggcgctggtaccatgagtgtgagcctggtagcagacgagaatcctttcgcgcaaggagccctgaagagcgaggattgcttcatcctggatcatggaaaagacggaaaaatcttcgtgtggaaaggaaaacaggcaaacacagaagaacggaaggcagcacttaaaactgcaagtgacttcattaccaaaatggactatccaaagcaaactcaggtgagcgtgttgcccgagggaggagagacacctctgtttaagcagttctttaagaattggcgcgaccccgatcagaccgacggcctcggactctcctacctctcgagccacattgccaacgtggaacgcgtcccatttgatgcggcaacacttcacacttccactgcaatggccgcccaacatggcatggacgacgacgggaccggccaaaaacaaatctggagaatcgagggctctaataaggtccccgttgatccagccacctatggccagttctatggaggtgactcctatatcattctctataactatcggcacggcggtcggcaaggtcagatcatctacaattggcaaggcgctcagtccacccaggacgaggtggctgcctctgctatcttgactgcccagctagacgaagagctgggtggaacaccagtgcagtccagagtggttcagggtaaggagcctgctcatttgatgagccttttcggcgggaagcccatgattatctacaaggggggcacaagcagagagggcggacagactgcgcctgcctcgactcgactattccaagtgcgggctaactcagccggagctacacgggccgtcgaggtcctgccaaaggcgggagcccttaattctaacgacgcgtttgtgctaaagacccctagtgctgcgtacctgtgggtcggcaccggagcctctgaggctgaaaagactggcgctcaggaactgctcagggtcttacgcgcccagcctgtacaggtggctgagggaagcgagcctgatgggttttgggaagctctgggcggaaaggcagcgtacagaacctctccccgactgaaagataagaaaatggatgctcaccccccccgcctttttgcatgcagtaacaaaatcggccgctttgtgatcgaagaagtccctggagagttgatgcaggaagaccttgcaaccgacgacgtgatgctcttggatacatgggaccaagttttcgtgtgggtgggaaaagatagccaggaggaggaaaagacagaggccctgacgtcagcaaagaggtacatcgaaaccgatcctgcaaaccgcgatcgccgcaccccaataaccgtggttaaacaagggtttgaaccaccttcattcgtgggttggttcctgggatgggatgatgattattggtcagtggaccccctggaccgggccatggccgagttagctgcatag

SEQ ID NO: 189051 - DNA, 783 bp, Artificial Sequence
  Description of Artificial Sequence: Synthetic coding sequence
atggtggtggagcaccccgagttcctgaaggccggcaaggagcccggcctgcaaatttggcgagttgagaagttcgatttagtccctgtcccaacgaacctttacggtgacttctttacaggggacgcatatgtgatcctgaaaaccgttcagctgagaaatggaaacctgcaatacgacctccactactggcttgggaacgaatgctctcaggatgagagtggagctgccgcgatcttcaccgtccaactggatgattacttaaacggaagggccgtccagcaccgcgaggtgcaaggcttcgaatctgcaacatttctgggatattttaagagtggtttgaagtacaagaaggggggtgtggcctctggattcaagcatgttgtacctaacgaggtggtggtgcagaggctttttcaggtcaaaggacgacgggtagtgagagctactgaagttcccgtcagttgggagagtttcaacaatggagattgctttattcttgacctcggaaacaacattcatcagtggtgtggaagtaattctaatcggtatgaaaggctaaaggcaacccaggtctcaaaggggattcgcgacaatgagcgttcaggcagagcccgcgtacacgtgagtgaagaggggactgagccggaagctatgctccaggtacttggtcccaagccagccctgcctgcaggcacagaagatactgcaaaggaagacgcagcaaataggaaattagcgaagttatataaagtctcaaacggtgctggcactatgtcttag

SEQ ID NO: 189052 - DNA, 2229 bp, Artificial Sequence
  Description of Artificial Sequence: Synthetic coding sequence
atggagaagctgttctgctgcttccccaacagcatggtggtggagcatcctgagtttctcaaagccggcaaggagccagggctgcaaatttggcgggtcgagaagttcgacctggtaccagttccaacgaatttatatggcgatttttttacaggtgatgcttatgtgatcctgaagactgtccagctgcgcaatggaaacttgcagtatgacttgcactactggctgggtaacgaatgctcccaggacgagagcggcgctgccgcgatcttcactgttcagcttgatgactacctgaacgggagggcagttcagcaccgggaagtgcaaggtttcgagtccgccacatttctcggctacttcaagtcaggcctgaaatacaaaaaaggaggggtggcaagcggcttcaaacatgtggtccccaatgaagtcgtggtgcagcgtctgttccaggttaaaggtcgccgcgtcgtgagggccacagaggtcccagtttcttgggaatctttcaacaacggggattgttttattctcgatttggggaataacatccaccaatggtgtgggagcaatagcaataggtatgagagactgaaggctactcaggtgtctaaggggattcgcgacaacgagcgaagtgggcgcgcccgcgtccatgtgagcgaagagggaaccgagcccgaagcaatgctccaggtgctgggaccgaagccagcactgcccgctggtaccgaggatacagccaaagaggacgcggctaaccggaaactggccaagctttataaggttagcaatggtgccggcactatgtctgtgtctcttgtggccgatgagaatccttttgcgcagggcgccttaaagtcggaagactgtttcatcctggatcatggaaaggatggtaagatattcgtgtggaaggggaagcaggccaatacagaggagagaaaggccgccctcaaaacagcctccgactttatcactaaaatggactacccgaagcagactcaggtgtctgttctgccagaggggggcgaaacccctttgttcaaacagttttttaagaactggagagatcccgatcaaactgacggcctagggctctcctaccttagttctcacatcgccaacgtcgagcgagtcccgttcgatgcggctacccttcacacgtccacagccatggcggcccagcatggaatggacgacgatggaactgggcagaagcagatctggcgcatcgagggttcaaataaggttccggtggaccccgcaacatatgggcaattctatgggggtgactcatacatcatcctgtacaactacagacacggtggccgtcagggccagatcatatataattggcagggtgcccagagcactcaggacgaggttgctgcgtctgctatcttgacagcccagctggacgaagagctgggcgggacgcctgtgcagtccagggtggtgcaggggaaagaaccagctcatctgatgtctctgttcggcggcaagcccatgattatttacaaaggaggcaccagcagggagggcggacagactgctccagcttcaacgcgattattccaggtccgagcaaactccgcaggcgccacacgagccgttgaggttctcccaaaagcaggagctttaaactctaacgatgcattcgtgctgaagacaccctcagccgcctatctttgggtcgggacaggcgcatcagaagccgagaaaactggggcccaggaactcctcagggtcctcagggcccaacctgtccaagtggccgagggctccgaacccgatgggttctgggaggccctgggaggaaaggctgcctataggacttcaccacggctgaaagacaaaaagatggatgcccatccaccacgactgtttgcttgctcaaacaaaataggcagattcgtgattgaagaagtcccaggcgagttgatgcaagaagatctcgccactgatgatgtgatgctcctggacacttgggatcaggtgttcgtatgggtcggcaaggattcgcaagaggaggaaaagactgaggcgctgacatctgctaagcgctacatcgagactgaccctgcaaatagggatagaaggacgcctataacagtcgtgaaacagggattcgaacctccatcatttgtggggtggtttttgggctgggatgacgactactggtccgttgacccgctggatcgagctatggccgagctggcggcatag

SEQ ID NO: 189053 - DNA, 2196 bp, Artificial Sequence
  Description of Artificial Sequence: Synthetic coding sequence
atggtggtggagcaccccgagttcctgaaggccggcaaggagcccgggctgcagatctggcgggttgaaaagttcgatcttgtgcctgtgccaacgaacctttacggtgattttttcactggtgatgcctacgtgatactcaagactgtacagcttagaaacgggaacctgcagtatgatcttcactactggctgggcaacgaatgctcccaggatgaatccggagccgctgctatattcaccgtacagctcgatgattatcttaatggtcgcgccgtccagcaccgcgaggtgcagggattcgaaagcgccactttcttaggttattttaaaagcggactgaagtataagaaaggcggggtcgcttctgggttcaagcatgtcgtccccaacgaagtcgtggtgcagaggttgttccaggtgaaagggagacgagtagtgcgcgccaccgaggtgccagtcagctgggagagttttaataatggtgattgttttattttagatcttggaaacaatattcaccagtggtgcggctccaattcaaaccggtacgagaggctgaaagctacccaggtgtcaaagggcatcagagataacgaaaggtcgggacgagcccgcgttcatgtctcagaagagggtacagagcctgaagcaatgctccaggttttgggccctaagcctgctttaccagcaggaactgaagatactgcaaaggaagacgcggccaaccgtaagctggccaaactgtacaaagtgagtaacggagccgggacaatgtctgtgtccctggttgctgatgaaaacccctttgcccaaggtgccttaaaatccgaggactgttttatcctggaccatggtaaagatggaaaaatcttcgtgtggaaaggcaagcaggccaatactgaggaaaggaaagccgcgctaaagacagcgagtgacttcattacaaagatggattatcccaaacagacacaagtaagcgtcctgccggagggaggtgagacgccacttttcaagcagttctttaaaaattggcgagacccggatcaaacagatggcctgggcttgagctatctgtcttctcatatcgctaacgtggaaagagtgccatttgatgccgctaccctgcacacctctactgcaatggccgcacagcatgggatggacgatgacggcaccggacagaagcagatttggagaattgagggttctaataaggtccctgtggaccctgctacctacggacagttttatggcggcgatagctatataatcctgtacaattacagacatggaggccgccaaggtcaaatcatttataattggcagggcgcccagtcaacacaggatgaagttgcggccagcgccatactaactgcacaactggatgaggagctgggcgggacccccgttcaatcgagagtcgtacagggcaaagagccagctcacttgatgtctctcttcggtggaaagcctatgatcatctataagggggggacttctcgcgagggaggacagacggcaccagcttctacccggctgttccaagtccgtgctaatagcgctggcgcaacgcgtgctgttgaggtgctcccaaaggccggagccttgaatagcaatgacgcatttgtattaaaaactcctagcgcagcgtatctctgggttggtactggcgctagtgaagccgaaaagaccggggctcaggaattattgagggttttgcgggcccaacctgtgcaggtggctgaaggaagcgagcctgacgggttttgggaggctctcggtggcaaggcagcctaccgtacctctccccgccttaaggacaagaaaatggacgcccaccccccaagactgttcgcctgtagcaacaagataggccggttcgtcatcgaagaggtgcccggcgagctcatgcaggaagatctggcgactgatgacgttatgctcttagatacgtgggatcaggtgtttgtctgggtgggcaaagattcacaggaggaagagaagaccgaggctctaactagtgccaaaaggtacattgaaacagacccagcaaacagggatcgaaggaccccaatcacagtggtgaagcagggatttgagcccccctccttcgtgggctggttcctgggttgggacgacgactattggtctgttgatcctttggatcgtgctatggcggagcttgctgcctag

SEQ ID NO: 189054 - DNA, 2118 bp, Artificial Sequence
  Description of Artificial Sequence: Synthetic coding sequence
atggtggtggagcaccccgagttcctgaaggccggcaaggagcccgggctacaaatctggcgggtggagaaatttgacttagtgccggtgccaaccaacttgtatggagatttttttaccggggacgcgtacgttatcctgaagactgtgcagttgaggaacggcaacttgcagtatgacctccactattggctaggaaatgagtgttctcaggatgagagcggtgcggctgcaatcttcaccgttcaactagatgattatctcaagtacaagaaaggaggagtagcaagtgggtttaagcatgtggttccaaatgaggttgtggttcagcgcctattccaggtaaaggggcgccgggtagtgcgcgccacagaggtgcctgttagttgggaatctttcaataacggagattgttttatactagatttaggcaacaacattcatcaatggtgcggtagtaacagcaatcgatatgagagactcaaagccactcaggtctcgaaaggcatacgggataacgagagaagtgggcgggctcgtgtgcatgtgagcgaggagggaaccgagcccgaggcgatgctccaggtcctgggcccaaaaccggctcttcctgctggaactgaggacaccgcgaaagaagatgccgcaaatagaaagctcgctaaattgtataaggtgagcaacggggccggcacaatgtctgtgtcacttgtcgctgatgagaatccctttgcacaaggtgcactgaagtccgaagattgcttcattcttgaccatggcaaggacggtaagattttcgtgtggaagggcaaacaggccaatacagaagagaggaaagcggccctcaaaaccgcatccgacttcatcaccaaaatggactacccaaagcaaacgcaagtttccgtcctgcctgaggggggggaaactcctctgttcaaacaattctttaaaaattggcgagatccagaccagactgacggccttggactgagctacctaagttcccacatagccaatgtggagagagtgccttttgacgcagccaccctgcatacaagtaccgcgatggccgcccagcatggcatggacgatgacggtacaggacaaaagcagatatggcgcattgaaggctccaataaggtacctgtcgacccggctacctacggacagttctacggaggcgatagctacatcatactgtataactaccgacacggggggcgacaggggcagattatttacaattggcagggagctcagtctacccaggacgaagtggcagctagcgcaatcctgacagctcaactggacgaggagctaggaggcacacccgtgcagagtagggtcgtccaagggaaggaacccgcccacttgatgagcctgttcgggggtaagcctatgattatctacaaaggtggcacatcaagggagggaggccaaaccgcgcctgcaagcacccgcctgttccaggtgagagctaattctgcaggggccacgagagctgtggaagttttgcccaaagccggggcccttaacagtaacgacgctttcgtgctgaagaccccatccgccgcctatttgtgggtcggaactggggcttcagaagccgaaaagaccggtgctcaggagttgctgagggtcctgcgtgcacagccggtccaggtggcagaggggtccgaacccgatggcttctgggaagccttggggggaaaagcagcttacagaacttcccccagactgaaagataaaaaaatggatgctcatccccccagactcttcgcctgctcaaacaaaatcggtagatttgtgatcgaggaggtgcctggagaactcatgcaagaggaccttgccacggatgacgtaatgctcctggatacctgggaccaggtcttcgtatgggtagggaaagatagccaggaagaagagaagacagaggctttgaccagcgccaaaagatatattgaaaccgaccccgcgaacagagatcgtcgaactccgattaccgtggtgaagcaaggttttgagcccccttcttttgtgggatggtttctgggatgggacgacgattattggtcggtggaccccctggaccgcgccatggccgaactggccgcctag

SEQ ID NO: 189055 - DNA, 2220 bp, Artificial Sequence
  Description of Artificial Sequence: Synthetic coding sequence
atgcccctgtgcacccccaacagcatggtggtggagcaccccgagttcctgaaggccggtaaggaacctggtctacagatctggcgtgtggagaagttcgacctcgtgcccgtgcctacaaacctctatggcgatttttttacaggtgatgcgtatgtgatcctgaaaactgtccagttgcgtaatgggaatctgcagtatgatcttcattattggttaggtaacgaatgctcacaggatgaatcaggggccgctgcaattttcactgtgcagttggatgactacctcaacgggcgcgcggtccagcatagggaagttcaggggttcgagtcggcaaccttcctgggatacttcaagtccggattgaagtataagaaaggcggagttgctagcggatttaagcacgtggtgccaaatgaggtggtagtccagaggctgtttcaagtcaagggcaggcgagtggtgagagccactgaagtgcctgtctcttgggagagctttaacaacggggactgtttcatcctcgaccttggcaacaatatacatcagtggtgcggcagtaacagcaacagatacgagaggctcaaggcaacccaggtcagtaaaggaatccgggacaatgaacgaagcgggcgcgcacgcgtacatgtgtcggaagagggcactgagcccgaggcaatgctgcaggtgttgggacccaagcccgccctgcctgccggtaccgaggatactgccaaggaggatgccgctaataggaaactagctaagttgtacaaggtgagcaacggcgccggcacaatgagcgtgagtctggtggctgacgagaatccatttgcccaaggcgccttgaaatccgaggactgctttatcttggaccacggtaaagacggaaaaatttttgtctggaaaggaaaacaagctaataccgaagagcggaaggccgctttaaagacagccagcgactttatcaccaagatggactatcctaagcagacacaggtatctgtcctaccagagggaggagagacacctttatttaagcagttttttaagaactggagagacccggatcagactgatggcttgggcttatcatatctgagctcacacatcgctaacgtggagcgggtacctttcgatgcggcaacactccacacgtccacagccatggccgcacagcacggcatggacgacgatgggaccggtcagaagcagatctggaggattgagggctctaacaaggtgcctgtggaccctgctacctatggccagttttacggaggagactcttacatcatcctctacaattaccgccacggcggccgccagggccagattatctacaattggcagggcgcacagagcacccaggatgaggtagcagcctcagctatccttacagcccagctggacgaggagctgggggggacccctgtgcaatctcgcgttgtgcagggaaaggagccagctcacctgatgtcactgtttgggggaaagcccatgataatctacaaaggtggaacctcgagggaaggtggccaaaccgccccagcgagcacacgcctattccaggtgagggcgaatagcgctggcgctacgagagccgtagaggtgttgccaaaggccggagcccttaatagcaatgatgccttcgtgctcaaaaccccaagcgcagcctatctgtgggtgggaaccggagcctcagaggcggagaaaactggggctcaggagctgctgagggtcctgcgtgcccaaccagtccaggtcgctgagggatccgaaccagacggcttctgggaggccttaggcggaaaggccgcatataggacatcccccaggctgaaggacaaaaaaatggacgctcacccacctagactgttcgcgtgttcgaacaaaatagggcgattcgttatcgaagaggtgccgggcgagctcatgcaggaagatctggccaccgatgatgtgatgctactggatacctgggaccaagttttcgtgtgggttgggaaagatagccaggaggaagagaagaccgaggctctgactagcgcaaagaggtacattgaaaccgaccctgctaaccgggacagaagaacacctattaccgtagttaagcagggctttgagcctccctcattcgtgggctggtttctgggctgggacgatgattattggagtgttgaccctctcgacagagctatggccgagttagcggcttag

SEQ ID NO: 189056 - DNA, 4527 bp, Artificial Sequence
  Description of Artificial Sequence: Synthetic coding sequence
atgggccaggagccccggaccctgccccccagccccaactggtactgcgcccggtgctctgacgctgtccctggcgggctctttgggttcgcagctcgaacgtctgtcttccttgtccgcgtgggtccaggagctggcgaatcccctggcaccccaccttttcgcgtaataggggagttggtgggccacactgagcgcgtgtcaggattcactttctctcaccaccccggccagtacaatctttgcgctacttccagtgatgacggcacagtgaagatctgggatgtggagactaaaacagttgtgacggaacacgccctgcaccaacataccattagtaccctgcattggtctccccgagtcaaggatttgatcgtcagcggggacgaaaagggagtcgtgttctgctactggttcaaccggaacgactctcagcatctgttcattgagcctcgtacaattttctgtctgacttgttctcctcaccatgaggatctcgtggctatcgggtacaaagatgggatcgtggtgatcattgacataagcaaaaaaggggaggtgatccaccgtcttcggggacatgatgatgagatccattcgatagcgtggtgtcctctgcctggcgaggactgtctgagcattaaccaggaggagaccagcgaggaggcagaaatcacaaacggcaatgccgtcgctcaagcgcccgtgaccaagggttgctacctcgcgactggcagcaaggatcagaccatccggatatggagttgtagcaggggccgaggcgtgatgattttaaaactacctttcttgaagaggcgaggaggaggaatcgatcccacagtgaaggagcgactttggttaacattacactggccctcaaatcagccaacccagctcgtgtctagctgcttcggcggggaactacttcaatgggacctcacccaatcctggcggcgtaaatatacactgttcagcgcaagtagcgaaggacaaaaccattctcgtatagtgttcaacttgtgtcccctgcaaaccgaggacgacaaacaattactcctgagcacgtctatggatagagatgtcaagtgctgggacatcgcaactctggagtgcagctggacactgccaagcctgggggggtttgcctactctctcgccttcagctcagtcgacattggtagcctggccattggtgtgggggacgggatgatccgtgtctggaacaccttatccatcaagaacaactacgatgtcaagaatttctggcaaggtgtgaagagtaaggtgacagcactgtgctggcaccccacgaaggagggatgcctggctttcggcaccgatgacgggaaggtggggctttacgatacttacagcaacaagccacctcagatttcctctacataccacaagaaaaccgtgtatacactggcttggggccctcccgtccccccgatgtccctcggcggtgaaggcgacagaccttcccttgctctttatagttgtggtggcgaagggattgtgctgcaacacaacccgtggaagctttctggtgaggccttcgacattaacaagctgatacgggacacaaactcaattaagtacaaattgccagtgcacactgagatcagttggaaggctgatggcaaaattatggcgctcggtaatgaggacggctcaatcgagatctttcagattcctaacctcaaactgatatgtacaattcagcaacatcataaattggtgaacacgatctcctggcaccacgaacatggtagtcaacccgagctgtcctacttgatggcaagcggatcgaacaacgccgtgatctacgtacacaaccttaaaaccgtgatcgagtcgtcccccgagtctccagtcactattaccgaaccctaccggactctaagcggacataccgctaaaatcacctcagtggcctggtcaccgcatcacgatggcagactggtgtcagcgtcttatgacgggactgcccaggtatgggacgctttgagagaggagcctttgtgcaacttccgcgggcatagaggcagactcctctgcgtagcgtggtccccattagatcctgactgtatctattccggcgccgacgacttttgtgtgcataaatggcttacatccatgcaggaccattccagacctccacagggcaagaaaagtatcgagctggaaaagaagcgcttgagccagccaaaagccaagcctaagaagaagaagaaaccaaccctccgcacacccgtgaagctcgagagcatcgacggaaatgaggaggagagcatgaaagagaatagcggacctgtcgaaaatggagtgtctgatcaggaaggcgaagaacaggctagagaacccgagcttccatgtgggctcgccccagctgtaagtagggaacctgttatctgtaccccagtctcaagcgggttcgaaaagagtaaggtcactattaataacaaggtaatcctattgaagaaggagcccccgaaagaaaagcctgagactctgattaaaaagagaaaggccaggagtctgcttcccctgagcaccagtctggaccacagaagtaaggaggaactgcatcaagactgcctggtgctggcaactgcgaaacactccagagagcttaacgaggacgtctccgccgatgtggaagaacggttccaccttgggctcttcacagaccgcgctaccctttatagaatgatcgatatcgagggaaagggccacttggaaaatgggcaccctgaactttttcaccagctcatgctttggaagggtgatctcaaaggcgtcctccagaccgcggccgaacgtggcgagctcactgacaacctagtcgctatggcaccagctgctggatatcacgtttggctttgggctgtggaggccttcgccaaacagctatgcttccaggatcagtacgtaaaagcagccagtcacctccttagtattcacaaagtgtatgaggccgttgagctgcttaaaagtaatcatttttaccgggaagctattgctatcgctaaggcccgactccggcctgaagatcccgtgcttaaagatttgtacctgagttggggaacagtgctggaacgcgacggacactatgcagtggcagcgaagtgttacttgggcgccacttgtgcttatgacgcggccaaggtcctggccaagaagggcgacgccgcctcgctgagaacggcagccgaactcgcagccatcgttggcgaagatgaattaagcgcttcgctggcactgagatgtgcccaggagctattacttgccaacaattgggtgggggctcaggaggctctccagctccacgaatctctacaggggcagagactggtcttctgcctgctcgaacttctgagccgtcacttagaagagaagcagctctccgaagggaaaagttcctccagctaccacacatggaacactgggaccgaaggaccctttgtagagagagtcaccgctgtgtggaagtccatcttctcactcgacaccccagaacagtatcaagaagccttccagaagctgcagaacataaagtacccttcagccacgaataacaccccagccaaacagctactgttgcacatttgccacgatctgacgctcgccgtcctcagtcagcagatggcttcgtgggatgaggccgtacaggcattgttacgcgccgtagtcagatcatacgactcaggtagcttcaccattatgcaggaagtctactcagcattcctcccagatggttgcgatcatttgcgcgacaagctgggtgatcaccagtcccccgctacacccgcatttaagagtcttgaagcattttttctgtatggccgcctgtatgaattctggtggagtttgagccgcccttgcccaaacagctcagtttgggtgcgcgctggacataggacactgagtgttgagccatcacagcagcttgacaccgcctccacagaggagacagatccagagacctcgcagccagaaccgaatcgacctagcgaactggatctccggctgacagaggagggggagaggatgctctctacctttaaggaactgttcagcgaaaaacacgcatccctccaaaactcccagcggacagtcgctgaagtccaagaaacattagctgaaatgatccgccagcaccagaaaagtcagctgtgtaagtctacagccaacggccctgacaagaacgagcccgaggtggaagcagagcagcccctgtgttcatcacaatcccagtgtaaggaagaaaaaaacgaacctctctcactgccggaactgaccaagaggttaacagaggctaatcagagaatggcaaagttcccagaaagtataaaagcatggccatttccagatgttcttgagtgctgcctggtactgctactgattcgatcccactttcctgggtgtcttgcgcaagaaatgcagcagcaagcgcaggaactcttgcagaaatatggtaataccaaaacctacaggcgacattgtcagactttttgcatgtag

SEQ ID NO: 189057 - DNA, 396 bp, Artificial Sequence
  Description of Artificial Sequence: Synthetic coding sequence
atgcagacccccgtgaacatccccgtgcccgtgctgcggctgcccagggggccggatggattctcccgcggtttcgcacccgatgggagacgcgcaccgttgcgccctgaggttcctgagatccaggagtgcccaatcgcacaggaaagcctggaatcccaggaacagcgggccagagcggctcttagggaaagatatcttcggtccctactggccatggtggggcatcaagtgtcttttacgctgcacgagggggtccgcgtggcagcccattttggtgctaccgacttagatgtagcaaatttttacgtgtcacaattgcaaacccccatcggcgtacaagccgaggccctgcttagatgttcagatataattagttacacatttaagccatag

SEQ ID NO: 189058 - DNA, 396 bp, Artificial Sequence
  Description of Artificial Sequence: Synthetic coding sequence
atgcagacccccgtgaacatccccgtgcccgtgctgcggctgcccagaggccccgacggtttttctcgcgggtttgctcctgacggccgaagagctcccctgcgacccgaagtgccggagatccaggagtgtcccatagcacaggaatcccttgagagccaggagcaacgtgctcgggccgccctgcgggagaggtatctgaggagtctgctcgcaatggtaggccaccaagtctcttttactttgcatgaaggagtcagggttgctgcccatttcggcgcgaccgacctggatgtagcgaacttctatgtatcccaattgcagacaccgatcggcgtccaagccgaagccctccttcgctgctccgacataatctcctatacattcaagccatag

SEQ ID NO: 189059 - DNA, 2913 bp, Artificial Sequence
  Description of Artificial Sequence: Synthetic coding sequence
atggacgccgccgagcccggcctgccccccggccccgagggccggaaaaggtattcagatatttttaggtctcttgacaacctggaaatttcattgggcaatgtcacactcgaaatgctggcgggcgatcctctcttatcagaagatccagaacccgacaagactcctacagccactgtgaccaatgaagcgtcttgctggtcaggccccagccctgaggggcccgtccctctcactggagaagagctcgatctgagactcatccggaccaaaggtggcgtcgacgctgctttggagtacgcaaagacctggtctcggtatgcaaaagagctcctagcttggacagagaagcgggcctcctacgagctggagttcgcaaaatcaaccatgaaaattgctgaagccgggaaggtgtccatccagcaacaatctcacatgccgctgcagtacatatatacattgttcctggaacacgatctctctctgggaaccctggccatggaaacagtggctcaacagaaacgagactactaccaacctctggccgctaaacgcaccgagatcgaaaagtggagaaaggagtttaaggagcagtggatgaaggaacaaaaaaggatgaatgaggctgtgcaggctctgagaagggctcagcttcagtacgtgcagcggtctgaggacctgagagccaggtcgcagggaagccctgaagattccgcccctcaggctagcccgggccctagcaaacagcaggaaaggcggcggcgctcaagagaagaggcccaggccaaagctcaggaggctgaagcactgtaccaagcctgcgtgagggaagctaacgcccgacaacaggacctcgagatagcaaagcagcgaattgtatctcacgtgcggaagctggtgtttcaaggtgatgaggtgttgagacgcgtcacactgtctttgttcggcctcaggggcgcccaagccgagcggggccccagagccttcgccgcattagcggaatgttgtgccccatttgaaccaggtcagagataccaagagtttgtccgggcccttcggcccgaggccccacccccacccccaccagcttttagtttccaggaatttctgccatcacttaattcgtcccctctggacattagaaaaaagctgtcaggcccacttccgcccaggctcgatgaaaatagcgcggagcccgggccttgggaggatcccggcactggctggcgttggcagggcacgcccggccctactcccggatccgatgtggattctgttggcggcggtagtgaaagccgatccctggattcccccacttcatcaccgggagctgggactcgacaattggttaaagcctcttctactggaacagaatcgtcagatgactttgaggagagagatcccgacctaggtgacgggctcgaaaatggccttggcagtccgttcgggaaatggacactctccagcgcggcgcaaacacaccagctaagacgtttgaggggccctgccaagtgtcgagagtgtgaggcattcatggtctccgggaccgaatgcgaagaatgttttctgacctgccacaagcgctgtctggagaccctcctaatcctgtgtggacaccgcaggctgccagccagaacaccactgtttggagtggattttctgcagctcccccgcgatttcccggaggaggtacctttcgtcgtgacaaaatgcaccgctgaaatcgaacaccgcgcattagacgtgcagggtatctaccgggttagcgggagtcgcgtgagagtcgaacgattgtgtcaagctttcgagaatggccgcgcgctggtcgaactctccgggaactccccccacgacgtgagttcagtcctgaagcggttcctgcaggaactcaccgagccagtcattcccttccatttatacgacgcttttatttcactagctaaaaccctgcacgctgacccaggagacgacccaggaactccatccccctccccagaggttattcgctccttaaaaaccctgcttgttcagctgcctgacagcaactataacacccttagacacctcgtggctcatctctttagggtggccgcgcggttcatggagaacaaaatgtctgctaacaaccttgggatcgtcttcggaccgactctgctgcggccacccgacggtcctagagcagccagcgccattcccgtgacttgtttgcttgatagcgggcatcaggcacagctggttgagtttctcattgttcactatgagcaaatcttcggcatggatgagctgccccaggccaccgaacctcctccgcaagactccagccctgccccgggcccccttaccaccagttctcagcctcccccgcctcacctcgatcccgattcacagccacctgtgctggcttctgatcctggacccgacccccagcaccactcgaccctggaacagcaccctacagcaacacctaccgagattccaaccccacagagtgaccagcgggaggacgtggccgaagacactaaagatggcgggggcgaagtctcatcccagggtccggaggatagtctgctgggtacccaaagccgaggccacttttcccgccagcccgtgaaatatccgaggggcggagtcaggccggtgactcaccagctgtcttcactcgctctggtggcctccaagctatgcgaagagacccccatcacgtccgtcccgagaggatctctgagaggtcgtggaccatcacccgcggcggcatcacctgaaggcagtcctttgaggcgaacaccactacccaagcacttcgagatcacccaagaaactgccaggctgctgagtaagcttgattccgaggcggtaccacgtgctacctgttgtccggacgtccagccagaagaggcggaggaccacttgtag

SEQ ID NO: 189060 - DNA, 2826 bp, Artificial Sequence
  Description of Artificial Sequence: Synthetic coding sequence
atggacgccgccgagcccggcctgccccccggccccgagggccggaaaaggtactcagacatattcaggagccttgacaatctcgaaatttccctgggaaacgtcacgttggagatgttggccggcgatccattactaagcgaagaccccgaaccggacaagacccccacggctacagttactaatgaggcatcttgttggtccggcccaagtccagaaggccccgttcctctcaccggcgaggaattggacctcaggctgatcaggactaagggaggagtcgacgctgcattggagtatgctaagacttggtctcgatacgcaaaggaattgttggcgtggactgaaaagcgggcaagctacgaactcgaattcgccaagagtaccatgaagatcgccgaggccgggaaggtctccattcagcagcagtcccatatgccacttcagtacatttacactctgtttctggagcatgatctgagtctagggactctggccatggagacagtcgcacaacagaagagagattactaccaacctttggccgcaaagcgcaccgaaattgagaagtggaggaaggaatttaaggagcagtggatgaaagaacaaaaacgtatgaacgaggcagtgcaggctttgaggcgagcccagctgcagtacgtgcagcggagtgaagaccttagggccagatcccaaggtagccccgaagattctgcacctcaggcatctcctggaccctccaaacagcaggaacgcagacggcgctctagagaggaggcgcaggctaaggctcaggaagccgaggccctctaccaggcctgcgtccgggaagccaatgcgaggcaacaggatctggagatagccaagcagaggattgtatcccacgttaggaagctggtgttccagggcgacgaggtgttgcgacgggtgacattgtccttgttcggactgcggggcgcccaggcagaacggggtccccgtgccttcgccgcactggccgagtgttgcgctcctttcgaaccaggtcagcgttaccaggaatttgtgagagccctcaggcctgaggctcctccacctccaccaccagctttttcgtttcaagagtttctgccctctctcaactcgtctccacttgatattagaaagaagttatccggaccactgccacctcgacttgacgaaaactccgcagaacccggtccctgggaagatcctggtaccggctggcggtggcagggtcccaccccaggcagtgacgtggattcagtaggtggaggatccgagtcccggagcctggattcaccaacctcaagtcccgacctgggagacggtctcgaaaatgggctgggctcaccgttcggcaagtggacactctcatctgcagcccaaacccatcagctgagaagactgcgaggtcccgctaagtgtcgcgagtgcgaggctttcatggtgtcagggacagaatgcgaggaatgcttcctcacctgccacaaaagatgcttagagaccctgctcattctgtgcggacacagaagactgcccgcccgtacgccacttttcggagtcgactttctgcagctgccaagagatttcccagaggaggtgcccttcgtggtgaccaagtgcacagcggagattgaacacagagccctcgacgtgcaggggatctacagagtgtccgggtctagagtaagagtcgaacggctgtgccaagcctttgaaaatgggcgggccttggtggaattgagcgggaactcaccccatgacgtgtcaagcgttcttaagcgctttttacaagagttgacagagcctgtgatcccattccacctgtacgacgcgttcatcagtctcgccaaaacattacacgcggaccccggcgacgacccgggaacgcctagtccctcgccggaggtcattagatctcttaagactctactcgtacaattgcccgatagtaattataacacactccgccacctggttgcacaccttttcagagtagctgcccgtttcatggaaaataagatgtctgccaataatctcggtattgtgttcgggcctactctgctgcgccctcctgacggaccccgagcggctagcgccatacctgtgacttgccttctcgactctgggcaccaggcccagttagtggagtttctgatcgtgcactatgagcagattttcgggatggacgagcttccacaagctacagaacccccgccacaggactccagtcccgctccaggaccactgaccaccagtagccagcctcctcctccacacctcgatcctgactctcagccacctgtcttagctagcgaccctggaccagacccacagcatcattccactctggagcagcatcccaccgctacccccaccgaaataccaaccccccaatccgatcagcgggaggacgtggctgaagatacaaaagatggcggaggcgaggtgtcctcccagggtccagaggactcactcttgggaacacagagcagaggacacttctcaagacagcctgtgaagtacccgcggggcggagtccggccggtgacacatcagctttcatcgctcgctctggtagcctctaagctctgcgaggagactcccattacgtctgtgccaagagggtcgctccgtggacgcggcccgagccctgctgcggctagtcccgagggctccccactcagacggacacccctccccaaacactttgaaatcacccaggaaacagcgcgtcttctgagcaaacttgactctgaggcggtgcctcgagcgacttgttgtcccgacgttcagcctgaagaggcggaggaccacctgtag

SEQ ID NO: 189061 - DNA, 1005 bp, Artificial Sequence
  Description of Artificial Sequence: Synthetic coding sequence
atgaacaccatcctgccctgccaggaccagtacttcgtgggcggccagagctacaactgcccctattcgactactaccagtgagtcctccgtggacgtgtctactgaaacatgggtgagcttctgggctgctgggctgctcgacaatcgagaactgcagcaggcccctcaggcgcaagagtccttctccgatagcaacttcccccttccggacttgtgtagctgggaggaggcacagctgtcatcgcagctgtaccggaacaaacagctacaggacaccttagtacagaaggaagaggagctagctcgtttgcacgaagagaataatcaccttagacagtacctcaactccgctctcgtcaagtgccttgaagagaaggccaagaaactccttagtagcgatgaattctctaaggcatatggtaaatttagaaaaggtaagcggaagtccaaagagcagagatatagtcccgcagagattccgcaccccaaaaatgcaaaaaggaatctgagcagcgagtttgccaactgtgaggagcaggccggtcccccagtggatccttgggtcttacagaccctcggcctgaaagatctagacacaatagacgacacatcttccgctaattactccgcactggctagccacccaagacgcgtggcatcaacctttagccagtttcctgatgacgccgtggactacaagaacatcccccgggaagatatgccgattgattataggggggaccgcacgacacctcttcatagtactgccactcacggggaggattttcacatcttaagtcagctaagcaatccccctgttggactcaaaaccttgccctattatacagctcacgtctccccaaacaagaccgagatggccttcagtacctccctgtccccccactgtaatgtcaagacccatagcttccaccaggggcaggcgtttgtcaggagggacgaggaagggggatggaagtttacctgggtaccaaagcagagctag

SEQ ID NO: 189062 - DNA, 2727 bp, Artificial Sequence
  Description of Artificial Sequence: Synthetic coding sequence
atgggcgtgaacgacctgtggcagatcctggagcccgtgaagcagcacattccgctgcgtaatcttgggggcaaaaccatagccgtggatctctcgctctgggtctgcgaagcccagaccgtgaagaaaatgatgggttccgtgatgaagccgcaccttagaaatctgttcttcagaatcagttacttaacacaaatggatgtgaagttagtcttcgtgatggaaggagagccacctaaattgaaggccgatgtcatctcaaaaaggaaccagtcccgatacggatccagtggtaaatcttggtctcaaaaaacaggccgctctcactttaaatccgttctccgtgagtgtctccacatgcttgagtgcctgggtattccctgggtccaagcggccggagaggcagaagctatgtgcgcttacctgaatgcaggagggcacgtggatggctgccttaccaacgacggagatacattcctctatggcgcccagaccgtgtacaggaactttacaatgaatacgaaggatccccacgttgactgctatactatgtcctcgattaagtccaaacttggtttggacagggatgctctcgttgggctagccattctcctggggtgcgattacttgcctaagggggtgcctggggtgggcaaggaacaggcacttaaactgatccagatcctcaagggacagtctctgctgcagcggtttaaccgctggaacgagactagctgtaactcgtcaccacaattattagtgacaaagaaactcgcacattgcagcgtgtgctcccaccctggatcccccaaagaccacgagaggaacggatgccgcctctgtaagtccgataagtattgcgaacctcacgattacgaatactgttgcccctgcgagtggcatcggaccgagcatgatagacagttatctgaggtggagaacaacatcaagaagaaggcttgctgttgtgagggcttcccgttccatgaggtcattcaggagtttctcctgaataaagacaagttggttaaggtgattcgctaccagcggccagacctcctattattccagcggttcaccttagaaaaaatggagtggcctaaccattatgcgtgtgagaagctgctggttctgctgactcactacgacatgattgaaaggaagctgggatctcgaaattctaaccagctgcagccaattaggatcgtcaaaacacgcattcggaacggagtccattgtttcgagattgaatgggaaaagcctgaacattacgccatggaggacaagcagcacggtgaattcgccctgctgaccattgaggaagagtccctgtttgaagccgcttatcctgaaattgtcgcggtataccagaaacagaaacttgagataaagggaaagaaacagaagagaattaaacctaaggaaaacaacctccccgaaccagacgaagtcatgtcttttcagagtcatatgacgctcaagccaacatgcgaaatcttccacaaacagaacagcaagcttaattctggcatctctcccgacccaactctgcctcaggagtccatatcggcctctctgaattccctcctgttgcccaagaacacgccctgtctgaacgcacaggaacaattcatgtcatcactgcgcccgcttgcaatacaacagatcaaggccgtgtcaaagtccctgataagcgagagctctcagcctaacacgtcaagtcacaatatctcagtcatcgccgacttgcacctgtcgactatcgactgggaggggaccagcttctcaaacagtcccgccatccagaggaatacgttctctcatgatttgaagagcgaggtagaatccgaattaagcgctatcccggatggatttgaaaacatccccgagcagttatcctgcgagtccgaacggtacaccgccaatatcaaaaaggtgctggacgaagacagcgatggtatctcccccgaggagcacctgttgtccggcatcacagacctatgtctccaggacctgcccttgaaggaaagaatcttcaccaagctgtcttacccccaagataacctgcaacctgatgtaaatctgaagactctgagcatcttgtcagtcaaggaatcctgcattgccaacagcggttcggattgtaccagtcatctttcaaaagatctgcctggaatcccgcttcagaatgaatcacgcgattctaaaatcctaaagggcgaccaactccttcaggaagattataaagtgaacactagcgttccctactcggtgagtaacacagtggtgaagacatgtaacgttcggccacctaatacagcgcttgaccactctagaaaggtggatatgcaaacaacccggaagatcctaatgaaaaagtccgtgtgcctggatagacatagtagcgatgagcagtccgcgccagtgttcggcaaagcaaagtatacaacccagcgtatgaagcactcatcacagaagcacaactccagccacttcaaggagagcggccacaataagctgtcttcgcctaagatacacatcaaggaaactgagcagtgcgtgcggagctacgagacagctgaaaatgaggagagttgtttccctgacagtactaagagcagcctgtccagtttgcagtgtcacaagaaggagaacaactccggaacatgtttggacagcccactgcccttgaggcagcgcctcaagctgaggtttcagagcacctag

SEQ ID NO: 189063 - DNA, 2727 bp, Artificial Sequence
  Description of Artificial Sequence: Synthetic coding sequence
atgggcgtgaacgacctgtggcagatcctggagcccgtgaagcagcatatcccactgcggaatctcggtggaaagacgatcgcagtcgatctctctctgtgggtgtgcgaagcgcaaacagtaaaaaaaatgatgggatcagtcatgaagcctcaccttcgaaacctgttttttaggatttcatacctgacccaaatggacgtcaagctggtcttcgtaatggaaggggagccgccaaagctcaaagcagatgttattagcaagcgcaaccagtccagatacggcagcagtggaaagtcctggagtcagaaaactggcagatcgcactttaaatccgtgctaagggaatgtctccatatgttagaatgcctggggatcccgtgggtgcaagcggctggcgaagccgaggccatgtgtgcttacctgaacgcaggtggacacgtcgatgggtgccttacaaatgatggcgacacctttctctacggtgcccagaccgtttaccgcaatttcaccatgaacaccaaagacccacatgtggattgctacaccatgtcttccatcaagtctaagttgggtctcgatagagatgctctggtgggactggccattttgttggggtgtgactatctccccaaaggcgtgccaggcgtaggaaaagagcaggctctgaagttaattcagatattaaaggggcaatccttgctccagaggttcaacaggtggaacgaaacatcatgcaacagctcaccccaactactcgtgaccaaaaagttggctcactgtagcgtctgtagtcatccaggcagcccaaaagaccacgaacggaacggatgtcgtctgtgcaagagtgacaaatactgcgagccccacgattacgagtattgttgcccatgtgagtggcacaggaccgaacatgacagacaactgagcgaggtggagaacaacatcaagaaaaaggcgtgctgttgcgagggcttccccttccatgaggttatacaggagtttctgctcaataaggataaactagtcaaagtgatcagataccagagacccgacttgctgctgttccagcgtttcacattggaaaaaatggagtggccgaaccactacgcctgcgagaagctccttgtgcttctgacacactatgatatgattgagaggaagctgggatcaaggaattctaatcagctacagccaatccgcatcgtgaagacgagaatccgtaatggtgtgcactgcttcgaaatcgaatgggagaagcccgagcattatgcaatggaggacaagcaacacggggagttcgcactgctgactatagaagaagagtctctgttcgaagccgcctatcctgaaatcgtcgccgtgtaccagaagcagaagcttgagatcaaaggtaaaaaacagaaacgtatcaagcccaaagagaataacttacctgagccggacgaggtcatgtcctttcagtcccacatgaccctcaaacctacctgtgagattttccacaaacagaacagcaagctgaattccggaatcagtccagatccaaccctccctcaggaatccatctctgcttccctcaatagcctattactcccaaaaaatactccctgtttgaatgcccaggagcagtttatgtcctcccttaggcccctggccatccagcagatcaaggccgttagcaagagtcttatcagtgagagctctcagcctaatacaagctcccacaatatcagtgtaatcgccgacctgcatctctctacaatagactgggagggcacgagcttctctaactcgccagctattcagaggaataccttttcacatgatctgaaaagtgaggtggagagcgaactgtcagcaatcccagacggcttcgagaatatcccagagcaacttagctgcgagtcggaacgatacacagctaacatcaaaaaggtcctcgatgaggattcagatggaatcagtccggaggaacatctgctgagcggtattaccgatttgtgcctacaagacctccctttgaaagagagaatctttactaaattatcataccctcaggacaatctccaaccagacgtgaatctcaagacattgtcaatcctctccgtcaaggagtcttgcatcgctaattccggtagcgattgtacttcacacctctccaaagacctgcccgggatcccgcttcaaaatgaaagtcgtgatagcaaaatcctaaagggcgatcagttgttacaggaagattacaaggtcaatacttcggtgccatacagcgtttctaatactgtggtcaaaacttgcaacgttcgccctcccaacactgcgcttgaccattcacgcaaagtagacatgcagaccacccgcaagattctgatgaagaaatccgtgtgcctggaccgccactcttctgacgagcaaagcgcccctgtctttgggaaggctaaatacacaacccagcgaatgaagcatagtagtcagaaacacaactcttcacactttaaggaatcgggtcacaataagttgtcatccccaaaaatccatatcaaagagacagagcaatgtgtgcgatcatacgagactgcggagaatgaggagagctgcttcccagattcaaccaagtccagcctgtcgtctcttcaatgtcacaaaaaagaaaataacagtgggacatgtctggactccccccttccgctccggcagcggctgaagctgcggttccagagcacttag

SEQ ID NO: 189064 - DNA, 381 bp, Artificial Sequence
  Description of Artificial Sequence: Synthetic coding sequence
atgggcgtgaacgacctgtggcagatcctggagcccgtgaagcagcacattcctcttcgcaatctggggggcaagactatcgccgtggatctctcactgtgggtctgtgaggcccaaaccgtgaagaagatgatgggcagcgttatgaagccccatctgagaaacttattttttcgcattagctatctaacccaaatggatgtgaaactggtattcgttatggaaggagagccaccaaaacttaaagccgatgtgatcagcaaacgaaatcagagtcgctacgggagctctggaaagtcatggtcccagaaaaccggccggtcccatttcaagtcagtcttgagggagtgcttgcacatgctcgagtgcctcggcatctag

SEQ ID NO: 189065 - DNA, 282 bp, Artificial Sequence
  Description of Artificial Sequence: Synthetic coding sequence
atgggcgtgaacgacctgtggcagatcctggagcccgtgaagcagcacatccctctccggaacctcggcggaaagaccatcgccgttgatctcagtctctgggtctgcgaggcccaaacggtgaagaagatgatgggctccgttatgaagccccacttgcggaatctcttctttagaattagttacttgactcaaatggacgtcaaactggtgtttgttatggaaggggagcctcctaagctgaaagctgacgtgatttctaagcggaatcagtcaaggtag

SEQ ID NO: 189066 - DNA, 1431 bp, Artificial Sequence
  Description of Artificial Sequence: Synthetic coding sequence
atggagtggcccaaccactacgcctgcgagaagctgctggtgctgctgacccattatgacatgatcgagcggaagttggggtcccgaaactctaaccagttacagcccattcgcatcgtcaagacacgaattcgaaatggggtccactgcttcgagattgaatgggagaaacccgagcactatgctatggaggataagcagcacggcgaatttgccttgctgacaatagaggaggagtccctgttcgaggctgcctatcccgagattgtggctgtttaccagaagcagaagttggagataaaggggaaaaagcagaagaggattaagcccaaagaaaacaaccttccagagcccgatgaggtgatgtcctttcagtctcacatgacactcaaaccaacctgcgagatctttcacaagcagaattctaaattgaactcaggtatttcacccgacccgacacttccccaggaatcaattagcgcaagtctcaattctttgcttcttcctaaaaataccccttgtctgaatgcgcaggagcagttcatgtcttcccttcggcctcttgcgattcagcagatcaaagccgtctcgaaatctctgatcagcgaatctagtcagcctaatacttcttcccataatatatctgttatcgctgatctgcatctcagcacaattgactgggaaggcacctctttctctaatagcccagcaatccagcggaacaccttcagccatgatctcaagtccgaggtcgaatctgagttatcagccattcccgatggtttcgagaatattccagagcaactgtcctgtgagtccgagagatacacagctaatattaagaaggtgctggatgaggactccgacggtatctcacctgaggagcacctgctctctgggatcacagatttgtgcctgcaggacctgcctctgaaagagcgaatctttacaaaactgagctatccacaagacaatttacaacctgacgttaatctgaagacactgagtatcctttctgtgaaagaatcatgcatcgcgaacagcggaagcgattgcacttcacacctctcaaaagacctgcctggcatcccactgcagaacgagtccagagatagtaagattctcaaaggtgaccagcttctgcaagaagattataaagtgaataccagcgtgccgtactccgtgagtaacactgtcgtgaaaacatgcaatgtgcgcccacccaataccgccctcgaccatagccggaaggtcgacatgcagaccactagaaagattctcatgaagaagtccgtgtgtctggaccggcattcatccgatgaacagagcgctcccgtgtttggtaaagcaaagtatacaactcagcgtatgaaacactcttcacaaaagcataattcatctcattttaaggagtcggggcacaacgaatag

SEQ ID NO: 189067 - DNA, 1437 bp, Artificial Sequence
  Description of Artificial Sequence: Synthetic coding sequence
atggcctgcctgaaccccgtgcccaagctgtaccggagcgtgatcgaagacgtaatcgagggagtcagaaatctgtttgcagaggaggggatcgaagagcaggtgctgaaagatctgaagcagctctgggagactaaggtactccagagtaaagccacagaggacttcttccggaactcaatccagagtcctctctttacgctacaactcccacactcccttcaccaaacactgcagagttccaccgctagtctggtgattcccgcaggtcggaccctgccaagttttacaaccgcagagctgggaacctccaattcttctgccaatttcacctttcccgggtatcccatccatgtgcctgccggggtaactctgcagaccgtgtctggccacctgtacaaggtaaatgtgccgattatggtgactgagacatccggtcgagcaggcatcttgcaacatccaattcagcaggtctttcagcaactggggcagccttcggtgattcaaactagcgtgcctcagctgaatccctggtctttgcaagcaactacggagaaaagccagaggatcgaaacggtacttcagcagcccgccatcctgccctcaggcccagtggatcgtaaacatttagagaacgccacttcagacatacttgtgtcacccggcaacgaacataaaattgtcccagaggctctgttatgccatcaggaatcatcacactacatctcattgcccggggtcgtgttcagtcctcaggtctctcagactaactccaatgtggagtccgtgctctcagggagcgcctctatggcccagaatttgcatgatgagtcactgtccacttcccctcacggcgctctgcatcagcatgtcacggatattcaattacacattctaaagaacaggatgtacggatgcgatagcgtaaagcagcccaggaatatcgaggaaccatcgaatattcccgtgagtgagaaagattctaacagccaggtagacttgagcatccgtgtcaccgacgacgatatcggcgagattatacaagtggacggctctggcgacacgtcctctaatgaggaaatcggcagcactagggacgcggacgaaaacgagtttctcgggaacatcgatggaggagacctcaaagtgcctgaggaagaagctgacagtatttccaacgaagatagcgctactaactccagcgataatgaggacccacaagtaaacatcgtggaagaagacccgcttaatagtggggacgatgtttccgagcaggatgtgcccgacttatttgacactgacaatgtgatcgtatgccagtatgacaagatacacagatcaaagaacaaatggaaattttacttaaaagatggggtgatgtgttttggcggccgggactacgtctttgctaaggccatcggggatgcagagtggtag

SEQ ID NO: 189068 - DNA, 1335 bp, Artificial Sequence
  Description of Artificial Sequence: Synthetic coding sequence
atggcctgcctgaaccccgtgctgtgggagaccaaggtgctgcagtctaaagcgacagaggacttcttcagaaattcaatccaatctcccctgtttaccctgcagctgcctcattcactccaccagaccctgcagtcttctactgcgagtcttgttatccccgctggccgaactctgccgtcatttactacggcagagctgggtacgagtaattcttccgccaactttacgttcccagggtacccaatccacgtccccgccggggtgacacttcagacagtgagtggacacctttacaaggtgaatgtgcctattatggtcaccgaaaccagtgggagggccggaatacttcagcaccccatccagcaggtcttccagcaactcggacagccttcagttattcaaacctcagtgccccagctcaatccgtggagtctccaggcgaccaccgaaaagtctcagagaatcgaaacagtgctgcagcagccagcaatactacccagcgggccagttgaccgaaagcatctcgaaaacgctacctctgatatcttggtctcacctgggaatgaacacaaaattgtgcctgaagccctgctgtgccatcaggagtccagtcattatatctcgctacctggcgtggtgtttagcccacaggtctcgcagaccaacagtaatgttgagtcagttctgtccggctcagcctcaatggcgcagaacctccacgacgagtccctgagcacttcaccccacggagccttacaccagcatgtcaccgacatccaactccatatactgaaaaaccgtatgtacggctgtgactccgtcaaacagcctcggaatatcgaggaaccttccaacattcccgttagcgagaaagactcaaattcccaagtagatcttagtattagagtaacagacgacgatataggggagattattcaggtagacggaagcggcgacacttcctcaaatgaggagatcggtagcacccgggacgctgacgagaatgaatttttgggcaatatcgacggaggcgatctgaaggtgccagaagaagaggctgattctatctctaatgaggatagtgcgaccaatagttccgacaatgaggatccccaggttaatatcgtggaggaggaccccctcaattcaggggatgatgtgtcagagcaggacgttcccgatttgttcgataccgacaacgttattgtctgtcaatatgacaaaatccatcgatcaaaaaataaatggaaattttacctgaaggacggcgtcatgtgttttggcggaagggattatgttttcgcaaaagccattggagacgcggaatggtag

SEQ ID NO: 189069 - DNA, 951 bp, Artificial Sequence
  Description of Artificial Sequence: Synthetic coding sequence
atggccagcaccagccggctggacgccctgccccgggtgacctgccctaatcaccctgatgccatcctggtggaagattacagggctggcgacatgatctgtcctgaatgtggcctcgttgtgggtgatcgggtgatcgatgtgggctccgagtggcgaactttttctaacgataaggccaccaaggacccttccagagtgggcgacagccagaatcccctcctttccgatggcgacttgtcaaccatgatcgggaaggggaccggtgctgctagtttcgacgagtttgggaacagcaagtatcagaaccgccgaactatgagcagctctgatcgcgccatgatgaacgccttcaaagaaatcaccactatggctgacagaatcaaccttccacgcaacattgtcgaccgcacaaacaacctattcaagcaggtgtatgaacagaagtctctgaaaggtcgcgccaatgacgcaatcgcctccgcctgcttgtatatagcatgccgacaggaaggggttccccgcacctttaaagaaatttgcgcagtgtccagaatctccaaaaaggaaatcggccgatgtttcaagttgatcctgaaagctctggagacctccgtggacctcataaccactggcgacttcatgtcacgcttttgctccaacctctgcctcccaaagcaagttcaaatggccgctacccacattgcccggaaagccgtcgaactggatcttgtgccaggacgcagtcctatcagcgttgccgcggctgccatctacatggcttcccaggcctccgccgaaaaacgaactcagaaagaaatcggcgatatagcaggagtggccgacgttactattcggcagtcctaccgtttgatttacccacgggcacccgatttatttcccacagattttaagttcgatactcccgtggacaagctgccccaactgtag

SEQ ID NO: 189070 - DNA, 696 bp, Artificial Sequence
  Description of Artificial Sequence: Synthetic coding sequence
atggccagcaccagccggctggacgccctgccccgggtgacctgcccgaaccaccctgacgccatcctcgtcgaggattatagagccggcgacatgatttgcccagagtgtgacagagttattgacgttggaagcgagtggaggaccttttccaacgacaaagcaactaaagatccaagtcgggtaggggatagtcagaacccccttctctcagacggggacctaagtacaatgattgggaaaggcaccggcgctgcttcttttgacgaatttggaaactcaaaatatcagaacagaagaaccatgtcttccagtgacagggcaatgatgaacgcatttaaagaaatcacaacaatggcagaccgtataaatttgccacggaacattgtggaccgaaccaacaatctgttcaaacaggtgtacgagcaaaaaagtctgaaagggagagcaaacgacgccattgcaagtgcatgtctgtacatcgcatgcagacaggagggcgtacctagaacatttaaggaaatatgcgcagtgagccgcatctctaagaaggagattgggagatgcttcaaactaattctcaaggctctcgaaacctccgtcgacctgatcactacgggcgacttcatgagcagattttgtagcaatctgtgtcttcctaagcaggtgcagatggccgcaacccacatcgcctag

SEQ ID NO: 189071 - DNA, 675 bp, Artificial Sequence
  Description of Artificial Sequence: Synthetic coding sequence
gccagcaccagccggctggacgccctgccccgggtgacctgccccaaccatccggatgcaattttagtggaagattatcgtgccggggacatgatctgccccgagtgcgggctcgtggtcggggatcgggtgatcgatgtgggctctgaatggagaactttctcaaacgacaaggcgacgaaggacccctcacgtgtgggcgattcccaaaatcctttgctaagcgacggggacctatccaccatgatcggaaagggtaccggcgctgcttcctttgatgagtttgggaattcaaagtaccagaaccgaaggacaatgagttcgtcagatagggctatgatgaatgccttcaaggagataaccaccatggccgatcgcatcaatctgcccaggaatatcgtcgaccgaacaaacaatttatttaaacaggtttatgagcagaaatccttaaagggtagggctaacgacgccatcgcctcggcctgcctttatattgcttgcaggcaagaaggagtaccacgtacattcaaggaaatatgtgccgtctctcgcattagtaagaaggagattggtcggtgctttaagctgatccttaaggcattggagacatcagtggacctgattacgaccggggacttcatgtcaagaaattggaggtattgttggtgttgttag

SEQ ID NO: 189072 - DNA, 876 bp, Artificial Sequence
  Description of Artificial Sequence: Synthetic coding sequence
atggaccccagcctgctgcgggagcgggagctgttcaagaagcgggctttgtccacccctgtggtggagaaacgaagtgccagcagcgagtcttcaagttctagcagtaaaaaaaaaaaaacaaaggttgaacatggcggttcatccgggtctaaacagaattcagatcatagcaatggctcgtttaacctgaaggctctgtctggcagcagcggctataagtttggtgtcctggcgaaaattgtgaactacatgaagactaggcatcagcgtggggatacccatcccctgaccctcgatgagattctcgacgaaacccaacatcttgacatcggactcaagcaaaagcaatggttgatgaccgaagccctcgtaaataatccaaagatcgaggttatcgatgggaagtatgcatttaagcccaagtacaatgtgagagacaagaaggccctgctgcgcctgttggaccagcacgatcagagaggccttggcggaatactcctggaagatatcgaagaagccctgcccaacagtcagaaggctgttaaagctttgggcgaccaaattcttttcgtgaatagacccgacaaaaagaagatcctttttttcaacgacaaaagctgtcagtttagcgtagacgaggaatttcagaaactgtggcgctcagtgaccgtggatagtatggatgaggagaaaattgaagagtatctcaaaaggcaggggatcagctcaatgcaggaatcaggccctaagaaggtggctccgattcagcgtcggaaaaagcctgcttcccagaaaaagcgtcgatttaagacccataacgagcacctggccggggtgttgaaggactattcagacattactagttccaaatag

SEQ ID NO: 189073 - DNA, 381 bp, Artificial Sequence
  Description of Artificial Sequence: Synthetic coding sequence
atggaccccagcctgctgcgggagcgggagctgttcaagaagcgggctctctctactcccgtggtggaaaagcggagcgcctcctcggaatcatcaagctcctcctctaagaagaaaaaaactaaggtggagcatggtggatccagcggcagcaagcagaacagcgaccactctaatgggagtttcaatctcaaggccctaagcggatccagcggatataaatttggcgtgctggccaaaatagtgaattacatgaagacccggcaccagagaggcgacacccatcccttgaccttagatgaaatactggacgagacccagcacttagacataggacttaagcagaagcaatggctgatgactgaggcactcgtcaactag

SEQ ID NO: 189074 - DNA, 597 bp, Artificial Sequence
  Description of Artificial Sequence: Synthetic coding sequence
atggaccccagcctgctgcgggagcgggagctgttcaagaagcgggccctctccactccggtcgtggagaaaagatcagcctcttcagagagttcatcttcttcctccaaaaagaagaaaacaaaagtggagcatggcggttcttctggatcaaaacagaatagcgaccacagtaatgggtcttttaatctcaaggctttgagcggttctagcggctataagttcggagtcttggctaaaatcgttaactatatgaagacccgccaccagcgaggtgacacacatcccttgaccttggacgaaatcctcgacgagacacagcatttggatattggcttaaagcagaaacagtggctaatgacagaagccttggtcaacaaccctaaaatcgaggtgattgacggcaaatacgcatttaagcccaagtataatgtgcgggataaaaaggcactgctgagacttctggaccaacatgaccaacgcgggctgggtggtatcctactggaagatatagaagaagccttacctaattcccagaaggccgtaaaagctttgggagaccagatcttgtttgtgaacaggcctgataagaaatag

SEQ ID NO: 189075 - DNA, 1554 bp, Artificial Sequence
  Description of Artificial Sequence: Synthetic coding sequence
atggccgccctgggccccagcagccagaacgtgaccgagtacgtggtaagagtcccgaagaatacaacgaagaagtacaacatcatggcttttaacgcagctgataaggtaaattttgcaacttggaaccaggcccgacttgaacgcgacctatcaaataaaaaaatttatcaggaagaggagatgcccgagtcgggcgccggctcggagtttaaccgcaaactgagagaagaggcccgccggaagaagtacggtatagttctgaaggaattccggccagaggatcagccttggctcctgagggtgaacggaaagagcggcaggaaatttaaaggcatcaagaaagggggggtgaccgagaatacttcatattacatattcacccaatgccctgatggcgctttcgaggcattccctgtgcacaattggtataactttacacccttagcaaggcacagaacactcaccgcggaggaagccgaagaggagtgggaaagacgaaacaaagtgctgaaccacttttcgattatgcagcagagacggctcaaggaccaggatcaggacgaagatgaagaagagaaggagaagcgggggaggaggaaagcctccgagctgcggatacacgacctcgaggacgatcttgaaatgtccagtgatgcaagcgacgcctctggagaagaaggtggtcgagtcccaaaagccaaaaagaaggctccattggccaagggtggtcgcaagaaaaaaaaaaagaagggttcagatgatgaggccttcgaagactccgacgacggtgactttgagggacaagaggtggactatatgtcagatgggtcctccagcagtcaggaggaacccgagagcaaggcgaaagcgccgcagcaggaagagggaccgaagggggtggacgaacagagcgatagcagcgaagagtcagaggaagaaaagcctcctgaagaggataaagaggaggaggaggagaagaaagccccaactcctcaagagaagaagagaaggaaagactcctccgaagagtctgatagttctgaagagagcgatattgatagcgaagcgtcctcagccctctttatggcaaaaaaaaagacgccgccaaaaagagagcgtaagccatctggaggatcgtctcgagggaactcccgcccgggcactccaagcgcagagggcgggtcaacctcatctacattacgggcggccgccagtaaattagagcagggtaagagggtgagcgaaatgcccgcggcaaagaggctgcgcttggacaccggaccacagagtctttccggcaagtctactccccagcctccttctgggaaaaccacaccaaacagcggtgatgtgcaggtcaccgaggacgctgtccgaaggtatcttactcgtaaacctatgaccactaaggacctactgaagaaatttcagacaaagaagactggtctctcctccgagcagactgttaacgttcttgcccaaattcttaaacgtttgaacccggagcggaagatgatcaatgataagatgcacttttcactaaaagagtag

SEQ ID NO: 189076 - DNA, 1299 bp, Artificial Sequence
  Description of Artificial Sequence: Synthetic coding sequence
atggccttcaacgccgccgacaaggtgaacttcgccacctggaaccaagcccgactggaaagggacctctctaacaaaaagatttatcaggaggaggagatgcctgagtctggggctggctctgagtttaaccgaaaactgagggaagaggcgcggcgaaaaaagtatggcatcgtcctcaaggagttccggcctgaagatcagccatggctgctgagagtgaatggaaaatctgggcgtaaacgtaataaggtcctgaatcacttttctatcatgcagcagaggagattgaaggaccaggatcaggacgaagatgaggaggaaaaggagaagagagggcggcgcaaagcttccgagctccgcattcacgatctggaagatgacctggaaatgagttccgacgcttctgacgcctccggcgaggagggaggtagagtccctaaagcaaaaaagaaggctcctctagctaaaggcggacgaaaaaaaaaaaagaagaaaggctccgacgatgaggcattcgaagacagtgatgacggagacttcgaagggcaggaggtcgattacatgagtgacggcagttcatcatcacaggaagaaccggagtccaaggccaaggctccacagcaggaggaaggtccaaagggtgtcgacgagcagagcgacagttcagaggagagtgaagaggagaagcctccagaagaggacaaggaggaagaggaagaaaaaaaagcccctaccccacaagaaaaaaagagacggaaagattccagcgaagagagtgactcttccgaagaaagtgacattgactctgaagcctcttccgctctgtttatggctaagaaaaagacaccgccaaagcgcgagcgaaagcccagcggaggctcaagtcgaggtaactctagaccagggacaccgtccgccgagggaggtagcacgagcagcacactgagggcagccgcctcaaaactggaacagggcaaaagggtgtctgagatgcctgccgcgaagcggctgcggctggacaccgggcctcagagcctttcaggcaagtctactccacagccaccaagcgggaaaactacccccaattccggtgatgtgcaggtcactgaggacgctgtccggcgatacctgacccgaaagcctatgaccacgaaggacctgctgaaaaagttccagaccaaaaaaacagggctgagctctgagcagactgtcaatgtgttggcgcaaattctgaagagactcaatcctgagcgtaagatgattaatgacaagatgcatttctctctgaaagagtag

SEQ ID NO: 189077 - DNA, 384 bp, Artificial Sequence
  Description of Artificial Sequence: Synthetic coding sequence
atggccgccctgggccccagcagccagaacgtgaccgagtacgtggtgagggtgccgaagaatactacaaagaaatacaacatcatggcattcaatgccgcggataaggtgaattttgccacatggaaccaggcacgcttagagagagatctgtccaataaaaagatctaccaggaggaggagatgccagaatctggcgcaggctccgagtttaatcggaagttaagagaggaggctcggcggaagaagtacggcatcgtcttaaaagagtttaggcccgaagatcagccctggttgctccgggtgaacggcaaatctggtaggaagttcaaggggataaaaaaaggcggtgttacggagaatacctcttactacatcttttag

SEQ ID NO: 189078 - DNA, 1647 bp, Artificial Sequence
  Description of Artificial Sequence: Synthetic coding sequence
atggccaccagcagcgaggaggtgctgctgatcgtgaagaaggtgagacaaaagaagcaggacggcgctttgtacttaatggcagagaggatcgcctgggcgcccgagggcaaagaccggtttacaatatcccatatgtatgccgacataaagtgccagaaaatatcacctgaaggcaaggccaagatccagttacagttagtgctacatgcaggggacaccacaaattttcatttttctaacgaatctacggccgttaaagagagggacgccgtcaaagaccttcttcagcaactgttacctaaattcaaacgaaaggctaacaaggagctcgaagaaaaaaaccgcatgctgcaagaagaccccgtgctgttccagctgtacaaggacttggtcgtttcccaggttatctccgccgaggagttctgggccaacagattgaacgtgaacgctacggacagcagtagtacttcgaaccacaagcaggatgtgggcatcagcgctgccttcctcgcagatgtaaggccccaaacggacggctgtaacggcctgagatacaatttgacttcagacatcatcgagtccatatttcggacttaccctgccgttaaaatgaagtatgccgagaatgtccctcacaacatgaccgaaaaggagttctggactcgctttttccagagtcactatttccaccgggataggctgaacaccggttccaaagacttatttgccgaatgcgccaagatcgatgagaaggggctcaagactatggtttcacttggagttaaaaaccccctgctggacctgactgccctggaggacaagcctttggacgagggctacgggatatccagcgtgcctagcgcttcgaacagtaaaagcatcaaggaaaattcaaatgcggcgatcatcaaacgcttcaaccaccattcagcaatggtcctggctgcgggcttgcggaagcaagaggcccagaatgagcagactagtgagccatctaatatggatgggaattcaggagacgctgactgcttccaacctgccgtgaagcgcgctaagctgcaggagtcgattgagtacgaggaccttggaaagaacaatagcgtcaaaaccattgccttaaatctgaaaaagagcgatcgctattatcacggtcccacaccaatacagagcctgcaatatgccacatcccaggacattatcaattctttccagagcatcaggcaggagatggaggcttacacgccgaagctcacccaggttctgagtagtagcgctgccagctcaaccatcacggcactgtcccctggaggagcactgatgcagggggggacacagcaggccatcaaccagatggtgcctaatgacatccagtccgaactcaaacacctgtacgttgctgtgggagagctgctgcgccacttctggagctgcttcccagtgaacaccccatttctggaggaaaaagttgtgaagatgaagtctaatcttgagcgattccaggtgaccaaactttgcccctttcaagagaagatccgcagacagtatctgtcgacaaacctcgtgtcacacatcgaagagatgttgcagaccgcctacaacaagctgcatacatggcagtctagacgcctgatgaagaaaacatag

SEQ ID NO: 189079 - DNA, 1647 bp, Artificial Sequence
  Description of Artificial Sequence: Synthetic coding sequence
atggccaccagcagcgaggaggtgctgctgatcgtgaagaaggtgcgacagaagaagcaggatggcgctctttaccttatggccgaaagaattgcttgggctccagagggaaaggacaggttcaccatttctcacatgtatgccgacattaaatgtcagaagatctccccagagggaaaggctaagattcaattgcagctcgttctgcatgccggagacaccaccaacttccattttagcaacgagagcaccgccgtgaaagagcgggacgctgttaaagacctattgcagcagcttctgcccaagttcaaacgcaaggccaataaggaactagaagagaagaatcgtatgcttcaggaggatcccgtgctctttcagttatacaaggacttggtcgtctcacaggtaattagtgcagaggagttttgggccaacaggctcaatgtgaacgctacagatagtagtagtaccagcaatcacaagcaggatgttggcatctcagcagcctttctggccgatgtcagaccccagaccgacggatgtaatggcctccgatataatctaactagcgatataattgaatctatcttcagaacatatcccgccgtcaagatgaaatacgctgagaacgtcccccataacatgaccgagaaggagttctggacccggttttttcagtcccactattttcatagggaccgcctgaatacaggcagcaaggacctgtttgccgagtgcgccaagatagacgagaaaggactgaaaacgatggtctcacttggggtgaagaacccattattagatttgacagctcttgaggataagccactcgacgaagggtacgggatctcaagcgtgccctccgcttcgaactcaaagtctatcaaggaaaactctaacgctgctatcatcaaaagatttaaccaccatagcgcaatggtgttggctgccgggttacgaaagcaggaagcccagaacgagcagacgagcgaacctagcaacatggatggtaatagcggggatgccgactgctttcagcccgccgtcaagcgcgctaagttgcaggaaagcattgagtatgaggatcttggaaaaaataatagtgtcaagaccatcgcccttaacctgaaaaaatctgacaggtactaccatggaccaacacccattcagtctctgcaatatgccaccagtcaggacattattaattcatttcagagtatcaggcaggaaatggaagcctacaccccgaagctgacccaggtgctcagctcaagcgcagcctcctctaccataacagcattatcacccggcggagccctgatgcagggcggaacacagcaagcaataaatcaaatggtccccaacgatattcagagtgagctgaagcatctttatgttgcagtgggagagctgctacggcacttctggtcttgtttccctgtgaacacccctttcctggaagagaaggtcgtgaagatgaagtctaaccttgaacgatttcaggtgacgaaattgtgccccttccaagagaagattcgccggcagtacctgtcaaccaacctcgtctcccacatcgaggagatgctacagaccgcttataataaactgcatacgtggcagagtcgtcggctgatgaaaaagacctag

SEQ ID NO: 189080 - DNA, 288 bp, Artificial Sequence
  Description of Artificial Sequence: Synthetic coding sequence
atggccaccagcagcgaggaggtgctgctgatcgtgaagaaggtgcggcagaagaagcaggacggtgcgctgtaccttatggctgagagaatagcatgggcaccagagggtaaggatagattcacaatttcccatatgtatgctgacattaaatgccagaaaatatcacctgaagggaaggcaaagattcagctgcaactggtgcttcacgcaggggacacaacaaatttccacttctccaacgagtctacggccgtcaaagaacgtgacgctgtaaaggatctctag

SEQ ID NO: 189081 - DNA, 1299 bp, Artificial Sequence
  Description of Artificial Sequence: Synthetic coding sequence
atgctgcaggaggaccccgtgctgttccagctgtacaaggacctggtagtgtcacaggttattagtgccgaggagttctgggctaaccgactcaacgtcaatgctacagatagctcaagtacgagtaatcataagcaagatgtggggatttctgccgcatttctggcggacgtcagacctcaaaccgacggttgcaacggcttgcggtacaatctgacctccgacatcattgaatctatctttcgcacctaccccgcagttaaaatgaagtacgccgagaacgtgccacataacatgactgagaaggagttctggacaaggttcttccaatctcactacttccaccgtgacaggctcaatacaggatctaaggatctgttcgcggaatgcgccaaaattgacgaaaaagggctgaaaaccatggtatctttaggagtgaaaaatccactgctcgacttaacggcactggaagacaaacccctcgatgaggggtacggtataagcagtgtcccctccgcaagtaactcaaagagtatcaaggagaactcaaatgcggcgattattaagagattcaatcatcactctgctatggtgcttgccgcaggactgcgaaagcaagaggcccagaacgaacaaacctctgaaccttccaacatggatgggaacagcggagatgctgattgctttcaaccagcagttaagcgagctaaattacaagagtcgatcgaatacgaagaccttgggaagaataatagtgtgaagaccatcgcactgaatctgaagaaatctgatcggtattatcatgggcctacccccatccagtccttgcagtacgcaacatcccaggacattattaactcatttcaaagcatccgacaagagatggaggcctatactccaaaactgacacaggtgctctccagcagcgccgcatcatctaccatcacggctctcagccctggcggcgccctgatgcaaggcggtacccagcaagccatcaatcagatggtgcccaacgacatacaaagcgagttaaagcatctgtacgtagcggtcggtgagttactcaggcatttctggtcctgttttccagtgaacaccccatttcttgaagagaaggtggttaaaatgaagtccaatctcgaaagattccaagttaccaagctctgcccctttcaagaaaagattaggcggcagtatctaagcaccaatctggtatcacatatcgaagagatgcttcagactgcatataacaagcttcacacgtggcagagcagacggcttatgaaaaaaacctag

SEQ ID NO: 189082 - DNA, 1188 bp, Artificial Sequence
  Description of Artificial Sequence: Synthetic coding sequence
atggacgaggagcccgagcggaccaagcggtgggagggcggctacgagaggacatgggagatcttgaaggaagatgaaagtggctcactcaaagccaccatcgaggatatcctgttcaaagcgaagcgcaagcgggtgttcgaacatcacggtcaggtgagactgggcatgatgcggcatctgtatgtcgtggtggacgggagtcgtaccatggaggatcaagatctcaagcctaaccgtttgacttgcaccctcaagcttttagaatactttgtggaggaatacttcgatcaaaaccctatcagccagattggcattatcgtcaccaagagtaagcgcgccgagaaactgaccgagctttcaggtaacccaaggaagcatatcactagcctgaaaaaggctgtggacatgacttgtcacggcgagcccagcttatataactcactgtcgatcgccatgcaaacccttaaacacatgccgggccatacatctagagaagttctgatcatttttagcagtctgaccacctgtgatcctagcaatatctacgatctgattaagactctgaaggccgccaagatcagagtgagtgtgatcgggctgagcgcggaagtgcgggtgtgcaccgttctcgcccgggaaaccggggggacctaccacgtcatcttagacgagtcacactataaggagctgctgacccaccatgtgtcgcctcccccagcatcaagcagttcagagtgttcactgattaggatgggcttccctcagcacaccattgccagcctgagcgatcaggatgccaaaccttcattctccatggctcatctggacggtaacacagagcccggcctcactctgggaggctatttttgtccacagtgtcgcgctaagtattgcgaattaccagtggaatgcaaaatctgtggcctcacacttgttagtgctccccatttagcgagatcatatcaccatctgttccctctcgacgccttccaggagattcccctggaggagtataacggcgaacggttctgctatggctgtcagggagagcttaaggaccagcacgtttacgtgtgcgccgtatgccaaaatgtcttttgcgttgattgcgacgtcttcgtgcatgatagccttcattgctgtcccggatgtattcacaaaatccctgcccccagtggcgtctag

SEQ ID NO: 189083 - DNA, 1188 bp, Artificial Sequence
  Description of Artificial Sequence: Synthetic coding sequence
atggacgaggagcccgagcggaccaagcggtgggagggcggctacgagcgcacctgggagatcctaaaggaagacgagagcggctctctcaaagccaccatagaggatattctgttcaaggcaaaacgcaaacgcgtgttcgaacatcacgggcaggtgcgcctcgggatgatgaggcacctatatgtcgtggtggacggctctaggacaatggaagaccaggatctcaaacctaacaggctgacatgtactctgaaactcctggagtactttgtggaggagtatttcgaccagaaccccattagtcaaatcggaattatagtgactaagtccaagcgggcagagaagttgacggagctgagcgggaacccacgcaagcacatcaccagtttaaagaaggccgtagacatgacatgccatggcgagcctagcctgtataactctctttctatcgcgatgcagactcttaagcatatgccagggcatacatcgagagaagtgctgatcattttctcatcgctgacaacatgcgacccatcgaatatttacgatctcatcaaaaccctcaaagccgcaaagatcagagtgtccgtgattggtctcagtgcggaagtgcgtgtctgtaccgttctcgcaagggagaccggcggaacttaccacgtgattctggatgaaagtcattacaaagaattgttaactcatcacgtcagtccgccacctgcttccagcagcagcgagtgcagcctgatccgcatggggttcccacaacacacgatcgcatcacttagtgaccaggatgcgaaaccgtccttttcaatggcccacttggacggcaacaccgaacctggacttactctgggcgggtatttttgccctcagtgcagagccaagtactgtgagctgcccgtcgagtgcaagatttgtggattaaccctggtgtctgcgccgcatttagcccgtagctaccaccacctcttccccctggacgctttccaagagattcccctggaggaatataatggggagcggttctgttacgggtgtcagggcgagcttaaggatcagcatgtctacgtgtgtgctgtgtgtcagaacgttttttgcgtcgactgtgacgtcttcgtgcacgattccttgcattgttgtccaggctgcatccataagatccccgctccctccggcgtgtag

SEQ ID NO: 189084 - DNA, 1017 bp, Artificial Sequence
  Description of Artificial Sequence: Synthetic coding sequence
atgcggcacctgtacgtggtggtggacggcagccggaccatggaggatcaggacctgaagcctaatcggttaacatgcacactgaaactcctggaatattttgtggaggaatactttgaccagaacccgatcagccagatcggcattatcgttactaagtctaagagagctgagaagctcactgaactgtccggtaatcctaggaagcatataacctccctgaaaaaagctgtcgacatgacctgccacggcgaacctagtctgtataacagtctgtccatcgcaatgcagaccctcaaacatatgccaggccatacatcccgcgaggtcttaattattttttccagtctgaccacgtgtgatccttctaatatctacgatctgattaagactctcaaagcagctaaaatccgcgtatccgtaataggtctgtccgccgaggtccgggtgtgcacagtactggctcgggaaaccggaggcacctatcatgtcattctggacgaatctcactacaaggaactgcttacacatcatgtgtcgcccccacctgcatcatccagctccgaatgttccctgattcgcatgggattccctcagcacacaattgcaagtctttctgaccaggatgctaaacctagctttagcatggcccacttagatggtaacacggagcctggccttactctgggcggctatttttgtccccaatgcagagccaaatactgcgagttacctgtggaatgcaagatttgtggcctcacactggtcagcgccccacacctggccaggtcctaccaccacctgtttccccttgatgccttccaggagatccccctagaggagtacaatggcgaacgcttttgctacggatgccagggagagctgaaggatcagcatgtgtacgtgtgtgccgtctgtcagaacgtcttctgtgttgactgcgacgtatttgtgcacgatagcctccactgttgccccggctgcattcataaaattcccgctccaagcggagtctag

SEQ ID NO: 189085 - DNA, 1188 bp, Artificial Sequence
  Description of Artificial Sequence: Synthetic coding sequence
atggacgaggagcccgagcggaccaagcggtgggagggcggctacgagcgcacgtgggagattctcaaagaagacgagtctggtagcctgaaggcaaccatcgaggatatattgttcaaggcaaaaaggaaacgggtgttcgagcatcacggccaggtgcggcttggcatgatgcggcacctctatgtggtggtggatgggagccgtactatggaggaccaggacctcaaacccaatcggctaacatgcactcttaagcttcttgagtacttcgtcgaagagtacttcgatcagaacccaattagccaaattggcatcattgtgacaaagtctaagagagctgaaaaacttactgagctttctgggaaccctagaaagcacattacaagtctaaagaaggccgtggatatgacatgtcacggtgaaccatcattgtataactccctctcaattgccatgcaaaccttgaagcatatgccgggtcacacatctcgtgaagttctaatcatcttttcaagccttacgacatgcgacccatctaacatctacgacctgattaaaaccctgaaagcagccaaaattcgggtgtctgtgattggcctttccgctgaggtcagagtatgcactgtcttggcccgtgagacaggggggacgtatcacgtgatcttggatgaatcgcactacaaggagttgctcacacatcatgtgtcccccccccccgcctcatcgtctagcgaatgtagtctgatcaggatgggctttccgcaacacactatcgcgtcactgtcggatcaggatgctaagccctccttcagtatggcacatctggacggcaacacagaaccagggctgacactcggtggttatttttgccctcagtgcagggccaagtactgtgaactaccagtggaatgcaaaatctgcggcctgactctagtctcagcgccgcacttggctcgcagttaccatcacttgttcccacttgacgcgtttcaggagatcccattggaagagtacaacggtgaacggttctgctacggctgccaaggcgagctgaaggaccagcatgtgtacgtctgtgcggtctgccagaacgtcttctgcgtggattgtgatgtgttcgtccatgactccctccactgctgtcccggctgcatccacaaaatccctgctccaagtggcgtatag

SEQ ID NO: 189086 - DNA, 1389 bp, Artificial Sequence
  Description of Artificial Sequence: Synthetic coding sequence
atggagagcacccccagccggggcctgaaccgggtgcacctgcagtgtagaaacctgcaggagtttcttggagggttatcccccggcgtactggataggttgtacggccaccccgctacttgtttggcggttttccgcgagttgccgtccctggcgaaaaactgggtgatgcgcatgctcttcctcgaacagccccttccccaggccgccgtcgcgttgtgggtgaagaaagaatttagtaaggctcaagaggagagcactggacttttgtcagggctgagaatctggcacactcagctgttgccgggcggtctgcagggtctcatcctgaaccctatcttcaggcagaacctgcgcatcgctttacttggtggaggaaaagcctggtcagatgacacttcgcaactgggtccagataaacacgctcgcgatgtgccatccttagataaatacgccgaggaacggtgggaggtggtcctccacttcatggtgggctcaccgtctgccgctgtgagccaagatctggcgcaacttctatcacaggccggcttgatgaaatctactgaacccggcgaacctccatgtattacaagcgccggattccagttcctgttgcttgatacccccgcccagctctggtacttcatgttacagtacttgcaaacagctcagagcagaggcatggaccttgtggagatcctcagcttcctgttccagctgtcctttagcacgctggggaaggattattctgtggaaggcatgagcgattctctgttaaacttcctgcagcatcttagagaattcggccttgtgtttcagcggaaacgcaagtcaaggaggtactatcctacaagacttgcaattaacttgtcttccggagtaagcggcgccggcggtaccgtccaccaaccaggtttcattgtggtggagacaaactacaggctgtacgcttacacggagagcgaacttcagatcgccctgatcgcactcttcagcgagatgttgtatagattccccaatatggtcgtggctcaggtgactcgagaatccgtgcagcaggcgatagcctcaggcatcaccgcacagcagatcattcacttcttgagaacacgggcacaccctgtcatgctgaagcagacccctgtcctgcctccgactataaccgaccagatacgtttgtgggaattagagagggatcgccttcgattcacagagggggtgctgtacaaccagtttctgtcccaggtcgacttcgaactccttcttgctcacgcccgcgaactcggagtgctcgtgttcgaaaattccgcaaaaaggctgatggtcgtcaccccagcagggcactccgatgtcaagaggttttggaaacggcaaaagcactcatcctag

SEQ ID NO: 189087 - DNA, 1389 bp, Artificial Sequence
  Description of Artificial Sequence: Synthetic coding sequence
atggagagcacccccagccggggcctgaaccgggtgcacctgcagtgtcggaacttacaggagttcttgggaggcttgtccccaggcgtcttggaccgcctttacgggcatcccgcaacctgtcttgctgtattccgtgaacttcctagcctcgcaaagaactgggtaatgcgaatgttgtttttagaacagcctctgccgcaggcagccgtcgccctgtgggtgaaaaaggagttctctaaggctcaagaggagtccaccggactgctgtcagggctcaggatatggcatacccagcttctgccaggcggcctacaagggctaattctgaaccccatatttcgccagaatctgcgcattgctttacttggcggcgggaaggcatggtccgatgacacttcccaactggggccagacaagcacgccagagatgtgcctagcctggacaaatacgccgaggaaagatgggaggtggtgctgcatttcatggtgggaagcccttctgccgctgtatcacaggatttagcccagttactgtcccaggctggcctgatgaagtctacagaaccgggggagcctccctgtatcacatctgccggcttccagtttctcttactggatacccccgcgcagctgtggtatttcatgctccagtacctacagaccgctcaaagtcggggtatggacttggtcgagatactgtcattcctgtttcagctgtcctttagcacattgggtaaagactatagtgtggagggaatgagcgactcactcctgaattttctacaacacctcagagagtttggccttgtgttccagaggaagaggaagtccagacgctattacccaaccaggctggcgatcaatctgtctagtggggtctccggggcggggggcaccgtccatcagcccgggttcatcgtggttgaaaccaattaccgactgtacgcctatacagagagcgaattgcaaattgctctgatcgccctcttttccgagatgctttataggttccctaacatggtggttgcgcaggtaacacgcgaatctgtgcagcaggcaattgcatccggtatcactgcacaacagataattcatttcctccggactcgggctcatccagtgatgttaaaacagacacccgtcttgcctccaaccatcaccgaccagattagactgtgggagcttgagcgggaccggctccgcttcaccgaaggcgtactctataaccagttcctgagccaggtcgacttcgagcttcttttggcccatgcgagggagctcggtgttttagtgttcgagaactccgccaaaaggcttatggtggtaaccccagcaggccatagcgatgtgaagagattttggaaaagacaaaagcacagcagttag

SEQ ID NO: 189088 - DNA, 1389 bp, Artificial Sequence
  Description of Artificial Sequence: Synthetic coding sequence
atggagagcacccccagccggggcctgaaccgggtgcacctgcagtgtcggaacctgcaggaatttctcggcggcctgtcgcctggagtcttagaccggctttatggccatcctgccacctgtctggcggtgttcagagagcttcctagcctggcaaaaaattgggtgatgcgcatgctgttcttggagcagcccctcccacaggccgcagtggctctatgggtgaaaaaggagttctccaaagcacaggaggagagcaccgggttactcagcggactgcgaatctggcacacccaactgctgcccggagggctccaaggtctcatcttgaaccctatcttcaggcagaatctacggattgcactgctcggcggagggaaggcttggtctgacgatacctcgcagctcggacccgacaagcacgccagggacgtgccatccctggacaaatacgcggaagagcgatgggaagtggtcttgcattttatggtaggctcgccttccgcagccgtgtcacaggatcttgcacagctcctcagccaggccgggctcatgaagtctaccgagccaggagaacctccctgtatcacctccgccgggtttcagttcctgttgcttgacaccccagcccagctgtggtactttatgttacaatacctgcagacagctcagagccgcgggatggacctggttgagattctgagctttctgtttcagctttcgttttctacgctgggaaaagattatagcgtcgaggggatgtctgattctcttttaaattttctgcaacatttgcgtgagttcggattagtattccagcggaagcgtaagtcccgcagatattaccccacacgccttgccattaacctgagctccggggtaagtggtgctgggggcactgttcatcagccgggtttcatcgtggttgaaaccaactacaggttgtacgcttatactgagagcgagttacagatcgcactaattgccctcttctccgagatgctctaccgcttccccaatatggtggtcgcccaggtgactcgggaaagcgtgcagcaggcgattgcgtcagggattactgcgcaacagataattcacttcctcaggacaagggctcaccccgtgatgttgaagcagactccagtcctgcccccaacgatcaccgaccagatcagactgtgggaactggaaagagatcgtctgcggtttaccgaaggcgtcctctacaaccaattcttatcacaagtggactttgagctgctcctggctcatgcaagagagttaggtgtgctggtgtttgaaaatagcgccaagaggctgatggtggtgacccccgcgggacattctgatgtgaaacgcttctggaagcgccagaagcacagttcttag

SEQ ID NO: 189089 - DNA, 1389 bp, Artificial Sequence
  Description of Artificial Sequence: Synthetic coding sequence
atggagagcacccccagccggggcctgaaccgggtgcacctgcagtgtagaaacctacaagagttccttggcggcctgtcccccggagtcctggatcggctctacggacaccctgccacttgcctggccgtatttcgtgaacttccatctcttgcaaaaaactgggttatgagaatgctgttcttggagcagcccctcccacaagctgccgttgccctgtgggtgaaaaaagagttttccaaggctcaggaagagagcaccggtttgctgtccggactacgcatctggcacactcagcttttgcccggcggcctccagggcctgatactcaaccctatctttcgccagaacctgcgcatcgcattactggggggcggtaaagcatggtccgatgacactagtcagctgggccctgataagcacgccagggacgtgccatctctggataagtatgccgaggagaggtgggaagtcgtgctccacttcatggtgggttcgccctccgccgcggtttcacaggacctggcacagctgctgagccaggcgggactaatgaagagtacggagcctggagaacccccttgcatcacgagtgccggcttccagtttttgctattggatactccagctcaactctggtacttcatgctgcaatatctgcagacagcccagagtcgaggcatggatctcgtggaaattctctcctttcttttccagctcagtttcagcaccctggggaaagattattccgtcgagggcatgtcagatagcctgctcaatttcctccaacacctccgggagttcggtttagtgttccagagaaagaggaagtctaggagatactatcccacacgcctggccatcaacctatcatccggtgtctcaggggcaggaggaaccgtgcatcagcctgggttcatcgtcgttgagaccaattatagactctacgcctacaccgagtccgagttacagattgctctgattgccctcttctcagagatgctgtaccgtttccctaacatggtggttgcgcaggttacccgggagtccgtgcagcaggctattgcaagcgggatcaccgcccagcagatcattcacttccttcggacccgggcccaccccgtgatgcttaagcagacccctgtcctacctcctacgattacagaccagattagactctgggaattggagagggacagactgcggttcaccgagggagtgctttacaaccaatttctatcgcaggtcgactttgaattgctgcttgcccatgctagagagttaggtgtccttgtcttcgaaaattcagctaagaggctgatggtcgtgacgccagcgggacactcagacgtgaagagattctggaagagacaaaagcatagttcatag

SEQ ID NO: 189090 - DNA, 1389 bp, Artificial Sequence
  Description of Artificial Sequence: Synthetic coding sequence
atggagagcacccccagccggggcctgaaccgggtgcacctgcagtgccgaaacctgcaggaattcctgggaggactgagccccggcgtcctcgatcgcctatacggacatcctgctacctgcctggccgtgtttagagagctgccttccttggccaagaactgggtgatgcggatgctgtttctagagcagcctctgccacaggccgccgtggctctttgggtgaagaaagagttctctaaggcacaggaggagagtactgggctattatcaggcctgcgaatttggcatacgcaactgctgcccgggggactgcaagggctcatactgaaccccatcttcaggcagaaccttcggatcgcattgctgggaggcggtaaagcctggagtgacgacaccagtcaattaggtccggataagcatgcccgggatgtgccctccctggataaatacgctgaagaaagatgggaggtcgtgctgcatttcatggtagggtctcccagcgccgccgtgtctcaggatcttgcccagctgctgtcacaagcaggactcatgaagtcaaccgaaccaggcgagccaccgtgcatcactagtgctggctttcagtttcttctgttggacaccccagcacagctctggtatttcatgctgcagtacctacagacagctcagtcacggggtatggatctggtggagatcctttctttcctgttccagttgagcttctcaaccctgggtaaggactactccgtggagggtatgagcgactcacttctgaattttctgcaacatctgcgagaattcggacttgtttttcagagaaagcgtaaatctaggagatactatccaaccagactcgcaatcaacctttctagtggagtttctggcgccggaggcactgtccaccaaccaggcttcattgtggtggaaacgaattatagactgtatgcatacacagagtccgagctgcaaattgccctaatcgcactcttttccgaaatgttatatcggtttcctaatatggtagtggcacaggtaacaagggagagtgtgcagcaggctattgcatctggcattacagcgcaacaaatcatccactttctcaggactcgggcacaccctgttatgctgaaacagacaccagtactgcccccgacaattactgatcagattcggctgtgggaactcgagcgggaccggctgcggttcacagaaggggtgctgtacaatcagttcctctctcaggttgactttgagctgctcttggctcacgcacgagagttgggcgttctggtgtttgaaaacagtgccaagcgtctcatggtggtgacccccgccggccactcggatgtcaaaagattctggaagcggcagaaacattcaagctag

SEQ ID NO: 189091 - DNA, 417 bp, Artificial Sequence
  Description of Artificial Sequence: Synthetic coding sequence
atggagagcacccccagccggggcctgaaccgggtgcacctgcagtgccgtaatcttcaagagttccttgggggtctgtcacctggtgtccttgatagactctatggccatcctgctacttgcctggctgtgttccgagagctcccgtcgcttgccaaaaattgggtgatgcggatgctttttctggagcagccactcccacaagccgctgtggcattatgggttaaaaaggaattctctaaagctcaggaggaaagcactggactcctgtctggcctaaggatttggcacacccagctgcttcctggtgggctgcagggtttaatactcaaccctatctttcggcagaatcttagaatcgcactgttgggtgggacaggcatcacaggggtgtcccactgtgcctggcctggctag

SEQ ID NO: 189092 - DNA, 1389 bp, Artificial Sequence
  Description of Artificial Sequence: Synthetic coding sequence
atggagagcacccccagccggggcctgaaccgggtgcacctgcagtgtagaaaccttcaggaattcttaggaggcctctcacccggcgtgctggaccgcctctacggacatcccgctacttgcttggccgtcttcagagagctgccgagcctagctaaaaactgggttatgagaatgctattcttggagcagccactcccacaggccgctgtggcgctgtgggttaagaaggagttcagtaaggcgcaagaagagtctaccggtcttttgtcagggctgagaatatggcacacccagttgctgccagggggattacaaggactgatactcaatccaatttttaggcagaacctgagaatcgctctgcttgggggaggtaaagcctggagtgacgacacctcgcagctcggccctgataagcacgcccgtgacgtgccgagtctcgacaagtatgccgaagagcgctgggaagtagttctgcattttatggttggttcccccagcgcagccgtcagtcaggacctcgcacagctgctgagccaggccgggctgatgaagagtaccgaacccggagaacccccctgcatcacatccgctggcttccagttcctactgctggacactcctgcccagctctggtatttcatgctgcagtatcttcaaactgcacagtctagaggcatggacctggtcgagatcctgtctttcctctttcagctgagtttttccacattagggaaagattactctgtcgagggtatgagcgattccttgttgaactttcttcagcaccttagggaatttgggctcgtgtttcagcgcaagagaaaaagtcggcgatattatccgactagacttgccattaacctctcgtccggggtctccggcgcggggggcaccgtgcaccagccagggtttattgtcgtggaaactaattatcgcctgtatgcgtatacagaatctgagctgcagatcgcccttattgctttgttcagcgagatgctgtatcgcttcccaaacatggtggttgctcaggtgaccagggaatcggtgcagcaggcaatcgcaagtggtattacagcccaacagatcatccactttcttcgaaccagagcccatcccgtgatgctgaaacagacgcccgtccttcctcctaccattactgaccaaatccgactctgggagttggagcgcgaccggctcagatttacggagggagtactgtacaaccagtttttatctcaggtcgactttgaactgttactagcacatgcacgggaactgggcgttttggtttttgagaacagtgctaaacggctaatggtggtcactcccgccggacacagcgacgttaaaagattctggaaacggcagaagcacagctcttag

SEQ ID NO: 189093 - DNA, 417 bp, Artificial Sequence
  Description of Artificial Sequence: Synthetic coding sequence
atggagagcacccccagccggggcctgaaccgggtgcacctgcagtgtcgtaacctccaggagttcctcggcggtctatcacccggggttcttgacaggctgtatggacaccccgccacttgcctagccgtgttcagagagctaccttccctggctaaaaactgggtcatgcgtatgttatttctggagcaaccattgccacaggccgcagttgcactctgggtgaagaaagaattttccaaggcccaggaggagagcacaggtctcttgagcggcctacggatctggcatacccagctacttcctggcggtcttcaggggctgattttgaatcctatctttcgccaaaacctgagaatcgcacttctcggcggcacagggatcactggggttagtcactgcgcttggccaggctag

SEQ ID NO: 189094 - DNA, 1389 bp, Artificial Sequence
  Description of Artificial Sequence: Synthetic coding sequence
atggagagcacccccagccggggcctgaaccgggtgcacctgcagtgtcgaaacttgcaggagtttctgggtggcctgtcccctggggtcctggacagactctacgggcatcccgcaacatgtttggccgtgtttagagagcttccaagtctggccaaaaattgggtcatgagaatgctgttcttggagcaaccactgcctcaggcagccgtggcattgtgggtcaagaaagaattcagcaaggcccaggaagaatctactggtttactgtcaggcttacgcatatggcacactcagttattaccagggggcctacagggcctgatcctgaatccaatattcagacaaaatctgaggatcgcactgctcggtggagggaaggcttggtcagacgatacttctcaactcggaccagacaaacacgcaagagatgtcccctcactggacaagtatgctgaagagagatgggaggtggtcctgcatttcatggtgggatccccgagcgccgcggtgtcccaagatctggcgcagcttctgtcacaggctggactgatgaaatctactgagcctggcgaacctccttgcattacaagcgcggggttccaattcctgcttctggacacccccgcccagttatggtactttatgctgcaatatctccagacggctcagagtcgggggatggacctggtggagatactcagctttttgtttcagttgtctttttccactctcggtaaggattactcagtcgagggcatgtcagattcactgctcaattttttacaacaccttcgcgagttcggactggtctttcaaaggaagcggaaatccagaagatattatccaacaagactggccataaacctgtccagcggcgtttccggggctgggggcacagtgcaccagcccggcttcattgtcgtggagactaattaccggttgtatgcctatacagaatccgagttgcagattgctttgatcgcacttttcagcgaaatgttgtaccgctttcctaacatggtcgtggcgcaggtgactagagaatctgttcagcaggccatcgcttcaggcatcactgcccagcagatcatccacttcctgcggaccagagcccatcctgtcatgttgaagcagacaccagtgctcccacctacaatcaccgatcaaatcaggctgtgggaattagagagagacaggctcaggttcaccgaaggcgtgttatataaccagtttctgtcccaagtagactttgaactccttctcgcgcatgcgcgagaattaggcgtattggtgttcgagaattctgcaaagcggcttatggtggttacacctgctgggcacagcgacgtgaagagattctggaagcgacagaaacactcctcttag

SEQ ID NO: 189095 - DNA, 417 bp, Artificial Sequence
  Description of Artificial Sequence: Synthetic coding sequence
atggagagcacccccagccggggcctgaaccgggtgcacctgcagtgtcgcaacttgcaggaatttctgggaggcctatcgccaggcgtgctggatagactgtacgggcaccctgcaacatgtctcgccgtttttcgcgagcttcctagccttgctaagaactgggtcatgcggatgcttttcctagagcagccattgccccaggccgccgtcgcactgtgggtgaaaaaggagttctcaaaggcacaagaggaaagtactggcctactgagcggacttaggatttggcatactcagctgctgccgggcggcctacagggactaattctaaatcccatcttcaggcagaatctccgcatcgccctacttgggggcactggtataacaggggtgagccattgtgcttggcccggctag

SEQ ID NO: 189096 - DNA, 1389 bp, Artificial Sequence
  Description of Artificial Sequence: Synthetic coding sequence
atggagagcacccccagccggggcctgaaccgggtgcacctgcagtgccgtaacctgcaggagttcctgggcggcctatctcctggcgtcctggacaggttgtacggacacccagccacctgtctggcagtttttagagagcttcctagcctggccaagaactgggtgatgcgcatgctgttcctggagcaacctctaccccaggctgcagtagccctctgggtgaaaaaagaattctccaaagcccaagaggaatctaccggcctgctgtccggcctcaggatttggcacacgcagcttttaccggggggtctgcagggtttaatcttaaacccaatcttccgacagaatcttcgcatagccctgctcggcgggggaaaagcctggtctgacgataccagccagctgggtccggacaaacacgctcgggacgtgcctagcctcgataagtacgccgaggagcgttgggaagtggtgctgcactttatggttggcagcccgagtgcagctgtgtcacaggaccttgcccaactgctgtctcaggccggcctcatgaaatctacagaacctggcgagccaccttgtattacttcggcaggcttccagtttctgttgctggacacacctgctcaattatggtacttcatgctccagtacctgcagactgcacagtctcgcgggatggatctggtcgaaatcttgtcattcctgtttcagttgagctttagcacactggggaaggattacagtgtcgagggcatgtcagatagtctcctcaatttccttcagcaccttcgagagttcggcttggtcttccagcgcaagagaaagtcgcggaggtattacccgacccgtctcgcaattaaccttagctccggagtctcaggcgccggaggaactgtgcaccagccggggttcatcgtcgtagagactaattacaggctgtatgcatatactgaaagtgagttacaaatcgcattaattgctctgttctctgagatgctgtatcggtttccaaacatggtggtggcacaagtcacccgggagagtgtgcagcaggccatagcctccggtattacagcccagcaaatcatacacttcctgagaactagggcccacccagtcatgctcaagcaaactccagtgctcccacccacgatcactgatcagattagactttgggagctggaaagagatcggttgaggttcacagaaggcgtgctgtacaatcagtttcttagccaagtggatttcgaactcttgttggctcatgcccgggagctgggcgtcctggtcttcgaaaattccgctaaaaggctcatggtcgtgacacccgccggccattctgatgtcaagcggttttggaagaggcaaaagcactcctcatag

SEQ ID NO: 189097 - DNA, 1389 bp, Artificial Sequence
  Description of Artificial Sequence: Synthetic coding sequence
atggagagcacccccagccggggcctgaaccgggtgcacctgcagtgccgcaacctccaggagttcttagggggtttgtccccgggagttctggaccggctttatggtcatccagccacgtgtctggcagtgttccgcgagctaccatcactggcgaagaactgggtgatgagaatgcttttcctcgagcagcctcttccgcaagccgcagtggccctgtgggtgaaaaaggagttctcgaaggcacaagaagagtctacagggttgctttctggcctgcggatctggcacacccaacttttgcccgggggccttcagggcctgatcctgaatcctatcttcaggcagaacttgaggatcgctctcctggggggaggcaaagcctggtctgacgacacttcccagctagggccagataaacatgcaagagacgttcctagtcttgacaagtacgccgaggaaagatgggaggtggtgctccatttcatggtcggttcaccttcggccgctgtgagccaggatctcgctcagctgctaagccaggcgggcttgatgaagtctactgaacctggcgaacctccctgtattaccagcgccgggttccagttcctccttctggacacacccgctcagctgtggtatttcatgcttcagtacttacagacagcacagagccgaggcatggacttagtcgagattctcagcttcctgttccagctcagtttcagcacccttggaaaagactatagtgtggaggggatgtcagatagcctgctgaatttcttgcagcacttgagagaattcggcctagtgttccagcgcaagcgcaagtccaggcgttactaccccacccggctcgcaatcaatttgtctagcggagtctctggggcagggggcactgttcaccaaccgggcttcattgtagtggaaactaattacagactctatgcatacactgagtcagaactgcagattgctctaattgctcttttctctgagatgctgtatcggtttcctaatatggtcgtcgcacaggtgactagagagtctgtgcagcaggccatagctagcgggataacagcgcaacagatcatacatttcttgcgcacccgcgctcatcccgtcatgctgaagcagacccctgtgctccctcctaccatcaccgatcaaattaggctctgggagctcgagcgtgaccgactgcgctttacagaaggagtcctgtacaaccagttcttgtcacaggtggattttgaactcctgctggcgcacgcacgggagctgggggtactcgtctttgagaactcggccaagcggctgatggtggtgacccccgctggacacagtgatgtgaaacgcttttggaaacgacaaaagcattcgtcttag

SEQ ID NO: 189098 - DNA, 1389 bp, Artificial Sequence
  Description of Artificial Sequence: Synthetic coding sequence
atggagagcacccccagccggggcctgaaccgggtgcacctgcagtgtcggaatcttcaggagtttctcggtggactgtcgccgggcgtcctggatcgcttgtacggacatcctgctacctgtctagcggtgttccgggagctacccagtttggcaaagaactgggtaatgagaatgctattcctagagcagccactgccacaggccgctgtcgcactgtgggtaaaaaaggagttctccaaagctcaggaagaatctacaggactgctttccgggctgagaatttggcatacacaactgctcccaggagggctccaggggctcatcctgaatccgatttttcgccagaatctgaggatcgccctcctcggaggtggtaaggcctggtccgacgatacctctcagctcggacctgacaagcatgcacgggatgtgccttccctagacaaatacgccgaagaaaggtgggaggtagtgctacacttcatggtcgggtcaccttctgccgccgtgagccaggatctagcacagctgttaagccaagccggactgatgaagtcaacagagcctggcgaacccccctgcatcacaagcgccgggttccaatttttattactcgacacaccggcccagctctggtacttcatgctgcagtatctgcagaccgctcagtcacgcggcatggatctggtggaaattttgtcatttctcttccagttgagcttttcaaccctaggcaaggattattcagtcgaggggatgagcgatagcctgttaaactttctccagcatctgagggagttcggcctggtttttcagcgcaaacggaaatccaggaggtactaccctaccagacttgccatcaatttgagcagcggagtgagcggagctggaggtactgtgcaccagcccgggttcatcgtggtcgagacaaactaccgcttgtacgcttatacagaaagtgagctccagatcgctctgattgcgctgttttcagagatgctgtacaggttcccaaatatggtggtggctcaagtgactcgcgaaagtgtccagcaggctattgcctcaggtattactgctcagcagattattcactttctccggactcgggcccatcctgtgatgctcaaacagacaccagtgctgccaccaactatcacagatcagatccgcttgtgggaacttgagcgagatcgcctgcgatttacagaaggcgtgctctataaccagtttttgagccaggttgactttgagctcctgttggctcatgcaagagaacttggcgtgctggtgttcgaaaatagtgcaaagcggcttatggtcgtgaccccggctggacactctgatgtaaaacggttttggaagaggcagaagcacagctcatag

SEQ ID NO: 189099 - DNA, 1389 bp, Artificial Sequence
  Description of Artificial Sequence: Synthetic coding sequence
atggagagcacccccagccggggcctgaaccgggtgcacctgcagtgtagaaatctccaggaattccttggcggcctgagccccggtgtgctcgacagactgtatggccatcctgcaacatgcctggctgtgtttcgagaactgcccagtctagctaaaaactgggtgatgaggatgctgtttctggaacagccccttccgcaggcagctgtcgcgctttgggtcaagaaggaatttagtaaggctcaggaagaatctacaggactgctgtctgggctgcggatctggcatactcagctgctgccgggtggcctgcagggacttatcctgaatccaatctttcggcagaacttacgcatcgccttgctggggggtggcaaagcctggagcgacgacacttcccaattaggacccgataaacacgctcgagatgtgccctcacttgacaagtacgcggaggagcgttgggaggtagttctccacttcatggtcggctctcctagcgcagccgtgagccaggatcttgcgcagctgctgtcccaagcaggactgatgaaatcaaccgaacctggagaaccaccctgcatcacctccgccggcttccagttcctcctgctcgatacacctgctcagctttggtacttcatgctgcagtacctccagaccgcacagagccggggaatggatctagtggagatccttagttttcttttccagctgtccttctcaactttagggaaagattattcggtcgaggggatgtccgatagcttgttgaatttcctgcagcacctacgcgagttcggtttggtgtttcaacgaaagcggaaatcgcgccgctactacccaacccgcctggccattaatctgtcctctggtgtatccggcgctgggggaaccgtgcaccaaccaggctttatagtcgtggagacaaactaccgcctatacgcttatactgaatccgagcttcagatcgccctgatcgctctcttcagcgaaatgctataccgcttcccgaatatggtagtggctcaggtaacccgcgagagcgtgcagcaggccattgcaagcggaatcaccgcccagcagatcattcattttctgagaacgagagctcaccctgtgatgctgaaacagactcccgtgctccctccaactataaccgaccagattcgcctttgggagctggaacgggatcggctgagattcacagagggcgttctgtacaaccagttcttaagccaggtcgacttcgaactattactggcacatgcaagggagctcggggtgcttgtgttcgaaaattcagcaaaacggttgatggtggtgacccccgcaggacattctgacgtgaaacggttctggaagcgtcagaaacactcgtcttag

SEQ ID NO: 189100 - DNA, 417 bp, Artificial Sequence
  Description of Artificial Sequence: Synthetic coding sequence
atggagagcacccccagccggggcctgaaccgggtgcacctgcagtgccgtaatcttcaggaatttctgggaggtctgtccccaggtgtactcgatcgcctatatggtcatccggccacatgcctggctgtctttagggagttgcccagcttagcaaagaattgggtcatgaggatgctgtttctcgagcaaccactccctcaggctgcggtggctctctgggtgaagaaggagttttcaaaagctcaagaggagtcgacaggcctattgtcaggacttagaatttggcacacccagctgctccctggtggccttcagggcctgatcctgaacccgattttccgccagaacctcaggatcgcccttctaggcggaacaggcattaccggcgtctcacattgcgcatggccggggtag

SEQ ID NO: 189101 - DNA, 417 bp, Artificial Sequence
  Description of Artificial Sequence: Synthetic coding sequence
atggagagcacccccagccggggcctgaaccgggtgcacctgcagtgtcggaatctgcaggagttcctcggtggattgagtcccggcgttctggataggctctacggtcatcctgcgacctgcctggcagtttttcgggagttgcctagcctggccaaaaactgggttatgagaatgctgttcctggaacaacctttgccacaggcagcggttgcgctgtgggtgaagaaggagttctcaaaagcgcaagaagaatctaccggcctcttgtctggtctgaggatttggcacacacagctcttgcctgggggtctgcagggtctgatcttgaatccaatctttaggcagaaccttaggatagccctactgggaggcactggtattaccggggtcagccactgcgcctggccaggctag

SEQ ID NO: 189102 - DNA, 417 bp, Artificial Sequence
  Description of Artificial Sequence: Synthetic coding sequence
atggagagcacccccagccggggcctgaaccgggtgcacctgcagtgccgcaacttgcaagaatttcttggtggcctgtctcccggagtgctggatcgtctgtatggtcatcctgccacttgcctcgcagtatttcgcgagttaccatccctggccaagaactgggtgatgaggatgctcttcctcgagcagccactgccacaggccgccgttgcactgtgggtgaagaaagaattctccaaggcccaggaggaatccacgggactcttgtctggactccgcatctggcatactcagcttttacccggcggcctccagggacttattctaaatcccatcttccggcagaaccttaggatagcactccttggtggcacaggcattaccggtgtgtcccattgcgcctggccaggatag

SEQ ID NO: 189103 - DNA, 1389 bp, Artificial Sequence
  Description of Artificial Sequence: Synthetic coding sequence
atggagagcacccccagccggggcctgaaccgggtgcacctgcagtgtcgtaacctgcaggaattcttgggcggactcagtccaggtgtcctcgacaggctatacggccacccagctacttgcctcgcagtattccgggagctaccgagcctcgccaagaactgggtgatgcggatgctgttccttgaacagcccctgccccaagctgcagttgcattatgggtcaagaaagaatttagcaaggcgcaggaggaatctacggggcttctcagcgggctgcgcatttggcacacgcaattgcttccagggggtctgcagggcttaatcctaaaccctatcttcagacaaaatctccggatcgccctattaggtggcggcaaagcctggtccgatgacacaagccagctcggtccggataagcacgctcgggacgttccttccctggacaagtacgccgaggaacgatgggaggtcgtgctgcactttatggtcggtagtcccagcgcggctgtgagccaagatctcgctcagctcctgtcccaagccggcctgatgaagtccacagagccaggggagcctccttgtattacgtcagcaggatttcagtttctgctgctcgacacgcccgcccagctgtggtatttcatgttgcaatacctgcagacagcgcagtcgcgcggaatggatcttgtggagatcctctcttttttgttccagctgtcattttctaccctgggaaaggactatagtgtggagggaatgagcgacagcctcttaaatttcctccaacaccttagggagtttgggctggttttccagcggaagagaaaaagcaggcgttattaccccacgagactagcaatcaacctatcttccggtgtaagcggggccggtgggacggtacaccagcccggcttcatcgtcgtcgagaccaactacaggctatatgcatacactgagtcagaattacagattgcattaattgcactgttctcagagatgttatacaggttccccaatatggtggtcgcacaggtcaccagagagagcgtgcagcaagcgattgcctccggcattacagctcagcagatcatacacttcctgaggacacgagcacaccccgtgatgttgaagcagacccctgtgctgccccctactatcaccgaccagatcaggctgtgggaacttgagcgcgatcggctccgatttacagagggcgtcctttacaaccaatttctcagtcaggttgattttgaactgctcctcgcccacgctcgcgagcttggggtgctggtgtttgagaattccgccaagagactcatggtagtcacacccgccggacactctgacgttaaacggttctggaaacgacagaagcactcatcatag

SEQ ID NO: 189104 - DNA, 663 bp, Artificial Sequence
  Description of Artificial Sequence: Synthetic coding sequence
atgcggatgctgttcctggagcagcccctgccccaggccgccgtggcactttgggtgaagaaagagttctccaaggcccaagaggagagtaccggactgctaagtggtctgcgcatctggcatacacagctcctgcctggtgggttacagggcctcatactgaatccaatctttcgccagaacttgcggatcgccctgctcgggggcggaaaggcctggtcagatgatacaagtcaattgggacctgacaaacacgcgagggacgtgccgtccctggataaatacgcagaagagcggtgggaggtagtcctgcattttatggtcgggagcccatccgcagcagtgtcacaggacctcgcccaactcttaagccaggccggtttaatgaaatctaccgaacccggggagcctccatgcattaccagcgccgggtttcagtttctattattggatacccccgcacagctttggtactttatgctccagtatctgcaaaccgcacagagtcgcggaatggatttggtggagatcctcagttttctctttcagctaagcttttcgactctcggtaaggattactccgtggaggggatgtctgatagtttgctgaactttctccagcacctgagagagtttgggcttgtattccaaagaaaagtctag

SEQ ID NO: 189105 - DNA, 663 bp, Artificial Sequence
  Description of Artificial Sequence: Synthetic coding sequence
atgcggatgctgttcctggagcagcccctgccccaggccgccgtggcactgtgggtgaagaaggagttttctaaagcccaggaggagtccaccggcctgctgtccggtctaagaatatggcacacccagcttctgccgggaggactgcaggggcttatcttgaaccctatcttccggcagaaccttagaattgccttacttggaggtggcaaggcatggagcgatgacaccagtcagcttggtcctgacaagcatgcacgggatgtgcccagtttagacaaatacgctgaggagcggtgggaggtggttctccattttatggtgggaagcccatctgctgccgttagtcaggatctggcccagttgctctcacaggccggcctcatgaagagtaccgaacctggagagccaccctgcataacaagtgccggcttccagttccttttgttagatacgccagctcagctgtggtactttatgctacagtacctgcaaacagcacagagcaggggcatggacctcgttgagatcctttccttcttgttccagctcagcttttcaacactaggcaaagactactctgtggagggaatgtccgatagcctgctgaattttctgcaacacctaagggagttcgggctcgtgtttcagagaaaggtgtag

SEQ ID NO: 189106 - DNA, 663 bp, Artificial Sequence
  Description of Artificial Sequence: Synthetic coding sequence
atgcggatgctgttcctggagcagcccctgccccaggccgccgtggctttgtgggtgaaaaaggagttctctaaggcgcaggaagagagcactgggcttttgtcagggcttcggatctggcatacccagttgctgccaggtggacttcaggggttgatcttaaatccgatcttcagacagaatctgcgcattgccctgctcggaggcggcaaagcttggagcgacgatacatctcaactaggccctgacaagcacgcccgagacgtgccttcacttgacaagtacgccgaggaacgatgggaggtggtactacacttcatggtcggttctccgagtgctgctgtttcccaggacctcgcacaattgctttcgcaagctggccttatgaaaagcactgagccaggcgagcccccctgtatcacttcagccggctttcagtttcttctgctggatacaccagcacagctgtggtatttcatgctccagtatctgcagacggcacagtctaggggcatggatctggtagagatcctcagcttcctgttccagctgtccttctcgaccctggggaaagactactcagtagagggcatgagcgattccctgctgaactttctacagcacttgcgagagttcggtctagtcttccagcgcaaagtgtag

SEQ ID NO: 189107 - DNA, 663 bp, Artificial Sequence
  Description of Artificial Sequence: Synthetic coding sequence
atgcggatgctgttcctggagcagcccctgccccaggccgccgtggcactgtgggttaagaaggagttcagtaaggcacaagaggagtctaccgggttgttgagtgggctccggatttggcatacgcagctgctccctggtggcctgcaaggtctcattctgaaccctatttttcggcagaatcttagaatcgccctgttaggcggtggcaaggcatggtccgatgacactagtcagttgggtcccgataaacacgcgcgggacgttcccagcctcgacaaatacgcagaagaaagatgggaggtggtgctgcacttcatggttggtagccctagcgccgccgtgagccaggacctggctcagcttctctcccaggccggtctgatgaaatctacagagcctggggagcccccatgtattacatcagccggattccaattcctgctcctggacacgccagctcagctgtggtattttatgctccagtacctgcaaactgcccaatcacgcgggatggacctggtcgaaattttgagctttctgttccagctctctttttctacacttggcaaagactacagcgtggaaggcatgtctgacagtctgctaaattttctccaacatctgagagagttcgggcttgtgttccaacggaaggtctag

SEQ ID NO: 189108 - DNA, 663 bp, Artificial Sequence
  Description of Artificial Sequence: Synthetic coding sequence
atgcggatgctgttcctggagcagcccctgccccaggccgccgtggccctctgggtcaagaaggagttctcgaaggcgcaggaagagagcacagggctcctgtccgggctgcgcatttggcacacccagttactgccgggaggactgcaggggttgatcctgaatcctatctttaggcagaatcttcgcattgcactcctggggggaggcaaggcctggagtgatgacactagtcaactgggcccagataagcacgcccgagacgttccctcgcttgataaatatgctgaggaacgttgggaagttgtactgcacttcatggtcggatcaccatctgctgcagtttctcaagatttagcgcaattgctgtcccaagccggcctgatgaaatcaacagagcctggggaacctccctgtattacgtcagctgggtttcagtttttattattggatacccccgcccagctgtggtatttcatgctccagtatctgcaaaccgcccaatccagaggcatggaccttgttgagattttaagctttctgtttcaactgagcttctcgaccctgggaaaggattacagcgtcgagggaatgtccgatagcctgcttaacttcctccagcacttgagggaattcggacttgtgttccagaggaaggtgtag

SEQ ID NO: 189109 - DNA, 663 bp, Artificial Sequence
  Description of Artificial Sequence: Synthetic coding sequence
atgcggatgctgttcctggagcagcccctgccccaggccgccgtggctctttgggttaaaaaggagttcagcaaagcccaagaggaatccacaggtctgctttctgggctgaggatctggcacacacagctgttacctgggggtctgcaagggttaattttaaatcctatctttcgacagaatctgaggatcgccctgctgggagggggcaaggcctggtctgacgacaccagccaattaggacccgataagcacgctagagatgtccctagcctcgataaatacgctgaagaacgatgggaagtggtattacattttatggtggggagtccaagcgccgcagtaagccaagatcttgcccagctcttatcccaggccggcttgatgaagagtactgaaccgggagagcccccatgtataacaagcgcgggatttcagttcctccttctcgacacgcccgcacagttgtggtacttcatgttacagtacctgcaaactgcccagtcccgcggaatggacctggtggaaatattgtcatttctgtttcagctgagttttagtactctcggcaaggactacagcgtggaaggcatgtctgactctctgctcaactttttgcagcatctgcgggaatttgggttggtgtttcagagaaaagtgtag

SEQ ID NO: 189110 - DNA, 216 bp, Artificial Sequence
  Description of Artificial Sequence: Synthetic coding sequence
atggtgaacgtgctgaagggcgtgctgatcgagtgcgaccccgccatgaagcaattccttctttatttggacgagtctaacgccctgggcaaaaagtttatcattcaggatatagacgatacgcacgtgtttgtcatagctgaactggtgaacgtgctgcaagagcgcgttggcgaactgatggatcagaacgccttctccctcacacaaaagtag

SEQ ID NO: 189111 - DNA, 2997 bp, Artificial Sequence
  Description of Artificial Sequence: Synthetic coding sequence
atggcccaggtggccatgagcaccctgcccgtggaggacgaggagtcctccgagtcgaggatggttgtgacatttttgatgagcgctctggaaagtatgtgtaaggagctggccaagagtaaagcggaggttgcctgtattgccgtctacgagaccgacgtgttcgtcgtgggaactgagagagggagggccttcgtgaacacgcggaaggatttccaaaaggacttcgtgaagtactgtgtggaggaggaggagaaagcggcagagatgcataagatgaaatccacaacccaggccaatcgaatgagtgtggacgcagttgaaattgagaccctgcgaaagaccgtggaggactacttctgcttttgctatggaaaagccctgggcaagtcaacagtggtgccagtaccttacgagaagatgctgcgggaccaatctgccgttgtcgttcaggggctgcctgagggcgtagcctttaagcatcctgagaattacgatttggccactctgaagtggatcctcgagaataaggccggcatcagttttattattaagagacccttccttgagccgaagaaacacgtgggcggtcgcgtgatggttaccgatgccgaccgctcgatcctctccccagggggcagctgtggaccaatcaaagttaagacagaaccaaccgaagacagcggcatatcactcgagatggccgccgtgactgtgaaggaagagtccgaagacccagattactaccaatataatattcaggctgggccgtccgagaccgatgatgtcgacgagaaacagcccttgtctaagcctctgcagggttcacaccattcctcagagggaaacgaagggaccgagatggaggtccccgctgaagatagtacccagcacgtccccagtgaaacctccgaggatcccgaggttgaagttactattgaagatgacgattactcacctccttcaaagagacccaaggccaatgagcttccccagcccccagtacccgaacctgcaaacgcaggtaagcgcaaggtgagagaatttaacttcgagaaatggaacgcaagaattaccgacctgcggaagcaggttgaagagctgttcgaacggaaatatgctcaagcaataaaagccaagggtccagtaaccattccctaccccctgtttcagagccacgtggaggacctctacgttgaaggtctacctgaaggtattcccttccgaagacctagcacgtatggtattccgagactggaacggatactgctggccaaagagcggatccggttcgttatcaaaaagcatgagctgctgaactcaacccgtgaagacctgcagctcgacaagcccgccagcggcgttaaggaggagtggtatgcacggataacaaagcttcgtaaaatggttgatcaactgttttgtaagaagttcgctgaggccctggggtccacagaagctaaagccgtgccttaccagaagttcgaagctcatcccaatgacctgtatgtcgagggtcttccagagaatatcccatttagatcaccttcctggtatggaatcccccgtctcgagaagatcatccaagtgggcaaccggattaaatttgttatcaagagacccgaactcctcacccacagtactactgaagtcacacagccccgcaccaacacccccgtgaaggaggactggaacgtgcgaatcacaaaactgcgaaaacaggtcgaagaaatattcaaccttaaatttgcccaagctcttgggctcaccgaggcggtcaaggttccttacccagtctttgaaagtaatcccgaatttctgtatgtggagggtctcccggaaggaattccatttaggtcccctacatggttcggcataccgcggcttgaaagaattgtgagaggttcaaacaaaataaaatttgtggtgaagaagcccgagctcgtaataagctacctgccgccaggaatggcctctaaaattaataccaaagcacttcagagccccaagcggccgcgcagccccggctctaatagcaaagttcccgagatagaagtgaccgtagaggggcctaataacaataaccctcagacaagcgcagtgagaacccccacccaaacgaatggctcaaacgtcccgtttaagcctaggggcagagagttttctttcgaagcctggaatgcaaaaataaccgatctcaaacaaaaagttgaaaatctgttcaacgaaaaatgtggggaagctttaggcttaaagcaggccgtcaaagtaccgttcgctctcttcgagtccttccccgaagatttctatgtggagggactaccagaaggtgttccattcaggcgcccaagcacttttgggattcctaggctggagaagatactgcggaacaaagccaaaataaagtttatcattaaaaagcctgaaatgttcgagaccgcaatcaaagagtctacatcttccaaatctccgccccggaagattaactcctcgccaaacgttaacactacggcctccggcgtagaggacctgaacatcatacaggttacaatcccagacgatgacaacgagagactatcaaaggttgagaaggcccgccagctgcgggagcaggtgaacgatctgttttcccgaaagtttggagaagccatcgggatgggcttccccgttaaggtcccctacagaaagatcactatcaatccaggatgcgtggttgttgacgggatgcccccgggagtgtcattcaaggctccatcctatctagagatttccagcatgagacggatcctcgacagtgccgagttcataaagtttaccgttatccgccctttccctggattagtcattaataaccagctggtggaccagagcgagagcgaagggcccgtgatccaggagagcgcagaacctagccaattggaagtgcctgctactgaagagatcaaggagactgatggcagctcacagattaagcaggaacctgaccccacctggtag

SEQ ID NO: 189112 - DNA, 2934 bp, Artificial Sequence
  Description of Artificial Sequence: Synthetic coding sequence
atggcccaggtggccatgagcaccctgcccgtggaggacgaggagagctcggaatctagaatggtggtgacgttcctgatgtccgccttggagtcaatgtgcaaggagctcgccaagagtaaggccgaggtggcctgcattgctgtgtacgagaccgacgtgttcgttgtgggcacagagcgaggacgagccttcgtgaacacacgcaaggacttccagaaagacttcgtgaaatactgcgttgaggaggaagaaaaggctgctgagatgcataaaatgaagagcacaactcaggccaatcggatgagtgtggatgccgtggagattgaaaccctgcggaagacggtggaggattatttctgtttttgctatggaaaggcactgggcaaaagcactgttgtcccagtgccttatgaaaaaatgttgcgcgaccagtctgccgtggtggtccaggggctgccagagggagttgcgtttaagcaccctgagaactatgatttggcaaccctgaagtggatcttggagaataaggccggtatctcatttatcatcaagcgcccattcctcgaacccaaaaagcacgtgggcggccgggtgatggtcacagatgccgaccgatcaatcctttccccaggcggctcttgtggtccgatcaaggtgaagactgagcctaccgaagactctggcatcagcctggagatggcagccgtcaccgtgaaggaagaatcagaggatcccgactactatcaatacaacattcaggcgggcccttccgaaaccgatgatgtggacgaaaagcagccactctcaaagcccctccaggggtctcatcactcgagtgagggtaacgaggggacagaaatggaggttcctgccgaggacgatgactatagcccacccagcaagcgcccaaaggctaatgagctgcctcagccgcccgtgccagaacctgcaaatgccggaaaaaggaaggtgagagaattcaattttgaaaagtggaacgccagaataacggacctccgaaagcaggtcgaggagcttttcgaaagaaaatacgcccaggccatcaaagcaaaggggcccgtgacaatcccttatccgctcttccagtcacatgtggaggacctatatgtggagggactgccagaagggataccatttcggagaccttctacctatgggataccccgattggaacgaatactcctcgccaaggagcgcatcaggttcgtaataaagaaacatgagttgttgaactccacaagagaggatctacagctggacaagcccgcttcgggagtcaaagaggagtggtatgccagaatcacaaaactccgtaagatggtggaccagctgttctgtaagaagttcgctgaggccttgggatccactgaagccaaggctgtaccatatcagaagtttgaggcgcaccctaacgacctgtacgtggaggggctcccagagaacataccatttagaagcccctcctggtatggaattcccagactcgagaagatcatccaggtcgggaataggattaaattcgtcattaagcggcctgaactgcttacacatagtaccacggaggtgacacaaccgaggacaaacaccccggtcaaggaggactggaacgtgagaattaccaaactgagaaagcaggtcgaagagatctttaacctcaagttcgcgcaggctctcgggctgaccgaggcagtgaaagtgccctacccagttttcgaatcaaatcctgagtttctgtacgtcgagggcctccctgagggcattccgtttcgcagtcctacctggttcggcatacctcgtcttgaacggattgtgcgtggcagtaataaaatcaaattcgtcgtgaaaaaaccagagttggtcatttcgtatctgcctcctggcatggcgtcaaagatcaacactaaggccttacagagtccaaagcgtcctcgaagccccggctccaattctaaagtccctgagatcgaggttactgtggaggggcctaacaacaataacccccagacgagcgccgtcaggacgccgactcagaccaatgggtctaatgtgccatttaagccaagaggccgtgagttttccttcgaagcctggaacgcgaagatcacagatctaaaacaaaaggtggagaatttgtttaatgagaaatgcggagaggccttgggtttgaaacaggctgtaaaagtcccttttgccctcttcgagtccttcccagaagacttttacgtggaaggtcttcccgagggggtgccgtttcgtcgaccctctactttcgggatacctagactggagaagatactccggaataaagccaaaatcaaatttatcatcaagaagcctgagatgttcgagacagccattaaggagtcgacaagctcaaagtcgcctccacgtaaaattaacagcagccctaacgtgaacaccactgcttcaggcgttgaagacctgaacatcattcaagtgaccatcccagacgatgacaatgagaggctgtctaaagtggaaaaagcccggcaactgcgggaacaggttaacgacttgttctcaaggaagttcggggaagccattgggatgggcttcccagtgaaggttccttataggaaaattacgatcaatcctggctgtgtggtggttgatggtatgccacccggggtttccttcaaggctccttcttacctcgagatcagttctatgcgaaggattttggattcagccgagtttatcaagtttacagttattaggccattcccagggctcgtgattaacaaccagctggtggaccagagcgaatccgaaggtccagtcatccaggagtccgctgagcccagccaactcgaggtccctgctacggaggagatcaaggaaaccgatgggagcagccagattaagcaggaacccgatcccacttggtag

SEQ ID NO: 189113 - DNA, 2937 bp, Artificial Sequence
  Description of Artificial Sequence: Synthetic coding sequence
atggcccaggtggccatgagcaccctgcccgtggaggacgaggagagctctgaaagccgtatggtggtcactttcttaatgtctgcccttgaatccatgtgcaaggaacttgccaaatcaaaggcagaggtggcatgcatagccgtgtatgagacagatgtctttgttgtcggcacagagaggggcagagcattcgtgaacaccaggaaggactttcagaaagatttcgttaaatactgtgtggaggaagaagagaaagccgccgagatgcataagatgaaatcgacgactcaagccaatcgtatgagcgtggatgctgtggagattgagacactgagaaagaccgtcgaggactacttctgtttctgttacgggaaggcattaggcaagagcactgtggtgcctgtgccttatgagaagatgcttagggaccagagtgctgtggtagttcagggcttgccagaaggagtggcttttaaacatcccgaaaattatgatcttgcaacactcaaatggatcttggaaaataaagcgggcatctcttttatcatcaagcgcccctttctcgaacctaagaagcatgttggtggccgggtgatggtgaccgatgcagataggtcaattctgagcccaggcgggtcatgtggaccaattaaggtgaagactgaacccacggaggattctggtatatccctcgaaatggccgctgtgaccgtgaaagaagagagcgaagatccggattactatcagtataatatccagggttcacaccactcctccgaaggtaatgaaggcacagagatggaagtccccgccgaggatagcactcaacacgtcccttccgagacatccgaagatcccgaggtggaagtcacaatagaggatgatgattactcaccaccatctaagcggccaaaagccaacgagctgccacaaccacctgtgccagaacctgccaacgccgggaagcggaaggtgcgcgagtttaactttgaaaagtggaatgcccgtataacagatctgcgcaagcaagtagaggagttgttcgagcgcaaatacgctcaggccattaaagctaagggccctgtaactattccctatcccctgttccagtcacatgtcgaggatctgtacgtcgaaggcttgcccgagggaataccattccggaggccatccacttatggcattccccgacttgagcgcattctgctggctaaagaacggataaggtttgttatcaaaaagcatgaactgcttaatagcacgcgtgaggatttgcagttggataaacctgcctcaggggtcaaggaggagtggtatgcgaggataaccaaactccggaagatggtggaccagctcttctgcaaaaagttcgcggaggctcttgggagtaccgaggccaaagctgtcccgtaccagaaattcgaggcgcatcctaatgatctgtatgtcgagggtttacctgaaaacatcccctttcgttcaccttcttggtatgggattcccaggttggaaaagataattcaggttggcaataggatcaagttcgtgattaagagaccagaattactgacccattctacaacagaagtcacccaaccgcggacaaacacacctgtaaaagaggactggaatgttaggatcactaaattgaggaagcaggttgaagagatctttaacctcaaatttgcccaggccctggggcttaccgaagccgtcaaggttccatatcccgtcttcgaatctaacccggagtttttgtatgttgaaggacttccagaaggtatcccattccgctctcccacttggttcggaatacctagactagagcggattgttcggggcagcaataagataaagtttgttgtgaagaagccagaactggtgatctcatacctaccaccaggcatggcttcgaagatcaataccaaggccctgcagtctccaaagcgccctcgctcccccgggtctaattctaaggtgcccgaaatcgaagtgaccgtggaggggccaaataataataacccacagactagcgcagttaggaccccaactcaaactaacggctctaacgttccattcaaacctcgcgggagagaatttagcttcgaggcctggaacgctaaaattactgacctcaagcagaaggtggaaaacctcttcaatgagaaatgcggggaagcccttggactaaagcaggcagtgaaagttcccttcgcactctttgaatcattccctgaagatttttatgtagagggcttacccgagggcgtgccatttcgcaggcccagtacttttggcatccctcggttagagaagatattaaggaataaggccaagataaagtttattattaagaaacccgaaatgtttgaaaccgcaatcaaagagtcgacatctagcaaaagccccccccgaaagatcaacagtagccctaatgtaaataccacggcctccggggttgaagatctcaatatcatccaggtcaccatccctgatgatgataatgaaagactgagtaaggtggaaaaggcacggcagctgcgggagcaggtcaatgatctcttctcacgcaaattcggggaagcaatcgggatgggttttcccgtgaaagtcccgtatcgtaaaatcaccattaatcccggttgtgtcgtggtcgatggtatgcctccaggcgtttcattcaaagccccttcttacctcgaaatcagcagcatgcggcgcatactggattccgcggagttcatcaagtttactgtaatccgaccattcccgggattggtgatcaataaccagttggtcgatcagagcgaatccgagggcccagttattcaagaaagtgctgagccttcccaactggaggtgccagctacggaggaaatcaaagagacggatggcagctcccagatcaagcaggagccagatcccacgtggtag

SEQ ID NO: 189114 - DNA, 2874 bp, Artificial Sequence
  Description of Artificial Sequence: Synthetic coding sequence
atggcccaggtggccatgagcaccctgcccgtggaggacgaggagagctccgagagccggatggtggtgacttttctgatgtccgccctcgaatccatgtgcaaagagctagcaaagagcaaggccgaggtggcctgtatagctgtgtatgaaaccgacgtgttcgttgtggggactgagcgcgggcgagcttttgtcaacacccgtaaagatttccagaaagatttcgttaaatactgtgtggaggaagaagaaaaggctgccgagatgcacaagatgaagagtacaactcaggccaatagaatgagcgtagatgccgtagagattgagaccctgcgcaaaaccgtagaggattacttttgtttttgctacggaaaggccctcggcaaatcaacagtcgtgcccgtgccatatgagaaaatgctgcgggatcagtcagccgtggtagtgcagggccttcccgagggcgtagcgtttaaacatcctgagaattacgaccttgctaccctgaagtggattctggagaataaagccggtatctccttcatcattaagcgtcccttcttggagcccaaaaaacacgttgggggaagggttatggtgacggacgccgaccggtctatactgagtccggggggcagttgcggacctataaaggtgaagactgagccaactgaagattccgggatctctctcgagatggcagcagtgacagtgaaagaggagtcagaagaccccgactattaccagtataacattcaagggtcacatcactcttctgagggtaacgagggaactgagatggaagtacctgccgaggacgatgactactccccaccttccaagcgccctaaagccaatgagctgccacagccccctgtccctgagccagctaacgcgggtaagagaaaagtacgagaatttaactttgaaaagtggaacgcacgtattacagacttgcgcaaacaagtggaagagttgtttgaaagaaagtatgcacaggccataaaagctaaaggccccgtgaccatcccctatcctctgttccaatctcatgttgaagacttgtacgtggaaggcctgcccgagggcatcccatttagacgtccatccacttatggcatccctcgactcgaacgtatcctgctcgctaaggaaagaatacgcttcgtcatcaaaaagcacgaactgctgaactcgacccgggaagatcttcagctggacaagcctgcgagtggcgtcaaagaagagtggtacgcgagaataaccaaactgcggaagatggtagaccaacttttttgtaagaagttcgctgaggctctcggaagcacagaggctaaggccgtgccctaccagaaattcgaggctcaccctaacgacctctatgttgagggcctccctgagaatattcccttcagatccccttcttggtacggcatcccaagattagagaaaataatacaggtgggcaatcgtattaagttcgtcatcaagcgcccggagctccttacccactcgacaacggaggtcacccagccacgtacgaatactcccgtgaaagaggattggaacgtcaggatcaccaagctccggaagcaggtggaggaaattttcaatctgaagtttgcccaggctctggggctaacagaggccgtcaaagtgccctaccccgtattcgaaagtaatcctgaattcctgtacgtggagggcctgcctgagggaatccccttcaggtcgccgacttggtttggcattccacgactcgaaaggattgtgagaggaagtaataaaattaaattcgtcgttaaaaagcccgaactcgtaatctcttacttgcccccaggtatggcctctaagatcaatacaaaagccctgcagagtccaaaaagacctcgatccccaggttctaacagtaaagtgcccgagatcgaggtcacggtagagggaccgaacaataataaccctcagacctccgcagtgaggacacctacccagaccaatggctctaatgtaccttttaagcccaggggacgtgagtttagtttcgaagcttggaatgcaaaaatcaccgatctaaaacagaaagttgagaacctgttcaatgaaaagtgtggtgaggcactgggcctgaagcaggccgtcaaggttccttttgcattgttcgagtcttttcccgaggatttctatgtagaaggcttgccagagggagtcccctttaggcgtccttcaacatttgggattccgaggctggaaaagatccttcgaaataaggcaaaaatcaaattcattattaagaagccagaaatgttcgagactgcaatcaaggaaagcacaagcagcaaatcacctccccgaaagatcaattccagtcccaacgtgaatactacagcatcgggggtagaggatctgaatatcattcaagtgacaattccagacgatgacaacgagcgccttagcaaggttgaaaaggcccgacagctgagagaacaggtgaatgatctgttctctcgcaaatttggtgaagccatcggtatggggttccctgtcaaagtaccatataggaagatcacaatcaaccctggatgcgtggtggtggacggaatgccccctggggtgtcatttaaggccccctcctacctcgagatttcctcaatgagacgcattctggacagtgctgagttcattaagttcaccgtgattcggccatttcccggtctagtgatcaacaatcaactggtggaccagtcagaatctgaagggcctgttatccaggaatccgccgaaccctctcagctcgaggtccccgcaaccgaggagatcaaagagactgacggatcatcccagatcaagcaggagcccgacccaacatggtag

SEQ ID NO: 189115 - DNA, 321 bp, Artificial Sequence
  Description of Artificial Sequence: Synthetic coding sequence
atggcccaggtggccatgagcaccctgcccgtggaggacgaggagtcatcggagtcacggatggtcgtgactttcctgatgtctgccctcgagtctatgtgcaaggagttggcgaagtcaaaagcggaggtcgcttgcatcgctgtctacgagaccgacgtgtttgtcgtggggacagagagaggcagagcatttgtgaacacaaggaaggacttccagaaggactttgtgaagtattgcgtggaggaagaagaaaaggcggccgaaatgcataaaatgaaatctaccacccaggccaaccgtatgagcgttgatgcatag

SEQ ID NO: 189116 - DNA, 825 bp, Artificial Sequence
  Description of Artificial Sequence: Synthetic coding sequence
atggcccaggtggccatgagcaccctgcccgtggaggacgaggagagcagtgagagccggatggtggtgaccttcctcatgagtgctctcgagtctatgtgcaaggaattagcaaagtctaaggccgaagtcgcatgtatcgcagtgtatgagactgatgtctttgtggttggcactgagcggggcagggcttttgtgaacacccgcaaggattttcagaaagactttgtgaaatactgtgtggaggaagaagaaaaggcggctgagatgcacaagatgaagtcaaccacccaagctaacagaatgtccgtagacgctgtggaaatagagaccttaaggaaaacagtggaggactacttttgcttttgttacggcaaggccctcgggaagtccacagttgtccccgtgccttatgagaagatgctccgcgaccagtcagcagtggtcgtacaaggtctaccggagggggtggcttttaaacacccggagaactacgatctggctactctcaagtggatccttgaaaataaagctggtatcagcttcatcattaagaggccttttctcgaaccgaagaagcacgtgggaggaagggtgatggtcaccgatgcagacaggtccatcctatcaccaggaggctcttgcggccccatcaaggtgaagactgaacccaccgaagacagtggtatatccttggaaatggccgccgtcacagtcaaagaggagtccgaggatcccgattattaccagtacaatattcagggttcgcaccatagctccgagggcaacgaggggacagagatggaagtgccagccgagggatag

SEQ ID NO: 189117 - DNA, 2982 bp, Artificial Sequence
  Description of Artificial Sequence: Synthetic coding sequence
atgagcaccctgcccgtggaggacgaggagagcagcgagagccggatggtggtgactttcttgatgagcgcgctggaatccatgtgcaaggagttagctaagagcaaggctgaggtggcttgcatagctgtctatgaaactgatgtgtttgtcgtcggaacagaaagggggagagctttcgtgaatacgcgaaaggacttccagaaagattttgttaagtactgcgttgaggaggaggaaaaggctgccgagatgcataagatgaagtcaactacgcaggccaaccggatgtccgtggacgcagtggagattgagacccttaggaagacggtggaggattacttctgcttttgctatggcaaagcccttggtaagtctaccgtagttccagtcccgtatgagaaaatgctgagggaccaatccgcggtggtggttcaggggctccctgagggggtggcgttcaagcacccagagaattatgacctcgctaccttgaagtggatcctcgagaataaggcaggaatatcattcatcatcaagagacccttcctggaacctaagaaacatgtaggagggcgcgtgatggtgaccgatgcggaccggtctattctatccccaggaggctcctgtggcccgatcaaagtcaagacggaacctaccgaagattccggcatcagcctggagatggccgctgtgaccgtgaaggaagaatccgaggaccccgattattaccagtataatatacaagctggaccctctgagaccgatgatgtcgacgagaagcagccactcagtaaacctctccagggatcccatcatagctctgaaggaaacgagggtacagaaatggaagttccagccgaagattcaactcaacacgttccatctgagacaagcgaagaccctgaagtcgaggtcacaattgaggacgatgactactccccgccttccaagcgtcctaaagcaaatgagctgccccaaccccctgtgccagagccagcaaacgctggcaaacgaaaggtgagagagttcaattttgaaaaatggaacgccagaatcacagatctcagaaaacaggtggaggagctgtttgagcggaagtacgcacaggcaataaaggccaaaggccccgtcactataccctatcctctattccaaagtcacgtggaggacttgtatgtggagggacttcccgaaggaatcccattccgaagacccagcacttatgggattccaagactcgaaagaattctcctcgccaaggagaggattcgtttcgtgattaagaagcatgaactcctcaactctacccgggaggatttacagttggataagccagcctcaggagtcaaggaggaatggtatgcgcgcattacgaaactcaggaagatggtggaccaactgttttgcaagaagttcgccgaggcccttggttctaccgaagctaaggctgttccgtaccagaagtttgaggcccacccaaacgatttgtacgttgaagggttgccagagaacattcccttcaggagccccagttggtacgggattcctcgattggagaagattatccaggtgggtaatagaatcaaattcgtcatcaaacgtcctgagttgcttactcactctactacagaggtcacacaaccgcgtacgaatacgcccgtcaaagaagattggaatgtcagaataaccaagcttcgcaaacaggtggaagaaatcttcaatctgaaatttgcccaggctttgggtctgacagaggccgtgaaggtgccctaccctgtgtttgagtcaaacccggaatttttatatgtcgaaggcttgcctgaaggaattccttttaggagcccaacgtggttcggcatcccccgcctggagagaatcgtacgtggaagcaacaagattaagttcgtcgtcaagaaacccgaactggtcatcagttatttgcctcccgggatggcctccaaaatcaacacaaaggccctgcaaagcccaaaacggccccgcagtcccgggtccaacagtaaagtgcccgaaatcgaggtgacggtggaggggccaaataataacaacccccaaacgagcgcagtgaggaccccaacgcaaactaacggcagtaacgtgccatttaaaccaagagggcgcgagtttagcttcgaagcttggaacgcgaagataacggaccttaagcagaaggtggagaacctgttcaatgagaagtgtggggaggccttagggctgaagcaagccgtgaaggtgccttttgcactttttgaatcgtttccagaagatttttatgtggagggattgccagaaggagtccctttcaggagacctagtacgtttggtatccctagactcgagaagattctgagaaataaggccaagatcaaatttattataaaaaagcccgaaatgtttgagactgctattaaggagtccacttcttctaagagtccccctaggaagattaacagtagccccaatgttaatacaacagcctcaggggttgaggatctcaacattatccaggtgacgattcccgacgacgacaacgagagattgagcaaggtcgagaaggccaggcagttaagagaacaagtgaacgacctgttttcccggaaattcggggaggctatagggatgggtttcccggtcaaagtgccctacagaaaaatcactattaatccaggatgtgtcgtggtggacggaatgccgcccggggtatcctttaaagcaccgagttacttggagatctcgagcatgagacgaatcttggacagtgctgaattcatcaagttcactgtcataagaccttttccagggctggtgatcaacaatcagcttgtggatcaatcagagagcgaaggtccagtgatccaggaatctgctgaaccaagccaactcgaggttcctgcaaccgaagagatcaaagagacagatgggtcctcccagattaagcaggagccagatccaacctggtag

SEQ ID NO: 189118 - DNA, 642 bp, Artificial Sequence
  Description of Artificial Sequence: Synthetic coding sequence
atggccgccgccgccgacgagcggagccccgaggacggcgaggacgaggaggaagaggagcagttggtcctcgtggagctctctggcatcatcgacagcgactttctcagcaaatgtgaaaataaatgtaaggtgctgggaattgataccgagaggcctattcttcaggttgacagttgcgtttttgccggcgagtacgaagatacgctgggcacctgtgtgatcttcgaagaaaatgtggagcacgctgacacagaggggaataataagacggttctgaaatacaagtgccacactatgaaaaaactttccatgactagaacactgctcaccgaaaaaaaggagggggaagagaacataggcggagtagaatggcttcagataaaagacaacgatttttcttaccgtcccaacatgatttgcaatttcctacacgagaatgaagacgaggaggtggttgcctctgctcccgacaagagcctggaactcgaagaggaagaaatccaaatgaatgactcaagtaatctttcctgtgaacaggagaagcccatgcatttagagattgaggatagcggccccctgattgatatacccagtgagacagagggcagtgtttttatggaaacacagatgctcccatag

SEQ ID NO: 189119 - DNA, 2118 bp, Artificial Sequence
  Description of Artificial Sequence: Synthetic coding sequence
atggccaccgagggcatgatcctgaccaaccacgaccaccagatccgcgtcggggttttgaccgtcagcgacagctgcttccgtaatttagctgaggataggagcggaattaatctgaaggacttagtgcaggatcccagtctgcttgggggaactatctccgcctataaaattgtgcccgatgagattgaggagataaaagcaactaaggaggtcatcgagcgcgaggcacctggcatggcgctggccatgctgatggggtcactaaatgttacacccctcggcatgttgagccgccccgtgtgcgggattcgcgggaaaactctcatcatcaacctacccggctccaagaaaggatcgcaggagtgtttccagtttatccttcctgctttaccacatgctattgacttgctgcgggacgcaattgtgaaagtgaaagaagtgcacgacgaattggaggatctacctagtccccctcccccactaagccctcctccgactacatcaccccataagcagactgaagataagggggtgcaatgtgaagaggaggaagaggaaaagaaagactccggagtggccagtactgaggactccagctccagtcacatcacagctgctgccatcgccgcaaagattcctgatagcattatcagtcggggtgtgcaggtactccctcgagacacagcaagtctcagcaccacaccatctgaaagccctcgcgcgcaagccacttcaaggctgtctaccgcttcgtgtcctacaccaaaggtgcaaagcagatgcagttccaaagaaaacatactccgggcgagccactcagcagtcgacatcacaaaggtggcccgcaggcatcgcatgagccccttcccactgacgtccatggacaaggccttcataaccgtgctggagatgactcccgtactgggtactgagataatcaattatcgcgatggtatgggcagagtcctggcacaggatgtctatgctaaggataaccttcctccatttccagcgtctgttaaagacgggtacgctgtcagagccgccgacgggcctggggatagatttataattggggagtcacaggcgggcgagcagcccacacagaccgtgatgccaggccaggtgatgagagtcacaaccggtgcccccatcccatgcggggccgacgctgtggttcaagtggaggacactgaactgatccgcgaatccgatgacggtactgaagaactcgaggtgcggatcctggtccaggcacgacctgggcaggatatcagaccaatcggtcacgacatcaaacgtggtgagtgcgtcctcgcaaaaggcacccatatgggcccaagtgaaataggcctcctggccacggttggcgtaacagaagttgaggtcaacaaattccctgtcgtggcagtgatgagcacaggtaatgagcttctgaaccccgaagatgatctcctgcccggaaaaattcgggactccaaccggtctacactgctggcaaccatccaggaacacggctacccaacaatcaatttggggatcgtaggcgataatccggacgatctcctgaacgccctgaacgaggggatctcaagagccgatgtgattataacttccggcggtgtctctatgggagaaaaagactacctcaaacaggtcctggacattgacctgcatgcccagatccattttgggagggtgtttatgaaaccaggcctgccaaccacattcgctaccctcgacattgatggtgtaagaaaaatcatctttgccttgccaggtaaccccgtgtctgctgtcgtgacatgtaacttgttcgtagtgcctgctctgcgaaagatgcagggcatcctggatccaaggcccactatcattaaggctcgtctatcctgcgacgtcaaactggacccgcgcccagagtatcacaggtgcatcctcacttggcaccaccaggaaccattgccctgggcccagtctacaggaaatcagatgagcagcaggctgatgtccatgcgcagtgctaacgggctgctgatgctcccacccaagaccgagcagtatgtagagctccacaagggtgaggtggtggacgttatggtgattggtaggctctag

SEQ ID NO: 189120 - DNA, 2211 bp, Artificial Sequence
  Description of Artificial Sequence: Synthetic coding sequence
atggccaccgagggcatgatcctgaccaaccacgaccaccagatccgggtgggcgtgctgacggtgagcgacagctgttttaggaatttagcggaagacaggtctggaattaatctgaaagacctggtgcaggacccaagtctcttgggcggtaccatctctgcgtataagatagtccccgatgagatagaggagatcaaggagacactgattgactggtgtgatgaaaaagagcttaatctcatcctgaccacaggtggtacaggcttcgcgccccgtgacgtgacaccagaggccacaaaggaggtcatagagagagaggccccaggtatggccttagccatgttaatgggatccctaaacgttacaccccttggtatgctgtctaggcccgtctgtggcattcgcggtaagacgctgattataaacctacctgggagcaagaagggatcacaggagtgtttccagttcatcttacctgccctcccccatgcaatcgatctgctacgcgatgctatcgtgaaagtgaaagaggtgcacgacgaactagaggatttgccaagcccgcctcccccactgtcccctccgcctacaacaagcccccacaagcagaccgaagataaaggggttcaatgtgaagaggaggaggaggagaagaaggactctggtgtggcctcaaccgaggactcctcgagttcccacatcaccgccgccgctattgctgcgaaaatccccgacagcattattagtcgcggcgtgcaggtgctaccacgtgatacagcctctctcagtaccactccctccgaatctcccagagcacaggccacctctagacttagcacagctagctgccctacacctaaggttcagagccggtgctcgtcaaaagagaatattctgagggcgtcccatagcgccgtggacattaccaaagtggcccgccgacaccgtatgtcaccatttccccttacctctatggataaggccttcataacagttctggagatgactccggtgctaggtacagaaatcatcaactacagggatggcatgggcagggtgctggcacaggacgtgtacgcaaaggacaacctcccaccatttcccgcaagtgtcaaagacggttacgctgtccgtgcggccgacggaccgggtgacaggtttattattggggagagtcaagccggagagcagcctactcagaccgtgatgcctggacaggtaatgagggtcacaaccggcgcacctataccatgtggtgccgatgccgtcgtccaagtggaggataccgagttgatccgagagtccgatgatgggaccgaagaactcgaagtccggattctggttcaggcccggccagggcaggatatccggcctatcgggcatgatatcaagcgaggcgaatgtgtactggcaaagggaacacacatgggtcctagcgaaatcggcctcttagcgactgtcggggttacagaggtcgaggtgaataaattccccgtcgtggcagtcatgtccactggaaatgaactgctcaaccccgaggacgacctgctgcccggaaagatcagggatagcaaccggagtaccctgctggctaccattcaggagcatggataccctacgataaatctgggaatagtgggggacaaccctgatgacctgttgaatgcccttaatgaaggaatcagtcgtgccgacgtcattattactagtggcggtgtctcaatgggagaaaaggactatttaaaacaggttctggacatcgaccttcatgcccagatacacttcgggcgagtattcatgaagccaggccttcccactacatttgctacactggacatcgatggcgtgcgcaagattatctttgctctacctgggaatccagtctcagctgtagtaacatgcaacctgtttgtcgtaccagctttgcgaaaaatgcaaggcatacttgatcctcggcctactatcatcaaggcacgtctgtcttgcgacgttaagctcgatcctaggccagagtaccaccgttgcattcttacctggcatcatcaggagcccctgccctgggcccagagtacaggaaatcagatgtcttctcggctgatgtctatgcgctctgctaatggcctcttaatgctgccccccaagaccgagcagtatgtggagcttcataagggtgaggtagtggatgtgatggtcatcggcagactgtag

SEQ ID NO: 189121 - DNA, 2310 bp, Artificial Sequence
  Description of Artificial Sequence: Synthetic coding sequence
atggccaccgagggcatgatcctgaccaaccacgaccaccagatccgcgtcggagttttaacggtgagcgatagctgcttcagaaatcttgcggaagatcgttcagggataaacttgaaagatttagttcaagacccgtcactgctcggaggaaccataagcgcatacaagatcgtgcccgatgagatagaggaaattaaagagacgctcatcgactggtgcgatgaaaaggaactgaatttaatcctgacaacagggggaacaggttttgctcccagagatgtgaccccagaagcaacaaaagaggtcattgagcgagaagctccaggcatggccctcgctatgctcatgggatcattaaacgttacaccacttggtatgctttctcgacctgtgtgtgggatacggggaaaaactttaatcatcaacctgcctgggtccaaaaaaggatctcaggagtgctttcagttcattctgccagccttacctcatgccatagatctcctgcgtgacgctattgtaaaggtgaaagaagttcacgatgaactggaggacctgcctagcccccccccccctctgtcgccgccaccaactacgtccccgcataaacagaccgaggataaaggagtccaatgcgaagaggaagaggaggaaaagaaggacagcggtgtagcatccaccgaagactcatcctcttcccacatcacagcagcagcaatcgcagctaagaaacatcctttttacaccagtccagctgttgtgatggcacacggtgaacagccaatccccggtctgattaattactcgcaccattcgacagatgaaagaatcccagactcaatcatttcccgtggcgtacaggtcttaccgagggataccgccagcctgtccactaccccatcagagtcaccgagagcccaggccacctctcggctctcaaccgcaagctgccccacccccaaagttcaaagtaggtgctcctctaaagagaacatccttagagcaagtcactcagcagtggacattacaaaggtcgcccggaggcacagaatgtcaccatttccactcacctctatggataaagcctttatcactgtccttgagatgacacccgtcctgggaactgagattataaactaccgcgacggcatgggccgggtgcttgcccaggacgtgtacgccaaggacaatttgcccccttttcctgcctccgtgaaagatggctacgctgtaagggcagctgacggtccaggtgacagattcatcatcggagagtcccaggcgggggagcaacccacgcagaccgtgatgcctggtcaggtgatgagggtgactacaggcgcgccaatcccttgtggggccgacgcagttgtccaggttgaagataccgagctgattcgagaaagtgacgacgggacagaggaactggaggtgaggatcttagtgcaagccaggccaggccaggacatccgccctatcggacacgacattaaacgcggcgagtgtgtgctggccaaaggtacccacatgggacctagcgagatagggctgctagccacggtgggcgtgactgaagtggaagtcaacaagtttcccgtcgttgcagttatgtctaccggcaacgagctgttgaatccggaggacgatctactgcctggcaagatcagggatagcaaccgctctacgctgctggctaccatccaagagcacggataccctactatcaacctgggaatcgtgggggacaacccagatgacctgctcaacgccctcaacgaagggatatctagagcagacgtgatcatcacctcaggaggggtgagtatgggcgaaaaggactacttgaaacaggtgcttgatatcgacctccacgcccaaatacacttcggtagagtgttcatgaagcccggccttccaaccacctttgctacacttgatattgacggagtgcgaaagataattttcgctctaccaggaaatcccgtgtcagccgtagtgacttgtaacctgttcgtagtcccggccctgagaaagatgcaggggattctagacccacgcccgactattatcaaagctagactgtcttgcgatgtcaagttggacccacgccccgagtaccaccgctgcatactgacctggcaccatcaggagcccctgccttgggcacagtctaccggtaatcagatgtcatcacggctaatgtccatgagatccgccaatggcctgctgatgctgcctcctaaaaccgaacaatacgttgaattacacaagggggaagtggtcgacgtaatggttattggccgactatag

SEQ ID NO: 189122 - DNA, 903 bp, Artificial Sequence
  Description of Artificial Sequence: Synthetic coding sequence
atggagaagacccaggagaccgtgcagcggatcctgctggagccctataagtatctgctgcagctgcctgggaaacaggtgagaaccaagctatcccaagcatttaatcactggttaaaagtaccagaagacaagctgcagattatcattgaggttactgagatgttgcacaacgcctcccttttgattgacgatattgaagataactcgaagctgaggcggggctttcccgtggcccactcaatctatggaattccgtccgtaatcaactctgcaaactatgtgtatttcctcgggctggagaaggttctcaccctggatcaccccgacgcggtgaagcttttcacacgacaattgttggagctacaccaaggccaggggctggatatctactggcgggacaactacacatgccccaccgaagaagagtacaaggcgatggtactccagaagaccggaggtctttttgggctagctgttggactcatgcagctcttctccgactacaaggaagatctgaaaccgctgcttaacacgctgggtctatttttccagatccgcgatgattacgccaatcttcacagcaaggagtattccgaaaataagtccttctgtgaggacctcactgaaggcaagtttagcttccccactattcacgcgatctggagcaggcctgaatctacacaggtccagaacatccttcgccagcgtacagaaaacatagacatcaaaaaatattgtgtccattatttggaagatgttggctcctttgagtacaccagaaacacccttaaagaactggaggcaaaggcatataaacagattgacgcacgaggcggtaacccagaattagtcgccctcgtgaaacatctgagcaagatgtttaaggaggagaacgagtag

SEQ ID NO: 189123 - DNA, 903 bp, Artificial Sequence
  Description of Artificial Sequence: Synthetic coding sequence
atggagaagacccaggagaccgtgcagcggatcctgctggagccctataagtacctgttacaacttcccggaaagcaagtgcgtacgaaactgtcacaggcgtttaaccactggctgaaggtgcccgaggataagctgcagattattatagaggtaactgagatgctccataacgcgagtttgctcatcgacgacatcgaagacaatagcaagctgagacgaggtttccctgtcgcccactctatatacggcatcccttccgttatcaattccgcaaactatgtctattttcttggattggaaaaggtcttaacactcgaccaccccgacgcagtgaaactgtttactcgccagctccttgaacttcaccaggggcagggcctggacatctactggagagacaattatacctgccctaccgaggaagaatacaaggccatggtgctacagaagacaggaggactattcggcctcgccgtgggcctaatgcagcttttctccgattataaagaggacctgaagcctctgctcaataccctcggcctcttcttccagatccgcgacgactacgccaatctgcacagcaaagaatactcagaaaacaaaagtttctgtgaggacctgactgagggcaaattcagtttcccgaccatacacgcaatctggagccgacccgaatccacccaagtccagaacatactccgtcagcgcaccgaaaacatcgatatcaagaagtattgcgtgcactatctggaagatgtgggcagcttcgagtacacccgcaacaccttgaaagagcttgaagctaaagcgtacaagcagatcgacgctcgcggcggcaaccccgaactggttgccctggtgaagcacctcagtaagatgttcaaggaagaaaatgaatag

SEQ ID NO: 189124 - DNA, 729 bp, Artificial Sequence
  Description of Artificial Sequence: Synthetic coding sequence
atggagaagacccaggagaccgtgcagcggatcctgctggagccctacaagtacttgcttcagttgcctggaaagcaggtcagaacaaagctttcccaggcttttaatcactggcttaaggtacctgaagacaagcttcagatcatcatcgaggtaactgagatgctgcacaatgcctcacttctgattgatgatatcgaggacaacagcaagctccgccgtggctttcccgtggctcattccatttacggcatcccatctgtgatcaatagcgctaattatgtctacttcttaggcctggagaaggtcctcacactggaccatccagatgctgttaagctgttcactcggcagctgctcgagcttcatcaaggtcagggcctcgatatctactggcgggacaactacacgtgtccaacagaggaagagtacaaggcaatggttcttcagaagaccggaggtttgtttgggctggcagttggtctcatgcagctgttttctgattataaggaggacctgaaaccactactgaatacattaggcctgttctttcagatccgggatgattacgcaaacctccactcaaaagagtatagtgagaacaaaagcttctgcgaggacctgacggaagggaagttcagttttccaactattcatgcgatctggtcaaggcccgaaagcacccaggttcagaacatcctaagacagcgaactgagaatatcgactag

SEQ ID NO: 189125 - DNA, 903 bp, Artificial Sequence
  Description of Artificial Sequence: Synthetic coding sequence
atggagaagacccaggagaccgtgcagcggatcctgctggagccctataaatatctgttgcagctgccaggaaagcaagtacggacaaaactgagtcaagcctttaaccattggctcaaggtgcccgaggataagctgcagattattatcgaagtgactgagatgctacacaacgcaagcctcttgatcgacgacatcgaagataacagtaaactgaggcgaggcttccccgttgcccactcaatctatggcatccccagcgtgattaactcagccaattatgtgtactttcttggattagaaaaagtgctgacattggaccatcctgacgcggtgaagctgttcacacgacaattactcgaactccatcagggccagggactggatatctattggcgcgataattacacatgtcccaccgaggaggaatataaagcaatggtgctgcagaaaacaggcgggctgttcgggctggccgtggggctgatgcagctgttttcagattataaggaggacttaaagccgttgttgaacacattgggtctcttttttcagattagggatgactacgctaacctgcattcaaaggaatatagcgagaataaatcattttgcgaagatctcaccgagggaaaattctccttcccgactattcacgccatctggtcaaggccagagagtactcaggtccagaacatcctccgacaacggactgagaacattgacataaagaaatattgcgtgcactatctcgaagacgtgggaagcttcgagtatacaagaaacactctgaaagaactggaggccaaggcgtacaagcagatcgatgcaagaggcggcaaccccgagctggttgctttggtcaagcacttgtccaaaatgtttaaagaggaaaatgaatag

SEQ ID NO: 189126 - DNA, 903 bp, Artificial Sequence
  Description of Artificial Sequence: Synthetic coding sequence
atggagaagacccaggagaccgtgcagcggatcctgctggagccctacaagtacttattacaactcccgggcaagcaggtgcggaccaagttgtcacaggccttcaatcactggctgaaagtcccagaggataagctgcaaatcatcattgaggttaccgagatgttacataatgccagcctgctgatcgacgacatcgaagacaactcaaaactacgtagaggattccctgtagcccattctatttacggaattcccagtgttattaatagcgctaattatgtgtactttctcggcctcgaaaaggtgctgacgctcgatcatccggacgcggtcaaattattcacccgccagctcctggaattgcatcaggggcagggtttggacatttactggcgcgacaactatacgtgcccaacagaggaggagtataaggcgatggtactgcaaaagactggggggttgttcggactggccgtgggtctcatgcagctctttagcgactataaagaggatctgaagccattgcttaatacactcggcctctttttccagattcgggatgattatgccaacctgcattcaaaggagtacagcgaaaacaaaagtttctgtgaagacttgactgaagggaaatttagcttcccgaccatccacgcgatctggtctcgacccgagagtacccaagtgcagaacatactgcggcagcggactgaaaacatagatatcaagaagtactgcgttcattatctggaggacgttggctccttcgaatacacccggaatactttgaaggaactggaggcgaaggcttacaagcaaattgacgctaggggaggcaaccccgagctggtggctctggtgaaacacctctcaaagatgttcaaagaggagaatgagtag

SEQ ID NO: 189127 - DNA, 693 bp, Artificial Sequence
  Description of Artificial Sequence: Synthetic coding sequence
atggagaagacccaggagaccgtgcagcggatcctgctggagccctataagtacctgttgcagctcccgggtaaacaggtgagaactaagctgagccaggccttcaatcattggctgaaggtgcctgaggacaagctccaaattatcatcgaagtgactgagatgttacataacgcgagcctcctgattgacgatattgaggacaacagtaagttgcggagaggatttccggtagctcatagtatctacggcatcccgtcagttataaactccgccaattacgtctacttcttgggactagagaaggtgctgaccctcgaccacccagatgccgtgaaactgttcacaaggcagctgcttgagctgcatcagggccaggggctggatatatattggagggacaattatacctgcccaacagaggaagagtataaggcaatggtacttcagaaaactggtggcctcttcggtctggcagtcggactgatgcagctatttagtgattataaagaggacctgaaacctctgctcaacacattgggcctgtttttccagattcgcgatgattatgcaaacctgcactcaaaagaatactccgaaaacaagagcttctgtgaggatctgacggaaggcaagtttagtttccccacaatacacgcaatttggagtcgccctgaatccacacaggtgtag

SEQ ID NO: 189128 - DNA, 537 bp, Artificial Sequence
  Description of Artificial Sequence: Synthetic coding sequence
atgggcaacagcctgctgcgggagaaccggcggcagcagaacacccaggagatgccttggaacgtgaggatgcagagccctaaacaacgcacttcaagatgctgggatcaccatattgccgaagggtgcttctgcctgccatggaaaaaaattcttatatttgagaagagacaggatagccagaatgaaaacgaaaggatgtccagtactccgatacaggataacgtggatcagacttacagcgaggagttatgttataccttgattaaccatcgggttctttgcacccgcccaagtggcaactccgcggaggagtattacgaaaacgtgccctgcaaggcagaaagaccacgcgagagccttgggggaaccgaaaccgagtattctctcttgcacatgccctccaccgatccccgtcatgcaagatcgccggaggacgagtacgagctcctgatgccgcaccgaatctctagccatttcttacagcaaccacgccccctcatggctccttctgagacacagttttctcacttatag

SEQ ID NO: 189129 - DNA, 492 bp, Artificial Sequence
  Description of Artificial Sequence: Synthetic coding sequence
atgggcaacagcctgctgcgggagaaccggcggcagcagaacacccaggagatgccctggaacgtgcgaatgcagtctcctaaacagcgcacaagtaggaaaaaaatcctcattttcgagaaacgccaggattcccagaacgagaatgaaaggatgagctcaacacctatccaagataatgtcgatcaaacatactccgaagagctgtgttacactcttatcaaccacagagttctatgtactcgaccatctgggaactccgctgaggagtactacgagaacgtgccctgtaaagcagagaggcctagggagtccttaggcgggaccgagacggagtatagtcttctgcacatgcccagcaccgacccgcgccacgccaggtctccagaagacgaatacgagcttctgatgccacaccggatcagcagccacttcctccagcagcctaggcccctcatggccccgagcgagacccagttcagccacctctag

SEQ ID NO: 189130 - DNA, 543 bp, Artificial Sequence
  Description of Artificial Sequence: Synthetic coding sequence
atgggcaacagcctgctgcgggagaacagcttccggcggcagcagaacactcaggaaatgccctggaatgttcgaatgcaaagtcccaagcagcgaacctctcggtgctgggatcaccatattgcagagggttgcttttgcctcccatggaagaagatcttaatttttgaaaaacgccaggactcacaaaatgaaaatgagaggatgagcagtacaccaattcaagacaatgtcgatcaaacctattccgaagagctgtgttacaccctgatcaatcatagggtcctctgcactcgcccaagtggcaatagtgcagaggagtattacgagaatgtgccttgtaaggctgaaagacctcgagaaagcctgggaggaactgagaccgagtactctctgctgcacatgccctcaactgaccctcgacacgctcggtcccccgaagatgagtacgaacttctaatgccgcaccggatcagctcccacttcctgcagcagccccggcctttaatggctccgtcagaaactcaattcagccacctctag

SEQ ID NO: 189131 - DNA, 351 bp, Artificial Sequence
  Description of Artificial Sequence: Synthetic coding sequence
atgcccagccccggcaccgtgtgcagcctgctgctgctgggcatgctgtggcttgacttagccatggcagggagttcttttctgagccccgaacaccagagagtccaacgaaaagaatccaagaagcctccagctaaactgcaaccacgcgcattagcaggctggctgaggcctgaagatggcggccaggcagagggggcagaggatgagctggaagtgcgcttcaatgctcccttcgatgttgggattaaactgagtggggtccagtaccagcagcacagtcaggctttgggcaagttcctgcaggatatcttatgggaggaggcaaaagaggcaccagccgataagtag

SEQ ID NO: 189132 - DNA, 354 bp, Artificial Sequence
  Description of Artificial Sequence: Synthetic coding sequence
atgcccagccccggcaccgtgtgcagcctgctgctgctgggcatgctttggcttgatctggccatggctggaagctctttcctgtcacccgaacaccagcgtgtgcaacagagaaaagagagcaaaaagcctccagcaaagcttcagccgcgcgccctcgccggatggctcagaccagaagacggggggcaagctgaaggcgccgaagatgaattagaggtacgtttcaatgcaccatttgatgtgggcatcaagctgtccggcgtacagtaccagcagcatagccaagctctggggaagtttcttcaggatatactgtgggaggaagccaaagaagcccctgccgacaagtag

SEQ ID NO: 189133 - DNA, 276 bp, Artificial Sequence
  Description of Artificial Sequence: Synthetic coding sequence
atgcccagccccggcaccgtgtgcagcctgctgctgctgggcatgttgtggttggatctggccatggctggcagcagtttcctctctcccgagcatcagcgcgttcaacaacgcaaagaaagcaaaaagccaccagctaaactgcaaccacgcgctctggccgggtggctgcggcctgaggatgggggccaggcagagggcgctgaagacgaactggaggtgcgccgcccccagccaacctcagataggccccaggccctgttaacgagcctgtag

SEQ ID NO: 189134 - DNA, 102 bp, Artificial Sequence
  Description of Artificial Sequence: Synthetic coding sequence
atgcccagccccggcaccgtgtgcagcctgctgctgctgggcatgctatggctcgacctggcaatggctgggtctagtttcttatccccagagcaccaatag

SEQ ID NO: 189135 - DNA, 354 bp, Artificial Sequence
  Description of Artificial Sequence: Synthetic coding sequence
atgcccagccccggcaccgtgtgcagcctgctgctgctgggcatgttgtggcttgacttagcgatggccggatccagtttcttaagccccgaacaccagcgagtgcagcagcgcaaggaatctaaaaaaccaccggccaagctacaaccacgtgctctagctggctggcttcggcctgaggacggagggcaagctgaaggggccgaggacgagttggaggtgaggtttaacgctccctttgatgtgggaattaagctcagcggtgtgcaataccagcagcacagccaggctctgggaaaattcttgcaggatatcctctgggaagaagccaaggaagcacctgctgataagtag

SEQ ID NO: 189136 - DNA, 351 bp, Artificial Sequence
  Description of Artificial Sequence: Synthetic coding sequence
atgcccagccccggcaccgtgtgcagcctgctgctgctgggcatgctgtggttggacctcgctatggccggttcatcattcctttcccctgaacaccagcgcgtccagaggaaggagtccaaaaaaccgccggctaagctccaaccacgggccctggccggttggctgcgcccagaggacggagggcaagctgaaggtgccgaggatgagcttgaagtgcgattcaacgccccttttgatgtcgggatcaagctgtccggagtgcagtaccagcaacacagccaagccttgggcaaatttttacaggacatcttgtgggaggaggccaaggaagcgccagctgataaatag

SEQ ID NO: 189137 - DNA, 318 bp, Artificial Sequence
  Description of Artificial Sequence: Synthetic coding sequence
atgttcacctgctggtggagctacctgcggagcaccctggccgccgtccccggagaggcatcacgcgtgcagcagaggaaggaaagcaaaaagccgcctgccaagctgcagcctcgagcgttagccggctggctacgcccagaggatggtggacaggccgaaggtgcggaggatgaactggaggtcaggtttaatgctcctttcgatgtaggaatcaaactgagcggtgtgcaataccagcaacactcccaggccctggggaaatttctgcaggatattctatgggaagaggccaaggaggcacctgccgacaagtag

SEQ ID NO: 189138 - DNA, 201 bp, Artificial Sequence
  Description of Artificial Sequence: Synthetic coding sequence
atgttcacctgctggtggagctacctgcggagcaccctggccgccgtgccaggcgaagcctccagagtgcagttcaacgctcccttcgacgtgggcattaaactgtctggtgtgcagtaccagcaacattcacaagcattgggaaagtttctgcaggacatactgtgggaagaagccaaggaagctccagccgacaaatag

SEQ ID NO: 189139 - DNA, 315 bp, Artificial Sequence
  Description of Artificial Sequence: Synthetic coding sequence
atgttcacctgctggtggagctacctgcggagcaccctggccgccgttcctggtgaagcttctcgagtacagaggaaggagtcgaaaaagcctcccgctaagttgcagcccagagccctggccggatggctgcgccctgaagatggagggcaggccgagggagctgaagacgagcttgaagtcagatttaacgccccctttgatgtcgggatcaaactgagcggtgtgcagtatcagcagcacagtcaggcactgggcaagtttctgcaagatattctttgggaggaggctaaagaggccccagccgacaaatag

SEQ ID NO: 189140 - DNA, 351 bp, Artificial Sequence
  Description of Artificial Sequence: Synthetic coding sequence
atgcccagccccggcaccgtgtgcagcctgctgctgctgggcatgctatggttagatctcgccatggcgggctcttcatttctgagtcctgaacaccagcgcgtgcagagaaaagagtccaagaagccacccgcaaagctgcaaccccgagctctagcagggtggttacgccctgaggatggtggccaagcagagggtgcagaggacgagctggaggtacggtttaatgctccatttgacgtgggcatcaaactgtcgggagtgcagtatcagcagcactcccaggcactgggaaagttcctgcaggacattctctgggaagaggctaaagaagccccagcggataagtag

SEQ ID NO: 189141 - DNA, 354 bp, Artificial Sequence
  Description of Artificial Sequence: Synthetic coding sequence
atgcccagccccggcaccgtgtgcagcctgctgctgctgggcatgctgtggctggacctggcaatggccggtagttctttcctgagtcccgagcaccagagagttcaacagaggaaagaatctaaaaagccaccagcaaaactacagccccgagctctcgctggttggcttcgacccgaggacgggggccaggcagagggcgcagaagatgagcttgaggtgcggttcaatgccccattcgatgttggaataaagcttagcggagttcaatatcagcagcacagccaagctctcggaaagtttcttcaggatatcctttgggaggaggcgaaggaggcgcccgcggataaatag

SEQ ID NO: 189142 - DNA, 354 bp, Artificial Sequence
  Description of Artificial Sequence: Synthetic coding sequence
atgcccagccccggcaccgtgtgcagcctgctgctgctgggcatgttatggcttgacctggcaatggctgggtcttctttccttagccccgaacaccagcgcgtccagcaaagaaaggaatccaagaagccccctgccaaactgcagccccgggccctggccggatggctccgacccgaggacggaggccaggctgaaggagcagaagatgaactcgaagttcgcttcaacgccccattcgatgtggggattaagctctcgggagtccagtatcaacagcacagccaggcccttggcaaatttctgcaggacattctgtgggaggaagccaaggaggcccccgcggataaatag

SEQ ID NO: 189143 - DNA, 1794 bp, Artificial Sequence
  Description of Artificial Sequence: Synthetic coding sequence
atggccgagggcagcgccgtgagcgacccccagcacgccgcccggctactacgtgccctgtcaagttttcgggaagagagtaggttttgtgatgcccatctcgtcctcgatggcgaggagatacctgtgcagaaaaatattttggctgccgcatcgccttacatccggacaaagctcaattacaatcctcctaaagacgacggttctacttataaaatcgaactggaggggataagtgtcatggttatgagggaaatcttggactacatcttttccgggcagatacgcctgaacgaagatacaattcaggacgtagtgcaagctgcagacctgttactgctcactgacctcaagaccctttgttgcgaattcctcgaaggatgtatagcagctgagaattgtatagggattcgggacttcgcactgcactactgtctgcatcacgtgcactacttggccaccgagtacttggagactcatttccgagacgtctcaagcacagaggaatttctggaactctcaccccagaagcttaaagaagtgatctccctcgagaagctcaacgtgggtaatgagaggtatgtcttcgaagcagttattcggtggatcgctcacgacactgaaatacgcaaagtgcacatgaaggatgtcatgtccgccctctgggtgtcaggtctggactcctcataccttagggagcaaatgctgaacgaacctttagtgcgcgagatcgtcaaggaatgctcaaatatccccttgtcccagccacagcagggtgaggcgatgctggccaattttaaaccacgaggatatagtgaatgtatagtgactgtaggaggcgaagaaagagtgtctcggaaacctaccgcagctatgagatgtatgtgcccactgtatgacccaaaccgacaactgtggatagagttagctcctctgtcaatgcctaggataaaccatggagtgttgtccgctgagggatttctgtttgtgtttggtgggcaggacgagaacaagcagaccttgtcatccggagagaagtacgatccagatgctaacacctggaccgccctgcctcctatgaatgaggctaggcataattttggaattgtagaaatcgacgggatgctctatattctgggcggagaagatggcgaaaaagagttgatttcaatggaatgttacgatatttacagcaagacatggaccaagcaaccggatctaaccatggttcgaaagatcgggtgctatgctgccatgaaaaagaagatatacgccatgggcggaggatcgtatggaaagctctttgaatctgttgagtgttacgacccccggactcaacagtggacggccatctgccccctgaaagagcggcgcttcggcgcggtagcttgtggcgtcgcgatggagctgtatgtgtttggtggcgtccgcagtcgagaagatgcccaaggatccgagatggtcacttgcaaatccgagttctatcatgacgagtttaagcgttggatctatctgaatgatcagaatctttgcatcccagcctcctcctctttcgtctatggagccgtgcctattggcgcctcaatctatgttatcggcgacctcgatactggcactaattacgattatgttcgggaattcaagaggtcaactggtacctggcatcatactaagccgctgttaccatcagacctgcggaggacgggatgcgccgctctgcggattgctaactgcaagctgttccgacttcaactgcagcaaggtttgtttcgtataagagtgcacagcccatag

SEQ ID NO: 189144 - DNA, 591 bp, Artificial Sequence
  Description of Artificial Sequence: Synthetic coding sequence
atgttctgcgagaaggccatggagctgatccgggagctgcaccgggctcccgagggtcagcttcccgctttcaacgaagatggactgaggcaagtgctggaggagatgaaagcactctatgagcagaaccaatccgatgtcaacgaagctaagtctggcggcaggtcggacttgatccccactattaaattccgccattgcagtctgctcaggaatagaaggtgcacagtggcatatctgtacgacaggctgctgcgcatccgggctctccggtgggagtacggctccgtcctgcccaacgctctaagatttcacatggcagccgaagaaatggaatggtttaataactataagcgatcactcgccacctatatgcgatcactcggtggggacgagggcctggacatcacacaggatatgaagccgcccaagtctctgtacatcgaggtcagatgtctcaaggactacggggaatttgaggtggatgatggtacgagtgtgctgttgaagaagaactcgcagcacttcttacctagatggaaatgcgaacagctgatccggcagggcgtgcttgagcacatcctgtcctag

SEQ ID NO: 189145 - DNA, 498 bp, Artificial Sequence
  Description of Artificial Sequence: Synthetic coding sequence
atgttctgcgagaaggccatggagctgatccgggagctgcaccgggcccccgaaggccagctgcccgcttttaatgaggatgggcttaggcaggtactcgaggaaatgaaagccctgtacgaacagaatcaatcagatgtgaatgaggccaaatccgggggaagatcagatctcatccccacaatcaagttccgacattgtagtttgctgcggaatcgacggtgcacggtagcatacttgtatgaccgtctccttcgaattcgggcattacggtgggagtacggttctgtgttgcctaatgccctgaggtttcacatggccgcggaggagatggagtcccgctccgttgctcaagcaggtgtccagtggtgtattttgtgttctctgcagttacccccccccggctttaagcaattctcctgcctgtcccttccatcctcttgcgattacagatggtcaggactgatcataatcaaagacctgcttctcctgatctag

SEQ ID NO: 189146 - DNA, 558 bp, Artificial Sequence
  Description of Artificial Sequence: Synthetic coding sequence
atggacgccgccgaggtggagttcctggccgagaaggagctggtgacgataattcctaacttctcactggacaaaatttatttaattgggggcgacttaggcccatttaaccctgggctgcccgtggaagtgcccctctggctggccattaatcttaagcagcgccaaaaatgtcggcttttacccccagagtggatggatgtagaaaagctggagaagatgcgggaccacgaaagaaaggaagagactttcactcccatgcccagcccatactatatggagttaacgaagctactgctaaaccacgcttccgacaatatacctaaagctgacgagattcgtacccttgttaaagatatgtgggatacgcggatcgccaaactgagagtgagcgccgactccttcgttaggcagcaagaagcccacgccaagctggacaacctcaccctgatggagatcaacacatctggcacttttctaacccaggctctaaatcatatgtataagctgagaacaaatctccagcctctggaaagcactcagagccaggatttctag

SEQ ID NO: 189147 - DNA, 651 bp, Artificial Sequence
  Description of Artificial Sequence: Synthetic coding sequence
atgagcgaggcctacttccgggtggagagcggcgccctgggccccgaagaaaacttcctgagtctagatgatatcctcatgagccacgaaaaactgcctgtccgaacagagaccgctatgccccgccttggggccttctttctggaacgaagcgccggagccgagaccgacaacgccgtcccacaaggaagcaaactggagttgcctctgtggctggcaaaggggctgttcgataataagagaagaattttgtctgtcgagttacctaagatctaccaggagggatggaggacagtgttcagtgccgatcctaacgtcgtcgacctacataaaatgggcccacacttctatggcttcggctctcagctgctgcactttgacagccctgagaatgccgacatcagtcagagccttctccagacatttattggtaggttcagacgcatcatggactcaagccagaatgcgtataatgaagacactagcgctctcgtcgccagattagatgagatggagagggggctttttcagaccgggcagaagggtctgaatgattttcagtgctgggaaaaagggcaagcaagccaaattacagcaagcaatctggtccagaattacaaaaagagaaaattcacagatatggaagactag

SEQ ID NO: 189148 - DNA, 417 bp, Artificial Sequence
  Description of Artificial Sequence: Synthetic coding sequence
atgagcgaggcctacttccgggtggagagcggcgccctgggccccgaggagaacttcctctccctagatgatatactgatgagtcatgagaagttgcctgtcagaacagagacagcaatgccccgtctaggggcgtttttccttgaacgctccgcaggggcggagacagacaacgccgtaccccagacctttattggccggtttcgcaggattatggattcctcacagaacgcatataacgaagacacttctgctctagtcgccagacttgacgagatggaaagaggcctctttcagacaggacagaagggactgaacgatttccaatgttgggagaaagggcaggcttctcagatcactgcaagcaatctcgtacaaaattacaaaaaacgcaagttcacagacatggaggactag

SEQ ID NO: 189149 - DNA, 768 bp, Artificial Sequence
  Description of Artificial Sequence: Synthetic coding sequence
atgagcgaggcctacttccgggtggagagcggcgccctgggccccgaagaaaatttcttgagcctcgacgatattctgatgtctcatgaaaagctccccgtacggaccgagaccgcgatgcctaggctcggtgcattctttttggagcggagcgcaggggctgagactgacaacgcagttcctcagggctttgccctgctgccacggctggagtgcagcggcgttatttggctgacagctgctttgaccagtcaggcaccagaaatcctgccgccacagcccccaatgtggctggtgttacagggtagcaaactcgaactccccctctggctcgcaaaggggctgtttgacaacaaacgtcggatcctctcagtggagctgccgaagatctaccaggagggctggaggaccgtgttctccgcagaccccaacgtggttgatcttcataaaatgggtccccatttctacggcttcggatcccaactgcttcattttgacagtcctgagaacgccgacattagccaatcactgctgcagacgtttatcggacgattccggcggattatggatagttcccagaatgcttacaatgaggacacgagtgcactggtcgcccgcctggatgaaatggaacgaggccttttccaaacagggcagaagggcctgaatgactttcagtgttgggagaaggggcaggcatcccaaattacagcctccaacctcgtgcagaattataaaaagcgaaaattcacagatatggaggactag

SEQ ID NO: 189150 - DNA, 672 bp, Artificial Sequence
  Description of Artificial Sequence: Synthetic coding sequence
atgaccgaggaggtggacttcctgggccaggacagcgacggcggcagtgaagaagtggtgctgacccctgccgaattgatcgagcgcttagagcaggcctggatgaacgagaagttcgcccctgagctactcgaaagcaagcctgaaatagtcgaatgtgttatggaacaactcgagcacatggaggagaacttacggcgagccaaacgtgaggacctgaaagtgagtattcatcagatggaaatggagcgaatcagatacgtattatccagctacctgaggtgtaggctgatgaagatcgaaaagttcttcccccacgtgctggagaaagaaaaaacacgtccagaaggtgaaccctcatcactgtctcccgaggaacttgctttcgccagggagttcatggctaacacagaatcttacctgaagaatgtcgcactgaagcacatgccccccaacctgcaaaaagtcgatctttttcgcgcggtgccaaaacccgatctcgattcctacgttttcttgagagtgagagaaaggcaagaaaatatcttggtagaacctgacaccgacgaacagcgcgactatgtaatagacctggagaaggggtctcaacatctgatccggtataaaacgatcgcaccactcgttgcgtccggggcggtccagcttatatag

SEQ ID NO: 189151 - DNA, 672 bp, Artificial Sequence
  Description of Artificial Sequence: Synthetic coding sequence
atgaccgaggaggtggacttcctgggccaggacagcgacggcggcagcgaagaggttgttcttaccccagcagaattgattgaacggctagaacaggcctggatgaatgaaaaattcgcccctgaactgcttgaatctaagcctgagattgttgagtgcgtcatggaacagctggagcatatggaggaaaacctccgcagggcaaagcgggaggatctgaaggtgagtatacaccagatggaaatggagcgtattcggtacgtgctttcttcgtaccttcgctgtcggcttatgaaaatcgaaaaatttttccctcatgtgctggagaaggagaagaccagacctgagggcgagccttcctctctgagccccgaggagttagctttcgcccgggagttcatggccaacactgaaagttacctcaaaaacgtggctcttaagcatatgcctccgaatctgcagaaagttgatctgttccgggccgtgcccaagcctgatctggatagttatgtgtttctgcgagtcagggaacgccaggagaatatcctcgtggaacctgacacagacgagcagcgggattatgtcatcgacctggaaaagggatctcagcatctgatcaggtacaagacaatcgctcctctcgtagcctcgggcgccgtgcaattgatttag

SEQ ID NO: 189152 - DNA, 303 bp, Artificial Sequence
  Description of Artificial Sequence: Synthetic coding sequence
atgaccgaggaggtggacttcctgggccaggacagcgacggcggctcagaagaggtagtgctcactcctgcagagctcattgaacggttagagcaagcatggatgaatgagaaattcgcgcccgaactgctggaaagcaagccagagattgtggaatgtgttatggaacaactcgagcacatggaggaaaaccttcgacgtgccaaaagggaggacctaaaggttagtatccatcaaatggaaatggagaggattagatacgtgctctccagctatctaagatgcagactcatgaaggtgtag

SEQ ID NO: 189153 - DNA, 939 bp, Artificial Sequence
  Description of Artificial Sequence: Synthetic coding sequence
atggagggcgccgccgcccgggaggcccggggcaccgagacccccagggcctctgccccacctccagcaccatccgaacctccagctgctcctcgcgccagaccgaggctggtatttcgcactcaattagcacacggcagtccgaccggcaaaatcgagggatttactaatgttagagagctgtacgctaaaatcgccgaggcctttggcattgccccgactgaaatactgttctgcactcttaactcccacaaggtagacatgcagaagcttctagggggccaaattggactagaagatttcatcttcgcccatgtgaggggggagacaaaagaagtggaggtgaccaagacagaggacgcactgggcctgacaatcacagacaacggcgcagggtatgcctttataaaacgcatcaaggagggttccatcattaatcggattgaggcagtatgtgtaggggactctattgaggccattaatgaccacagcatcgtggggtgcagacactacgaggtagccaagatgctgcgagagttgcccaagtcccagcccttcaccctgaggcttgtccagccgaaacgtgcgttcgacatgattgggcagcgctcacggagcagcaaatgtcccgtagaggcaaaggtcacctctggaagggaaactctccggctgcgctctgggggagctgccacagtggaggaggcccccagcgaatttgaagaagaagccagccgcaaggttgacgacttactggagagttatatgggtattcgagaccctgagctcgccagcacaatggtcgagactagcaagaagactgccagcgcccaagaattcgctagatgcttggattccgtgctgggtgaatttgcctttcccgatgagttcgtcgtagaagtttgggccgctatcggtgaagctagagaggcgtgcggctag

SEQ ID NO: 189154 - DNA, 2097 bp, Artificial Sequence
  Description of Artificial Sequence: Synthetic coding sequence
atgcccagcgagggccggtgctgggagaccctgaaggccctgcggagcagtgataaaggacggttgtgttattaccgcgactggctgctgcgtcgggaagatgtactggaagagtgcatgtctcttccaaagctgagctcttattcaggctgggtggtggaacacgttttaccgcacatgcaggaaaaccaaccactgtcagaaacatcacccagctctacatctgcctcagcgctcgaccaaccatcatttgtcccaaagagtcccgatgctagttccgcatttagccccgcttctcccgccactcctaatggcaccaaaggaaaggacgagagtcagcacactgaatctatggttctgcagtcctcccgagggattaaggtggaaggctgcgtacggatgtacgagctggtccatcgcatgaagggcacagagggactgagactatggcaggaggagcaggaacgcaaagtccaggcattgagtgagatggcttctgaacaactcaagagattcgacgagtggaaggagttgaagcagcacaaggagtttcaggacctccgcgaagtgatggagaagtcctcccgggaagccctaggccatcaggaaaaacttaaagccgagcaccggcacagggcgaagattctaaatctgaaactgagagaggctgaacaacagcgtgtgaaacaagcagagcaggagcgactccggaaagaggaaggtcagatccggctccgagctctgtatgcactgcaagaagagatgctccaattgtctcagcagctcgatgcaagcgaacagcataaagctttactgaaggtggatttagctgctttccagacaaggggtaatcaactgtgtagcctcatatctggcatcatcagagcatcctcagaaagctcatacccaaccgcagagtcgcaggccgaagccgagagagctctgagggagatgcgtgatctccttatgaacctcggccaggaaatcactagagcatgcgaagataagagaaggcaggacgaggaggaggctcaagtgaaactgcaagaagcgcagatgcagcagggccctgaggcccacaaggaaccgcctgctccttcccaagggcccggtggcaaacagaacgaagatctgcaggtcaaagtgcaggatataaccatgcagtggtaccaacagctgcaggatgcatctatgcagtgtgttctgactttcgagggcctgaccaactccaaagattcacaagcaaagaaaatcaaaatggacctccagaaagctgccaccatcccagtgagccaaatttcgaccatcgccggctccaaacttaaagaaatcttcgacaaaatacattctctgttaagcgggaaaccggtccagtcagggggcaggtcagttagcgtaaccctgaacccccaaggattagacttcgtgcagtataaactggctgaaaaattcgtgaagcagggggaggaggaagtggcaagccatcacgaggccgcctttcctatagccgttgtcgcttcggggatttgggaactgcacccaagagtcggagacctaatcctggcgcatttgcacaagaagtgtccctactcagtgcccttttatcccacctttaaggaggggatggccctggaagattatcaacgcatgctgggatatcaggtcaaggattccaaggttgagcaacaagacaacttcctcaaaaggatgtcaggaatgatcaggctttacgccgctattattcaactgagatggccatatggtaacagacaagagatccatcctcatggcctcaaccacgggtggcgctggctggcccagatcctcaacatggaaccactgagcgacgtgaccgccacactgctgttcgattttttggaggtatgcggaaatgctctgatgaaacagtaccaggttcagttttggaagatgctgattctcataaaggaagattacttcccacgcattgaggctattacctcttccggccagatgggttcattcattagattgaaacagtttctggagaaatgccttcaacacaaagatatcccagtgccaaaggggttcctgacgtcatccttctggcgctcctag

SEQ ID NO: 189155 - DNA, 1980 bp, Artificial Sequence
  Description of Artificial Sequence: Synthetic coding sequence
atgcccagcgagggccggtgctgggagaccctgaaggccctgcggtcttccgataagggtcggttgtgctattaccgtgattggttgctgagaagggaagatgtactggaggagtgtatgagcctgcctaaactttcgtcctacagtgggtgggtggtggagcatgtacttccccacatgcaggagaaccagcccctttctgaaaccagcccgtcgtccacatctgcaagcgctcttgaccagccctcatttgtgccaaagtctcccgatgcttccagtgcttttagccccgcctctcccgctactcccaatggtacaaaaggtaaagacgagagccagcacactgagagtatggttctgcagtcttcacgaggcattaaggtggagggctgcgttaggatgtacgagctggtacaccgcatgaaaggcactgagggcctacgactatggcaggaagagcaagaaagaaaagtgcaggctctttcagagatggcctccgaacagttgaagaggtttgatgagtggaaagagttgaaacagcacaaagagtttcaggatttacgagaggtgatggagaagtcttctagagaggcactgggacatcaggagaagttaaaggccgaacatcgccatagagccaaaatcctcaacctcaagctgcgcgaggcagaacagcagcgggtaaaacaggccgagcaggagcggttgagaaaggaggagggacagatcaggctgcgtgccctctatgccttgcaggaagaaatgctacagttatctcaacaactggatgcatcagagcaacataaggctttactgaaagtggacttggccgcctttcagactcgcggaaaccagctgtgcagtctcatttccggcattatacgggcttcaagtgagagctcctatccaactgctgagtctcaggccgaggctgagcgggcactgcgagaaatgcgcgacttacttatgaacctcggccaggaaattactcgtgcctgcgaggataaaaggcgccaagatgaagaggaagcccaggtgaaactgcaggaggcccagatgcagcaggggccggaagcgcacaaggagccccctgctccttcccagggccccggcggcaagcaaaacgaagacttgcaagtgaaagtacaggacatcacaatgcaatggtatcagcaacttcaagatgcctcaatgcagtgtgttcttacattcgaaggcctcaccaacagtaaagattcccaggccaagaagatcaagatggacctccagaaggctgccacgatcccggtcagtcaaatctcaaccattgccgggtcaaagctaaaggaaatctttgacaaaattcacagcctgctcagcgggaaacccgtacagtccggaggtagatcggtttcagttacattaaatcctcagggactggatttcgtgcagtacaagctggcggagaaatttgttaagcagggagaagaagaggtggcttcccaccacgaggccgcattccccatagctgtcgtcgcttccggtatatgggagctgcacccaagagtcggagatttgattttggcccatctccacaagaaatgtccttattccgtccccttctatcctacttttaaagaggggatggccctggaggattatcagaggatgctcggttatcaggtcaaggattctaaggtcgaacagcaggataacttcctgaagcggatgtctggcatgattcgtctgtacgctgccattattcagctgcggtggccctatggcaatagacaggaaattcacccgcatggactgaatcacgggtggaggtggcttgcacaaattcttaacatggagccactttcggacgtgaccgccaccctgctcttcgacttcttagaggtgtgcggcaatgctttgatgaagcagtatcaggtgcagttctggaagatgctgatcctgatcaaagaagattactttccacggtaccaggcgtgctag

SEQ ID NO: 189156 - DNA, 1335 bp, Artificial Sequence
  Description of Artificial Sequence: Synthetic coding sequence
atgctgcagctgagccagcagctggacgccagcgagcagcacaaggcactgctgaaagtagacctcgctgcattccagacccgcgggaaccagctctgtagcttaatttctggaattattagggccagcagcgagtccagttaccccaccgcagagtcccaggctgaagccgagagagccctgagagagatgcgggacctgcttatgaatctgggtcaggaaatcacaagggcctgtgaggacaaacgacggcaggatgaggaggaagcccaggtgaagctgcaagaagcgcagatgcagcaaggaccagaggcacataaggagcctcccgcccctagtcaagggccaggtgggaagcaaaacgaggacttacaagtcaaagtgcaggacattacaatgcagtggtatcaacagctacaggatgcgagcatgcagtgtgttctaacattcgagggacttacaaattccaaagatagccaggctaaaaaaattaagatggacttgcaaaaggccgcaaccatacctgtgagtcagatctccaccatagctgggagcaaacttaaagagatttttgacaaaattcacagtcttctgtccggtaagcctgtacagagcggtgggaggagcgtgagcgtgacactgaacccgcagggattagacttcgtgcaatacaaacttgcagaaaagttcgtgaaacaaggcgaagaggaggttgcctcccatcacgaggcggctttcccaatcgctgtcgtagcttctggaatatgggaactccacccccgggtgggcgacctgatcttagctcatctgcacaaaaaatgtccttatagcgtgcccttctatcccacatttaaggaggggatggcactagaggactaccagcggatgcttggataccaagtgaaggattccaaagttgagcagcaggacaactttctcaaaaggatgtctgggatgatacggttatacgccgccatcatccagctgcgctggccctacggaaatcgtcaggaaatccatcctcatgggctgaaccacggttggcggtggctggctcagatcctcaacatggagccactttctgacgtgacagccaccctcttgtttgactttcttgaagtgtgcggcaatgccctcatgaaacagtaccaagtccagttttggaagatgcttatcctgattaaagaagattatttcccgaggatcgaggctatcaccagtagcggccagatgggatccttcattcgattaaaacagttcttagaaaagtgcctacagcacaaagatatcccggtgcccaaagggtttctgacaagttcattttggaggtcttag

SEQ ID NO: 189157 - DNA, 2490 bp, Artificial Sequence
  Description of Artificial Sequence: Synthetic coding sequence
atggccctgaccagcatcaacgccacccccacccagctgagcagcagttccaattgccttagtgacacaaaccaaaacaaacagagctcggagtctgcagtttcttccaccgtcaatccagtggcgatacataagcgcagcaaggtgaagacagagcctgagggcctgcgccctgcctctccgctcgcactcacacagggccaggtgtccggccacggtagctgcggctgtgcattgcctttatcccaggagcagcttgctgatttgaaggaggacctggacagagacgactgcaagcaggaggctgaggtggtgatttatgaaacgaattgtcattgggaagactgcaccaaggagtatgacacccaggagcagctcgtgcaccacattaacaacgagcatatacacggcgagaaaaaggaattcgtgtgtcgatggcaggcttgtacacgagagcagaagccattcaaggcacagtatatgctggtcgtgcatatgaggcgtcacactggtgaaaaaccacataaatgtacttttgaaggttgttctaaggcctattcacggctggagaacctcaagacccatttaagatcacatactggagaaaaaccttatgtgtgtgaacatgaagggtgcaacaaagccttctccaatgctagcgatcgagctaagcaccagaacagaacacactcaaacgaaaaaccctacatctgcaagattccagggtgcacaaagaggtacactgaccctagttcattgcgcaagcacgtcaaaacggtacacggaccagatgcccacgtgaccaagaagcagcgcaacgatgtccatctacgaacccccctcttgaaggaaaacggcgattccgaagccgggactgaaccaggcggcccagagtctactgaggcaagctctacctcccaggctgtcgaagattgcttgcacgttcgggcaattaagacagagtcctctggcctttgccagtcctcaccgggagctcagtctagctgttccagcgagccatccccactgggcagtgcccctaacaatgatagtggcgtagaaatgccaggcacaggcccaggctcattgggtgatctgaccgcactcgatgacacgccccctggggccgacacaagcgcattagcggctccatccgccggcggtcttcagttgaggaagcacatgaccaccatgcaccggttcgagcagctgaaaaaggaaaaactaaagtctcttaaagatagctgcagctgggctgggcctaccccgcacactcgtaacacaaaattacccccactccccgggtcaggtagtattctggaaaattttagtggtagcgggggcggaggccctgctggactcttacctaacccgcggctgagtgaactaagcgccagcgaagtaactatgctgagccagttacaagaaagaagagatagcagcactagtacagtttcttccgcgtacacggtcagccgaagaagcagcggtataagtccttacttcagctcacgccgttctagcgaagcctctcccttgggagccggccgtccacacaatgcttccagcgccgactcttacgatcctatttcaacggatgccagcagacgcagttcagaggcgagccagtgttccggtggatccggcctcttaaatcttacgcccgcccagcaatacagtctgagagcaaagtacgcagccgcgactggcggcccccctccaacccccctgcctggccttgaacggatgagcctacggacgcggcttgccctcctcgatgctcccgagaggaccctccccgcaggatgtccccggcctctcggccctcggcggggatcagacggtccaacctatggccacggccatgctggggctgcacctgcattccctcatgaagccccgggtggaggcgcccgacgcgcatcagaccccgtgagacgccccgacgcactgagcctgcctcgggtacagcgatttcactcaactcataacgtaaaccctggccccttgccgccatgtgccgaccgacggggattacggctgcagagccatccatcaaccgacggcggcctggcaaggggcgcctattcccctcgacccccaagtataagtgagaacgtggcaatggaggccgtcgccgcaggagtggatggagccggcccagaagccgacctggggctgcctgaggatgacctggtgcttcctgacgatgtggttcagtacatcaaagctcacgccagtggggcactggacgaaggcaccggacaggtttatcccaccgagtctacaggattttccgacaatcctaggctacctagtccagggctccatggccagcgtcgcatggtggccgcagatagtaatgtgggccctagcgcccctatgctgggtggttgccaactaggttttggagctccaagctcactgaacaaaaataacatgcccgtgcaatggaacgaagcctcagctacatggctgtctggcacctag

SEQ ID NO: 189158 - DNA, 4761 bp, Artificial Sequence
  Description of Artificial Sequence: Synthetic coding sequence
atggagaccagcgccagcgccaccgccagcgagaagcaggaggccaagtccggcatcctggaggctgcgggatttccagaccctggcaagaaggctagccctttggttgttgcagccgctgcggcagccgccgtcgctgcccagggcgtgcctcagcacttgctgccaccttttcacgctccattgccaattgacatgaggcaccaggagggccggtaccactatgagccccattccgtgcatggagtgcacggcccgccggccttgtccggcagtcccgtcataagcgatattagtttgatccgcctgtcgccccacccagcaggtcctggtgagtctcctttcaacgcgccacacccatacgttaaccctcacatggagcattacctccggtctgtgcattcgtcacctaccctatccatgattagtgcagcaaggggtttgtctcccgccgatgttgcccaggagcacctcaaagagcggggcctgtttggtctcccggcgcctggcactactccttcggactactatcatcagatgacactggttgccgggcatcccgctccctatggcgacttactgatgcagtccggaggggctgcatcagcaccccatctccacgactatctgaaccccgtcgacgttagcaggtttagctctcctagagtgactcccagattatccagaaagcgcgccttaagcatctcgcctctatcggacgcatctctcgacttacaacggatgattcgaacctcgcctaattccctggttgcctacataaacaactccaggagctcatctgctgccagcggaagttatggacatctttccgctggagctctctctcctgcctttacttttccacatcctatcaatccggtggcataccagcaaattctatcacaacagaggggcctcggcagcgcttttggccatactcctccgttgatccagccgtctccgacatttttggctcaacagccgatggctttgacaagcatcaacgcaacaccgacccagctgagttccagtagcaattgcctttcagatactaatcagaataaacagagtagtgaaagcgcagtcagttccactgtaaacccagtcgctatccacaaacggtctaaagtaaaaacggagccagaaggccttcggccagcatctccattggccctgacccagggccaggtgtctggccatggcagttgcgggtgtgctctgcctctgagtcaggaacaactagctgacctgaaggaagacttggacagagacgattgcaagcaggaggccgaggtggtaatctacgaaacaaactgccattgggaggattgcacaaaggaatacgatacacaggaacaactggttcaccacatcaataatgaacacatacatggggagaaaaaagaattcgtctgtcggtggcaagcttgtacccgagaacagaaaccctttaaagctcaatacatgctggtcgtccatatgagaaggcacaccggggagaaaccccataagtgtacattcgaaggttgcagcaaagcttatagcagactcgaaaatctgaagacgcacctgcgttcacataccggggaaaagccatacgtatgtgagcacgaaggctgcaacaaggcttttagcaacgcatcggatagagcaaagcatcaaaaccgcacccactctaacgaaaaaccctatatctgcaagatcccaggttgcacaaagagatataccgatccgtcttctctgagaaagcacgtgaaaacagtacatggtccagatgcacacgttacgaaaaaacagaggaatgacgtccatctacgaactcccctgctgaaagagaacggggactctgaggcaggcactgagccgggaggacccgagagcactgaggctagcagtacttcacaggctgtagaggactgcctgcatgtacgggccataaaaaccgagtcaagcggcctatgtcaatccagccccggcgcccagagctcttgcagcagcgaaccctccccactcggatccgccccaaataacgattctggggtagagatgccgggtacagggcctgggtcactcggtgatctgaccgcgttggatgatacccctcccggagctgatacctccgccttagcagcccctagcgctggaggcctgcagctacgaaaacatatgacaactatgcatcggttcgaacaattaaagaaggagaaactcaagtctttgaaggatagttgcagttgggcaggacccacccctcacaccaggaataccaaattacctcctctgcccggtagcggctcaatcctcgagaacttctctggttccggcggtggtggcccagccggtctgttgccaaaccctagactctccgagcttagtgcatcggaggtcactatgttgtcccagctacaggaaaggcgagatagcagtacgagtactgtttcatctgcctacactgtgagtcggaggagcagtgggattagtccctacttttcttccaggcgctctagtgaagcatccccgttgggagccggccgacctcacaatgcctcaagcgcggatagctatgatcccattagcacggacgcgagtaggcggtcttccgaagcaagtcaatgctccggggggtcagggctgctgaacctgactcccgcacagcagtacagtttacgggcaaaatatgcggcagcaactggtgggcctccgcctacaccgctcccgggcctcgaaaggatgtcgctaaggacacgtttggcgctactagacgcacccgagagaactctccccgccggttgtcctcggcctctcgggcctcggcgtgggagcgatgggccaacttatggccacggacacgcaggcgccgcacccgcttttccccatgaagcgcccggagggggcgccagaagggccagcgacccagtcagaagaccagacgccttgtcactccctagagttcagcggtttcattcaacacataatgtgaaccccgggccgttacccccatgtgccgataggagagggctgcggctacagagtcatcccagcacagatgggggtctagcccggggagcttatagtccacgtcccccaagcatcagtgaaaacgttgccatggaagctgtggccgcgggagtggacggtgctgggccagaagccgatcttggactccctgaggacgaccttgtcttgccagatgatgtggtgcagtacatcaaggctcatgctagtggtgcgctggatgaaggtacaggacaggtatatcccactgagtccacaggattcagtgacaatccgagactgccatctcccggcctgcacggacagcgtagaatggtcgctgccgatagtaatgtaggcccatccgccccaatgctaggcggatgtcagctgggatttggagccccttcttcacttaacaagaataacatgccagttcagtggaacgaggtgagtagcggcaccgtcgacgcgttggcatcgcaggtcaaaccaccccccttcccgcagggaaacttggccgtagtacagcagaaacccgctttcggtcagtaccccggctatagtcctcagggattgcaggccagtccagggggcctggatagtacgcagcctcaccttcagcctcgcagcggcgctccgagccaggggatccctcgcgtgaactacatgcagcagctcagacagcccgtggcgggaagccagtgccccggaatgacgaccaccatgtctcctcatgcttgttacggtcaggtacacccccagctgtcccccagcactatcagtggggcactaaatcagtttccacagagttgtagcaatatgcctgccaaaccaggccatctagggcatccacagcagacagaagtggcaccagatcccactaccatgggcaatagacacagggaattaggcgtcccagattcagcactcgccggggtgccgccccctcacccagtccagtcttacccgcagcaatctcatcatctagctgcctctatgtcccaggaagggtatcaccaggttccctcacttctgcctgccagacagcctggctttatggaaccccagaccggccccatgggggtcgctacagctgggttcggactcgtccaaccccggccaccgctggagccttctccaaccggacgccatcgcggggttcgggcggtgcaacagcagctcgcctacgctcgagccaccggacacgccatggccgcaatgccgtccagccaggagacagccgaagcagtcccgaaaggggccatgggcaacatgggctcagtgcctccccagccacctcctcaagacgcagggggtgcgcctgatcattccatgctatactattacggacagattcacatgtacgagcaggacggggggctcgagaacttagggtcttgtcaggtcatgcgtagtcagccacctcagccccaggcctgtcaagactcgatccagccacagcctcttcctagccctggggtcaatcaggtcagtagtacggtcgactcgcagctactggaggccccacagatcgactttgacgccatcatggatgacggggatcatagcagtctgttctcaggggcactgtccccaagtcttctccactcgttaagccagaacagcagccgactcacaacaccccgcaacagcctcaccttacctagcatacccgcaggtattagtaatatggcggtaggcgacatgagttcaatgctcacatccctagccgaagaaagtaaattcctgaatatgatgacctag

SEQ ID NO: 189159 - DNA, 249 bp, Artificial Sequence
  Description of Artificial Sequence: Synthetic coding sequence
atggagaccagcgccagcgccaccgccagcgagaagcaggaggccaagagtggcatccttgaggcggccggctttcctgatccaggaaaaaaagccagccccttagtggtcgcagctgccgctgctgctgctgtggctgcccagggtgtgcctcaacacctgcttccacccttccatgcccctttgccgattgacatgagacaccaggaaggtcggtaccactatgaacctcacagcgttcacggatag

SEQ ID NO: 189160 - DNA, 660 bp, Artificial Sequence
  Description of Artificial Sequence: Synthetic coding sequence
atggagaccagcgccagcgccaccgccagcgagaagcaggaggccaaatccgggatcctggaggcagcaggtttccccgaccctggaaaaaaggcatctccacttgtggtcgccgctgctgcagcagcagcggtcgcagctcagggggtccctcagcatcttctgcccccctttcatgccccacttcccatcgacatgaggcatcaggaaggccgctatcactacgaaccacactccgtacatggcgtgcacggtgtgccctttttgcaacctgccggtgacgcccctcctgagcctcaagctggagcggtgcatctacccacgcttcgaaggcagcccggcccagctgctgatgatcctcatctaacacaactggcttctggccttcaccagcagctgccgaagcagctgggcgggcaacggtttttacgcgccagtgtgagcggatgcccacagcccagcctgcaccttcctccacctcaccagccacgcggtctaccagccgattcggaaccggccgaaggcagcggtgtgtccctctggacacacacgacccctgatcctgccctgacacacttacctggccctgccgcccacgggcctcacctgcaccaatgccatgctcacccagcccagcagcagcaacagctcagtgagtag

SEQ ID NO: 189161 - DNA, 4761 bp, Artificial Sequence
  Description of Artificial Sequence: Synthetic coding sequence
atggagaccagcgccagcgccaccgccagcgagaagcaggaggccaagtcagggatccttgaggccgccggatttcccgacccaggcaaaaaggcatccccactggtcgtggcagctgctgccgctgctgccgtggcagcacaaggggtgccacagcatctgcttccgcccttccacgccccactgcctattgacatgcggcaccaagaagggcggtaccattacgaaccacattccgtgcacggcgtgcatgggccgccggctctcagcggttcacctgtcataagtgatatcagtcttattcggctctcaccgcaccctgcaggccccggagagtctccctttaatgccccccacccctacgttaacccacacatggagcactacctccggtctgttcactcaagccctacgttgtccatgatctctgccgctagggggctaagcccagcagacgtggcccaagagcacctgaaagagcggggactgttcggactccctgccccgggcaccacgccatcagactattatcaccaaatgactcttgtcgcaggccatccagcaccgtacggcgacttgctcatgcagagtgggggcgctgctagcgctcctcacctgcacgattacctgaacccagtggacgtgtcccggttttcctccccacgggtgacaccacgactcagtagaaagcgcgccctgtctatttctcccttgtccgatgcgagcctagacctgcagcgtatgatccgtactagccccaactccttggttgcctacataaataacagtcgctcttcgtcagctgcttccggatcctacggccatttgagtgccggtgcattatcgccagcctttacctttccacacccaattaaccccgtggcctatcagcaaatcctgagccaacaaaggggcttgggaagtgcgttcgggcacacacctccccttatccagccttccccaacctttctcgcacaacagcctatggccctaaccagtattaatgcgactcccacacaactgagcagcagtagtaattgtctctccgacaccaaccagaataagcagtcttccgaatcagcagttagcagtacagtgaaccctgtagccattcacaagcgcagcaaggtgaaaactgagcccgaaggtctccgcccggctagccccctggccctgacccagggacaagtttccggtcacggatcctgtggatgcgcccttccattatcccaagagcagttggccgatcttaaagaggatttagatagggacgactgcaagcaggaagccgaagtcgttatctacgaaacaaactgtcactgggaggactgcacaaaggaatatgacacccaagagcagctggttcatcacatcaataatgagcacatccacggcgagaagaaagagtttgtctgccggtggcaggcttgcactagggaacagaaaccattcaaagcgcaatacatgctggtagtgcacatgcggcggcataccggcgaaaaaccccataagtgcacgttcgaaggttgctccaaggcttattcccggctggaaaacctaaagacacacttgagatcgcacaccggtgagaagccctatgtgtgtgagcatgaaggatgtaacaaggccttttccaacgcgagcgatcgagctaaacatcagaacaggacccactctaacgagaaaccttacatctgcaagatccctggttgtactaaacgttacacagacccctcatccctaaggaagcatgtgaagactgtccatggtccagacgctcatgtaacgaagaaacagcgcaacgacgtgcatctacgaacacccctgctgaaggaaaatggcgactcggaggctggcactgagcctggcggacctgaaagcaccgaggcttcaagcactagtcaggctgtggaggactgcctacatgtgcgggccatcaagacagaatcttcaggtctgtgccaaagctcccccggagctcagtcatcatgtagttctgaaccttctccactcgggagtgcccctaataatgattcaggcgtggaaatgccaggcactggaccggggagtctcggtgatctcactgccctcgatgatacgccacccggcgccgatacatcagccctcgcggcaccaagtgctggtgggttacaactccgaaagcatatgaccactatgcatagatttgagcagctgaagaaggagaaactaaaatccctgaaagactcctgctcatgggctggacccaccccacataccaggaacaccaaacttcccccgctccctgggagcggtagcatccttgaaaacttcagcggttccggcggcggcgggcccgctggactgcttcctaacccccgcctctcagagctctcagcttccgaggtgaccatgcttagtcagttacaggaaagacgagactcaagtaccagtacagtctcttctgcgtatacagtgtcaagacggtcctctggcatttccccctatttcagcagccgccgttccagcgaggcttcccccctcggcgcaggccgcccacacaatgcaagctccgccgactcctacgatcccattagcactgacgcaagcaggagaagctctgaggcaagtcagtgctctggcggctctgggttattgaatttgactccggctcagcaatacagcctgcgtgcaaagtatgccgccgccaccggtggacctccccccactccactccccggcctggagaggatgtccttacgcactagactggcccttctcgatgccccagaacggaccctgcctgccgggtgcccccgcccactgggcccaagacgaggatctgatggccccacatacggacacggtcacgccggtgctgcgcccgcatttcctcacgaagccccaggtgggggcgcccgacgtgctagtgaccccgttcggaggcccgacgccttatctttgccgagggtgcaacgttttcactcaacgcacaatgtcaaccctggcccattgcctccctgcgctgacaggcgaggacttaggttacagtctcatccttccacggacggtggcctcgcgcgcggggcctactcaccgaggcccccctccataagcgaaaacgtggccatggaagctgtcgctgccggcgttgacggggctggccccgaggccgacttggggctgccagaggacgatctggtattaccggacgacgtcgttcagtatattaaggcccatgcttcgggcgcactcgatgaaggcaccgggcaagtgtatccaactgaaagcacaggcttctctgataatcccagattgccaagtccgggtctgcacggtcaacggcgcatggttgccgccgactcaaatgtgggcccctctgcccctatgctgggcgggtgtcagcttgggttcggggcgcctagtagcctgaacaaaaataatatgcccgtgcaatggaacgaagtgtcctctggaacggtggacgccctcgcctctcaagtgaagccccccccattcccccaggggaatctggcggtggtgcagcaaaagcccgcattcggccaatacccagggtattctcctcagggcctgcaggcatcacctggcggcctcgatagcacccagccacatctacagccaagatccggcgctccttcccaagggatcccgcgcgtaaactatatgcaacagctgcgccagcccgtggctggctcccagtgccctggaatgacgaccactatgagccctcatgcctgttacggccaggttcacccccagttatcgcctagcactatttctggagccctaaatcagttcccgcaatcgtgtagtaacatgcctgccaagccaggccatttgggccacccacaacagacagaagtggctcctgacccgaccacaatgggtaaccggcacagagagctgggggtgcccgattctgctctggcgggcgtgccccctcctcaccctgtccagagctaccctcagcaatcccatcacctggctgcatcaatgtctcaggaagggtaccaccaggtacctagcctgctgcccgctcgacagcccggcttcatggaaccccagactggaccaatgggagttgccacagccggttttggactggtacagccgagaccgccacttgaaccaagtccgactggccgacaccgcggagtgcgcgccgtccagcagcagttggcgtacgcacgcgcgactggccacgccatggccgccatgccctcatcacaggagaccgccgaggccgtacctaagggggcgatgggtaacatgggttccgtcccacctcagccacccccccaggacgcaggcggagcaccagatcactccatgctctattactatggccaaatccatatgtacgaacaagacgggggtctcgaaaatctgggctcatgtcaagtaatgagaagccaacctccgcaacctcaagcctgtcaggactctatacagccgcagcctctgccatctccgggcgttaatcaggtgtccagcaccgtcgacagccagctcctcgaagctcctcaaatcgattttgacgctatcatggatgacggagaccatagctcactgttttctggggccctctctccgagccttttgcactcgctgagccagaactccagccgacttaccacgccccgtaactcactcaccctcccatcaataccggctggcattagcaacatggctgtgggggatatgagcagtatgctgacatcactggctgaggagtctaaattccttaacatgatgacatag

SEQ ID NO: 189162 - DNA, 4743 bp, Artificial Sequence
  Description of Artificial Sequence: Synthetic coding sequence
atggaggcccagagccacagcagcaccaccaccgagaagaagaaggtggagaatagcatagtgaagtgcagcactcgcacagatgttagcgaaaaggctgtggcatcgtcaaccacctccaacgaagatgagtcacctggccagacataccacagggagagacggaacgctataacaatgcagcctcagaacgtacaggggctatctaaggtgagtgaagagcccagtacaagctccgatgaacgcgcctcattgattaaaaaagagattcacggctccctaccccacgtggccgagccatctgtaccttatcgcgggacggttttcgccatggacccgcgaaatggttacatggagcctcactatcatccgccccatctcttcccagctttccacccacctgtccctatcgatgcaaggcaccatgaaggaaggtaccactacgaccccagccctataccacccctccacatgacttcagccctcagctcttcccctacatacccagatctgccattcatccggattagcccacatcgcaaccctacagcagcctcggaatctccctttagcccgccgcacccgtacataaacccctacatggattacatacgctcactgcacagctctcccagtctgtccatgatcagcgccaccaggggcctgagtcccacagacgctccacacgcaggcgtgagccctgcagagtactaccaccagatggccttgctgactggtcagcgtagcccctatgccgacatcattcccagtgccgcaaccgcaggaacaggcgcaattcacatggaatacctgcacgccatggactccacccgctttagttctccccggctgtctgcacggccctccagaaagcgtacactctccattagcccgctatctgaccacagttttgacctgcagactatgattcgcaccagcccaaacagtctggtgactatcctcaacaactcgcggagcagttcctccgctagcggaagctacgggcatctgtctgcgtctgcgatctcccccgctttgagctttacgtactcatctgcccccgtgagcctgcacatgcaccagcaaatactctctcgccaacaaagcttaggcagcgcatttggccactcccctccccttatccaccccgcccccacattccccactcagcgtcccatccctggaattcctaccgtgcttaacccggtgcaggtgtctagtgggccttcagaatcctctcaaaataagccaacttcggaaagcgccgtaagctctacaggtgaccccatgcataataaacgctccaagatcaagccagatgaggatcttccatcccctggagctagaggtcagcaggaacagccagagggaaccaccctggttaaggaagagggagacaaggatgagtcaaagcaagagccagaggtaatttacgagacaaattgtcactgggaaggatgcgcgcgcgagttcgacactcaagagcagctggtgcaccatattaacaatgaccacatacacggcgagaagaaagagtttgtgtgccgctggctcgattgttcaagagagcagaagccattcaaagcacagtatatgctggtcgtccacatgcgacgtcacaccggggagaaaccccacaaatgcactttcgagggatgcactaaggcgtattctaggctggagaacctgaaaactcatctccgcagccacacgggagaaaagccttatgtctgtgagcatgaaggctgcaacaaggccttttccaacgcctccgatcgcgccaaacaccagaaccgtactcatagcaatgagaagccatacgtttgcaagatacctggatgcacaaaaagatataccgatccctcgtccctcagaaaacacgtaaaaaccgtgcacggccccgaagcacacgtaactaaaaagcagcggggcgatatacatccaaggcccccgccgccacgagatagcggctcacacagccagagccgctctcccgggcggcccacccagggagcactgggagagcaacaagacttatccaatactactagtaagcgagaagaatgcctgcaggtcaaaaccgtgaaggcggagaaacccatgacctctcagccttcgcccggtggccagagtagctgttcttcccaacagagccccatatctaattactcgaatagtgggctggagctcccgctaaccgacggaggcagcattggcgaccttagcgcaattgatgagacacccattatggatagcactatcagtaccgcaaccacggccctagctctacaggcacgcagaaacccagcagggacaaaatggatggagcatgtcaagttggaaaggctaaagcaggtgaacggcatgtttcctcgacttaatcccattctgcccccaaaagctcccgcagtgagccctctgatcggcaatggaacgcagtctaataacacctgttctctaggcgggcccatgactcttctgccagggcgttcagacctgtctggagttgacgtgacgatgctgaatatgctgaacagaagggattcctccgcctctacaatatcctcagcctatctcagtagtagaaggtcctctggcattagcccctgttttagttcccggagaagctctgaggcttcgcaagccgagggtagaccacaaaatgtgtccgtggctgactcatatgatccgatttccacggacgcaagccgacggagcagtgaagcatcacaaagcgacgggctgccctctcttctttccctgaccccagcgcaacagtaccggctcaaggctaaatatgcagcagcgactggtggacctccccccacccccctgcctaacatggaaaggatgagtctcaaaactcggttggccttgttgggcgacgctttggagccaggtgtggccctaccccctgtgcacgctccccgtcgctgtagcgacggcggcgcccatggctatggcagaaggcatttgcagccccatgacgcacctgggcatggggtccgacgcgcttccgacccagttagaacagggagcgagggactggcccttccgcgagtacctcggttcagtagcctttcttcctgtaatccccccgcaatggccacatctgctgaaaaaagatctttggtgctgcagaattacacccgccctgagggtgggcagagccgaaattttcatagcagtccatgcccaccatccatcacagagaatgtcacactggagtcacttaccatggacgcggatgcaaatctcaacgacgaagactttctgcctgatgatgtggttcaatacctcaactcccagaatcaggctggttatgagcagcatttcccctcagcattacccgatgattcaaaggtgccccatggcccaggggactttgatgccccaggcctccccgactctcatgccggccaacagttccatgctctggagcaaccgtgtcccgaggggagcaagaccgacctacctatccaatggaacgaagtgtcgtccggttcagcggatttgagttcgtctaagctgaagtgcgggccccgccccgccgtgccccagacaagggctttcggcttctgtaacggaatggtggtgcacccacaaaaccctttacggtcaggccctgccggtggttaccaaaccctgggtgagaactccaacccatatggggggcctgagcacctaatgctccacaactcaccaggatcagggacaagcgggaacgctttccacgagcagccctgcaaggctccccagtacggcaattgtctgaacagacagcctgtggctcccggtgctcttgatggggcatgcggtgccgggatccaagcgtctaaacttaagtccacccctatgcagggatctggaggacagctcaacttcggcttaccagtagcacctaatgagtccgctggctcaatggttaacggtatgcagaaccaagatcccgtcggccagggctaccttgcccaccagcttcttggggattccatgcagcatcccggtgcagggcggcccgggcaacagatgttaggtcagatctccgctacctctcacatcaatatatatcagggcccagagagctgtttgccaggggcacatggtatggggtcccagcccagtagtctggccgttgtgaggggctatcagccttgtgcaagtttcggtggtagtcggagacaggccatgcctagggactcactagccctgcagagtggacagctatccgatacttcacagacctgtagggtcaacggcatcaaaatggaaatgaagggacagccccaccctttgtgttcaaacctacagaactactccggccagttctatgaccagaccgtgggattttcacagcaggacacaaaagccggaagtttcagcatatctgatgcatcctgcctgctgcagggtacctcagccaagaatagtgaactgttgtcccccggagcaaaccaagtcacctcgacggttgatagtcttgattcccacgacctggagggggttcaaatagatttcgatgccatcatcgatgacggcgatcactcctctctgatgtctggcgccctttccccatcaatcattcaaaacctgtcccactcaagttctcgactcaccaccccacgcgcaagcctgccctttcccgccctttccatgtctacaacgaacatggctatcggagatatgtccagccttttaacgagcctggccgaggaatccaaattcctggcagtgatgcaatag

SEQ ID NO: 189163 - DNA, 543 bp, Artificial Sequence
  Description of Artificial Sequence: Synthetic coding sequence
atggaggcccagagccacagcagcaccaccaccgagaagaagaaggtggagaatagcatagtcaagtgttcaactaggaccgacgtgagcgagaaagctgtggcatcttcgacgacctcaaacgaagatgagtcacctggacagacataccatcgggagcggcgcaatgctatcactatgcagccacaaaacgtacaggggctgagtaaagtgagcgaggagccgtccacttcctctgacgaaagggctagtctgattaagaaagagatacatggctccctgccacacgttgctgagcctagcgttccttaccggggaacggtcttcgctatggatccgcgaaacggttacatggagccgcactatcatcctcctcacctttttccggcgttccatccaccagtgcccattgatgcgaggcatcacgagggccggtatcattatgatccgtcacccattcctccgttacatatgactagtgcactgtcctcttcaccgacttatccagaccttcctttcatcagaatttcgccacataggtag

SEQ ID NO: 189164 - DNA, 1131 bp, Artificial Sequence
  Description of Artificial Sequence: Synthetic coding sequence
atggccgccctgggcgacatccaggagagccccagcgtgcccagccccgtgagcctgtctagtcctggaacaccggggacccagcatcacgagccgcagttacacctccacgggcaccaacatggaagtcccggctcttctcctaaagtgctgtctcagccttccgatctggatctgcaggacgtggaagaggtggaaattggtcgcgatactttctggcctgacagcgagcccaaaccggagcaggcaccccgctcccccggctcacaggcaccagacgagggggccggcggcgctctgcggagcctgctgagatccttgccccgacgtgcacgctgctcagctggctttggccctgagagctccgctgaaaggcctgcggggcagcctcctggcgcagtcccctgcgcccagcccagaggagcctggcgggtaacgctcgttcagcaggcggcagccggacctgagggagcaccagagagagctgccgagctcggagtgaatttcggtaggagccgtcaaggatccgcaaggggcgctaagccccaccgctgcgaagcttgcggcaagagctttaaatacaactcccttcttttgaagcaccagcgaattcacactggagagaaaccttacgcctgccacgaatgcgggaagcggttccgcggctggagtggctttatccaacaccatagaattcacaccggggaaaagccctacgaatgtggacagtgcggcagagcgtttagccatagtagccacttcactcagcatctgcgtattcataacggcgaaaaaccctacaaatgcggggagtgcggacaagcatttagccagtcttccaacctggtcagacaccagcgcttgcatactggtgagaaaccatacgcgtgttcccagtgcggaaaggccttcatatggagctcagtactgatagagcatcaacgaatccacaccggggaaaagccatacgaatgctctgattgcggcaaggcctttaggggcaggtcacacttcttccgtcatctgcgaacacataccggtgagaaaccctttgcgtgcggcgcctgtgggaaagcgttcgggcagagttcccagctgattcaacaccaacgagtccattaccgggaatag

SEQ ID NO: 189165 - DNA, 1131 bp, Artificial Sequence
  Description of Artificial Sequence: Synthetic coding sequence
atggccgccctgggcgacatccaggagagccccagcgtgcccagcccagtctcccttagttcaccgggcacccctggtactcagcaccacgaacctcaactgcatcttcacgggcaccagcatggcagtccaggatctagccctaaagtgctgagccagccctccgatctggacctgcaagatgtggaagaagtagaaattgggcgagacaccttttggcccgattccgagcccaagcctgaacaagcccccagatctccaggtagtcaggcaccagatgagggagcaggcggcgcactgcggagcctgctgcggtccctgcctagaagggcccgctgctctgcagggttcggccctgaaagtagcgctgagcgtccggctggtcaaccccccggggccgtgccttgcgcacagcctaggggcgcgtggagagtgacgcttgttcaacaggctgcggccggccccgagggagcccccgagcgagcagccgaactgggtgttaacttcggccggtctagacaggggtccgctaggggcgcaaagcctcatcgctgcgaggcctgcggcaagagcttcaagtacaactcactgctgctgaagcaccagcgtattcacacaggagagaagccctacgcatgccacgagtgcggcaagagattccgcggctggagcggttttatccagcaccacagaatccatacgggggagaagccgtatgagtgcggccagtgcggccgcgcgtttagccactcatcccacttcacccagcacttacggatccacaatggtgaaaaaccatacaagtgcggtgagtgcggccaggctttttcacagtcatccaatctggtgaggcatcagcgattgcataccggggagaaaccatatgcctgcagtcagtgcgggaaggcatttatatggagctccgtccttatagaacatcagaggatccatacgggcgaaaaaccttatgagtgcagtgattgcggcaaagcttttagaggaaggtctcatttctttcgccatctgaggacacatactggtgaaaaaccctttgcatgtggcgcttgcgggaaggcttttggacagtcatctcagctcatacaacaccagagggtgcactatagggaatag

SEQ ID NO: 189166 - DNA, 801 bp, Artificial Sequence
  Description of Artificial Sequence: Synthetic coding sequence
atgcgggtgaccctggccaccatcgcctggatggtgagcttcgtgagtaattattcgcacactgctaacattctgcctgacattgagaatgaggactttattaaagactgcgttcgcattcataacaaatttaggtcagaggtgaagccgactgccagtgatatgctttatatgacctgggatcccgccctcgctcagatcgccaaggcctgggccagtaactgccaattcagccacaatactcgccttaaacctccgcacaagctgcatcctaattttacaagcctgggcgagaacatctggaccggctcagttccaatcttcagcgtttcctcagccattaccaactggtacgatgaaattcaggactatgactttaagactaggatttgcaaaaaagtctgcggacattatacccaggtggtgtgggcagattcatacaaagtgggttgtgctgtccagttctgccccaaagtgtccggcttcgacgctctgagcaatggggcgcatttcatctgcaactacggaccaggaggcaactatccaacttggccgtataagcgtggtgcaacatgctcggcgtgcccaaacaatgataaatgtctggacaatctttgtgtgaacagacagagagatcaggtcaagaggtactactccgtagtgtaccctgggtggcctatctacccgaggaacagatacacatctctctttcttatagtgaatagtgtgattcttatactgtctgttatcattacgattcttgttcagcacaaatacccaaatctggtcctgctggactag

SEQ ID NO: 189167 - DNA, 429 bp, Artificial Sequence
  Description of Artificial Sequence: Synthetic coding sequence
atgagcgacagcctggtggtgtgcgaggtggaccccgagctgaccgagaagctgaggaagtttcgattcaggaaagaaacagacaatgccgccataataatgaaggtggacaaggatcgccaaatggttgtgctcgaggaagaatttcagaatatatccccagaggagttgaagatggagctgccagaacgtcagccccggttcgttgtgtactcttacaagtatgtccatgatgacgggcgggtgtcttatcccttatgtttcatcttctctagtcctgtaggttgtaaacctgaacagcagatgatgtatgctggcagcaagaaccgcctggtccagaccgcagagctgaccaaagtgtttgagattagaactactgatgacttgactgaagcttggctgcaggaaaagctgagcttcttcaggtag

SEQ ID NO: 189168 - DNA, 429 bp, Artificial Sequence
  Description of Artificial Sequence: Synthetic coding sequence
atgagcgacagcctggtggtgtgcgaggtggaccccgagctgaccgaaaaactgaggaagtttcgctttcgtaaagagaccgataacgcagccattattatgaaggtcgacaaagaccgtcagatggtagtcctggaagaagagttccagaatatttcccccgaggaattaaagatggaactgcccgagcgccagccgaggtttgtcgtatacagctataaatacgtacacgatgatggaagagtgtcctatcctctgtgttttatcttcagcagcccagtggggtgcaagccagaacagcagatgatgtacgctggctcaaaaaataggctagtccagacggctgagctcacgaaggtttttgaaattcgcacaaccgatgacctaacagaagcttggcttcaggaaaagctcagcttcttcagatag

SEQ ID NO: 189169 - DNA, 1299 bp, Artificial Sequence
  Description of Artificial Sequence: Synthetic coding sequence
atggagcggcggcggatcaccagcgccgcccggcggagctacgtgtcatcaggggaaatgatggttggcggtctggctcccggtagacggttggggccaggaacccgcctgtccctggctaggatgcctccaccactgcccacgagagtggacttttctttggccggtgccctcaacgctggcttcaaggaaacgagagcaagtgaaagagccgaaatgatggaactgaacgaccgattcgcctcctatattgagaaggttcgatttctggagcagcaaaacaaggcactcgccgccgagctcaaccagctgcgagcgaaagagcctactaagttagctgacgtctatcaagccgaactcagagagctcaggctgcggctcgatcagctgacagccaacagcgctagattggaagtggaaagggataatctcgcgcaagatctcgccaccgtgaggcaaaaactccaggatgagacgaacctgcgccttgaggccgaaaataatctggcagcctatcggcaggaagccgatgaggctacgctggctcgtctggacctggaacgcaagattgagagcctcgaagaagagatccgatttcttcgtaaaattcacgaggaggaggtgagggagcttcaggagcagctggccaggcaacaagttcatgtggaattagatgtggccaagccagatcttaccgctgcgttaaaggagatccgcacccagtatgaggcgatggcctcgagtaacatgcatgaggcagaagagtggtatcggagtaagttcgcagatttgacagacgctgctgctcgcaatgccgaacttttgcggcaagcaaagcacgaggcaaatgactataggaggcaactgcagagtctgacatgcgatttggaatccctaagaggaaccaacgagtcccttgaaaggcagatgagagaacaggaggagcgtcatgttagagaggccgcaagttatcaagaagctctcgcaagattagaagaagaaggacagtcacttaaagacgagatggcaaggcatctacaagagtatcaggacctcctgaacgtaaagctggctctcgatatcgaaatcgcaacgtatagaaagttacttgaaggtgaagaaaaccgaataaccatccctgtccagacgtttagcaatttgcagatccgcgaaacctccttggacaccaagtcggtctcggaaggacacttgaagaggaatatcgtagtcaagactgtggaaatgagagacggggaagtcattaaagaaagcaaacaagaacacaaggatgtgatgtag

SEQ ID NO: 189170 - DNA, 540 bp, Artificial Sequence
  Description of Artificial Sequence: Synthetic coding sequence
atggagcggcggcggatcaccagcgccgcccggcggagctacgtgtcctcaggtgagatgatggtgggcggcttggccccgggcagaagactagggcccggaacccggttgagtctggctaggatgcctccccccctgccgactagagttgacttcagccttgcaggagcactcaatgctggttttaaagaaacccgggctagcgaacgagctgaaatgatggaacttaatgacagatttgctagctatatcgaaaaggtacgtttcctcgagcagcagaacaaggcactggcagccgagcttaatcaactcagggcaaaagagcccacaaaactggctgacgtctaccaggctgagttacgtgagctgcggctgcggctggaccagcttacagccaatagtgcccggctcgaagtagagagagataatttagctcaggacctggccacagtccgccaaaagaagcagatgaaaccgccctggcctgtatggatatggagaggcagactgagtcgatggcggcgtaggagtggcagctag

SEQ ID NO: 189171 - DNA, 1224 bp, Artificial Sequence
  Description of Artificial Sequence: Synthetic coding sequence
atggagcggcggcggatcaccagcgccacccggctgagcctggcccggatgcccccccctctgccaacacgcgtggacttctcacttgcaggcgcactcaacgctggcttcaaagagacccgggcctctgagagggccgaaatgatggagctcaatgacagattcgccagctacattgaaaaggtgcgattccttgaacagcagaataaagcactcgcagccgaacttaaccaattgcgagcaaaggagccaacgaaactggcggatgtgtatcaggccgagctgagagaactgcgacttaggctcgatcagctgaccgcaaattcagcccggttagaagttgagagagacaatctggcccaggacctcgctaccgtgaggcagaaactgcaagatgagacgaacctgaggctagaagctgaaaacaatctggccgcctaccggcaggaagctgatgaagcaacccttgcaagactcgacctggagagaaaaatcgagtccctcgaagaagagattcggttcctgagaaaaatccatgaagaagaggtgagggagctgcaggaacagctggcaagacaacaggttcacgtcgagttagatgttgccaagccggatctgaccgccgcccttaaggagatccgcacacagtacgaagcaatggccagcagcaacatgcacgaagcagaagagtggtaccggtcaaagttcgctgacctcactgacgccgccgcgagaaacgccgagttgctacgtcaggctaagcacgaggcaaatgattatagaagacagttgcagtctctgacttgtgatctcgaaagcctcagagggaccaacgaatctctagagcgtcagatgcgcgagcaggaggagcggcacgttcgagaggccgcaagctatcaagaggccctggcacggctagaggaggagggacaaagcctgaaggatgagatggcgaggcacctgcaagaataccaggacctgctgaacgtgaagttagctctcgatatcgaaattgccacctatcgcaaactgctggagggggaagaaaaccgaataaccatacctgtacagacattcagcaacctgcagatccgagagacctcactggataccaagagcgtcagtgagggccacctgaagcgaaacatagtcgtgaagacagtggagatgagggatggagaggtcatcaaggagagcaagcaggagcacaaagatgtgatgtag

SEQ ID NO: 189172 - DNA, 1296 bp, Artificial Sequence
  Description of Artificial Sequence: Synthetic coding sequence
atggagcggcggcggatcaccagcgccgcccggcggagctacgtgtcatctggggaaatgatggtgggcgggctggccccaggccggaggttgggtcctgggacccgcctgagcctcgcccgcatgccgccccccctgccaaccagagtggatttttccttggctggagctctgaatgctgggtttaaagagacacgagcttctgagcgcgcagagatgatggagctgaatgatcgctttgcttcgtatatcgagaaggtgaggtttctggaacagcagaataaagctctggccgcagagcttaaccagctcagggcaaaggagccaactaagctggccgatgtatatcaggctgagctgcgagagttgcgtttaaggctggaccagctaacagccaattctgctcgcctcgaggttgagcgggacaacctagcgcaagatctagctacagtgagacagaagctgcaagatgagacaaatcttcggcttgaagctgagaacaatctggccgcgtacaggcaagaggccgacgaggctaccctcgcgagacttgacctggagaggaagatcgaatcactggaggaagagattaggtttctccggaaaatccacgaggaggaagtgcgtgagctccaagaacagctggctcggcagcaggtgcatgttgagctggacgtcgctaagcccgacctcactgctgctctgaaagagatcagaacacagtatgaagctatggcttcgtcgaacatgcacgaagctgaagagtggtaccgtagcaagttcgctgatcttaccgacgcagctgcccgaaacgccgaactattgagacaggcaaagcacgaggcgaacgattaccggcgtcaattgcagtctcttacctgcgacctggagtccttgaggggaaccaatgagagcttggaaagacaaatgagagaacaggaggagcgccacgttcgagaggccgcatcgtaccaggaggctctggccagactggaagaggagggccagtccttaaaggacgaaatggcccgtcacctccaggaataccaggatctgctgaacgtcaagttagctctggatatcgagatagcgacctaccgcaagctgctggaaggggaggagaatcgcattaccatccctgtgcaaacattctctaacctgcagatccgcggggggaaatccaccaaggatggggagaatcataaagtaacaagatatcttaagtccctgacaattagggtcattcccatccaagctcatcaaatagtcaatggcactccccccgcaagggggtag

SEQ ID NO: 189173 - DNA, 1317 bp, Artificial Sequence
  Description of Artificial Sequence: Synthetic coding sequence
atggagcggcggcggatcaccagcgccgcccggcggagctacgtgtcctccggggaaatgatggtaggcgggctcgccccgggcagacgactaggccccggcacccggctaagtttggccagaatgcctccaccgctgccaacccgagtggactttagcttggccggggcactcaacgccggttttaaggagactagggcatccgagcgagcagagatgatggagctgaacgaccggtttgcttcctacatcgaaaaggttcgttttctggaacagcaaaataaggcactggccgccgaactgaaccagctccgtgcgaaagagcccaccaaacttgctgatgtgtaccaggcggaattgcgcgagctacggctccggctggatcagctcactgctaacagtgcccgactggaggtcgagagagacaaccttgcgcaggacctcgccaccgtcaggcagaagctgcaggatgagacaaatctaagactcgaggccgaaaataatctcgctgcctacaggcaggaagcggacgaggcaaccctcgcccggcttgatctcgaacgtaagattgagagtctggaagaggagataagatttttgcgcaagatccacgaggaagaggtgagggagctgcaagaacagctggcgcgccagcaggtccacgtagagcttgatgtagctaaacccgacctcacggcggccttgaaggaaatacgcacacagtacgaggcaatggcctcatctaatatgcacgaagctgaggagtggtatcggtcaaagtttgctgacctgaccgacgctgcagccaggaatgcggagctgctgcgccaggccaaacatgaagcaaacgattatagaaggcagctccagtccctaacttgcgatctggaaagtctaagaggtacgaatgagtccctagagagacagatgcgggaacaggaggagcgtcatgtgagagaggccgctagctaccaggaagccctcgccaggttggaggaggagggtcagtctctgaaggacgaaatggccagacacttacaggaataccaggatctgctcaacgtcaagttggctcttgacattgagattgcaacttatagaaagttgcttgagggcgaggaaaatcggattacaatcccggtgcagacattttctaacttgcaaataagggggcagtactctagagcctcatgggaggggcactggagtccggctccatcaagccgggcctgtagactgctccagacaggaaccgaagatcaaggtaagggcattcaattatcattgggggccttcgtcacattgcaacgatcctag

SEQ ID NO: 189174 - DNA, 861 bp, Artificial Sequence
  Description of Artificial Sequence: Synthetic coding sequence
atggccgcccgggtgctgcgggcccggggcgccgcctgggccggcggtctgctgcagcgagcggctccctgttccctgcttcctcgcttgcgaacatggacctcaagtagcaatcgctcgcgggaggatagttggctgaaatccttattcgttcgcaaagtagacccacggaaagacgctcatagtaacctcctcgctaagaaagaaaccagcaatttatataaactgcagtttcataacgtcaaacctgaatgcctggaggcctacaacaagatctgccaagaagtattacccaaaattcacgaggataaacattatccttgtacccttgtaggaacttggaacacctggtatggcgagcaggaccaagccgtgcatctgtggagatacgaggggggatatcccgccctcactgaggtgatgaacaaactgagggaaaataaggagtttctggaatttcgcaaagctcgcagcgatatgttgctgagccgcaagaatcagctgcttttggagttctccttttggaacgagccagtgccacggagcgggcccaacatctatgagctgagatcctaccagctgcgaccaggtactatgatagagtggggtaactactgggcccgagccatacgattcagacaggatggtaatgaagcagttggtggctttttcagccagatcggacagctctacatggtccatcatctgtgggcataccgcgatttgcaaacccgggaggatatccgcaatgccgcctggcacaagcatgggtgggaggagctagtctactacacagttcccctaatccaagaaatggaaagccgtattatgatcccactcaaaacttcaccgcttcagtag

SEQ ID NO: 189175 - DNA, 744 bp, Artificial Sequence
  Description of Artificial Sequence: Synthetic coding sequence
atggccgcccgggtgctgcgggcccggggcgccgcctgggccggcggactgcttcagcgcgctgcgccatgctcgcttctcccacgtctgcgcacttggacatccagttcaaacaggagcagagaagattcctggttgaagtctctgtttgtcaggaaggtggatccaaggaaggacgcacattctaacctcctggccaagaaagagacttcaaacctttacaaacttcagtttaagcggtgttgccaacgttttactaagatcaatacaaccttggtgctctggtgggggcttggaacccgtgggatggcgtcccggactaaattagaattcctggagtttaggaaggcccgcagtgacatgttgctgtcacgcaagaaccagttgttgctggaattttctttctggaatgagcctgtgccaaggagcggtccgaatatttacgaacttaggtcataccagctacgaccaggcacaatgattgagtgggggaattactgggcaagggccataaggttcaggcaggatgggaacgaagccgtgggcgggttcttctcccagattggccagttatatatggttcaccacttatgggcttaccgtgatctgcagaccagagaggacattcgaaacgccgcctggcataagcacgggtgggaggagctcgtgtattataccgtcccacttattcaagagatggaaagcagaatcatgattcctctcaagaccagtccactccagtag

SEQ ID NO: 189176 - DNA, 4683 bp, Artificial Sequence
  Description of Artificial Sequence: Synthetic coding sequence
atggacgacgaggacggccggtgcctgctggacgtgatctgcgacccccaggcactgaacgactttctccacggctctgaaaagctagattccgacgaccttttagataaccctggtgaagctcagtctgccttttatgagggaccaggcctccatgttcaggaagcctcaggtaatcatctcaaccctgagccgaatcagcccgccccaagtgtcgacctcgactttttagaagatgatattttgggctctccggcaacaggtggcggagggggaggctcgggtggcgccgaccaaccttgtgacattctgcagcaatcattacaagaggccaatatcactgagcagactctcgaagctgaagctgagctggacctaggtccgttccagctgcctaccctgcagccggccgacggcggcgctggaccaaccggtgccggcggtgccgctgccgtggcggcaggtccacaggccctgttccctggcagtacagaccttctgggtctgcaggggccccctaccgtcctcacccaccaggccctcgtccccccgcaagatgttgtcaataaggccctgtccgtgcagccattcttacagccggtgggacttggtaatgtaactcttcaacccatacctggcctgcaggggcttcctaacgggagccctggaggggccactgctgccaccctcggcttggctccaatccaggtggtgggccagcctgtaatggctctgaatactccaacgagccaacttcttgctaaacaagttccagtgtccggctacctcgcctccgctgcaggcccgagcgagccagtaacactggcttcagctggtgtgtccccacagggagctgggcttgtgatacagaagaatctgagcgctgccgtggctactactctgaatggcaacagtgtgtttggaggtgctggcgcagcgtcagctccgacaggaaccccttccgggcagcctctcgctgttgcccccgggctgggatctagtcctctcgtgcctgcacccaatgttattctgcaccgtacccccacgcccatacaacctaagccagcgggtgtcttaccccccaagttgtaccagctaacccctaagccttttgctcccgcaggcgccacgttgacgatacagggagagcctggcgctctgccccaacagccgaaggcccctcaaaaccttacgttcatggccgctgggaaggctggacaaaacgttgtactctccggcttccccgcccccgctttgcaagccaacgtgttcaagcagccacctgcgacgacgaccggagccgcacccccccagcccccaggtgcactctccaagccaatgtccgtgcacctgctcaaccagggatcttccatcgtgattcccgctcaacacatgctgcctgggcaaaatcagttcctgctgcccggcgcacccgccgttcagttgccccagcaactcagcgcccttcccgccaacgttggtggccagatcctggcggcagcagcgccacatactgggggtcaactgattgctaatcctattctgacgaatcaaaatcttgcggggccgctgtcccttggacctgtgctggcaccacacagcggggcacactcagctcatattctgtctgccgctccgattcaagtcggccagccagctctgtttcagatgcccgtgtccctggcggccgggtctttgcctactcagagccagcctgcaccagccggccccgccgcaactaccgtcctccagggggtgaccctgcccccgagtgccgtagcgatgctgaatacacccgacggcctggtgcaaccggctacccctgctgccgccacgggtgaggccgcccctgtactaacggtgcagccagccccacaggcgcccccagccgtgtccacccccttgccgttaggcttgcagcagccacaggcacaacaacctccacaggcccccacgccgcaggctgccgcacctcctcaagcaactaccccacagccaagcccgggcctggcaagcagccccgaaaaaattgtcctgggtcagccacccagtgccacacctacagccattcttacccaggacagcctccagatgtttctgccccaggagcgctcacaacaaccactgtctgctgagggacctcacttatcggtccccgcctctgtgatcgtgtcggcccctcctcctgcccaggatcctgctcctgccacacccgtcgctaagggggccggcttagggccacaagcacctgatagccaagcatcccctgcccccgctccacaaatccctgccgccgctcctcttaaagggcccggcccctcaagcagcccctcactcccccaccaagcgcccctgggggattcgccacacctaccatccccacatccaacaagacctcccagccggccaccatctagaccacaatccgtttccagaccaccatccgagcctccactgcacccatgtccaccaccacaggcacctcccaccctgccagggatctttgtaatccaaaaccagctcggggtcccaccccctgcaagcaatcccgcacctacagctccaggtccccctcagcctcctctgagaccgcagtctcaacctcctgaggggcccttgcctcctgctccacatctgccaccctcaagtacatcatccgccgtggcgtcctcctctgaaacctcatccaggttgcccgcgccaacgccctccgatttccaattgcagttcccaccctctcagggcccccacaaatcacccacccccccccccacgttgcatctggtacccgagcctgcggcccctcctccgccccccccacgaactttccaaatggtcaccaccccgtttcccgcactccctcagcccaaagccctgctggaacgctttcatcaggtcccctccggaatcatactgcagaacaaagccggaggggcccccgccgcccctcaaacttccacttcgctgggccccctgacctccccagctgcgtcagtgctcgtgtcagggcaggcaccatccgggacccccacggcaccaagccatgcccccgctccagcgcccatggcggcaacaggcctgcctcctctgctacccgcggagaacaaagcattcgcctctaaccttcctaccttaaacgtggccaaggcggcgagctctgggccagggaagcctagtggcctgcagtacgaaagcaagctttccggactgaaaaaacccccaacgttacagccctcgaaggaagcttgttttctggaacatttgcataaacaccagggatctgtgctgcacccagattataagaccgccttcccttcatttgaggacgccttgcacagactgctgccgtatcatgtgtatcaaggtgctcttccaagtccaagcgattatcataaagttgatgaggagttcgaaactgtctcgacgcagctgctgaaacgcacacaggctatgctgaacaagtaccgcctgctcctgttagaggagagccggcgggtgtctccttcggccgaaatggtgatgatagatcgaatgttcatccaggaagagaagacaaccctagctctcgacaagcagttagctaaggaaaaacccgacgagtacgtttcaagctctcggtccctgggcttgcctatcgcggcatcgagtgagggacatcgcctcccgggccatggccctctgagctcctcagcacccggagcctcaacgcagccaccgcctcacctgcctacgaagctggtgattcgccacggcggagcaggcggctcacctagtgttacttgggccagagcatcctcatccctgtcatcgtcatcgagcagctcatctgcagcgagctccctcgacgccgacgaggacggtcctatgccaagtcgcaataggcctccaatcaaaacttacgaggctaggtctaggattggcctgaaactaaagatcaagcaggaagccggcctgagtaaggtggtgcataacactgctcttgaccccgtacaccaaccacctcccccaccggcaaccttgaaggtggcagaaccccctccaaggccaccaccacctccgcctcccacgggccagatgaacgggacagtggatcatccaccccctgcggcacccgagaggaagccactcgggactgccccccattgcccccggttgcctttaaggaagacctatagagagaacgtcggaggacccggagcacccgagggtacaccggctggtagggcgcgcgggggttcacccgcgcccctgcccgctaaggtggacgaggctacatcaggtcttataagggagctagccgcagtggaagatgaactatatcagcggatgttaaaggggcctccacctgaacccgctgcttctgcggcccagggcactggcgaccccgactgggaagcgccagggctgccgcccgccaagaggaggaaatcggaatctcctgatgtggaccaagcctcattttcatccgatagtcctcaggacgacaccctaactgagcacctccagtctgccatagactccatactaaacctgcagcaggctccaggtcgaactcccgcaccctcatatccccacgcagcttccgctgggacaccagcgagtccccccccattgcatagacctgaagcgtaccccccctcttcccataatggggggctgggcgccaggaccctgacacggtag

SEQ ID NO: 189177 - DNA, 1437 bp, Artificial Sequence
  Description of Artificial Sequence: Synthetic coding sequence
atggccgccggcggcagcggcgtgggcggcaagcggagcagcaagtcagatgctgacagtgggtttctcggcctccgcccaacgtctgtggaccccgctctccgacgacgcagacgaggccctaggaacaagaagcggggatggcgccggttagcccaggaacctttaggacttgaggtggatcagtttttggaagatgtgaggctgcaggagcgcacgtccgggggactcctgagcgaggcgccaaatgagaaactgtttttcgtggatacggggtctaaagagaagggcctcactaagaaaaggaccaaggtgcaaaagaagtctctccttctcaagaagcccttgagagtggacctgatccttgagaacactagcaaagtgcctgcaccaaaagatgtgctggctcaccaggtgcctaacgcgaagaagctgcggcgcaaggaacagttatgggaaaagcttgccaaacagggcgagctcccccgagaagtgcggagggctcaggcgagactcctgaaccctagtgccacgcgagccaaacctggacctcaggacactgtcgagcggcctttctacgacctctgggcttctgacaacccgcttgatagacctctggtgggtcaggacgagtttttcctggagcaaacaaagaagaagggggtcaagcggccagcccgtttgcacaccaagccttcccaggcacccgctgtcgaagtcgctccggcaggcgcctcatacaaccccagcttcgaggaccaccagacattactctccgccgcacacgaagtggaactgcaacgacagaaggaagctgagaagctggaaaggcagttggctcttcccgccacagagcaggcagcgacccaagagtctaccttccaagagctgtgtgaggggcttctcgaggagagcgacggggagggagagcctgggcaaggcgagggcccggaagcaggtgacgcagaagtctgccctacccccgcccggttagcaaccacagagaaaaagaccgaacagcagcggcgcagggagaaggcagtacatcgcctcagggtgcagcaggccgctctgcgagctgcacggttgcgtcaccaagaactgtttcggcttcggggcatcaaggctcaggtggctctgcggctcgcggaactggcccggcgtcagagacgtcgtcaggcccggcgcgaggccgaggccgacaaacccagaagactcggacgactgaaataccaggccccggacattgacgtccagttaagctctgagttgacagattcactgcggaccctgaaacccgaagggaacatcttgagggacaggttcaaatctttccaaaggcggaatatgatcgagcctcgcgagcgggctaagtttaagaggaaatacaaggtcaaactggtggagaagcgcgctttcagggagatccagctctag

SEQ ID NO: 189178 - DNA, 1419 bp, Artificial Sequence
  Description of Artificial Sequence: Synthetic coding sequence
atggccgccggcggcagcggcgtgggcggcaagcggagcagcaagagtgacgcagatagtggctttctgggcctgcggccgacgtcagtggatccagccttaaggcgcagaaggagaggcccgagaaataagaaacgtggctggaggcgattagctcaggagcccctggggctggaggtcgatcaattcttagaggatgttcgcctgcaggaacgaactagtggcgggctcctttctgaggccccgaacgaaaagctcttctttgttgacacgggctccaaagaaaaaggcctgaccaaaaagagaacgaaagtgcagaagaaatctctgctgcttaagaagcctctgagggtagacctgatactggagaatacttctaaggtccccgctccaaaggacgtgcttgctcaccaggtcccgaacgcaaaaaaattaaggcgcaaagagcagttgtgggaaaagctggctaaacagggtgagttgccccgtgaagtaaggcgcgcccaggcccggctgctaaatcctagcgcaacacgggctaagccgggtccgcaggacactgtcgagcgtcctttctatgatctatgggcatcagacaatccgttagatcgccccttggtgggacaggatgagttcttcctggagcagacaaagaaaaagggcgtgaaacggcccgctagattacacacgaagccttcacaggcacccgccgtggaggtcgctccggcgggtgcatcatacaacccaagtttcgaggatcaccagaccctgctgagcgctgctcatgaagtcgagcttcaacgccagaaggaagccgagaaactggaaagacagctggcactgcccgcaaccgagcaagccgccacacaagagagtacctttcaggagctttgcgaaggactgttggaagagagcgacggggagggcgaacctggccaaggtgaggggccagaggccggcgacgccgaagtctgccccaccccagcacgccaccaccgggaggaggatggggccgccgccgcgcgtcggctctgtactggatgtggatacagccgcccaagatgtgggccaccaggaagcggcaccaggagctgctcaggttgcgccggttcacccgggggaccagaagctggaggagctcggcgacagagaagacgccaggccaggagggaagctgaggctgacaaaccacgacggcttggccggttaaagtatcaggctcccgatattgacgtacagttatccagcgagctgacagacagtctgaggactttgaagccagaagggaatatcttgcgggatcgcttcaagtcattccagcgtagaaacatgatcgagccaagagagcgagccaagttcaagaggaaatacaaagttaaactggtagaaaagagagcctttagagagatacagttatag

SEQ ID NO: 189179 - DNA, 792 bp, Artificial Sequence
  Description of Artificial Sequence: Synthetic coding sequence
atggccgccggcggcagcggcgtgggcggcaagcggagcagcaagtccgatgcagacagcggcttcctaggcctgaggcctactagcgtggaccctgctctgcggcgaaggcgtagaggacctcggaacaagaaaagaggctggcgtaggctggcccaagaacctctgggtcttgaagtcgaccagtttctcgaggacgtccggttgcaggagagaacttctggaggcctcctcagcgaggctccgaatgagaagctcttcttcgtggacacaggaagtaaggaaaaggggctcaccaagaagaggaccaaggttcagaaaaagagcttgttgctgaagaagcctctacgcgtggatctcatcctggaaaatacctccaaggttccagcccctaaagacgtgttggcccatcaggtgcctaacgctaagaagttacggcgtaaggagcaactttgggccagtgataaccccctcgacaggcccttggtgggccaggacgaattttttctggagcagactaaaaagaaaggggttaaaaggcgcgaagcagaggctgacaagcctaggagactcggccgactgaagtatcaggcccctgacattgacgtgcagctgagctctgagttgacggacagcctccggactctgaaaccagagggaaatatcctccgcgaccgctttaaatcattccagagacgcaatatgatcgagccccgagaacgggccaagtttaagcgaaaatataaggtgaagttggttgaaaaacgcgccttccgggaaatccagctgtag

SEQ ID NO: 189180 - DNA, 1656 bp, Artificial Sequence
  Description of Artificial Sequence: Synthetic coding sequence
atggcccggggcgccgagggcggccggggcgacgccggctggggcctacgcggagccctcgccgctgtggccctgctctccgcactgaatgcagctggaactgtgtttgctctgtgccagtggagagggttgtctagcgcactcagggcactggaggctcagagaggacgggagcaacgcgaggactctgccctgcggtccttcctcgccgagctcagtcgcgctccacgaggggcaagtgccccccctcaagacccagcttcttccgcccggaacaagcggagtcactctggcgaacccgctccacatatccgagccgagtctcatgatatgcttatgatgatgacttatagcatggtgcccatacgtgtgatggtcgacctgtgcaacagcacaaagggcatctgcctgaccggcccatcgggacccccaggaccccccggagccgggggtctgcctggtcataacggcctcgacggccagcctggaccccagggacctaagggggagaagggcgccaacggaaagcggggaaaaatgggcattcccggagctgctgggaatccaggcgagcggggagaaaagggtgatcacggtgagctgggattgcagggcaacgagggccctccgggacagaaaggggagaaaggggataaaggggatgtgtcaaacgacgtgctcctagctggcgccaaaggagatcaggggccccccggaccccccggacctcctgggcccccaggacctcctggtccacctggttccagaagagccaaaggaccgaggcagccgtctatgtttaatggacaatgtcctggggaaacctgcgccatcccgaatgacgacaccctggtgggcaaagccgacgagaaggcgtctgagcaccattccccgcaggcggaatccatgattacttccattggcaacccagtccaagtcctgaaggtgaccgagacgttcggcacctggataagagagtcggctaataagtcagatgatcgcatctgggtaaccgagcacttcagtgggatcatggtcaaggaattcaaggaccaacccagcctcctgaatggttcttatacatttatccatctgccttactacttccacggttgtggccatgtagtatataacaattccctctactatcataaagggggctctaatacgcttgtgaggttcgagttcggacaggagacctcacagacactgaagctggagaacgccctctactttgaccgaaaatacctctttgccaattccaagacatatttcaacctggccgtagacgagaagggtctctggatcatatacgcctcgtcagtcgatggcagcagtatcctggtggctcagcttgacgagcgcaccttctccgtggttcagcatgtgaataccacctatcctaaatctaaagctggtaatgccttcatagcccggggaatactgtatgtgactgatacgaaggacatgcgggtcacattcgcttttgacctactcggaggcaaacagatcaacgcaaactttgacttgcgcacgtcgcagtctgtgctggcgatgctggcatataacatgagagaccagcatttgtatagctgggaagatggccatctgatgctgtacccggtgcagtttctctctacaacattgaaccaatag

SEQ ID NO: 189181 - DNA, 1284 bp, Artificial Sequence
  Description of Artificial Sequence: Synthetic coding sequence
atggtggacctgtgcaacagcaccaagggcatctgcctgaccggcccaagcgggcctcctggtccacccggtgccggcgggctaccagggcataacgggctagacggccagcccggcccacagggtcctaaaggcgagaaaggcgccaacggcaagcgcgggaagatggggataccaggcgccgcaggcaaccccggtgaacgaggcgagaaaggagaccacggcgaactgggacttcagggtaacgagggcccgcctggacaaaagggagagaaaggtgataagggagatgtgtccaatgatgtgctcctggccggtgccaagggtgatcaaggtcctccaggcccccctggcccccctggtccccctggtcccccagggccacccggctcacgaagagccaagggtccaaggcagccatcaatgtttaatgggcagtgccctggcgagacatgcgccattcctaacgatgatactctggtgggcaaggcagatgaaaaagcatctgagcaccacagccctcaggctgagagcatgataactagcatcggaaacccagttcaggttctcaaggtaacagagacgttcggcacttggattcgcgaatcagctaacaaatccgatgatagaatctgggtgacagaacactttagcgggatcatggttaaagaatttaaggaccaaccctcccttctaaatgggagctacacctttatccatttaccttattattttcatggatgcgggcatgtcgtctacaacaattccctgtactatcataagggtgggtccaatacgctggtgaggtttgaattcgggcaggagacatcccagactttaaagctcgaaaacgccctatatttcgatcggaagtacctgtttgcgaattctaagacctactttaacctcgcggtggacgagaagggactatggataatttacgcatcatccgttgatggttccagcatcctggtggcacaactggacgagcgtacctttagtgtggtgcagcatgttaacacgacctatccaaaatccaaagctgggaatgcttttattgcgaggggcatcctgtacgtaacagacaccaaggatatgcgcgtgacgttcgccttcgacctgctcgggggcaaacaaatcaatgcaaatttcgatcttcggacttctcagtcagtgctggcgatgctagcatataacatgcgtgaccagcatctctattcttgggaggatggacacttgatgctgtatcccgtgcagttcctgagcacgacacttaaccagtag

SEQ ID NO: 189182 - DNA, 1284 bp, Artificial Sequence
  Description of Artificial Sequence: Synthetic coding sequence
atggtggacctgtgcaacagcaccaagggcatctgcctgaccggcccatctggcccaccaggacctcccggagcaggaggccttccaggccacaacggcctggacggtcagcctgggccacaaggcccaaaaggcgagaagggtgcaaacgggaaaagaggcaaaatgggtatcccaggtgccgctggtaaccccggggaacgaggagagaagggcgaccacggcgagctgggtttacaagggaatgagggtccccctgggcagaagggggagaaaggcgataagggtgacgtgtccaacgatgtgctgctggccggcgccaagggcgatcagggcccacccggccctcccggtccacctggtccgccgggacccccaggaccacctgggagccgcagagcaaagggtccacgtcaaccatccatgtttaatgggcagtgtccaggagagacctgcgccatacccaatgacgacactctagtgggtaaggcagacgagaaggccagtgagcaccacagtccccaagcagagtctatgattactagtataggcaacccagtgcaggtgctgaaggttacagagaccttcgggacctggattcgtgagagcgctaacaaatccgacgacagaatatgggttacagagcatttttctggaattatggtcaaggagtttaaggaccagcccagcctcctgaacggttcttatacctttatccatctgccctactatttccacggatgtggccatgtggtttataacaactccctgtactatcataaggggggctcaaacaccttggttcggtttgagttcgggcaagagacctcgcagacactgaagctagagaacgccctgtacttcgatagaaaatatttgtttgccaactccaaaacttacttcaacctagcggtggatgaaaaggggctctggataatctatgcctcctctgtcgacggatccagtattttagtcgctcagttagatgagcgtaccttcagtgttgtgcaacacgtgaacactacttatccgaaatctaaggccgggaatgcgtttatcgctagggggatcctctatgttaccgacaccaaagacatgcgtgtcacattcgcatttgacctcttgggtggcaagcaaattaacgctaacttcgatttgcggacatcgcagtcagtcttagccatgttggcctataacatgcgagatcaacatctgtactcatgggaagatggacacctgatgctttatcccgtgcaatttctgtcaactacattaaaccagtag

SEQ ID NO: 189183 - DNA, 1575 bp, Artificial Sequence
  Description of Artificial Sequence: Synthetic coding sequence
atgcacagcctggacgagcccctggacctgaagctgagcatcaccaagctgagagctgcccgtgagaaaagagaacgcaccctgggagtcgtgcgcccacgggctctgcacagggaacttgggctggtggatgatagccccaccccggggtccccgggatcaccaccgagtggttttctcttgaatagcaagttcccagagaaagtggagggccggttttctgcagcccccttagtggaccttagcctgtccccaccttccggcctcgactcccccaatggctctagcagcctctcacccgagaggcaagggaatggagaccttccccccgttccatccgccagtgattttcagcccctgcgttaccttgatggcgttccgagctcttttcagttttttttgccattgggaagcggaggcgccctgcatctcccagcctctagttttttaaccccccctaaagacaagtgcttgtcccccgacctgcctctgcctaaacaacttgtctgtcgttgggcaaaatgcaaccagcttttcgagctactgcaggatctagtggaccacgtaaacgactatcatgtgaagcccgagaaggacgcaggatattgttgtcattgggaagggtgtgcccgccatggacgtggattcaacgcaaggtataagatgctgattcacattcgtacccacaccaatgaaaagccacaccgctgtccgacatgttctaagtcattcagtaggctcgaaaacctcaaaatccacaatcggagtcacacgggtgagaaaccttacgtgtgtccctacgagggatgcaataaacgctactctaatagttccgaccgatttaaacataccagaactcattatgtggataagccttactactgcaaaatgccgggatgccataaaaggtatacggatccaagtagcctgcgcaaacacatcaaggcccatggtcacttcgtgagtcacgagcagcaagaactgctacagctccgccccccaccaaaacctcctctgccagcaccggatggaggtccctatgttagcggggcccagataatcatacccaatccggcggccctctttggcggccccggtttgcccggtctgcccctgccccttgcacccgggccactggatctgtccgccctagcttgtggaaacggaggaggaagcggcgggggaggcgggatgggaccgggcttgcccggtcctgtgttacctctgaatcttgccaagaatcctttgctgccttcaccatttggagcaggcggcctggggctccccgtagtttcactcttagctggcgccgctggcgggaaagccgaaggagaaaaaggacggggttcagtgcccacgagggcactgggaatggaggggcataagactcctttggaacgcaccgagagctcatgttcccggccctccccagacgggctcccactgctccccggcacggtccttgatttaagcactggcgttaactcagcagccagctctccggaagcactggctcctgggtgggtggtgattccacccggtagtgtccttctgaagcctgcggtggtgaactag

SEQ ID NO: 189184 - DNA, 1575 bp, Artificial Sequence
  Description of Artificial Sequence: Synthetic coding sequence
atgcacagcctggacgagcccctggacctgaagctgagcatcaccaaacttcgagccgccagagaaaagagggagcgtactcttggagttgtccggccgagggccttgcatagggaacttgggctggtggacgactctccaacccccggctcaccagggtctccgccttccggttttttacttaactctaaatttcccgaaaaggtagaaggtcgctttagcgcagctcctctggtggatctgtctttgtcgccaccaagcgggctggactcacccaacggtagctcgagtcttagtccggagcgccaaggcaacggcgatcttcctcccgtgccttcagcatcagattttcagcctctgcggtatctggacggcgtgccctctagttttcagttctttctgcccctaggcagtggaggtgctctgcaccttcctgcgtcttcctttctcacacctcctaaggacaaatgcctttcccctgacctgccgcttccgaaacagcttgtatgccgttgggccaagtgcaaccagctgttcgaacttttgcaagatttggtagaccacgtgaacgactaccacgtcaaacccgaaaaagatgccggatactgttgtcactgggaaggctgcgcccgtcatgggaggggttttaatgccaggtacaaaatgctgatccatatcaggacccatacaaacgaaaagccgcacagatgcccaacgtgcagtaagtctttcagcaggcttgaaaacctgaagatacacaacagaagccatactggcgagaaaccgtatgtgtgcccatacgagggttgcaacaagaggtacagtaactcttcagatcggttcaagcacacgcggacccactatgtggataagccgtattattgcaaaatgcccgggtgtcacaaacggtacaccgatcccagttctttgcgaaaacacattaaggctcacggacacttcgttagtcacgagcagcaggagttgctgcaactgaggccacccccaaaaccccctcttcctgcaccagatgggggtccatatgtctctggggctcagattataatccccaacccagctgctttgttcgggggtccaggtctgcctggtctgcctcttccccttgcacccgggcccctggatttaagcgccctggcctgcggcaacggcggcggctctggcggtggcgggggtatggggcctggtctaccgggcccagttctgcctctgaacctggcaaagaatcctcttttaccctctccatttggagccggcgggttaggattaccagtggttagcctgctggcaggagccgccggaggtaaagctgagggagagaaggggcggggcagtgtgcctacacgtgcccttgggatggaaggacacaaaacgccactggaaaggactgagagctcgtgtagcagaccctcacctgatggtctgcccctgctgcctggaactgtgctcgatctgagtaccggggtgaattcggctgcatctagtcccgaggccttggcccctgggtgggttgtgatcccaccaggctctgtcctgttgaaacctgccgtggtgaactag

SEQ ID NO: 189185 - DNA, 2328 bp, Artificial Sequence
  Description of Artificial Sequence: Synthetic coding sequence
atgatggtgcagcggctgggcctgatcagcccccccgccagccaggtgagcacagcctgcaaccaaatctctcccagccttcagagagctatgaacgccgcaaatctgaacattcccccctccgatacccggtcactgatctcccgggaatctctggctagtaccactctgagcttgactgagtctcaaagtgcttccagcatgaaacaggagtggtcacagggatacagagctctgccgagcctcagcaaccatggatcccagaatggcctggacctcggtgacctcctttctctgccacccggcacctccatgtcaagcaacagcgtttcaaactccttgccttcctatctcttcggcaccgaaagcagtcattccccctatcctagcccaaggcatagttcaaccagaagccattcagccagaagcaagaaacgcgcactgtcgctttctccactgagtgacgggatcggcattgactttaacacaatcatccgaacctcacccacaagcctcgttgcctacatcaatggatctcgcgccagtcccgcaaacctgtctccacagcccgaggtgtacgggcacttcctgggtgtccgggggagctgtattccgcaaccgcgcccagtgccaggaagccagaaaggcgtgctggtcgcccccgggggccttgccctgcccgcctacggcgaagacggagccctggagcacgaacgcatgcagcagctcgaacacggaggactgcagcccggactggtgaaccacatggttgtgcagcacggcctgcctggacccgactcacagagcgcggggttgttcaaaacagaacgccttgaggaattcccaggaagcacagtagatctccccccggcccccccattgccccccttgccacccccacctgggccgccaccgccctatcacgcccacgcacatcttcatcatccagaactcggcccccatgcacaacaattagcactacctcaggccaccctggacgatgacggagaaatggacggcattggagggaagcattgctgccgctggatcgattgcagcgccttgtatgatcagcaggaagagctggtacgacatatcgaaaaagtgcatatagatcaaaggaaaggggaggatttcacttgcttctgggcaggttgtcctcgccgatataagcccttcaatgcccgatataaactcctcatccacatgagagtccactctggggaaaagcccaacaagtgcacctttgaaggctgcgaaaaagccttctctcgcctggaaaaccttaaaattcatctccggtctcacacgggtgagaaaccttatctttgtcaacaccctggatgtcaaaaagccttctcaaattcgagtgaccgcgcaaaacaccagcgaactcacctggacacgaagccttatgcatgccaaattcctggatgcaccaaacgctataccgaccccagcagtctcagaaaacacgttaaagcgcactccagtaaagaacagcaggccaggaagaagcttaggtcatcgacagagctgcaccccgatctgctgactgactgtcttactgtgcagagcctccagcccgcgacatcaccccgtgacgcagccgccgaaggaacagtcggaagatcacccgggcctggtcccgacctatattccgctcctatttttagctctaactactcaagcaggtccggcaccgcggccggagccgttcccccgccccacccagtgagccaccccagccctggccataacgtgcagggctccccccataacccatccagccaattgccacctctgacggccgttgatgccggggccgagcgattcgccccctcagcacctagtccgcatcatatctctccacggcgtgtgcccgccccgagttccattttacaaagaacccagccaccctacactcagcagccgtctggctctcatttaaagagctatcagcccgagactaacagttcattccaacctaatggcatacacgtgcatggtttctacggtcagctccaaaagttctgcccccctcactatccagattcccagcgcattgtgccaccggtgagtagctgtagtgtggttccgagcttcgaggactgcctagtacctacgtcaatgggacaggctagctttgacgtgttccatcgggccttttctactcacagtgggatcactgtgtatgacctgccatcttcttccagctccctcttcggggagagtctccggagtggagctgaagacgcaaccttcctgcagattagcactgtggaccgatgtccttcccagttaagtagcgtttataccgaaggatag

SEQ ID NO: 189186 - DNA, 2793 bp, Artificial Sequence
  Description of Artificial Sequence: Synthetic coding sequence
atgaacggccggagctgcagcatgagcctgcaccggaccagcggcaccccacagggcccacgtatggtctcaggccatcacatccccgcaataagagcacattctgggacccctggaccgagtccttgtggttcaacgtctagcccaaccatggctagcttagcaaataatctgcacctgaaaatgccgagcggaggaggtatggctccccagaacaacgtcgctgagagccgtatccacttgccagctctctctccgcgacggcaaatgttgaccaacggcaaaccccgtttccaggtcacgcaggccggaggaatgtctggcagtcacacgctgaaacctaaacaacaggaattcggctcaccatttcctccaaatccaggcaagggtgccttgggatttggaccacagtgtaagtcaatcggcaagggctcttgtaacaatctcgttgtaaccagctcgcctatgatggttcaaaggctcggcctgatctctccccctgccagtcaagtgtccacagcgtgtaaccaaatctccccctccctgcagcgcgcgatgaacgctgctaatctcaacatccccccatccgacacccggagtctcatctctcgcgagtccctggccagcaccaccttatccttgaccgaatcccaatcagcttctagcatgaagcaagagtggtctcagggttatcgcgccctacctagcttgtctaaccacggctcccagaacgggctcgacctcggagatctgttgtctcttccgccgggcaccagcatgtctagtaactccgtgagtaactccctccccagttaccttttcgggacggaatcaagtcatagtccatatccctccccaagacattcctccacaagaagccattctgctaggtctaaaaagagagctctcagcttgtcccctctgagcgatgggatcggaattgatttcaacaccataatccggacatctccaacctctttggtcgcttatattaacggctcccgcgcatctcctgctaatctgagcccccaacctgaggtgtatggacacttcctcggcgtgcgcggctcatgcataccccagcccaggcctgtccctggtagtcaaaagggtgtgcttgttgcaccggggggcctcgcccttcccgcctatggggaagatggcgcccttgaacatgagcggatgcagcagctcgaacatggagggctgcagcccggcctagtgaaccacatggtggtgcagcacggcttgcctgggccagactcacagtctgcaggactgtttaagacagagcgtttggaagagttccctggttcaactgtggacctgcctcccgctccacccttgcctcctcttcctcctccccccggtccccctcctccataccacgcccacgctcatctgcaccaccccgaactgggacctcacgcccagcaactggctctgccccaggctactttggatgacgacggagagatggacggaatcgggggtaagcactgttgtcgttggatagattgctctgccctgtacgatcagcaggaagaattagttaggcatatagagaaggttcacatagatcagcgcaagggagaagacttcacatgcttttgggcagggtgcccacgcagatacaaaccctttaacgcccgatataagcttctgattcacatgagggtccattcaggagagaaaccaaataaatgcactttcgaaggctgtgagaaagccttctcccgcctggaaaacctcaaaatccatctcagaagccatactggggaaaagccctacttgtgccagcatcctggatgccagaaggccttcagtaacagctcagatagagcaaagcatcaaaggacacacctcgacactaaaccctacgcatgtcagatccccggatgtaccaaacgctataccgacccttcttctctgcggaaacacgtgaaggcacatagtagcaaagaacaacaagctcgaaagaaactgcgatccagcacagagcttcacccagacttactgacagattgtctgaccgtacagtctttgcaaccagccacgtcccctcgggacgccgctgccgagggcacagtgggccgctctccggggccgggaccagacctctatagtgctcctatcttctcctctaactattccagcagatctggtaccgcggcaggcgccgtaccaccaccccatcccgtatcgcacccctcacctgggcacaacgttcaagggagcccacacaacccctcatcccaactgccccccctcactgccgtcgatgctggagctgaacggttcgcacctagcgctccttcgccacaccatatttccccacgaagagtgcccgccccttcctctattctgcagcggactcagccaccttacacccaacagcctagcggatctcacctgaagagctaccagccagaaactaactccagttttcagcccaatgggatacatgtgcacgggttttacggccaacttcagaaattttgcccaccacattatccagattcacagcgcatcgtaccacccgtgtcatcttgttctgttgtgcccagcttcgaggactgtctggtccctacatccatgggccaagcgtccttcgacgtgttccatcgcgcattttcgacccacagcggaattaccgtgtatgacctgccatcgagtagctccagcttatttggtgagagcttgcgctcgggcgcagaggacgccacgttcttacagatatctacagttgatagatgccccagtcaattgtcgagtgtctatactgaggggtag

SEQ ID NO: 189187 - DNA, 270 bp, Artificial Sequence
  Description of Artificial Sequence: Synthetic coding sequence
atgatggtgcagcggctgggcctgatcagcccccccgccagccaggtgagtacagcctgcaaccagataagcccttcacttcagcgggcaatgaatgccgcaaatttaaatatccccccatccgacacgcggtcgctgatttctagagaatctctggcgagcacaacactgtctctcactgaaagccaatctgcatctagtatgaagcaggagtggtcacaaggttatagagcactgcctagcctgtccaaccatggaagtcaaaactag

SEQ ID NO: 189188 - DNA, 735 bp, Artificial Sequence
  Description of Artificial Sequence: Synthetic coding sequence
atgaacggccggagctgcagcatgagcctgcaccggaccagcggcacaccccaaggccccaggatggtttctgggcaccacattccggccataagggctcacagcgggactccaggtcctagcccttgcgggtctacaagctctccgaccatggcctctctcgcgaacaatttacacctgaagatgccttccgggggcgggatggcacctcaaaataatgtggctgaatcgcgtatccatttgcctgccctgagccccagaagacagatgttgactaacggaaagcctcgattccaggttacgcaggccggagggatgagcgggagccacaccctcaagccaaaacagcaggagttcggcagcccttttccaccgaaccccggcaagggtgccctagggttcggaccgcagtgtaaatctatagggaagggctcatgcaataatttggtagtcacatctagccccatgatggtccagaggttaggcctcatttcaccccccgccagccaggtcagcacagcctgtaaccaaatcagtccatcattacaacgcgcaatgaacgccgccaatctgaacattccacctagcgataccagatcgctaatttcacgtgagtctctcgcctcaactacacttagtctgacagagtctcagagcgcatcctctatgaagcaagaatggtcccaaggttatagggcccttccgtctctcagcaaccatggctcccagaattag

SEQ ID NO: 189189 - DNA, 270 bp, Artificial Sequence
  Description of Artificial Sequence: Synthetic coding sequence
atgatggtgcagcggctgggcctgatcagcccccccgccagccaggtctcaacggcctgcaatcagatttcaccatctcttcagcgcgccatgaatgccgcaaacttgaatatccctccctccgacactcgcagcctgatcagtcgcgaatcccttgcatccaccacactttctttgacagagtctcaaagcgcaagctcaatgaagcaggagtggagtcaggggtaccgggctttaccgtcactgtcaaatcacgggtcccagaactag

SEQ ID NO: 189190 - DNA, 270 bp, Artificial Sequence
  Description of Artificial Sequence: Synthetic coding sequence
atgatggtgcagcggctgggcctgatcagcccccccgccagccaggttagcactgcctgcaatcagatttcgccaagcctgcaacgggctatgaatgccgctaacctgaatataccgccaagcgatacccgctcactgatatctcgagaaagtctggcttcaaccaccctgtcgcttacggaatcgcagtcagctagctccatgaaacaggagtggtcccagggctaccgcgcccttcccagcctgtctaaccacgggagtcaaaattag

SEQ ID NO: 189191 - DNA, 735 bp, Artificial Sequence
  Description of Artificial Sequence: Synthetic coding sequence
atgaacggccggagctgcagcatgagcctgcaccggaccagcggcacaccgcaggggcctcgcatggtatccggtcaccacattccagctataagggctcatagcgggaccccaggaccctctccgtgcggttccacatcctcacctacgatggcctccctcgcaaataacctgcatctcaaaatgccatcgggcggtgggatggctccgcagaacaacgtggccgagagtaggatacacctgcccgctcttagcccaaggcgccaaatgttaaccaacggtaagccccgctttcaggtaactcaggccggtggaatgagcggctcgcatactttgaaaccaaagcagcaagaatttgggtccccattccctcctaaccctggcaaaggggccttaggatttggtccccagtgcaagtcaatcggaaaggggagttgtaataacctcgtggtgacttccagccccatgatggtccaacgacttggtctcattagccctcctgccagtcaggtctccacagcttgtaatcagatctctccttcactgcagagggctatgaatgccgcaaatcttaatatccccccaagcgacacccgttccctcatttccagagagagcctggccagcacgaccctatccctcacagaaagccagtctgcaagcagcatgaagcaagaatggagccagggctatcgagcattaccttccctgtctaaccacgggagtcagaattag

SEQ ID NO: 189192 - DNA, 219 bp, Artificial Sequence
  Description of Artificial Sequence: Synthetic coding sequence
atgcaccggcggcggctggccctgggcctgggcttctgcctgctggccggtactagccttagtgtgttgtgggtgtacttagaaaactggctacccgtgagttatgtgccttattatttgccctgccccgaaattctccttgagtacagaggagttatatctgctcactgcaacctccacctgcccgggagtagcaattgtcatgcaagcgcaacttag

SEQ ID NO: 189193 - DNA, 483 bp, Artificial Sequence
  Description of Artificial Sequence: Synthetic coding sequence
atgcaccggcggcggctggccctgggcctgggcttctgcctgctggcaggtactagtttgagcgtgctgtgggtgtatttagagaactggctgccggtgtcctatgtcccctattatctaccttgccccgagatcttgcctatgatgatggccctctcctgcttatgtcatcagcagcacgaagccgctctgcaggagggcgaagcgacccccgcaagaggaatggtgacagtcccatccgcgcaggctgccggcgcccaagcccataccgctgccgacactcatacactagtcggcgcacacaggctgaggggcaatctacagccacgagcttctgccgctcacctccctgccacagagcccgaccattgggggcacggggtgtgcagaggcgaagttcacagcttccacccagtgttgccaggggtaagtaggggtgtactgcacgcttgggttcccggagcccttctgcatcttcattag

SEQ ID NO: 189194 - DNA, 1044 bp, Artificial Sequence
  Description of Artificial Sequence: Synthetic coding sequence
atgcaccggcggcggctggccctgggcctgggcttctgcctgctggcaggcactagcctcagcgttctgtgggtatatctagagaactggctcccagtgtcctacgtcccttactacctcccttgtcccgaaatatttaacatgaagttacactataagcgagagaagcccctccagcctgttgtgtggagtcagtaccctcagccaaagctccttgagcacaggcctacgcagcttcttactctaactccatggctggctcccatagtgtctgaggggactttcaaccccgagctcctgcagcatatatatcaacctctgaatctaactataggtgtcactgtgtttgccgtcggcaagtatacacactttattcagtccttcctcgagtcagccgaggagtttttcatgagaggatatagagtgcattattatatcttcaccgacaatcccgcagcagtgccaggtgtccccctgggtccacatcgactgctgagtagcattccgatccaaggtcactcacattgggaagaaacaagcatgagacggatggagacaatatcacagcacatcgctaagcgtgcccaccgcgaggtcgactacctcttctgtctcgatgtcgacatggtgtttagaaatccatggggtccggaaaccctgggagatctcgtggctgcaattcatccatcctattacgccgtcccgaggcagcagttcccctatgaacggcgccgagtgtccaccgccttcgtggcagactcggagggcgacttctactacggcggcgctgtttttggcggacaggtcgccagggtgtacgagtttaccagaggctgtcacatggccatcttggccgataaagctaatggcatcatggcagcttggagggaggaatcccatctgaaccgccattttatttcaaacaaaccgtctaaggtcctctctccagagtatctttgggacgaccgtaagccgcagcccccctctttaaaactgatccgattcagtaccttagacaaagatatatcttgccttcggtcctag

SEQ ID NO: 189195 - DNA, 885 bp, Artificial Sequence
  Description of Artificial Sequence: Synthetic coding sequence
atgcaccggcggcggctggccctgggcctgggcttctgcctgctggcggggacaagtctgtcagtgttatgggtatatctggagaactggttacccgtctcctacgtcccttactaccttccgtgtccagagatctttaacatgaagctccattataaaagagagaaacctctgcaacctgttgtatggtcccagtatcctcagcccaaactactcgagcaccgacccacacagctgctgacactgaccccttggttagctcccatcgtgtccgaaggaacgtttaatcccgagctcctgcagcacatttaccaaccacttaaccttaccataggagtcacagtgttcgctgtgggcaaccccagttggagccagccgcgttcatcttcctgtgtgggaactgggtgcaccacaacttcttccctgaccacgctgcagccctttcccggctctagatgggttcctactgggttttctgcaccctctccatctcgggtgacgccaactggaagacgtcatccatgtgccggttggcgcccaagcgcaagcaccctgctgagaggcctgactggtcgctggacaacctcaagcgccctcatgtggacctggtgtttcgggacaaggggtgctctgcggccttgggagacttggtggttaccttttacacaggcaaccacacctttccctgcctcctcttctcccatgtcagccggggtctttccactgccactgtggcagacagctaagggaacctctatcatggtgggacagtccagtggcgggcgatggcccggatacatgtcgttgctcggggccgcgacatggcccagttggcggactagaccgatggcctcctggctgcccgggggacgcaaggcaacatag

SEQ ID NO: 189196 - DNA, 993 bp, Artificial Sequence
  Description of Artificial Sequence: Synthetic coding sequence
atgcaccggcggcggctggccctgggcctgggcttctgcctgctggcgggaacaagcctgtccgtactttgggtgtacctggagaactggctcccagtttcctatgtgccttactatctcccatgtcctgagatcctgtcccagtacccgcagccaaagctgctggagcaccggcctacccagttgcttacgctgaccccttggctggcccctatcgtgtcggaggggactttcaaccctgagctgctccagcacatctaccaacccttgaacctgacaattggggttactgttttcgcagttggaaaatatactcactttatccagtccttcctggaaagtgccgaggagttcttcatgaggggctaccgggtgcattactacatcttcaccgataacccagccgcggtgcctggcgtccccctaggacctcatcgcctactctcaagcattcccatacaaggacactcccactgggaggagacctccatgaggcggatggagaccatttcgcaacacatcgctaagcgcgcacacagagaagtcgactacttgttctgcctggatgtcgacatggtatttcggaacccttggggcccagagacactcggcgatttggtcgctgccatacatccatcttattacgccgtgccccgccagcagtttccgtacgagagaagacgggtgtcaacagcatttgtagctgacagcgaaggggacttttactacggtggtgccgtttttgggggtcaggtggcaagagtgtatgagttcacgagaggttgtcatatggccatcctggccgacaaggccaacggaatcatggcggcatggagggaagaatcacatctgaacagacacttcatctccaataaacctagcaaagtgcttagtccagagtacttatgggacgataggaaacctcagccaccctcactgaaacttatccgatttagtacactggataaggatatttcgtgtttgcggtcctag

SEQ ID NO: 189197 - DNA, 1434 bp, Artificial Sequence
  Description of Artificial Sequence: Synthetic coding sequence
atgcccccctgccagccccagcggcccctgctgctgctgctgctgctgttggcctgtcaacctcaggttccatccgcacaagttatggactttctctttgaaaaatggaagctctacggagatcagtgccatcacaacctgtctctactgccaccccctactgagctcgtatgcaacaggacttttgataaatatagctgctggccagacaccccagctaatacgacagcaaatatttcctgtccttggtacctaccctggcatcataaggtccagcacagattcgtgttcaaaagatgcggtccagatggacaatgggtgcgcggccccagaggccaaccctggcgagacgcaagtcagtgccaaatggacggagaagaaattgaggtccagaaagaagtggccaaaatgtactcctcttttcaggtgatgtatactgtcgggtactcgctttctctgggtgccctgctgcttgctctagctattctaggcgggctttccaaactccactgcaccaggaatgcaatccacgcaaacctttttgccagcttcgtcttgaaagcttcctccgtgctcgtcatcgatggcctgttgagaactaggtatagccagaagatcggggacgatctttcagtatccacatggttgtccgacggagctgtggccggctgccgagtggcagcggtgttcatgcaatacgggattgtggctaattattgttggttgctggtggaagggctgtatcttcacaatctgcttgggctggcaaccctccccgaaaggagcttcttttccctttacctgggaatcggctggggtgcgcctatgctgttcgtcgtcccttgggccgttgtcaagtgcctcttcgagaacgtgcagtgttggacgtccaacgataacatgggcttctggtggatattgcgttttcctgtattcctggctattctcatcaatttttttatctttgtacgtatcgttcagctgctcgtagctaaactaagagcgcgtcagatgcaccacactgactataaatttcgactcgccaagtcaaccctgacgctgattcccctactaggggtccacgaggtcgtttttgccttcgttacagatgaacatgcccagggtacactgagatctgccaaactctttttcgatctattcctctcctccttccagggtttactggtggccgtactctactgctttctgaataaagaggtgcagagtgaactgcggcggcggtggcacaggtggaggttgggcaaggtattatgggaggaacgcaatacttctaatcaccgcgcatcgagctcaccagggcatggcccgccgtctaaagaacttcaattcggaagaggtggaggcagccaggattcgtctgcggaaacaccactggccggagggctgcctaggctcgcggagagcccattttag

SEQ ID NO: 189198 - DNA, 1392 bp, Artificial Sequence
  Description of Artificial Sequence: Synthetic coding sequence
atggccggcgcccccggccccctgcggctggccctgctgctgctgggcatggtcgggagggccgggcccaggccacagggagccactgtgtccctttgggaaaccgtgcagaagtggagggaataccgccggcagtgccagcgctctttaactgaggacccaccccccgctacagaccttttttgcaatcgcacctttgacgagtatgcctgctggcccgatggcgaacctggctcttttgtcaacgttagctgcccctggtatctgccttgggcttcttcggtgccacaaggccatgtttaccgtttctgcactgccgaaggcctctggctgcagaaggacaatagctccttgccatggcgggacctgtctgagtgtgaggaaagtaaacgtggcgagcgaagctcacccgaagaacagctgctgtttctgtatatcatctacaccgtaggctatgcgctgagtttttcagctctcgttatcgctagcgctatactgctgggattcagacatctccattgcacaaggaactacatccacctaaatctgtttgcttctttcattctaagggctttgagcgtctttatcaaagatgctgccctcaaatggatgtattcgacggccgcgcagcagcaccaatgggatggcctcctctcatatcaggattctttgtcttgtcgcctggtcttcctgttgatgcagtactgtgtggccgctaactactactggttgctggttgagggtgtgtacctgtacaccctgttggcattctccgtcttaagcgagcaatggatctttagactatacgtgtctattggctggggcgtacccctcctgtttgttgtgccttggggtatcgtcaaatatttgtacgaagatgaggggtgttggactaggaactcgaacatgaactattggctgatcattcgtctacccatactctttgctatcggtgtgaactttctgatcttcgtgagagtcatatgcattgtggtctctaagctaaaggccaatttgatgtgcaagacagacattaagtgtcgcctggccaagtccactctgacgctgatcccactgctgggaacacacgaagtaatattcgcctttgtgatggacgaacacgccagagggacgttacggtttatcaaactgttcactgaactttcgttcacatccttccaaggcttgatggtagcaatcctgtactgctttgtcaataatgaggtgcagctcgagttccggaagtcatgggagaggtggcgtctcgagcacctccacatacagcgggatagctctatgaagcccctgaaatgccctacttcttctctgagctcaggcgccactgccggaagttccatgtatacggcaacctgtcaggccagctgttcctag

SEQ ID NO: 189199 - DNA, 1662 bp, Artificial Sequence
  Description of Artificial Sequence: Synthetic coding sequence
atgaagctgggcagcagccgggccggccccggccggggcagcgccggactcctccccggtgtccacgagctccccatgggaattcctgccccatggggaaccagtcccctgtccttccacaggaagtgttctctgtgggccccaggacgccctttcctgaccctagtacttctagtgagcattaagcaagttactggtagtcttctggaggagaccacacggaagtgggcgcaatacaaacaggcttgcctgcgtgacctacttaaagagccaagcggaatcttttgcaacggcacctttgaccagtacgtgtgctggccacactcttccccgggcaatgtgagtgtcccatgtcccagctatctaccctggtggagcgaagagtcttcaggacgggcgtatcgccattgcctcgcccagggcacatggcagacaatcgagaacgcaactgatatatggcaagacgacagtgagtgcagcgagaatcacagtttcaagcagaacgttgataggtacgcactccttagcacactgcagttgatgtatacggtgggctacagcttctccctgatttctctgttcctggctttgactctgttgctgttcctgcgcaaattgcactgcacaaggaactacatacacatgaacctgttcgcttcctttattttgaggacactcgccgttctggtgaaagacgtggtcttctataacagctactccaagcgccccgacaatgaaaacggatggatgtcctatttatctgaaatgtccacctcgtgccggagtgtgcaggtcctgcttcattattttgtgggggccaattatctctggctgctggttgagggtctttacctccacacccttctggaacccacagtgctccctgagaggcgcctttggccacgttacttgcttctcgggtgggcctttcccgtgctcttcgtggtgccctggggctttgcacgtgcccacctggagaatacaggttgctggaccaccaatggcaacaagaagatctggtggatcatcagaggcccaatgatgctttgcgtaactgtcaacttctttatctttctcaagatcctcaaactcctgatatctaagctgaaggctcaccaaatgtgtttcagagattacaagtacaggctggctaagtcaacgctagtgcttatcccgttactcggtgtccatgagatactgttctcatttatcacagatgaccaggtggaaggcttcgctaagctgatcaggttatttattcagttgactctcagctctttccacggatttcttgtggccctgcagtacggatttgcgaatggagaggtcaaggcggagcttaggaaatactgggtaagattcctattggctcggcacagtggttgtcgggcctgcgtactgggaaaggactttagattcttaggtaagtgtccaaaaaagttgtctgaaggcgacggagccgaaaagttaaggaaactccagccaagcctgaattcgggacgactccttcatcttgcaatgcgcgggctcggggagctgggggcccagccccagcaggatcacgcacgctggccccggggctcgagtcttagtgaatgttcagagggagacgtcaccatggccaacaccatggaggagattctcgaagaatctgagatttag

SEQ ID NO: 189200 - DNA, 1053 bp, Artificial Sequence
  Description of Artificial Sequence: Synthetic coding sequence
atgggcatccccgccccctggggcaccagccccctgagcttccacaggaagtgcagcttgtgggcccctggacgcccgtttctgactctggttcttcttgtgagcatcaagcaggtgacaggcagcctgctcgaagagactaccaggaaatgggcgcagtacaaacaggcctgcctccgcgacctgctaaaagagcccagtggaattttctgtaatggcaccttcgatcagtatgtgtgctggccccatagtagtcctggaaatgtctccgtgccatgtcccagctatctgccctggtggtcagaggagagtagtgggagagcctatcgccattgcctggctcagggcacctggcagacaattgaaaatgcaacagatatttggcaggacgatagcgagtgtagtgagaaccatagctttaagcaaaacgtggatagatacgccttgctgtccaccctccagctgatgtacaccgtcggatactcattcagcctgatttcacttttcctggcattgacactgcttctctttctgagaaagctgcactgcacccgcaactacattcacatgaacctttttgccagtttcatcctcaggactttagcagtgcttgtaaaggatgtcgtgttttataattcatacagtaagcgcccggataatgaaaatggttggatgtcctacttaagtgagatgtcaacaagttgtcggtctgtccaagtgcttctgcactattttgtcggtgccaattacctgtggttgcttgtggaaggcctgtatttacatacccttttggagccaacggttcttcctgagaggcgattgtggcctaggtaccttctcctcggctgggccttcccagtgttgtttgtggtgccctggggcttcgctagggctcacctggaaaacaccggatgctggacaacaaacggaaacaaaaaaatctggtggatcatccgcggacccatgatgttatgcgtgacagcgctgggcctcgaagaaactggcctcaagaggaacgggtcaattccttttgggcataaagaggatatctag

SEQ ID NO: 189201 - DNA, 1665 bp, Artificial Sequence
  Description of Artificial Sequence: Synthetic coding sequence
atgaagctgggcagcagccgggccggccccggccggggcagcgccggattactaccgggagttcatgagttgcctatgggcattcccgccccttggggcactagtcctctgtcatttcatcgaaagtgttccctttgggcccccggccgaccattcctgacacttgtactgctagtttctattaagcaagtcaccgggtcccttctggaggagactacaaggaagtgggcccagtataagcaggcatgccttcgcgatttgctcaaggaacctagtggaatcttctgcaatggcacttttgatcagtatgtctgttggcctcactcatctcccgggaacgtatccgtgccgtgccccagttatctgccgtggtggtcagaggagagctcgggacgcgcatacaggcactgcttagctcagggcacatggcaaactattgagaacgccacggatatctggcaggatgatagcgagtgtagcgagaaccattccttcaaacagaatgtggaccggtatgccctgttgtcaacactacagctgatgtacaccgtcggatactctttttctttgatcagcctgttcctggccctcaccctgctcctgtttttgagaaaacttcattgtacgaggaactacatacacatgaacctcttcgcatcattcatcctgaggaccttagccgtactcgtaaaagacgttgttttttacaattcatattccaaaaggccggacaatgaaaacgggtggatgtcttatcttagcgagatgtctacctcatgtaggtccgtgcaagtgctgctgcactacttcgtgggggccaattatctgtggttgctggtcgaagggttgtatctgcatacattgttagagccaacagtgttgcccgagcgaagactctggccccggtacctgttgttggggtgggcatttccggtcctgttcgtggtgccctggggattcgctcgcgcccatctggaaaatactggttgctggactaccaatggaaataaaaagatctggtggatcattaggggcccaatgatgttgtgcgtgactgtcaacttcttcatttttctgaagattctcaaactcctgattagtaagctgaaggcgcaccagatgtgcttccgggattataaatatcgcttagctaagagtaccctggtcctcatacctctactgggcgtccatgagatccttttcagttttatcacagacgatcaggttgaaggattcgccaaacttattcgcctatttatccagctgactctgtcatccttccacggctttcttgtggcattgcagtacgggtttgctaatggcgaagtaaaggctgaattacgaaaatactgggtgagattcctgctggccagacattccgggtgtcgcgcctgcgtactcggcaaggacttcaggttcttggggaagtgccctaaaaaattgtccgagggggacggagccgagaagttacgaaagctgcaaccatcccttaattctggcaggcttctgcatctggctatgcgaggcctcggagaactgggcgcgcaaccccagcaagaccatgcccgctggccccgcggttcatcactatcagagtgttccgagggcgacgtcacaatggccaataccatggaggagatccttgaagagaaaagatcccaatag

SEQ ID NO: 189202 - DNA, 687 bp, Artificial Sequence
  Description of Artificial Sequence: Synthetic coding sequence
tgagccaccgacatctggcaggacgacagcgagtgcagcgagaaccactcctttaagcagaacgtggatcgctatgccttgctgagtacacttcagttaatgtacacggtcggctattccttttccctcatctctcttttcctcgccctgactctgctgctctttctccgaaaacttcactgtactaggaactacatacatatgaacctttttgctagcttcatcctccgtactctggcagtgctggttaaggacgtcgtgttctacaatagttactccaagcgaccagataacgaaaatggctggatgtcatatctatcagaaatgtcaacaagctgccggtccgtgcaagtgcttttgcattacttcgtgggagctaactacctatggctgctagtggaagggctttacctgcatacattgctggaacccaccgtgctgccagagagaagactctggccccggtacctgctactcggctgggctttccctgtgctgttcgtcgttccctgggggtttgcaagggcccacctcgagaatacggggtgctggactacaaatggtaacaagaaaatctggtggataataaggggacccatgatgttgtgtgtcacagcgctgggcctggaagaaacaggcctcaaaagaaacggttctatcccattcgggcacaaggaagacatatag

SEQ ID NO: 189203 - DNA, 1725 bp, Artificial Sequence
  Description of Artificial Sequence: Synthetic coding sequence
atggagcccaccgagaacccctgccagggccccctgggccagaaggcgggagagaagccgctggccgccggaccgggcgaagaagaactgctcagagggagcgcccctcacgcccaggatacgcagtccgaggagctcccccccagctgtactatttcaggcgaaaagaaaccccccgcggttagtggagaagctaccggcgcggacgcaggaagactgtgtcctcctccaagatctcgtgcccctcataaggatagaacactcgccaggtctagaccccagactcagggggaggactgtagtcttccagtgggggaagtgaagataggaaagaggtcctatagtcctgctcctggaaagcaaaaaaaacctaatgctatgggcctggctccaacttcgtcccctggtgccccgaactctgcacgggctacacacaatcccgttccctgtggctcgggccgtggcccctgccacctggctaacctattgagcacactcgctcaatccaaccagaacagagatcacaagcagggtccccccgaggtgacctgccagattcgcaagaagacccgcaccttgtatagaagcgaccagctagaagaattggagaaaatcttccaagaggatcactatcctgattcggataaacgcagagagattgctcagacagtcggcgtgacacctcagaggatcatggtgtggtttcaaaatagaagagccaagtggcgaaaaatggagaagctgaacggaaaggaaagcaaagacaacccggctgccccgggaccagcctcttctcagtgtagcagtgccgctgaaatcctcccagcagttccgatggaacctaaacccgatcctttcccccaggagagccccttggacacattcccagagccccccatgctgttgacctccgatcagaccctagctccaacccagccatcagagggcgctcaaagggtggtgaccccccccttgttttctccaccccccgtgcggcgggctgacctcccctttccactgggcccggtgcacaccccacaactgatgccactgctgatggacgtcgccggctccgactcttcccacaaagacggcccctgcgggagctggggaacatcgatcactctcccaccaccttgttcatatctcgaggaacttgagccacaggattatcagcagagcaaccagccaggtccatttcagttcagccaagcacctcaacctcccctgtttcagtcaccacagccaaagctgccctacctccctaccttcccattttcaatgccatcctcccttactcttccccctcctgaagattccctgtttatgtttccttgtgggcccagcggaggcaccagccagggttactgtccaggtgcctcctctgggcagatcctcatgcagccccctgctggcaacataggtacagcgtcctggtcagacccttgcctgcctgagcttccattccccggacccttttgcccccaggcacttggacatccgcctggcggggacggctacttcccagacctgttcccaactccatgccctcaggctctgggtcggcagccgtccagcgctttgagctggatgccagagggcgcacggcctggaacaggcccgctgctctcaaaggcaaaggaggagccccctgcagcttcactggatcagccctcggcactcgaggaggcaaggggtgacgacaagaacagccacgtcccctag

SEQ ID NO: 189204 - DNA, 1722 bp, Artificial Sequence
  Description of Artificial Sequence: Synthetic coding sequence
atggccaacgccgaggtgagcgtgcccgtgggcgacgtggtggtggttccaactgaaggcaatgagggagagaaccccgaggacactaagacccaggtgatactccagctgcaacccgttcaacagggtctattcattgatggacacttctacaatcgaatctatgaagccggttctgaaaataacactgcagtcgtggccgtggagacccacacaatccataagatagaggagggtattgacacagggacaatcgaggccaacgaggatatggagatcgcctatcctatcacgtgcggcgaatctaaagcaatcctgctgtggaaaaagtttgtgtgtcctggcataaacgtgaagtgtgtgaaattcaatgatcagctgatcagcccaaaacacttcgtccacctggccgggaaatcaacactcaaggattggaaaagggccatccgcctaggagggatcatgctccggaaaatgatggattccggacagatcgacttctatcagcacgataaagtctgcagcaatacgtgcaggtcaacaaagtttgacctgctgatttccagcgctcgcgcccctgtcccaggccagcagacttcagtggtccagactccaaccagcgctgatggaagcataacccagattgctatttccgaggaaagcatggaggaagccggcctggagtggaattccgccctgaccgcagccgtcactatggcaactgaggagggtgtaaagaaggactctgaagaaattagcgaagacacactcatgttctggaaaggcatagcggatgtgggtctcatggaggaagtagtatgtaacatacagaaggaaatcgaggaactcctgcgtggtgttcagcagcgcctgatccaagcccccttccaggtaaccgacgccgccgtcctcaacaacgtcgcacatacgtttgggctgatggacacggtgaagaaggtgctggacaataggcggaaccaagtggaacaaggcgaagagcagtttctatacactctgaccgatctggaaaggcagctagaagagcagaaaaaacagggccaagatcatcgcttgaaatcccagaccgtgcagaacgtcgttctgatgccagtgtccacacccaagcccccaaagaggcccaggctacagagaccagccagtacgactgttctgtctcccagcccccctgtccagcagcctcaatttacagttatctcccctattaccattacacctgtgggccagtccttctccatgggcaatattcccgtcgccacgcttagccaaggtagtagccccgtaaccgtgcacaccctgccttctggtccacagctctttcgctacgccaccgtcgtgtcatccgcgaaatctagctcaccggatactgtgacgattcacccgagcagcagtttggcactcctgtctagcaccgcaatgcaagacggttctacactcggaaatatgaccactatggtgtcacctgtggaactggttgccatggagtcgggtctgacatctgctatccaggcagttgagtcaacctccgaggacggacaaaccattatcgagatcgatcccgcgcccgatcctgaagccgaggacaccgagggaaaagccgtgatcctggagaccgagctgagaacggaagagaaggtcgtcgccgagatggaggagcaccagcaccaagttcacaatgtggaaatagtcgtgctcgaagactag

SEQ ID NO: 189205 - DNA, 1692 bp, Artificial Sequence
  Description of Artificial Sequence: Synthetic coding sequence
atggccaacgccgaggtgagcgtgcccgtgggcgacgtggtggtggtgcctactgaaggaaatgaaggcgaaaaccccgaggacaccaagacccaggttatattgcaactgcagcctgtgcaacagggtatctatgaagcaggttcagagaacaatactgcggttgtcgcagtggagacccacacgatccataaaatagaggagggcatcgataccggcaccattgaagcaaacgaggacatggagatcgcgtatccgattacctgcggggagtcaaaagctatccttttatggaagaagtttgtgtgccccggaataaacgtgaagtgtgtcaagtttaacgatcagctcataagtccaaagcatttcgtccatctggcaggcaagtccacactgaaggactggaagcgtgctattagactcggcggcatcatgttgcgtaagatgatggatagtgggcagattgatttctaccagcatgataaagtatgttctaacacatgccgaagcacgaaatttgaccttctgatcagctcagcgcgcgcaccggtgcccgggcagcagacatccgtcgtgcaaacaccgacatcagccgatggaagcattacccagattgcaatttcagaggagagcatggaggaggccggactggagtggaattctgcacttaccgctgcggtgaccatggccactgaggaaggagtaaaaaaagacagcgaggagatcagtgaggacacccttatgttctggaagggtatcgctgatgtaggcctgatggaggaggttgtctgtaacattcagaaggagattgaggaactgctgaggggagtgcagcaacggctgatacaagctccctttcaggtgacggacgctgccgttctaaacaatgttgcccacacgtttgggcttatggacaccgtgaagaaggtgctcgacaaccgccgtaaccaggtcgaacagggcgaagagcagttcctgtacaccttaacagatctcgaaaggcagcttgaagagcaaaaaaagcagggacaagatcatcgattaaagtcccagactgtccagaacgtggttctaatgcccgtgtcgacccccaaaccacccaagcgcccacggctgcaacgccctgctagtacaaccgtcctttcaccctcccccccagtgcagcagccacagtttaccgtgattagcccaataacaatcactcccgtgggccaaagtttttccatgggaaatatccccgtcgccactttgagccagggtagctcgcccgtcaccgtgcacaccctgcccagtggaccacaattattcagatatgctacagtagtgtcttccgccaaaagctcctcaccagacacagtgacgatccacccttcctcctccttggctctactctcatcaactgctatgcaagacgggtccactctgggaaatatgacaacaatggtttcccctgttgagcttgtagccatggagtccggattgacctctgcgatacaggctgtggaaagtaccagcgaagatggtcagactataatcgagatcgatccagctccagaccctgaggcagaggataccgagggaaaggctgttatactcgagacagagctaaggactgaggaaaaggtggttgccgaaatggaggagcaccagcaccaggtgcacaatgtggagattgtcgtgctggaggattag

SEQ ID NO: 189206 - DNA, 1692 bp, Artificial Sequence
  Description of Artificial Sequence: Synthetic coding sequence
atggccaacgccgaggtgagcgtgcccgtgggcgacgtggtggtggtgcctactgaagggaatgaaggggaaaatcctgaggacactaagacccaggtgatactccaactgcaacctgtacagcagggcatctacgaggccggtagtgaaaacaatacggccgtagtggctgttgaaacccatacaatacacaaaatcgaagagggtatcgataccgggacgatagaagcgaacgaggacatggaaatagcttacccaataacttgtggcgaatcaaaggccattttgctgtggaagaagttcgtgtgccccggcattaacgtaaagtgtgtaaagttcaatgaccagcttatcagtccaaagcattttgtgcacctggcagggaaatccaccttaaaggattggaaaagggctatacgccttggagggattatgctgcgcaaaatgatggatagcggacagattgatttttaccaacacgacaaagtgtgttcaaatacctgcagatctacaaagttcgatctgctgatatcttccgcgcgggcaccagtgcctggccagcagacttctgtggtacagaccccgacctctgccgacggctccattacacagattgcaataagcgaggagtccatggaggaagctggcctggagtggaactccgctctgaccgccgctgtcactatggccacagaggaaggagtcaagaaagacagtgaggagatttcggaagacaccctgatgttttggaagggaatagcggatgttggcctgatggaagaggtggtctgcaacatccagaaagaaatcgaggagctgctaaggggggtccagcaaaggctgatccaggcgccattccaagttaccgacgctgcagtgttgaataacgtggctcatacattcgggctaatggacacggtcaagaaagtgctggataaccgaaggaatcaggtggagcagggagaggagcaattcctctacaccctcacagatcttgaaaggcagctggaagagcagaagaaacagggacaggaccacagattgaagtctcagactgtccagaacgtcgtgctcatgcccgtcagcacgcctaagccacctaagcgccctagactgcaacgcccagcgtctacaactgtcctttccccctcacctcctgtgcagcagccccagttcaccgtcatatcacccatcactattaccccggtggggcagtctttcagcatggggaatattcctgtggccacattgtcccagggctcctccccggtgaccgtgcacacattgccaagtggaccacagctgttcaggtacgcgacagtggtcagttcagccaagagctccagtccggacacagtgaccatccacccctcatccagtttagccctgctttcctcaacggcaatgcaagacggatccacattgggcaatatgacaactatggtgtccccagtcgagctggtggccatggaatctggacttacctcggccatccaggcagtagagagcaccagtgaagatggccagacaattatcgagattgaccccgctccagacccggaagcagaggacaccgaggggaaggccgtgatattggagacagaattgcggactgaagaaaaggtcgtggctgagatggaggagcaccagcaccaggtccataacgtggagatcgttgtccttgaagactag

SEQ ID NO: 189207 - DNA, 1083 bp, Artificial Sequence
  Description of Artificial Sequence: Synthetic coding sequence
atgctgcggcggctgcccgccctggccgcccggcggccccccgcccgaagacggcgtatctatgaggcaggaagcgaaaataataccgccgtggtggcggtcgagacccatactatccataaaatcgaggagggaatagataccggaacaatagaggccaatgaagatatggagatcgcctacccgatcacgtgcggggaatctaaggccatcttactctggaagaagttcgtatgccctggaattaacgttaagtgtgttaagttcaacgatcagctcatctcacccaagcacttcgtccatctggccggtaagtccaccttgaaagactggaagcgcgcgatacgtttagggggcattatgttgagaaagatgatggactccggtcaaattgatttctatcagcacgataaagtgtgttcaaacacttgccgttctaccaagtttgacctcctcatttcctctgcacgggcccctgtgcctggacagcagacctctgtggtgcagactccaacgtccgctgacgggtccattacacagatcgccatttcagaagagtcaatggaggaggcggggctcgaatggaatagcgcgcttaccgccgccgtgactatggccacagaagaaggggtgaagaaggattctgaggagatctctgaagataccctgatgttttggaaagggatcgccgacgtgggtctcatggaagaggtcgtttgtaacattcagaaggagatcgaagagctgttgaggggagtgcagcaacggctcatccaggcaccattccaggttaccgatgctgctgtgttaaataatgtggcccatactttcggcctgatggacacagtgaaaaaagttctggataatcggagaaaccaggtggagcaaggtgaggagcagttcctgtatacactcaccgatctggagcgccagctggaggagcagaagaaacaggggcaggaccacagattaaagagccaaacagtacaaaatgtggtgcttatgcccgtctcaacaccaaaaccccctaagcgaccacgtctgcagcggcccgcttctactaccgtgctcagcccctcctag

SEQ ID NO: 189208 - DNA, 1593 bp, Artificial Sequence
  Description of Artificial Sequence: Synthetic coding sequence
atggccacccccgacgtgagcgtgcacatggaggaggtggtggtggttacaacaccagatacagccgtggatgggtccggcgttgagggagttaaaaccgttcttgtcaccaccaacctcgccccccacggcggtgacctcactgaggataatatggagactgagaacgccgccgctgccgctgcagcagctttcaccgctagctcacaactgaaagaagccgtgttggtcaaaatggccgaggagggagagaatttggaagctgaaatcgtctaccccataacctgcggtgattccagggctaatctgatctggcgcaagttcgtgtgccctggaataaatgtcaagtgcgtgcagtatgatgaacatgtaatcagtcccaaggagttcgtacacctggccggtaagtcgaccctcaaagattggaagagagccattagaatgaacgggataatgctgaggaagataatggactctggagagctggacttctatcagcacgataaagtttgctctaacacgtgtcgttccactaaaatagatctgtctggcgctagggtgagtctgtcgtcacccaccagcgccgaatacatccctctgacgcccgcagctgctgatgtcaacggatcgcccgcaaccattactattgaaacatgtgaggatccaggtgactggacggccgctataggggatgataccttcaccttttggcgggggcttaaggacgctggcctgctggacgaggttatccaggagttccatcaagagcttgttgaaacaatgaggggactgcagcagcgtgttcaggacccccccctgcagttacgagacgccgtgttactcaacaatatcgtccagaatttcggcatgttggacttggttaagaaagtgctcgcctctcacaaatgccagatggataggtctagagagcagtacgccagggatctggctgccctggagcagcagtgtgatgagcaccgtcggagggcaaaagagctgaagcacaagagtcaacatttgagtaatgtgttaatgacgttgacccctgtctcactgcctccgccagtgaaacgacctcgcttagcgagagccacttcaggtcctgctgctatggcgtcccaggtgctgactcaatcagcccagttggcgcttggacctggcgtccccgtccctcagcttactagtgtacccctgggtaaggtggtgagcacactccctagcaccgtgctgggaaagggatccctgcaggctcctccagcatccagtccagcatcaccgctcctgggaggctacaccgttttagcctcttccgggtcaacgtacccctctactgtggagattcaccctgacgcctcttcacttacagtccttagtaccgcggcagtgcaggacggcagtaccgtgtttaaagttgtgagccctctgcagttgctgaccttgcccggactggggcccacactgcaaaacgtggcccaagcttctccagggtcctctaccatcgtgactgtgccagcgggagccgctcccggcccagaggagcacacagccaccattgaggttgcagctatggccgaagatcacgagcgcaagtag

SEQ ID NO: 189209 - DNA, 1440 bp, Artificial Sequence
  Description of Artificial Sequence: Synthetic coding sequence
atggagaccgagaacgccgccgccgccgccgccgccgccttcaccgcgtctagccagctcaaggaggctgtccttgtgaagatggccgaggaaggagaaaacttagaggctgaaatagtatatcctattacatgcggcgattctcgggctaacctgatctggcgcaagttcgtatgccctggcataaacgtgaagtgtgtgcagtatgacgaacacgtcatttccccgaaggaattcgtgcatctagctggtaagtcaacgcttaaggattggaaaagagccatccggatgaacggcatcatgctaaggaaaatcatggacagcggcgaacttgatttctatcagcatgataaagtgtgcagtaatacttgtcgctccacgaaaatcgaccttagcggcgcccgggtctccctcagctcccccacttctgccgagtacatcccccttacacctgcggccgccgacgttaatggttcccccgcaactattacgatagaaacttgtgaggatcccggcgactggacggcagcaattggggatgacacttttaccttctggagagggttaaaggatgctggcttgctcgatgaagtgatccaggagttccatcaggagttggtggaaaccatgagaggcctgcagcaacgggtccaggatccaccactacaactgcgagatgcagtactgctgaataatattgtgcagaactttggcatgctagacctagtcaaaaaagtgcttgccagtcataagtgtcaaatggatcggtcaagagagcagtatgctcgtgacctcgctgccctagaacagcagtgcgatgaacacaggcgacgcgcgaaggagctgaagcataagtcgcaacacctatccaatgtgctgatgacactgacacccgtgtccctgccccccccggtgaaaagacctaggctggcgcgggccacttcagggcctgctgcgatggcttcgcaggtgctgacacagagcgcccagcttgctctggggccaggagtaccggttcctcaacttacctcggtgccccttggcaaagtagtgtccactctccccagtactgttctgggaaagggatctctgcaagctcctcctgcctctagtcctgcctcacctttattgggaggctacaccgtgctggcctccagtggatcaacctacccaagcacagtggaaatccacccggatgcaagctccctcactgtcttgagtacggcagcggttcaggatggtagcaccgtctttaaagtcgtcagccccctccagctgctcactcttccaggcctcggcccaacactgcagaacgtcgcccaggcatcccccggatccagcaccatcgtgacagtgcccgctggggctgctcctggccccgaagagcacacagctactatcgaagtcgctgccatggccgaggatcatgaacgaaaatag

SEQ ID NO: 189210 - DNA, 1593 bp, Artificial Sequence
  Description of Artificial Sequence: Synthetic coding sequence
atggccacccccgacgtgagcgtgcacatggaggaggtggtggtggtaacaacacctgacaccgccgtggatggctccggtgtagagggagttaaaaccgttttggtcactacgaacctggccccacacgggggagacctcacggaagacaacatggagaccgagaatgctgcggccgcagcggctgcagcattcacagcgtcgtcgcagcttaaggaggcggtactggtcaagatggctgaggaaggtgagaacctcgaggctgaaattgtttatcccattacctgtggagattcccgagccaatctaatttggcggaagttcgtatgtccaggaatcaatgtcaagtgtgtgcaatacgatgagcacgtgattagtccgaaggaatttgtgcatctcgcaggcaagagtactttgaaggattggaagcgcgccatcagaatgaacgggattatgcttcggaaaatcatggacagcggtgagctggacttttaccagcacgacaaggtttgttccaacacatgcagaagcaccaaaatagatctgagtggagcccgcgtgagcctgtcatcacccacctccgcagaatatatccctcttactcctgcggcggccgatgtcaatggaagtcccgcaacaattacgattgaaacttgtgaggaccctggtgactggaccgcagctattggcgacgatacgtttactttttggcggggcctcaaggatgcagggctactcgatgaggtgattcaggaattccaccaagagcttgttgagactatgaggggactgcagcagagagtgcaggaccccccactgcagctgcgcgacgccgtgcttctgaataatatcgtgcagaactttgggatgctggacctggtcaagaaggtcctcgcctctcataaatgccagatggacagaagtagagaacagtatgcgcgggatctcgccgctctggagcagcaatgcgatgaacacagaagaagggccaaagagttgaagcacaaatcccaacacctgtctaacgttctgatgaccctgacgccagtaagtctccccccccctgtcaagaggcctagactagccagagccacttcaggcccagccgccatggcctcccaagtattgacacagagtgcacagctggctttgggacccggcgtgccagttccacagctgacatctgttcccctgggtaaagtggtgtctaccctgccgtctacagtgctggggaagggctccctgcaggcccctcccgctagttcaccagctagtccacttctgggaggctacaccgtgttagcaagtagcggcagcacttatcccagcactgtcgaaatacaccctgatgcgagcagtcttacagtgctgagcacagctgcggtgcaagatggctctactgtgttcaaagttgtgagtccactgcaattactcacgctacctggcttaggaccaacactccagaatgtggcacaagccagcccagggagcagcaccatcgtgacagttcctgctggggcagcacctggccctgaggaacacaccgccactatcgaggtggctgccatggcagaagaccatgagagaaaatag

SEQ ID NO: 189211 - DNA, 1401 bp, Artificial Sequence
  Description of Artificial Sequence: Synthetic coding sequence
atggccatggacgtgacccggagccaggcccagaccgccctgaccctagtcgagcagattctggcagagtttcagcttcaggaagaagatctgaaaaaagtgatgaggcggatgcagaaagaaatggatcggggcctgagactggagacccacgaggaagcctccgttaagatgctccccacatatgtacgttctacaccagagggctccgaggtgggggattttctctctctggatttaggcggaacaaattttagagttatgctggtcaaagttggggaaggagaggaagggcagtggagcgttaagaccaagcaccagatgtacagtatcccagaggatgccatgactggcaccgctgagatgctgtttgattacatttccgaatgtatctcagacttcctggacaagcaccagatgaaacacaagaagttgcccctcggctttaccttctcttttcccgttagacacgaggacatagacaagggaatcctgctgaattggacgaaaggcttcaaggcctccggtgctgaaggaaataatgtggtggggctgctgcgggatgcgatcaaacgcagaggcgacttcgagatggacgtggtcgcgatggtaaatgacactgtagctactatgatctcctgctactatgaggatcatcaatgtgaggtcggaatgatcgttggaacgggctgtaatgcctgctacatggaagaaatgcagaacgtcgagctcgtggaaggcgacgagggccgcatgtgcgtaaacaccgagtggggcgcctttggagattccggagaactggacgagttccttctggaatacgaccggttagtggatgagtctagtgctaacccagggcagcagctgtacgaaaagctgatcggcggtaaatatatgggcgagctcgtgaggctggtgctgctgcgtctggtcgacgagaatctcctctttcacggcgaggcatctgagcaactcagaacccgtggtgccttcgagactagattcgtttcccaggtggaatccgataccggtgatcgcaaacagatctataatattctgtcgaccttaggattgaggccgtctactaccgactgtgacatcgtgagaagagcctgcgaaagcgtcagcaccagagccgctcatatgtgtagcgcaggcttagctggggtgattaatagaatgagggagtcaagatcagaagacgtgatgcgaatcactgtgggcgtggacggatctgtgtacaagctgcatccaagcttcaaggaacgattccacgcgtcggtgcggaggctaacacctagctgcgagatcacctttatcgagtctgaagaaggctctggcaggggggccgctcttgtcagtgctgtcgcatgcaagaaagcatgtatgctcgggcagtag

SEQ ID NO: 189212 - DNA, 1395 bp, Artificial Sequence
  Description of Artificial Sequence: Synthetic coding sequence
atgccccggccccggagccagctgccccagcccaacagccaggtggagcagatcttggcagagtttcagttgcaagaggaagacctgaaaaaggtcatgaggcggatgcagaaggagatggataggggcctccgcttagaaactcacgaggaggcttcagttaagatgcttcctacatacgttaggagtacccccgagggctctgaggtcggggacttcttaagccttgatcttgggggaactaacttccgtgtcatgctggtcaaggtgggcgagggcgaggaaggccagtggtctgtgaaaacaaagcaccaaatgtattccattcccgaggatgctatgactggaaccgcagaaatgttgttcgactacatttctgagtgcatatccgattttcttgacaaacatcagatgaagcataagaaattgccgttgggattcacattttcatttcccgtacggcatgaggatattgacaagggtatactcctaaactggacaaagggctttaaagcctccggcgccgagggaaataacgtggtggggctgttgcgcgatgcgattaaaagacggggcgacttcgaaatggacgtggtcgctatggtgaatgacaccgtcgctacaatgatctcatgttattacgaggaccatcaatgcgaggtgggaatgatagtagggacagggtgcaatgcatgctacatggaggaaatgcagaacgtcgagcttgtagagggggatgagggcaggatgtgtgtgaatactgaatggggggccttcggcgattcaggcgagctcgatgagttcctgctggaatacgaccgacttgtggatgagagtagcgccaaccctggtcaacagctgtacgagaaactgatcgggggcaaatacatgggagaattagtgcgtctggtgctcctgcggctggtcgacgagaacctccttttccacggggaagcctccgagcagttaaggaccaggggcgccttcgaaacgcggtttgtatctcaggtggaatctgatactggagacaggaagcagatctataacatcttgagcacactcggactccgcccctccaccacagattgtgatatcgttagaagagcatgcgagtctgtttcgacgagagcggcccacatgtgttccgcaggactagccggggtgattaaccggatgagagaaagtcgcagtgaggatgtcatgaggattaccgttggcgtggacggcagcgtctataagttacatccttcgttcaaggaaaggtttcacgctagtgtgaggagactgacgccatcctgcgagataactttcatcgagagtgaagaggggtccggccgaggggctgccctggtatccgctgtcgcctgtaagaaagcttgtatgctgggacagtag

SEQ ID NO: 189213 - DNA, 1398 bp, Artificial Sequence
  Description of Artificial Sequence: Synthetic coding sequence
atgctggacgaccgggcccggatggaggccgccaagaaggagaaggtcgaacagatcttggcagagttccagctgcaggaagaggacttaaagaaagtcatgcgtcggatgcaaaaagagatggatcgcggacttcgtctggaaactcacgaagaggcctccgtcaagatgctccccacatatgttaggtcaacaccggagggctcggaggtgggcgacttcctgtcactggacttgggaggcactaacttcagagtaatgctagtaaaagtgggcgagggtgaagaggggcagtggtctgtgaagactaagcatcagatgtacagtatccccgaggacgccatgacaggcacagctgagatgctttttgattatatcagcgagtgtatcagtgattttttggacaagcatcagatgaagcataaaaagctccctctgggctttacgttctcctttccagtgcggcacgaggacatagataaaggtattttgttgaactggacaaaagggttcaaagcatctggcgcggagggcaacaatgtggtcggattacttcgcgacgcaatcaagcggcgtggagatttcgagatggacgtggtggctatggtaaacgacactgttgcgaccatgattagctgttactacgaggatcaccagtgcgaggtgggtatgatcgtgggtacaggatgtaatgcctgttatatggaagaaatgcaaaatgtcgagctggttgaaggagatgaggggcgtatgtgtgtcaacaccgagtggggcgcattcggggactctggggagttagacgagtttcttctggagtacgaccggctggttgacgagtcatctgccaatccagggcagcagctttacgaaaaactcatcggcgggaagtacatgggcgagttggtaagacttgtgctcctgagattagtggacgagaatctgctgttccacggagaagcgagtgaacagctcagaacccggggggcatttgagacccggttcgtaagccaggtcgaatcagacaccggcgacagaaagcagatatacaacatactgagtacactgggacttagacctagcaccaccgactgcgacatagtgagacgggcctgcgaatcagtgtctacacgcgcagcacacatgtgcagcgcagggttggctggcgttataaatcgtatgagggaaagccgctccgaagacgtcatgaggattacagttggagtcgatggctcggtatacaagctgcatccttcttttaaagaacgctttcacgccagtgtaagaaggctgacacctagctgtgagatcacgttcatcgagtcagaggaagggtcagggaggggcgccgcgcttgttagcgcggtggcatgcaagaaggcctgcatgctgggacagtag

SEQ ID NO: 189214 - DNA, 1878 bp, Artificial Sequence
  Description of Artificial Sequence: Synthetic coding sequence
atgcccggcaccaagcggttccagcacgtgatcgagacccccgagcccggcaagtgggagctgtctggctatgaggcagctgtccctatcacggaaaaatcaaacccactgacacaggacctggacaaggccgatgcagaaaacatcgtgcggctcttgggccagtgtgacgcagagattttccaggaggagggtcaggcactgtcaacctatcagcgtctctattccgagagtattctgactacaatggtgcaggtcgcaggaaaagtccaggaggtccttaaagagcccgatggtggacttgtggtcctgtctggcggaggcacaagtggtagaatggcgtttctgatgagcgtgtcctttaaccagctgatgaaaggactgggccagaagcccttgtacacctacttaatagcaggaggggacaggagcgttgttgcaagcagagaaggaaccgaggattccgccctccacggcatcgaggagctcaaaaaggtggcagccggaaaaaaacgtgtgattgtgattggtataagcgtgggcctttccgctcccttcgtggctggccaaatggactgttgtatgaacaacacggccgtgtttcttcccgtgctggtcggcttcaacccagtgtcaatggctaggaacgaccccattgaagactggtcctccacatttcgccaggtcgccgagcggatgcagaagatgcaggaaaagcagaaagcgttcgtgttgaaccctgccatagggccagaaggcttaagcgggtctagtcgcatgaagggcggcagtgccacaaagatcctgttagaaaccttgctgcttgctgcccataaaaccgttgaccaaggtattgccgcctcccaacggtgcctgctggagatcctccgcacctttgagagggcccatcaggtgacttactcacagagcccaaaaatcgcaaccctgatgaagtccgtgtccacttcgctcgagaagaagggacacgtttacttggtgggctggcagaccctcggcattatcgccataatggatggcgtcgagtgcatccacacttttggcgctgatttcagagacgtcaggggattcctcattggggaccacagtgatatgtttaatcaaaaagctgaattaactaatcagggcccacagttcacattcagccaggaggactttctgaccagtattctgccgagtctgacggagattgataccgtcgttttcatcttcactctggacgataacctgacagaagtgcagactatcgtcgaacaggttaaagagaaaacaaatcatatccaagccttggcacactcaaccgttgggcaaaccctactgattccactgaaaaaactttttccaagtatcattagtatcacatggcccctacttttcttcgaatacgagggaaatttcatccaaaagtttcagcgggagctttccacgaaatgggtcttgaataccgttagcaccggcgcacatgtgctgctcggcaaaattctgcaaaaccacatgctagacttaaggatatccaactccaagttgttttggagagcactagcaatgttgcagcggttttccggccagtccaaagcccgatgcattgagagcctcttgagggccatccactttcctcagccacttagcgacgacatccgcgcggctccaattagttgtcatgttcaggtcgctcacgagaaggagcaggtgatcccaattgcactgctatcactcctgtttcgctgctcaattacggaagcccaggcccacctggcagcagcgccttctgtttgcgaggccgtgcgaagcgcgctggccgggcccggccaaaagagaacagccgatccactagagatactggagcccgatgttcagtag

SEQ ID NO: 189215 - DNA, 1308 bp, Artificial Sequence
  Description of Artificial Sequence: Synthetic coding sequence
atggactgctgcatgaacaacaccgccgtgttcctgcccgtgctggtcgggttcaatccagtaagcatggcgagaaacgatcccatagaggactggtcatcgacattccgtcaggtagccgagcggatgcagaagatgcaggaaaagcaaaaggcctttgtcctaaaccctgccataggacctgaggggctaagcggaagttcacggatgaagggcgggtctgccaccaagattctgctggaaacactgctgctagcggcccataaaactgttgatcaaggtatcgctgcaagccagcggtgtctcctggagatcctcagaacttttgagagggctcaccaggtgacctactcacagtcaccaaagattgccaccctcatgaaatcagtgagcaccagcctcgaaaagaagggccacgtgtatctggttggctggcagacacttggaattatcgccatcatggatggtgtggagtgcatccacaccttcggggccgatttccgggacgttagaggcttcctcatcggcgaccattctgacatgtttaaccaaaaagccgagctgacaaaccaaggcccgcagtttacattctcccaggaagattttctcacaagtattctgccgtcactgaccgaaattgacaccgttgtgtttatattcacgttggacgataacttgactgaggtccagactatcgtggaacaggtaaaggagaagacaaatcacattcaggcactggcccattccaccgtaggtcagaccctgctgattcccctcaagaaactttttccttcgataatctctatcacgtggccgctgctattttttgagtacgagggtaacttcatacagaagttccagagagaactgtcaaccaagtgggtgctgaacacggtgtctacaggtgcacacgttcttctcgggaaaatcctgcagaaccacatgctggaccttcgcatttcaaacagtaaactgttttggcgtgcactggctatgctgcagagattctcaggccagtccaaagcccgatgcatcgagagcttgctgagggctatacacttccctcaaccactgtccgatgatataagggcggcccccatcagttgtcatgtgcaggtcgcccatgagaaggaacaggtaatccccatagccctcttatccttactctttaggtgctccattactgaagcccaagctcatttggctgccgcgccttctgtgtgtgaagccgtgcgttccgcgctggccggtccaggccagaagcggacagctgatcctctggagatactagagccagacgttcaatag

SEQ ID NO: 189216 - DNA, 1659 bp, Artificial Sequence
  Description of Artificial Sequence: Synthetic coding sequence
atgcggctgctgcccctggcccccggccggctgcggcggggcagcccccgccacttaccctcatgttcccctgcccttttgctgctggtcctcggaggttgcttaggtgtctttggcgtggcagccggtaccaggagaccgaatgtggtcctcctattgaccgacgatcaggacgaggtgctcggcggcatgacccctcttaaaaaaaccaaagcattgataggagaaatgggaatgaccttttcctcagcatatgtgccaagcgccctgtgttgcccatccagggcatcaatacttaccggcaagtatcctcataatcaccatgtggtgaataataccttggaggggaattgcagttctaagagctggcagaaaatccaggagccaaacactttccccgctattctgaggtccatgtgcgggtatcagacctttttcgcaggcaaataccttaatgaatatggtgccccggacgcaggtggactggagcatgtaccactgggctggagctattggtatgctctggaaaagaactctaagtattacaactacaccctgagtattaatggaaaggcgagaaagcatggcgagaattactctgttgactacctcacagacgtcttggcgaacgtgagtcttgattttcttgactacaagagcaacttcgagccgttttttatgatgattgctaccccagcccctcactctccttggacagcggcacctcagtaccaaaaggcctttcagaatgtattcgctcctagaaacaaaaactttaacattcatggtaccaacaagcattggcttatcagacaggccaagacgccaatgaccaatagttctatccaatttctggacaacgcatttcgtaaacggtggcaaactttgctgtcagtcgacgatttggttgagaaacttgtcaaaaggttggaatttaccggtgagttaaacaatacctatatcttttatacatcagataatggctatcacaccggacaattctccctcccaatcgataagaggcagctctatgaattcgacatcaaggtgccgcttctggtgcgcggtccagggatcaaaccaaatcaaacaagtaaaatgctggtggccaatatagatctaggtcccacaattttggatattgcaggttacgacctgaataaaacccagatggatggaatgtcccttcttcccatacttaggggcgcttccaaccttacctggcgttccgatgtcctggtggagtatcagggtgaggggaggaacgttaccgatccaacctgccccagtttgtcaccaggggtatcacagtgttttcccgactgcgtgtgcgaggatgcttacaacaatacttacgcctgcgtgcgcaccatgtccgctctgtggaacctccagtactgtgagtttgatgatcaggaggtgttcgttgaggtctataacctgacagcagatcccgaccaaatcacaaatattgccaagaccatcgatcctgagctgctgggcaaaatgaattaccggctgatgatgctgcagagctgcagtggacccacctgccgaactcccggcgtgttcgaccccggatacaggtttgaccctcgcctaatgttctctaaccgcggatccgtgaggacgcgccgcttctcaaagcacctactctag

SEQ ID NO: 189217 - DNA, 1410 bp, Artificial Sequence
  Description of Artificial Sequence: Synthetic coding sequence
atgtacgtgcccagcgccctgtgctgccccagccgggccagcatcctgaccggaaagtaccctcacaaccatcacgtagtcaataatactctggagggcaactgctcctcaaaatcttggcagaagatccaggagccaaataccttccctgcaatcctaagatcaatgtgcgggtatcagacattcttcgctggaaaatatttaaatgagtacggggcccccgacgccggcggcctggaacatgtgccactcggctggtcctattggtatgccttggaaaagaacagcaagtactacaactacaccctctccattaacggaaaggcccgcaagcacggtgagaattacagtgttgattacctaactgatgtgttagcaaacgtgagtcttgattttcttgattacaaatccaattttgagccttttttcatgatgatagccactccggctcctcactccccctggaccgctgctccccagtatcagaaggcctttcagaacgtttttgctccaaggaacaagaattttaatattcatggtacaaacaaacactggttgatccgacaggccaagacacctatgaccaactcctccattcagttcctcgacaacgcgttccgtaagcggtggcagacactcctgagcgtggatgatcttgtggaaaaactcgtgaagcggctcgagtttactggagaactgaacaacacttatattttttacacatccgacaacggttaccacactggccagttttctctccctatcgataaaaggcagctgtatgagtttgatattaaggtgcccctgctggtccgagggccagggatcaaaccgaaccagacctcaaagatgctggttgccaatatcgacctgggaccgactatccttgatatagccggctacgacctgaacaaaacccagatggacggtatgtcactcctgcccatactccgcggcgctagcaacctaacctggagaagtgacgttctcgtggaatatcaaggcgagggaaggaatgtgaccgaccccacatgcccttctttaagccccggtgtctcccagtgtttcccagattgtgtgtgcgaggatgcctataacaatacctacgcctgcgttagaacaatgtcagctttgtggaacctgcaatattgtgagtttgacgatcaagaagttttcgtggaagtatacaacttaactgccgaccctgatcagatcaccaatattgccaaaaccattgatccagaactgctcggaaagatgaattatcgtctaatgatgctacagtcttgttcaggaccaacctgtcgtactcccggcgtcttcgatcccggctatcggttcgacccacgcctgatgtttagtaacagaggttctgtgcgtacgcgccggttttcgaaacacctgctttag

SEQ ID NO: 189218 - DNA, 1599 bp, Artificial Sequence
  Description of Artificial Sequence: Synthetic coding sequence
atgcggctgctgcccctggcccccggccggctgcggcggggcagccctcgtcacctgccatcctgctcccccgccctcttgctgctcgttctcggtggatgtttgggagtgttcggtgtcgctgctggaacccggagaccgaatgtcgtgctacttctgaccgacgaccaggacgaagttctgggcgggatgtacgtcccttcagcgctgtgctgtccctctcgtgccagcattttaacaggcaagtatccacacaaccaccatgtggtaaataacacattagaagggaattgctcctccaagagttggcagaaaatacaggaaccgaatacctttcctgccattttgagaagcatgtgcggctaccagaccttctttgcaggcaagtacctaaacgaatatggggcacctgacgccggaggacttgaacatgtcccactaggatggtcctattggtacgccctggagaaaaacagcaaatactataattatacactgtctatcaacggcaaggctcgcaagcacggcgagaactacagcgtggactacttaacggatgtcttagctaatgtgtcccttgattttctggactacaagtcaaattttgagcctttttttatgatgatcgccacaccagccccacactcaccgtggacggctgctccccagtaccagaaggctttccagaacgtgtttgcacccagaaataaaaattttaacatccacggtacaaacaagcattggctcatccgtcaggccaaaaccccaatgaccaattcctctatccagttcctggataacgcgtttagaaagagatggcagacgcttctgagcgtggacgacctggtcgaaaagcttgtgaaacgattggagtttactggcgaactcaataacacatatattttctatacatccgataatggctaccatacagggcagtttagtctgcccattgataagagacagctgtacgagtttgatatcaaagtccctctcctcgtcagagggcctggcattaagcccaatcagacatctaaaatgttggtcgctaatattgatctaggacccaccatcctcgacatcgccggatatgatctcaacaaaacccagatggatggtatgtccctcctgccaatactgaggggcgcctcaaacctaacgtggcggagcgacgtgctagtggaataccaaggagaagggaggaatgtcactgaccccacatgcccaagtctgtctcctggagtctcacagtgttttcccgattgtgtgtgcgaagatgcttacaacaatacttacgcgtgcgtgcgaactatgtcagccttgtggaacctccaatactgtgagtttgacgaccaagaggtctttgtggaggtctacaatctgaccgccgatcctgatcaaatcaccaacatcgcgaagactatcgaccctgagttgctcgggaagatgaactatagactcatgatgctccagagctgttcaggccccacatgtcgtacccctggtgtgtttgaccccgggtataggtttgacccccgcctgatgttcagcaatagggggagtgtaaggactagacgattttcgaaacatctgctatag

SEQ ID NO: 189219 - DNA, 2154 bp, Artificial Sequence
  Description of Artificial Sequence: Synthetic coding sequence
atgcccatcggcgactgcagcgtggccgccaagccccggaagcagttactatgctccctgtttcagactacgcttggctatcgagcaagggcaagcggatggaaacccatggttatttgccgtggatcgcatgcatttaaggatctaatcaacacgtaccgaatgattgagcaggatgattttgatattaatacaaggctgcacactatagtgaggggtgaggacgaggctgccatggtggagagcgttggcctggccctagtcaaactgcctgacgtgctgaaccgcctgaagcctgacatcatgatagtacatggggatcgcttcgatgcgctcgctttggcgacttcagccgcgctcatgaatattcggattcttcatatcgaggggggggaggtctctggcaccattgacgactccatccggcatgctataaccaagcttgcccattaccatgtctgttgtacaagatctgcggaacagcacctcatctctatgtgcgaagaccacgacaggatcctgctcgctggctgtccctcttacgataagctgctaagtgctaagaataaagattatatgagcatcatcagaatgtggctcggggatgatgtaaaatctaaagattatatcgtcgctctgcagcatcccgtgaccacagatattaaacacagcattaaaatgttcgaactgacactcgatgcactgatctcattcaataagcgaactcttgtgttgttcccgaatattgatgccggcagcaaagagatggtccgtgttatgcgaaagaagggaattgagcatcaccccaacttccgcgcagtgaaacatgtccctttcgatcagtttattcagctggtggcccatgccggctgtatgattggtaactcatcatgcggagtgagggaggttggagccttcggtaccccagtgatcaacctcggcaccaggcagattggtcgcgagactggtgagaacgtcttgcacgtcagggatgcagacacccaggacaagatcctgcaggccctgcacctgcagtttggaaaacagtacccgtgctccaaaatctatggtgacggcaacgcggttcctaggattctcaagttcctgaaatcaattgacttgcaagagcccctacagaagaagttttgtttcccgcctgtgaaggagaacattagccaggatatcgatcatatcttggaaaccctatccgcgctcgcagtggacttgggaggaaccaacctgcgggttgccatcgtctctatgaagggtgagatcgtcaagaagtatactcagtttaatcccaagacctacgaggagagaatcaatctcatcctccagatgtgtgtagaagccgcagccgaggcagtgaagctcaactgccgtatccttggcgtggggatcagcacgggtggtagagtgaaccccagggaggggatcgtcctccactctaccaagttgatccaagagtggaattcagtcgacctgagaactcctttgtctgacacgctccatctcccagtgtgggtggataacgatggcaattgtgccgctctcgcagagcgtaagttcggacaggggaaaggcctcgagaacttcgttaccttgattacgggaaccggaatcggcggtgggattattcaccagcacgaattgatccatgggtcgtctttctgtgcagctgagctcggtcatttggtggtcagcctagacggccccgactgcagctgcggcagccacggctgcattgaagcctacgctagcggaatggccctgcagagagaagccaaaaagcttcatgatgaggacctcctgttagtggagggcatgagtgttccaaaggatgaagctgtgggcgccttgcaccttatacaagctgctaagttaggcaatgctaaggcccagagtattctgcgcactgctgggacagcgctgggacttggcgtggttaatattcttcacacgatgaatccctccttggtgattttgtcaggagtgctggcttcccactatattcatattgtgaaggacgtgatccggcagcaggccctgtcatcagtccaggacgtggacgtagtcgtttccgatctcgtcgatcctgctctgctgggagcagcttctatggtgctcgattatacaactcggaggatttactag

SEQ ID NO: 189220 - DNA, 2169 bp, Artificial Sequence
  Description of Artificial Sequence: Synthetic coding sequence
atggagaagaacggcaacaaccggaagctgcgggtgtgcgtggccacctgtaatcgcgcagattactccaagctggctccaatcatgttcggaatcaagaccgagcctgagttctttgaactcgatgtcgtggtcctgggatctcatctgattgatgattacggaaacacctaccggatgattgaacaggacgactttgacattaatacacggctgcataccatcgtgcggggggaagatgaggccgccatggtggagagtgtgggactcgcccttgtaaagctgcctgacgttctgaaccggctgaagccagacataatgatcgtccatggcgatcggtttgacgccctggctctagctacgtcggcagccctgatgaatattcgcattttacacattgagggaggagaagtttctggtactattgacgatagtattcggcacgccatcactaaactcgcccactatcacgtgtgctgtactcgatccgccgaacagcacctgatttctatgtgcgaagaccatgaccgcatccttctcgccggttgtccctcctatgacaagctccttagcgctaagaacaaagactacatgtcgatcatccgcatgtggttaggtgatgacgtaaagtcaaaggattacatcgtggccttgcagcatccggtgaccacagatattaagcattctataaaaatgtttgagctgaccctggatgccttaatctccttcaataaaagaaccttggtcctattcccaaacatcgatgcaggcagtaaggagatggtacgcgttatgagaaaaaagggcatcgagcaccacccgaactttcgggccgtgaagcacgtgccattcgatcaattcatacagctggtagcccacgctggttgtatgatcgggaattcgagttgcggcgtgagggaagttggcgccttcggtacccccgttatcaaccttggaaccagacagatcggccgggaaacgggcgagaatgtgctgcacgttcgggatgcagacacccaagataagattctccaggctttgcacctgcagttcggtaagcaatatccatgttcgaagatatatggagacggtaatgcggtccctaggatcttgaagttcttaaaaagcatcgacctgcaagagcctctccaaaagaaattctgctttccgcccgtgaaagagaacatcagccaagacatcgaccacatcctggaaactttgtcagctctggccgtggatctcggagggacgaatctgcgtgtcgccattgtgagtatgaaaggcgaaatcgtgaaaaagtacacacagtttaacccaaagacctacgaggaaagaatcaatctgatcttgcagatgtgtgtcgaagccgccgcagaggccgtgaagttgaactgtcggattctgggtgtgggcatttccacagggggtagggtaaacccccgggaggggatcgtattgcactccaccaaactaatccaagagtggaatagtgtcgacctgcgcacccccttgtctgacacgctccatctcccggtgtgggttgataacgacggaaactgtgccgctctggcagaaaggaagtttggacagggtaaaggactagagaatttcgtgacactaatcaccggaacgggtatcggtgggggcattatacatcaacacgagctgatccatggatctagcttttgtgctgcagagctgggccatctggttgtctccctggatggccccgactgctcatgcggtagtcacggctgtatcgaggcttacgccagcggtatggcactccaacgggaggccaaaaaactgcatgacgaagatttacttcttgttgaaggcatgtccgtgcccaaggatgaggccgttggggcattgcacctgatccaggctgctaagctcggtaatgctaaagcacagtctattcttcggaccgccggaactgccctgggccttggagttgtgaatatcttgcacaccatgaacccctccctggttattttatctggcgtattggcaagccactacatccacattgtcaaagacgttattagacagcaggctttatcaagtgttcaggacgtggatgtggtagtttccgatctggtggacccagctcttttaggcgccgcgagcatggttcttgactacacaacccgccggatctattag

SEQ ID NO: 189221 - DNA, 2262 bp, Artificial Sequence
  Description of Artificial Sequence: Synthetic coding sequence
atggagacctacggctacctgcagcgggagagctgcttccagggcccacatgagctgtactttaaaaatcttagcaagcgcaataaacagatcatggagaaaaatggaaataatcgcaagctgcgagtgtgcgtggctacctgtaatcgcgcagactacagcaaactcgcacccatcatgtttggcataaagacagagcccgaattcttcgagctggacgtcgtggtgctgggatcacacttgattgacgactacgggaacacataccgcatgattgaacaggatgattttgacatcaatacccggttgcatactattgtgagaggcgaggacgaggccgcaatggtggagagtgtgggcttggccctggtgaagttgccagacgtactgaaccgcttgaagcctgatattatgatcgtccatggcgatcggttcgatgcactcgctctggccactagcgccgccctcatgaacattagaattctccacatcgagggcggggaagtgagtgggaccattgacgattcaattaggcacgcgattaccaaactggctcactaccatgtctgttgtaccagatctgcagagcagcacctgatcagtatgtgcgaagatcacgatagaattctcctggccggttgtccaagttatgacaagttgctgtcggctaaaaacaaagactatatgtctataatacggatgtggctcggggacgatgtaaaatctaaggactacattgttgccctccagcaccccgtcaccacagacatcaaacactccatcaaaatgtttgaattgactttggatgcactgatctccttcaataagaggacactggtattattccccaatatcgatgcaggttccaaagaaatggtgcgggttatgagaaagaaaggcattgagcaccaccctaactttagggcggtcaagcacgtgccattcgaccagtttatacaactcgtggctcatgcgggctgcatgatcggaaatagttcatgtggcgtgagagaagtgggcgcttttggaacacccgtaattaatttaggcacacgtcagatcgggcgggagaccggggagaacgtgttgcacgtcagagatgctgacacacaggacaagatcctccaggccctgcacttgcagttcggcaagcagtatccttgttctaaaatttatggcgatggcaacgcggttccccgaatcctgaaattccttaagagcatagatctgcaggagccactccagaagaagttttgctttcctcctgtaaaggaaaacatcagccaagatatcgatcatattttggaaactctctctgctctagctgtggacctgggcggcaccaatctgcgggttgccatcgtgtccatgaagggcgagatcgtgaagaaatatacacagtttaatcctaaaacgtacgaggagaggatcaacttaattcttcagatgtgcgtcgaagccgcagctgaggccgtgaagctaaattgccgcattctcggcgtaggcatctccactggcgggagagtaaaccctagggaaggcattgtccttcacagtactaagctgattcaagagtggaactcagtcgatttgcgaacgcccttatctgatactcttcacctccccgtctgggtcgataatgacggtaactgcgctgcccttgcagaacgcaaatttggccaaggaaagggactcgagaacttcgtcacactgattaccggcacaggaatcggcggcgggatcatccaccagcacgagcttatacacggcagctcattctgtgcagccgaattaggacacctggtcgtctccctcgacggacctgactgctcctgcggctcccatggttgtatagaggcatacgctagcggcatggccctccaaagagaggctaaaaagctgcacgatgaggacctcctgctggtcgagggtatgagcgttcctaaagatgaggctgtcggcgctctacacttgatccaggctgccaaactaggaaatgcgaaggctcagtctattttgcgcacagccggtacggcattgggcctgggggtggtcaatatcctacacaccatgaatcccagtttggtaattctgagcggtgtactagcttcgcactacattcacattgtcaaggacgtcatcagacagcaagcactgagtagtgtacaggacgtcgatgtggttgtatctgatctcgttgaccctgcactgctgggggcagcatctatggtattagattacactacacgccgcatttactag

SEQ ID NO: 189222 - DNA, 399 bp, Artificial Sequence
  Description of Artificial Sequence: Synthetic coding sequence
atgttcgagctgaccctggacgccctgatcagcttcaacaagcggactctggttcttttccctaatattgacgcaggatctaaggaaatggtccgggtcatgcggaaaaaagggatcgaacatcaccccaattttagggcggtgaagcatgtgccatttgaccagtttatccaactggtggcacacgcaggttgcatgatcggaaactctagttgtggagtgcgagaggtcggggccttgacaaggctctatacttatgtgtcttgctataagcatactcatacacatactcacactcacccttcgtcctcaaacccgaagctgcggagccagaaagtcatacaatccgagaacaggggcaagtcctaccaggagggactgaaatatacctttttctag

SEQ ID NO: 189223 - DNA, 2169 bp, Artificial Sequence
  Description of Artificial Sequence: Synthetic coding sequence
atggagaagaacggcaacaaccggaagctgcgggtgtgcgtggccacctgtaaccgcgccgattactccaagctggcaccaatcatgttcggcattaagactgagccggaattctttgagctcgatgtggtcgtgttgggcagccatctgatcgacgattacggaaacacgtaccgcatgattgagcaggacgacttcgacataaatacccgacttcatacaatcgtgcggggggaggatgaggccgcgatggtcgagagtgtcgggttggcactggtgaagctcccagatgtgctcaatcgtctaaagcccgacatcatgatagtacacggggatcgctttgacgccctggccttagctaccagcgccgccctaatgaatatcaggatccttcacatagaggggggagaggtgtccgggaccattgatgactccatccggcacgcgattaccaagttggcgcactaccacgtctgttgtacccgctccgccgagcagcatctcatcagcatgtgcgaggaccacgatagaattctgctggcaggttgccccagctacgataagctgttgagcgccaaaaataaggactacatgagcataatcaggatgtggctgggggatgacgttaagtctaaggactacattgttgccctgcagcaccccgtgacaactgacattaagcattccattaaaatgttcgaactgacactggacgctctgatatcctttaataagcgcactttggtgctctttcctaatatcgacgccggttccaaggaaatggtgcgcgtcatgaggaaaaaagggatcgaacaccaccccaacttccgcgccgtcaaacatgtgcccttcgatcagtttattcagctagtagcccacgccggctgcatgatagggaactccagctgtggggtgcgggaagttggcgccttcgggaccccagtcattaacctgggcacgcgtcaaattggccgagagaccggagaaaacgtcttacatgttcgggatgcagatacccaagacaaaattctgcaggcactccatctgcaatttggaaagcagtacccgtgctcaaagatctacggagatggaaatgcagtgccgcggattttaaaattcctaaagagtattgaccttcaagagcctttacagaagaaattttgctttcctcccgttaaagaaaacatctcacaagacatcgatcacatcctggagacactctccgccctggccgttgatttgggaggcaccaatcttcgagtagcgattgtgtccatgaagggagaaattgttaagaaatacacccagttcaacccaaaaacttatgaagaaaggattaatctgatcttgcagatgtgcgtggaggctgcagcggaggctgtgaaactcaattgccgcatcctcggcgtgggtatatcaacaggggggcgggtgaatccccgagagggaatagtccttcattcaaccaaactgatccaagagtggaactcagtggatttacgcacgcctttaagcgatactcttcacctacccgtatgggttgacaatgacggaaactgtgcagcccttgccgagcgaaagttcggccagggcaagggcctcgagaactttgtcacccttatcaccggaacaggtataggcggaggcattatccaccagcatgagctgatccacggatcctcgttctgcgctgctgaactggggcacctcgttgtgtccctcgatggcccggactgcagctgcggttcccacggctgtatcgaggcatacgcatcaggcatggcgctgcagcgagaggcaaagaaattacatgacgaagatcttttgctagtggaaggcatgtctgtgcctaaagacgaggccgtcggggccttgcacctgatccaagccgcaaagctgggcaatgctaaggcccagtctattctgaggaccgccggtactgcattaggtctcggcgtggttaacatactgcacaccatgaaccctagcctagttattctgtccggcgtcttagcttcacattacattcacatcgtgaaagatgtgattcgacagcaagcgctgtcctccgtgcaagacgtggacgtcgtcgtctccgacttggttgatcctgccttactgggcgctgcctctatggtgctggactataccacacggaggatttattag

SEQ ID NO: 189224 - DNA, 1947 bp, Artificial Sequence
  Description of Artificial Sequence: Synthetic coding sequence
atggagaagaacggcaacaaccggaagctgcgggtgtgcgtggccacctgcaaccgggccgattattcaaaattggccccaatcatgttcggtatcaagaccgagccagaatttttcgaactcgatgtcgtggtgctgggctcccacctgatcgatgactacggcaacacgtacaggatgatcgagcaggatgacttcgacattaacactaggctccacactatcgtacgcggggaagacgaagccgcaatggtggagtctgtgggactggccttggtgaagctccctgatgtcctgaatcggctcaagccagatatcatgattgtacacggcgaccggtttgacgctctggcactggctactagtgccgcgttaatgaacatccgtatcttacacatcgaagggggcgaagtgtccggtacaattgacgacagcatcagacacgcgattaccaagctcgctcattaccatgtctgctgtacacggtccgcagagcaacatctgattagtatgtgcgaggatcatgaccggatactcctggctggttgcccatcctacgacaagctgctgtcggccaaaaataaggactacatgagtatcattagaatgtggctgggtgacgacgtgaagagtaaggactatattgttgcgcttcagcaccccgtgacaacggacattaaacactccatcaaaatgtttgaacttacactggacgcgctgattagcttcaataagcgtactctggtcctgtttcccaatattgacgccgggtccaaggaaatggtgagagtcatgcggaagaaaggcatcgagcaccatccgaatttccgcgccgtcaaacacgtacccttcgatcagttcattcaactggtcgcgcatgccggatgtatgatcggcaactctagctgtggcgtgcgcgaggttggcgcattcgggaccccggtaattaacttaggtacaaggcaaatcggtcgcgagacaggtgaaaacgttttacatgtgagagatgctgacactcaagataaaattcttcaagctttgcatctgcagtttggaaaacaatatccctgctccaaaatctacggcgacggaaacgccgtcccacgaatcttgaagttcttaaaatccattgacctgcaggagccgctgcagaagaaattctgcttcccacccgtgaaagagaatatttcacaagatatcgatcatattctcgaaactttgagcgctctggccgtcgatctgggggggaccaacctgagagtggccatcgtgtctatgaagggcgagatcgtgaagaaatacacgcagtttaaccctaaaacgtatgaagagcggatcaacctaattttgcaaatgtgcgtcgaggccgccgctgaggcagtcaaactgaactgccgtatactgggagtgggtattggcggtgggattattcatcagcatgagcttatccacgggagctccttctgtgccgccgagctcggccacctggtggtctctctcgatgggcccgactgctcctgcggcagccacggttgcatagaggcctatgccagtggaatggcactccagcgcgaggcaaaaaagctgcacgatgaggacctacttttagtggaaggcatgtcagtccctaaagacgaagccgtgggagccctacatctcatccaggccgcgaaactgggaaatgcaaaggcacaatctattttgcgtacagccgggaccgctctcggcctcggggtagtgaatatcctgcacacaatgaacccctctcttgtcatcttaagcggagtgcttgctagccactacatccacatagttaaggatgttatccgccaacaggccctcagttctgtccaggatgtcgatgtagttgtgtctgatctggtagaccctgcccttcttggtgccgccagcatggttctcgactatactacacgccggatatactag

SEQ ID NO: 189225 - DNA, 1839 bp, Artificial Sequence
  Description of Artificial Sequence: Synthetic coding sequence
atgatcgagcaggacgacttcgacatcaacacccggctgcacaccatcgtgcgcggcgaggatgaagctgccatggtggagtctgtggggctggccctggtcaaactcccggacgtcctcaatagattaaaacccgatattatgatcgtgcacggggatcgatttgacgcattggcattggcaacttccgccgccctgatgaatatccgaatcctccacatagaagggggcgaagtaagtgggactatagacgactccatccgacatgctatcacaaagctcgcacactaccacgtctgctgtacaagaagcgcggagcaacacctgatcagcatgtgtgaggatcacgacaggatcctgttagcgggttgtccctcgtacgataaactgttatccgcaaagaataaggactatatgagtattatcagaatgtggctcggaagtaaagaaatggtacgggtaatgcgaaagaagggcatcgagcatcacccaaattttcgcgccgttaaacacgtcccatttgaccaatttatccagctcgtggcgcatgccggttgcatgattggtaacagttcttgcggtgttcgggaggtgggtgcgttcggaacccccgtcattaacctcgggaccaggcagataggcagggagaccggcgaaaacgttctgcacgtacgagacgctgacacacaggataagatactgcaggccctacacctgcagtttggcaaacagtacccttgctctaaaatctatggagatggcaacgccgttccgcggatccttaagttccttaagagcatcgatctccaggaacctctccagaagaaattttgtttcccccctgtgaaggagaacatttctcaggacatcgatcatatcctggagacactgtctgccttggcggtagatctcggggggactaacctacgggttgccatcgtcagcatgaaaggggagatcgtgaaaaagtacacgcagtttaatccaaaaacatacgaggagcgaattaacctgatcctacagatgtgtgtggaggctgcagctgaggctgtgaagctgaattgccgaattttaggggtgggcatttctacgggtggtagggtgaatcctcgggaaggtatagtcctccacagtacaaaactgatacaggaatggaattccgtggacttgcgcacccccctctctgatacactacatctgcctgtgtgggtcgacaacgacggcaattgtgcagcgctggctgaacggaaatttggacagggcaaggggctggagaattttgttaccctgatcacaggcaccgggatcggcggcggcatcatccaccagcatgagttgatccatggctctagcttttgcgccgcagagttaggacacctggtggtgtcactggatggaccagattgtagctgcggcagccatggatgcattgaagcatacgcgagtgggatggcccttcagcgcgaggcaaagaagctgcatgacgaggaccttctcctggtggagggcatgagtgtgcctaaggacgaggcagtcggcgccctgcacctgatccaggcagctaagctggggaatgctaaagcccaatctatcctgcgaacagctgggacagccttgggattaggcgtcgtgaatatcctgcataccatgaacccctcattggttattttatcaggtgtgttggcttctcactacatccacattgtgaaggatgtcattaggcagcaagctttgtccagcgtgcaggacgtcgacgtggtggtcagcgatctcgtcgaccctgccttgctgggggccgcctccatggtcctcgattatacaacacgccggatttattag

SEQ ID NO: 189226 - DNA, 870 bp, Artificial Sequence
  Description of Artificial Sequence: Synthetic coding sequence
atgaagctgatcatcctggagcactacagccaggccagcgagtgggcagcaaagtacattaggaatcgaatcatccaattcaatcccggcccagaaaagtatttcaccctgggacttccgacagggagcacccctctgggatgttacaaaaaactcatcgagtactataaaaatggagacctgtcgtttaaatacgtgaaaacttttaatatggacgagtatgtgggtctcccccgggaccacccagaatcatatcattccttcatgtggaataacttctttaagcacattgatatccacccggaaaacacgcacatcctcgatgggaatgctgtggatctccaggccgaatgcgatgcttttgaagaaaaaatcaaggccgcaggaggtatcgaactgtttgtgggtggcattggtcctgacggccacattgcctttaacgaaccaggtagctcccttgtcagccggacacgagttaaaactctggcaatggatacgatcttggccaacgcacgcttctttgacggagaacttacgaaagtcccaacgatggcactgacggtaggagtagggacggtcatggatgctcgcgaggtcatgatcttgattactggggctcacaaggcattcgcactctataaagccatcgaggaaggtgtgaatcatatgtggacggtgagcgcattccaacagcatcctcggaccgtcttcgtctgcgacgaagacgccactttggagctcaaggtgaaaactgttaagtattttaaagggctcatgctggtgcataataagctagtggatcccctctacagcatcaaggaaaaagaaaccgagaagtctcaaagttctaagaaaccttactcagattag

SEQ ID NO: 189227 - DNA, 768 bp, Artificial Sequence
  Description of Artificial Sequence: Synthetic coding sequence
atgaagctgatcatcctggagcactacagccaggccagcgagtgggcggctaagtacataagaaacaggataatccagttcaacccgggcccagagaagtatttcacacttgggctgccgactggacttccccgagatcaccctgagtcttaccactccttcatgtggaacaattttttcaagcacattgatatacatcctgaaaatactcacatactggacggcaacgctgtcgatctccaggcggaatgtgatgcgttcgaagagaaaattaaggctgcaggcggcatcgagcttttcgtaggagggattggcccagatgggcacatcgcgttcaatgagccagggtcctctcttgttagccgtaccagggtgaaaaccttggccatggataccatcctggcaaatgcacggttcttcgacggagaactaactaaagtgcccaccatggctctaacagtcggagttggtacagtgatggatgcacgtgaagtcatgatccttataaccggcgcccacaaggcctttgccctgtacaaggctattgaggagggtgttaaccatatgtggactgtgtcagcattccagcagcatccccggactgtgttcgtgtgcgacgaggatgctactctggagttgaaagttaagacagtgaaatatttcaagggattaatgctggtgcataacaagttggtggatcccctgtactctatcaaggaaaaggaaaccgagaaatcgcagtccagtaaaaaaccctactccgattag

SEQ ID NO: 189228 - DNA, 870 bp, Artificial Sequence
  Description of Artificial Sequence: Synthetic coding sequence
atgaagctgatcatcctggagcactacagccaggccagcgagtgggccgccaagtacatcaggaacagaatcattcagttcaaccctgggcccgaaaaatactttaccctgggcctgcctaccggctccactccacttggatgttacaaaaagctcatcgagtactacaagaacggggacctcagctttaagtatgtgaagacattcaacatggatgagtatgtgggtctgcctcgcgaccacccagaatcataccattcattcatgtggaacaactttttcaagcacatcgatatacaccccgagaatactcacatattagacgggaatgccgtggatctgcaggctgagtgcgatgccttcgaagaaaagatcaaagccgcggggggcattgagctcttcgtgggcgggattgggccggatgggcacatcgcatttaatgagcctggatctagcctcgtgtcccgcactcgcgtgaagaccctagccatggataccatcttggctaatgccagattttttgacggagagttgaccaaagtgccaaccatggctctcaccgtgggagtgggaactgtgatggacgctcgggaggtcatgatcctgatcactggagcccataaagcctttgctctatacaaagcaatagaagagggagtgaatcacatgtggacagtgtcggccttccaacagcaccctcgcaccgtcttcgtttgtgacgaggacgccactcttgaacttaaagtcaagactgtgaagtactttaaaggcctgatgctagtccacaacaagttagttgatcccttgtattctataaaggagaaggaaaccgagaagtctcagagcagtaagaagccctatagtgactag

SEQ ID NO: 189229 - DNA, 417 bp, Artificial Sequence
  Description of Artificial Sequence: Synthetic coding sequence
atgaagctgatcatcctggagcactacagccaggccagcgagtgggctgctaaatacatcaggaatcgtataatccagtttaaccctggccctgagaagtactttacactcgggctccctactggcagtactccgctggggtgttataagaaactgattgagtattataagaatggcgacctcagcttcaaatacgtcaagactttcaatatggacgagtatgtaggcctgccacgcgaccacccagagtcgtatcactcattcatgtggaataatttcttcaaacatatcgacatccatcccgaaaatacacatatcttagacggaaatgccgtggatttgcaggccgaatgtgacgcttttgaggaaaagatcaaagccgccggaggtatcgaactcttcgttggcgggatctag

SEQ ID NO: 189230 - DNA, 870 bp, Artificial Sequence
  Description of Artificial Sequence: Synthetic coding sequence
atgaagctgatcatcctggagcactacagccaggccagcgagtgggcagccaaatatattaggaatcggatcattcagttcaatcccggacccgagaagtactttaccctgggcttaccaaccggaagcactccactcggatgctacaagaaactgatcgaatactacaaaaacggagacctttcctttaaatatgtgaagacttttaacatggacgaatacgtcgggctgccgcgggatcatccagaatcttaccactcattcatgtggaacaattttttcaagcatatcgatatccaccccgagaacacccacatacttgatggaaacgcagtcgacttacaggctgagtgcgacgcttttgaagaaaaaattaaggctgcggggggaattgaactgttcgtgggagggataggtcctgacgggcatatagcattcaatgagcctggatctagtctggtctcacgcacccgcgtaaagactctggccatggacacaatcctggctaacgccagattctttgatggggaactgaccaaggtccctaccatggctctgactgtcggagtcgggacggtgatggatgctcgcgaggtgatgattttaatcaccggcgcccacaaagctttcgccctgtataaggcaattgaggaaggcgttaatcacatgtggacagtctccgctttccagcagcatccgcggacagttttcgtgtgcgatgaagatgccacgctggagctgaaggtgaagaccgtcaagtactttaaggggttaatgctggttcacaataagctcgtggaccccctgtattccattaaggagaaggaaacagagaaaagtcagagctcaaaaaaaccctattccgactag

SEQ ID NO: 189231 - DNA, 90 bp, Artificial Sequence
  Description of Artificial Sequence: Synthetic coding sequence
atgaagctgatcatcctggagcactacagccaggccagcgagtgggcagctaagtacattcgcaatcggatcattcagtttaatccttag

SEQ ID NO: 189232 - DNA, 870 bp, Artificial Sequence
  Description of Artificial Sequence: Synthetic coding sequence
atgaagctgatcatcctggagcactacagccaggccagcgagtgggcagcgaagtatattagaaaccggattatccagtttaatcccggcccagagaaatacttcacgctcgggctcccgaccggcagcacaccgttagggtgctataagaagttgatagagtattataaaaatggggatctgtctttcaagtatgtaaagacttttaacatggacgaatatgtgggactgccacgcgaccacccagagagctatcattcctttatgtggaacaactttttcaagcatatcgacatacatcccgagaacacacacatcttagacggcaacgctgtcgacctgcaggcggagtgcgatgccttcgaagagaagatcaaagccgcaggcgggatcgagctatttgtggggggcatcggtccagatggccatattgccttcaacgagcctgggagcagtcttgtgtcccggacacgggttaaaactctggctatggacacaatccttgccaatgcacggtttttcgatggggagctgacaaaagttcccactatggcattgaccgtgggcgtgggaaccgtgatggatgcacgagaggtgatgatcctcatcacgggggcgcacaaggctttcgcactttacaaagccatcgaggaaggtgttaaccacatgtggaccgtcagcgccttccagcagcacccacgcacagtgtttgtgtgtgatgaagacgccaccttggagctaaaggtcaagaccgtaaagtattttaaaggactgatgcttgtccacaataaactggtcgacccactgtactctatcaaggagaaagagacagaaaagagccagtcctccaaaaaaccatatagcgattag

SEQ ID NO: 189233 - DNA, 486 bp, Artificial Sequence
  Description of Artificial Sequence: Synthetic coding sequence
atgaagctgatcatcctggagcactacagccaggccagcgagtgggctgcaaagtatattcgaaatcgcatcatacagtttaatcccggcccagaaaagtatttcacacttgggctgcccacagggtccacccccctgggctgttataagaagctgattgagtactacaagaacggagacttgtcatttaaatatgtgaaaacattcaacatggatgagtacgtggggctgcctcgggaccatccagagagctaccactcctttatgtggaacaacttcttcaaacatattgacattcacccggaaaacactcatattcttgatgggaacgccgtggatctgcaagcagagtgcgacgcattcgaagaaaaaataaaagctgccggaggaattgaactgttcgtgggcggcatcggaccggacggtcatatcgcttttaatgagcctgggagttccctagtctctcggacccgggtaaagacctag

SEQ ID NO: 189234 - DNA, 639 bp, Artificial Sequence
  Description of Artificial Sequence: Synthetic coding sequence
atgaagctgatcatcctggagcactacagccaggccagcgagtgggcagctaagtacatacgaaataggattattcagtttaatcccggtccagaaaagtattttacactgggtctgcccacaggatcaaccccactgggatgttataagaagcttatcgaatactacaaaaatggggatttgtcattcaagtacgttaaaactttcaatgagccaggttcctctctggtatctagaacccgagtaaagaccttggcgatggatacaatcctggctaacgctcggttcttcgatggcgagttaactaaggtccctacaatggctctcaccgtaggcgtcgggaccgtcatggatgctcgggaggtaatgatactcatcaccggtgctcataaagcctttgcattgtacaaggccattgaagagggagttaaccatatgtggactgtgtccgcctttcagcaacacccaaggacggttttcgtttgcgacgaggacgcaactttagaactgaaagtgaaaacagtgaaatacttcaagggcctgatgctcgttcataataagctggtggaccccctgtactctatcaaggagaaggagacagagaaaagtcagtcttccaagaagccttatagcgactag

SEQ ID NO: 189235 - DNA, 831 bp, Artificial Sequence
  Description of Artificial Sequence: Synthetic coding sequence
atgcggctggtgatcctggacaactacgacctggccagcgagtgggccgccaagtacatttgtaaccgaattattcagtttaaaccagggcaggaccggtactttaccctgggactccctactggatctacgccgttaggatgctataaaaagctgattgaatatcacaagaatgggcatctaagttttaaatacgtaaaaaccttcaatatggacgaatatgtcggtttaccaaggaatcaccccgaatcctaccatagctatatgtggaataacttctttaagcacattgatattgaccctaacaatgcccatatcctcgatgggaatgccgcggacttacaggccgagtgtgatgcgttcgagaacaaaattaaggaggcgggcggtattgatttattcgtcgggggaatcgggccagatggtcatatcgcttttaacgagcccggctcgtcactggtttcaaggacacgtttgaagacacttgccatggatactattctcgctaacgcaaagtatttcgacggagatctgagcaaggtccctacaatggctcttaccgttggtgtaggcactgtgatggacgcacgtgaagtgatgattcttattactggagcacataaggcctttgcactgtacaaggccatcgaggaaggcgtgaaccatatgtggacagttagcgcattccagcagcacccccggacgatattcgtgtgcgacgaggacgctactcttgagctcagagtgaagacagtcaaatattttaaggggctgatgcacgtgcacaacaagctcgtggacccactgttctctatgaaggacggcaactag

SEQ ID NO: 189236 - DNA, 780 bp, Artificial Sequence
  Description of Artificial Sequence: Synthetic coding sequence
atgcggctggtgatcctggacaactacgacctggccagcgagtgggcagctaagtacatttgcaatcggattatccagtttaagccaggtcaggatagatattttaccttgggtttacccaccgggagtacgcccctagggtgttacaagaagcttattgagtaccacaaaaatggccatctgagcttcaaatacgtgaaaacattcaatatggatgaatacgtgggactgcctaggaaccatcctgagtcttaccattcttacatgtggaataatttcttcaaacatatagacatcgacccaaataacgcacacattttagacggtaacgccgccgatttgcaggcagagtgcgatgcattcgagaacaagatcaaggaggctggaggcatagatttattcgtgggaggcattggaccagatggccacatcgcttttaacgaaccggggagctccctggtgagcaggacaaggctcaaaaccctggctatggataccatcctggcgaatgcaaagtatttcgatggggatctgagcaaagtgcctaccatggctctgaccgtcggtgtgggaacagtgatggacgccagggaagtgatgatcctgattactggcgcccacaaggcatttgctctttacaaggccattgaggagggggtgaaccatatgtggacagttagcgcgtttcaacaacacccacgaaccatattcgtctgcgacgaggacgctaccctggagttgcgggtcaagacagtaaaatatttcaaaggcgaacattag

SEQ ID NO: 189237 - DNA, 729 bp, Artificial Sequence
  Description of Artificial Sequence: Synthetic coding sequence
atgcggctggtgatcctggacaactacgacctggccagcgagtgggccgccaagtacatttgcaatagaattattcaattcaaaccaggccaggatcgctatttcacacttggactgcctaccggccttcccaggaaccaccctgaatcatatcactcatatatgtggaataattttttcaagcacatcgacatcgaccccaataatgctcacattctggacgggaacgcagctgacctgcaggccgagtgcgacgctttcgagaacaaaataaaagaggcagggggtatcgatttgtttgtgggtggcattggccctgatggccatattgccttcaacgaacctggaagtagcctggtttcccggacgcggttgaaaacacttgcgatggataccatcctggccaatgcaaaatactttgacggggacctgagcaaggtgcccaccatggctctaaccgtgggagttggaacagttatggatgctcgcgaggtcatgatcctcatcaccggcgctcacaaagccttcgctttgtacaaagcaattgaggaaggagttaatcatatgtggacggtgtctgcattccagcagcacccacggactatcttcgtctgtgatgaagatgccacccttgaactgcgcgtgaaaacagtcaaatatttcaagggcctgatgcatgtccataataagctggtggaccctctgttctccatgaaagatggaaactag

SEQ ID NO: 189238 - DNA, 1287 bp, Artificial Sequence
  Description of Artificial Sequence: Synthetic coding sequence
atgctgcggaccctgctgcggcggcggctgttcagctaccccaccaagtactattttatggtcttggtacttagtctcatcaccttctctgttttgagaatacaccagaaaccggagttcgtttccgtaagacaccttgagctggctggcgaaaacccaagctcagacatcaattgcactaaagtccttcagggcgacgtgaatgagattcagaaggttaaattagagatccttactgtgaaatttaagaagcgtccacgctggacacccgatgactatatcaacatgactagcgactgtagctcctttatcaaacgacggaagtacattgtcgagccattatctaaagaggaagccgagtttccaatcgcttatagtatagttgttcaccataaaatcgaaatgcttgatcgcctactccgggccatttacatgccccaaaacttctactgtattcatgtcgacacaaaaagtgaagatagctacctggctgccgtgatgggcatagcttcatgcttttccaatgtgtttgtggcgtctcgcctcgaaagcgtggtgtacgcctcttggtcccgagttcaggccgacctaaactgcatgaaagacctgtatgccatgtccgcgaactggaaatacctgattaacctctgtggtatggattttccaatcaagaccaaccttgagatcgtgcggaaactgaagttattgatgggggagaacaacctggaaacagagcggatgccctcccacaaggaagaaaggtggaaaaagagatacgaggttgtcaacggtaagttaacgaatacgggaacagtcaagatgttgccaccactcgaaaccccactgttcagcggatcagcctacttcgtcgtcagcagagagtacgtcggctacgtgttgcagaatgagaaaattcagaagttgatggagtgggcccaggatacttactcccccgatgaatatctttgggcaactattcagcgcattcccgaagtccctgggagcctgccagcctctcataagtacgacctatccgatatgcaggctgtggcccgattcgtgaaatggcagtacttcgaaggggatgtgagcaaaggggctccttaccccccatgcgacggggtgcatgtaaggtccgtgtgtatatttggggcaggcgaccttaactggatgcttcgcaaacatcatcttttcgctaacaagtttgatgtggacgttgacttattcgctatccaatgcctggacgagcatttacggcacaaggcgttggagacccttaagcactag

SEQ ID NO: 189239 - DNA, 1287 bp, Artificial Sequence
  Description of Artificial Sequence: Synthetic coding sequence
atgctgcggaccctgctgcggcggcggctgttcagctaccccaccaagtactacttcatggtgctggtactgtcgcttatcacattcagtgtactgcggattcatcagaagccggaatttgtgtcagtgcgacacctggagctggcaggtgagaatccaagttccgatataaactgcactaaagtgctacagggcgacgttaatgaaattcaaaaagtgaaactggagattttaactgttaagttcaaaaagaggccacgttggactccagacgattatataaacatgacaagtgactgtagctcatttatcaagcgacgtaagtacatcgtggagcccctgtccaaggaagaggcagaattccccattgcttattctatcgtggtgcaccacaagatcgagatgcttgaccgcttgctgcgggccatttacatgccgcagaatttttattgtatccacgtcgacaccaagtcagaagactcatacctcgccgcagttatggggatcgcctcttgtttcagtaacgttttcgtggcctccaggcttgagtctgtcgtgtatgcaagctggtcacgggtccaggcagatctgaattgcatgaaggatttatacgccatgagcgccaactggaagtatctgatcaacctttgtgggatggacttccccatcaagaccaacctcgaaatcgtgagaaagctgaagctgctgatgggtgagaacaatctcgaaaccgagcgcatgccctcacacaaggaggaaagatggaaaaaacgttacgaggtggtaaacggaaaactgaccaatactggaaccgtcaaaatgcttccaccgctggagaccccactgtttagtggcagcgcctacttcgtagtgagtcgagagtacgtaggttacgtcctccagaacgaaaaaatacaaaagctcatggaatgggcacaggacacctatagtccagatgaatacttgtgggcaacaattcaacgcattcccgaggtgccggggagtctgcccgccagtcacaagtatgacttgtccgacatgcaggcagttgcacgctttgttaaatggcagtactttgaaggagacgtctctaaaggggcaccctatccaccttgcgacggggtgcacgtcaggtcagtgtgcatttttggcgcaggagacctgaactggatgttacggaagcaccacctctttgctaacaaatttgacgtcgatgttgacttgtttgctatccagtgtctcgacgagcacctgcgacataaggcgcttgagacattgaaacactag

SEQ ID NO: 189240 - DNA, 1287 bp, Artificial Sequence
  Description of Artificial Sequence: Synthetic coding sequence
atgctgcggaccctgctgcggcggcggctgttcagctaccccaccaaatattatttcatggtcctggtgctgagtcttataacattttctgttttgaggattcatcaaaagcctgagtttgttagcgtgcgacacctggagctcgccggcgaaaaccccagtagtgatatcaattgtacgaaagtcctgcagggggatgtaaacgagattcaaaaggtcaagttggaaatcctgaccgtcaaatttaagaaacgtcctcgctggaccccggacgattacattaatatgactagtgactgttccagcttcattaaacggcgaaagtatatcgtggagcctctgtccaaagaagaggcagagtttcccatcgcttactccattgtggttcatcacaaaattgaaatgttagatcgcctgcttcgagcaatatacatgccgcagaacttctattgtatccacgttgatactaagagcgaggatagttatcttgcagctgtcatgggtattgcttcatgtttctctaatgtgttcgtggcttccaggctcgaatccgtggtttatgcgtcctggagtcgcgtccaggccgatctgaactgtatgaaggatctgtacgcaatgtccgcaaactggaaataccttatcaatctctgtgggatggacttcccaataaagaccaaccttgagatcgttcgcaaactaaaactcctgatgggggaaaacaacctggagacagaaaggatgccttctcataaggaggaaaggtggaagaaacgatacgaggtagttaacggaaaattgacaaacacagggactgttaaaatgctgccacccttggagacgccgctctttagtggaagcgcctacttcgtggtttcccgcgagtatgtcgggtatgtgttacagaacgagaagatccagaagctcatggagtgggcgcaggacacttactctccagacgagtatctatgggccaccatccaaaggatcccagaggtgcccgggtcgctgcctgcatcacataagtatgatctgtccgatatgcaggccgtggctcggttcgtgaaatggcaatattttgaaggagacgtatctaaaggagccccctatccgccttgcgatggggtccatgtgcgctctgtatgtatattcggggccggcgatctcaactggatgctcaggaaacaccacctgttcgctaataaatttgatgttgacgtggacttgttcgccatccagtgtcttgatgaacatttgcgccataaagccctcgagacccttaaacattag

SEQ ID NO: 189241 - DNA, 1287 bp, Artificial Sequence
  Description of Artificial Sequence: Synthetic coding sequence
atgctgcggaccctgctgcggcggcggctgttcagctaccccaccaaatactattttatggttttagttctgagtctcatcaccttttctgtgttaaggatacaccagaagcctgaatttgtaagcgtacggcacctggagctggcaggggagaacccttctagtgatatcaattgcaccaaagtgcttcaaggcgacgtgaatgagatccagaaggtgaagctggagatcttgacagttaaatttaaaaaacgacccagatggactcccgatgactacatcaacatgacatctgattgtagcagcttcatcaagagacgcaaatatattgtggagccccttagcaaggaggaagccgagtttccaattgcctactcaatcgtcgtgcaccataagatcgagatgcttgatcgacttttgcgtgcaatttacatgcctcaaaatttttactgtatccacgtggatactaagagcgaggattcctatctcgccgctgtcatgggcatagcctcctgcttttccaatgtgtttgtggctagccgcctcgaatctgttgtgtatgctagctggagcagggtacaagcagatttgaattgcatgaaggacttatacgcgatgtccgccaattggaagtatttgattaatttgtgtgggatggattttcctattaagactaaccttgagattgtccgcaaactgaaactcctgatgggcgagaataaccttgagactgaacggatgccatcacataaagaggaacggtggaaaaagagatatgaagtggttaatggtaagcttacaaataccggcaccgtgaagatgctgcctccgctcgagacaccacttttctctggcagcgcctacttcgtggtgtcccgggaatacgttggttacgttctgcagaacgagaaaattcaaaaactaatggaatgggcccaggatacgtacagccctgatgaatatttatgggctaccatacaacggattccagaagtgcccggatccctgcccgctagccacaagtatgacctgagcgatatgcaagcggtggcccgcttcgtgaagtggcagtattttgaaggcgacgtgagcaagggggccccctatccgccatgcgacggagtgcacgtgagaagcgtctgcatcttcggcgcaggggacctaaattggatgctccggaaacatcatctgtttgccaacaagttcgacgtggacgtcgatctgtttgctattcagtgtcttgatgaacacctccgacacaaagctttagaaaccttaaaacattag

SEQ ID NO: 189242 - DNA, 1209 bp, Artificial Sequence
  Description of Artificial Sequence: Synthetic coding sequence
atgaacttctggcggtactgcttcttcgccttcaccctgctgagcgtggtgatcttcgtcaggttctacagttcccagctgagcccccctaaatcctatgagaagctgaacagctcgtccgagcggtatttccggaaaacagcatgtaaccacgccctggagaagatgcccgtgtttctgtgggaaaacatccttccttcacccctgagaagtgtcccctgtaaggactatcttacgcagaatcactatataacctctccgctctccgaagaggaagctgctttccccctggcttatgtaatggtaatccataaagacttcgacacgttcgaaagactgtttcgagccatatacatgcctcagaatgtatattgtgtgcacgttgatgaaaaagcgccagctgagtacaaggagtccgtgcgacagctcctttcctgcttccagaatgctttcatagcatcgaaaacggagagtgtggtttatgccggcattagtcgcctgcaagccgatctcaactgccttaaggatttggtggcgagtgaggtcccatggaaatacgtcatcaacacctgcggccaggatttccccctgaagaccaatcgtgagatagtgcaacatctgaaaggattcaagggtaaaaatatcactcctggtgtcttaccaccagaccacgcaatcaagagaacaaagtacgtccaccaggagcacaccgataagggcgggttctttgtcaaaaatacaaacatcctaaagacttccccacctcatcaactgaccatatactttggtaccgcttatgtggcactcactcgggactttgtggatttcgtgctgcgagatcagcgtgccatcgacttgcttcagtggtcaaaagatacatactcaccagatgaacacttctgggttacgctcaatcgggttagcggcgtgcctggttctatgcccaatgccagttggaccggaaatctacgcgctatcaagtggtcagatatggaggacagacacggaggatgtcacggccattacgtccatgggatatgtatctatggcaacggggacttgaagtggcttgtgaattcaccatcactgttcgcaaataagtttgaattgaatacgtatcctctcacggtggaatgtctagaactgcgccaccgggagagaacactaaatcagagtgagaccgccatacaaccttcatggtatttttag

SEQ ID NO: 189243 - DNA, 1203 bp, Artificial Sequence
  Description of Artificial Sequence: Synthetic coding sequence
atgcccctgagcatgcggtacctgttcatcatcagcgtgagcagcgtgattatcttcatagtcttcagcgtgttcaactttggaggcgacccgtcattccagcggcttaacattagcgaccctctgaggctgacccaggtttgtactagctttatcaacggaaagacacggttcctttggaaaaataagcttatgattcacgaaaagtcctcttgtaaggagtatctgactcagtcccattacataaccgctccgttgtcaaaggaggaggcagattttcctctagcatacattatggtcattcatcaccacttcgatactttcgctcggctctttcgcgccatatacatgcctcagaatatctattgcgttcatgtggacgaaaaggccacaactgagtttaaggacgccgtagagcagctgctttcatgctttcccaatgcattcctcgcaagtaaaatggagccagtggtgtatgggggcattagccgcctccaggctgacctcaactgtattcgggacttgagcgccttcgaagtcagctggaaatatgtgattaacacttgtggccaagacttcccattgaagactaacaaggaaatcgtccagtatctgaaaggatttaaaggaaagaacattactcccggagttctgccccccgcccacgcaatcggaaggactaagtacgtgcaccaggagcatcttggtaaagagctgagctacgtcatcagaaccactgctctgaagccccccccgccacataacctcacgatatacttcggctctgcgtatgtcgcgctttcgagggagtttgcaaatttcgtgctgcatgaccctagggcggtggatctcctgcagtggtctaaggacacgttttctccagacgagcacttctgggtcacattaaataggattcccggagtacctggaagcatgcccaatgcctcctggaccggcaatctgagagctataaaatggtccgacatggaggaccgtcacgggggatgccatggacactacgtgcatgggatctgcatctacggcaacggggacctgaaatggctagtcaattcccccagtcttttcgctaataagtttgagctgaacacatacccactgactgtggagtgcctcgaactccgccacagggaaaggacgctcaaccaaagcgaaacagcgatccagccgtcctggtatttctag

SEQ ID NO: 189244 - DNA, 1209 bp, Artificial Sequence
  Description of Artificial Sequence: Synthetic coding sequence
atgatgggcagctggaagcactgcctgttcagcgccagcctgatctccgctctgatcttcgtcttcgtctacaatactgagctttgggagaataagagatttctgcgggccgctctaagcaacgctagcctacttgccgaggcatgccatcaaatcttcgaaggcaaggtgttttatccaactgaaaacgctctgaaaaccaccctggacgaagcgacgtgttacgaatacatggttcggtcccattatgtgaccgaaacattgagtgaggaggaagccggtttcccactggcgtacacggtcaccatacacaaagactttggcaccttcgaacgactgttccgcgcaatttacatgcctcagaatgtgtattgcgtccacctggatcaaaaagcgaccgatgcttttaagggagccgtgaagcagcttctcagctgcttccccaacgctttcttggcgtcaaagaaggagtcagtggtttacggagggatatcgcgcctgcaggccgatctcaactgtctggaagaccttgtggcctccgaagtaccttggaagtacgtgatcaacacctgcggacaggattttccactcaagacgaacagagagatagtgcaatatctgaagggctttaagggtaagaatatcaccccgggtgtattaccgcccgatcatgcagtgggcaggaccaaatacgtgcatcaggagctgctcaatcataaaaacagctatgtgatcaagacaaccaagctcaaaacgcctcctcctcacgatatggtcatctactttggaaccgcgtacgtggcactgactcgtgacttcgcaaactttgtgctccaggatcaactggccctagacctcctgagctggtccaaagatacctattctcccgacgagcacttttgggtgaccttaaatcggattcccggcgtgcctggatcaatgccaaatgcctcttggactgggaatctgcgcgccattaagtggagcgacatggaggatcgtcacgggggttgtcacgggcactatgtgcacggcatctgcatctatggtaacggcgacctgaaatggctggtaaactcacccagcctctttgccaacaaattcgagttgaatacctaccctttaaccgttgaatgcctcgagctgcgacaccgcgaaagaacacttaatcagtctgaaactgcaatccagcccagctggtacttttag

SEQ ID NO: 189245 - DNA, 1209 bp, Artificial Sequence
  Description of Artificial Sequence: Synthetic coding sequence
atgatgggcagctggaagcactgcctgttcagcgccagcctgatctcagccctgatattcgtcttcgtgtacaacacagagttatgggagaacaagcggtttttgcgagccgcgctgtcgaacgcttcactgttggctgaggcatgccatcagatatttgagggaaaggtgttctacccaactgagaatgccctcaaaacaacattagacgaggccacgtgttacgaatacatggtccggtctcactacgtgacagagaccctctctgaagaggaagctggatttcccctggcctataccgtgaccatacataaagattttgggacctttgaaagactatttcgggcaatatacatgccacagaatgtctattgcgtgcacctggatcagaaggccacagacgcattcaagggagctgtcaagcaactgcttagttgcttccccaacgctttcttagcgagcaaaaaagagagcgtggtctacgggggaatcagtcgactccaggcagatctgaactgtctggaagacctggttgcaagtgaggtgccctggaaatacgtaattaacacctgcggccaggattttccattaaagactaaccgcgagattgtgcagtacctaaaaggctttaagggcaagaacatcacccccggagtactgccaccagatcatgccgtaggtcgcaccaagtacgtgcaccaggaactgctcaatcataagaactcatacgtgattaagactacaaagctgaaaacccctcccccccacgatatggtaatatatttcggcaccgcttatgttgcccttacgagggattttgcgaactttgtcctgcaggatcagttggcactcgacttgctttcctggtctaaagacacgtatagcccagacgaacacttttgggtgaccctcaaccggattcccggcgtgcctggctcaatgcctaacgccagctggaccggcaatctgagagctattaagtggagtgatatggaggaccgacacgggggttgtcacggccattatgtgcacgggatctgtatctacggaaacggtgacctgaaatggttagtcaattctccttccctctttgcaaataagtttgagctaaatacctatccactgactgtcgaatgtcttgaactgcgccacagagaaagaactctgaaccaatcggagacagcgatacagcctagttggtatttctag

SEQ ID NO: 189246 - DNA, 1317 bp, Artificial Sequence
  Description of Artificial Sequence: Synthetic coding sequence
atggtgcagtggaagcggctgtgccagctgcactacctgtgggccttaggttgctatatgctcctggccactgtcgccctcaagctgtcattcagattaaagtgtgatagtgatcacctgggactcgagtctcgtgagtcccagtcgcaatactgtaggaacatcctgtataattttctgaagctacccgcaaaacgcagcataaattgttcgggtgtcaccaggggcgatcaagaggccgtcctccaggccattctgaacaacttggaggtcaagaagaagagggaaccgtttacggacacacactatttgtccctgacacgagactgtgagcactttaaggccgaacgcaaatttattcaattccctttgtcgaaggaagaagtggaattcccaatcgcttactccatggtcattcacgaaaaaatcgagaacttcgaacgcctgctccgcgctgtctacgccccgcagaacatttattgcgtgcacgtggatgagaaaagccctgagactttcaaggaggcagttaaagctattatttcgtgttttccaaacgtcttcatagcttccaagcttgtcagagtcgtctacgcctcctggtcaagggtgcaagcggacctcaactgtatggaggatctgctgcagagcagcgtgccctggaagtatttcttaaatacatgtggcacggactttcctataaagagcaacgccgaaatggtgcaagctctaaagatgctcaatggtaggaattcaatggaatccgaagtgccacctaaacataaggaaacacggtggaaataccactttgaggtggtgcgcgatacattacatcttacaaataaaaagaaagacccgcccccatacaacctcaccatgtttacgggtaatgcttacatcgtcgcaagtagggatttcgtgcagcacgtgcttaagaacccaaagtctcagcagctgattgagtgggttaaagatacctactcacccgacgaacacctttgggcaacgctgcagagagcacgatggatgcccggctcggtccccaatcaccccaagtacgacatctctgacatgacctccattgctcgactcgtaaagtggcagggccatgaaggggacatcgataaaggggccccttatgccccgtgttctggaatccaccaacgggccatctgtgtttatggcgctggggatctgaactggatgctgcagaatcatcacctccttgccaacaagttcgacccaaaggtcgacgataatgcccttcaatgcctggaggagtatcttcgatacaaggcaatctacggcactgaactctag

SEQ ID NO: 189247 - DNA, 264 bp, Artificial Sequence
  Description of Artificial Sequence: Synthetic coding sequence
atggtgcagtggaagcggctgtgccagctgcactacctgtgggccctaggctgctatatgctgctggcaaccgtcgccctgaaactgagtttcaggctcaaatgtgactccgatcacttaggcttggagagccgcgaaagtcagagccagtactgtaggaacatattatataatttcctaaagctgcctgccaagcgctccatcaactgcagtggggtcactcgtggagatcaggaagccgttctgcaggccattctcaactag

SEQ ID NO: 189248 - DNA, 462 bp, Artificial Sequence
  Description of Artificial Sequence: Synthetic coding sequence
atggtgcagtggaagcggctgtgccagctgcactacctgtgggccctggggtgttacatgctattagccaccgtggcacttaaacttagctttcgcctgaagtgtgactcagaccatctcggcctcgagtcaagggagtcacagtcacagtactgccgaaatatcttgtataactttctaaaactaccggccaagcgaagcatcaattgctcaggcgtgacacgcggagaccaggaggctgtactccaagcgatcctgaataatctcgaggttaagaagaagcgcgagccttttacagacactcactatctatccctcaccagggactgtgaacattttaaggccgaaagaaagttcatccaattccccttgtcaaaggaggaggttgagtttcccattgcttacagtatggtgatccatgagaagatcgaaaattttgaacgcctcctgagagccgtgtag

SEQ ID NO: 189249 - DNA, 162 bp, Artificial Sequence
  Description of Artificial Sequence: Synthetic coding sequence
atggtgcagtggaagcggctgtgccagctgcactacctgtgggccctgggatgctatatgctgctggccacggtggcattgaaactctctttcagactcaaatgcgactcggaccatctcggattagagtctagggagagtcagagccagtactgtaggtag

SEQ ID NO: 189250 - DNA, 1317 bp, Artificial Sequence
  Description of Artificial Sequence: Synthetic coding sequence
atggtgcagtggaagcggctgtgccagctgcactacctgtgggccctggggtgttatatgctccttgctacagtcgcactgaaattatctttccgccttaagtgtgactcggaccatctcgggttggagagcagggagtcccagtcacaatactgccgcaacatcctgtataatttcctgaagctcccggcaaaaagatccattaactgtagtggcgtgaccaggggcgaccaggaggctgttctgcaggcaatcctaaacaatttagaggtgaagaagaaaagagagcccttcactgatacacattatctgtctctcactcgagactgtgaacatttcaaggcagaaaggaaatttattcaattccccctgtccaaggaagaagtggagttccctatcgcttatagtatggtgatccatgaaaaaatcgaaaacttcgagcgcctgctgagagcagtgtatgcacctcagaatatttactgtgtgcacgtcgacgaaaagtcaccggagaccttcaaggaggccgtcaaagccatcatcagctgttttcccaatgtttttatcgcttctaagctcgtgagggtggtctacgcttcctggtctagggtccaagctgatctcaattgcatggaggatttattgcaatctagcgtgccatggaagtatttcctgaatacatgcggcacagactttccaattaagtcgaatgctgagatggtgcaggcactgaagatgctcaacgggcgcaactcgatggagagcgaggtacccccaaagcacaaagagactagatggaaatatcactttgaggtggttcgggatactttgcatctaacaaataaaaagaaggatcctccgccctacaacctgaccatgttcaccgggaatgcatatattgtggcctctcgggattttgtacagcatgtgctcaaaaatcctaagagccagcagctcattgagtgggtcaaggacacctattctccggatgaacacctatgggctacattacaacgcgcccgctggatgccaggcagtgtcccaaaccacccaaagtatgacatttctgatatgacaagtatcgcccgcctggtgaaatggcaaggtcacgaaggagatatagacaaaggagcgccatacgccccgtgcagtggcatacatcagagagccatttgcgtgtacggcgcaggcgatctgaattggatgttgcagaaccaccaccttctcgccaataaatttgaccccaaagtggatgacaacgccctccagtgtctcgaggagtatctgcgctacaaggcaatctatggtaccgagctctag

SEQ ID NO: 189251 - DNA, 1041 bp, Artificial Sequence
  Description of Artificial Sequence: Synthetic coding sequence
atggagagcaccctgggcgccggcatcgtgatcgccgaggccctgcaaaaccagcttgcgtggctggagaatgtgtggttatggattactttcctgggagaccctaaaatacttttcttgttctattttcctgccgcatactacgcctcaagaagggtgggcatcgcggtcctgtggatcagcctcattacagaatggttgaatctgatttttaagtggttcttattcggagaccgaccattttggtgggtccacgagtccggctattatagccaggcacctgcgcaggtccatcagttcccatcgagttgcgagaccggcccaggtagtccctctgggcattgtatgatcaccggagcagctttatggcctattatgactgcactgagcagccaagtggcaactagagcaagatccagatgggtccgcgttatgccaagcctggcctattgcactttcctcctggcagtgggactgtctcgaatctttattttggcccatttcccacatcaggttttagccggcctgataaccggcgctgtgctcggatggcttatgacacctagagttcccatggagcgagaattaagtttttatgggttgactgctcttgccctgatgctcggcacctctctaatctattggacattattcacactcggcctagacttaagttggagcatttctcttgcctttaagtggtgtgagaggcctgagtggatacacgtcgacagtagaccctttgcgagtctgtcaagggacagcggcgccgcactgggactaggcatagctctgcattcaccatgctacgcccaagtccggagggctcagctgggaaacggtcagaagattgcatgtctggtgcttgcaatggggctcctcgggccgctcgactggttgggtcaccctccccaaattagtctgttttatattttcaacttcctcaaatacaccctctggccttgcttggtcctggctttggtgccgtgggcggtgcacatgttcagcgcacaggaagcccctccgattcacagctcctag

SEQ ID NO: 189252 - DNA, 465 bp, Artificial Sequence
  Description of Artificial Sequence: Synthetic coding sequence
atggacttcctgcaccggaacggcgtgctgatcatccagcacctgcagaaagactaccgagcttattacacctttcttaacttcatgagtaacgttggggacccacgtaacattttttttatctattttcccctgtgctttcagtttaaccaaactgtgggaacaaagatgatttgggtggccgtcatcggcgactggttgaacctgatttttaagtggattctgttcggccaccgaccctattggtgggtgcaggagacgcaaatctaccccaatcacagctctccatgtctcgaacagttccctaccacatgcgagacaggacccggatctccttctggacatgctatgggtgcaagttgtgtctggtatgtcatggtgactgcagccttaagccacaccgtctgcggaatggacaagttctcaataaccctgcatcggcacgctgggggacggggactgtag

SEQ ID NO: 189253 - DNA, 1068 bp, Artificial Sequence
  Description of Artificial Sequence: Synthetic coding sequence
atggacttcctgcaccggaacggcgtgctgatcatccagcacctgcagaaagattatcgagcttattatacatttctgaatttcatgtcaaacgtaggagatccaagaaatatcttttttatttacttccctctctgttttcagtttaatcagaccgttggcaccaagatgatctgggttgctgtcatcggagattggcttaatctaatcttcaaatggattctatttggtcaccggccatactggtgggtccaggagactcaaatttatcccaaccattcatcaccctgtctagaacagttcccgaccacctgcgagacgggacctggatcaccttctggccacgctatgggagcatcatgcgtttggtatgtaatggtgacggcggccctatctcatacggtgtgtgggatggacaaattctcgatcaccctacaccgccttacctggtctttcctgtggagcgttttctggttgatccagatatccgtttgtatctctagagtattcatcgcaacccatttcccccaccaggtgattttaggcgtgattgggggtatgttggtggcggaggcgttcgaacacacacccggcattcagaccgccagtctcggaacatatctcaaaacaaatctcttcctctttctgttcgcagtgggcttctatttactgttgagggttctgaacatagatttgctttggtcagtgccaatagctaagaaatggtgtgctaatccagattggatccatattgacaccactcctttcgcgggccttgttcgtaacctcggggtgctctttggactcggtttcgcgatcaactcagaaatgtttctgttatcctgtcgcggcggaaataactatacattgtcttttcggctgctgtgtgccctgacgtcgctcaccattctccaactgtatcacttcctccagattcccacccacgaggagcatctgttctatgtgctgtccttttgtaaaagtgccagcattcctttaactgtggtggccttcattccttacagcgtccacatgctaatgaagcagtctggaaagaagtcacagtag

SEQ ID NO: 189254 - DNA, 1677 bp, Artificial Sequence
  Description of Artificial Sequence: Synthetic coding sequence
atggccgccctgacccgggacccccagttccagaagctgcagcagtggtacagggagcacagatcagagctaaaccttcgtcggttgttcgatgccaacaaagacaggttcaaccatttcagcctgacattaaacaccaatcatggacacatcctggtggactatagcaaaaaccttgttacagaggatgtgatgaggatgctcgtcgatctcgccaaaagcaggggggtggaggcagcgagggaaaggatgttcaacggtgagaagattaattataccgagggacgggcagttctgcatgtcgcactccggaatcggtctaacacacccattctcgtggatgggaaggatgtgatgccagaagttaacaaagtcctggacaagatgaaatccttttgccagcgcgtccgtagcggagattggaaaggttacacaggcaagactattacagacgtgatcaacatcggcattggcggttccgatttaggaccgttaatggttaccgaggctcttaagccctatagcagcggcggtcctcgcgtgtggtatgtgagcaacatcgacgggacacatattgcgaaaactctggcccagcttaacccagaatcttccctgttcatcatcgctagcaagacttttacaacccaggagacaataactaatgcagagacagcaaaagagtggtttttgcaggcggcaaaggatccctctgctgtcgctaagcatttcgtggcgctgagcacaaacacaacaaaagtcaaggagtttggaattgatcctcagaacatgttcgagttttgggattgggtgggcgggagatattccctgtggtctgctattggactttcaatagcactccacgttggctttgataactttgagcagctcctctctggcgcccattggatggatcagcactttaggaccacccctctggaaaagaacgcccctgtgctgctggcactgttaggtatctggtatatcaattgctttggctgtgagacacacgcaatgttaccctacgaccaatacctgcaccgcttcgccgcatacttccagcagggtgacatggaatcgaatggcaaatacatcaccaagagcggcacccgagtggatcaccaaacagggcccattgtgtggggggagccaggaacgaacggccaacacgccttctaccagctgatccaccaaggtaccaaaatgattccttgcgatttccttattcccgtccagacccagcatccaatccggaagggcctacatcacaaaattttgctggcgaatttcctggcccaaaccgaggcccttatgagaggaaaatccactgaggaagcccgcaaggaattgcaggctgcgggaaagagtcccgaggaccttgagagactgctgccacataaggtcttcgaaggtaatcgaccgactaatagcattgtcttcaccaaactgaccccatttatgcttggtgctttggtcgcaatgtacgaacataagatctttgtccagggaataatttgggatatcaactccttcgatcagtggggggtcgaacttggcaagcagctggcgaaaaagattgagcctgagctcgatggcagcgcgcaggtaactagccacgacgcatctacaaacggcttgattaacttcataaaacagcagagggaggcccgtgtacagtag

SEQ ID NO: 189255 - DNA, 1563 bp, Artificial Sequence
  Description of Artificial Sequence: Synthetic coding sequence
agccggcacggccggagccaccccggcccccccgtgcccgaggccgcagccatggttccccgagctcccctgcgcgctgagcctgctccgccgctgaggtgccagcagggccctctccaacctctgcaagtgcgcgcgggcaggagaagggggctccctcgggccgccccagggaccggccatgctggactaggctccgggggcggcgggagcggggccagaggtcctcagtccccaacttccagacccaggaccggtgctcaagccgagagtgcccttcggccctggagtctgctcggcgtgagatcgtggggtctcgcagcctccccaggggttagtgctcccgggctcctcaggtatgaggagaaacgggcccccccgtgggggcactttcctagctcgtcaccttgctcatcaggacacttgtcccgcgggagttttcgttcttgcgaagaacgaccttggctgacacagcaggccggcaaaggatgtccttttccctctgcgcccggacacatgtctctgggtgcgtccgcggggcgggcggcacgggccggggtctttgaaggggccggatggaaggatggggacgtcgggcgtgactcatgtaggaggcacttgtgcacaaccggaaagtgggagggcgtgttcgagcagattatgggaggttccgcagctaagggcgctctgatcacagatacaggaggaggcgggggtggagaacggctgtggctgagggctcgtaggcccgacggtcacccttgtcatcttgacggatgtctgtccaacctgagacaaaaagtggaggcactgggacgcggcggcccacccctgcagtctgggttactcattcagggtctgcctgccagcacagtatgtgaagacggttttttcctttgggccgccgtggctgaccatccaggcggacccgccggtgaccgccatcaccattgtgcaggctggcctagaccattatggggcgtcgggcaaggtggatgtttcttctgggagcagctgctactgcgtgcctggcttccagcaagggagacccgtgtctggagcgcggcttcacccagtttttgttcattgaccctgaatacaaaccatggacacattctggtggattacagcaagaatctggtgacagaagacgttatgcgaatgttggttgatttggccaagtcccgcggcgtggaggctgcaagagagcgaatgttcaacggtgagaaaattaactataccgaggttagtcggccacacattcctagcggagcatcatttctgcccttcggagtctatctcacggtgtccaggattacgctgtgcctccaccccttcagttgggcgatgctcctgttgaacgaggggccggaggggctgttccctccagcatgctccagagcattgggatgtgcttttcacaagatcggcttggttagcagcctcgagtggttccctgtatctgcatgggaggagcacatttcctacccgcagggggaatttctaaaggccgatatctttctggagaaactgaccttaatttacccgcaatgtaagttttag

SEQ ID NO: 189256 - DNA, 1710 bp, Artificial Sequence
  Description of Artificial Sequence: Synthetic coding sequence
atggtggccctgtgcagcctgcagcacctgggcagcagcgaccccagggccctacctaccttgccaacggccacatcgggccagaggcctgctaaacgtaggagaaagagccctgccatggctgcgctgaccagggacccccagtttcagaagctgcagcagtggtacagagaacaccgttctgaacttaacctgaggaggctgttcgatgcaaacaaagatcgcttcaaccacttttcccttaccctcaacacaaaccacggccacatcctcgtggactactccaaaaatcttgtgaccgaagacgtgatgcgtatgctagtcgacttggcgaagtctagaggagtcgaagcggcccgggagcggatgtttaacggcgaaaagattaactatactgaagggagggcagtcctacacgtcgcactgagaaatcgctctaacactcccatcctggttgatggaaaagacgtgatgccagaggttaataaggtgctggataaaatgaagagcttttgtcagggcccactaatggtgacagaagctcttaagccttattcttccggaggacccagggtctggtatgtttcaaacatagacggaacacatattgctaagacgctggcccagcttaatccggagtcttccctctttattattgcttctaaaacctttacgacacaagagacaattactaacgctgagacagccaaggaatggtttctgcaagctgccaaagacccgagcgcagttgctaaacattttgtggcattgtccaccaacaccaccaaggtgaaagaatttggcatcgaccctcaaaacatgttcgaattctgggactgggttggaggaagatactccctctggagcgcgatcggtctcagtatcgccctccacgtggggtttgacaattttgagcagctgttaagtggcgcacactggatggaccagcattttcgcaccacacccttggagaaaaatgcaccagttttgctggcactgttgggtatctggtacatcaattgcttcggttgtgagacgcatgccatgttgccctatgaccagtacctgcatcgttttgcggcctattttcagcaaggtgacatggagagtaacgggaagtacatcacaaaaagtggaacaagagttgaccatcagacagggcccattgtctggggagagcctggaacgaatggccagcacgctttctaccagcttatccaccaggggacaaagatgatcccctgcgattttttgattccagtccagacacagcatccaatccggaaaggactgcatcataagattctcctggctaacttcctagcccaaacagaagcgttgatgcgcgggaagtcaacagaggaggcacgtaaagagctccaggctgcaggcaaatcacccgaggatttggaacggcttctcccgcataaagtgtttgaaggcaatcgtccaaccaactctatcgtctttacaaagttgactccattcatgctaggcgctctggtcgcaatgtacgagcataagatattcgtgcaaggtattatctgggacatcaactcttttgaccaatggggcgttgaactcggaaaacagctggctaagaaaatagagcctgagctggatggctccgcacaggtgacttcacacgacgcatccaccaatggcctcatcaactttattaaacagcagagagaagcccgcgtgcagtag

SEQ ID NO: 189257 - DNA, 2901 bp, Artificial Sequence
  Description of Artificial Sequence: Synthetic coding sequence
atggccgccgtggccgccgtggccgcccggcggcggcggagctgggctagcctcgtattggcgtttcttggtgtctgtctggggatcaccctcgctgtggaccgcagtaacttcaagacctgcgaagagtcctctttctgcaagcgtcagcggtcaatcaggccaggcctcagcccatatcgcgccctcctcgatagcctacagctcggccccgatagcctgactgtgcacctcattcacgaggttactaaagtgttgttggttctcgagctgcagggattgcaaaaaaacatgacacggtttcgcatcgatgaactggagcccagaagacctcgatatcgagtacccgatgtcctggtagctgaccctccaattgccagactgtcagtgagcggcagggacgaaaatagcgtggaacttactatggccgaaggtccttacaaaattatcctcacggctaggcccttccggttggaccttcttgaagacagatcactgctgctaagtgtgaacgctcgcggcctcttagagtttgagcaccagcgcgcccctagggtgtcattcagcgataaggtgaatctgaccctgggttcaatttgggataagatcaagaatttgttttcccgacaaggctccaaggatccagccgagggcgatggggctcagcccgaggagacccccagagatggcgacaaacctgaggagacacagggaaaagccgagaaggacgaaccaggtgcttgggaagagacctttaagacgcattctgactcgaaaccttatggccccatgtcagtaggcctggacttttctctgcccggcatggaacacgtctatggcatccctgagcacgccgacaacttgcgcctgaaagtgaccgaaggaggagagccttaccgactgtacaatctggacgtatttcagtacgagctatataaccccatggcgctgtacggcagtgtgccggttctgctggctcacaacccccaccgcgatctgggaatcttttggctcaatgcagcagagacatgggtggatatctcttcgaacaccgccggaaaaaccctgttcggaaaaatgatggactacttgcagggatcgggcgaaactccccagaccgatgtccgttggatgagcgaaacggggattatcgatgtgtttcttctcctgggtccgagcattagcgacgtgtttagacagtatgcgagtctgaccggaacacaggctctccctccgctgttctcactagggtaccaccagagcagatggaattaccgggatgaagccgatgtgcttgaggtggatcaaggttttgacgatcacaatctcccatgtgatgtaatttggttggatatagaacacgccgatggaaagaggtacttcacttgggatcctagccgttttccgcaacccagaacaatgctggaaagactggcatcgaagcgcagaaaactcgtagctattgtggatccacatattaaagtggactctggatatcgggtccacgaggagcttcgaaatttagggctctatgttaagacaagagacgggtcggactatgaggggtggtgctggccgggcagcgcaggataccctgatttcacaaacccgacaatgcgtgcgtggtgggcaaacatgttttcctatgataattacgaggggtcagcacctaatttgttcgtctggaatgacatgaatgagccaagtgtgttcaacgggcccgaggtcacaatgctcaaagacgcccaacactatgggggctgggagcaccgggacgtgcataacatctacggtctctacgtacacatggcaacagcagatggtctccgccagaggagcggcggaatggagaggccatttgtgctggcccgggccttttttgcaggtagtcagaggttcggcgcggtttggaccggggataacacagcggagtgggatcacctgaagatcagtatacccatgtgcctgtcactcgggctagtgggcctctccttctgcggagcagatgttggcggcttctttaagaatccagagcccgaactgctcgtgcgatggtatcagatgggagcctatcaacccttctttcgagctcatgcccatctcgacaccggccgccgagagccctggctgctcccctcacagcacaatgatatcatccgggacgcccttgggcagagatactccctcctaccattttggtacactctcttgtaccaggcacatcgcgagggtattcccgtgatgcgacctctttgggtccagtaccctcaagacgtcacaaccttcaatattgacgaccagtacctcctcggagatgccctacttgtccacccagtttcagattctggagcccatggcgtgcaagtatatctgcccggtcaaggcgaagtctggtacgacatccagagctatcagaagcaccatggcccacaaacgctgtacttaccagttactctgagctcaatccctgtattccaacggggcggcactatcgtacctcgatggatgcgggttcgacgttcatctgagtgcatgaaggatgatccaattaccctgtttgtcgccttatccccccaaggcactgcccagggagagctcttcctagatgatggacacacctttaattaccagacacgccaggagtttcttctcagacggttttctttttcaggcaataccctggtgtccagcagtgctgaccccgaaggccactttgagacgcccatttggatagaacgggtggtgatcatcggcgctggcaagccggcagccgttgttttgcaaacaaaaggcagccctgagtccaggctcagctttcagcatgacccagaaacgagcgtgctcgtccttcgaaagcccggcattaacgttgcctctgattggagcatacacctccgatag

SEQ ID NO: 189258 - DNA, 2835 bp, Artificial Sequence
  Description of Artificial Sequence: Synthetic coding sequence
atggccgccgtggccgccgtggccgcccggcggcggcggagctgggcttccctggtcctggcctttctgggcgtgtgtttgggcatcacccttgcagtggatagatccaattttaaaacatgcgaggaatcatccttttgcaagaggcagcgttccatccgccccggactgtcaccctatagggccctgctggacagccttcagctggggccagacagtctgaccgttcatctgatccacgaggttacgaaggttctcctcgtgctagaattacaaggactgcagaagaatatgactcgcttccggatcgacgaacttgagccacgtaggccccgctaccgggtccccgatgtgttagtcgcagatccccccattgcccggctttcagttagcggcagagacgagaattccgtggagctgacgatggccgagggcccatataagattattctgactgctcgccccttccggttagatctgttggaagatcgctccttgctgcttagcgtgaatgctcgcgggctcctggaatttgagcaccagcgcgcccctcgggttagccaaggatccaaggatcccgccgaaggcgacggcgctcagccagaggaaactcccagggatggcgacaaaccagaagagacccagggcaaggccgaaaaggatgaacctggagcctgggaagagacattcaagacccacagcgattccaaaccttacgggcccatgtccgtaggtctcgacttctccctccccggcatggagcatgtctacgggattccagagcatgccgataatctgcgtcttaaggtgacagagggtggtgagccttatcgcctgtataacttagacgttttccagtatgagttatataaccctatggcactgtacggtagtgtaccggtattgttagcccacaacccacacagggacctcgggatcttttggctgaatgccgcagagacctgggtggatatctcctctaacacagctggtaaaaccctgttcggaaaaatgatggactacctccagggctcgggggagactccgcagaccgacgtgcggtggatgtctgaaaccggtattatcgatgtatttttgcttctcggaccctctatctcagacgtcttcagacagtatgccagcctgacaggaacccaggcccttcctcccctcttttcactgggttatcatcagtcacgctggaattacagagacgaggccgacgttctcgaggtggaccaaggtttcgacgatcataatctaccttgcgatgtgatttggctggatatcgagcacgcggacggcaaacgatactttacgtgggatcccagccgattcccacaaccccgcactatgctggaacgactagcctcaaagcgtcggaaacttgtggccatcgtcgacccccacattaaagtggatagtggctaccgcgtccacgaagagttgcgcaacctgggtctgtacgtgaaaacacgggatgggagtgattatgaaggctggtgctggccaggtagcgctgggtatccggactttacgaaccccacaatgcgcgcttggtgggctaacatgttcagctacgataattacgaggggtccgcccctaacctttttgtttggaacgacatgaatgagccttctgtatttaatggccctgaggtcaccatgcttaaagacgcccagcattacggaggttgggaacacagagatgtgcacaatatctacggcctgtatgtgcacatggcaacagccgacgggctgcgccagagatctggaggtatggagagacctttcgttctcgcccgcgctttctttgctgggtcccagcgatttggcgcagtatggaccggagacaacacggcggaatgggatcatttgaaaatttctattcccatgtgcctctctctcggtctggttggcttgtccttctgcggcgccgacgtaggtggcttttttaaaaaccccgaaccagagcttttggtccgatggtatcagatgggagcctaccagccgttttttcgtgctcatgctcacctcgataccggccggagagaaccttggctgcttccttcccagcacaatgacatcatccgcgacgcactcggacagagatactccttactgcccttctggtatacattgctgtaccaggcacacagggaggggattccagtaatgagaccactgtgggttcagtatccccaggatgtgacgacttttaacatagatgatcagtatctcctgggcgacgccttacttgtacacccggtgagcgatagcggggcccacggtgtccaggtttacctgcccggccagggcgaagtgtggtacgacattcagtcctatcaaaagcatcacggaccgcagacactgtacctgccagtaacgctctctagtattcccgtgttccagaggggcggtaccatagtgcccaggtggatgcgggtccggcgatcatccgaatgtatgaaagatgacccaattaccctatttgtagcgctctcaccacaggggaccgcccaaggggagctgtttttggacgacggtcataccttcaactaccaaacccgccaggaatttctgttgagacgtttcagctttagcggaaacacactggttagctcgagcgccgatcccgaaggccacttcgagaccccaatttggattgagcgcgtagtcatcatcggcgctggaaagccagctgcggtggtcctccaaaccaaagggtcacctgagtccaggttatcattccaacacgatcccgagacttcggttctggtcctcagaaagcccggaatcaacgtggcgtcagattggagtatacacctgcgatag

SEQ ID NO: 189259 - DNA, 2544 bp, Artificial Sequence
  Description of Artificial Sequence: Synthetic coding sequence
atgacccggttccggatcgacgagctggagccccggcggccccggtatcgcgtgcctgacgtcctggtagccgatccacccattgcgcgtctctccgtcagcggacgtgacgagaactctgtcgagctaactatggccgaaggcccatacaagatcattctgactgcccggccattcagactggatctgctcgaagatcgaagtctactgctgtctgtgaatgctcgtggactgctggagttcgaacaccagcgtgcccccagagtctcacagggctctaaagacccagctgagggcgatggagcccagccagaagagactccaagggacggcgataagcccgaggagacccaaggcaaagcggaaaaagacgaaccaggagcttgggaagagacgttcaagacccacagtgattctaagccatatggccctatgagtgtggggttggacttttcgctgccggggatggagcacgtctacggcatacctgaacacgctgacaatctccgcctgaaggtgaccgagggtggggaaccatatagactgtacaatctggatgtttttcagtacgagctgtataacccaatggccctgtatggcagtgttcccgtgctgttagctcacaacccccatagagatcttggcattttttggctgaacgcagctgagacctgggtcgatataagttcaaacaccgctgggaaaaccctgtttggcaaaatgatggactacctgcaaggtagtggtgagacaccccagacggacgttaggtggatgagcgaaactggcattatcgacgtttttctgctactgggaccatcaatctccgacgtctttcgtcagtatgcttccttaacaggtacccaggctctgcccccactgttcagcctcggctaccaccagtctcgctggaactatagggacgaggcagatgtcctggaggtagaccagggatttgatgaccataacttaccttgtgacgtcatctggctggacattgaacatgccgacggtaagagatacttcacatgggatccgtcaaggttcccccagcccaggaccatgttggagagactcgcgagtaaaagacggaaattggtggctatcgtggatccacacatcaaagttgacagcgggtaccgggtccatgaagagctccgaaacctcgggttgtacgtcaagacccgcgacggtagtgattacgagggctggtgttggccgggatctgcagggtacccggacttcacaaatccaactatgagggcttggtgggcaaacatgttttcgtacgacaattacgaaggatctgctcctaatttgttcgtctggaatgacatgaacgagccctcggtcttcaatgggcccgaagtgacaatgctcaaggacgcacaacactacgggggatgggagcacagagatgtgcataacatatatggcctgtatgttcatatggccacagcggacggattaagacagagaagcggtgggatggaaaggcccttcgtgttggcgagagccttctttgccgggtctcagaggtttggggctgtttggaccggggacaatactgccgagtgggatcacctaaagatatctatcccaatgtgtctctccctggggctcgtcggattgtcattttgcggtgccgatgtcgggggcttcttcaaaaacccggaaccagaactgctggtcagatggtaccagatgggggcataccagccgtttttccgagcgcatgcccacctcgataccggacggagagaaccctggctgcttccttcccagcacaacgatatcattcgcgacgcgctgggccagaggtacagcctgttacctttctggtatacgctactgtatcaagcacaccgtgaaggtattcccgtgatgcggcctctttgggtgcagtatccccaggatgttaccacattcaacatcgatgatcaatacctgctgggagatgccctgctcgtccacccagtctcagacagcggcgcacatggagtccaggtgtatttgccaggccagggagaggtgtggtatgatattcagagctaccaaaagcaccatggcccccagacattgtatttgcccgtcaccctgtcatctatacccgtctttcaaagaggaggcaccatagtccctaggtggatgcgcgtgaggcgatcctctgagtgcatgaaagacgatcccatcaccttgtttgtggctctgtcccctcagggcactgcccagggcgagctgtttttggacgacggtcatacattcaactaccaaacaaggcaggagtttctgcttcgaaggttcagcttcagcggtaataccctcgtgtcttcttcagccgatcctgagggacactttgaaacccccatttggattgagcgggttgtgatcatcggcgcagggaaacccgcagccgtcgtcctgcagaccaaaggcagcccagaatccaggctgtccttccagcacgatcccgaaactagtgtcctggtacttagaaagccaggaatcaacgtcgcatccgactggagcattcacctgcggtag

SEQ ID NO: 189260 - DNA, 2745 bp, Artificial Sequence
  Description of Artificial Sequence: Synthetic coding sequence
atggaggccgccgtgaaggaggagatcagcctggaggacgaggccgtggataaaaatatcttcagagactgtaacaagatcgcattctacagaaggcaaaagcaatggctctcgaaaaaatccacataccaagccttgctggactccgtgactacagacgaagacagcacacgcttccaaataataaatgaagcaagtaaagtgccattactggccgagatatatggcatagagggaaacatttttcgactcaaaatcaatgaggaaaccccactgaaaccacggttcgaggttcctgacgtattgacttcgaagcctagtacggttaggctgatatcctgcagcggagacacaggatcactgattctggcagatgggaagggtgacttgaagtgtcatatcacagccaaccctttcaaagtggacttagtgtccgaagaggaggttgtcatttctatcaactctctgggccagctgtacttcgaacatttacaaatcctacataagcagagggctgccaaggagaatgaggaagagacaagcgtggatacaagccaggaaaatcaggaggatctgggcttgtgggaggagaagttcggaaagttcgtcgacattaaagctaacggtcctagctccatcggtctggatttctcactccacggattcgagcatttgtacggcatacctcagcacgccgaatctcaccagctcaaaaacacaggggatggagacgcgtatcgcctgtacaacctggatgtgtacggttaccagatatatgacaaaatgggcatctacggctccgttccgtatctcctggcacacaaactgggtcgaacgattggcattttctggctcaacgcttcagaaaccttggtggaaattaatactgagccagcggtggagtatactctgacccagatgggcccagttgcggcaaaacagaaagttcgcagccgcacccatgtccactggatgtcagagagcggaattattgatgtcttcctgttaactggacccactccctctgacgtcttcaagcagtacagccatcttactggcacacaggccatgccgccactcttttccctgggttatcatcaatgcaggtggaattatgaggacgagcaggacgtaaaagctgttgacgccggtttcgacgagcatgatataccttatgacgccatgtggctggacatcgagcatacagagggcaaacgatactttacttgggacaaaaatcgattcccgaaccctaaacgaatgcaggaacttctgcggagtaaaaagcgaaaactggtggtaatcagtgacccacacatcaagattgaccccgattacagcgtatacgtgaaagccaaggaccaggggttctttgtgaaaaaccaggagggggaagatttcgaaggagtttgttggcctgggctaagttcctatctggacttcacaaaccccaaggtgcgtgaatggtattcctctctgtttgccttcccagtatatcaagggtctactgacatactgtttctgtggaacgatatgaatgaaccgtctgtctttagagggccggagcagacaatgcagaaaaatgcaatccaccacggcaattgggagcacagggagctacataacatttacggattttaccatcagatggccactgccgaagggctcattaagcgctctaagggtaaagaaagacccttcgtgctgactagatccttcttcgctggctcacagaaatatggcgccgtgtggaccggcgataataccgctgaatggagcaatctgaagatttcaatacctatgcttctgactctgtccatcacaggaatatcattttgcggcgcagacattggcggatttatcggaaacccggaaaccgagcttctcgtgcgctggtatcaggccggggcctaccaaccattttttagaggccacgccactatgaatactaagcggcgcgagccatggttattcggggaggagcatacgagactcatccgggaagcgatcagagaacggtacgggctactcccatattggtatagtttgttttatcatgcccacgttgcctcccagcccgtgatgcgccctctgtgggtcgaatttccggacgagcttaaaactttcgacatggaggacgagtacatgctaggcagcgccctattggttcatcccgtcaccgagcccaaagcaactacggtcgacgttttcttacctggctcaaacgaggtgtggtacgactacaaaactttcgcccactgggagggagggtgcaccgtgaagatccctgtggctctggatactatcccagtgtttcagcggggcggaagtgtgatccctataaaaaccacggtcgggaagtccacagggtggatgactgagtccagttacggcctgcgcgtggctcttagcaccaaggggagctccgttggcgaactatatctagacgacgggcactccttccagtacttgcatcagaagcagttcctgcaccggaagttctctttctgctctagcgtgcttatcaacagtttcgccgatcagaggggtcactatccctccaagtgtgtggtggaaaagatactggtgctcggtttcaggaaggaaccaagttcagtcaccactcactcgagtgacggcaaggaccaacccgtcgcctttacctactgcgctaagacttcaattttatctcttgagaagctgagccttaatatcgcaaccgattgggaggtgagaatcatctag

SEQ ID NO: 189261 - DNA, 849 bp, Artificial Sequence
  Description of Artificial Sequence: Synthetic coding sequence
atggaggccgccgtgaaggaggagatcagcctggaggacgaggccgtcgacaaaaatatctttcgcgactgtaataaaattgcattttacagaaggcagaaacagtggttgtcgaagaaatcaacttaccaggcacttctcgacagcgtgaccactgacgaagattccactagattccagataatcaatgaggcctccaaggtgcggtgtcaagatcagagcccaactacactcgatgcttttaaagggaaagagaccacagtgcaggaggaaactcaggatctgtctacaagacaacaccttgcccagaaagaggctgaggagcccgacaagcagggtcaaatcacttgggatattagcaacgtggccccgaaaactgagaatttcgaggatctccttgaacagaccccctgcagtgcctgcttgcagggttttaccagagataacactagcagttcattcagtgaggatgcgggcatatccttatccaccagtgtaaagctcccacttgccagcagttctaagcctaacgagaatgaggcgctccccaaccaaccgccctctcagcaaattagacacaactataggctgctggcctccactgtgagtgctgagatggcaaggaatagacagttgatttgggagctcgccaggcagtccgaagcccatctggataggccggtggttttaggtgaacaggcatccgcacagcgcgaggttgcgtcgatcctttgccgaaaatctgtcctggctatcaaccagctggccgcaaccgtcgagggcacgatatcagtgctgcaacagttcaacgagttactggatcaccctctcgatccaggtcggtcttag

SEQ ID NO: 189262 - DNA, 1230 bp, Artificial Sequence
  Description of Artificial Sequence: Synthetic coding sequence
atgcggcggtacctgcgggtggtggtgctgtgcgtggcctgcggcttctgttctttactatacgcgttcagccagcttgctgtgtctctcgaagaaggcactggtggaggcgggggaaagcctcaagcagcggtagcttcctggctcgccgggggggggcgcggggctgttagaggcgccggagtagcaggccccgccgcacacccaggcgtgtctgatcgctatagcttgaagattcagcctgtagaaaaaatgcatttggctgtagtcgcctgtggagagagactcgaggaaacgatgactatgttaaagtctgccattattttttcgatcaagcctctgcagtttcacatttttgctgaggatcagcttcaccacagctttaagggacgccttgataattggtcatttctgcagactttcaattacactttgtatcctatcacgttcccatcagagaacgctgccgagtggaaaaaactgtttaaaccctgtgcttcacagaggctgtttctgccacttattttaaaggaggtggattctttgctttacgtagatacagatatcctgtttcttcggcctgtggacgacatttggagcctcctcaagaaatttaacagtacccagattgccgctatggcaccagagcacgaggaaccgaggattggatggtataaccgttttgctcgtcatccctactacgggaagacaggcgtgaacagtggcgtgatgctaatgaatatgactagaatgcgcaggaagtattttaagaatgatatgaccactgtaagactgcaatggggagatatcttaatgcccctgctgaaaaagtataaactgaatattacatggggagaccaggacctgttgaatattgtattcttccacaacccagaatcactctttgtgttcccttgccagtggaattatagacctgaccactgcatttacgggtccaattgccaggaagcagaagaggggggaatatttatcctccatggcaaccggggcgtgtaccacgacgataaacagcctgctttccgcgccgtatatgaggccctacgcaactgctcgtttgaagatgataacatacggtcactgctgaaacccctggaacttgaactgcagaagaccgtgcatacatactgcggcaaaatctataaaattttcatcaagcagctggccaagtctgtgagagatcggtacgccaggagccccaaagaaaagtag

SEQ ID NO: 189263 - DNA, 1323 bp, Artificial Sequence
  Description of Artificial Sequence: Synthetic coding sequence
atgcggcggtacctgcgggtggtggtgctgtgcgtggcctgcggcttttgctccctgctgtacgctttttcccaattagcagtgtcccttgaggagggcacaggggggggcggcggcaagcctcaggcggccgttgccagttggctggctggcggcggccgtggcgctgtgcgaggagctggcgtggcaggacctgctgcccaccctggggtgtcggataggtgcaaggatttctcactgtgttactggaacccttattggatgctgccttccgatgtctgtgggatgaactgcttttgggaagctgcgttcagatattctctgaaaatccagccagtggagaaaatgcacctggctgtggttgcatgtggcgagagactcgaagaaactatgacaatgctgaaatctgcaatcatcttctccataaagcctctccagtttcacattttcgcagaggaccaattgcaccatagctttaaagggcgccttgataactggtcttttttacagacctttaactacacattgtacccgattacattcccctctgaaaatgctgcagaatggaagaagctttttaagccttgcgccagccagcggctgttcctccccctgatactgaaagaagttgatagtctgctgtacgtggatactgacatcctgttcttgaggcctgttgacgacatctggtcacttctcaaaaaattcaatagcacccagattgcagcaatggccccggaacacgaagagcccaggattgggtggtacaatcgcttcgctaggcatccttattacggcaagacaggggtgaattccggggtgatgctcatgaacatgactcgaatgcgtcgcaaatactttaagaacgatatgacaacagtccggttacagtggggagatatcctcatgcccctgttaaagaaatataaactcaacatcacctggggtgaccaggatcttttgaacatagtcttcttccataacccagagtccttgttcgtgtttccctgtcaatggaactaccgcccggaccattgcatttacggctccaactgtcaggaagccgaggagggaggaatattcatcctgcacggtaaccggggcgtgtaccatgatgacaaacagcccgctttccgagccgtttatgaggccctgaggaactgtagcttcgaagatgacaatattcggtccttgctcaagccactggaactggagcttcagaagactgttcacacatactgcggaaaaatttacaaaatcttcatcaaacagctggcaaaatcagtcagggatcgctatgctagatctcctaaggaaaagtag

SEQ ID NO: 189264 - DNA, 1332 bp, Artificial Sequence
  Description of Artificial Sequence: Synthetic coding sequence
atgaagctgcggagcaaggccgccgccctgctgctgctggccctggcagcgctgctgctcgctctgctgagcctccgggcagggagagcggagcctcctgctctcccagcccggcctgcatcagcccctcagagacatcctgcgccagtccctgctcgctggcctgggccaggggccctacctggcgctagtcccggtgtaaggcgacgcagacctccgcggccacggccccgcgctggaaggagaggagcagccagacttgagaaactggccagaagaccgggggagccacgctctttccaggctgtgcttccacctgaactgtggattcatctggccgtggtagcctgcgggaatcggctggaagaaactctcgtcatgctcaaatcggcggtgttgttctcccatcgtaagatccagttccacatcttcacggaggattcactgaagcctgaattcgacaaacaattaagacagtggccggattcttataccaaaaaattcgagcacagaatctaccctatcactttctctgtgggcaacccccaagagtggaagaagctttttaagccatgcgccgcacagagattattcctgcccgttattctgaaagatgtagactcactgctctatgtcgataccgatgtcttgttcctacgtcccgttgatgacatctggaagctactacgattgtttaactccacccagttagcagcaatggcccctgaacacgagatcccaaagatcggctggtattcaaggtttgcacgtcaccccttctacgggtccgccggcgtcaatagtggggtaatgcttatgaacttgacacggatccgcagtacccaattcaaaaactcgatgattccgactggcctggcctgggaagacatgctgtacccactgtaccaaaagtacaagaatgccatcacatggggagaccaagacctactgaacatcatcttctacttcaatccagagtgtctgtatgtgttcccttgtcagtggaactaccgacccgaccactgtatgtatggctccaattgtagggaggcagaacacgaaggcgtgtccgttctccatgggaaccggggcgtctaccacgatgacaagcaaccaactttccgagccctctatgaagccatcagagactttccctttcaggacaatctattccagtcaatgtattatcccttacagctcaagtttctagagactgtgcatactctgtgcggtagaatcccacaagtattcttaaagcagatagagaagactatgaagagagcctatgagaaacacgtgatcattcatgtggggcctaatcaaatgcattag

SEQ ID NO: 189265 - DNA, 1854 bp, Artificial Sequence
  Description of Artificial Sequence: Synthetic coding sequence
atgcggtgcctggccgcccgggtgaactacaagaccctgatcatcatctgcgctttatttactctggtgaccgtactattgtggaataagtgttccagcgacaaggcaattcaatttccgcggcggagcagctccgggtttagagtagatggctttgagaaacgggctgccgcgtcagaaagcaataattatatgaatcacgttgcaaaacagcagtcagaggaagccttcccccaagagcagcagaaggcccctccagtggtgggtgggtttaatagcaatgtgggctctaaagtcttaggactgaagtatgaggagatagattgcctcatcaatgacgagcacaccatcaaaggcaggagggaaggtaacgaggtcttcttaccttttacctgggtggaaaaatattttgatgtgtatggtaaagtcgttcagtacgacggttatgatagatttgagttcagccattcttacagcaaggtttacgcccagagagccccataccatccggacggcgtgttcatgagctttgagggatataatgtggaagttagggaccgcgttaagtgcatctctggagtggaaggagtgccgctatctacacagtggggcccacaaggatacttttaccccatacagattgctcaatatggacttagtcattacagcaaaaacctgacagagaaacctccccacatcgaggtttacgaaacagccgaagacagagataaaaataagcctaatgattggacggtgcccaaagggtgttttatggccaatgtcgctgacaaatcaaggttcacaaatgtgaagcaattcatagcaccagaaaccagtgagggggtgtcactgcagctcggcaatactaaggacttcatcatctctttcgacctgaaatttttgactaatgggtctgtctccgtggtgctggaaacaacagaaaaaaatcagctgttcacgatccattatgtgtctaatgctcaactgatcgccttcaaggagagggacatctactacgggattggaccaagaacaagctggagcaccgtcactcgcgacctggtcacagatctgagaaagggtgtcggtcttagtaatacaaaagcagtcaagccaaccaagatcatgccaaaaaaagtggtgcgtctgattgctaaggggaaggggtttctagacaacatcaccatctcaaccaccgcccacatggctgccttctttgctgcttctgattggctggtgcgaaaccaggacgagaagggcgggtggcctatcatggtgactcgaaagctgggggagggatttaagtccctggaacccgggtggtactctgccatggctcagggccaagcaataagcacactggttagagcatacctgctaactaaggatcatatattccttaacagtgcgctccgcgcaacagcaccctataaatttctatcagaacagcatggggtgaaagccgtgttcatgaacaagcatgactggtatgaggagtacccaaccacaccgtccagtttcgttctcaacggctttatgtattcattgattggtttatacgacctgaaagaaaccgcgggagaaaaattagggaaggaagcccgatccctgtatgagcggggcatggagtccctgaaggccatgctccccctttatgataccggcagcggtacgatctatgacttacgacactttatgctgggtatagccccaaatctcgcgcgctgggactatcacactacccatatcaaccaacttcagctgctctcaacaatagatgagtcccctgtgtttaaagaatttgtgaaacgttggaaatcataccttaaggggtctcgggcaaagcataactag

SEQ ID NO: 189266 - DNA, 1662 bp, Artificial Sequence
  Description of Artificial Sequence: Synthetic coding sequence
atgaaccacgtggccaagcagcagagcgaggaggccttcccccaggaacagcaaaaagctccccctgtggtcggggggtttaattctaacgtgggttcaaaggttctcggactgaaatatgaggagatcgactgtctcataaacgatgagcatacaatcaagggccgcagagaggggaacgaggtttttctgccatttacatgggttgaaaaatatttcgacgtatacggtaaagttgtgcaatatgacggatacgacaggtttgagttctcccattcctattctaaagtgtatgcccagcgagccccataccaccctgacggagttttcatgagtttcgaaggatataacgttgaggtccgcgacagagttaagtgcatctccggcgttgaaggagtaccattgtccacccagtggggcccccagggctacttctatccaattcagatcgcgcagtatggcctgtcccactattcgaagaatttaaccgagaaaccgccacacattgaagtttatgagaccgccgaagatcgggacaagaataagcccaatgactggaccgtccctaagggttgttttatggcgaacgtggccgataagtctcgttttactaatgttaaacagtttatcgcgcccgagacgtcagaaggcgtctcgctgcagcttggtaacacaaaagattttattatctccttcgatttgaagttcttgaccaatggctctgtgtcagtggtgctggaaacgactgagaaaaaccagctcttcacaatccattacgtaagcaatgcacaactgatcgctttcaaagaacgggacatctattacggcatcggcccaagaacaagttggagcacagttacacgcgatcttgtgaccgaccttcgcaagggcgtggggctgagtaacaccaaagccgtaaaacccactaagatcatgcctaagaaggttgtgcgactgatcgccaagggcaaagggtttctggataacattacaatctccactactgcgcatatggctgctttcttcgcggcctccgattggctcgtacggaaccaggatgagaaaggtgggtggcccatcatggtgacacgtaaactgggcgagggtttcaagagcctggaacctggctggtattctgcaatggcccagggacaagctatttctaccttggtgcgggcttatctgctcacgaaggaccatatctttctgaactcagccttacgtgccacagccccctacaagtttctgagcgaacagcacggggtgaaggcggtcttcatgaacaaacacgattggtacgaggaatatcctacaacaccttcctcctttgtactgaatggttttatgtatagcctgatcggactttacgacctgaaggagactgccggcgagaagctcggcaaggaggctagatctttgtacgagaggggaatggagagcctgaaggctatgctgcccttgtatgatacaggcagtggaacaatctatgatctgcgtcattttatgctcggaatcgcaccgaatcttgctcggtgggactatcacactacacacattaatcagttacagctcctcagcactattgatgagtcccctgtgtttaaggaatttgtgaaaaggtggaagtcgtaccttaagggcagtcgagccaagcacaattag

SEQ ID NO: 189267 - DNA, 1956 bp, Artificial Sequence
  Description of Artificial Sequence: Synthetic coding sequence
atggcccggggcagcgccgtggcctgggccgccctgggccccctgctgtggggctgtgcactgggcctccaggggggaatgctttatcctcaagaatctccaagccgtgagtgtaaggaactagatggcctctggagctttcgcgcggatttttcagataaccgaaggagagggtttgaggagcagtggtaccggcgcccactctgggaaagcggccccaccgtggatatgccagtgccatctagctttaatgacatttctcaggactggaggttacggcatttcgtgggctgggtgtggtatgaacgcgaagtgatactgcccgagagatggacacaggacttgaggacaagagtggtgctcaggataggcagtgcccactcttacgccatcgtgtgggtcaatggagttgacacactcgaacacgaaggcggctacctgcctttcgaggccgatatttcaaacctcgtacaggtggggcctctgccttcccggctccgaataaccatcgccatcaataataccctgacccccacaacgctaccacctggcactatccaataccttaccgacaccagcaaatatcccaaggggtacttcgtgcagaatacgtactttgacttctttaactatgccggcctccaaagaagtgtattgctctacaccactcctacaacctacatcgacgacattacagtcaccacgagtgtcgagcaagatagcggccttgtcaactatcagatctccgtgaaaggatctaacctgtttaagctggaggtgcgcctgctcgacgccgagaacaaggtggtcgctaacggcacaggtactcaaggtcaactgaaagtgccgggggtttcgttatggtggccgtacctaatgcatgagcggccggcttatctctattcccttgaggttcagttgaccgcccagaccagtctgggccctgtcagtgacttttataccctgccggtagggattcggacggttgccgtcacgaaatcccagttcctcatcaacggcaaacctttttacttccacggcgtgaacaaacacgaggacgcagacatccgcggcaaaggattcgattggccattgctcgtgaaggactttaacttgcttcgatggctgggggccaatgcattccgaacctcccactacccatatgccgaggaggtgatgcagatgtgcgaccgatatggaatcgtagtcatcgatgagtgccccggtgtgggcttagcactgcctcaattcttcaataatgtctcccttcaccatcatatgcaggttatggaagaggtggttagacgcgacaagaatcaccctgcggtggtgatgtggtctgtcgcaaatgagcctgcctcccaccttgagagcgcaggttattacttaaagatggtgatagcccacactaagagcctggaccctagtagacctgttaccttcgtgtctaattcaaactatgccgcagataagggcgcaccctatgtcgacgtcatatgtcttaacagctactactcatggtaccacgactatggccacttagaactgatccaactgcagctggctacccaatttgaaaattggtacaagaaataccagaaacctatcattcagagcgaatatggcgctgagactatcgccggatttcatcaggatccacctttaatgtttacagaggagtaccagaagagcttactggaacagtatcatctgggactcgatcagaagcgtaggaagtacgtggtgggggagctcatatggaattttgccgacttcatgacggagcagtcccccaccagagtcttgggaaacaaaaaaggaatttttacccgccagcgccaacctaaaagtgccgcttttctgttgcgagaaagatattggaagatagctaacgagacaagatatccccacagcgtggcaaaatctcagtgcctggagaacagcctgtttacttag

SEQ ID NO: 189268 - DNA, 1803 bp, Artificial Sequence
  Description of Artificial Sequence: Synthetic coding sequence
atggcccggggcagcgccgtggcctgggccgccctgggccccctgttgtggggctgcgctctaggcttacagggtggaatgctttacccccaagaaagtccatccagggagtgcaaggagctggacggcctctggagtttccgagccgatttctcagataaccggcggcgcgggtttgaagagcagtggtaccggaggcctctgtgggagagcggccccaccgtagacatgcccgtcccctcttccttcaatgatatttctcaagactggcgtttacgtcacttcgtcgggtgggtctggtacgagcgggaagttatcctccccgagcgctggacacaggaccttcgtactcgggtagtcctcaggatcggcagcgctcatagctacgcgatcgtgtgggtgaacggcgtcgacactctggaacacgaaggcggctaccttccgtttgaagcagatatttcaaacctggtacaggtaggccctctcccttctcgcctccgcataacgattgccattaacaataccttaacgccgaccactctgcctccaggaaccattcagtacctgaccgatacgtctaagtatcccaagggatacttcgttcagaacacttacttcgacttcttcaattacgcaggattgcagagaagcgtgctgctgtataccacacccaccacctacatcgacgacatcactgtgaccacctctgtcgagcaggacagtggcctggttaattatcagatcagtgtcaagggctctaatctttttaaactggaggtgcgcctgttagacgccgaaaataaggtggtagcaaacggaacaggcacccaagggcagctcaaggtgcccggggtctcactctggtggccttacctgatgcatgaacgtcctgcctatctgtactcgcttgagatacggggcaaaggctttgattggcctctgctggtcaaggacttcaatctactgcggtggcttggcgcgaatgcatttagaacatctcactatccttatgctgaggaggttatgcagatgtgtgatagatacggcatcgtcgtaatcgacgaatgtcccggcgtgggccttgcccttcctcagtttttcaacaatgttagtctgcatcaccatatgcaggttatggaagaggtcgtgaggagagacaagaaccatccagccgttgtcatgtggtctgttgccaatgaacccgcctcacacctcgaatcagcgggttattacctgaagatggtcatcgcacatacaaagagtttagatccgtccaggcccgtaaccttcgtgtctaatagcaactacgccgctgataagggggcgccctatgtggacgtcatctgccttaactcctattactcctggtaccacgactatggccacttggagctcatacagctgcaactcgccacccagtttgagaattggtataagaagtaccagaagcccatcatacagagcgagtacggcgccgagactatcgccgggttccatcaagaccctcctctgatgttcaccgaggaataccagaagagccttctggaacaataccatctgggactcgaccagaagcgacgcaaatatgtggtgggagagctgatctggaatttcgccgacttcatgacagagcaaagccctacacgcgtactggggaacaaaaaagggatttttacaagacagagacagccaaaatcagccgccttcctgctcagagagcggtattggaagatcgcaaacgaaaccaggtatccacacagcgtggcgaagtcacaatgtctcgagaattctctttttacctag

SEQ ID NO: 189269 - DNA, 675 bp, Artificial Sequence
  Description of Artificial Sequence: Synthetic coding sequence
atggccagcagcacccccagcagcagcgccaccagcagcaacgccggggcagatccgaacacaacaaacctgcgccccaccacatatgatacctggtgtggcgtcgcgcatgggtgcacccgcaaacttggcctgaaaatatgtggctttctgcagcgcacaaatagcctggaggaaaagtcccggctggttagcgcctttaaagagcgtcagtccagtaagaatctcctctcttgcgaaaactcagacagagatgcccgcttcaggcgcaccgaaaccgacttctccaatctgtttgcacgggacctgctgccggccaagaacggggaagagcagaccgttcaatttctgctcgaggtggtggatatccttctgaactatgtgcgcaagacattcgacagatctaccaaagttctagactttcaccacccacatcagctactggaggggatggaggggtttaacctagagctgtcagaccatccggagtccctggagcagatcctcgtcgattgtcgggacacgcttaaatacggcgtgcgaaccggtcacccccgctttttcaaccagctttccaccggactggacattattggactcgccggggaatggctgacctctactgctaacactaacatgcctagtgacatgcgcgagtgttggttgcttcggtag

SEQ ID NO: 189270 - DNA, 1785 bp, Artificial Sequence
  Description of Artificial Sequence: Synthetic coding sequence
atggccagcagcacccccagcagcagcgccaccagcagcaacgccggggccgaccccaataccacgaatctccggccaaccacctatgatacttggtgtggcgtggcccatggctgcactaggaaactgggattgaaaatctgtgggtttctgcagcgtacaaatagcctagaagaaaagagccgccttgttagtgcttttaaagagaggcagagctctaaaaacctgctcagctgcgagaatagtgacagagatgcccgtttcagacgaacagaaaccgacttctccaacctattcgcaagggatctcctgccggcaaaaaatggtgaggagcaaacagttcagtttctgctggaagtagtggacatactgctgaattacgtgcgtaaaacttttgataggtcgaccaaggtcttggactttcatcacccccaccagctgctcgagggcatggagggttttaatctggaactatcagaccaccctgagtcgctggagcagattttagtcgactgcagagatacattgaagtacggagtcaggacagggcaccctcgtttctttaaccagttgtctaccggcttggacattattggcttggctggagagtggctcacctctaccgctaacacaaacatgttcacttacgagattgcccctgtgtttgtgttaatggagcagataaccctgaaaaagatgagggaaatcgtagggtggtcttctaaagatggcgacgggattttctccccagggggtgcaatcagcaatatgtacagtattatggctgcacgctacaaatatttcccagaagtgaagactaaaggaatggcagccgttccaaaattagtcctgttcacctccgagcagagccattactccataaaaaaagcgggagctgcgctgggttttggtacagataacgtgatccttataaagtgtaatgaacgggggaaaattatccccgctgactttgaggcaaaaatcctagaggctaagcagaagggatatgtcccgttttatgtaaatgctacagccggcactaccgtctacggggctttcgatcctatccaggagatcgccgatatctgtgaaaaatacaacctatggctacacgtggacgctgcgtggggggggggcctgctcatgagtagaaagcaccgccataagctgaacggcattgagcgtgccaacagtgtgacatggaatccccataaaatgatgggcgtgctgttgcagtgctcagcaatactcgtgaaggaaaagggcattttgcagggttgcaatcaaatgtgtgccgggtatttgtttcagcccgataaacaatacgacgtaagctatgacacaggcgacaaggctatacagtgcggtagacatgtggatatatttaagttctggctgatgtggaaggcgaagggaactgtcggctttgagaatcagatcaacaaatgtttggaactggctgaatacctttatgcgaaaatcaaaaacagagaggagttcgaaatggtattcaatggtgaacccgagcacaccaatgtttgtttctggtatatcccccaatccttgcggggtgttccagactcaccccaaagacgagaaaagctgcataaagtggcaccaaagattaaagccctgatgatggaaagcggtaccacgatggtcgggtaccagccacagggcgacaaggcaaacttctttcgaatggtcatttcaaaccccgccgctactcagtccgacatcgattttctcatcgaggagattgaacgtcttgggcaggacctctag

SEQ ID NO: 189271 - DNA, 675 bp, Artificial Sequence
  Description of Artificial Sequence: Synthetic coding sequence
atggccagcagcacccccagcagcagcgccaccagcagcaacgccggggctgatcccaacactactaatctgcgacccaccacctacgatacatggtgtggagtagcccatggctgcactcgaaagctgggcctcaaaatttgcggatttctgcagcggacgaattcactagaggagaagagccggctggtttctgctttcaaggagcgacaatcgagcaagaacttgctgtcttgcgaaaactccgatagagatgcacgctttagaaggacagaaactgacttttccaacctcttcgcacgggatctgctgcccgcaaagaacggcgaggaacaaactgtacaatttctgctggaagtcgtggatatcctactgaattatgtgaggaagaccttcgaccgatccaccaaagtgctggatttccaccatcctcaccagctgctggaggggatggagggctttaatctcgagctgtcagatcatccggaatccctcgaacaaattctcgttgattgtcgagacaccttgaagtatggggtccgtacgggacacccacggttcttcaatcagctaagcaccggccttgacattattggcttggcaggagagtggctgacgagtactgctaatacgaacatgccaagcgacatgcgtgagtgttggttgttacgatag

SEQ ID NO: 189272 - DNA, 114 bp, Artificial Sequence
  Description of Artificial Sequence: Synthetic coding sequence
atggccagcagcacccccagcagcagcgccaccagcagcaacgccggggccgaccctaataccaccaacctgcgccctacaacgtacgatacgtggtgtggcgtggcccactag

SEQ ID NO: 189273 - DNA, 258 bp, Artificial Sequence
  Description of Artificial Sequence: Synthetic coding sequence
atggccagcagcacccccagcagcagcgccaccagcagcaacgccggcgcggatccaaacacaacaaacctccggcctacaacgtacgacacctggtgtggcgttgcgcacggatgtacccggaagctgggcctgaaaatatgcgggttcctgcagcgcaccaactcattggaggagaaaagccggcttgtgtctgcttttaaagagaggcagtccagcaagaatctcctgtcatgcgaaaactcagaccgtgattag

SEQ ID NO: 189274 - DNA, 348 bp, Artificial Sequence
  Description of Artificial Sequence: Synthetic coding sequence
atggccagcagcacccccagcagcagcgccaccagcagcaacgccggcgccgacccgaataccactaatctgcgtcctaccacgtacgatacttggtgtggtgttgcacatggttgcacacgaaaacttggtctgaaaatctgtggatttttacagcggaccaacagcctagaggagaagtctagactggtgagcgcctttaaagaacggcagtctagtaaaaacctgctgagctgtgagaactctgacagggatgcccgctttaggagaacggagaccgactttagcaacctctttgctagagatctacttccagccaaaaatggcgaggagcaaacagtccagtag

SEQ ID NO: 189275 - DNA, 366 bp, Artificial Sequence
  Description of Artificial Sequence: Synthetic coding sequence
atggccagcagcacccccagcagcagcgccaccagcagcaacgccggcgccgaccctaatactacgaatctgcgtccgaccacttatgatacatggtgcggggtggcgcacggatgtacacgtaagctgggcctcaaaatatgcggattccttcaacgaaccaacagcttggaggaaaaatctcgattggtaagcgcctttaaagagcggcagagtagtaaaaacttactgtcctgcgaaaactccgacagggacgcccggttcaggcgcacggagaccgacttctcaaatttgtttgcgcgcgatcttttacctgccaagaatggggaagagcagactgtccaattcctgttggaagtggtctag

SEQ ID NO: 189276 - DNA, 1758 bp, Artificial Sequence
  Description of Artificial Sequence: Synthetic coding sequence
atggccagccccggcagcggcttctggagcttcggcagcgaggacggatctggtgactccgaaaatcccggcacagctcgagcctggtgtcaggtggcccagaaattcacgggcggtataggaaacaaactttgtgcactcttgtacggagacgccgaaaaacccgcagagtccggcggtagccagcctccacgcgcagcggcccgcaaggcagcgtgcgcctgtgatcagaagccttgcagctgctctaaagtcgatgtgaactacgcttttctccatgccaccgacttactccctgcctgtgatggcgaacgaccaacccttgcatttctgcaggacgtaatgaatattctgctccagtacgtggtcaagagcttcgacaggtccactaaggtgattgattttcattacccaaatgaactcttacaggagtacaattgggaactggccgatcagccccagaatcttgaagaaattctgatgcattgccaaactacactgaaatatgctattaaaactggccacccccgctattttaatcagctcagcaccggcctcgacatggtggggctcgcggccgactggcttactagtaccgcaaacacaaacatgttcacgtatgagatagcacctgtctttgtgctcttggaatacgtgacactaaagaaaatgcgcgaaatcataggctggccaggaggcagtggcgatggaattttttccccaggcggcgcaatttctaacatgtacgccatgatgatcgcccggttcaagatgttcccagaagttaaggagaaagggatggccgcacttccacggctgattgcttttactagtgagcacagccacttcagtctgaagaaaggagccgccgccctgggcataggcaccgactctgtcattctgatcaaatgtgacgaacgaggcaagatgataccttcagacctggaacggcggatactcgaggcaaagcaaaaagggttcgtgcccttcctcgtgtcagctacggccgggactacagtgtacggagcatttgaccccctcctggcagtggccgacatttgcaaaaagtataagatctggatgcacgtggatgccgcttggggaggtgggctccttatgagcaggaagcacaagtggaaactgtcgggagtggagcgggccaattcagtgacttggaacccacacaaaatgatgggagtgccccttcagtgcagtgccctgctcgtaagagaggaggggctcatgcagaactgtaatcagatgcatgcttcatacctgttccaacaggataagcactacgacctcagctacgatacgggtgataaggctcttcagtgcggaaggcacgtcgatgtattcaagttgtggctgatgtggcgcgccaagggcactacaggcttcgaagctcatgtggacaagtgcttagaacttgccgaatacctctacaatatcattaaaaatcgagagggctacgaaatggtgttcgatggcaagccccagcacactaacgtttgtttttggtatatccctccctccctgagaacactggaggataacgaggagcgaatgagtaggctatcgaaggtggccccagtgatcaaggctagaatgatggagtacgggactaccatggttagctaccaacctctaggcgacaaggttaacttctttagaatggttatctcgaatcccgctgccacacatcaagacatcgacttcttgatcgaggagattgagcgcctgggtcaagacctatag

SEQ ID NO: 189277 - DNA, 390 bp, Artificial Sequence
  Description of Artificial Sequence: Synthetic coding sequence
atgaacatcctgctgcagtacgtggtgaagagcttcgaccggagcacaaaggttattgattttcactaccccaatgaactgctgcaggaatataactgggagttagccgaccagccccagaatctggaggaaattctgatgcactgccagaccactcttaagtacgctataaagacagggcacccccgctatttcaaccagctgagcacagggctagatatggtcggcctcgctgcagattggctgactagcacggcaaacacaaacatgtttacatacgagatcgctccagtgttcgtcctgctggagtacgttacacttaagaagatgcgtgaaatcattggatggcctggaggatccggcgatggcatcttctcacccggaacatag

SEQ ID NO: 189278 - DNA, 1758 bp, Artificial Sequence
  Description of Artificial Sequence: Synthetic coding sequence
atggccagccccggcagcggcttctggagcttcggcagcgaggacgggtcgggagatagtgagaatcccggcaccgcccgggcatggtgccaagtcgctcagaagttcaccggtggcattgggaacaagctgtgcgccctgctgtacggagatgcagaaaaaccagcggagtctggcggtagccaacctcctagagcagccgctcgcaaggccgcatgtgcctgcgatcagaagccttgcagctgctctaaggtagacgtgaactacgcattcctccatgcaaccgatctgttaccagcgtgcgatggcgaacgacctactttagcgtttctgcaggatgtcatgaacattctgctgcagtacgtagttaaatcttttgatcgcagcacgaaagtcatcgacttccattacccaaacgagctcttgcaagaatacaattgggagctcgccgatcaaccccagaatttggaggagattctgatgcactgccagacaactttgaaatatgcgatcaagaccggacaccctcgttactttaatcagctgagcacgggtctggatatggtggggctagcagcggactggctcactagcaccgctaacaccaacatgtttacttacgaaatcgcacccgtgtttgtccttctggagtatgtgactttgaaaaagatgagagaaattatcgggtggcccggtggatcgggcgatgggatcttttcacccggcggcgctatttctaatatgtacgccatgatgattgcgcgctttaagatgttccctgaagttaaagagaaagggatggcggcactgccacgcctgatcgcatttactagcgagcacagtcacttttccctaaaaaagggagctgccgctctgggcattgggacagactctgtgatactgataaaatgcgacgagcgtggcaagatgattccatctgacttggaacgacgcatcctggaggcaaaacagaaggggtttgtgccgtttctcgtttctgctaccgcgggcactacggtttacggggccttcgaccctcttttggctgttgccgacatttgcaaaaagtataagatttggatgcacgtcgacgccgcgtggggcggaggcttgctgatgagtcgtaaacacaaatggaaactgagtggggtggagcgtgctaatagtgtgacatggaaccctcacaagatgatgggtgtccctctgcagtgctcagcacttttggtgcgcgaggagggtctgatgcaaaactgcaatcaaatgcatgcctcttacctgttccaacaggataaacactacgatctgtcatatgataccggtgataaagcactccagtgcggcagacatgttgacgtatttaagctgtggttgatgtggcgcgcaaagggtaccaccggcttcgaagctcacgttgacaagtgtttggagttggcagagtatctttataatattataaaaaaccgtgaagggtacgaaatggtgtttgatggaaagcctcagcataccaacgtctgcttctggtacataccccctagcctgaggaccttggaggacaacgaggaacgaatgtccaggttatcaaaagtggcaccagtaattaaagcgcgcatgatggagtatggcaccactatggttagctaccaaccattaggcgacaaagtcaacttttttaggatggtgatctccaaccctgctgccacgcaccaggatatagatttccttatcgaggagatcgagcggctcggccaggatctctag

SEQ ID NO: 189279 - DNA, 567 bp, Artificial Sequence
  Description of Artificial Sequence: Synthetic coding sequence
atggccagccccggcagcggcttctggagcttcggcagcgaggacgggtcaggcgatagtgagaatcccggaactgccagagcgtggtgtcaggtggcgcagaaatttacaggcgggattgggaacaaactgtgtgcccttctgtatggggatgccgagaagcctgctgagagtggaggatcacaaccacctcgcgcagccgcaagaaaggccgcttgcgcatgcgaccagaaaccatgttcctgcagcaaggtggacgttaattatgctttcttgcacgcaacggatctgcttcccgcgtgtgatggggagaggcctactttggcgtttctgcaggacgtaatgaatatcctattgcagtacgtggtgaagtcttttgaccggtcaaccaaggtcattgacttccattaccccaatgaattgctacaagaatacaattgggaactcgcggatcagccccagaacctggaggagattctgatgcactgccagactacgttgaagtatgccattaaaactggcatcgttagcagcaagataatcaagctgttcttccgtctgcagtag

SEQ ID NO: 189280 - DNA, 1677 bp, Artificial Sequence
  Description of Artificial Sequence: Synthetic coding sequence
atgtaccggtacctgggcgaggccctgctgctgagccgggccggccctgctgccctaggatcggccagcgctgacagcgccgccctgcttggatgggctcgggggcagcccgcagctgcacctcagcctgggctcgccctagctgctaggagacactattcagaagcagtcgcagaccgggaagatgaccccaatttctttaaaatggtagagggtttctttgacaggggtgcgtctatagtggaagacaagctggttgaagacttacggactagggaaagcgaggagcagaagaggaacagagtgagaggcatccttcggatcataaaaccatgtaatcacgtgttatcgcttagcttcccaatacggcgcgacgacggttcctgggaggtgatcgagggataccgggctcagcatagccaacacaggaccccctgcaaaggcggtattagatactccacagatgtctccgttgatgaagttaaagccctggccagtctcatgacatataagtgtgcggtggtcgacgtgcctttcggaggagccaaggctggggtgaaaattaacccaaaaaactatactgataatgagctagaaaagataaccaggagatttactatggagctcgcaaaaaaaggattcatagggcctggcattgatgtccccgcccctgacatgtccacgggtgagcgggagatgtcttggatcgccgatacctatgcgtccacaatcggacattacgatatcaatgcccacgcttgtgtgaccggaaagccaatatctcaggggggaatacatggcaggatctccgccacagggcgaggcgtgttccacgggatcgaaaatttcatcaacgaagctagctacatgagtatcctcggcatgacccccggcttcggggataagacgtttgtcgtccagggctttggcaatgtgggcctgcattccatgcggtatctccatcgctttggagctaaatgcatcgccgtcggggagagtgatggctccatatggaatccagatggcatcgatcctaaggagctggaggatttcaaacttcagcacggctcgatcttaggttttcccaaggctaagccatatgaaggctctattctcgaggcagattgcgatatcttaattcccgccgcatccgagaagcagttgaccaagtccaacgcacctcgggtgaaggctaagattatcgccgagggcgctaacggaccgacgacaccagaagcagacaagatcttcctggagagaaatattatggtcatccctgacctttatctcaacgccggaggggtcaccgtaagctactttgagtggctaaagaatctgaaccacgtctcttacggaagactgactttcaagtacgagcgggattccaattatcatctgttaatgagcgttcaggagtccttggagcgcaagtttggcaaacacggcggcacaatcccgatcgttcccacagctgaatttcaggaccgtatcagcggcgcctcagaaaaggacatcgtccactcaggactggcgtacactatggagagaagtgctagacaaattatgcggaccgccatgaagtataatttgggactcgatctccgcacagccgcttatgtgaatgcgatcgagaaagtgtttaaggtgtacaacgaagctggagttactttcacttag

SEQ ID NO: 189281 - DNA, 1548 bp, Artificial Sequence
  Description of Artificial Sequence: Synthetic coding sequence
atgtaccggtacctgggccccggcaccgcccggcggcggcccgccgctggcgctggtattggacgtcccgccccccttcagaggggtgggggaaggccgagagggcgtccacagttgctgcaggacggcggaggactcctccggagtcgtcgccaacaccgcggaggacaggcaggaggaggccctgaggaccctggcgaacggggcgcggaagccgaacctggggcacggcaccccgcagaccaccaggcactgcagccatgtgcagaaagtctgctgccccagcacagccagcatcgcaccccatgtaagggaggaattcgttatagcactgatgtttctgtggatgaagtgaaagctttagctagcctaatgacctacaaatgcgccgtggtggatgttccattcggcggcgctaaggcaggagtcaaaatcaatcctaaaaactacaccgacaatgagctggaaaagatcacccgaagattcactatggagctcgctaaaaaaggatttatagggcctggtatcgacgtacccgcaccggacatgtccacgggggaacgcgagatgtcatggatcgctgatacatacgcaagtacaatcggccattatgatattaacgcccacgcctgcgtcaccggcaagcccatctctcagggaggcatccatggacgtataagcgccaccggccgcggagtctttcatggaatcgagaacttcataaacgaggctagttacatgtccatcttgggaatgacgcccggcttcggggacaagacttttgtggtgcagggattcggcaatgtgggactacatagtatgcgctatctgcaccgattcggagcgaagtgtatcgccgtcggggaaagcgacggaagcatttggaaccctgacggaattgatcccaaggagctcgaggattttaagctccaacacggatccatattgggttttccaaaggctaagccctatgagggtagcatcctggaggccgactgtgacatcttgatccccgctgccagcgaaaagcaactgacaaagtccaatgctccacgggttaaggctaaaataatcgctgagggggccaacggacccaccacacccgaggccgataagatttttctggagcgcaatatcatggtcatccctgacctgtatctcaatgccggcggggtaacagtcagttacttcgagtggctgaagaaccttaatcatgttagctacggacgactgacattcaagtatgagcgagactctaattaccacctgctgatgtcagtgcaagagagtctggagcgcaaattcggcaaacatggagggacgattcctatagtgccgactgctgagtttcaggaccgcatcagtggcgcatctgagaaggacattgtgcattccggcctcgcctacacaatggagcggagtgcccggcagatcatgcgcacagcaatgaaatacaatctcgggcttgacctgagaaccgctgcctacgtgaacgctattgagaaggtctttaaagtctacaatgaggccggggtgaccttcacatag

SEQ ID NO: 189282 - DNA, 1473 bp, Artificial Sequence
  Description of Artificial Sequence: Synthetic coding sequence
atggtggagggcttcttcgaccggggcgccagcatcgtggaggacaaactggtcgaagacttgcgaaccagggagagcgaagaacagaagaggaatcgagtgaggggaatcctgaggatcataaagccatgtaaccacgtcctgtcactaagcttccccatacgccgggacgacggttcatgggaagtcatagagggctatcgggcccagcattctcagcaccgcaccccctgcaaaggtgggattaggtacagtaccgacgtgtccgtcgatgaagtcaaagctctcgctagcctcatgacctacaagtgtgccgtggtagacgtgccttttggaggggccaaggctggcgttaaaattaatcccaagaactatacagataatgaacttgagaagataacccgtaggtttaccatggagttggctaaaaagggattcatcgggcctggaatagatgtgcccgccccagacatgtctactggcgagagagaaatgagttggatcgctgacacatacgctagtaccatcggccattacgatatcaacgcccacgcctgtgtcaccggaaaaccaatatcccaggggggaattcatggtcggatttctgctacaggccggggagtcttccatggcattgagaatttcattaatgaggcaagctatatgagcattctcggtatgacacctggcttcggagacaagaccttcgtggtgcagggatttggcaacgtgggcctccactccatgagatacctccaccggttcggcgctaaatgtatcgccgtgggcgaatcagacggtagcatctggaatccagacggaatcgacccaaaggagcttgaggacttcaaacttcaacacggctccattttggggttccctaaagctaagccttatgagggctcgatactggaggcagactgcgacattttgatcccggccgcaagcgaaaaacagctcactaaatccaacgcaccccgggtgaaggctaagattatagctgagggggccaatgggcccaccacgcccgaggcagataaaattttcctggagcgcaatattatggtgatccccgatctctacctgaacgctgggggcgtgactgtgagctatttcgagtggctgaaaaatctgaaccatgtatcatatggaagacttacgttcaaatacgagcgggattcgaattatcacctcttgatgagtgtccaggaatccctagaacgaaagttcggcaagcacggcgggactatacccatcgtgccgactgccgagttccaggatcgcatatcaggtgccagcgaaaaggatattgtccatagcggcctcgcctatactatggagcggtcagcgcgccagattatgcgtaccgctatgaaatataatttggggctagacctgcgcacggcagcgtacgtgaatgccatcgaaaaagtgtttaaggtctataatgaggcgggagtcacttttacttag

SEQ ID NO: 189283 - DNA, 774 bp, Artificial Sequence
  Description of Artificial Sequence: Synthetic coding sequence
gagaacttcatcgtggagggcttcggcaacgtgggcctgcacagcatgcggtacctacatcggtttggtgccaagtgcattgccgtcggagagtctgatggcagcatctggaatcctgacgggatcgatcctaaagaactcgaggatttcaagctccagcacggatccatactcggattccccaaagcgaagccttacgagggcagtatactggaggcagattgtgatatactcatacccgccgcctctgaaaagcaactgacaaaaagcaacgccccaagagttaaagccaaaatcatcgctgagggagcaaatgggccgacgactcccgaggcagacaaaatcttcctggagagaaacatcatggttatacccgacctgtatctgaacgcgggcggcgtgaccgtgagctacttcgagtggcttaagaacctgaatcacgtgtcatacgggcggttaacctttaaatatgaacgggattcaaactaccacctcctgatgtcagtgcaggaatccctcgaacgtaaattcgggaagcacggaggaactatcccaatcgttcctacggcagaattccaggatcggattagcggagcatccgagaaggatatagtgcacagcggattagcgtacaccatggaacgaagcgcccgccagatcatgaggactgccatgaaatacaacctcggcctggatctgcgcacggcagcttacgttaacgcgatcgagaaggtgttcaaggtgtacaacgaggctggcgtcaccttcacatag

SEQ ID NO: 189284 - DNA, 1176 bp, Artificial Sequence
  Description of Artificial Sequence: Synthetic coding sequence
atgacctacaagtgcgccgtggtggacgtgcccttcggcggcgccaaagcaggagttaagataaatcctaagaactacactgataacgaacttgagaaaatcacacgaagattcactatggagttagcaaagaaaggtttcatcgggcccggcatagacgtccccgctcctgatatgagcacaggtgaaagggagatgtcatggatcgccgatacatacgcaagcacaatcgggcactacgatattaatgctcatgcttgtgtgaccggaaagcccataagccagggtggaattcacggtcggatctctgccaccgggagaggggtcttccatggcattgaaaattttatcaacgaagctagctacatgtccatcttgggaatgacccccgggttcggtgacaagaccttcgtggtacagggcttcggaaacgtggggctgcattctatgagatatctccaccggttcggcgctaaatgcattgccgtgggagaatccgacgggtcgatctggaacccggatggtattgatcccaaggagctagaagattttaagctgcagcatggctcgattctgggattccctaaagccaagccctacgagggttctattctggaggccgattgcgacatcctcatccccgccgcatccgaaaaacagcttactaaaagcaatgctccgcgtgtgaaggcgaaaatcatcgccgagggagcaaacggtccaaccacccccgaggccgataagatatttttggaacgcaatataatggttattcccgatttgtacctcaacgccgggggagtgacggtgtcgtacttcgagtggctcaaaaatttaaatcacgtgtcttacgggagactgaccttcaagtacgaaagggactctaattatcacctgctcatgtctgtccaagagtccttagaaaggaagtttgggaaacacggcggtacaataccgatagtgccaacggccgagtttcaagaccggatctctggtgcatctgaaaaggacatcgtccatagcggattggcatacactatggagcgtagcgctcgccagattatgcgcacagcaatgaagtacaacttgggccttgatctacgaactgctgcatatgtgaacgctatcgaaaaggtcttcaaggtgtataatgaagccggagtcacgtttacatag

SEQ ID NO: 189285 - DNA, 1278 bp, Artificial Sequence
  Description of Artificial Sequence: Synthetic coding sequence
atgacctgcccctgcgacaacgccagcagcgtgttcctgggcttctgtatcaggtattccacagatgtctccgttgacgaggtgaaagcacttgcttctctgatgacgtacaaatgcgctgttgtggacgtaccatttgggggggctaaggccggagtgaaaattaacccgaagaattataccgataatgaactggagaaaatcaccaggcggttcaccatggagctggccaagaagggcttcatcggccccggtatcgacgtgcctgcgcccgatatgagtacgggagaaagagaaatgtcctggatcgcagacacttacgctagtacaattggccattatgatataaacgctcacgcctgtgtgactggcaaacccatcagtcagggtggaatccatggcaggatttccgcaaccggtcgcggagtgtttcacggtatcgagaactttatcaatgaagcctcgtacatgtctattctgggtatgacaccgggtttcggagataaaacattcgttgtccaggggttcggtaacgtgggtctgcattctatgagataccttcatagatttggcgcgaagtgcatcgcagttggagagtcggacggatccatttggaaccctgacggcatcgacccaaaagagctggaggatttcaaactgcagcatggctcgatcctggggttccccaaagccaagccatatgaaggtagcatcctggaggccgactgcgacatcctgatacccgcagcttctgagaagcagttgacaaagagcaacgctcccagagttaaggctaagatcatagccgagggcgccaacgggcctacaactccggaagcagacaagatttttctcgaacgtaacatcatggtaatacccgatttatatttaaatgctggcggagtcactgtgtcatacttcgagtggctgaagaacctgaatcacgtctcatacggccgccttacctttaagtacgaaagggatagcaattaccacttattaatgagcgtacaggaatccttggaacggaagttcgggaagcacggcgggaccatccctattgtccccacagcagagtttcaggataggatttctggtgcttctgaaaaggacatagtgcattccggattagcttacaccatggagagaagtgcccgccaaataatgcgcacggccatgaaatacaacctcgggctggatcttcgaactgcagcttacgtcaatgcaatcgaaaaggtgtttaaggtctataacgaagccggcgttactttcacttag

SEQ ID NO: 189286 - DNA, 1677 bp, Artificial Sequence
  Description of Artificial Sequence: Synthetic coding sequence
atgtaccggtacctggccaaggccctgctgcccagccgggccggcccggccgccctgggttccgccgccaatcatagtgccgctctcctaggccgtggacggggtcaacccgctgctgctagtcaaccaggcctggcgcttgccgctagacggcattattctgagctagtggccgatcgggaggatgaccctaatttctttaaaatggtagaaggcttcttcgatcgaggggccagcattgttgaggacaagcttgtgaaggacctcaggacccaagaatctgaggaacagaaacggaaccgagtgagaggtattttacgcatcatcaaaccatgtaatcacgtgttgtccctttcatttcctatccggcgggatgatggctcctgggaagtgattgagggctatcgggcccaacattcccagcaccggaccccttgtaagggcggaattcgctatagcacagacgtcagcgtggacgaagtcaaggcgttggcctccttaatgacttataaatgtgctgtggtggatgtcccattcggaggggcaaaagcaggggtaaaaataaacccaaagaattatacagaaaacgagttggagaaaataacaaggcggttcaccatggagcttgccaaaaagggcttcatcggcccaggagtcgacgtgcctgccccggatatgaatacgggagaaagggagatgtcttggattgcggatacatatgcttctactatcggacattacgatatcaatgctcacgcctgcgtgacaggcaagcctatttcccaaggcggtattcacggaaggatttctgctacaggacgaggtgtgtttcacgggatcgaaaacttcatcaatgaagccagctacatgagcattctgggcatgacccctggatttagggataaaactttcgtggtacagggcttcggaaatgttggactgcactctatgcgctatctgcataggtttggtgctaaatgcatagccgtcggcgaaagcgatggctctatttggaatcctgatggtatcgatccaaaggagttggaggacttcaaactccaacacggatcgatactgggctttccgaaggctaaaccttatgagggaagcatccttgaagttgattgcgacatcctgataccagctgccaccgagaaacaactcacaaagagtaatgctccccgggttaaagcgaagattatcgcggaaggagcaaatggcccaacaacacctgaggccgacaagattttcctcgagcggaatatcctggttatccccgatctgtatctaaatgctgggggtgtgacagtgagctactttgagtggctcaagaacttaaatcatgtgagctacggacggttaactttcaagtatgagagagatagcaattatcacctgctgctttcagtgcaagagagtttggaacggaagtttggaaagcacggcgggacaatccccatcgtacccaccgccgaattccaagactctatatctggcgcgtcagagaaggacatagttcatagtgcactcgcctacaccatggagcgctcagccagacagattatgcacacagccatgaaatataacctcggccttgacttgagaacagccgcatatgttaatgcgatcgaaaaggtgttcaaggtgtattctgaggccggggtgacctttacctag

SEQ ID NO: 189287 - DNA, 3342 bp, Artificial Sequence
  Description of Artificial Sequence: Synthetic coding sequence
atgatcgccgtgagcttcaagtgccggtgccagatcctgcggcggcttacgaaagacgaatcaccttatactaaatctgcttcacagactaagccaccagacggggctctggccgttcggcgccagagcatccctgaggagtttaaaggtagcacagtggtcgaactgatgaagaaggagggcaccaccctcgggctaaccgtttcgggcggtattgacaaagacggcaagcccagagtgtccaacctccgccagggtgggattgccgcacgcagcgatcaactcgacgtgggggattatatcaaggccgtcaatggaataaatctggccaagttccggcatgacgagataattagcctcctgaaaaatgtgggcgagagagtagttctggaagtggagtacgaacttccccctgtctctgtgcagggcagtagtgttatcttccgcacggttgaagtgactctgcataaggagggcaataccttcggatttgtcattcggggcggagcacatgacgatcgcaacaaatctcggccggtggtcataacctgcgtgaggcccggaggcccagctgaccgagaggggacaatcaagcccggcgatcgcctactgagtgtggacggcattcggctgctgggcactacacatgcagaagcgatgtcaattttgaagcaatgtggacaggaagcagctctactgatcgagtacgatgtgtcagtgatggattctgtcgcgaccgccagcggcccattattggtcgaggttgccaaaacaccaggagctagcctgggcgtggccctgacaacaagcatgtgctgcaataagcaggttatagtcatcgataagatcaaaagtgctagcatcgcagatagatgcggtgccctgcacgtgggcgatcacatcttgagcatcgacggaacctccatggaatattgcaccctggccgaagcaacgcagtttttggccaacactacagaccaggttaagctcgaaattctgccccaccaccagacacggctcgctctgaagggccccgaccacgtaaagatacagcgtagcgatcgacaactgacgtgggacagctgggcctctaatcactcttccttacacacaaatcatcactacaatacataccaccccgatcattgccgggtacccgccctgacattccccaaggcccctccgcctaattctcccccagcactggtgtcctcttccttcagtcccacctcaatgtcggcctattctctgtcttcactcaacatgggcacccttcctcgctctctctacagcacttccccccgagggactatgatgcgtcgccggctgaagaagaaggacttcaaaagctccctgagtttagccagctccacagtcggactggctggccaggttgtgcacaccgaaaccacggaggtggtactcactgccgacccagttacaggatttggcattcaactccagggaagcgtcttcgctaccgaaacactgagctctcccccgcttatcagctatatcgaagcggacagccccgcagagcggtgcggagttttgcaaatcggagaccgggtgatggcaatcaacgggatacccacggaggattctacctttgaagaggctagccaattgctgagggatagttcaattacctctaaagtgaccttagaaatcgagttcgacgtggcagagtcagtaatccctagcagcgggacgtttcatgtcaagttacccaagaaacacaacgttgagctgggcatcactatatcctcacccagcagtaggaaaccaggagatcctttggttatatctgacatcaaaaagggctcggtggctcaccgcacagggacactggagttaggagacaagctgctcgcaatcgacaacattcgattagacaattgttccatggaggatgcagttcagattctacagcaatgcgaagatctggtgaagctcaaaattcgcaaggacgaggacaacagcgacgagcaggagagcagcggtgccatcatctacaccgtggaattaaagaggtatgggggccccctgggcattaccataagcgggaccgaagaaccttttgatccaattattattagttcattgaccaaggggggtttggccgagcgtactggagcaattcatataggagaccgcatcctggctatcaattccagttctctgaaagggaaacccctttcagaagccatacacctgcttcaaatggctggcgaaaccgtcactctgaagataaagaagcagacggacgctcaaagcgcatcttcccccaaaaagtttccgatcagttcccacttatcagatcttggggatgtggaagaagatagttcacccgcccagaagcccggcaagttgtccgacatgtatccaagtaccgtgccctcagtcgacagtgctgtggatagctgggacggttctgccattgatacgtcttacggcacacagggcaccagctttcaggccagcggttacaatttcaatacctatgattggcgtagccctaaacagcggggatctctatctccagtcacaaaaccacgctctcagacataccctgacgtaggtctgagctatgaagactgggatcggtctaccgctagcggatttgcaggtgccgcagatagtgcagaaaccgagcaggaagagaacttctggtcgcaggcgctggaagacctggagacatgtgggcagagtgggatcctgcgggaactggaagctaccataatgagcgggtcaacgatgagtctgaaccatgaggctcctacgcctagatctcagctggggaggcaggccagcttccaggagcgatcatctagtaggccgcattactctcagaccaccaggtctaataccctacctagcgacgtgggtagaaagagcgtgacgctccggaaaatgaagcaagaaataaaagaaatcatgtcacctacacccgttgagctccacaaagtgacactctacaaggactcagatatggaggactttgggttttccgtcgccgacggacttttggaaaagggcgtgtacgtcaaaaacatccgccccgcgggccccggggatctgggtggactaaaaccatacgaccggctcttgcaggtcaatcatgtgagaacccgagactttgactgttgtctggttgtgcccctgatcgccgagtctgggaacaaactagacctggtgatctctagaaatccccttgcatcccagaagagtattgaccagcagtctctccctggggactggtctgagcagaacagcgcttttttccagcaaccttctcacgggggcaacctagaaacccgggagcccaccaacaccctgtag

SEQ ID NO: 189288 - DNA, 3387 bp, Artificial Sequence
  Description of Artificial Sequence: Synthetic coding sequence
atgatcgccgtgagcttcaagtgccggtgccagatcctgcggcggctgactaaggatgagtcaccatacactaaatccgctagccagacgaagccacctgacggagccctcgccgttcgtaggcaaagcatccccgaagagttcaaaggctctacagttgtggaactgatgaaaaaggagggcaccactctgggcctaacagtgtccgggggaatcgacaaggacggcaagcctcgggtgagtaaccttagacaaggtggtatcgcggcgcggtcagaccaattggacgtgggagattacataaaggcagtaaacggaatcaatctggccaaattccgacatgacgagatcatctccctgttgaaaaatgtcggggagagagtggtcctggaggtcgagtacgaactgccacccgtgtccgtgcaaggaagctcagtcatatttagaaccgttgaggtgacccttcacaaggagggaaacacattcggctttgttatcagaggaggggcccacgacgataggaataaatcaagacccgtcgttatcacatgcgtgaggcctggcggcccagctgacagggagggtactattaagccgggagataggcttctgagtgttgatggaattaggcttcttggaacaacccatgctgaagccatgagcatcctgaagcagtgcgggcaggaggcggctctactgatagagtatgatgtgagtgtaatggatagtgtggcaacggccagcggtcccctgctggtcgaggtggcaaagactccaggggcatccctgggggttgccctgacaacctccatgtgctgcaacaagcaggtgatcgtgatagacaagattaagagtgcttctattgccgataggtgcggtgctctgcatgtgggagaccacattctctccatcgatgggacatcaatggagtactgtaccttggcagaggctactcaatttctggcaaacaccacagaccaggtgaagctagaaattctgccacaccatcagacaaggctcgcccttaaaggaccagaccatgtgaaaatccagaggagtgataggcagctcacatgggactcatgggcctccaaccacagcagccttcatactaatcaccactacaacacgtaccatcctgatcattgtcgagtgcccgccctgacatttccgaaagcccccccccccaacagtcctccagcgctggtttcgtcctctttttcacccacatctatgtcagcttatagtctgtcgtccctgaacatgggtactttaccacgcagtctgtattctacttcacctcgcggaaccatgatgcgccggcgactcaaaaagaaggacttcaaatcgagcctttctctcgcttcctctaccgtagggctagctggacaggtggtgcatacagagaccactgaggtcgtgttgaccgcagatcccgtaacagggttcggcatccagcttcagggatcggtctttgcgacggaaacactcagctctcctcctttaatatcctatatcgaagctgatagccctgccgagcgttgcggagtccttcagattggtgatagagttatggccatcaatggaatccctaccgaagattctacctttgaggaagccagccagctcctgcgggatagtagcatcacctcaaaggtgacactggaaattgagttcgatgtggccgaaagcgtaatcccctctagcggcacgtttcacgtcaaacttcccaagaagcacaatgtagagctcggaatcactatctccagtccatcatccagaaagcctggcgatccccttgtgatctcagacatcaaaaaggggtcggtggcccatcggaccggaactctggagctcggggataagttgctggctatagacaatatccgtcttgataactgctccatggaagatgctgtgcaaatcctccagcaatgtgaggacctcgtaaaacttaaaatcagaaaggatgaggataatagtgatgagcaagagagctccggtgccattatctacaccgtcgagctgaagaggtacggcggccctttgggcatcactatcagcggaaccgaggagccattcgaccctattatcatatccagcctcactaaaggcggcctggctgaaagaacgggagctatccacataggggaccgaatcctggctataaactcatcgtcactcaagggcaaacccctgagcgaggccattcatctgctgcagatggcaggggaaacagtgactttgaagatcaaaaaacagaccgatgcacagtctgccagctctccaaaaaaatttcccatctcttcacacctgtccgatctgggagacgtagaagaagacagctcaccagcccaaaaacccggcaagctcagcgatatgtacccaagcaccgttcccagtgtggatagtgcagtagatagctgggacgggtccgcaatcgacactagttatgggacacagggtacttctttccaggcctcggggtataatttcaacacctacgattggagatcaccaaagcagagaggctcactcagccctgtaaccaaacctcgatcccagacttatcccgacgtgggacttagctatgaagactgggaccggtctaccgcatccgggtttgcaggcgctgccgactcagccgagacagaacaggaggagaacttctggtcccaggctcttgaggacttggagacttgcgggcagagtggcatcctgcgggagctcgaggagaaggctgatagacgggtcagtctgaggaacatgacccttctagccacaattatgagcggatcaaccatgtcgctgaatcacgaagcccctacgccgcgctcacagttgggacgccaggctagcttccaggagagaagtagctctaggccccattactcgcagaccacccgatccaatacactgcctagcgatgtgggccggaaatctgtaacactgcggaagatgaagcaggaaattaaggagattatgagtcccacgcctgtcgagctccataaagtgaccctgtacaaagactctgacatggaggactttggtttcagtgtcgccgacgggctcctggagaaaggggtctatgttaagaacattaggccggcaggtcctggtgacctgggcggactcaagccctacgaccgactccttcaggtaaaccatgtacgtacccgggacttcgattgctgtctggtcgttcccctcatcgctgagagtggaaacaagctagaccttgtgatttcaagaaacccactagcaagccagaaatctattgaccagcagagcctacccggcgattggtctgagcaaaactccgccttctttcaacaaccgtcccatgggggcaacttagaaacaagagagccaaccaataccctgtag

SEQ ID NO: 189289 - DNA, 3231 bp, Artificial Sequence
  Description of Artificial Sequence: Synthetic coding sequence
atgatcgccgtgagcttcaagtgccggtgccagatcctgcggcggcttactaaagatgaatccccgtacaccaagtccgcgtctcaaaccaaaccccctgatggtgctctggcggtccgtcggcagagcatccctgaggagtttaagggaagcactgtggttgagctgatgaaaaaggagggaacgactctcggactgactgtctctggtggcatcgataaggatggcaagcctcgtgtgtccaatctgcgccagggaggcatcgcggctcgtagtgatcagctggacgtgggagactacataaaggcagttaatgggatcaacctcgcaaagttccgccatgacgagataattagcttactcaagaacgttggcgaacgggtcgtgctggaggtggaatacgagttgcctccagtgtccgtgcaagggtcaagcgtaatatttcggaccgtggaagtgactctgcataaggagggcaacacatttgggttcgtcatcagaggcggtgcccacgatgatagaaataagtctagacctgtggtgattacttgtgtccgacctggaggtccggccgaccgcgagggcacaattaaaccaggcgacagacttttgtccgttgacgggattagacttctggggactactcatgctgaggctatgagcatcctcaagcagtgcggccaggaagcggctctgttaatcgaatacgatgtgtccgtgatggacagcgttgcgacagcctctgggcctttacttgttgaggtggctaagacccctggcgcctcactgggggtcgcactcactacgagtatgtgttgtaataagcaggtcatcgtgatcgataagattaaaagcgccagcatagctgacaggtgcggagcgctgcacgtgggggaccacatcctctctatcgatggaacttccatggaatactgcactctagccgaggctacccagtttcttgccaacaccactgaccaagttaagctggagattctgccccaccatcagacacgactggctctcaaggggccggatcacgcagcattggttagttctagctttagcccgacctccatgagcgcatattccctgtcttctctgaacatggggacgctgcctcgcagcttgtactcaacttcccccaggggaacaatgatgaggcggcgccttaagaagaaggactttaagtcaagtctgtccctcgcgtctagcaccgtggggctggcgggccaggtggtacataccgagacgacggaggtggttttgaccgcagatccagtgactggatttggcatccagttgcaaggcagcgtgttcgccactgaaacactttcttcgcctcccttgatctcgtatatcgaagctgatagccctgcagaacgctgcggcgtcctacagattggcgacagggtgatggcaattaatggcatccccactgaagacagcaccttcgaagaagcctctcaactcctgagagactcttctattacatctaaagttactctcgagatcgagttcgatgtggccgaaagtgtgattccctccagtggtacgtttcatgtgaaactgcctaagaagcacaatgtcgaactgggaataacaattagttctccatccagcaggaagcctggggatcccctggtgatatccgatatcaagaaaggatcagtggctcaccgcaccggtacgctggaactgggagacaagctgctggcgatcgataatatcaggcttgataactgctccatggaggatgcagttcaaatcctgcagcagtgcgaggaccttgtgaaattaaagatacgaaaagacgaggacaattctgatgagcaggagtccagcggggcaatcatctacaccgtggaacttaagcgatatggtgggccgctaggaatcaccatctccggaacagaggagcccttcgatcccataattatctcatcgctgactaagggtgggcttgcagagaggacaggagcgattcacatcggggatcgaatcctagccatcaattcctctagtcttaaggggaagccgctcagtgaggctatacacctgctgcagatggccggcgagacagtgactctaaagataaagaagcagaccgacgcccagagcgcctcatccccaaaaaaatttcccatctcttctcacctaagcgacctgggagatgtggaagaggattcctctcctgcacagaagcctgggaagctttcggatatgtatcctagcacagtccctagcgtggatagcgccgtggacagttgggacggcagcgcaatcgataccagttacggtactcaggggaccagcttccaagcttctggatacaattttaatacgtatgactggcgctctcctaaacagaggggatcactgtccccagtaaccaaacctaggagccaaacttatccggatgttggcctttcctatgaagactgggacagatctactgcctccggatttgcaggggctgcggactccgctgagacagaacaggaggagaatttttggagtcaggccctcgaagacctcgagacgtgcgggcagagcgggatattgcgggaacttgaggaaaaagccgatagacgggtttcactgagaaatatgacactgcttgccacaatcatgtccggtagcactatgtccctgaaccatgaagcacctaccccgcggtcccagctgggccggcaggctagctttcaggaaaggagttcttccaggcctcactattcccagaccacaagatcgaatactctacctagcgatgtggggcggaagtccgtgaccctgcgaaagatgaagcaagagatcaaagaaattatgagtccaacccccgttgaactacataaggttaccctgtataaagattctgatatggaggactttggatttagcgtggccgatgggctgctggaaaagggcgtctacgtaaagaacataagacctgctggccctggtgacctgggaggactgaagccatatgatagactcctgcaggtcaatcatgtgagaactcgcgacttcgattgttgcctggtcgttccgctgatcgctgaatctggtaacaaactggatctcgtcatatccagaaacccactagcatcgcagaaatcaatcgaccagcagtccctcccaggcgactggtctgaacagaatagtgctttctttcagcagcctagccatggcgggaatctcgagacaagggagccaactaacaccttgtag

SEQ ID NO: 189290 - DNA, 2511 bp, Artificial Sequence
  Description of Artificial Sequence: Synthetic coding sequence
atggtgcagttcagcaccagcgagttccggctgaccccccacatcgataatctggaggttgctaatagtttcgccgttactaacgcattttgcagtcaattctctcgtggcgtgtatgccatattcggcttctatgacaagaagtctgtcaatactataacgtccttctgtggaacactccacgtttcatttatcactccgtcctttccgactgacggcacccacccattcgtcatacaaatgcgcccagatcttaaaggggccctcttatctcttattgagtattaccagtgggataagttcgcctacctatatgattccgacaggggtttgtccacgttgcaggctgtgttggacagcgcagcggaaaaaaagtggcaagtcacagcaatcaatgtaggcaacatcaataatgataaaaaggatgaaatgtatagaagtctgtttcaggacttggagctgaagaaggagcgccgcgtgatcctggactgtgaaagggataaagtcaacgacatcgtggatcaagtcatcaccatagggaaacacgtcaagggttaccattatatcattgccaacctggggtttaccgatggtgaccttctgaagatacaattcggcggtgccaacgtgtccggcttccagattgtcgactatgatgacagcttggtatccaaattcatcgagcgctggagcaccttggaggagaaagagtaccctggagcacacacaacgactattaaatacaccagcgccttgacatacgacgctgttcaggtcatgacagaggccttcaggaatctccgcaagcaacggatcgaaatatctcggagaggtaatgctggggactgcctggctaatcctgccgttccctggggccagggcgtagaaatcgaacgggcactgaagcaggtgcaagtcgagggactgagtggaaacatcaagtttgaccagaatggcaagcgaattaattataccattaatatcatggagttgaaaaccaacggacccaggaaaatcggctattggtcggaagtagacaaaatggtagtgacactcaccgagcttccctctgggaacgatacatctggactcgaaaacaaaactgtagtggtcaccactattttggagtcaccctacgtaatgatgaagaagaaccacgaaatgctggaggggaacgaacgctatgaaggttactgtgtcgatttggctgcagaaattgcaaagcactgtggattcaagtataagctaactattgtgggtgacggcaagtacggcgcaagagatgcggataccaagatctggaatggtatggtgggcgaactggtgtacgggaaggcagatatagccatagccccactgacgatcactctggtgcgggaggaagtcattgacttctcaaagcccttcatgagtctggggatttcaatcatgattaaaaaaccccagaagtctaagcccggcgtgttttctttcctagacccactggcctacgaaatctggatgtgcatcgtgtttgcctacattggcgtgagtgtggtgctgtttcttgtttcaagattttcaccctacgagtggcacaccgaagaattcgaagacggacgggaaacccagtcctctgagagcacaaacgaattcggcatcttcaattctctgtggttctccctaggcgcttttatgcagcaggggtgcgatatctcccctcgtagcctttctggtaggattgttggtggagtctggtggttctttacattgatcatcatttcatcttatactgcgaatttagcggcctttcttaccgtcgaacggatggtgagtcctatcgaaagcgccgaggatttaagcaagcagaccgagatcgcttatggtacgttggattccggttccacaaaggagttcttccgccgttccaaaatagcagtgttcgacaaaatgtggacttatatgcggtccgccgaaccgagcgtatttgtgcgcacaaccgccgaaggagttgccagagtcaggaaaagcaaaggcaagtatgcttacctgctcgagtcgacaatgaatgagtatatagagcaaaggaaaccatgtgacactatgaaagttggtggcaacctagattcaaaggggtatggcattgcaacgcctaaaggttcttccttgaggacacccgtgaatttggctgttctgaaactgtccgagcaaggagtactcgataaattgaaaaataaatggtggtacgataaaggagaatgcggtgccaaagactccggctctaaagagaagactagcgcactgtcgctgtccaatgtcgccggagttttctatatactagtgggaggattaggcctggctatgctcgttgcgttgattgaattttgttacaaatcacgcgcggaggcgaagagaatgaaagttgccaagaacgcccagaatatcaacccaagcagcagccaaaacagccagaactttgctacctacaaagaaggttacaatgtgtatggcatcgaatctgtcaagatctag

SEQ ID NO: 189291 - DNA, 2706 bp, Artificial Sequence
  Description of Artificial Sequence: Synthetic coding sequence
atgagcaccatgcggctgctgaccctggccctgctgttcagctgctctgttgcaagggccgcgtgtgatccaaagatagttaacattggtgccgtgttgtccactaggaaacacgagcaaatgttccgagaagcagtgaatcaggccaataagaggcacgggtcctggaagatccaactgaacgcaactagcgtgacgcacaagccaaacgcaattcagatggcactgagcgtgtgtgaagatctcatcagtagtcaggtctacgcaatcctcgttagtcatcctcctactcctaacgaccacttcacacccacaccagttagctataccgctggcttttacaggatccctgtactgggactcactacaaggatgtcaatttactccgacaagagtatccacctcagctttctgcggacagtgcccccatattcacatcaatcgagcgtatggttcgaaatgatgagagtttattcttggaaccacattatcctgctcgttagtgacgatcacgagggtcgggccgcgcagaaaaggcttgagaccctgcttgaagagagggagtcaaaagccgaaaaggtcctccagttcgaccccggaactaaaaatgtcaccgcactcctcatggaagccaaagagctcgaggcaagggttattatcctctccgctagcgaagacgatgccgccaccgtgtaccgagctgcggcaatgctgaatatgacagggtctgggtatgtgtggctggtcggagagcgggagatttccggaaatgcacttaggtacgccccggacggtattctcgggcttcagctgataaatgggaaaaacgagtccgcccacatttcagacgctgtcggtgtagttgcccaggcggttcacgagctcctggaaaaggagaacatcaccgaccctccccggggctgcgttggaaatacaaatatctggaagacagggcctctattcaaaagagtcttaatgtcctccaagtatgcagatggggtcacaggacgggttgagtttaacgaagatggagacaggaaattcgctaactactctattatgaacctgcaaaatcgtaagctggtgcaggtgggtatctacaacggtactcacgttattccaaacgataggaagattatttggccaggaggcgaaaccgagaaaccgagaggttatcagatgtctaccaggctgaaaatagtcacaattcatcaggaaccatttgtctacgtcaagcccaccctgtctgacggaacatgcaaggaagaatttacagtgaacggcgaccctgtcaaaaaggtgatatgtactggacctaacgacacatcaccaggtagccccaggcataccgtgccacagtgttgttacgggttctgtatcgacctgctgattaaactggcaaggaccatgaattttacttatgaggttcaccttgtggccgacggaaaattcggcacgcaagagcgcgtgaacaacagcaataagaaagagtggaacggcatgatgggagaactgctgtctggccaggcagacatgatcgtggccccactgaccatcaataatgagagggcccagtacatcgagttttcaaagccttttaagtaccagggactcactatcctggtcaaaaaggagatcccacggtccaccctcgattcctttatgcaaccctttcaatccacgttgtggctgctcgttggattgtccgtgcatgttgtagccgtaatgctgtacctattggaccggtttagtcccttcggtagattcaaggtgaattcagaagaagaggaagaggatgctctgacgcttagtagcgccatgtggttctcctggggggtcctgttgaattcgggtatcggtgaaggcgcccctcggagcttctccgctcggatactaggaatggtgtgggccgggtttgccatgatcattgtggcctcctacaccgcaaacttggcagccttcctcgtgctggataggcccgaggaacgcatcactggtatcaatgacccacgactgagaaacccctcagataagttcatatacgccacggttaagcagtctagcgtggacatttattttcggaggcaagtcgagcttagcacaatgtatagacatatggagaaacacaactacgagtcagctgctgaggcgatccaggcagtccgagataataagttgcacgcttttatatgggattcggccgtgctagagttcgaagcatctcagaaatgcgatctcgtcacgaccggtgaactattttttagatctggctttggcattggcatgaggaaggactcaccctggaaacaaaatgtgagtctgtcgatccttaaatcccacgaaaacgggttcatggaagacctggacaagacatgggtgcgctatcaggaatgtgactcccgcagtaatgctccagccacgttaacatttgagaacatggctggcgtgttcatgctcgtagccggtggcattgttgccggcatatttctcatcttcattgagattgcatataaaaggcataaagatgctcgcagaaaacaaatgcaactggcctttgctgccgttaacgtgtggaggaagaacctccagtccaccggcggtgggagaggggccctgcaaaaccagaaagacacggtgctcccacgccgtgctatcgagcgagaagagggtcaactgcaactttgctcccggcacagggaaagttag

SEQ ID NO: 189292 - DNA, 2658 bp, Artificial Sequence
  Description of Artificial Sequence: Synthetic coding sequence
atgagcaccatgcggctgctgaccctggccctgctgttcagctgcagcgttgcccgggcggcctgcgaccccaaaatagtgaacattggagctgtacttagcactagaaaacacgagcagatgtttcgcgaagccgtcaaccaggcaaacaagcgccacggctcctggaaaattcaactgaacgccaccagtgtgacacataagcccaatgcaattcagatggcactgtcggtgtgcgaagatttgatctcttctcaagtttacgccatcctggtatcccatccacccacacccaacgatcactttactcccacccctgtgtcttacacagccggtttttataggatccctgttcttggattgaccacccgcatgtctatttacagtgataaatcaatacatctgagcttcctacgcacggtgccaccgtactcacaccagtcttccgtctggttcgaaatgatgagggtgtattcctggaatcatatcatcttgttggtgtccgacgaccacgaaggtagagccgctcagaagcgcctcgagactttgctcgaggaacgggagtctaaggccgagaaagttttgcagttcgaccctgggaccaagaacgtgaccgcgctgttgatggaggcgaaagaacttgaagctagggtcataattctgtctgctagtgaagacgacgcagcaacggtttacagagcggctgccatgctgaacatgactgggtctggctacgtatggctagtgggtgagcgcgaaatttctggaaatgctctgagatacgctcccgacggcattctgggtttgcagttgattaacggaaaaaatgaaagcgcccacatcagcgacgccgtgggagtggtggcccaagcagtgcatgaactgctcgaaaaagagaatatcacagatcctcctcgcggttgcgtgggaaacaccaatatctggaaaactggtccgctgtttaaacgggtgctgatgagcagtaaatacgctgacggagtgaccggacgtgtggagttcaacgaggacggagaccggaagttcgctaactacagcatcatgaatcttcagaacaggaaacttgttcaagtgggcatctataatggaacccatgttatcccgaacgatagaaaaattatctggccgggaggcgaaaccgaaaagccgcgggggtaccagatgagcactagactgaaaatcgttacgatccatcaggaaccctttgtgtatgtcaagccgaccctcagtgatggcacctgtaaggaggagtttacagttaacggagaccccgtgaagaaagtgatctgtacagggccgaacgatacaagccccgggagccctcgccacaccgtcccccagtgctgctatggcttttgcatagacttactgattaagttagcccggacaatgaattttacctatgaggtgcatttggtcgcagacggaaagttcggcacgcaggaacgggtaaacaacagcaacaagaaggagtggaatggcatgatgggtgagcttctgtccggtcaggccgatatgattgttgctccattgacgattaacaacgaacgagcccagtacatagagtttagcaaaccctttaaatatcagggcctgactatcttggtgaagaaggagatccctcgttctacccttgacagttttatgcagccttttcaatccacattatggcttctcgtcggtctctcggtgcacgtcgtcgccgttatgctctatctgctcgacaggtttagcccctttgggagattcaaggtcaatagcgaagaagaggaagaagacgcgctgaccctgagctccgcaatgtggtttagttggggcgtgctgctaaatagtgggatcggcgaaggcgcccctagaagcttctctgctaggatccttggcatggtctgggcgggattcgccatgattattgtggcttcttacaccgcgaatctggcagctttcctggtgctcgatcgaccagaggagagaataacaggcattaatgaccctcgccttcgcaaccctagcgataagttcatctacgcaactgtgaagcagagcagcgtggatatttatttccggagacaggtcgagctcagcaccatgtatcgccatatggaaaaacacaattatgagtcggccgctgaggcaatccaggctgtgagggacaataaattgcatgcgtttatctgggattctgcggttctcgagttcgaagcatcacaaaagtgcgatctcgtgaccactggcgagctgttctttcggtccggcttcgggatcgggatgcggaaagactctccttggaagcagaacgtttctctgtcgatcctgaagtcacacgaaaacggctttatggaagacctggacaaaacttgggtgcgatatcaagagtgcgacagcagatcaaacgcacccgccactcttacattcgagaatatggccggcgtctttatgcttgtcgctggcggaattgtagcaggaatattccttatctttatcgagattgcgtacaaacgacacaaagatgctcggaggaagcaaatgcagctcgcatttgcagctgtaaacgtctggagaaagaatctgcaacagtaccatcccactgatattacgggacctctgaatttgagtgaccctagtgtttccacagttgtgtag

SEQ ID NO: 189293 - DNA, 2769 bp, Artificial Sequence
  Description of Artificial Sequence: Synthetic coding sequence
atggtgcagctgcggaagctgctgcgggtgctgaccctgatgaagttcccatgctgcgtactcgaagtactcctgtgcgcgctggccgctgccgcccggggccaggagatgtacgccccacacagcatccgcatcgagggcgacgttactcttgggggcctcttccctgtgcatgcaaagggcccatctggggtgccatgcggggacatcaagagggagaacgggattcacagactcgaggccatgctctacgctctcgaccagatcaactcagaccctaacctcctccctaacgttacactgggagctagaatactggacacctgtagccgggatacctatgctctggagcagtcactgaccttcgtccaggcattaattcagaaagatacctctgatgttaggtgcacaaacggggagcctcccgtgttcgtaaagccagaaaaggtcgtgggggtgatcggagcatctggttcatcagtgagtatcatggtcgccaatattctccggttgtttcagattccgcagatctcctacgcttctaccgcacctgagctcagtgacgatcgccggtacgatttcttcagccgtgtggtgccccccgattctttccaagcacaggcaatggtggatattgtgaaagccctggggtggaactacgttagtactcttgcctccgagggctcgtatggggaaaaaggcgtggaaagtttcactcaaatttccaaagaagcggggggcctgtgcatcgctcaatccgtgcgcatacctcaggaacggaaagaccgcactatagactttgacagaatcatcaaacagttattggacaccccgaattcaagggccgtggtcattttcgccaatgacgaggacattaagcagattctggccgctgctaagagggcagaccaagtgggacactttttgtgggtagggtcagacagctggggatctaagattaatcctttgcaccagcacgaggacatcgccgagggcgcaataaccattcagccgaaacgtgcgactgtggaagggtttgacgcatatttcacgtcaaggaccctggagaacaatcggcgtaatgtttggtttgccgaatactgggaagagaattttaactgcaaacttactatcagcggctccaagaaggaagatacagacagaaagtgtacgggtcaagagcggatcggcaaggacagtaattacgagcaggagggtaaagtccagttcgtgatcgacgctgtgtacgccatggcacatgcgctgcatcatatgaacaaagacctttgtgcagattaccggggagtgtgtccggagatggaacaagcaggcggtaagaaactgctgaagtatatcaggaacgtcaactttaatgggtccgccggtacacccgttatgttcaacaagaatggggacgcaccaggtcggtatgacattttccagtaccagaccacgaatacctctaatccggggtaccgcctgatcgggcagtggaccgatgagcttcaattaaacattgaagacatgcaatgggggaagggagtccgggagattccagcatcagtgtgtacactgccttgtaagccaggccagcgcaagaagacccaaaaagggaccccatgttgctggacttgcgaaccatgtgatgggtaccagtaccagttcgatgagatgacctgccaacattgtccctatgatcagaggccaaacgaaaaccgaacagggtgtcaggatatccccatcatcaagctagaatggcacagcccctgggccgttattccggtgttcctggccatgctcggaattattgctaccatcttcgtgatggccacatttataagatataacgacacacctatagtgagggcctctggtagagagttgtcatacgtgctgctgactggaatttttttatgctatattattaccttcctaatgattgctaagccagacgtggcggtgtgttctttccggcgcgtcttccttgggctggggatgtgtatatcatatgccgctctcctgacaaaaactaaccggatctacaggatatttgaacaaggaaagaagtcggtcacggctccaagactcatcagtcccacctcccagcttgctataaccagctcattaatttcagtgcagctgttaggcgtcttcatctggttcggtgtggatccccccaacattatcatcgactatgacgagcataagaccatgaatcctgagcaggctcgcggagttctcaaatgtgatatcaccgacctgcaaatcatctgttcgcttggctactctattctactgatggtcacctgcaccgtgtacgccataaaaaccaggggagtgcctgaaaatttcaatgaggcaaagccaatcggtttcaccatgtacacaacatgcattgtgtggcttgcattcattccgatcttttttggtaccgctcagtccgcggagaaactgtatatccagacgacaaccctcaccatctcaatgaacctctccgcgtctgtggctctcggaatgttgtatatgccgaaagtctatatcattatcttccacccagagctcaatgtccagaaacgcaagagatcattcaaggccgtcgttacagctgctaccatgagcagcaggctgtctcataaaccgtcagaccgtcctaacggcgaggccaagactgaactctgcgagaacgttgacccaaacaattgtattccacccgtgaggaagtctgttcaaaaatccgttacctggtataccatcccccccacagtctag

SEQ ID NO: 189294 - DNA, 2685 bp, Artificial Sequence
  Description of Artificial Sequence: Synthetic coding sequence
atggcccggcagaagaagatgggccagagcgtgctgcgggccgtgttttttctggttctgggactgctaggccacagtcacggtggtttcccaaacacgatctcaattggaggcctttttatgaggaacaccgtacaggagcactctgcattcaggtttgcagtgcagctttacaatactaatcagaatactacggagaagcccttccatcttaattaccacgtggatcacctggattctagtaactcctttagcgttactaacgcattctgttctcagttctcccgaggagtatacgccatattcggtttttatgatcagatgtccatgaatacccttaccagcttctgcggggcactgcacacctcttttgtgacacctagcttcccaaccgatgcggacgtccagttcgtcatccagatgagacccgccctgaagggagcaatcctgtccctgctcggacactataagtgggaaaagtttgtgtatctgtatgataccgagcgaggtttttcaatactgcaggcaattatggaggccgcagttcagaacaactggcaggtaactgcgaggagtgtgggaaacatcaaagacgtgcaagagtttaggaggattatcgaggaaatggaccgtcggcaggagaagcgctatctgattgattgtgaagtggagagaatcaacaccatcctggagcaagtcgtaattctggggaagcactctcggggctatcattacatgttagccaacctgggcttcacagacattctcttggaacgtgttatgcatgggggagcgaatatcactggatttcagatcgtcaacaatgaaaatcccatggtgcagcagttcatccagaggtgggtgcgacttgacgaacgcgaattcccagaggccaaaaacgcacccttaaaatacacttccgcactcactcatgacgccatcctcgtgattgcggaggcatttagatacctgcgcaggcagcgagttgatgtgagcaggagggggagcgccggagactgcctggccaaccctgccgttccctggtctcagggtattgacatcgagagagctctgaagatggtgcaggtacagggaatgacaggcaacatccagttcgacacatacggacgcaggaccaactataccattgatgtgtatgagatgaaggtcagtggctcgcgtaaagcggggtactggaatgagtacgagcgatttgtgccattcagcgaccaacaaataagcaacgattctgcctcgtcagaaaatcgcacaatagtggttacgacaattcttgaatccccctacgtcatgtataaaaaaaaccacgagcagctggaggggaacgaacgctatgagggttactgtgttgacttagcatatgagatcgccaagcatgtgcggatcaaatacaaattatctatcgtgggcgatggtaagtacggcgctcgcgacccggaaaccaagatttggaacggaatggtgggcgaattggtctacggcagagcagatatagccgtggccccactgacgattactctggtcagggaggaagtgatcgattttagtaagccattcatgtcactgggcatcagtataatgataaaaaagcctcaaaagagcaagcctggggtcttttctttcctggacccactggcttatgagatatggatgtgcattgtctttgcgtacatcggcgtgagcgttgtgctgtttctggtttctcggttcagcccgtatgagtggcacctggaggataataacgaagagcctcgtgacccccaatcgccccccgatcctcccaacgagtttggcatcttcaattccttgtggttcagccttggggccttcatgcagcagggatgcgatatctccccccggagcctcagcggccgaatcgtaggaggcgtgtggtggttcttcacgttgatcatcatatccagctataccgcaaatctagcagcgtttttaacagttgagcggatggtgagccctatcgagagcgccgaggatctggctaagcaaaccgaaattgcatacgggactctggactccgggagtacgaaggagttttttcgacggtcaaagattgcagtctatgagaagatgtggtcctatatgaagtccgcggaaccgagcgttttcacgaagacaactgcagatggcgtggcgcgtgtgcgcaaatcaaaaggtaagtttgcatttcttctcgagagtacgatgaatgaatacatcgaacagcgtaaaccctgcgataccatgaaggtcggaggaaatctggacagtaaggggtacggtgtagccacccctaaaggctcagctctgcgtaatgccgtgaatctcgcagtactgaagctgaatgagcagggtcttctggacaagctgaagaataaatggtggtacgacaagggagagtgtggctccggtggcggcgacagtaaggataagaccagtgccctctcactgtcgaacgtggctggcgtattttacatcctggttggcggcctgggcctcgccatgatggtggctttgatcgagttttgctacaagtccagggctgagtctaaaagaatgaagcttactaagaacactcaaaactttaaacctgctccagctactaacacacagaactacgcaacgtaccgagaaggctacaatgtgtacggcacggagtccgttaaaatttag

SEQ ID NO: 189295 - DNA, 432 bp, Artificial Sequence
  Description of Artificial Sequence: Synthetic coding sequence
atggcccggcagaagaagatgggccagagcgtgctgcgggccgtgttctttcttgttctcggcttgctgggccacagtcatgggggctttcccaatacaatttctattggggggctattcatgcggaacactgtgcaagaacatagtgcttttcggttcgcagtccaattgtacaataccaatcaaaacacaaccgagaaacccttccacctgaactaccacgtagaccacttggacagctcaaattcattctccgtgacgaacgcctgccctgccgagagagattatctaccctggcctggttccattagagaaaacaactggactgcacttccgtgctgtaaggaccacggcctccttcaccttaaatgcagccccggagggcggcagaactgggcgtattgtatctggggggttacaggagagctctag

SEQ ID NO: 189296 - DNA, 2685 bp, Artificial Sequence
  Description of Artificial Sequence: Synthetic coding sequence
atggcccggcagaagaagatgggccagagcgtgctgcgggccgtgttctttctggtactagggttgctgggacattcccacggtggcttcccgaacacgatctcgatcggtggcctcttcatgagaaacactgtgcaggaacacagcgcctttcggttcgccgtgcagctctataacaccaatcagaacaccactgagaaaccttttcatctgaactatcacgtagatcatttggattcttctaacagcttctcagtgactaacgctttctgtagccaattttccaggggggtgtacgctatcttcggcttctacgaccagatgtccatgaataccctaacaagcttctgtggcgcgctgcacacgtcgttcgtgaccccgagctttccaactgatgccgatgttcaatttgtgatacagatgcggccagccctgaaaggcgctattctgagtctcctgggccactacaagtgggagaaatttgtttatctctatgacacagaacgtggcttcagtattctgcaggccatcatggaagccgcagtacagaacaattggcaggtgacagcccgcagtgtcgggaatattaaagatgtgcaggaattccgccgtattattgaagagatggaccggagacaggagaagcgctacctcattgactgcgaagtggaacgaatcaacaccatactggagcaagtggtaattttaggcaagcacagccggggttaccactatatgttagctaatcttggtttcactgacatcctcttggaacgcgtgatgcacggcggcgccaatattactgggtttcagattgtgaataatgagaacccaatggtccaacaatttattcagcgctgggtccggctggacgagagggagttccctgaggccaaaaacgccccactaaaatatactagtgcacttacccacgacgccatcctggtgatagccgaggccttccgctatcttcgacggcagagagtcgacgtctctaggaggggatcggcaggagattgtctcgcaaatcctgctgtaccatggagccagggcattgatattgagcgcgctctaaagatggtccaggttcagggcatgaccggcaatattcagttcgatacgtacgggagaaggactaactatacaatcgacgtatatgagatgaaagtgtcagggtctcggaaagccggatattggaatgagtatgaacgctttgtgccattttctgaccaacagatctccaacgacagcgccagcagcgaaaataggacaatcgtggtgactacaatactcgagagcccttatgtgatgtacaaaaagaatcatgagcagctagagggcaatgagagatacgaaggctattgcgtcgacctggcatatgaaattgccaaacacgtgcggatcaaatacaagttgagcattgtgggagatggaaagtacggtgcccgcgaccctgagacgaagatctggaatggcatggtgggggagctcgtatacggcagagctgacatcgctgttgcccccctgaccattactctagtcagagaggaagtgattgacttttccaagccattcatgtctctcggaatctccatcatgataaagaaaccgcagaaatcaaagcccggcgtcttctccttcctcgatcctctcgcatatgaaatctggatgtgcattgtctttgcctatatcggggtgtccgtggtactgtttcttgtgtcaagattcagcccttacgagtggcacctggaggataataatgaagaaccaagagaccctcagagtcccccagaccccccaaatgagtttggtatctttaactcactgtggttctcgttaggcgccttcatgcagcagggctgtgacattagtccaaggtccctgagcggccggatagttggcggggtctggtggtttttcaccctgattatcatctcctcgtatacagctaacctagcggcttttctgactgtggaacggatggtaagcccaatcgaaagtgccgaggacctggctaagcagactgagattgcttacggcactttggatagcggctctactaaggaattttttcgccggagcaaaatcgccgtgtacgaaaaaatgtggtcatatatgaagagcgccgaaccttccgtatttacaaagactaccgctgatggtgtggctcgggttcggaaaagcaagggaaaatttgcgttcctgctggagtcaactatgaacgaatatatcgaacagaggaaaccatgcgataccatgaaagtaggagggaatttggattccaaggggtacggagtggccacccctaaaggatcagcactacgtaatgccgtgaatctggcagtgctgaagctcaatgaacagggactgctggacaagctgaaaaataaatggtggtacgacaaaggggaatgtgggtcgggggggggtgattctaaagataaaacctccgctctgagtctgtcgaatgtggcaggggtcttctatattctggtgggcggtctgggtttggccatgatggtcgccttgattgaattttgttacaaatctcgtgctgagtcgaagcggatgaagctgacaaaaaatactcagaacttcaaaccagcccctgcaactaacacgcagaactacgctacgtatagagaagggtacaacgtgtacggtaccgagtccgtgaagatatag

SEQ ID NO: 189297 - DNA, 2685 bp, Artificial Sequence
  Description of Artificial Sequence: Synthetic coding sequence
atggcccggcagaagaagatgggccagagcgtgctgcgggccgtgttcttcctcgtccttggcttattaggacattcccatggaggcttccccaacacaatctcgattgggggcctgttcatgaggaataccgttcaggaacattcggctttccgctttgccgtgcagctctataatactaatcagaatacaactgagaagccattccacctgaattatcatgttgatcatctggactcatctaattcattttcagtgacgaatgctttctgttctcagttctcacgtggagtatatgcaatatttggcttttacgatcagatgagtatgaatacccttacatctttttgtggcgctctgcacacatcgttcgtaacaccaagttttcctaccgatgctgacgtccaatttgtgatccagatgagaccggccctgaaaggggcaatcctgagccttctgggacactacaaatgggagaaatttgtctatctgtatgacaccgagaggggatttagtattctgcaagcaattatggaggcagctgtgcaaaataactggcaagtcacggccaggtcagtgggcaacatcaaagacgttcaagagtttcgccggatcatcgaagagatggacaggaggcaggaaaaacgctatctgatagattgtgaggtagaacgcatcaacacgatcctggaacaagtggtcattctgggcaaacactcacgcgggtaccactatatgctcgctaatctcggttttaccgatatactccttgaacgtgtgatgcatgggggcgccaatattactggcttccagattgttaacaatgaaaaccctatggtgcaacagttcattcagaggtgggtgaggcttgacgagcgagaatttcctgaggcaaaaaatgcccccctgaagtatacgagcgcactgacgcacgatgccattctcgttattgccgaggcctttagatacttaagacgacagcgggtggacgtgtcgcgacggggatcagctggagactgtctcgcaaaccccgcggtgccttggtcccaaggaattgacattgagcgcgctttgaagatggtgcaagtgcagggtatgaccgggaacatacaatttgatacttacgggcgccggacaaactacactatagacgtgtatgagatgaaagtcagcggctctaggaaggcaggctattggaacgaatacgagagattcgttccattcagcgaccagcagatcagtaacgattccgcctcttctgagaaccgcacgatcgtcgtgacgactatattagagagtccatacgtcatgtacaagaaaaatcatgagcaactggaaggcaatgagagatatgagggatactgcgtggatctggcctacgagattgccaagcacgttcgtatcaaatacaaattatctattgtgggggatggaaaatatggcgctagagaccccgaaaccaagatctggaatggaatggttggagaactggtgtacggaagggcagatattgccgtggcaccacttacgataacgctggtgcgtgaagaagtgattgacttctccaagccctttatgtccctggggatcagtatcatgattaagaaaccccagaaatccaaaccaggggttttctcctttctagatccactcgcatatgagatttggatgtgtattgtctttgcatatattggcgtgtctgtcgttctttttctcgtctctaggttcagcccctatgagtggcatctggaagataacaatgaagaaccacgggatccccaatctcctccagaccctcctaacgagttcgggatctttaactctttatggttctcattgggggcctttatgcagcagggctgtgacatatccccccgttctctctctggcagaatcgttggtggtgtgtggtggttcttcaccctgattattattagcagttacaccgccaacctggctgccttcctaacagtcgaaaggatggtcagtccaatagaatccgcggaggacttagctaaacagaccgaaattgcatacggcacactcgattccgggagtacaaaagagttcttccgccggtctaaaatcgctgtatacgaaaagatgtggagctatatgaagtccgccgagccatcagttttcacaaaaaccacagccgatggagtagcacgggtacggaagagcaaagggaagttcgccttcctgctggagtctacaatgaatgagtatatcgaacagagaaaaccatgcgacaccatgaaggtgggcggcaacttggactcaaaaggctacggggtggctacaccaaagggcagcgctctgaggactccagtgaatctggcggttctcaaactgtccgagcagggcatcttagacaaactcaagaacaaatggtggtacgacaagggcgagtgcggggctaaagattcaggcagtaaagataagacctccgcactctctctatctaatgtagcaggggttttctatattctggtcggcggattgggactggccatgatggttgcactgatcgagttctgctacaaatcgcgagccgagagtaagcgaatgaaactgaccaaaaacacacaaaatttcaaaccagccccagcgactaacacccagaactacgctacctaccgggaggggtataatgtttacggtactgaatccgtaaaaatctag

SEQ ID NO: 189298 - DNA, 495 bp, Artificial Sequence
  Description of Artificial Sequence: Synthetic coding sequence
atggcccggcagaagaagatgggccagagcgtgctgcgggccgtgtttttcctcgtgctgggtcttctgggacattcacacggcgggtttcccaacaccatttccatagggggcttgttcatgagaaacactgtgcaggagcactctgcttttcgttttgccgtgcagctgtataatacaaaccagaatactactgaaaaaccttttcacctgaattaccacgttgatcaccttgacagctctaattcttttagcgtgacaaacgcctgtcctgctgagagagactacttaccctggcccggctcgattagggagaacaactggacagccctaccgtgctgcaaggatcacggtttgctccacctaaaatgtagtcctggtggccccgctaagactgggcctatagtgagtggagctctgcaggtcaattgcaagatgcggactcgctcccaggtttcaaccacctcatcactgctggagttcagtaccgaatag

SEQ ID NO: 189299 - DNA, 495 bp, Artificial Sequence
  Description of Artificial Sequence: Synthetic coding sequence
atggcccggcagaagaagatgggccagagcgtgctgcgggccgtgttcttcctagtgttgggcctgttaggccatagccatggcggttttccgaacactatcagcattggagggttgtttatgaggaacacagtgcaggagcactcagccttcagattcgctgtccagctctacaatactaaccagaatacaactgagaagccattccatctcaattatcacgttgatcatctggattcttcgaacagcttcagcgttacaaatgcatgccccgccgagcgggattacctcccatggcccggcagcatccgcgaaaacaactggaccgccctgccttgttgcaaggatcatggtctgttgcatctcaaatgtagccctgggggacccgccaaaaccggccccatagtgagtggcgccctccaggtgaactgcaagatgaggacacggtcccaggtttcaacaaccagttctctcctggagttttccactgagtag

SEQ ID NO: 189300 - DNA, 1989 bp, Artificial Sequence
  Description of Artificial Sequence: Synthetic coding sequence
atgctgcagggcggcgaggagagccggctgttcggcagcctgctgtggaccctcccgtggcgcggcctcttcatgcgcaacactgttcaggagcactctgcctttagattcgctgttcagttgtacaatacgaaccaaaacactaccgaaaagccctttcacctgaattaccacgtcgatcatcttgattccagtaattcattttccgtaaccaatgcattctgctcccagttttccagaggggtgtacgctattttcggcttctatgatcagatgtctatgaatacattgacgtccttctgtggagcacttcacactagtttcgtgacacctagcttccctactgatgcagatgtccagttcgttatccagatgcgacctgccttaaagggagctattctgtctctgctgggccattacaaatgggaaaaattcgtctatctctacgacactgagcggggtttcagcatactgcaagccattatggaggctgccgtacaaaataattggcaggtgacagcccgctctgtcgggaacatcaaagacgttcaggaattccgaagaataatcgaagagatggacaggcgccaggagaagcgttatctgatcgattgcgaagtagagcggatcaatacaattcttgagcaggtggtgatactcgggaagcactccagggggtaccactatatgctggctaacctcgggttcacagacatcctcctggagagagttatgcacgggggggccaacataaccggttttcagatcgtgaataacgagaaccccatggtgcagcaatttatccaaagatgggtcaggttggatgagcgcgagtttccagaggccaagaacgcccctttgaaatatactagcgccctcacgcatgatgccatcctcgtcatagcggaggctttcaggtacctccgtaggcagagggtggacgtttccagaagaggaagtgccggggactgtctcgcaaacccagctgtcccatggtcccaaggaatagatattgagcgggccctgaagatggtgcaggtccagggcatgacgggtaatattcagttcgacacttacgggaggcgcacaaactacaccatcgatgtctacgagatgaaggtgagcggttctaggaaggctgggtactggaacgagtatgagagatttgtgcccttctctgaccagcaaataagtaatgacagcgcctctagtgagaacaggacgattgtagttaccaccattctagaatctccatacgtgatgtataagaagaaccacgagcagctcgaaggcaacgaaaggtacgagggttattgcgtggacctggcgtacgaaatcgcgaagcacgtcagaattaagtataaactgtccatcgtaggcgacggtaagtatggtgccagggatccagaaacaaagatttggaacggaatggttggggagctggtgtacggaagagctgacatcgctgtcgctcccctaactattaccttagtccgggaagaggtgatagatttcagtaagccctttatgtcacttgggatctcaatcatgattaaaaaaccccagaagtccaagcctggagttttctccttcctggatccgcttgcttatgagatatggatgtgcatcgtatttgcctatatcggcgtatctgtcgtcctatttttggtgagccggttttccccttacgagtggcatctcgaagacaacaacgaggaacctcgggaccctcagagtccccccgatccacctaatgaatttggtatatttaactccctttggttctccttgggcgcttttatgcagcaggggtgcgatattagtcctagattcgtgtttgtcgcctacagcatgccacattgtattctttggagttacagcattcatgtgcacatggtgttcatacacctgaattcaagatttttctcattcaacatcccctcaaatgatcgcttaagtagcagtcactgcgtgtgcctgtgcccctag

SEQ ID NO: 189301 - DNA, 2475 bp, Artificial Sequence
  Description of Artificial Sequence: Synthetic coding sequence
atggcccggcagaagaagatgggccagagcgtgctgcgggccgtgttcttcctcgtgctaggcttactcggacacagccatggagggtttcccaacactattagcattggcggcctattcatgcgtaacacagtgcaggagcacagtgctttccgattcgctgttcagctgtataacacaaaccagaataccaccgaaaaacccttccatctgaactaccatgttgatcacctggatagctccaattcgttttccgtgaccaatgcattttgttctcagttctccagaggcgtgtatgcgatttttggtttctatgaccaaatgagtatgaacacgctgacatcgttctgcggcgccctgcacacttctttcgtgacaccttcctttcccaccgacgccgacgtgcaattcgtcatccagatgcggcctgccttaaaaggagccatacttagccttctggggcactataagtgggagaagttcgtttatctgtacgacacagagcgcgggtttagtatcctgcaggccattatggaagccgctgtgcagaacaattggcaggtgactgcacggtcagtcggaaatattaaagacgtccaggaattcaggcgcataatcgaggaaatggacaggcgccaggaaaagaggtacttgatagattgcgaggtggagcgtattaacactatcctcgaacaggtagtgatcctcggtaagcattcaagagggtaccactacatgctcgccaacctggggtttaccgacattttgctggaaagagttatgcacggtggggccaacattacggggtttcagattgttaacaacgaaaatcctatggtccaacagttcattcagcgatgggtcagactggatgagcgggagttcccagaagcaaagaacgctccactgaagtacaccagcgcactcactcacgacgcgatactggttattgccgaggcctttcgttacctgcgccgacagagggtcgacgtatcaagacgagggtcggctggagattgcctcgcgaatcctgctgtgccatggtctcagggaatcgacatcgagcgagcactgaagatggtgcaggtccagggcatgaccggcaacattcaatttgatacctacggcagaaggaccaactacaccatcgacgtgtatgaaatgaaggtctcaggctctcgtaaggctgggtattggaacgaatatgagcgcttcgtgcccttttccgatcagcagatcagtaacgattctgccagcagtgagaacaggacaatcgtagttacaactattctggagtctccctacgttatgtacaaaaagaaccatgagcagctcgaaggcaacgagagatacgaggggtattgcgttgacttggcgtatgagatcgctaaacacgttcggataaaatacaaattgagcatcgtgggagatggtaagtacggcgcccgggaccccgagacaaagatctggaacggaatggtcggcgagctcgtatacggccgcgccgacatcgccgtggcacctcttacaatcacccttgttagggaggaagtcattgacttcagcaagccgtttatgtccctgggcataagcattatgataaagaagccccagaaatctaagcctggagttttttctttcttggaccctctggcctacgagatctggatgtgcatagtattcgcatacatcggcgtgtccgtggtgctgttcttagtctccagattctctccctacgaatggcacttagaagacaataatgaagagccgcgagaccctcagagtccccccgacccccctaatgaattcggcatctttaacagcctttggttctctctcggtgctttcatgcagcagggttgcgacatctctccacgttctcttagtgggagaatcgtgggcggagtgtggtggttctttacactaataataatctcaagttacacagctaatcttgcagcgttcctgacagtggaaaggatggtgtcaccgatcgaaagtgcagaggacttagccaaacagaccgaaatagcatatggcacacttgactccggaagcaccaaagagtttttccggaggagtaaaatcgccgtctacgaaaagatgtggtcctacatgaagtcagccgagccctcagtatttacaaagacaaccgctgatggcgtggcacgggtcagaaagagtaaggggaagtttgcgttcctcctcgagagcactatgaatgagtatatcgaacagaggaagccctgcgatacaatgaaggtgggcgggaatttagattctaagggctatggtgtcgcaacgcccaagggaagcgccctccgtaacgctgttaatctcgccgtgttaaagctgaacgaacaagggctgctagacaagttgaagaataaatggtggtatgataaaggtgaatgtggttccggcggcggcgactctaagaacgcttgtaagccatgttctattgagacccaatag

SEQ ID NO: 189302 - DNA, 2709 bp, Artificial Sequence
  Description of Artificial Sequence: Synthetic coding sequence
atgcggatcatcagccggcagatcgtgctgctgttcagcggcttctggggattggcaatgggagcttttcctagctccgtgcagattgggggccttttcatcagaaataccgaccaggagtataccgcattcaggctggcaatcttcttgcacaatacatcgccaaacgccagtgaggcaccctttaaccttgtgccacatgtggataatatagaaactgctaacagcttcgccgtgacaaatgctttctgcagtcagtatagccggggtgtgttcgccatctttggcttgtatgacaagcgcagcgtgcacacactcacaagcttctgttcggcgctccacattagtctgatcaccccttcatttccaacggaaggtgaatcacagttcgtgctgcagttgcgcccgtccctgaggggagcgctgttgtccttactcgaccactacgaatggaactgcttcgtcttcttatacgataccgatagaggctacagtattctgcaggctatcatggaaaaagctgggcagaacgggtggcacgtgtctgccatatgcgtcgagaatttcaacgacgtgtcttataggcaacttctggaagaattagatcgcagacaggaaaagaagttcgttatcgactgtgaaatagaaaggctgcagaatattctggagcagatcgttagcgtgggaaaacacgttaagggatatcattatatcatcgccaacctgggttttaaggatatttccttggagaggttcatccacggtggggctaacgtgacggggtttcagttagttgatttcaatacacctatggtgataaagctgatggatagatggaagaagctcgaccagagggagtatccgggatcagagaccccccccaagtacacctcagctttaacgtacgacggtgtgctggtgatggccgaaacgtttcggagtctgaggaggcagaaaatcgatatctcacgtcgagggaatgccggggactgcctggcaaatccagcagccccgtgggggcagggaattgacatggagagaacattgaaacaagtgaggatccagggcttaacaggaaatgtgcagttcgatcattatggacgacgcgttaattacactatggacgtctttgaactgaagtctactgggccccgcaaagtgggatactggaacgacatggacaagcttgttttaatacaagatgtccccacattgggcaacgacaccgccgccattgaaaaccgcaccgtcgtggtgaccaccattatggagtctccttatgttatgtacaagaagaaccacgagatgtttgaaggtaacgataagtatgaggggtactgcgtggatttggcttccgaaatcgctaaacacattggaataaaatacaaaatcgcaatcgttccagacgggaagtacggcgctcgcgacgcagacactaagatatggaatgggatggtgggcgaattggtctacggcaaggccgagatagctatcgcccctctcactatcactctcgttagagaggaggtgattgatttttccaagccattcatgagcttggggatcagcattatgatcaagaaaccacaaaaatctaaaccaggggtgttctccttcctcgaccccctcgcctacgagatctggatgtgcatcgtgttcgcctacattggtgtgtccgtggtgcttttccttgtgagtaggttctccccttacgagtggcataccgaagaacccgaagacggaaaggaaggcccatccgaccagccccccaatgaatttgggatttttaactcactctggttttccctcggggctttcatgcaacaggggtgtgacatatccccacgaagcttgtcaggacgcatcgtgggtggagtatggtggtttttcactctcattataatctcctcctacacagctaatttagctgcttttctgaccgtggagagaatggtctcccccattgaaagtgctgaggacctggcaaagcagaccgaaattgcttacggcaccctcgatagtggaagcacgaaggagtttttcaggcgcagcaaaatcgctgtttacgagaagatgtggacttacatgaggtctgccgaaccatccgtgttcacccggaccacggctgagggagttgcaagagtccgcaagtccaaggggaagttcgcattccttttggaatcaaccatgaacgaatatattgaacagcggaaaccttgtgatacgatgaaagtaggcggcaacttagacagcaaaggctatggagtcgctacgcccaagggatcaagtctgaggactcccgttaatctggccgtgctgaagttgagcgaggccggggtgctggataagcttaaaaacaaatggtggtacgacaaaggagaatgtgggcccaaagattcaggaagcaaagataagacatccgcccttagtctgtccaacgtcgctggggtcttttacatactcgttggcgggctagggctcgctatgctggtggcattgatcgaattctgctataagtctagggctgaggccaagcggatgaaactcacttttagcgaagctattaggaacaaggcccggctgtccatcacaggtagtgtcggcgagaatggaagagtgctcaccccggactgtcctaaggctgtgcatacaggtaccgcaattcggcaatcaagcggcctagccgtaatcgcctcagacctgccttag

SEQ ID NO: 189303 - DNA, 1302 bp, Artificial Sequence
  Description of Artificial Sequence: Synthetic coding sequence
atgcggatcatcagccggcagatcgtgctgctgttcagcggcttctggggactagccatgggggcttttccttcatcagtccagattggtggcctgttcatccggaatacagatcaggaatacaccgcatttaggctagctatcttccttcataacaccagccccaatgccagcgaagccccattcaacttagtgccacacgtcgacaatatcgaaaccgccaactcctttgctgtgactaatgccttctgttcacagtactctcgaggcgtctttgccatatttggactgtacgataagagaagcgtgcatactttaactagcttctgcagtgccttgcacatctctcttattacaccctcatttccaacagagggtgagtctcagtttgtgctgcagttacggccctctctacgcggcgcccttctctccctcctcgatcattacgaatggaactgttttgtctttctttatgataccgaccgcggatactcgatcctgcaggccattatggagaaggctgggcagaatggatggcatgtttcagccatttgcgtagagaactttaacgatgtgtcgtatagacagctgctggaggagttggaccgcagacaggaaaagaagtttgtcattgactgtgagattgagcgcctgcagaatatcctagagcagattgtctccgtaggtaagcatgtgaaaggatatcactatatcattgcgaacctcggattcaaggacatctcactggagagattcattcatggaggtgctaatgtaactggtttccaacttgttgattttaacactccaatggtgatcaaattaatggaccggtggaagaaactggaccagagggaatacccaggaagcgaaacgcctcctaaatacacttcagctcttacatacgatggcgtcttggtgatggctgaaaccttccgcagcttgcgccgacaaaagattgacatctctaggaggggaaacgccggagattgcctggccaacccggcggcgccctgggggcagggcatcgacatggaacgcacactgaagcaggtacgaattcagggactgactgggaacgtgcagtttgatcattacggtcgccgcgtgaattatactatggacgtgttcgaactaaaaagtacgggcccacggaaggtgggctactggaacgatatggacaaactggttttgatccaggacgtgcctacacttggtaatgacactgccgcaattgaaaatagaacagttgtggttacgacaattatgcctctgatgaaaaacccgatcctgaggaattag

SEQ ID NO: 189304 - DNA, 2655 bp, Artificial Sequence
  Description of Artificial Sequence: Synthetic coding sequence
atgcggatcatcagccggcagatcgtgctgctgttcagcggcttctggggcctcgccatgggggcatttccctcctctgtgcagatcggcggcctgtttattcgcaatactgaccaggaatacaccgcatttcggctggcaatctttctccataatacaagtcctaacgcgtccgaggcccccttcaacttggtgccccacgtcgataacattgaaaccgctaactctttcgccgtcactaatgctttttgttctcagtactctcgcggcgtatttgcaatatttggcctctacgacaaaaggtcagtccacacacttacctctttctgcagcgctcttcacatcagcctgattacaccgtcctttcctaccgagggtgaatcccagtttgtgcttcagctgaggccttccctcaggggagctttgctttcactgttggaccactatgaatggaattgctttgtattcctctacgataccgacagaggttactccatcctacaggccatcatggagaaggcaggacagaacggatggcatgtcagtgccatctgcgttgaaaactttaatgatgttagctacagacagctgcttgaagaactggatcgacgacaggaaaagaagtttgttatcgattgtgagattgaacgccttcagaacatccttgaacagatcgtctctgtggggaagcatgtgaaaggctaccactatatcattgctaatctcggatttaaggacatcagcctggagcgatttattcatgggggcgccaatgttaccggcttccaactcgtggattttaacacaccgatggtcatcaagctgatggatcgatggaaaaagcttgaccagcgtgagtatccggggagcgagacccctcccaagtatacctctgcgcttacatatgacggtgtcctcgttatggccgaaacatttcggtctcttcggcgccagaagattgatatcagtcgaaggggaaacgctggagattgcctggctaatccagctgctccttggggtcagggcattgacatggagaggactttgaagcaggtgcggatacagggcctcacaggcaacgtccagttcgatcattacggtcgccgggtcaactatacaatggatgtctttgaattgaagagcacaggacctagaaaggtgggttactggaacgatatggacaagctggtgctgattcaggacgtccctacccttggcaacgataccgccgctatcgaaaacagaaccgtcgtggtaaccactatcatggaaagcccatatgtcatgtataaaaagaatcatgagatgttcgagggcaacgataagtatgagggctactgtgtcgacctggctagcgagatcgctaagcacattggtatcaagtacaagatcgccatagtccccgacggcaaatacggcgcgcgcgatgccgacaccaagatctggaatggtatggtgggcgagctggtatacggcaaggctgaaatcgctatagcacccttaaccataacactggtgagggaagaggtaatcgatttttcaaagcctttcatgtctctggggatcagtataatgattaagaagccgcagaagtctaaaccaggcgtattcagctttttggaccctctcgcatatgaaatctggatgtgtattgtctttgcatacatcggggtaagcgttgtcctttttttggtgtccaggttctctccttacgagtggcacacagaagagccagaggacggcaaggagggaccctctgatcagccacctaacgagttcggtatcttcaatagcctgtggttcagcttgggcgccttcatgcagcagggatgtgatatcagtcccaggagcctgtcagggcgaatcgtggggggagtgtggtggttttttaccctgattattattagttcgtacacagctaatttagctgcatttctaacagtagagcgaatggtctcccccatcgaaagtgccgaggacctggcgaagcagactgagattgcctacggaacactggactccggcagtacgaaagagttctttcgcaggagcaaaattgccgtgtatgaaaagatgtggacctacatgcgcagtgccgaaccctctgtttttaccagaacgaccgccgaaggcgtagccagggtacgcaaatccaaaggcaaatttgcctttctgctggaaagcactatgaatgagtacattgagcaacggaaaccttgcgacacgatgaaagtagggggcaatctggatagcaagggctatggagtcgctaccccgaaaggctcaagcctgagaaatgctgtcaatctcgcggtgttgaagctgaacgagcaagggcttttggataagctgaaaaacaaatggtggtacgacaagggtgaatgtgggtccgggggcggggactccaaggataagacctctgcactgtcactctctaatgttgcaggcgtgttttacattcttgtgggcgggcttggcctggccatgctggttgccttaattgagttctgctataaaagccgagcagaggccaagagaatgaaggtggccaagagcgctcaaacattcaatcctaccagcagtcaaaacacacagaacctggcaacatatcgcgaaggctacaatgtctacggcactgaatctatcaaaatttag

SEQ ID NO: 189305 - DNA, 1302 bp, Artificial Sequence
  Description of Artificial Sequence: Synthetic coding sequence
atgcggatcatcagccggcagatcgtgctgctgttcagcggcttctgggggctcgctatgggtgcctttcctagttcagtccaaattggcggactgttcattcgaaacaccgatcaggagtataccgccttccgcttggccatattcttgcacaatactagtccaaatgcctccgaagcgcccttcaatctagtccctcatgtggataacatagagacagccaatagctttgctgtgactaacgccttttgcagtcagtacagtcgaggtgtgtttgccatcttcggcctctacgacaagcggagcgtccatacactcacctccttttgctcagcattgcacatctccctgattaccccctctttcccaaccgagggtgagtcccaatttgtgctgcaattgaggccctcccttcgcggggctctgctgtctctgctggatcattacgagtggaactgcttcgtgttcctctacgacacagaccgcggctactccattctgcaggccattatggagaaggccggtcagaatggttggcacgtgtctgctatctgtgtcgaaaactttaatgatgtctcctataggcagctgcttgaggagctcgatcggagacaggaaaagaaatttgtgatcgactgtgagattgagcgcctgcagaacatactagagcagatagtcagtgtcgggaagcatgtcaagggatatcattatatcatcgccaatctgggcttcaaggatatcagtctggaaaggttcattcacggaggcgcaaatgtcactggtttccaactggtggactttaataccccaatggttattaagctcatggacaggtggaagaagctcgaccagcgcgaataccctggttccgaaacccctccgaaatacactagtgccctgacatacgacggggtgttagttatggcagagacgtttaggagcctccgtcgacaaaaaatcgacatctcccgtcgaggcaacgcgggcgattgtctcgccaatcctgccgccccttgggggcaggggatcgacatggagcgaaccctcaagcaagtacgaatccagggtttgaccggaaatgtgcaatttgatcactatgggcgcagggtgaattacaccatggatgtgtttgagctgaagtccaccggacctaggaaagtgggctattggaatgatatggataaactggtccttattcaggatgttccaaccctgggaaatgacaccgccgcgatcgagaatcgcacagtagtggtgaccactatcatgcccctgatgaagaatcccatcctgcgtaactag

SEQ ID NO: 189306 - DNA, 2655 bp, Artificial Sequence
  Description of Artificial Sequence: Synthetic coding sequence
atgcggatcatcagccggcagatcgtgctgctgttcagcggcttctggggtctggcaatgggcgccttcccttcatctgtgcagatcggaggactgttcatacgcaacacagaccaggagtacacagccttcaggctcgctatcttcctacataacacctctccaaacgcgagcgaagctccttttaatttagtgccgcacgtcgacaacattgagacagcgaactccttcgctgtaaccaatgccttttgcagccaatactcccgaggcgtcttcgcaatcttcggcctgtacgacaaacggtccgtccacaccctcactagtttctgtagtgctttgcacatttcattaatcacaccctcttttccgacagagggcgagtcccagttcgtactccagttgcgcccgtcactacggggtgcgctgctgtctctgctggaccactatgagtggaattgctttgtctttctgtacgatacagaccgggggtactctatccttcaagctatcatggagaaagcgggccagaatggatggcatgtctcggccatttgtgtggagaactttaatgatgtgagctacagacaactattagaagaattggatcgccgtcaggagaaaaagtttgtgatcgactgcgagatcgagcgcctgcaaaatatactggagcagatcgtttccgttggcaaacacgtgaaaggctatcactacataatcgccaatctagggttcaaagatataagtctggaacggtttattcacgggggggctaatgtaactggatttcaactcgtggactttaacactcccatggtcattaagctgatggaccggtggaagaaactagatcagcgggagtatcctggctctgaaacaccccctaagtatacgtcagcgctgacctacgacggggttttggtcatggccgaaaccttcagatcattgagacgacagaaaattgacatttctcggcgcggaaatgcgggcgactgtctggcgaacccagctgccccatggggacaggggattgacatggagaggactctgaagcaggtgagaatccagggactgaccggtaacgtgcaattcgatcattacggaaggcgagtgaactatactatggacgtcttcgagctcaaatctacgggccctcgcaaagtcggctattggaatgacatggacaagcttgtgcttatccaagacgtcccaactcttgggaatgatacggccgcaatcgaaaacaggactgtggtcgtgacaaccattatggaatcaccctatgtgatgtataagaagaatcacgaaatgttcgaagggaacgacaagtatgaggggtactgcgtcgatctggcgtctgagatcgccaagcacatcggaatcaaatataagattgcgattgtcccagatggcaaatacggagcacgcgatgctgacaccaagatctggaatggcatggtgggtgagctcgtgtacggcaaggcggaaatagccatcgcgcctctcactataaccctggtgcgcgaagaggtgatcgatttttcaaagccattcatgagcctcgggatcagcataatgatcaagaagcctcagaaatctaagcctggggttttttccttcctggatccactcgcttacgagatatggatgtgcatcgtattcgcgtacattggggtttctgtggtactgttcctggtaagtcgcttttcaccatacgagtggcacaccgaggaaccggaggacggaaaagagggccctagcgatcagccgcccaatgaatttggcattttcaactcactgtggttctcactcggcgctttcatgcagcaagggtgcgacattagcccgagaagccttagtggtagaattgttggcggggtgtggtggttctttactttgatcatcatttccagctacacagctaacttagcagcctttttgaccgtggagaggatggtatctccaattgagagcgccgaggacctcgccaagcagacagagatcgcttatgggacactggactctggcagcacgaaggagttttttaggaggtcgaaaatcgctgtgtatgaaaaaatgtggacctatatgagaagtgcagagccatctgtctttacaagaactaccgccgagggggtggctcgggtccgcaagagcaaaggcaaatttgcgtttctcctggagagtactatgaacgaatacatcgagcagcggaagccttgcgatactatgaaagtcggcggaaatctggattctaagggttacggcgttgctacgcccaagggttcaagcctgagaaacgccgttaatctggccgtgctaaagttaaatgagcaaggccttctggataaactgaagaataaatggtggtatgataaaggcgaatgtggatcaggcggtggtgactccaaggataagacttctgcattatccctctctaacgtggccggcgtcttctatattctagttggaggcctcggcctcgctatgctcgtggctttgatagaattttgctataagagccgcgctgaagccaaaagaatgaaggttgcgaagtcagcccagacttttaatccgacatctagccaaaacactcagaatctggcgacatacagagaaggatacaacgtttacgggactgagtctatcaagatctag

SEQ ID NO: 189307 - DNA, 249 bp, Artificial Sequence
  Description of Artificial Sequence: Synthetic coding sequence
atgcggatcatcagccggcagatcgtgctgctgttcagcggcttctggggactggcaatgggtgctttcccctctagtgttcagataggtggattattcatcaggaacactgaccaggagtacactgcctttcgactggccatatttctccataacacgagcccaaatgcaagcgaggcacccttcaatctcgtgccacacgtagacaacatagaaacagctaacagctttgctgtcactaatgcatag

SEQ ID NO: 189308 - DNA, 249 bp, Artificial Sequence
  Description of Artificial Sequence: Synthetic coding sequence
atgcggatcatcagccggcagatcgtgctgctgttcagcggcttctggggcctcgctatgggagcgtttcccagttctgtgcagattggcggcctattcatccgcaataccgatcaggaatatacggcctttcgactagcaattttcttacacaacacttccccgaatgctagcgaggccccctttaatctggtgccacacgtcgacaatatcgagactgctaacagctttgcagtcactaacgcctag

SEQ ID NO: 189309 - DNA, 2709 bp, Artificial Sequence
  Description of Artificial Sequence: Synthetic coding sequence
atgcggatcatcagccggcagatcgtgctgctgttcagcggcttctggggacttgccatgggcgctttccccagctcagtacagattggcggcctgttcattcgcaatactgaccaagagtacacagcctttaggctggccatattcttacataacacctctccaaacgcgagcgaggctccattcaacttggtgccacatgtggacaacatcgaaaccgcgaacagctttgccgtcactaatgccttttgctcccagtactccagaggggtcttcgccatattcgggctgtacgacaaacgctctgtgcacaccttaacgtctttttgctctgcattacatatcagcctcattactccatcgtttcctacggaaggagaatctcagtttgtcctgcagctccggccttcactacgtggcgcacttctcagcctcctggaccactacgaatggaactgttttgtttttctctacgacacagaccggggatactcaatcttgcaggcgataatggaaaaggctggtcaaaacggctggcacgtttccgctatttgcgttgaaaatttcaatgatgtgagttatcggcagctgctggaagagttagatagaaggcaagagaagaaattcgtaattgattgcgagattgaacgcctccaaaatatactcgagcagatcgtgtccgtaggcaagcacgttaaaggataccattacatcatagccaacctagggtttaaagatatctcccttgagcgctttattcacgggggggccaatgtgacgggattccaactggtcgacttcaacactccgatggtcatcaagctgatggatcgatggaagaagttggatcagagagagtatcctggtagcgagacaccccccaagtatacctccgcgctaacatacgacggtgtcctcgtcatggcagaaacctttcggtccctccgtaggcagaagatcgatatctcgcgccgcggaaacgcaggggattgtctcgcgaaccctgccgccccatgggggcagggcattgatatggaacgtaccctaaaacaagttaggatccagggcctcacaggaaatgtgcaattcgaccattatggacgcagggtgaattacaccatggatgtgtttgaactgaagtcgacgggcccgcggaaagtaggatactggaatgatatggataaactcgtgctcattcaggacgtgcccacccttgggaacgacacagcagctatagagaatcggactgtggtcgttaccacaatcatggagtccccctacgtaatgtacaagaagaatcacgagatgttcgagggcaacgacaagtatgagggatactgtgtggacttggcttcagaaatagctaaacacatcggcattaagtataagatcgccatcgtgccagatgggaagtacggtgctagagatgcagatactaagatctggaacggcatggtcggcgaattggtgtatggtaaagctgagatcgccattgcgcctctgaccattacccttgtgcgcgaagaagtgattgactttagtaagccttttatgtcgctgggcatctcaattatgatcaagaagcctcagaaatccaagccgggagttttcagcttcttggaccctcttgcttacgaaatctggatgtgcattgtcttcgcctatatcggggttagcgtggtgctttttcttgtgagtcggttttcgccatatgaatggcacacggaggaacccgaagacggaaaagaaggcccgtcagatcagcctcccaacgaatttggcatcttcaattctctgtggttcagcctgggagcctttatgcagcagggctgcgatatttccccccgtagcctgtctggaagaattgtgggcggtgtctggtggtttttcaccctcatcatcatcagcagttataccgccaatctggccgcatttttgaccgtagaaagaatggtgagtccaatcgaatcagccgaagatttagccaagcagacagagatcgcatatggaactctggactcagggtctacaaaagagtttttcagacgcagtaagattgccgtgtacgaaaaaatgtggacttacatgcggtctgccgaaccgagcgtgttcaccaggaccacagccgaaggggtggcgagagttcgaaagtccaaaggcaaattcgcattcctcctggaatccaccatgaatgaatatattgagcagcgcaagccttgtgatacaatgaaggtgggcggcaacttggactccaagggttacggcgtcgccacaccgaagggcagtagtctgaggacgcctgttaacctcgcagttctcaagctctcggaggccggcgtgctggataagttgaaaaacaagtggtggtacgataaaggggagtgcggtcctaaagactctgggtcaaaggataaaactagcgctcttagtctttcaaatgttgccggggtattctacatactggtgggtggcctcgggctagcaatgctggtggcccttatagaattttgctataagagcagggcggaggcgaaacgaatgaagcttacattttcggaggccatcaggaataaggcacggttgtcgattaccggatcagtgggtgagaacggtagagtcctgacgcccgactgcccgaaggcagtccatactggcaccgccatcagacaaagttcaggcctcgctgtcatcgcatctgatctcccatag

SEQ ID NO: 189310 - DNA, 360 bp, Artificial Sequence
  Description of Artificial Sequence: Synthetic coding sequence
atgcggagcgccgagcccagcgtgttcacccggaccaccgccgagggtgtggctcgcgtgcgcaaatctaaaggcaaattcgcttttttgctggaatcaacaatgaatgagtacattgagcagcgcaagccctgtgatacgatgaaagtgggaggaaacctggactctaaagggtatggggtcgccactcccaagggctcgagcctccggaacgccgtcaacctggcagtgctgaagctaaacgagcagggactactcgacaaattaaagaacaagtggtggtacgacaaaggagagtgcggatctgggggaggcgacagtaagaatagttgtaagccctgcagatttgaaactcagtag

SEQ ID NO: 189311 - DNA, 2721 bp, Artificial Sequence
  Description of Artificial Sequence: Synthetic coding sequence
atgcagcacatcttcgccttcttctgcaccggcttcctgggcgccgtcgtcggagccaacttccccaataacatccaaattggtggcctgtttcctaaccagcaatcacaggagcatgccgcttttcggtttgcactctcccagcttactgagccgccaaaacttctgccccagatcgatatcgtgaatatctccgatagcttcgaaatgacttatcgattctgcagtcagttctctaaaggcgtttatgccatctttggcttttatgagagaaggacagtgaatatgctcacgagcttctgtggggcacttcacgtctgcttcatcacacccagcttcccagtcgacacaagcaatcagttcgtgttacagttgaggcctgaacttcaggacgccctcatttcaattatagatcattacaaatggcaaaaatttgtctatatctatgatgccgatagaggactgagtgtgctgcagaaggttttagacaccgctgctgaaaagaactggcaggttacagcggtgaacattctgaccactactgaggaggggtacaggatgctcttccaggacctggaaaaaaagaaagaacgccttgtggtcgtcgattgtgaaagcgagaggttaaatgccatacttggacaaatcattaaattagaaaaaaatggaattggatatcattatatattggcaaatctgggctttatggatattgatctgaacaagttcaaggagtctggcgcgaatgtcacaggcttccagctagtgaattatacagacacgatacctgccaagatcatgcaacagtggaagaactcagacgcccgcgaccatacccgcgtggactggaagcgccccaaatacaccagtgctcttacctatgatggcgtgaaggtgatggctgaggctttccaatcactccggcgccagcggatcgacatctcccgccggggtaatgctggggattgtctggctaaccccgcagtgccctggggccagggaattgacatccagagagcgttacagcaggtgcggtttgaagggcttacaggaaatgttcagtttaacgaaaagggcagaaggacaaactataccttgcatgtcatcgagatgaagcatgatggaatcagaaagatcggctattggaacgaggacgacaaattcgttcccgccgcgacggatgcccaggcaggaggcgacaattcaagtgtgcagaatcgcacctacattgtgacaaccatcctggaagatccttacgtgatgctcaagaagaacgcgaatcaattcgagggaaatgaccggtatgagggctactgcgtagagctcgcggcagaaattgcaaagcacgttggctattcttacagactggaaatagtttcagatgggaaatacggagctcgcgacccagacactaaggcttggaatggaatggtcggagaactggtctatgggcgcgctgatgtcgctgtcgcgccgttgactattaccctggtgcgagaggaggtcattgatttctctaaacccttcatgagtctgggcatcagtataatgattaagaagccccaaaagtccaagcccggcgttttttccttcctggatccactggcttatgagatctggatgtgtattgttttcgcgtacattggcgtcagcgttgtccttttcctcgtgtcccgttttagcccttacgaatggcacagtgaggagtttgaagagggaagggatcagacaacaagcgatcagagtaatgaattcggcattttcaattccctctggtttagtctcggcgcttttatgcaacagggctgcgacataagtcctcggtccctgagcggtagaatagtaggaggagtgtggtggttcttcactttaataatcatttcctcctatactgcgaaccttgctgcattccttaccgtcgagcgaatggtctcaccaattgagtctgcagaggacctcgcgaagcaaaccgaaattgcctatggcacgctggaggccggcagcacaaaggaatttttccgcagatcaaagattgcggtgtttgagaagatgtggacctatatgaagagcgccgagccaagcgttttcgtacgtaccacagaagaaggtatgataagggttagaaaatcaaaaggcaaatacgcatacctgctagaaagcactatgaatgagtacattgagcagagaaagccctgtgacaccatgaaggttggcgggaacctggattccaaagggtacggaattgccacccccaaagggagcgccctgagaaaccccgtgaacctggccgtactgaagttgaatgagcaaggccttcttgacaagctgaagaacaagtggtggtatgacaaaggggagtgcggctctggtggcggggactccaaagacaagacctcagccttgtctctgtctaacgtggcaggagttttctatatcctgattggaggcctgggcctggctatgctcgtcgcattgatagagttttgctacaagtcaaggagtgagtctaagcggatgaagggcttctgtctcattcctcagcagagtatcaatgaagcaattcgcacctccactcttccaagaaactccggcgccggggctagcagtggtggttcaggcgaaaatgggcgcgtggtgtcccacgattttccgaagtcaatgcagtcgatcccttgtatgtctcatagcagcggtatgcctttaggggctacaggcctgtag

SEQ ID NO: 189312 - DNA, 2721 bp, Artificial Sequence
  Description of Artificial Sequence: Synthetic coding sequence
atgcagcacatcttcgccttcttctgcaccggcttcctgggcgccgtcgtaggcgcaaatttccctaacaatattcaaatcggtggcctgtttccaaaccagcagtcacaggagcacgcggcgtttcgtttcgctttgagccagctcactgagcccccgaaattattgccccagatcgatatagttaacatctctgacagctttgagatgacataccgtttttgtagtcaattctctaagggggtttatgcaatcttcgggttttatgagcgacgcacagtgaacatgctcaccagtttctgcggtgctctgcatgtttgcttcatcactccttcatttcctgtcgacacatcgaaccagttcgtgctgcagctcaggcctgaactgcaggatgctctcatcagcattatcgaccattacaagtggcagaaatttgtctatatctatgatgcagataggggcctgagcgttctacagaaggtgctggacaccgccgccgagaagaattggcaggtaacagctgtcaatatacttacgactaccgaggaggggtatcggatgctgttccaagacctcgaaaagaaaaaagaacgcctcgtggtcgtcgactgtgagtctgaacgcctaaacgctattctggggcaaattattaaattggaaaaaaatggcatagggtatcactatatccttgcaaatctaggctttatggacatagacttgaacaagtttaaggagtcaggggcaaatgtgaccggctttcaactcgttaactacaccgacaccattcctgcaaagatcatgcagcagtggaagaattcagacgcacgagaccatactcgcgtcgattggaagagaccaaaatacacgtcagctttgacatacgatggggttaaagttatggcagaggcattccaatcactgagacgacagcggattgacatctcacgcaggggcaacgctggagattgcctggctaatccagcagtgccttggggacagggcatcgacattcagcgcgcgctccaacaagttaggtttgaagggctgactggtaacgtccagttcaacgagaaagggagacgcaccaactataccctgcatgtgatcgagatgaagcacgacgggatcaggaagatcggctactggaatgaagacgacaaattcgtgccagccgccactgacgcccaggccgggggagacaactccagtgtccagaatagaacttacatagtcaccacaatcctcgaggacccatatgtgatgctgaagaagaacgccaaccagtttgagggaaacgaccgctatgagggatattgcgtagaactggccgccgagattgcaaaacacgtaggatacagctaccgtctggaaatagtgtccgatgggaagtatggtgctcgggatcccgacactaaagcgtggaacggcatggttggagagctcgtgtatggccgagcagatgttgccgtggcccccctcacaatcacactcgtgcgcgaggaggtaatcgatttctccaagccattcatgagtctgggcatctctatcatgatcaaaaagccccagaaatcaaagcccggggtgttctcatttctggacccgctggcttatgaaatttggatgtgtattgtctttgcatacattggcgtcagtgtagtgctgtttttagtttcacgctttagtccttacgaatggcattcggaagagtttgaagaagggagggatcaaaccactagcgatcagtctaatgagttcggaatcttcaacagtctctggtttagtttaggggcatttatgcagcaagggtgcgatatatcgccacgaagtctgtctggaagaatcgtgggaggtgtctggtggttctttacactgatcattatttcgagctacaccgcaaacttggctgcatttctaaccgtggaacggatggtctcgcccatcgagtccgctgaagacctcgccaagcagaccgagatcgcctacggtaccctggaggcaggttctacgaaggaattcttcaggaggtctaagatagcagtctttgagaaaatgtggacgtacatgaaaagtgccgagcccagcgtgttcgtgcggactactgaagaagggatgattcgcgtgcgaaaatccaaaggcaaatacgcttatctgctggagagtactatgaatgagtacattgagcagaggaaaccctgcgatacaatgaaggtcggaggcaacctggatagcaaaggctacgggatcgctaccccgaagggttccgccctccggggacctgtgaacctggctgtgcttaagctgagcgaacagggggtccttgataaactgaaaagcaagtggtggtacgacaaaggcgaatgcggctctaaggactccggctcaaaggacaagacatccgctctcagtttgagtaacgtggccggggtgttttatatcctgatcggcgggctgggcctcgcaatgcttgttgccctgatcgagttttgctacaagagcagaagcgaatccaagaggatgaagggtttttgcctgattccacagcagtcaattaacgaagccatccgcacgagcacactccctcgaaattccggcgccggggcctcctcaggcgggtcgggcgagaatggccgagtcgtctcacacgattttcccaaatccatgcaatccattccctgcatgtcgcactcgtcaggtatgccactgggcgccacaggcttgtag

SEQ ID NO: 189313 - DNA, 2751 bp, Artificial Sequence
  Description of Artificial Sequence: Synthetic coding sequence
atgtgctgcagcacccacctgttccagcccctgcagctggccggcggcctggagtggccctggtcgaatctgctgtgctttcttacacccgttaagctgcatcctgaggtctgggggttatttcctaatcaacagagtcaggagcatgcggcgtttcgctttgcactgtcgcaacttactgagccccccaagctcctaccccagatcgacatcgtgaacatcagcgacagcttcgaaatgacttaccggttctgttcccagtttagcaagggcgtgtatgcaatctttggcttttatgaacggcgcactgtcaacatgctgactagtttctgtggggccctgcacgtctgttttatcacaccaagcttccctgttgatacttccaatcagttcgttctccaactgaggcctgaactgcaggatgctctgatctccattattgaccactacaaatggcaaaagttcgtatacatctatgacgccgacagaggtctgtccgttctccaaaaagttctggatactgcagcggaaaaaaattggcaagtcacagccgtcaacattctgacaacgacggaggagggatacaggatgctcttccaggacttggagaaaaaaaaggagaggctggttgtcgtggattgcgagagcgagagactgaacgctatcctgggccaaattattaaattagaaaaaaacggtatcggttaccactatattctggcaaacctgggattcatggacatcgatttgaacaagttcaaagaaagcggggccaatgtgaccggattccaactggtaaactataccgacacaattcccgccaagatcatgcagcagtggaagaacagtgacgccagggaccacacacgtgtggactggaagagacccaaatatacatctgcccttacgtatgacggagttaaagtgatggcagaggccttccagtctctacggcgccagagaattgacatatcccgacgcggcaacgccggtgattgcttagcgaaccccgccgtgccatgggggcagggcatcgatatccagagagctttacagcaggtgcgctttgaaggactgacaggcaatgtccaatttaatgaaaaaggacgccggacaaactacacactccatgtgattgagatgaaacacgacggtatccgcaagataggctactggaacgaagatgacaaattcgtgcccgcagccaccgatgctcaggccgggggtgataatagcagcgtgcagaatcgcacttacatagttactactatcttggaggatccttacgtgatgctgaaaaagaatgcaaaccaatttgagggcaatgataggtatgagggctattgtgtggagctggcagccgagatagcgaagcacgtgggctattcataccgacttgagattgtgagtgacggaaagtacggcgcacgggaccccgataccaaggcctggaacggaatggtcggggagctggtgtacggccgggcggacgtggccgttgcacctctcacgattactctggtgcgcgaggaagtgatcgacttctccaaaccatttatgtccctaggaatctcgatcatgatcaaaaagccacagaagagtaagccaggagtctttagcttcttggacccgctcgcctatgagatctggatgtgcattgtcttcgcctacataggtgtgagtgtggttctgtttttggtcagccgcttttctccgtacgagtggcactccgaggagtttgaagagggaagggatcagacaactagcgatcaatctaacgagtttgggattttcaattccctgtggttttctctgggcgcctttatgcagcaggggtgcgatattagcccacgatccttatcggggcgaatcgtcggtggcgtctggtggttctttaccctgatcatcatttcttcatacacagcaaacctggcggcattccttacggtcgagagaatggtcagccccatcgaaagtgctgaagacttggcgaaacaaactgaaatcgcatacggcacgctcgaggcaggttcaaccaaggaattcttccgcaggtccaaaatcgctgtgttcgagaagatgtggacctatatgaagtccgctgagcccagcgtcttcgtgagaaccaccgaggaggggatgatacgcgtgagaaagtcaaaaggaaagtacgcttatcttctcgaatccacaatgaatgaatatattgaacagagaaagccatgcgacacaatgaaggtgggtggaaatctggactccaaggggtacggcattgctacccccaaaggatcagctctgcgcgggcctgtcaatctggctgtgttgaagctgtctgagcagggagtgctggacaaactgaagtcaaaatggtggtatgataaaggggaatgtggctcaaaggactctggctcaaaagataaaacctcagccctctcattaagcaatgtggcaggtgtattctacattctgattggagggctggggcttgccatgctggtcgctctaatagaattttgctacaagagccgatcagaatcaaaacgcatgaaggggttttgcctcatccctcagcagtctataaatgaggcaatccgaaccagcaccctgcccagaaacagcggcgctggcgcgagctccggcggctccggtgagaacggcagggtggtttcccatgatttccccaaatccatgcagagcattccctgcatgtctcatagctccggaatgcctctcggggctacaggcctttag

SEQ ID NO: 189314 - DNA, 2481 bp, Artificial Sequence
  Description of Artificial Sequence: Synthetic coding sequence
atgcagcacatcttcgccttcttctgcaccggcttcctgggcgccgttgtgggagccaatttcccaaataatatccagataggtgggctctttccaaaccagcagagccaggagcatgccgcatttcgattcgcgctatcccagctcacagaacctcctaagcttttgcctcagatcgatattgtcaacatttctgactctttcgaaatgacctatagatgcttatcagtgctgcaaaaggtgctagacaccgctgccgagaaaaattggcaggtgactgccgtgaatatcctgactaccaccgaggagggctataggatgttgtttcaggacttggaaaagaagaaggagagattggtcgtggtcgactgtgagagcgaacggttaaatgcgattcttggccaaatcatcaagctggaaaaaaatgggatcgggtatcactacatactggccaatctgggattcatggacattgatcttaataaattcaaggagtctggggcaaatgtgaccgggttccagctggtgaactacactgacactattcccgctaaaatcatgcagcaatggaagaactctgacgcccgagaccacactagagtggattggaagagaccaaaatacacatcagcccttacttacgatggggtaaaggtgatggcagaggcattccagagtctcaggcgccagcggattgatattagccgccgcggcaacgcgggggattgcttggctaaccctgcagtcccttggggccagggtatcgatatccaacgtgcgctgcaacaggtccgctttgagggactcaccgggaatgtccagtttaatgaaaagggtcggcgaactaactacacactgcatgtaattgagatgaagcacgatgggattcgcaaaataggatactggaacgaggacgataaattcgtgcccgccgcgaccgatgctcaggcgggtggcgataattcctcggtgcagaatcgtacctatatcgtgacgactatcctggaggacccctatgttatgctgaaaaagaatgccaatcaatttgagggaaatgaccggtacgagggttattgcgtggaattagcggccgagatcgccaaacacgtggggtattcttacaggctggaaatcgtcagcgatggaaaatatggtgcacgggaccccgacacaaaggcttggaatggaatggtaggggagctggtgtatggtcgagccgacgtggccgtagcgccactgactatcaccctggtgagagaagaggtgatagactttagtaaacccttcatgagcctgggcatcagcataatgattaaaaaaccacagaagagcaagcccggcgtctttagtttccttgatcctctcgcttacgagatctggatgtgcatagtgtttgcttacatcggagtttctgttgtgctgttcttagtgtcgcggttttctccttacgagtggcactctgaagaattcgaggagggccgcgaccagacaactagcgaccagtctaacgaattcggtatcttcaattcactgtggttttctctgggggcatttatgcagcaaggctgcgatatcagccccagatccctttctggcaggatcgttggaggtgtctggtggttcttcactttgataatcatatcgagttatactgccaacttggcagcgttcctcaccgtggaacgcatggtttccccgatcgaaagcgcagaggatctggcaaagcagactgaaattgcgtatggaacgctggaagctgggagcacaaaagagttttttcggagatccaagatcgccgtgtttgaaaaaatgtggacttatatgaaatctgctgagcccagcgttttcgtacggacaacagaagaaggcatgatacgggttagaaagtctaaagggaagtacgcctatctactggagagtaccatgaatgagtacatcgagcaacggaagccctgtgatacaatgaaggtgggtggcaatcttgattctaagggctacgggatcgccacgcccaagggcagcgctctgcgcaaccctgtcaatttggccgtgctgaaacttaacgaacagggccttctcgataagctgaagaataagtggtggtacgataaaggggagtgcggatcaggaggcggcgatagcaaagataaaacctcagcactgtctctcagcaacgttgcaggcgtcttttatatattgattggcggcctcgggcttgcaatgttggtcgcattgatcgaattctgttataaatctcgctccgagagcaaacgaatgaagggattctgcctgatacctcagcagtcgatcaatgaggcgattagaacctccacactgcctcgtaattctggcgccggggcatctagtggtgggtccggagaaaatggcagggtagtatcccacgatttcccgaagtccatgcagtccattccatgtatgagtcactctagtggcatgccactcggcgcaactgggctttag

SEQ ID NO: 189315 - DNA, 2751 bp, Artificial Sequence
  Description of Artificial Sequence: Synthetic coding sequence
atgtgctgcagcacccacctgttccagcccctgcagctggccggcggccttgagtggccatggtcaaatttactttgtttccttaccccagtaaagttgcacccagaggtgtgggggctgttccctaaccaacagagccaggagcatgcagcattccgattcgctctctcccagctgactgaacctcccaagctgctgccccaaatagacattgtcaatatcagcgacagcttcgagatgacctatcgattttgcagccagttttccaagggagtctacgccatctttgggttctacgagaggagaaccgtgaacatgctgaccagcttttgcggggcacttcacgtctgtttcatcacgccttcgtttcctgtcgatacatcaaatcagttcgtcctgcagcttcgacctgagctgcaagatgctttaatttctattatcgaccactataagtggcagaagtttgtctatatctatgatgccgaccgtggcttaagtgtgctgcagaaagtactagacacggccgcggaaaagaactggcaggtaaccgccgtaaacattctcacaacaacagaggaggggtaccgaatgctcttccaggatcttgagaagaagaaggagaggttagtggtagttgactgcgagtccgaaaggctgaatgcaattctgggccaaatcatcaagttggaaaaaaacggaattggatatcactacatcttggccaacctgggcttcatggatatagacctgaataaattcaaggagtccggcgccaacgtgacagggtttcagctcgttaattataccgacacaatccctgccaagataatgcagcagtggaagaatagcgacgcccgggatcatactcgcgttgattggaagcggcccaaatacacctccgctctgacctatgatggcgtcaaggttatggccgaggctttccagagcctcagaaggcagcggattgacatctcccggaggggaaacgcaggggactgcctggccaacccagccgtgccatggggccaagggatcgatatccagcgcgccctgcagcaggtaaggttcgaaggtctgactgggaatgtccagttcaatgaaaagggcaggcgcactaactacactctgcatgtcatagagatgaagcatgacggaatacggaagatcggctattggaatgaagacgataaatttgtgccagctgccacagatgctcaggccggcggagacaactcatccgtgcagaatcgaacttacatagtgaccactattctggaagatccctacgttatgttgaagaagaacgctaatcaatttgagggaaatgatcgatacgaaggttactgcgtggagcttgctgcggaaatcgcgaagcatgtgggatatagctacaggctggagatcgtttccgatgggaagtatggggcacgcgacccagatacaaaagcatggaacggcatggttggagagctggtctatggtcgggccgatgtcgccgttgctccgctgacgatcaccctcgttcgggaggaagtaatagatttctctaaaccttttatgagcttgggcatctcaataatgataaagaagcctcagaaaagtaagccaggagttttttctttcctggaccccctagcttatgagatttggatgtgcatcgttttcgcctatataggggtgagtgttgtcctcttcttagtttcacggttttcgccatacgagtggcacagcgaggagtttgaggaaggcagagaccagacaactagtgaccagtccaatgagttcggaatctttaactcactgtggttttcactgggcgcctttatgcagcaaggctgcgacatctccccccggtcccttagcgggcgaatcgtgggtggggtatggtggttcttcacgttgatcatcatcagctcatatacggctaatctcgcggctttccttacggtggaaagaatggtgtcaccaattgagagcgcagaagacctggcaaagcaaaccgaaatcgcttacggcactctggaggctgggagtaccaaagagtttttccggagaagtaaaatcgccgtgtttgagaagatgtggacctatatgaagtccgcagagccttcagtgttcgtgagaactaccgaagaggggatgataagagttcgtaaaagtaagggtaaatacgcctaccttctggaatccacaatgaacgagtacatcgagcagaggaagccctgcgacacaatgaaggtgggtggaaatctggatagcaagggctacggaatcgcaacacctaagggcagcgccctgagaaaccccgtgaatctcgccgttctgaagctcaacgagcaaggactgctggataaactcaaaaataagtggtggtatgacaaaggtgagtgtggtagcggaggtggggactcgaaagataaaactagtgccctctctctgagcaacgtagctggagttttctatatccttataggcggactaggcttggccatgcttgtggcactcattgagttctgctacaaatctagatctgagagcaaacgcatgaagggattttgtcttatcccccaacagtccattaacgaggccataaggaccagtaccctgccgagaaactcaggtgccggcgcatcttccggtggttccggagaaaatggtagggtggtgtcccatgatttccccaagtccatgcagtcaattccttgtatgagccatagttcagggatgcccctgggcgcaacaggtctgtag

SEQ ID NO: 189316 - DNA, 2151 bp, Artificial Sequence
  Description of Artificial Sequence: Synthetic coding sequence
atgcagcacatcttcgccttcttctgcaccggcttcctgggcgccgttgtcggcgcgaacttcccaaacaatatccagatcgtgtgctcacagttctcaaagggagtgtacgctatcttcggcttttacgagcgaaggactgtcaacatgttaacatctttttgcggcgcgctgcacgtttgctttattaccccttcctttcccgtggatacttcaaatcagttcgttcttcagctgaggcctgagttgcaggatgcacttattagcatcatcgatcattacaaatggcaaaagtttgtgtacatctacgacgccgatcgcggactaagcgtcttacagaaagttctcgacactgcagccgagaagaattggcaggttaccgcagtgaacatcttgaccacgaccgaggaaggttaccgcatgctgttccaggatctggaaaagaagaaagaacgcctggtagtggtggactgcgaatcagaacgcctgaatgcgattctcggtcagatcattaagcttgagaagaatggcattggctaccactacatcctggctaatctgggctttatggatattgatctgaacaaatttaaggagagcggggccaacgtgaccggttttcagctggttaactacacagacactatcccagcaaaaatcatgcagcagtggaagaatagcgatgcgagggatcataccagggtagattggaagcggcctaagtatacttccgctctgacctatgacggtgtcaaggtcatggccgaagcgtttcagtcgctgcggagacagaggattgatatttcaagacggggcaatgccggtgattgcctggccaatcctgctgtgccgtggggacagggcatcgatattcagcgtgcactccagcaggtgcgctttgaaggcctaactggtaatgtgcaatttaacgaaaaaggcagacgaacaaactacactcttcacgtcatagagatgaagcacgatggcatccgaaagattggctactggaatgaagatgacaagttcgtccccgccgctacagatgcacaggcgggtggcgataatagcagtgttcagaatcggacatatatcgttacaacaatactggaagacccatatgtcatgcttaagaagaacgcaaatcagtttgaaggcaacgaccgttatgaaggatactgtgttgaactagccgcagaaatcgctaaacatgtgggctacagctacagacttgagatcgtttccgacggaaagtatggtgcacgggatcctgatacgaaagcgtggaatgggatggttggtgaattggtatatggacgagctgatgtagcagtcgcccctctcactattaccctagtcagggaggaggtgattgattttagcaaaccctttatgagcctgggcatttccatcatgataaaaaagccacagaagtcaaagcccggcgtcttttcctttctcgatccattggcgtacgaaatttggatgtgcatcgtgtttgcctatattggcgttagtgtagtgctgttcctcgttagccgcttttccccttatgagtggcactctgaggaattcgaagagggtcgggaccagactacgagtgaccagtccaatgagttcggcatctttaattccttgtggttctccctgggcgcctttatgcagcaaggatgtgatatcagcccacgatcgctgagtggccggatcgttggaggagtgtggtggtttttcaccctgattattatctcgtcttacaccgccaatctggctgctttccttacagtcgagagaatggtttctcccatcgagagcgcagaagatctggccaaacagacagagatagcctatggtacgcttgaggcgggttcaacgaaggagttcttccgtagatcaaagattgctgtgtttgagaaaatgtggacatacatgaaaagtgccgaaccttccgtgtttgtcaggaccactgaagaaggtatgattcgggtccgcaagtccaaaggcaagtatgcctacctgctcgaatcaactatgaatgagtacatagaacagaggaaaccctgcgacactatgaaggtaggaggcaatcttgattcaaaagggtacgggatcgcgacaccaaaaggctccgccctccgaactcgacaggctttgtag

SEQ ID NO: 189317 - DNA, 2721 bp, Artificial Sequence
  Description of Artificial Sequence: Synthetic coding sequence
atgcagcacatcttcgccttcttctgcaccggcttcctgggcgccgtcgtgggagctaacttcccaaacaacatccagatcggcggcctgtttccgaaccagcagtctcaggagcatgctgcatttaggttcgccctgtctcagctaactgagcctcctaaactgcttcctcagattgatatcgtcaacataagcgacagcttcgagatgacatatagattttgcagccagttcagtaagggggtctacgctattttcggattctatgagagacgcaccgtgaacatgttgacctcattctgcggtgctctgcacgtgtgctttatcacgccttcctttcccgtggacacctcaaaccagtttgtgctgcagctgaggccggagctgcaagatgcgctgattagcatcatcgatcactacaaatggcagaagtttgtttatatctatgacgccgatcggggcctttccgttctccagaaagtcctcgacaccgcagcggagaaaaactggcaagtgaccgccgtgaacattctgacaactactgaggaaggctatcgtatgctcttccaagacctggaaaagaaaaaagaacgattagtcgtcgtagactgtgaatccgagaggctgaacgccatactcggccagatcatcaagctagagaaaaatggcataggttaccactatattttagcaaatctgggattcatggatatcgacctcaacaagttcaaagagagtggcgccaacgtcacggggttccagctggttaactacaccgacaccattcctgctaagataatgcaacagtggaagaattctgacgcccgagaccacacgagagttgactggaaaaggcccaagtatacctcggccctgacgtatgatggagtgaaggtgatggccgaagcctttcagagcctgagacggcaacgcatcgacatctccagaagagggaacgctggtgattgtttggccaatcccgccgtcccctggggccaggggatcgacatccagagagccctgcagcaggtgaggttcgagggccttaccggcaatgtacagttcaatgaaaagggtcgccgcaccaattataccttgcatgttattgagatgaagcacgatggaattcgcaagataggctattggaacgaggatgacaagttcgtgccagctgctactgacgcgcaggccggcggggacaattccagcgtgcagaaccgaacttatatcgttacaacaatcctcgaggacccatacgtcatgctgaaaaaaaacgccaaccagttcgagggtaacgataggtatgagggttactgcgtggagctcgccgcggagatagccaaacatgtcggctacagttacagactggaaatagtgtccgatgggaagtacggagcacgggatcctgacactaaagcctggaacggcatggtgggtgaattggtttacggccgggccgatgtggctgtagctcccctcacaataacattagtaagagaggaagtcattgacttttcaaagccttttatgtccctgggcatctcaatcatgattaagaaaccacagaagtccaaacctggtgtcttctctttcttggacccgctggcatacgaaatttggatgtgtattgtgttcgcatacataggcgttagtgtggtgctctttttggtctcaagattcagtccttatgaatggcatagtgaggagtttgaggagggcagggaccagactacctcagaccagagtaacgaatttggcatttttaactccttatggttctcacttggggcattcatgcagcagggctgcgatattagcccgaggtcattgtctggccgcatagtgggaggcgtctggtggttcttcaccttaataatcatttcctcatatactgcaaatctggcggcgttcttgactgtggagcgtatggtctctccaatagaaagtgcagaggatctcgcaaagcagacagagattgcatacgggactctcgaagccggatcgaccaaggaattcttccgccgttcaaagattgccgtgtttgagaagatgtggacctacatgaagagcgcagagcccagcgtcttcgtccgcaccacagaagaggggatgattagggtgcgaaaatcgaagggtaagtacgcttacttgctggagtctacaatgaatgagtacattgagcagcgtaagccgtgcgacactatgaaagtgggcggcaatctcgattcaaaggggtatgggatcgctacacctaagggatccgccctgcggggtcccgtaaatttggccgttttgaagctgtcagaacaaggggttctggataaactaaagtctaaatggtggtacgataagggcgagtgcggctcgaaggacagtggttcaaaggacaagacctccgcactatctctgtcgaatgtggccggggtattctatattctcatcggaggacttggcttggctatgctcgtggcccttattgagttctgctataaatcacgctctgagagtaagcgaatgaagggcttttgtctgattccacagcagtctattaatgaagccattcgcacatctacactgcctaggaattcaggcgcaggcgcctcaagcggtggctccggtgaaaacggaagggttgtttcgcacgacttccccaaatcaatgcagagcattccatgtatgtctcattccagtggtatgccactcggagccaccggtttgtag

SEQ ID NO: 189318 - DNA, 2514 bp, Artificial Sequence
  Description of Artificial Sequence: Synthetic coding sequence
atgacctaccggttctgcagccagttcagcaagggcgtgtacgccattttcggtttctatgagaggcgaaccgtcaacatgctcacatctttttgtggagccctccacgtgtgttttattactccttcattccccgtggacacatctaaccaattcgttttgcagcttcgcccagagttgcaggacgcactgatcagcatcattgaccactataagtggcagaagtttgtctacatatatgacgccgatcggggcctgtccgtgctgcaaaaagtactggatactgcggctgagaaaaattggcaggttactgcagtcaatattctcaccactaccgaggaaggatacaggatgttgttccaagacctggagaaaaagaaagaaagacttgtggtcgtcgactgtgaatccgagagactgaatgctatcctggggcaaattatcaaattggagaaaaacggtatcgggtatcattacattctcgcaaatttgggatttatggacattgatctgaataaatttaaggaatctggtgccaacgttaccggctttcagttagtcaactacactgatacaatccccgcaaagataatgcaacagtggaagaactcagacgctagggatcatacaagagtagattggaagaggccaaagtacactagtgccctgacatatgatggagtaaaagtgatggctgaagcctttcagagcctgagacggcaaaggatcgacatcagccgtaggggaaatgcaggcgattgcctggcaaaccccgctgtgccttggggacagggcatagatatccagagagcgctccaacaagtaagatttgagggcctcaccggaaacgttcagtttaatgaaaaagggaggagaaccaactacacgctacatgtaattgaaatgaagcatgatggcatcaggaaaataggctactggaatgaggatgataaattcgttcctgcagcaacagatgcacaggcagggggggataattccagtgtgcagaacaggacctatatcgttacaactattctggaggacccatacgtgatgcttaagaagaacgctaaccagttcgaagggaacgatcgatatgagggctactgcgtagagctcgctgccgagattgccaagcacgtggggtatagctacagacttgaaatcgtgagcgatggcaagtacggagcccgcgaccccgatacaaaagcctggaatggaatggtgggagaacttgtgtatggaagagccgatgtcgctgtggcccccctgactattacgctggttcgggaggaggtcatcgacttctctaagccgttcatgtctctcggaatttctattatgatcaagaaaccccagaaatccaagccaggcgttttttccttcctggaccctctagcatatgaaatttggatgtgtatagtgttcgcttacattggagtgtccgtggtgctgtttctggtgagccgcttttctccctacgagtggcatagtgaagagtttgaggagggtagggatcagactacgtctgaccagagcaatgaatttggcatcttcaacagtctttggtttagtcttggcgcctttatgcaacagggatgcgatattagcccccgcagtctgtcaggcagaattgttgggggtgtgtggtggttcttcaccttgatcatcattagcagctatactgctaatttggccgcatttcttactgttgagcggatggtgagccccattgaaagcgccgaggatcttgccaagcaaactgagatcgcctatggcactctcgaggccggctctacaaaggaatttttcagacgttcaaaaattgccgtgtttgagaagatgtggacctacatgaagagcgccgaaccgagcgtctttgtgagaaccacagaagaaggcatgatacgtgtgcgcaagtcgaagggcaagtacgcatacctgttggagtcaacgatgaacgagtacatcgagcagcgtaaaccttgtgacaccatgaaggttggcggcaaccttgatagtaagggatatggaatcgcaaccccaaaaggatcggccctccgcaaccccgtgaacctggctgttctgaagctgaatgaacaaggtctgcttgacaaactgaaaaacaagtggtggtatgataagggggagtgtggaagtggcggtggcgactcgaaagacaagacaagtgctctcagtctcagcaacgtggccggagttttctacatccttatcggtggcctcggcctggccatgctcgtcgctctcatagagttctgttacaaatctcgaagtgaatcaaagcgcatgaagggtttctgcctgattccccagcagtcgatcaacgaggccatccgaacatctaccctcccccgcaactccggagcaggagctagctctggcgggagcggagagaacggtagggtggtgtcacatgactttcctaaaagtatgcagagtatcccatgcatgtcccacagctccggcatgccactgggtgcaacaggactttag

SEQ ID NO: 189319 - DNA, 2652 bp, Artificial Sequence
  Description of Artificial Sequence: Synthetic coding sequence
atgcagaagatcatgcacatcagcgtgctgctgagccccgtgctgtggggtctgatctttggcgtaagcagcaacagcattcagattggcgggctttttccccggggtgccgaccaggaatactccgcattccgggtggggatggtgcaatttagtacaagcgaattcagattgacaccccacatcgataatctggaagtggctaattctttcgctgttaccaacgcgttttgttcacaattttcacgaggcgtttacgctatctttggtttctacgacaaaaaaagtgtgaacactattacatccttttgcggcactctccatgtatcattcatcacaccttcatttccgacggacggaacacaccccttcgtcatccagatgaggcccgacttgaagggcgccctgctgtcccttatcgaatactaccagtgggacaagtttgcctatctctacgactctgaccgcggtttgtcaactctgcaagcagtactggattctgccgcagaaaaaaagtggcaggtgacagctattaatgtaggtaacattaacaatgacaaaaaggacgagatgtatagatctctgttccaggatttagagcttaagaaagagcgccgggtgatactggactgtgaaagagacaaagtgaacgatattgtggaccaggtgatcactataggcaagcacgtcaaagggtatcactatattatcgctaacttaggcttcacggatggggatttgctgaagattcagttcggaggtgcaaatgtgtcaggttttcagattgtcgattacgacgactctctggtcagtaagttcattgaaaggtggtcgacacttgaagagaaggaatacccgggggcacatactactactattaagtacacatcggcccttacttatgacgccgttcaagtgatgacggaggctttcagaaacctgcgaaaacagcgtattgaaatctcacgcagaggaaatgcgggggattgcctggcgaaccccgctgtgccgtggggccagggggttgaaatcgagcgggccctgaaacaggtacaggttgagggcctctcaggcaatataaaattcgatcaaaacggtaaacgcattaattatacaattaacataatggaactaaagacaaacggacccaggaaaattggatattggtcagaagttgacaaaatggtggtaacccttacagagttacccagtggtaatgatacgagtggcctggagaacaaaaccgtggtcgttaccacaattctggaaagcccatatgtaatgatgaaaaaaaatcacgaaatgttggaggggaatgaaaggtacgaaggctattgtgtggatctggcggcagagatcgccaaacactgcggatttaaatacaagctgaccattgttggcgatggcaagtatggcgcccgcgatgccgacaccaaaatatggaatggcatggtgggcgaattagtgtacggcaaagctgacatcgcaatcgccccactcaccattaccttggtccgagaagaggtcatcgactttagtaagccttttatgtcgctagggatatcaattatgattaagaagccccagaaatcaaagcccggcgtattttcattcctggatcccctggcatatgagatctggatgtgcatcgtttttgcttatattggcgtttctgtggtgctctttttggtgagccggttctcaccctacgagtggcacactgaggagttcgaggacgggcgcgaaacgcagtcctcggaatcaacaaatgaatttggaatctttaactcgctgtggttttctctcggcgcttttatgcagcaaggttgcgacatctcccccagatcactgagcgggcgcattgtgggcggggtgtggtggttctttacactgatcattatcagctcctataccgcaaatcttgccgcttttcttaccgtggaaagaatggtcagtccaatcgagagtgcagaggacttaagcaaacagactgaaattgcatatggtaccctagattcaggaagcactaaagaattttttcgaagaagcaagatcgctgtgtttgataagatgtggacatacatgcgcagtgcagaaccctctgtttttgtgcgaactactgccgagggcgtcgctcgggtcagaaagtccaaaggcaagtatgcatatctcttagaaagcactatgaatgagtatatcgaacagagaaaaccttgtgataccatgaaggtggggggcaatcttgacagcaagggatacggcatcgccacccccaaagggtcgtccctacgcaacgccgttaatctcgctgtgctgaaactgaatgaacaggggctgctcgacaagctcaagaacaagtggtggtatgacaagggggagtgcggctcgggggggggggactctaaggagaagacgtccgccttatctctgtccaatgtggcgggggtcttctatattctcgtgggcgggttgggcttggcaatgttagtggccctcattgagttctgctataagtccagggcagaggccaagcggatgaaggtcgcaaaaaacgcccaaaatattaatccaagctcgtcacagaacagccaaaactttgctacctacaaagaaggatataatgtgtatggaatcgagtctgtgaagatatag

SEQ ID NO: 189320 - DNA, 2652 bp, Artificial Sequence
  Description of Artificial Sequence: Synthetic coding sequence
atgcagaagatcatgcacatcagcgtgctgctgagccccgtgctgtggggcctgatcttcggggtgtcaagcaacagcattcagatcgggggccttttcccgcggggggccgaccaggagtattccgcttttagagttgggatggtgcagttctccacctctgagttcagactgacacctcacatcgataaccttgaggtcgccaacagtttcgccgtcaccaacgccttctgcagtcagttctcccgaggggtctacgctattttcggcttctatgacaagaagagtgtgaatactattacgtcattctgtggaacactgcatgtgagcttcatcactccctccttcccgacagatgggactcaccccttcgtgatccaaatgcgaccggacttgaaaggagctcttctgagcctcattgagtattaccagtgggataagttcgcgtatttatatgactcagatagaggactctcaaccctgcaagccgtgctggattcagcggccgagaagaaatggcaggtaacagccatcaacgtcgggaatattaacaatgacaagaaggatgaaatgtatcgaagcctgttccaggatttggagttaaaaaaggaacggagagtcatattagattgtgaacgcgataaagtgaacgatattgtcgaccaggttattacgattggaaaacacgtcaagggttatcattacatcatcgcaaacctaggatttactgacggtgacctccttaagatccagttcgggggcgccaatgtcagcggattccagattgtggactatgacgacagcctggtgtccaagtttatcgaacgctggagcaccttggaagagaaagagtacccgggcgcccacacaaccacaatcaaatacacatcagcattgacctacgacgcagttcaggtcatgaccgaggccttccgcaatcttagaaaacagaggattgagatcagccgcagagggaacgcgggggattgcttggccaaccccgctgtgccttggggtcagggcgtcgagatcgaacgggccttgaaacaggtgcaggtagaagggttgtcgggcaacattaagtttgatcagaacggaaagaggattaactatacaattaatattatggaactaaaaaccaacgggccaagaaagattggctactggtcagaggtggataaaatggtcgtgaccctgacggagttgcctagtgggaacgatacctcagggctggagaataagaccgttgtggttacaacgattctggagtctccctatgtcatgatgaagaagaaccatgagatgctagagggtaatgagagatacgaaggttattgtgtggatttagcggcggagattgccaaacattgtggcttcaagtataaattaacgatcgtaggagatgggaagtacggggctcgtgacgctgacacaaagatctggaacggcatggtgggcgagctcgtgtacggtaaggctgatatagcaatcgctcctctgacaatcacactcgtgcgggaggaagttatagatttcagcaagccatttatgagcttgggaatctctattatgattaaaaaaccccagaagtccaagcctggggtgtttagtttcttggatcccctcgcttatgaaatctggatgtgtattgtcttcgcttacatcggggtatctgtggtgctctttctggtcagcaggttctcaccttatgagtggcacaccgaggaattcgaggatggccgggagacacagagctcagagagcactaatgagtttggaatctttaattctctgtggttttctcttggagcatttatgcagcaaggttgcgatatatccccccgctctctgtccggtcgaatagtcggcggggtgtggtggtttttcactttgatcattatcagcagttatactgccaacctcgctgctttcttgactgttgaacgcatggtgagccctatcgaatcagccgaggacttgtcaaaacagacagaaatcgcctacggcacccttgacagcggctccacaaaagagttcttccgaaggagcaaaatcgctgttttcgacaagatgtggacatacatgcggagtgccgagccatcagtgttcgttagaacaacagccgagggcgtggcccgcgtgcggaagagcaagggtaagtacgcctatttacttgagtccacaatgaacgagtatattgagcagcgcaagccctgcgacactatgaaggtcggggggaatctcgactccaaggggtatggaattgccacccccaaagggtcctccctcagaacaccagtgaatttggcggtgttgaaactttcagaacagggggtgcttgataagctgaaaaataagtggtggtacgataaaggtgagtgcggcgccaaggactctgggtctaaggaaaagaccagcgcactgtccctatctaacgtagccggagtgttctacatcctcgttggaggtctcggactggcgatgctcgttgcgctgatcgagttttgctataagtcgcgtgccgaagcgaagcgtatgaaagtcgctaaaaatgcacagaacatcaatccaagctctagtcagaactcacaaaactttgcaacctacaaggagggatacaatgtctacgggatcgaatccgtgaaaatttag

SEQ ID NO: 189321 - DNA, 2193 bp, Artificial Sequence
  Description of Artificial Sequence: Synthetic coding sequence
atggtgcagttcagcaccagcgagttccggctgaccccccacatcgacaatctggaggtggccaattcattcgccgtgaccaatgctttttgttcgcagttttcgagaggcgtgtatgccatctttgggttctatgacaagaagtccgttaacacgattaccagcttctgcgggactcttcacgtctctttcataacacccagctttccaaccgatggaactcacccattcgtgattcagatgcgccctgacctgaaaggcgcactactttctctaatcgagtactatcagtgggacaagttcgcgtatctgtacgacagtgatcgcggcctctcaacactccaagccgttctggattcagcagctgagaaaaaatggcaagttacagccataaacgttggtaacatcaacaatgacaaaaaggacgagatgtaccgatccttatttcaggacctcgaactgaaaaaggagcgccgtgtgattctcgattgcgagcgggataaggtgaatgatatagtcgaccaggtaattaccattggcaagcacgtgaaggggtatcattacataattgctaatttgggcttcaccgacggtgatctgttgaaaatacagtttggcggcgccaacgtgtcaggctttcagatcgtggattatgatgattctcttgtgagcaaatttatcgagcggtggtctaccctcgaggagaaagaataccccggggcccatacgacaactatcaaatacacttccgccctcacttacgacgccgtacaggtcatgacggaggccttcaggaatctgcggaagcaaagaatcgaaatcagccggcggggcaatgctggcgattgcctcgcgaacccagcagtgccctggggccagggtgtcgagatcgagcgggcccttaaacaagtacaagtggagggtttatccggaaatattaaatttgaccagaacggcaaacggattaattatacaatcaacatcatggagctgaagaccaacggacctagaaagattgggtattggagcgaagtagataaaatggtggtgactctcaccgagctgcccagcggaaacgacaccagtgggctcgaaaataagacagtagtcgtgacaacaatcctggagtcgccgtatgtaatgatgaaaaaaaatcatgagatgctcgaggggaacgagagatacgagggatactgtgtagacctcgctgccgaaattgctaaacactgcggtttcaagtacaagctcactattgtcggcgacgggaagtatggggctcgggacgcagatactaaaatctggaatgggatggtcggggaactggtctatggcaaagctgacatcgcgatcgctcccctgacaatcactctggtgagagaggaagtcatagatttcagcaagccctttatgagtctgggaattagcatcatgatcaaaaagccacagaaatcgaaacctggggtttttagtttcttggatcccctggcctatgaaatctggatgtgcatagtttttgcttacattggggttagtgttgttctgtttctcgtctcacgcttcagcccatatgaatggcataccgaagagtttgaagatgggcgggagactcaaagctcagaaagcactaacgaattcgggatatttaattccttatggttttcactgggcgcctttatgcagcagggctgcgacatttccccaaggtctctgagtggtcggattgtaggaggcgtgtggtggttttttactctcattattattagctcatatacggctaacctcgccgccttcttgacagtggagaggatggttagtccaatagaatctgcagaagacctgagcaagcaaacagaaatcgcttatggaacacttgactcaggctccacaaaggaattcttccgcaggagcaaaatcgcagtattcgataaaatgtggacgtatatgcgctcagctgagccatccgttttcgtgcgcaccaccgccgaaggcgtggctcgcgtgcgtaaaagcaaagggaagtacgcgtacttgttagaaagcactatgaacgaatacatcgagcagcggaaaccgtgcgatacaatgaaagtcggcgggaacctggactcaaagggctacgggatagcaacacccaagggctcctctctgagcggagtcacatttaagacacttttatttgtttgctgtggctag

SEQ ID NO: 189322 - DNA, 297 bp, Artificial Sequence
  Description of Artificial Sequence: Synthetic coding sequence
atgaacgagtacatcgagcagcggaagccctgcgacaccatgaaggtgggaggcaatctagactctaagggctacggtatcgcgactccaaagggctcaagtctttccggcgttacttttaaaactttgatatgcctattatggataaatgccgtaaacttagcagtgctaaagttaaacgagcaaggtttgcttgacaagctaaagaacaagtggtggtatgacaagggcgaatgcggatctggtggcggcgattccaaaaatcctagtaagtcctgttctatagagactcagtag

SEQ ID NO: 189323 - DNA, 2511 bp, Artificial Sequence
  Description of Artificial Sequence: Synthetic coding sequence
atggtgcagttcagcaccagcgagttccggctgaccccccacatcgataatctcgaggtcgccaacagcttcgctgtgactaacgcgttctgttctcagtttagtagaggggtgtatgctatttttggcttttatgacaaaaaatctgtcaacaccatcaccagcttctgtggcacgctgcatgttagctttatcacgcccagcttccctactgacggcacccatccatttgtgatccagatgcgcccagatctaaagggagcactactgtcattgatagagtactatcagtgggataaatttgcctatctctatgattccgatcgggggctgagtactttacaggccgtcctggactccgctgccgagaagaagtggcaggtcactgcaattaatgtggggaatattaacaatgataagaaggatgaaatgtacagaagcctgtttcaggacctcgagctgaaaaaggagcgcagggtaatcctggactgcgaaagggataaggtcaatgacatcgtggatcaagtaataaccataggaaaacatgtaaagggatatcattatattatagcaaacctgggattcactgacggcgatttgctcaaaatccaatttggcggagctaacgtctctggtttccagatcgtcgactacgatgattcactggtttccaagttcatagagcgttggagcacgttggaggagaaggagtaccccggcgcccataccactaccatcaagtacacctctgcccttacgtatgatgcggtgcaggtgatgactgaggccttccgcaaccttagaaagcaacgcattgaaatctcacggcggggcaacgccggagactgtctggcgaatcccgcagtgccttgggggcagggtgtggaaatcgagcgagcgctcaaacaggttcaggtggaggggttgtcagggaacattaaattcgaccaaaatggaaaaaggattaactacaccataaacataatggagctgaagacaaatggaccaagaaagatagggtattggtcagaagtggacaagatggtagttacgttgacggagctaccatcaggcaatgatacctcaggcctggaaaacaagactgtggtggtcactacaatcctcgaatccccctacgttatgatgaaaaagaatcacgaaatgctggaggggaacgagaggtatgaaggatactgcgttgatttggctgccgagatagccaaacactgtggctttaagtataaactcaccatcgttggcgacggcaagtatggagctagggacgctgatactaaaatctggaacggtatggtgggagaactcgtgtacggaaaagctgatatagccatagcacccctgactataactctggttcgcgaagaagtgatcgacttttccaagccattcatgagtttggggatctccatcatgattaagaagcctcagaagtccaagcccggggttttctcattcctcgaccctctggcctatgagatctggatgtgtatcgtgtttgcctacatcggagtttcggttgtgctgttcctggtatccagattttcaccctacgaatggcacacggaagagttcgaagatgggcgggaaacacaatcttccgagtctacaaatgaatttggtatctttaacagtctgtggttctctctaggagccttcatgcagcagggctgtgacatcagccctcggtctcttagtggtagaatcgttggaggagtgtggtggttcttcacactgataattatctcatcctacactgcaaacctcgccgcctttttaactgtggaacgtatggtatctcccatcgagagcgccgaggacctgagcaagcaaactgaaatagcctacggcacactggactccggcagtacaaaggaattctttagaaggtcgaagatcgctgtgtttgataagatgtggacctatatgcggagtgctgaacccagtgtgttcgtgcggactaccgctgagggcgtggctcgggtgaggaagtctaaggggaaatatgcttacctactagagtcgacaatgaacgagtatatagagcaacgtaaaccgtgcgataccatgaaggtggggggcaacctcgacagtaagggttatggaatcgctaccccaaaaggttcctcactgcgtacccccgtgaacctggctgttctgaagctcagtgagcagggcgtcctcgacaagcttaaaaataagtggtggtacgacaagggagaatgcggggctaaagactccggtagcaaagagaagacatcagcgctgtcgctgagcaacgtcgccggtgtgttctatatcctcgtcggcgggcttggactggccatgctggtggctctgattgagttttgctacaaatcccgggcggaagcaaagaggatgaaagttgccaagaacgcccagaacattaacccatccagcagtcagaacagccagaactttgccacatacaaagaggggtacaatgtctatggcatcgaatcagtcaaaatctag

SEQ ID NO: 189324 - DNA, 438 bp, Artificial Sequence
  Description of Artificial Sequence: Synthetic coding sequence
atggtgcagttcagcaccagcgagttccggctgaccccccacatcgacaatctagaagtggctaattcttttgcggttacaaatgccttttgcagtcaatttagcagaggggtgtacgccatcttcgggttttatgataagaagtctgtgaacacgattacttccttttgcggtacactccacgtttccttcatcaccccatcgtttcctactgacgggacccatcctttcgtgattcagatgagaccagatctcaagggcgccctgctgtctttgattgaatactaccaatgggacaagtttgcctatctttacgatagcgaccgcggcctctcaactctgcaggccgtactggattcagcagcggagaaaaaatggcaggtgacggccattaatgtgggaaacattaacaacgataagaaagacgagatgtactag

SEQ ID NO: 189325 - DNA, 174 bp, Artificial Sequence
  Description of Artificial Sequence: Synthetic coding sequence
atggtgcagttcagcaccagcgagttccggctgaccccccacatcgacaacctggaggtggcgaatagctttgcagtcaccaatgctttctgttctcagttcagtcggggggtttacgccatctttggattctatgacaagaaaagcgtcaacacaataactagcttttgctag

SEQ ID NO: 189326 - DNA, 2511 bp, Artificial Sequence
  Description of Artificial Sequence: Synthetic coding sequence
atggtgcagttcagcaccagcgagttccggctgaccccccacatcgacaatttggaggttgccaatagtttcgctgtcactaacgccttctgcagtcaattttcacgcggggtttacgccatatttgggttttacgacaagaagtctgttaacacaatcacctcgttctgtggcacccttcacgtttcttttatcaccccctcttttcccactgatgggacccatccctttgtgatccagatgcgaccggatctcaaaggggctctgctgtcattgatagagtactaccagtgggataagttcgcctatttgtatgactccgataggggtctgtccacattgcaggcagtgctggatagtgctgcagagaagaaatggcaggtaaccgcaattaacgtaggaaacattaacaacgacaagaaggatgaaatgtaccggtccctttttcaggatctggagctgaaaaaagagcgcagggttatcctggactgtgagcgcgacaaggttaacgacattgtcgaccaagtcattactattggcaagcatgtcaagggatatcattatattattgcaaaccttgggtttacagatggggacctgctcaagatacagttcggcggcgctaacgtcagtggcttccagattgtagactacgacgacagtctggtgagtaaattcatcgagcgttggtccaccctcgaggagaaggagtacccgggggctcacactactacaatcaagtacacctcagcgttaacttacgacgccgtacaggtaatgaccgaggctttccgcaatctgagaaagcagaggattgagatctccaggcgggggaacgctggcgactgcctggccaaccccgcagtgccatggggccagggagtagaaatagaacgggcactgaagcaggtgcaggtcgagggactttccggaaacatcaaatttgatcagaacggcaaacggattaactacacaattaatataatggagctaaagaccaatgggcctcgaaaaatcggatactggtctgaggtggataaaatggtcgtcactttaacagagctgcccagcggcaacgacacctccgggctcgagaacaagaccgtggtagtgacaaccattctggagtctccctatgtcatgatgaagaagaaccacgagatgctggagggaaacgaaagatatgagggatactgcgttgatctggccgcagagatcgctaaacattgcggctttaaatataaattaaccattgtgggagatgggaagtacggtgcgagagatgcagataccaagatatggaatggcatggttggagagcttgtatacgggaaggctgacatcgccattgctccgcttacaattacacttgtgagggaggaggttatcgacttcagcaagccttttatgagcctgggcatttctattatgatcaaaaagccacaaaagtccaaaccaggcgtgttcagtttcctcgaccccctggcttatgagatctggatgtgtatagtgttcgcttacatcggcgtgagtgtcgtcttgtttctcgtttcaaggttctcaccttacgagtggcatacggaagaattcgaggacggcagggagactcagagctccgaaagcacaaacgagttcggcatatttaactccttgtggttctctctgggcgcctttatgcaacaaggatgtgatatttccccacgctccctctccggtcgcattgttgggggcgtctggtggtttttcactttaattattatctcctcttataccgctaatctggcagcatttttaaccgtagaaagaatggtctctcccatcgaatccgctgaagatctgagcaagcagactgagatcgcctacggtacactggacagcggatctacaaaggagttttttcggagatccaagattgctgtgttcgacaaaatgtggacatacatgcggagcgcagagccctccgtttttgtgcgtacaactgctgaaggagtcgcccgggtgaggaagagtaaggggaagtacgcttatctgctggagtccacaatgaatgaatacattgagcagcggaaaccttgcgacacaatgaaggtgggcggtaatctcgactctaaaggctacggcatcgccactccaaagggcagtagcctccgtacccctgtcaacctggcagtactcaagctttccgagcagggcgttctggacaagcttaagaacaagtggtggtacgacaaaggtgagtgcggcgctaaggatagcggtagcaaagaaaaaacctcagccctgtccttgtccaatgtcgccggggtattctacatcctggttggcggtttaggactggccatgttagtagccctcattgagttctgttacaagtcgcgggccgaagctaagcgcatgaaggtcgctaaaaacgcccagaacattaacccctcctcttcccagaattctcagaacttcgctacttacaaagaggggtacaacgtttacggcatcgaatctgtgaagatttag

SEQ ID NO: 189327 - DNA, 378 bp, Artificial Sequence
  Description of Artificial Sequence: Synthetic coding sequence
atgcagaagatcatgcacatcagcgtgctgctgagccccgtgctgtgggggctgattttcggcgtgagctccaatagcatccagatcggtggcctgtttccccggggcgccgaccaggagtactcagcctttagggtcgggatggtgcagttcagcaccagcgagttcagactgaccccacacattgataatctcgaagtcgcgaattcttttgcagtcacaaacgccttttgttctcaatttagcagaggggtgtacgccatcttcgggttctatgacaagaaaagtgttaacactatcacgtctttttgtggcaccctccacgtctcttttatcacccctagcttccccacagacgggacccaccccttcgtctag

SEQ ID NO: 189328 - DNA, 147 bp, Artificial Sequence
  Description of Artificial Sequence: Synthetic coding sequence
atgcagaagatcatgcacatcagcgtgctgctgagccccgtgctgtgggggctgatattcggagtatctagcaactctatacagattggtggactgttcccacggggcgctgatcaggagtactctgctttccgagtgggtatgtag

SEQ ID NO: 189329 - DNA, 3030 bp, Artificial Sequence
  Description of Artificial Sequence: Synthetic coding sequence
atggaggccctgaccctgtggctgctgccctggatctgccagtgcgtatcggtgagggcggatagcatcattcacatcggagcgatcttcgaagaaaacgcggccaaggatgatagggtgtttcaactcgcggtttccgatttaagcctgaatgacgacatacttcaaagcgaaaaaatcacctacagcatcaaggtaatcgaagccaacaatccctttcaggcggtgcaggaagcttgcgacctgatgacacagggaatactggccctagttacatctactggatgcgcctcagcaaacgctctgcagtctctcacagatgctatgcacatccctcatttgttcgtgcaaaggaaccctggtggatcacctcgaaccgcctgccatctgaatccatcccccgacggggaagcatacaccctcgcaagccgaccgccagtaagattgaacgacgttatgctgcgactggtgactgaacttaggtggcaaaagtttgtaatgttctacgattcagagtacgatattagggggctgcagtcctttctggatcaggcctctcgactgggacttgatgtgagcctgcagaaggtcgacaaaaatattagtcatgtgttcacatctctttttactaccatgaagactgaggagttaaacaggtatagggatacgttgcgccgcgcaatcctacttctctccccccagggagcgcacagctttattaatgaggctgtggagactaatctggcctccaaggattcccattgggtatttgtgaacgaagaaatctcagatccagaaattttggatctggtgcactccgctctgggcaggatgaccgtcgtgaggcagatctttccgagtgcaaaagataaccagaaatgcacacgaaataaccatcggatatccagtctgctttgtgacccacaagaaggctacctacaaatgctgcagatttccaatctgtatctgtacgatagcgtcctcatgctggcgaacgcatttcatcgaaaactggaggatcggaagtggcattccatggcatctctcaactgtattagaaagtctaccaagccgtggaacgggggacgcagcatgcttgacaccattaagaagggacatatcactggattgacgggggtgatggagtttcgagaagattccagtaacccttatgtgcagtttgaaatcctgggtaccacctattctgaaacatttggaaaggacatgcggaaattggctacttgggattccgagaaggggttgaatgggtctctgcaggaacggccaatgggctcccgtctccagggacttacgctgaaagtggtaaccgtccttgaggaaccctttgtgatggtggcagaaaatatactcggacagccaaagagatataaaggcttttcaattgatgtcctcgatgctttagccaaagcgctcggtttcaagtatgagatctaccaggccccagacggccggtatggacaccagctccacaatacctcctggaacgggatgataggcgagttaatcagcaaacgagctgacctggcaattagcgcaatcactataacgcccgaacgggaaagcgtggtcgatttctctaagcgctacatggactactcagtggggattctgataaaaaagcctgaggaaaaaatctcgatttttagtctgtttgcccctttcgattttgcggtctgggcttgtatcgccgccgccatccccgttgtcggcgttcttatattcgttctgaatcgcatccaggctgtgcgtgcacagtccgccgctcagcctcggccttccgcctcggcaacactccatagcgcaatctggatagtgtacggggcgttcgtccagcaggggggcgagagttcagtgaattccatggccatgcggattgtcatgggcagttggtggctgttcaccctgatcgtttgctcctcctatacagcgaacctggcggccttcctcaccgtgtctaggatggacaaccctatcagaaccttccaggatctgtccaagcaggtagaaatgtcctacgggacggtccgcgattccgcagtctacgagtatttccgggccaagggaacaaaccccctggaacaggactccaccttcgctgagttatggaggactataagtaagaacgggggagccgacaactgtgtgagttccccgagtgaaggaattcgaaaagccaagaagggcaattatgccttcctgtgggatgtagcagttgttgagtacgcggcactcaccgacgacgactgctcagttaccgtgatcggcaactctatatcttccaaaggatacggcattgccctgcagcatgggtccccatatcgggacctcttctcgcagagaatcttagagctacaggatactggggatctagacgtgctgaaacagaaatggtggcctcatatgggacgttgtgacttgacttcccacgccagtgcacaggccgatggcaagagcctgaagttgcacagctttgccggcgtattctgcatccttgcaatcggcttgttgctggcatgtctggtagccgccctagaattgtggtggaacagtaatcggtgccaccaggagaccccgaaggaggacaaggaagtcaacttggaacaggtccatagacggatgaactctctcatggatgaggatatcgcacacaaacagatctcccccgctagcatagaactgagtgccttggaaatgggcggcctagcgccaactcagactttggaacccaccagagaatatcagaacacccagctgagcgtgtctaccttcctccccgagcagtcttctcacggcacatccagaactctctccagcgggccctcgtccaatctgcctctacccttgtcgtctagcgccacaatgccctctatgcagtgtaagcatcggtcgcccaacggaggattgttccggcagtctcccgtaaagactccaatacccatgagcttccagccagtacccggcggagtgctacccgaggctctcgacaccagccatggaacatccatttag

SEQ ID NO: 189330 - DNA, 1743 bp, Artificial Sequence
  Description of Artificial Sequence: Synthetic coding sequence
atgggcagccggctgcagggcctgaccctgaaggtggtgaccgtgttggaagaaccttttgtcatggtggctgagaacatcctgggccagcccaagaggtacaagggattcagtatagatgtcctcgatgccctggcgaaggcgcttggctttaagtatgaaatttaccaggcgccagacgggaggtacggccatcagctgcacaacacatcatggaatggcatgatcggcgaactgatatcaaaacgggccgatctggcaatcagcgccatcaccatcactccagaaagggaaagcgtagttgatttctctaaaaggtacatggattattccgttggcatcctaattaaaaagcctgaagagaagatttctattttctcccttttcgcaccctttgatttcgccgtgtgggcctgcattgccgctgctatccctgtggttggcgtgctaatcttcgtgctgaacaggattcaggctgtcagagcccagagcgccgcccagcctagaccttccgcaagcgctacactgcactctgctatatggatcgtgtatggggcttttgtacagcagggaggcgagtcctctgtgaactctatggcgatgcggattgtgatgggctcctggtggctctttaccttgatcgtctgctcttcttacacagctaatttggctgcgttccttaccgtctcacgaatggataacccgattaggacgtttcaggatctatccaaacaggtggagatgtcttacggaactgtgagggactctgccgtatacgagtacttccgagccaaagggacaaatcctttagagcaggactcaacttttgcggaattgtggcggactattagtaaaaacgggggcgcggataattgcgtgagctccccctcggaaggcatcagaaaagcaaagaaaggaaactatgcatttctgtgggacgtcgccgtcgtggaatacgcagccctgactgatgacgactgcagcgtaacagttataggcaactcaatctccagtaaaggctacgggatcgcacttcagcatgggagcccatatcgggacttattcagtcagcggattctcgaactgcaggacacgggtgaccttgacgtgctgaagcagaagtggtggccacacatgggccgctgtgacctcacaagccatgcatcggcacaggccgacggtaaatccctgaagctgcacagttttgcaggcgttttttgtattctggctatcggacttctcctggcctgcttggtcgctgccctcgaactttggtggaactctaataggtgccatcaggaaacccctaaggaagacaaagaagtgaacctggaacaggtgcaccggcgcatgaatagtctcatggacgaagatatagcacataaacaaatttctcctgctagtattgaactcagcgcactggaaatgggtgggctggcacccacccagactttagagcctaccagagagtaccagaacacccagctctcagtgtccacttttctgcctgagcagtcgtctcacggcacaagtcgaaccctcagtagcggcccctcctccaacctcccattacctcttagcagttccgctactatgcccagcatgcagtgcaaacaccgaagccccaatggtggattgtttaggcagtctccagtcaagacacccattcctatgagcttccagcccgtcccaggtggtgttctccccgaggccctggacactagtcatggaaccagcatctag

SEQ ID NO: 189331 - DNA, 3024 bp, Artificial Sequence
  Description of Artificial Sequence: Synthetic coding sequence
atggaggtgttccccttcctgctggtgctgagcgtgtggtggagccggacatgggactcagctaacgccgactctattatccacattggagcaatcttcgacgagagtgccaagaaagatgacgaagtgtttaggacagctgtgggcgatctcaaccagaatgaggaaatactgcagactgaaaaaattacttttagtgtaacctttgttgatggcaacaaccctttccaagcagtgcaagaagcctgcgaactcatgaaccaaggaattcttgcactcgtttccagcattggatgtacgagcgccgggtccctgcagtcgctggccgatgcaatgcatattccgcatctgtttattcaaagaagcacggctgggacccctcggtccggatgcggcctcacccgatccaacagaaatgatgactacactctgtctgtccgaccacctgtttaccttcatgatgtcatcctgcgagttgtgacagaatatgcctggcagaaattcattatcttttatgactcagaatatgatatccgaggcatacaggagtttctcgataaggtgtcccaacaaggcatggacgttgccctacagaaagtcgaaaacaatatcaataaaatgataactactttgtttgacaccatgcgcattgaggagttgaaccgttatcgcgacaccctgcgcagggcaatactcgtgatgaaccccgcgacagcaaagagttttataaccgaggtggttgagacaaatcttgtcgccttcgactgtcactggatcatcattaatgaggaaattaacgacgtggatgtgcaggagttggtcaggaggtcaataggaagactcacaataatacgccagacttttcccgtgccccaaaatatatctcagcgctgttttcgcggaaaccacaggatctcttcgaccttatgcgatcctaaggacccatttgctcagaatatggaaatctcaaatctctacatctacgataccgtgctattgcttgccaacgcctttcataaaaaactggaggacagaaagtggcactcaatggctagcctgtcgtgtatcaggaaaaattctaaaccctggcagggaggacgttccatgttggagaccatcaagaagggaggggtgtccggcctgacaggggaactggagttcggggagaatggcggtaatcctaatgtgcacttcgagatcctaggaaccaactacggtgaggagcttggacggggcgtgcgaaagcttgggtgctggaatccggtgactggcttaaacggttccctgacagataaaaaactcgaaaataatatgcgtggtgtggtgttgcgcgtagtgacagtgctcgaagaacccttcgtgatggtctcagaaaacgtgttggggaagcccaagaagtaccaggggtttagcatagacgtgctggacgccctttctaactatcttggattcaattatgaaatctacgtcgcccctgaccataaatacggatcacctcaagaagacggcacctggaacggcctcgtgggggaactggtgttcaagcgcgcagatatcgggattagtgccctcacaatcacccccgatagggagaatgttgtggacttcaccactagatatatggattactccgtgggcgtccttcttcgcagggcagagaagactgtggatatgttcgcctgtctcgctccctttgatctgtccctgtgggcctgtattgctggaactgtgctgcttgtagggctgctggtttacctgctcaattggttgaaccccccacgcttgcaaatgggatctatgacatccactaccctgtacaactcaatgtggttcgtttacggttctttcgtgcaacaaggaggagaagttccctatacaacactcgccactcgcatgatgatgggcgcttggtggttgtttgccctcatcgtgatctcatcttatacagctaatctggcggcttttcttacaattacacgaatcgaaagtagcatccagagccttcaagacctgtccaaacaaacggagattccctacgggacagtcttagattctgccgtctacgagcatgtgcgaatgaagggactgaacccttttgagcgtgatagcatgtacagccagatgtggagaatgattaatcggtccaatgggtctgaaaacaacgtgcttgagagccaggccggcatccagaaggtgaaatacggcaactatgcattcgtatgggatgctgcggtgttggaatatgtggccataaatgatcctgactgctccttttacacaataggcaacacggttgcagacagagggtatggaatagcattacagcatggttcgccgtatcgggacgtgttctcccagagaatcctggaattgcagcagaacggggatatggatattctaaaacacaaatggtggcctaagaacgggcagtgcgacttatactcctcagtggataccaagcaaaagggaggcgcgttggatataaagtctttcgcgggcgtgttctgcatcctggctgctggtattgttttgtcttgctttatcgctatgctggaaacctggtggaataaacggaaagggtctcgcgttccaagcaaagaggacgataaggagatcgatctggagcacctgcaccgtcgcgtcaatagtctctgcactgatgatgattcaccacataagcagttttcaactagttctatcgacctcaccccactggatatcgacaccctgcctaccaggcaggccctggagcaaattagcgatttcaggaatacgcatatcacaactacgactttcattcctgagcagatacaaacattgtcacgcacactttcagcaaaggccgccagcggatttacatttgggaatgtgccagaacacagaactggaccctttcggcaccgagcaccaaacggcgggttcttccgctcccccataaaaactatgtcatcgattccctaccagcccacacccactttgggcctgaatctgggaaacgaccccgatcgaggcacgagcatttag

SEQ ID NO: 189332 - DNA, 2739 bp, Artificial Sequence
  Description of Artificial Sequence: Synthetic coding sequence
atggaggtgttccccttcctgctggtgctgagcgtgtggtggagccgcacttgggatagtgcaaacgccgactctatcatccatatcggtgcgatcttcgacgaatctgctaaaaaggatgatgaggtattccgcaccgccgttggcgacctaaatcaaaacgaggagatactgcagacagagaagattacctttagcgttaccttcgtggacgggaataatccctttcaggctgtgcaagaggatatcagagggatccaggagttcttggacaaggtctcacagcagggcatggacgtggccctgcaaaaagtggaaaacaacattaataaaatgattaccaccctgtttgacaccatgaggatcgaggaactcaatagatatagagacacactgcgcagggccatactagttatgaacccagcaaccgctaaatcgtttatcaccgaggtggttgagaccaatttggtagcttttgattgccactggatcatcatcaacgaggagatcaacgacgttgacgtgcaggagttggtgcggcgcagcattggacgcctgacgattattagacagacctttcctgtgccccagaatatcagccagcgatgctttagagggaatcaccgcatttcctcaaccctgtgcgaccctaaggaccctttcgcccaaaatatggagatatcaaatctgtatatctatgacaccgtgctacttctggcgaacgcattccacaagaaactggaagaccggaaatggcattcgatggcctccctatcgtgtattagaaaaaatagcaagccttggcaggggggtcggtctatgttagaaacaattaaaaagggcggcgttagcggtctgactggcgagcttgaattcggggagaacggaggcaatcccaacgtccatttcgaaatcctggggacaaactacggcgaggaactgggccgcggcgtccgaaagctgggatgttggaacccggtgaccggactcaatggatcgctgaccgacaagaaactggaaaacaatatgcgaggggttgtcctgcgggtagtgacagtgctggaggagccctttgtgatggtcagcgaaaacgtgctgggcaaaccgaagaaatatcagggcttctccattgatgtcctagatgccctaagcaactatttgggttttaactacgaaatctacgtggctcctgaccataaatacggctccccacaggaagacggcacatggaatggacttgtgggtgaattggtctttaagagggccgatattggtattagtgctctcacgattacccccgatagggagaatgtcgtggattttaccactcgttacatggactattctgtgggtgtccttcttcggcgggcagagaaaactgtggatatgttcgcctgcctggcaccttttgatctgtcactttgggcctgtatcgcagggaccgtgctgctggtcggcctgttggtgtacctgctgaattggctaaatccgccccgtctgcagatggggagcatgactagcacaactttgtacaactcaatgtggttcgtatatggtagtttcgtgcagcagggaggggaggtgccctacaccacattggctacaagaatgatgatgggcgcttggtggctgttcgcccttattgtgattagctcttacactgccaacctggcggcgtttctcaccattacccgcattgagagtagcatacagtccctgcaggacctgagcaaacagactgaaataccctacgggactgtactcgactctgccgtatacgagcacgttagaatgaagggtctaaatccttttgagcgcgacagtatgtatagccagatgtggagaatgattaacagatctaatggtagtgagaacaacgtgcttgagtcccaggctgggatccagaaggtaaaatatggcaattacgcattcgtgtgggatgcagctgtgctggagtacgttgctatcaacgacccagactgcagcttttatacaatcggcaatacggttgctgaccgcggttatggcattgccctccagcacggatcaccttatagagatgtgttctctcagagaatactggagctgcagcaaaatggcgatatggatatcctgaagcacaagtggtggcctaaaaacgggcagtgtgacctgtacagcagcgtcgacactaagcagaaagggggtgcactggacattaaatcttttgcgggtgttttctgtatcctcgcagcaggtatagtcctgtcctgcttcatagctatgctggagacttggtggaacaagcggaaggggtcccgcgtcccgtcgaaggaagacgacaaggagatcgaccttgagcatctacaccggcgtgtcaattcactctgcactgatgatgattcgccccataagcaattcagtactagcagcatcgatctcaccccccttgacattgatactctcccaactcgccaggcccttgagcagataagcgatttccggaatacacacattactacaaccacatttataccagagcagatacaaacgctgagccgcaccttgagcgctaaggccgccagtggtttcacctttgggaatgtacccgaacacaggaccggtccgttccggcacagagcacccaatgggggattttttcgttcccccatcaagacgatgtcctctattccttatcagccaactccgaccctgggactgaaccttgggaatgatcctgacagggggacttctatttag

SEQ ID NO: 189333 - DNA, 2763 bp, Artificial Sequence
  Description of Artificial Sequence: Synthetic coding sequence
atggagcacggcaccctgctggcccagcccggcctgtggacccgggacacgtcatgggccctgctgtactttttgtgttacatacttccccagactgctccacaggtcttgaggatcggagggatctttgagacagtggagaatgaaccggtaaacgtggaggagctagctttcaaattcgccgttacttctatcaaccggaatcggaccttaatgcccaacacaactctaacctatgatatccagagaataaacttgtttgactcattcgaggcctccagaagagcctgcgatcagcttgcgctaggggtggccgccctgttcgggcccagccatagtagctcagtgtcagctgttcagtccatatgcaatgcccttgaagtgccccacattcagaccagatggaaacatccaagcgtggataacaaggacttattttatatcaatctgtacccggactatgccgccatttctagagcgattctggacctagttctgtattataactggaaaaccgttactgttgtctatgaggattcaacaggcctcatacgcctacaggagttgatcaaggcacccagtagatacaacattaagattaaaatccgacaactaccatccgggaataaagacgctaaacccctcctgaaagaaatgaaaaaggggaaagaattctatgtgattttcgactgcagccacgagaccgctgctgagatcttgaaacagatactgtttatgggaatgatgactgaatattaccactatttctttaccacactcgacttgttcgccctcgatctggaactgtatcggtattctggagtgaatatgacgggtttccggcttctcaatattgacaacccacatgtcagctctattattgagaagtggtcaatggaacgcttgcaggctcctccgagacctgagaccgggctgttagatggaatgatgacaacagaagcagctctgatgtacgatgcggtatatatggtggctattgctagccatcgtgcctctcaactaacagtgtcttccctccagtgccatagacacaaaccttggcgccttggcccccgcttcatgaatctgattaaagaggctacagcgcggtgggatggattgactggtcacatcactttcaacaaaaccaatggtctccggaaggatttcgacctggatattatcagtcttaaggaggaaggcacggagaaagccgccggcgaggtgagcaaacatctttacaaggtctggaagaagattggcatctggaactcaaattccgggcttaacatgacggacagcaacaaggataagtcatcaaatattaccgactccctggctaacagaactctcatagtgactaccatcctcgaagaaccctatgtgatgtaccgcaaatccgacaagccactgtatggcaacgataggtttgagggctattgcctcgacttgctcaaggagttgagtaacatcctgggattcatttacgacgtcaaactggttcctgacggtaaatatggggctcagaatgataaaggcgagtggaatggtatggtgaaggagctgatcgatcatagagctgatctggctgtggcaccactgacaataacatacgtcagggagaaggtgatcgacttttcaaagccatttatgacactgggaatctcaattctctatcggaagccaaatggaacaaatcccggcgtcttttcatttctcaacccattgagccccgacatctggatgtacgtcctcttagcctgcctcggcgtctcctgtgtgcttttcgtcattgcccgttttaccccatatgagtggtataatcctcacccgtgtaaccctgacagcgacgttgtggagaacaactttacgctactgaattccttctggttcggggtcggggccctgatgcagcagggctccgaacttatgccaaaagctctttctacacgtatcgtcggggggatttggtggttttttaccttgatcatcattagctcttatacggctaacctggccgcgttcttaaccgtggagcggatggaatctccgattgacagcgcagacgatctcgcaaagcagaccaagatcgagtatggtgccgtaagggatggcagtactatgaccttcttcaagaagtctaagatctccacgtatgagaagatgtgggcctttatgagctctcggcagcagactgcactggtcagaaactctgacgaggggatccaaagagtgcttacgactgactatgccctgctgatggagtccaccagcattgagtatgtaacccagcgcaattgcaatctgactcagattggaggactcatcgactctaaggggtacggtgtaggcaccccgatcggatctccttaccgtgacaagattactattgcaattctgcagttacaggaggaaggtaaactgcacatgatgaaagaaaagtggtggagaggcaatgggtgccctgaggaggacaataaagaagcctctgccctcggcgtggaaaatattggcggcatatttatcgtgctcgctgccggtctggtgctgtccgtgtttgtggcaatcggcgagttcatctataaatctcgaaagaacaacgacattgagcaagctttctgcttcttctatggcttgcagtgtaaacaaacgcaccctaccaactcaacgagcggcacaacgctgtccactgatttggagtgtggaaagctgatccgggaggaacgggggattagaaaacaatcatctgtacatacggtctag

SEQ ID NO: 189334 - DNA, 2850 bp, Artificial Sequence
  Description of Artificial Sequence: Synthetic coding sequence
atggagcacggcaccctgctggcccagcccggcctgtggacccgggacacctcgtgggccctcctatattttctctgttacattttgccgcaaacagcccctcaggtgttacgtatagggggcatcttcgagacagtggaaaatgaaccagtgaacgtggaggaactcgcatttaagtttgccgtcacctccattaacagaaaccgcacactaatgccgaacactaccctgacatatgatattcagagaataaatttgttcgatagtttcgaggcgtcacggagggcatgcgaccagctggccttgggcgtggccgcacttttcggcccaagccacagttcaagcgtgtcggcagtacagtccatatgtaatgccttagaggtcccccacatccagacccgctggaagcacccttccgtggacaacaaagatctgttttatattaatttgtacccggattatgccgccattagcagggccattcttgatctggttctgtactacaactggaaaactgtcacagtggtatatgaggattccacaggacttattagactccaggaactcatcaaggccccctcaagatataatatcaaaatcaagattagacagcttccatcagggaacaaggacgccaaaccactgctgaaggagatgaaaaagggcaaagagttctatgtgatcttcgattgctcccacgagaccgctgctgagatattgaagcagattttgttcatgggaatgatgaccgagtactaccattatttctttacaacattagatctctttgctctggacctggaactctaccggtattccggcgtgaacatgaccggattcaggctcctgaatattgataaccctcacgtctcctcgatcattgaaaaatggagcatggagcggttgcaggcgccgcctaggccagagaccggtctcctggacgggatgatgactacagaggctgccctgatgtatgacgcagtgtacatggtcgccattgcgtcccatagagcctcacaactgaccgtttcgagtcttcaatgccaccggcacaagccatggcgtctggggccacgatttatgaacctgatcaaggaagcccgatgggatggcttaaccggacatattacattcaataaaaccaacggactacgaaaagattttgaccttgacataatctcactgaaggaggaaggcacggagaaggcagctggtgaggtgtcaaaacacttatataaggtctggaagaagattggtatctggaactctaattctgggttgaacatgacagacagcaataaagataagtcttctaacatcacagatagcctagcgaaccggacactcatcgttacaacgattttagaagagccctatgtcatgtacaggaagagtgacaagcctttgtatgggaatgaccgattcgaagggtattgcttagacctgctgaaggaactctctaacattctggggtttatctatgacgtgaagcttgtgcctgatgggaaatacggcgcccagaatgacaaaggagagtggaatggaatggtaaaagagctgatcgaccatcgcgcggatctcgccgtggcacccctgactattacctacgtacgggagaaggtcatcgacttcagtaagccttttatgactctggggataagcatcctgtatcgcaagcccaacgggacaaaccctggagtattttccttcctgaatccactgtccccggacatatggatgtatgtgctgctggcttgtttgggcgttagctgcgtgctgttcgtgattgctcggtttacaccctatgagtggtacaacccacatccgtgtaatccagacagtgatgtggtagagaataactttaccttattaaacagcttttggtttggggttggggccttgatgcagcaggggagcgaattaatgccaaaggccctgagtactaggattgtgggaggcatttggtggttcttcaccctcatcattatttcttcctatacagcgaacctcgccgccttcctgaccgtagagcgcatggaaagtcctattgatagtgctgacgacctcgctaaacagacaaagatcgagtacggggcggtgagggatggttcgaccatgactttcttcaagaagagtaaaatctcaacctacgaaaagatgtgggccttcatgagcagccggcaacagacagccctggtcagaaattcagacgaggggattcagagggtcctgaccaccgattatgccctcctcatggagagcactagtatcgagtatgtgactcagcgcaattgcaatctaacacagattggtggtctgatagatagcaaaggctatggcgtgggaacccccataggcagcccttacagggataagattaccatcgccattctccaacttcaagaggagggcaagctgcacatgatgaaggagaagtggtggcgcggtaacggctgccctgaagaagataacaaggaagcaagtgccctgggcgttgaaaacatcggtggaatcttcatcgtactggcagcaggcctggtgctctccgtattcgttgcaattggagagtttatctacaaatctcggaaaaacaacgacatcgagcaaaagggaaaatctagccgtatccgattctattttcgtaacaaagtccggttccatggccggaagaaacagtcccttggagttgagaagtgcctgtcctttaacgcaatcatggaagagctgggaatttctctcaagaaccagaaaaagataaagaagaaaagcaggacaaaggggaagtccagcttcacgagtatactgacatgtcaccaaaggcgcacacagcgcaaggaaacagtagcttag

SEQ ID NO: 189335 - DNA, 2616 bp, Artificial Sequence
  Description of Artificial Sequence: Synthetic coding sequence
atggagcacggcaccctgctggcccagcccggcctgtggacccgggatacgtcctgggctctgctgtattttctgtgctacatcttgccacagacagcaccacaagtgttgcgcattggaggaatctttgagacagtagaaaacgaaccagtcaatgtcgaagagctggcctttaaattcgcagtcacgagcatcaaccggaaccgaactttgatgccgaataccacgctgacttatgatatccagcggatcaacctgttcgatagttttgaggcctctcgacgagcctgtgatcagctcgcactgggtgtcgcagcactttttggccccagccactcgtcttcagtgtccgctgttcaatcaatctgcaacgcactggaagtcccccacattcaaacgcgatggaagcaccccagcgttgataacaaggatctgttttatatcaatttgtatccagactatgctgccatatcccgcgccatcctggaccttgttctctactacaattggaaaaccgtgacagtcgtatacgaagacagcaccggactcatcaggctgcaggagctcattaaagctcccagcagatataatataaaaattaaaatccgacagctgccctccggaaacaaggatgctaaaccactattaaaggaaatgaagaagggaaaggaattttacgtaattttcgattgttcacacgagactgctgccgagattctgaagcagatcctctttatgggtatgatgactgaatactaccactacttctttaccaccctggacctcttcgcacttgatcttgaactgtaccgatacagcggagtgaatatgactggatttagattactgaatatcgataacccgcacgtaagttcgatcattgaaaagtggtccatggagagactccaagctcctccccggcctgagacagggctgttagatggcatgatgacgacggaggcagcgctgatgtacgatgccgtctacatggtggccattgccagccaccgtgccagccaactgacagtgagcagcctgcagtgccatagacataagccgtggcgcctgggtccacggttcatgaacttgatcaaagaggctcggtgggacgggctgacgggccacattaccttcaataagaccaatggcctccgcaaagatttcgatctagacatcatttccctgaaggaggaagggacagaaaaagctgcgggtgaggtcagcaagcatttgtacaaggtgtggaaaaagatcgggatttggaatagtaattcggggttgaatatgacagactccaataaggataagtcctcaaatattacagattcgctcgccaataggactcttatagtaaccactattcttgaagaaccatatgtgatgtaccgcaaaagcgacaagcccctgtacgggaatgatagattcgaaggctactgcctcgatctgctgaaagagctttcgaacattctgggttttatctatgatgtgaagttggtgccagatggaaaatacggcgcccagaatgacaagggtgagtggaacgggatggtgaaagagctgattgatcaccgtgctgacctggcagtggcccccctgaccatcacctacgtgcgagagaaagtgatagatttttcgaaaccatttatgacactaggaatctctatcttgtacagaaaaccaaacggtactaaccctggcgtgtttagtttcctgaacccgctgtcccctgacatctggatgtacgtcctgctggcttgcctcggggtcagttgcgtccttttcgtgatcgcgcgcttcacaccatatgaatggtataacccacatccctgtaacccggatagcgatgtggtcgagaataatttcacactccttaatagtttttggttcggtgtgggcgctctcatgcagcaggggtccgagctaatgccaaaagccctttccacgaggatagttggcgggatctggtggttctttaccctgatcatcatctcaagctatactgccaacctggctgcttttctcacagtcgaacggatggagtcccctattgactctgccgatgacctggcaaagcagaccaagatagagtatggagctgtaagggacggcagcaccatgactttttttaaaaaatccaagatcagcacctacgagaagatgtgggcatttatgagtagccgacaacagacagccctggtccgcaattctgacgaaggtattcagcgtgtgctcaccactgactatgctctgttgatggaaagtacgtctattgagtatgtcacacagcgcaattgcaatctcacccagattggaggacttatcgattcgaagggctacggtgtgggaactcctattggcagtccttatcgggacaaaattactatcgcgattctccagctgcaggaggaggggaagttacatatgatgaaagaaaagtggtggcggggcaacggatgtccggaggaggataataaagaagcctcagccctgggtgtggaaaacattggcggtatttttattgtgctggccgctggtctggtgttatccgtatttgtcgccattggggagtttatctacaaatcccgaaagaacaatgatatcgaacagcactactag

SEQ ID NO: 189336 - DNA, 2718 bp, Artificial Sequence
  Description of Artificial Sequence: Synthetic coding sequence
atggagcacggcaccctgctggcccagcccggcctgtggacccgggatacatcctgggccctcctgtattttctgtgttatatcctgccgcaaacggctccacaggtgctgcgcatcgggggtattttcgaaacagtggagaatgagcctgtgaatgtagaagagttggctttcaagtttgctgtcacctccataaatcgcaaccgcactctgatgcccaacactacactcacctatgacattcagagaataaatctgtttgactcgttcgaagcctctaggcgcgcttgtgaccagctggctcttggagtggccgccctgtttgggccctctcactcttcatcagtctccgctgtgcagtccatatgtaacgccctggaagtgccacacatccagacacggtggaaacacccatctgtggacaacaaagacttattctacatcaacctttatcctgactatgcagccatcagccgtgccattctggacctcgtgctgtactacaactggaagacagttaccgtggtatatgaggatagcaccggcctcataagactgcaggaattgattaaggccccaagccggtataacataaagataaagattcggcagttaccatcaggcaacaaggatgctaagccattattaaaggagatgaagaaaggcaaggagttctacgtgatcttcgactgctctcacgagaccgcagcggagatcctgaagcagattctctttatgggcatgatgacagagtactatcactatttttttacaaccctggatctcttcgccctggatttggagctgtaccgatacagtggcgttaatatgacgggcttccggctacttaacattgataatccgcatgtgtctagcattattgaaaaatggagtatggagcgattgcaggccccccctcgccccgaaacaggcttattggacggcatgatgacaacggaggcggccttaatgtatgatgctgtctatatggtagccatcgcctcgcaccgcgctagccagcttaccgtgagcagcttgcagtgccatagacataagccatggcgtttaggtccaaggtttatgaatttaatcaaagaggcccgctgggacggcctgactgggcacattacattcaataagaccaacggccttagaaaagactttgacttggatattatttccttgaaagaagagggcactgagaaaatcggcatatggaacagcaactccgggttgaacatgactgattcaaacaaggataaaagcagcaatatcactgattccctagcaaatcgtactctgattgttaccaccattctagaggagccctacgtcatgtatcggaagtccgacaagcctttgtatggcaatgaccggtttgaggggtactgtctggacctcctcaaagagctctccaatatactgggctttatttatgacgtgaagctcgtccccgatggcaaatacggcgcgcaaaatgataaaggcgaatggaatggtatggtcaaagaacttattgaccatagggcagacctggctgtagcgccattgacaattacatatgtccgcgagaaagtaatcgatttctcgaaaccctttatgacgctgggcatatccattctgtataggaaacccaacggcacaaatccgggcgtgttcagtttcctcaaccctctgtcgccagatatatggatgtacgtattgctcgcctgcctcggagtctcctgtgtgctgttcgtgatagccaggtttacgccttacgagtggtataatcctcatccatgtaaccctgactctgacgtggtggaaaataactttactctattgaatagcttctggttcggggttggcgccctgatgcagcaggggagtgagctgatgccaaaagccctgtctaccagaatcgtcggaggcatttggtggttctttactctgatcattatttcaagttacaccgccaatctggccgcatttctgactgtggaacgtatggagagtccaatcgacagcgccgatgacctggcaaagcaaacaaagatcgagtatggtgcagtgcgcgatggctctaccatgactttctttaaaaaaagtaagatcagtacatatgaaaagatgtgggcattcatgtcttcacgtcaacagaccgcactggtacgaaatagtgatgaaggtattcagagggtgcttacaaccgactacgctttgctcatggaatcgacctccatcgaatatgtaactcaaaggaactgcaacttgacgcagatcgggggcctcatcgactcaaagggatatggcgtcggcactcctatcggatccccctatcgcgacaagattacaatagcaatcctacagttgcaggaagaagggaaattgcatatgatgaaggaaaagtggtggagagggaacggctgccctgaggaagacaacaaggaggcgtctgccctgggagtggagaacatcgggggcatcttcattgtgctggccgctggcctggtgctgtccgtgttcgtagcaattggggaatttatttacaaaagcaggaagaacaacgatatcgaacagtgtctgtcttttaacgccatcatggaggagctggggatttctttaaagaaccagaaaaagattaagaaaaagagccgtacgaaaggcaaatctagctttacatcaatcttaacctgtcaccagcgccgaacccagcgcaaggaaaccgtagcctag

SEQ ID NO: 189337 - DNA, 2757 bp, Artificial Sequence
  Description of Artificial Sequence: Synthetic coding sequence
atggagcacggcaccctgctggcccagcccggcctgtggacccgggacacatcatgggccttgctgtactttctctgctacatcctcccacagactgcaccccaggtactgcgcattggggggatattcgaaaccgtagaaaatgaaccagtcaacgtggaggaactggcatttaagtttgcggtcacttctattaatagaaacagaacacttatgccaaacactactcttacatacgatatacaacgcatcaatttattcgactctttcgaagcttctcgacgcgcttgcgaccagctcgccttgggcgttgcagcattgttcggaccatcgcactctagctccgtgtcagcggtgcaaagcatctgtaatgctctggaagttcctcatatccaaacacgctggaaacacccctcagtcgacaataaagatcttttctacatcaacttgtatcctgactacgccgctatttccagggccattctggatcttgtgctgtattataattggaagaccgtgaccgtggtgtacgaggatagtacagggcttatcagactgcaggagctgatcaaggccccatcgcgatacaatatcaagatcaagatccgtcagctgccaagcgggaataaggacgccaaaccgttgttgaaggagatgaaaaaaggtaaagagttctatgtgatctttgattgctcacatgagacagccgccgagattctgaaacagattctgttcatgggcatgatgacagagtattatcactacttttttacaactctggacctgttcgccctggatttggaactgtaccgatactctggagtaaacatgacaggattccgtcttctaaacatcgataatccacacgtgagttccattatagagaaatggagcatggaacgactgcaggcccctcctcgccctgaaaccggcctgctcgatgggatgatgactaccgaagcggcattaatgtacgatgccgtgtacatggtcgccatagcttctcacagagcaagccagctcacggttagctctcttcaatgtcaccgtcacaaaccctggcggctgggcccccgcttcatgaacctgataaaagaagcccggtgggacggactgactggccatatcacctttaacaagacaaatggtttgcgaaaggattttgatctggacatcatctctctgaaggaagaggggaccgagaaagcagcaggcgaggtcagcaagcacctgtacaaggtatggaaaaaaatcgggatatggaacagtaattccggactgaacatgaccgattctaataaggataagtcaagcaatatcaccgattcactcgcaaacagaacattaattgttactacaatattagaagagccgtatgtgatgtaccgcaagtctgataagccactgtacggcaacgacaggtttgagggatactgtctggaccttcttaaagaacttagtaacatcctggggtttatttacgacgtgaagcttgtgcccgatggaaaatatggtgcccaaaatgataaaggcgaatggaacggcatggtgaaggaactcatagaccatcgcgccgatctggcagtcgccccactgactataacatacgtgcgtgaaaaggtcattgactttagcaagcctttcatgacactgggcatatcgatactttatagaaaacctaatggtaccaatcccggggtgttctccttcctcaaccctttgagcccagacatatggatgtatgtgctacttgcctgccttggcgtcagttgtgtgctctttgtgattgctcgatttaccccatatgaatggtataatcctcacccttgtaacccggattccgatgtagtagaaaacaatttcactttattgaacagtttctggtttggagtaggcgccctcatgcagcaaggaagcgaactgatgccaaaagccctgtcgacacgcatcgtagggggcatctggtggtttttcaccctcatcataatcagcagttacacagcgaacctggcggcgttccttacagttgagcggatggaaagtccaatagactctgctgatgaccttgccaagcagactaagatagagtatggcgcagtgagagatggtagcacgatgacattctttaaaaagagtaagatctccacatatgagaaaatgtgggcctttatgtctagccggcagcagaccgcactggtgagaaacagcgatgaggggattcagcgggtgctgactaccgactacgcccttctgatggaaagcacgagcatcgagtatgtcacccagcgaaattgcaacctgacgcagattggaggcctgattgattcaaaagggtacggagtcgggacacccattggatccccttacagagacaagattaccatcgccatcctacagcttcaagaagagggtaaactgcatatgatgaaagaaaaatggtggaggggcaatggctgccctgaggaggacaacaaagaggcctctgccctgggagtggagaatattggggggattttcatagtattggctgcgggacttgtgctgtcagtcttcgttgccatcggtgaattcatctataaaagcaggaagaacaacgacattgagcaagctttctgcttcttctacggcctccagtgcaagcagacacaccccactaacagtacttccggcactacacttagtactgatctggagtgtggcaaactgattcgcgaggaacgaggaattcgcaagcagtcaagtgttcataccgtttag

SEQ ID NO: 189338 - DNA, 2712 bp, Artificial Sequence
  Description of Artificial Sequence: Synthetic coding sequence
atggagcacggcaccctgctggcccagcccggcctgtggacccgggacacgtcatgggccctgctctattttctctgctatatactgcctcaaactgctccccaggtactgaggataggcggaatcttcgagactgtggaaaatgaaccagtcaacgtagaggagctagccttcaagttcgccgttacaagcatcaacaggaaccgaacactcatgcctaacaccacacttacttacgacatccaaagaatcaacctttttgacagcttcgaggccagtcgccgggcctgcgaccagctggcactgggagttgccgccttattcggaccttcccactcttcttctgtctcggccgtgcagtctatctgtaatgctttagaggtgccacatattcagacccggtggaagcacccatcagtagataacaaagacctgttttacattaacctgtatccagattatgctgcgatatcaagagctatcctggacctggtgctgtattacaactggaaaaccgttacagtggtttatgaggattctacaggactgatccggttgcaggagcttattaaggccccatccaggtacaatatcaagatcaagattaggcagctccctagcggcaacaaggacgccaaacctcttttgaaagagatgaagaagggtaaagagttttatgtgatctttgactgctcacatgagaccgcagctgaaattctgaagcagatcctcttcatgggcatgatgaccgaatattaccactacttttttactaccctcgacctgttcgctctcgacctggagctgtacagatactcaggggtcaatatgaccgggtttagattgctgaacatagacaatcctcacgtaagctctataattgaaaagtggtctatggagcgccttcaggctcccccacgacctgaaacgggtctcttggatggaatgatgacaacagaagctgctctgatgtatgatgctgtgtacatggtggcaatagcatctcatagggcctcgcaactgaccgtgagcagcctccagtgccaccggcacaagccctggcggttgggccctcggttcatgaatcttatcaaggaggctagatgggatgggctgacgggtcacattactttcaacaagacgaacgggttgcgcaaagactttgacctggacatcatctccctgaaggaggaagggaccgaaaaaataggtatctggaattcgaactcaggcttgaacatgacggacagtaataaggacaaatcttcaaatatcacggactcactcgccaaccgtactttaatcgtgaccacaattctcgaggaaccgtacgttatgtataggaaaagtgacaaaccattatacggtaacgatcgtttcgagggatactgtttagacctgctcaaggaactctccaatattttgggatttatctacgatgtaaaactggtccccgacggtaaatacggcgctcagaatgacaagggagaatggaatggtatggtcaaagaactaatcgatcatagggctgatctggcagtggctcctcttaccattacttacgtccgcgagaaggttatagatttctcgaagccctttatgactctagggatctcaattctctataggaagccaaacgggacaaacccgggtgtcttctcgttccttaatcccctctctccagacatatggatgtatgtgctgctcgcgtgtctgggggtttcctgcgtgctcttcgttatcgctaggtttacgccatacgaatggtacaatccccacccatgtaatccagattctgacgttgtggagaataatttcactctgctgaattcattttggttcggagtgggggcactgatgcagcaaggctccgagttaatgccaaaagctctgtccacccggatagtgggaggaatttggtggttctttacgctaattataatcagcagctacaccgccaacctggccgcattccttacagtggagcggatggaaagccccatcgatagcgcagatgacctcgccaaacagactaagattgaatatggtgccgtccgggacggctccacaatgactttttttaaaaagtcaaaaattagtacttacgaaaagatgtgggcattcatgagttctcgtcagcagacagctcttgttcgaaattccgatgagggcattcagagagttctgacgactgactacgctctgctgatggagagtacttctattgagtacgtgacccagagaaactgcaatctgactcagataggcggcctcatcgactcaaaaggttatggggtgggaacaccaatcggtagcccttatcgagacaaaattaccatagccattctgcaactccaggaggaggggaagctgcatatgatgaaagaaaagtggtggcgcggaaacggttgccccgaggaggacaataaagaggccagtgccctgggtgtggaaaatatcggtggcatcttcattgtgctggccgccggcctcgttctcagcgtgtttgtggcaattggagaattcatttataagagccgaaagaataatgatatcgaacaggccttctgctttttctacggcctccagtgcaagcagacacacccgacgaacagcaccagcggcactacacttagtactgacttagagtgcggtaagctcatccgcgaggaaagggggatccgaaagcagtcaagtgtccatacagtttag

SEQ ID NO: 189339 - DNA, 2763 bp, Artificial Sequence
  Description of Artificial Sequence: Synthetic coding sequence
atggagcacggcaccctgctggcccagcccggcctgtggacccgggatacaagctgggctctcttgtatttcttgtgttatattctgccacaaactgctccccaggtgttaaggattggcggtatttttgaaacagttgagaacgagccagtgaatgtggaggaattggcattcaaattcgcagttactagtataaatcgcaatcggacactgatgcctaatactaccctgacctacgatattcagaggatcaacttattcgattcgtttgaagcatccaggagagcatgtgaccagctggcactgggtgtggccgcgctgtttggcccctcacattcttctagtgtgtcggcagtgcagtcaatctgcaacgctttagaagtgccacacatacagacccgttggaaacacccgtccgtggataacaaggacctcttctacattaacctttatccggattacgcggctatttcccgggctatattggacctcgtcctgtattacaattggaaaaccgtcactgtggtgtacgaagattccaccgggctaattagattacaggagctgattaaggcaccatcacggtacaatatcaagattaaaattcggcagctgcccagcggtaataaagatgctaagcccctgctcaaggagatgaaaaagggcaaggaattctacgtgatattcgattgctcacacgagaccgccgctgaaatcttgaaacaaatactttttatgggtatgatgaccgagtactatcactacttctttactacacttgacctgttcgccctggacttagagctgtatcggtactccggcgtgaacatgaccggttttagactcctcaatattgacaatccccatgtgtcatccatcatcgagaagtggagtatggaacgactccaggcacctccacgtcctgagactggcctcctggacggcatgatgaccaccgaggcggccctcatgtacgacgcagtgtacatggtcgcaatcgccagccaccgggcaagtcaactgacagtgagtagcctgcagtgtcatcgccataagccgtggcggttgggcccacggtttatgaacttgattaaagaagcgcggtgggacggcctgacgggccacatcacctttaataagactaacggacttagaaaggatttcgacctggatatcataagcctaaaagaagaagggactgaaaaggccgcaggtgaggtgtctaaacatctgtacaaagtctggaaaaaaataggaatctggaatagcaactcaggtttgaacatgaccgatagtaacaaggacaagagctcgaacatcactgactcattagcgaatcgcactctaatagtgacaactatcctggaggaaccttacgttatgtaccggaagtcagacaaacccctgtatgggaacgataggtttgaaggctattgtctagacctgctgaaagagttatccaatatcctgggtttcatctacgacgtgaaattagtgcccgatggcaagtacggggctcagaatgataaaggggagtggaatggcatggttaaggagctgattgatcaccgggcagatttggccgtggccccccttacaatcacatacgtccgcgaaaaagtcatagatttcagcaaaccattcatgacattgggcatatctattctgtaccgcaaaccaaatgggacaaatccaggcgtgttttcattcctgaaccctctgtccccagacatctggatgtacgtgctgctcgcctgtctgggagtgagctgcgtgttgttcgtgatcgctagatttaccccatacgagtggtacaatcctcacccatgtaatcctgattcagatgttgttgaaaataactttacactgctgaactccttctggtttggcgttggcgcactgatgcagcagggctccgagctcatgccaaaggcactcagcaccagaattgtggggggcatttggtggtttttcaccctaatcattatttcaagttatacagcaaacctcgcggcctttttgacggtggaaaggatggaatcccctattgattcggccgatgatcttgccaaacaaacgaaaatagagtacggcgcagtgcgggatggcagcaccatgacattttttaaaaagagcaagattagtacttacgagaaaatgtgggctttcatgagctcaagacagcagaccgcacttgtgaggaacagtgacgaggggatccaaagagttctcacaaccgactatgccctgctgatggagagcaccagcattgaatatgttacacagaggaattgcaacctcactcagatcgggggcctgatcgatagcaaggggtacggagtcgggactcctattgggagcccttaccgtgacaagattaccattgctatcctgcaattgcaggaggaggggaagcttcatatgatgaaggagaagtggtggcgaggaaacgggtgccctgaagaagataataaagaggcgagcgctctgggggtggaaaatatcggaggcatcttcatagttctcgcagcaggtctggtcctgagcgtgttcgtcgctataggcgagttcatctataaatcccgtaagaataacgatatcgaacagtgcctgtctttcaatgctataatggaggaactagggataagcctcaagaaccagaaaaaaatcaagaagaagagccgaaccaagggcaagagtagtttcacaagcatcctgacatgccaccagaggcgaacccagcgcaaagagaccgtagcctag

SEQ ID NO: 189340 - DNA, 2805 bp, Artificial Sequence
  Description of Artificial Sequence: Synthetic coding sequence
atggagcacggcaccctgctggcccagcccggcctgtggacccgggacacgtcatgggcactgctgtacttcctctgttacatcctgccccaaaccgctccccaagtgctgagaatcggcggcatctttgagactgttgaaaatgagcctgtgaatgtcgaggaactggcattcaaatttgccgtaactagcataaaccggaaccggaccctgatgcctaataccaccttgacttacgatatccagcgcatcaacttattcgactcgtttgaggcatccaggagagcttgcgatcagttggccttgggtgttgctgctctctttggccctagccacagcagctctgtctctgcagtccagagcatctgtaacgcactagaggttcctcatatccagactcgatggaagcatcctagcgtggataataaggatctattctacattaatctttatcctgattacgcggcaatctctcgggccatcctcgatcttgttctttactataactggaaaactgtcaccgtggtgtacgaagactctacgggcctgattaggctccaagaactcattaaagcacccagtagatacaatatcaaaatcaaaatccggcagctgccctccgggaacaaagatgcgaaacctcttcttaaggaaatgaaaaaggggaaggagttctatgtgatctttgactgttcccacgaaaccgcagctgaaatactgaaacagatactctttatgggcatgatgacagagtactaccattacttcttcaccacactggatctctttgcactggaccttgagctctacaggtacagtggggtcaatatgactggattcagacttcttaatatcgacaatccacatgtgtcatcaatcatcgaaaaatggtcaatggagcgactgcaggcgccccctcgccctgagacaggccttctggatggaatgatgaccaccgaagccgctctgatgtacgacgcggtgtacatggtcgctatcgccagtcatcgcgccagccagctgaccgttagctctcttcagtgccatcggcacaaaccatggaggctagggccgaggtttatgaatctgatcaaggaggccagatgggatggtctgactggacacattacgtttaacaaaaccaacggtctcagaaaggatttcgacctggacataatctcactcaaggaggaaggtaccgagaagattggtatctggaattccaattccggcctgaatatgaccgacagtaacaaggataaatcctctaacataaccgacagcctagccaacaggacactcatcgtcacaacaatactggaggagccgtatgtgatgtatcgtaagagcgataagcccctttatggaaacgaccgctttgagggttactgcctggatttgctgaaggaattgtctaatattctggggttcatatatgacgtgaagctggtcccggatgggaagtacggggcccagaatgataagggtgagtggaacggtatggtgaaggaactgatcgaccaccgcgccgacctcgctgttgccccacttaccatcacatatgttagggaaaaggttatcgacttttccaaacctttcatgacacttgggatatctatcctgtacaggaagcccaacggaactaatccaggcgtgttctctttcttaaacccgctatcaccagacatctggatgtacgtcttactcgcttgcctcggagtgtcttgcgttctgtttgtgatagctcgatttaccccttacgaatggtataatcctcatccatgcaaccccgatagcgacgtggtcgagaataactttaccctattaaactcattctggttcggtgttggtgctctgatgcagcaaggatccgaactaatgccaaaggccctctctaccagaatcgtgggaggcatttggtggttcttcacactcatcataattagcagctacacagctaacctggccgcattcctcacagtagaacggatggagtcaccaatcgactctgccgatgaccttgcaaagcaaactaaaattgagtatggtgctgtgcgggacggttccaccatgaccttctttaaaaagtcgaagattagtacatacgaaaagatgtgggcctttatgagctctcgccagcagaccgctctagtgagaaatagcgacgaggggatccaacgcgtgcttactacggactatgcgctcctaatggaaagcactagcattgagtacgtaacacaacgaaactgcaaccttacccagatcggcgggttgatcgattccaaagggtacggagtcggcacccccatcgggtcaccataccgcgataagatcacaattgcaatactacaactgcaggaggaaggtaagctgcacatgatgaaagagaagtggtggagagggaacggctgtcccgaggaggataacaaggaggccagcgctcttggagtggaaaacatcggagggattttcatcgttctggccgcaggactggttctgtcagtgtttgtggccataggagaatttatttacaagagccgcaagaacaacgatatcgagcagaaaggaaaaagttccagaatacgcttttattttcgtaacaaagtccgcttccacggacgtaagaaacagagcctgggggttgagaagtgtctgtccttcaatgctattatggaggagctggggattagcctgaagaaccaaaagaagatcaagaagaagtcccgtacaaagggcaagtcgagcttcacatccattctgacctgccatcaaagacgaacacagcgtaaagaaaccgttgcctag

SEQ ID NO: 189341 - DNA, 2769 bp, Artificial Sequence
  Description of Artificial Sequence: Synthetic coding sequence
atggagcacggcaccctgctggcccagcccggcctgtggacccgggatacatcttgggcccttctgtactttctctgttacatattgcctcagacagcaccccaggttttaaggatcggcggtattttcgaaaccgtggaaaatgagccggtgaacgtggaagagctcgcattcaaattcgcggtcaccagcattaatcggaacaggacactgatgccaaatacaactttgacctacgacattcagaggattaaccttttcgactcatttgaggccagcaggcgggcctgtgaccagttagctctcggagtggctgccctgtttggtccctcacactctagttccgtgagtgctgtccagtctatctgtaacgcactggaggtgccacacatccagacgcgttggaaacatcccagtgtcgacaacaaagatcttttctacattaacctgtatcccgactacgcagccatcagccgcgctattttggaccttgtactgtactataactggaaaacagttacagttgtgtacgaggactccaccgggctcataagattgcaggaactgataaaggcacccagtaggtataacattaagatcaagatcaggcagctgcctagcggtaataaggacgcaaagcctctgctgaaagagatgaaaaagggcaaggaattttatgtgattttcgattgctctcacgagaccgctgctgaaatcctgaagcagatcctgttcatgggcatgatgacagagtactatcactatttcttcacaaccctcgacctatttgcccttgacctggagttatatagatactctggagtgaatatgaccggttttcggctgctgaatatcgataacccacacgtatcctcaatcattgaaaagtggagcatggagagactgcaggccccccctaggcctgagaccggcctgctcgacggcatgatgactacagaggccgcattgatgtacgacgccgtgtacatggtggccatcgcttcccaccgggccagccagctgacagtttcaagtttgcagtgccacagacacaaaccttggcgattaggacctaggttcatgaacctgatcaaggaagcaaccgcacgctgggacggactcactgggcacatcacattcaataagacaaacggcctccgaaaagatttcgatctggacattatctcactcaaggaggaagggaccgagaaggccgccggcgaagtttctaagcacctctataaagtgtggaagaaaatagggatctggaatagcaattctggcctcaacatgaccgacagcaataaggataaatcttccaacattaccgattccctggctaatcgaactctgatagtcacgaccatcctggaggagccctatgtaatgtacagaaaatcagataagcccctttatggtaatgatagatttgagggttactgcctggatctacttaaagaacttagcaatatcttgggcttcatttacgatgtcaaactcgtgcccgacggaaagtatggggctcagaatgacaaaggcgaatggaatggaatggttaaggagctgattgatcatcgagccgatctggcagtcgcgcctttgactattacatacgttcgagagaaggtgatcgatttctcaaagccatttatgaccctggggatcagcattttgtatcggaaacccaacggcacaaatcccggagtcttttcttttctgaatcccctttcacccgatatctggatgtatgtgttattagcctgcctaggagtgagttgcgtgctgtttgtgatagcccgatttactccttacgagtggtacaaccctcatccttgtaatcccgacagtgatgttgtagagaataatttcactctccttaactcattctggttcggcgtgggcgctttaatgcagcagggctccgaactgatgcccaaggccctgagtactcgaatagtggggggcatctggtggttttttaccttgattattatttcctcttatacagccaatctggctgcctttctcacggtggagcgcatggagtcccccatcgactctgctgatgacctggcaaaacagacaaaaatcgagtacggggctgtcagagatggctcgactatgaccttctttaagaagtcaaagatctccacgtatgaaaagatgtgggccttcatgagttcacggcagcagaccgctttggtaaggaattccgatgagggtatccagcgtgtactgaccaccgactacgcgctcttgatggagtctaccagcatcgaatacgtaactcagaggaattgtaacctcacacagatcggtggtctgatcgactcgaaagggtacggtgtggggactccaatcggctctccgtatcgggataaaatcaccattgctatcctgcagttacaggaagaagggaaactgcacatgatgaaagaaaagtggtggcgaggtaacggttgcccagaggaggacaacaaggaagcctctgcactgggcgtcgaaaatatcggcggtatatttattgtcctggctgccggcctggtgctgtctgttttcgtggccattggagagttcatttacaagtcaaggaagaacaacgatatagagcagtgcctgagtttcaacgccattatggaagagctggggatctccctcaagaatcaaaaaaaaattaagaagaaaagtcgcaccaaaggaaagtcatcttttacttccatattgacatgccatcaacgaagaacccagagaaaagagaccgtggcctag

SEQ ID NO: 189342 - DNA, 2247 bp, Artificial Sequence
  Description of Artificial Sequence: Synthetic coding sequence
atggagcacggcaccctgctggcccagcccggcctgtggacccgggacacctcctgggctctgctgtatttcctgtgttacatcctgccccagactgccccgcaggtgctaaggatcgcttgtgaccaactggcgctgggggtggctgcactctttggtccttcgcacagttcatctgtctcagccgtgcaatctatctgcaacgctttagaggttccgcatatccagacaagatggaagcatccgtcagtggataacaaggatctcttctacattaatctgtatccagattacgcagccatctccagagcaatcttagatctggtcttgtactacaattggaagacagtcaccgttgtttatgaggacagtaccggactgatcaggcttcaggagctgataaaagctccaagccgctacaacatcaagataaaaataaggcaattgccctctggcaacaaggacgcaaagcccctcctgaaagaaatgaaaaagggcaaagaattctatgtaatcttcgactgttctcacgagactgccgccgaaatcctcaagcagatactttttatggggatgatgaccgagtattaccattacttcttcactacactggatctgtttgccctggatctcgagctgtataggtactccggagtgaacatgacaggattccgacttcttaacatcgataacccccacgtgagtagtattattgagaagtggagcatggagaggctccaggctcccccacggccagaaactggactccttgatggaatgatgacaactgaggctgccctgatgtatgacgctgtttacatggttgcgatcgcatctcatcgagccagtcagttgacggtttcatccctccaatgccaccgacataaaccttggagactcggacctaggtttatgaatttaattaaagaagctaggtgggacggtcttactggccatataactttcaataagactaacggcctccgcaaagacttcgatttggacatcatcagcctgaaggaagaaggaactgaaaaaatcggtatctggaatagcaattcaggcctgaacatgaccgattccaataaggacaagtcaagcaacatcaccgattctctcgctaatcgcaccctgatcgtaacaacgattctgagagcagatctagctgtagcaccgttaaccattacctatgtgcgcgagaaagttattgatttctccaaaccatttatgaccctgggtattagtattctgtatcggaaacccaacggaactaatcccggtgttttctcgttcttgaatcctctcagccctgacatttggatgtacgtgctcctggcttgcctgggcgtttcatgtgttctttttgtaatcgcacgttttaccccttatgagtggtacaacccacacccttgtaatcctgattccgatgtggttgagaataatttcacactgctgaattccttctggttcggtgtaggtgctttaatgcagcagggttctgaactaatgcctaaggccctgagcactcgcattgtgggcggtatctggtggttcttcacactgattatcatctcaagttacactgctaacctcgccgcatttttgacggtggagcgcatggagtcacccattgactcggctgacgaccttgctaagcagaccaagattgagtacggcgctgtcagggatgggtccaccatgacatttttcaaaaagagtaaaatcagtacctacgaaaaaatgtgggccttcatgtcctcaaggcagcagactgccctcgtaaggaattcagatgaaggaattcagcgggtgttaaccacagattacgcccttttgatggagtcaacttcaattgagtacgtcactcaacgcaactgtaatctcactcagattggtggactgatcgacagtaaaggatacggcgtcgggacacctattggatctccctacagggacaagattactatcgcaatcctgcagctgcaagaggaaggaaaactgcacatgatgaaggagaagtggtggagagggaacggttgcccagaggaggataataaggaagcttcggctctaggggttgaaaacatcggcgggatctttatcgtcttggctgccgggctagtcctaagtgtgttcgtcgcaataggcgaatttatctacaaaagccgaaagaacaacgacatagaacagtgtctttccttcaatgccataatggaggaactcggcattagcttaaaaaaccagtag

SEQ ID NO: 189343 - DNA, 2610 bp, Artificial Sequence
  Description of Artificial Sequence: Synthetic coding sequence
atgaagatcatcttccccatcctgagcaaccccgtgttccggcggaccgtgaaacttctgctgtgcttgttatggatcggctacagtcagggaacaactcacgttttgaggtttggggggatcttcgaatatgttgagtcaggcccaatgggggccgaagagcttgccttccgctttgcagtcaatacgatcaacaggaatcgtactctactgcctaatacaacgctgacttacgacacccagaagatcaacttgtatgacagctttgaagcatctaaaaaggcttgtgatcaactttctcttggcgtcgccgccatcttcggcccaagccactcctcatctgccaatgctgtccagtcaatctgcaatgcccttggggtgccccacatccagactcgctggaagcaccaggtatctgacaacaaagactcgttttatgtgagtctgtatccagatttttcctccttgtcgagggccatactggatctcgtacagttcttcaagtggaaaacagtgacagtggtgtacgacgacagtaccgggctcattcggctgcaggaactcattaaggctccaagcaggtataatttgcgcctgaagattcgtcagctgcccgccgataccaaggatgctaagcctttacttaaggaaatgaagagaggcaaagagtttcatgtgatcttcgactgctcccatgagatggccgccggaatattgaaacaagccttagccatggggatgatgacggagtactatcattacatcttcactaccctggacttgttcgcacttgacgtcgagccttatcgctacagtggcgtgaacatgaccggcttcaggattcttaacaccgagaacacacaggtaagtagcatcatcgaaaaatggtcgatggagcggctgcaagccccaccaaagcccgatagcggactgcttgatggctttatgaccaccgacgccgcgctgatgtatgacgcggtgcacgtggttagcgtggccgtgcaacaatttccgcagatgactgtgtcctccctccagtgcaaccgacataagccgtggcggtttggaaccaggttcatgagcctgattaaggaagcacactgggaagggctcacaggtcgtattacctttaataagactaacggattgcgcaccgacttcgatctcgatgtgattagcctcaaggaagaggggctcgaaaagatcggaacgtgggatcccgcttctggcctgaacatgaccgaaagccagaagggcaagccagctaatatcacagacagcctcagcaatcgcagcctgatagtgacaacaattcttgaagaaccgtacgtgttgtttaaaaaatcagacaagcctctgtatggcaatgaccgatttgagggctactgtattgatttgcttagagagttgagtacaattctgggatttacttatgagatccgcctggttgaagacggaaagtacggagctcaggacgatgctaatggacagtggaatggtatggttagggagctgatagatcataaagctgacctcgctgtcgctccactcgcaatcacctatgtaagggaaaaagtaatcgatttttccaagccgttcatgactttgggcatcagcattctttacaggaagcctaacggcaccaaccctggagtctttagctttctcaatccgttgtctcccgacatctggatgtacatactgctggcctatctcggcgtgtcttgcgtgttgtttgttattgctcgtttcagtccctacgagtggtataacccccatccgtgcaatccagacagtgatgtggttgaaaacaactttacattgctaaattctttttggttcggcgtgggagcccttatgcagcaggggtccgaattgatgccaaaagccctgtcaacaagaatcgttggcggcatatggtggtttttcactctgatcattattagctcctatacggccaatctcgccgcattcctcacggttgagcgaatggaaagccccattgactctgctgacgacctcgcaaagcagactaaaattgagtacggagctgtcgaagatggcgccaccatgacattcttcaagaaatccaagatctctacatatgataagatgtgggctttcatgagctccagaagacagtctgtattggtcaagagcaacgaagagggcatccaaagagtccttacgtcagattatgcttttctgatggaaagtaccactatagaattcgtgactcagaggaattgcaacctgacccagatcggaggcttgattgatagtaagggatacggtgttggaacacctatgggttctccctatagagacaaaattactatcgctattctgcagctgcaggaggaagggaagctgcatatgatgaaggaaaaatggtggcgcgggaatggctgcccagaagaagaatcaaaagaggcttctgcgctgggtgttcagaatatcggagggattttcattgtcctggcagctggtctcgtacttagtgtgtttgtagccgtgggagaattcctgtataagagcaaaaagaatgcgcaactcgagaaggagtcctcgatctggctcgtgcctccttatcaccccgatacggtgtag

SEQ ID NO: 189344 - DNA, 2580 bp, Artificial Sequence
  Description of Artificial Sequence: Synthetic coding sequence
atgggcgccgaggagctggccttccggttcgccgtgaacaccatcaatcgcaaccgcactctgctcccgaacactacactcacctatgatacgcagaaaatcaacttgtatgacagctttgaagcgtctaaaaaggcttgcgaccagctgagtttgggcgtagccgcgatctttggaccgtcccattcctcaagcgccaacgctgttcagagtatttgtaacgccctgggagtgcctcacattcagaccagatggaagcaccaggtgagcgacaataaagacagcttctatgtcagcctgtatccagacttctcaagtctgtctagggcaatcctggacttggtgcagttctttaaatggaagactgtgaccgtggtttatgacgatagtacgggtttaatcagactgcaggaactcattaaggctcctagtcgctacaatttgaggctcaaaatacggcagctccccgctgatactaaggacgctaaaccactgctgaaggagatgaaacggggaaaggagttccacgtgattttcgactgttcgcatgaaatggctgccggaatattaaagcaggctttggctatgggaatgatgacagagtattaccactacatttttacaaccctggatttgtttgccctcgatgtggagccttatagatattctggggtcaacatgacagggttcaggattctaaatacagagaatacacaggtgtcgtccattatagaaaaatggtccatggagcggttacaagccccgccaaagcccgactccgggctcctggacgggtttatgacaacagacgccgcgctgatgtacgacgctgtccacgtggtttctgtggcagtacagcagttcccccaaatgacagttagcagcctccagtgtaatcggcataaaccttggcgctttggcacacgttttatgtctctgattaaggaagctcattgggagggtctcactggtagaatcacctttaataagaccaatggtctgcgaacggacttcgatttagatgtgatctctctcaaggaggaaggcttggaaaagatcggaacgtgggacccagcctcaggcctgaacatgaccgaatcgcagaaaggcaaacctgccaatattactgattcattatctaacagaagcctcattgttacaactattttggaagaaccgtacgtgctctttaaaaagtctgacaaaccactgtacgggaatgaccgttttgaaggctattgtatcgatctgctaagggaattgagcaccattctgggctttacctatgaaatccgacttgtggaagacggcaagtatggagcacaggatgatgccaacgggcagtggaatggcatggtgagagagcttatcgaccataaagcggatctcgccgtggctccccttgcgatcacttacgtgagggagaaagttattgattttagtaagccttttatgactttaggcatctcaattctgtaccgaaaacctaacggaaccaatcccggcgtattctctttcctcaaccctctctcacccgatatttggatgtatatcctgttagcataccttggtgtatcttgcgtcttgtttgtgatagcgcggtttagtccatacgagtggtataatccgcatccatgcaatccagactccgatgtggtggaaaataacttcaccctgctgaatagtttctggtttggggtaggagcgctgatgcagcagggctcagagctcatgcccaaagcgctgagcactagaatcgtgggcggaatttggtggttttttaccctgattataatttcgtcctacaccgccaatttggccgctttcttaacagttgaacgcatggaatcccctattgactctgcagatgacctggccaagcaaactaagatcgagtacggagcagttgaggacggcgcaacaatgacgttcttcaaaaaaagcaaaattagcacttatgacaaaatgtgggcgtttatgagttccagacgtcaatcagtgctagtgaaaagcaacgaagaaggtattcagcgtgtactcaccagcgattatgccttcttgatggaatccactactattgaatttgtgacacaacgtaactgtaacctgacccagataggaggtctaattgattctaaaggctatggcgttggaaccccaatgggctcaccctatagagacaaaatcaccatcgcgattctgcagcttcaggaggagggcaagctccacatgatgaaggaaaagtggtggagaggaaacggctgtcccgaagaggaaagtaaggaggcgtctgccctgggcgtgcagaacataggagggatctttattgtcctggcagcagggctggtactgtcggtgttcgtcgccgttggggaattcctgtacaagagcaagaaaaacgcccagttggaaaagaggtccttttgttcagctatggtggaggaactcaggatgtccctgaaatgtcagcggcgcttaaagcacaagccacaggcccctgtaatcgtgaaaacagaagaggtgattaacatgcataccttcaatgatagaagactgcccgggaaagaaaccatggcctag

SEQ ID NO: 189345 - DNA, 2499 bp, Artificial Sequence
  Description of Artificial Sequence: Synthetic coding sequence
atgaagatcatcttccccatcctgagcaaccccgtgttccggcggacagtgaaattacttctgtgtctactgtggatcgggtatagccagggaaccacgcatgtccttaggtttggtgggattttcgagtacgttgagtctgggccaatgggagccgaagagttagcattccgcttcgccgtgaacaccattaatagaaaccgtacactccttccaaacacaacactaacatatgatactcaaaagatcaacctgtacgactccttcgaggctagcaagaaagcttgcgatcagctatccctgggggtcgccgcaatatttggaccatcccactcctcatccgccaacgccgttcagtccatatgcaatgcactaggtgtcccccacatccagacacgctggaagcatcaggtgagtgataacaaggactccttttatgtgtcactatatcccgactttagttcgctgtctagggccatactcgaccttgtacagttttttaaatggaaaaccgtgactgttgtatatgatgactcaacaggtcttattagactacaggaactgataaaagcaccgagccgctacaacctgcggctcaagataaggcagctccccgcagacaccaaggatgctaagccattgttaaaggagatgaaacgggggaaagagttccacgtgattttcgactgctctcatgaaatggctgccggcatcctcaagcaggctctcgcaatgggaatgatgactgagtattaccactatatattcacaacactggaccttttcgccctggatgttgagccttaccgttattctggagttaacatgactggtttcagaatcctaaatactgaaaacactcaggtgagttctattatagagaaatggagtatggaaaggttgcaggctcctcccaagcctgatagtggcctccttgatggatttatgacaacagatgctgccctgatgtacgacgccgtgcatgtcgtgagcgtagccgttcagcagtttcctcagatgacagtaagctctctccagtgcaataggcacaaaccttggaggttcgggacacgctttatgtccttgatcaaggaggcccactgggaggggctgactggccgaataaccttcaacaagaccaacggcttaaggactgatttcgatctggacgtgataagcctaaaagaggagggtctagagaagataggtacatgggatcccgcaagtggcctcaacatgaccgagagtcagaagggtaaacccgccaacatcaccgatagcttgtctaacagatcactgattgtcaccaccattctcgaggagccttatgtgttgtttaaaaagagtgataagcccctgtacgggaatgaccgatttgagggctactgtattgatctgttgagagaactgagtacaattctcgggtttacatacgagattcgtttagtggaagacggtaagtatggcgcacaggatgatgccaatggacagtggaacggcatggtgcgcgagctgattgatcacaaggccgatctggccgttgccccactggctatcacatacgttcgagagaaagtgatagattttagcaaacccttcatgacactgggtattagcatcttgtaccggaagcctaacggtagcgagctgatgccgaaggccctcagtaccaggatcgtgggcggaatctggtggtttttcacactcattattatttctagctacacagcgaatctggctgccttcctcacggttgaaaggatggaatcgccaattgacagtgccgacgatctcgccaagcagaccaagattgaatatggggccgtggaagacggcgccacgatgacttttttcaagaagagcaagataagtacctatgacaagatgtgggcattcatgtcctcccgccgccagtctgttcttgtcaaatccaacgaggaaggtattcaaagagtcctgacctccgactacgcttttctaatggagagcaccaccatcgaatttgtgacccaacggaactgtaatctcacacagatcggcggactgatcgactccaagggttatggagtcggtactcctatgggatccccctatcgagacaaaattactattgccatcctgcaattgcaggaggaaggaaaattgcacatgatgaaggagaagtggtggcgagggaatggctgcccagaggaggagtccaaggaagccagcgctctgggcgtgcagaacataggcgggatttttatcgtgcttgcggcaggcttagtgctttctgtgttcgtggcagttggcgaatttctgtataagtcgaaaaaaaacgcacaattggaaaagaggtccttctgctctgcgatggtggaagaactccgtatgagcctgaaatgccaacgcagactcaaacataaacctcaggcgcccgtgatcgtcaagacagaggaagtgattaacatgcacactttcaatgatcgccgactacctgggaaggagaccatggcatag

SEQ ID NO: 189346 - DNA, 2679 bp, Artificial Sequence
  Description of Artificial Sequence: Synthetic coding sequence
atgaagatcatcttccccatcctgagcaaccccgtgttccggcggactgtcaaactgctgctctgccttctgtggataggttattcacagggcaccacacacgtgttgcgattcggtggcatcttcgagtacgtggagagtggaccgatgggcgccgaagagctggcttttagatttgcagtgaacacgatcaatcgaaatagaaccctcctccctaatactacattgacttacgacacccagaagataaacttgtacgatagtttcgaagcctccaagaaggcatgcgatcagttgagtctcggagtggctgccatattcgggcccagtcattcctctagcgcaaatgctgttcaaagcatttgcaacgccctgggagttcctcatatccagacccgttggaagcatcaggtcagcgataataaggactcattttatgtttctctgtaccccgactttagctcactgagccgagctatccttgacctggttcagtttttcaagtggaaaacagtcacagtggtgtatgatgactctaccggtttaattcgtctacaggaactaataaaagccccatcccggtacaacttacgcctcaagatacgccagctgcctgccgatacaaaagacgccaagccccttttaaaagaaatgaagagaggcaaggagttccacgtgatttttgactgcagtcacgaaatggctgctggaatactgaaacaggcattggcaatgggcatgatgaccgagtactaccactatatctttaccacactcgatctcttcgcgctagatgtggagccctacagatatagcggcgtgaatatgaccgggttccgcattttgaacacagaaaatacgcaagtaagcagcatcatcgaaaagtggtcaatggagaggctacaagctccccctaagcccgactccgggttgcttgatgggtttatgaccaccgatgcggctctgatgtacgacgcagtccatgttgtgtctgtggcagttcagcaattccctcagatgaccgtgagtagtctgcaatgtaatcggcacaaaccatggcgcttcggcacacgcttcatgagtctcatcaaggaggctcactgggagggattgaccggcaggattacatttaacaagacgaacgggctccgcacagatttcgacctggacgtgatttcgttgaaagaggaggggctggaaaaaattggaacatgggatcccgcatctggtctcaatatgacagagtctcaaaaaggtaagcctgctaacataactgactccctcagcaacagatcactgattgtgaccacgatcctcgaagaaccctatgtccttttcaagaagtcggacaagcccttatatggaaatgaccggttcgagggctattgtatcgatctgcttcgagagctgtccacaatcttggggttcacttacgaaatacggttagtcgaggatggcaagtacggcgcacaggacgacgccaacgggcaatggaatggcatggtgcgggaactgatcgaccacaaagcagacttggctgttgctcccttagctataacctatgtacgggaaaaggtgatcgattttagtaagccgtttatgaccctcggcattagtatcttatatcgaaagcctaacgggactaacccgggggtcttttccttcttgaatccactcagccccgacatctggatgtatattctgctggcctacctgggcgtgagctgcgtactgttcgtgatcgcaagatttagtccatacgagtggtacaaccctcacccttgtaatcctgacagcgacgtggtggagaataacttcaccctccttaacagtttctggttcggtgttggcgccttaatgcagcaggggtcagaacttatgcccaaagcactgagcacgagaatagttggaggtatttggtggttttttaccttgatcatcattagcagttataccgctaaccttgccgcatttctgacagtagaacggatggagagcccaatcgactctgccgacgaccttgcaaagcagacaaagattgagtacggcgcggtggaggatggagccactatgaccttttttaagaaatctaagatctcgacttatgacaagatgtgggcctttatgagttctaggagacagtctgtgctggtaaagtccaacgaggagggtattcaaagggtgctgacctcagactacgccttcttgatggagtctacaaccatagagtttgtgactcaacgcaactgcaatcttactcagattggaggcctgattgactcaaaggggtacggtgtcggcaccccgatgggcagtccctaccgtgataagattactatcgccatactgcaattgcaagaggagggcaagctccatatgatgaaagaaaagtggtggagggggaacggctgtccagaggaggagagcaaggaggcgtctgcgctgggagtgcaaaatatcggcggaatcttcatcgtgctggctgccggcctggtgctttccgtgttcgtggctgtgggggagttcctttataagagcaaaaagaatgcccaactggagaaacgggctaagactaagctgcctcaagactacgtgttcctgcccattctggaatcagtcagcatatccaccgtcctgagttccagcccctcttcttcctcattgtcttcttgtagctag

SEQ ID NO: 189347 - DNA, 1755 bp, Artificial Sequence
  Description of Artificial Sequence: Synthetic coding sequence
atgaagatcatcttccccatcctgagcaaccccgtgttccggcggaccgtgaaacttcttttgtgtctcctgtggatcggctactcccagggcactacacatgtgctgaggttcggaggaatttttgagtatgttgagtcaggcccaatgggcgcagaagagctggcctttcggtttgctgttaatactattaatcgcaatagaaccctgctgccgaacacaaccctgacctatgacactcagaaaattaacctgtatgacagctttgaggccagcaaaaaggcttgcgatcaactgagtctgggggtggctgctatcttcgggcctagccactccagtagtgctaacgcagttcagagcatctgtaacgccctaggcgtgcctcacattcagacgaggtggaagcaccaggtatctgataacaaggactcgttttacgtgtcactgtaccccgacttcagttccctaagtagagcaatcctagatctcgttcagtttttcaaatggaaaactgtaacggttgtttacgatgattcaaccggcctaatccgactacaagagctgattaaggcccctagcagatacaatctcagactgaagatcaggcagttgcctgccgataccaaagatgccaagccgctcctgaaggaaatgaagcggggaaaggagtttcatgtcatattcgattgtagccatgaaatggctgccgggatcctgaaacaggctcttgccatggggatgatgaccgagtattatcattatattttcaccacgctggacctgttcgccctggacgtcgagccttaccgctacagtggcgtcaacatgacaggctttagaatcctcaatactgagaatacacaggtgtcaagcatcattgagaagtggtccatggagcggctccaggcacctcccaagccagatagcggactcctggatggctttatgactacagatgctgccctgatgtacgacgccgtacacgttgtgagcgtagccgttcaacagtttccccagatgaccgtctccagtctgcaatgtaaccgccataaaccgtggaggtttggcaccaggtttatgtcactcattaaggaagcacattgggagggcctgactggccgcattacattcaataagactaatgggttgcggaccgatttcgatctggacgtgattagtctcaaggaagagggtttagagaaaatcggcacatgggatccagccagcgggttgaacatgaccgaatcccagaaaggcaagccagctaacattacagattccctaagcaatagaagcttgatcgtcacaactattcttgaggagccttacgtcctattcaagaagagcgacaagcctctttacgggaacgataggtttgaagggtactgtatcgacctgctgcgggagcttagcaccatactcgggttcacatacgagatccgactcgtggaggatggaaagtatggcgcccaggacgacgcaaatggtcagtggaacggtatggttagagagctcatcgatcataaggcggacctcgcggtcgccccccttgctatcacatacgttcgggagaaagtgatcgactttagcaagccatttatgactctgggtattagcatactctaccgtaagcccaacgggaccaaccctggggtgttctctttcttgaaccctctgtcccctgacatctggatgtacatactgctggcgtacctgggcgtaagctgcgtacttttcgttatcgcgagattttag

SEQ ID NO: 189348 - DNA, 2610 bp, Artificial Sequence
  Description of Artificial Sequence: Synthetic coding sequence
atgaagatcatcttccccatcctgagcaaccccgtgttccggcggacggtgaaattgctcctgtgtctactgtggataggatactctcagggtaccacgcacgtgttgcgcttcggaggcattttcgagtacgtggagtccggacctatgggggcggaggaactggctttccgctttgccgttaatactattaaccgtaataggacactgctccccaataccacccttacatatgacacacagaagattaacctttatgacagcttcgaggctagtaaaaaggcatgtgaccaattgtctttgggcgtcgcagctatttttggaccctcgcattcgtcttcagcaaatgcggtccagtctatctgcaatgcccttggagtcccacacatacagaccaggtggaaacaccaagtatccgacaataaagactccttctacgtcagcctgtaccctgatttttcaagtctgtccagagctatcctagacctggtccagttcttcaagtggaaaaccgtgaccgtagtttacgatgattcaactggtctgataaggttgcaggaactgatcaaagcaccaagtaggtataatctacggctcaagatccgtcagcttccagccgacacaaaagatgcaaaacctctgctcaaggagatgaagcggggaaaagagttccacgtcatcttcgattgcagtcacgagatggcggctggaattcttaaacaggccctggcaatgggaatgatgaccgagtactaccattatatctttacaaccctggaccttttcgcactcgacgtggaaccatatagatattccggagttaacatgacgggctttcgaatcctcaatacagagaacacacaggtctcctctataattgaaaaatggtcaatggagaggctgcaggcaccacctaaacctgactccggcctcctggacgggtttatgaccactgatgcagcattaatgtacgatgctgtccatgttgtcagcgtcgccgttcagcagtttcctcaaatgaccgtctcttccctccagtgcaaccggcataagccttggcgctttggaacccgctttatgtccctgatcaaagaagctcactgggaggggctgacaggaagaatcacttttaacaaaaccaacggactgcggacagattttgatctcgacgtcatctcccttaaagaagaaggtctcgaaaagatcgggacgtgggatccagcctccggcctgaacatgacagagtcccaaaaagggaagccagctaatataacggactcactaagtaacaggtctctcatcgtcaccacaattctggaagagccttacgtgttatttaagaagtctgacaagcctctctacggcaacgacagattcgagggctattgtattgacctgctccgtgagcttagcaccatactcggattcacatacgaaatcagattggtggaagacggcaagtacggggcccaggatgatgctaatggccagtggaatgggatggttcgtgagctgatcgaccataaggccgacctggcagttgccccgctagccataacctacgtgcgcgagaaggtcattgatttctcaaagccctttatgactctgggcatcagcatcctgtaccgcaaaccaaatggcaccaatcctggagtgttcagctttctcaatcccttaagtccagacatctggatgtacatcctcctggcttacttgggagtttcctgtgttctttttgttattgcgagattcagcccctacgagtggtacaacccgcacccctgcaaccctgattccgatgtggtggagaacaacttcacactgttaaacagcttctggtttggggtgggcgccctgatgcaacagggtagtgagctgatgcctaaggctctgtccacacgcattgtgggaggtatctggtggttttttacactgatcataatcagctcttataccgccaatctggcagcatttttgaccgtggagcggatggagtccccaatcgacagtgcagacgatctggccaagcagacaaaaatcgaatatggcgctgttgaagatggagccaccatgacttttttcaagaagtcgaaaataagcacgtacgataagatgtgggccttcatgagttcaagacgccagtccgtactggttaagagcaacgaagaaggcattcaaagggtgctgacatctgactacgcttttctgatggagagcaccacaattgaattcgtcacccagcggaattgtaacttgacccagattggaggcctgatagatagcaaaggttatggagtgggcaccccgatgggttcaccctacagggataaaataacaattgctatcctgcagcttcaggaagaaggcaaattgcacatgatgaaagaaaagtggtggcgcggcaatgggtgcccggaggaggaatccaaggaggcaagcgctctgggcgtgcagaatattggcgggatttttatagtgctggctgccggactagtcctttctgtgttcgtggccgtgggggagttcctgtataaaagcaagaagaatgcccaactcgagaaggagagttctatttggctggttcctccttatcatcctgacactgtctag

SEQ ID NO: 189349 - DNA, 2727 bp, Artificial Sequence
  Description of Artificial Sequence: Synthetic coding sequence
atgaagatcatcttccccatcctgagcaaccccgtgttccggcggaccgtgaagctccttttgtgcctcctgtggatcggttattcgcagggtaccacgcacgttttaagatttggaggcatatttgagtatgtggagtccgggccaatgggggccgaggaactggccttccggtttgctgtgaacacaatcaatcggaataggacccttcttccaaacactaccctgacatacgacacccagaagatcaacctttacgactctttcgaggccagcaagaaggcctgcgaccagttaagtttgggagtggctgccatattcggcccgagtcatagtagctccgctaacgctgtccaaagtatctgtaacgcgctgggcgtccctcacattcagactagatggaagcatcaggtgtcggataacaaggacagcttttatgtgtcgctgtaccctgacttttcatccctcagcagagctattctggacctcgttcagttctttaagtggaagaccgttactgtggtgtatgacgactccacaggcctgatccgtctgcaggaactgattaaggctcccagtagatataacttgagactgaaaattcgccagctgcccgcagataccaaggacgccaagccgctgctgaaggaaatgaagcgcggtaaggagtttcacgtcatattcgattgctctcatgagatggctgccggaatcctgaagcaggctctggctatggggatgatgactgagtactaccactacatcttcaccacactggacctattcgcgctggacgtggaaccctatcggtactctggcgtgaacatgactggatttaggatcctgaatacagaaaacactcaggtttcttccattatcgagaagtggtcaatggaaagactgcaggccccccctaagcctgactcaggcctactggacggatttatgacaaccgacgcagctcttatgtacgacgccgtgcatgttgtgtccgtggcggtccagcagtttccccagatgaccgtgagcagtctccagtgcaacagacataagccctggcgtttcgggaccagattcatgtcgctgatcaaagaggcgcactgggaaggtctgaccggaagaataacctttaataaaactaacgggcttagaaccgatttcgatctcgacgtgatttctctcaaggaggagggtctagagaagatcggtacctgggaccccgcatcgggactgaacatgactgagtcccagaaaggaaagcccgctaatatcaccgattcacttagtaataggtctctgatagttacaaccattttagaggaaccatacgtcctgtttaaaaagtctgacaaaccactctacggtaatgacaggttcgagggctattgtattgatctgcttagggaactgtccactatcttggggttcacgtacgaaataaggctggtggaggacggaaagtatggagcccaggacgatgccaacggacagtggaacggcatggtccgggaactgatcgatcataaagccgacctcgcagtggccccgctagctattacatatgtgcgcgaaaaagtgatagatttctccaagcctttcatgactttgggcatttcaatcctttaccgaaaacctaatgggaccaaccccggggtattctctttccttaatcccctgagccctgatatctggatgtatatcctgttggcatatctcggcgtgagttgtgtactcttcgtgatcgcacggttctctccttatgagtggtataatcctcatccgtgtaatccggattccgacgttgtcgagaataatttcactctgctgaatagtttctggtttggcgtcggcgcactgatgcagcaggggagcgaattgatgcccaaggcccttagtaccagaattgtgggcggcatctggtggttttttaccctcatcatcattagctcgtacaccgccaatctggcagccttcctgactgtagagcgtatggaatcccctattgactctgcggacgatctggcgaagcagactaagatcgaatacggcgctgtggaagatggggcaacaatgactttctttaaaaaatctaagatttctacgtatgacaagatgtgggcctttatgagctcacgaaggcagagcgtattggttaaaagcaacgaggagggcatccagcgcgtccttacttccgattatgccttcctcatggaatccaccacaattgaattcgtcacccaacgtaactgtaatctgactcaaatcgggggtctcattgactccaaggggtacggcgttggcaccccaatgggttccccataccgcgataaaatcactattgcaattctgcagctgcaagaagaagggaagctgcatatgatgaaggagaagtggtggcgcggcaacgggtgcccagaagaagagagtaaagaagccagcgccctcggcgtacagaacattggtggtatctttatagttctggcagccggccttgtactgagtgttttcgtggcagtgggggaattcttgtataaaagcaagaagaacgcccagcttgagaagcgctcattttgttcagccatggtagaggagcttagaatgtctctgaagtgccaacgacgacttaagcacaaacctcaggcaccagttatcgtaaaaacggaagaggtgattaatatgcacacctttaacgaccgacggctcccaggcaaggaaactatggcttag

SEQ ID NO: 189350 - DNA, 1935 bp, Artificial Sequence
  Description of Artificial Sequence: Synthetic coding sequence
ggcggcatcttcgagtacgtggagagcggccccatgggcgccgaggagctggctttccggtttgctgtcaacaccattaatcgaaatcggaccctgttgcccaatacaaccctcacatatgacacacagaaaattaatctttatgacagctttgaggcaagtaagaaggcatgtgaccaactttctttgggcgtcgcggccatttttggccctagccactcatcaagtgccaatgctgtgcagtccatttgcaacgctttaggtgtcccccacattcagaccagatggaagcatcaagtgagcgacaataaagacagcttttatgtatctctgtatccggatttcagctcactgagtcgcgccatcctggacctggtccagtttttcaagtggaaaaccgtaactgtggtttacgatgacagcactgggttgatcagactgcaagagttgatcaaggctcccagcagatacaatctgcgattgaagatcagacagctgcccgctgataccaaggatgcaaagccactccttaaggaaatgaaacgaggaaaagagttccacgtaatcttcgactgctcccacgaaatggccgcaggcattctgaaacaggcccttgccatgggcatgatgaccgaatattaccattatatcttcacgaccttggatctctttgccttggacgtggaaccctaccggtacagcggagtcaatatgactgggtttaggatcttaaataccgaaaatacacaggtctcaagcattatcgaaaagtggtcgatggaacggttgcaggcgcccccaaagcccgactccggactcctagatgggtttatgacaactgacgcagccttaatgtacgacgcagtacacgtggtgagtgtggcggtgcagcagttcccgcagatgaccgtgtcatccctgcaatgtaatagacataagccatggcgattcggaactaggtttatgtccctgattaaggaagcccattgggaagggcttaccgggcggattacattcaataagactaatggactgcggacggatttcgatctcgacgtcatttctctgaaggaagagggtcttgaaaaaataggcacctgggatccagctagtggcctgaatatgacagaatcccaaaagggcaagcccgcaaatatcactgacagcttgagcaacaggagtctgatcgtgacaaccatccttgaagaaccttacgtgctgttcaaaaaatctgacaaacccttgtatgggaacgaccggttcgagggatactgcatcgatctgctacgcgaactaagcactattttgggtttcacttatgaaattagactggtggaggacgggaagtatggagcacaagacgacgccaatgggcagtggaacggcatggtgagggaattaattgaccacaaaagcaaaatatccacctacgataagatgtgggcattcatgtcatcacgccgccagtcggtcctcgtgaaatccaacgaagaaggcattcagagagttctcaccagtgattacgctttcctgatggagtccaccacgatcgaattcgttacccaaaggaactgcaacctaacccagataggaggcctgattgattcaaaaggctacggcgtgggaacgccaatgggaagcccgtatagggacaaaataacaattgccatcctgcagctccaagaggaggggaagctccatatgatgaaggaaaagtggtggagaggaaacgggtgccccgaagaggagagtaaggaggcctccgctttgggggtacaaaatatcggggggatcttcattgtgttggcagctggacttgtgctgagcgtgtttgtggcagtgggtgagttcctttacaaatctaaaaagaatgcccaattggagaaggaatcctcaatttggcttgtgccaccctatcaccctgatactgtgtag

SEQ ID NO: 189351 - DNA, 2760 bp, Artificial Sequence
  Description of Artificial Sequence: Synthetic coding sequence
atgaccgccccctggcggcggctgcggagcctggtgtgggagtactgggctggcctgctggtttgcgccttctggatacctgactctaggggcatgccccatgtgattaggattggcggtatctttgagtatgccgatggcccaaatgctcaggtgatgaatgccgaagagcacgcattcaggttctcagcgaacatcatcaacagaaaccgcaccttgttgcctaatacaacgcttacatacgatatacaaaggattcacttccatgactccttcgaagccaccaagaaagcatgcgaccagctcgcactgggagtggttgctatcttcggaccatcccaggggtcctgcactaatgctgtgcagagcatttgcaacgcccttgaggttcctcatattcagttgcgctggaaacatcaccctttagacaataaggacacattctacgtcaacctgtaccccgattacgcatccctgtctcacgctattctcgacctggtgcaatatttgaagtggcgcagtgcaacagtcgtgtatgacgatagtaccgggctgatacggctgcaagagttgataatggctccgtccagatataacatccgcctgaaaattcgacagctccccatcgacagcgatgacagtcggccattgctgaaggagatgaagcgcggaagagagttccgcatcattttcgattgctctcacaccatggctgctcagattctgaagcaggccatggcgatgggcatgatgactgaatactaccacttcatcttcactacactggatctatacgccctggacctcgagccctatagatattcaggcgtcaatctaacgggctttcggattctcaatgtcgataaccctcatgtatccgctatcgtggagaaatggtcaatggagcggctacaggcagcgcccagaagcgagagcggcctgctcgatggcgtgatgatgaccgatgctgcgctcctgtacgatgccgtgcacatagtatcagtatgctaccaaagagcgccacaaatgacagtcaactccctgcagtgtcatcggcacaaagcatggaggtttggtggccggttcatgaatttcatcaaagaggcccagtgggaaggactcaccggccgcatagtctttaataaaacctctggcctgcgaacagattttgatctcgatattatcagtcttaaggaagacggtctggagaaagtgggtgtgtggagccctgcagacgggctgaacatcactgaggtagctaagggtcgtgggcccaatgtaaccgattcactgacaaaccgttcactaattgtaacaacggtgctcgaggaacccttcgtgatgtttcgaaaatcagaccgcactctctacggtaatgacaggttcgagggctactgtatcgatttgctgaaagagttggcgcatattttaggattcagctatgagatcagactcgttgaggacgggaagtacggcgctcaggatgataaaggccaatggaacggcatggtcaaggagctgatagaccacaaggcagatctcgcagtggccccacttacaatcacgcacgtaagggagaaggccatcgacttttctaagccgtttatgaccctgggcgtgtcgatcttgtaccgcaaacccaacggcaccaatcctagtgtgtttagttttctgaaccctttaagtcccgacatttggatgtatgtgctcttggcataccttggggttagctgcgtgctgtttgtaattgcccggttctccccgtatgaatggtatgatgcccacccatgcaaccctggctcagaggtcgttgagaataacttcactctcctcaatagcttctggtttggcatgggcagcctcatgcagcagggttcagagttaatgcctaaggctttgtccactcggattataggcgggatctggtggttctttactttaatcatcatttcatcttatacagccaatctcgcagcattccttacagtcgagcgcatggagtcccccattgatagtgccgacgatctggccaagcagacaaagattgagtatggtgccgtaaaagatggagccactatgaccttcttcaagaagtccaagattagtacattcgagaaaatgtgggccttcatgtcttctaagccctcagctcttgtgaagaacaatgaggagggtatccagagagcactaactgctgactacgctttgctcatggagtctaccaccattgagtacgtgacccagcggaactgcaatttgactcagattgggggcttgattgattccaaaggttatggcatcgggacacccatgggatccccctacagggataagatcactattgccatcctgcagttgcaagaagaggataaactgcacataatgaaagagaaatggtggcgcggctctggatgccccgaagaggaaaacaaagaggcctccgcactggggatccaaaagatcgggggcatcttcattgtgctggccgcgggactggttctcagtgtgttagtagccgttggagaatttgtatacaagctgagaaagactgccgaacgggaacagcgttcattctgttccacagtggcagacgaaatacgcttctccctcacatgccagcggcgggtcaagcacaaacctcagccaccaatgatggtcaagaccgatgccgttattaacatgcacacattcaacgatagacggctccctggtaaagattctatggcctgctccacgtcgcttgctcccgtattcccgtag

SEQ ID NO: 189352 - DNA, 2619 bp, Artificial Sequence
  Description of Artificial Sequence: Synthetic coding sequence
atgaccgccccctggcggcggctgcggagcctggtgtgggagtactgggcgggccttctcgtgtgcgctttctggattcccgatagtaggggaatgccccacgtcattagaataggcggcatcttcgaatatgctgacggtcccaatgcccaagtgatgaacgccgaagagcacgcttttcgctttagcgcaaatatcatcaataggaacagaaccctactgccaaatacgacccttacatacgacattcagagaattcatttccatgattctttcgaagcgacaaagaaagcgtgcgaccagttggcactcggggtggttgctatattcggcccctcacaaggatcttgcacaaatgccgtccagtccatttgcaatgcacttgaggtcccccacatacaactccgttggaaacatcaccctcttgacaacaaggacacattttatgtgaatctgtaccccgactatgccagtctatcacatgccattctcgacttggtacaatatctcaagtggcgaagtgccacagttgtttacgacgattcgaccggacttatccgcctacaggagctcattatggcaccctctagatacaacatcaggctgaaaataaggcagctgcccatcgacagcgatgacagcaggccattgctgaaggaaatgaaacgaggcagagagttccgcatcatattcgactgctcacataccatggcagctcagatcttgaagcaggcaatggcgatggggatgatgacagaatactatcactttattttcactacgcttgatctgtatgctctagacctggagccttacagatatagcggcgtcaatctgaccggcttcaggatcttaaacgtggataacccccacgtttctgctattgtcgagaaatggtctatggagaggttgcaagcagcacctcggtccgagagcggcctcctcgacggggtcatgatgacagacgccgctctgttgtacgatgccgtacatattgttagcgtgtgctatcagagggcaccgcagatgacggttaacagtctgcagtgtcatcgccacaaagcctggcgcttcggtggacgctttatgaatttcattaaagaggcccagtgggaagggctgaccggaagaattgtgtttaacaagacctccggcctcagaacagattttgacctggacataatttccctgaaagaggacggcctggagaaggtgggtgtgtggagccctgccgatggtttgaatatcactgaggtggcaaaaggtcgcggacctaacgtgacggatagcctgaccaaccgtagcctaattgtcactacggtgctggaggagccctttgtgatgttcaggaaatcagatagaactctgtacggcaatgatagatttgagggctactgcatagacctgttgaaggaactggcccacattctgggattcagctacgagatccgacttgtagaagacggtaagtacggcgcccaggatgacaagggacagtggaacggcatggtgaaagagctcattgaccacaaagcagatctggccgtggcccccctaacgatcacccacgtgcgggagaaagcaattgatttcagcaagccctttatgaccctgggagtgagtattttgtatcgaaaacctaatggcacaaacccttccgtattttcattcctgaaccccttgagtcccgacatctggatgtacgttctgttggcataccttggagtcagttgtgtactgtttgtgatcgctaggttttcgccgtatgaatggtacgatgcccacccatgtaacccaggatctgaagtggtagaaaacaacttcacactccttaactcgttttggttcgggatggggtccctgatgcaacaagggagcgaactgatgcccaaagcactgtcaaccagaattatcggcggaatttggtggtttttcactcttattattatctcttcgtacaccgcaaatctcgccgcctttttaaccgttgagaggatggagtcgcccattgatagcgccgatgatctggcaaagcagacgaaaattgagtacggagccgtgaaggatggggccaccatgacgtttttcaagaagagcaagatatcaacctttgaaaagatgtgggccttcatgagttcgaagcccagcgctcttgtcaaaaataacgaagagggaatccaacgggcccttactgctgattatgccctgcttatggagtctacaaccatagagtacgtgacccaaagaaactgcaatttgacccagataggaggactaattgacagtaaagggtatggtataggtacccccatgggcagtccgtacagagataaaattactatagcaatcctccaactccaagaggaggataagctccacatcatgaaggagaaatggtggcggggatcaggctgccccgaggaagagaataaagaagcatctgcgctgggaattcagaagatcggagggatcttcatagtgttagccgcgggtttggtgttgtccgttctggtggcagtgggggaatttgtgtataagctgcggaaaaccgccgagcgcgagcaggtgtctctgcgggcatggtcacttcatagaatgggaaacggtgacagcaggtag

SEQ ID NO: 189353 - DNA, 2871 bp, Artificial Sequence
  Description of Artificial Sequence: Synthetic coding sequence
atgccccgggtgagcgcccccctggtgctgctgcccgcctggctggtaatggtggcctgctcacctcattccctaaggatagcggctatcctggacgacccaatggaatgctcccggggtgagcgtctgagcatcactctcgccaaaaatcgcattaacagggccccagaaaggctcggaaaagctaaagtggaggtggatatcttcgaactgctgcgggatagtgagtatgagacagccgagactatgtgccaaatactgccaaagggcgttgtagcggtgctcggccccagctctagtccagcttcttcgagcatcatcagcaacatttgcggcgaaaaagaagtccctcatttcaaggtggcacctgaggaatttgtaaagtttcaattccagcgttttactacactgaaccttcacccttcaaacaccgacatatcagtggccgttgcggggatcctcaattttttcaattgtactactgcttgcctgatctgcgccaaggccgagtgtctgcttaatctggaaaagctacttcgccaattcctgatcagcaaggacaccttatctgtgaggatgctcgatgacacacgggatcccactccgctgctcaaggaaatccgagacgacaagaccgcaactattattatccacgctaacgccagtatgtctcatactatcctcctgaaagcagcagagctcggaatggtgtccgcttactacacgtacatcttcacaaacctggagttcagtcttcagcggatggactccctggtggatgatcgcgtcaacatccttggtttctctattttcaatcagagccatgctttcttccaggaattcgcacagtcactgaatcagtcctggcaggagaactgtgaccatgtgccctttactggacctgctctgagcagtgcactgttatttgatgctgtgtacgctgtagtgacggccgttcaggagctgaataggtcacaggagatcggagtgaaaccactaagctgtgggtctgcacagatctggcaacacggaacctcgttaatgaattatcttcggatggttgaactggaaggcctgacagggcacatagagttcaattcaaaggggcagaggtcaaattacgccctgaaaattctacagtttacccgcaatggttttaggcagattggccagtggcatgtggccgaaggcctctctatggacagtcatctttacgcgtctaatatctccgacactctgttcaacaccaccctggtggtgacaaccattcttgaaaacccatatctcatgttgaaagggaatcaccaggagatggagggaaatgacaggtacgagggattttgcgtggatatgctgaaagaacttgcggagatcttacggtttaattacaaaattagactggttggggacggtgtgtatggcgtgccagaggctaatgggacctggactggaatggtcggggagctgattgctagaaaggccgacttagcagtggcagggctgacgatcaccgctgaaagagagaaagttattgacttttctaagcctttcatgacactgggcatcagcatcctgtacagagtgcacatggggagaaagcccggctacttcagtttcctggaccccttctcaccgggggtatggctgttcatgctcctggcctacttagccgtatcctgcgttttgttcttggtcgcccgtctgacaccgtatgagtggtatagcccccacccctgtgcacaaggtcgctgtaatctgctcgttaaccagtactctctgggaaactcgctgtggtttcctgtgggcggctttatgcagcagggaagtactatcgccccgagagccctttcgacgcgatgtgtgtccggagtttggtgggccttcacgctgataatcatcagctcatacactgccaatctcgcagcttttcttacagtacagcgaatggacgtgcctattgagtcagtggatgatttagctgaccagacagccatcgagtacggtactattcatgggggttccagcatgaccttctttcagaactcccggtatcagacttatcagagaatgtggaactacatgtattccaaacaaccttccgtcttcgtaaagtctactgaagaggggatagcgagagtccttaattcaaattacgccttcctgctcgaatctaccatgaacgaatactacagacagaggaattgtaacctgacacagatcggaggtctgctcgataccaaagggtacggcattggcatgcccgttgggtccgtttttcgcgacgagttcgacctcgccatactccagttgcaggaaaataatcgtctggaaattctgaagagaaagtggtgggagggggggaagtgcccaaaggaagaggatcatcgcgctaagggcctgggcatggagaatatcgggggcattttcgttgtgctgatttgcggactgatcgtagctatttttatggccatgcttgagtttctgtggaccctacggcatagcgaggcaacagaagtgtccgtttgtcaggaaatggtgaccgagctccggagtatcatactgtgtcaggattcaatccatccgagacgcaggagagccgccgtgccaccgccccgcccacccatacccgaggaacggaggccccgagggaccgccactctgtccaatggaaaactgtgtggggcaggagaacccgaccaactcgcccagaggctcgcccaggaagcggctctggtagctcgaggctgcactcatattagagtgtgcccagagtgccgccgctttcaggggttaagagcacggccgtcccccgctcgatccgaggagtctcttgaatgggagaagacaacaaactcatcggagcctgagtag

SEQ ID NO: 189354 - DNA, 2871 bp, Artificial Sequence
  Description of Artificial Sequence: Synthetic coding sequence
atgccccgggtgagcgcccccctggtgctgctgcccgcctggctggtgatggtagcttgctctccgcactcgctgaggatcgccgcaatactcgatgatcctatggaatgctcgcgaggcgaaagactgagcattaccctagcaaaaaaccgtattaatcgggcccctgaacgactgggaaaggcaaaggtggaagttgatatttttgagctgcttcgcgactccgaatatgagactgccgagactatgtgccaaattcttcccaagggagtggtggcggtccttggcccttcttccagtccagcctcctcaagcataattagcaacatttgtggcgagaaggaagtgccccacttcaaagtggcgccggaggaatttgtgaagttccagtttcagaggttcacaactctgaatttgcatccaagcaatactgatatctccgtggctgtggcaggcattctgaacttctttaattgcacgaccgcgtgcttaatctgtgctaaagctgagtgcctgctgaacctggaaaaactgctaaggcaattcctgattagcaaggataccctgagcgtgcgaatgcttgatgacacgcgcgacccaacccctctgctaaaagagattagagacgacaaaaccgcaactattataattcatgctaatgctagcatgtcccataccattctgttgaaagccgccgaactgggaatggtcagcgcttattatacgtacatctttaccaacctcgagttttctctgcagagaatggacagtctcgtggacgaccgagtgaacatccttggattcagcatcttcaatcagagccacgcttttttccaagagtttgcccagagtctgaaccagtcatggcaggagaactgtgaccacgttccatttacaggaccagcactcagctccgccttgctgtttgatgcggtatatgctgtggttaccgcagttcaggagctcaatcggtcccaggaaattggggtgaaacccctctcatgtgggtctgcacagatatggcagcatggtacttctcttatgaattatcttagaatggtagaactggaggggctgaccggacacatcgagtttaacagtaaagggcagcgtagcaactacgccctcaaaatattgcagtttacccgtaacggcttccgccagataggtcagtggcatgtggcagagggcctgagcatggactctcatctctacgcctcgaacatttcagatactctcttcaacaccacactggtggttaccaccatactagagaatccctatctgatgttgaagggcaatcatcaggagatggaagggaacgaccgatatgagggattttgcgtggacatgctgaaggaactagccgagatccttcgatttaattacaagatcaggctggtcggcgacggcgtttacggagtacccgaggcaaatggcacatggacgggcatggtcggagagctaatcgcccgcaaagccgatcttgctgtggcaggtctgaccatcactgctgaaagggagaaagtgatcgatttctccaagccctttatgacactcgggattagtattttgtatcgcgttcacatgggacgcaagccagggtactttagttttctggatccatttagtcctggagtctggctgtttatgttactagcatatctggccgtgtcatgtgtactgttcctcgtggcaaggctgaccccatacgagtggtattccccccatccctgcgcccagggaaggtgtaatctcctggttaaccagtatagcctcggcaacagcctgtggtttccggtgggaggatttatgcagcaaggctcaacaattgcccctcgcgctctgagcacgagatgtgtgtccggagtgtggtgggcctttacactgattattatctcatcttatactgcgaacctcgccgcattcttgactgttcagagaatggacgtcccgatagagtccgtggacgatttagccgatcagaccgccatcgagtatggaacaattcatggtggtagttccatgacttttttccagaactcgcgttatcagacataccagcggatgtggaactacatgtattcgaagcagccttctgtgttcgtgaagagcaccgaggaaggaatcgctcgcgtgctcaattctaactacgcattcctgctcgagtcaactatgaatgagtactaccgtcagagaaattgcaacctaacacaaatcggcggtttactggatactaagggatacggaataggaatgccagtaggctctgtgttcagagacgaattcgatctcgcaatactacagctccaagaaaataatcgtctggagatcttgaagagaaagtggtgggaagggggcaagtgtcccaaagaggaagatcaccgtgccaaagggctgggcatggagaacatcgggggtatcttcgttgtactcatatgtgggctcattgtggcaatttttatggctatgctcgagttcctctggacactgaggcactcggaggctacagaagtgagtgtgtgccaagagatggtaactgagctaagatccataatcctatgccaggatagtattcacccaagacggaggcgcgcagctgtgccacccccccgaccgccaatcccagaagagcggaggccacgcggtaccgctaccctgagtaacggcaagctctgcggtgccggcgagccggatcagctggcacaaaggctggcgcaggaggctgcacttgtggctagagggtgcacacacatcagggtgtgtcccgagtgtcgcaggtttcagggactgagggcccgtccctctcccgctcggtcagaggagagcctcgagtgggagaagacgacaaactctagcgaaccagaatag

SEQ ID NO: 189355 - DNA, 2943 bp, Artificial Sequence
  Description of Artificial Sequence: Synthetic coding sequence
atgcccgccgagctgctgctgctgctgatcgtggccttcgccagccctagttgtcaagtactctcttcgctccgcatggccgcgatactggatgaccagacagtttgcgggcggggcgagagattagccttggctttagcaagagagcagattaacggcattatcgaggtacccgccaaagcccgcgtcgaggtggacatcttcgagctgcaacgggatagccaatatgagacaaccgacacaatgtgccagattcttccgaaaggagtggtatcagtgctggggccttcttcgtcaccagcctccgccagcaccgtgtcccatatatgcggagagaaggagataccacacatcaaagttgggcccgaagaaacaccaagactgcagtatctccgctttgccagtgtaagcctgtacccaagtaacgaggatgtgtctctggcggtgagcagaatcctgaaatccttcaattacccatcagcctcgctcatctgtgccaaagccgaatgtctgctgcgcctggaagaattggtgcggggcttcctcattagcaaggaaacactgagcgttagaatgctggacgattcccgggatcctaccccattgctgaaagaaatcagggacgacaaggtttctactatcatcatagatgccaatgcctccattagccacctgatccttagaaaggccagtgagctggggatgacctccgcattctacaagtacattctgacaactatggacttccccatcctgcatctggatggcatagtcgaggatagttctaatattctgggattttccatgttcaatacctctcaccctttttatcctgaattcgttaggtcactgaacatgagctggagggagaattgtgaggccagcacctacctcggacctgcccttagtgccgccctgatgtttgatgcggtgcacgtcgtggtgtctgcagtgcgcgagctcaacagatctcaggaaatcggggtcaagcctttagcctgtacaagtgccaatatatggcctcatggcacaagcttgatgaactacctgagaatggtcgaatatgacggtttaactgggcgagtcgagttcaattccaaagggcagcgtaccaactataccctgcggattctagagaaatccagacagggtcatcgcgaaatcggggtgtggtattccaatcgaactttggcgatgaatgccacaactctggatataaatttatcacaaacccttgcgaacaaaactctggtcgtaactacgattttagagaatccatatgttatgcggcgaccaaactttcaggccctgtcgggcaatgaacggttcgagggcttttgcgtagacatgttgcgtgagttggcagaactgctacgcttccgttatcggctgagactagtggaggatggcctctacggtgcgcctgagccaaatgggagctggacaggtatggtgggggagttgataaaccgtaaggcggatcttgccgtagcagcttttaccattactgctgaaagagagaaggtaatagatttcagcaagccttttatgaccctaggcatctctatcctttacagagtccatatggggcgaaagcccggatacttctctttcctggatcccttcagccccgcggtttggttgtttatgttactggcttatctggccgtgtcatgcgtccttttcctcgcagcccggctgtcaccgtacgagtggtataatccgcacccctgtctgagggcccgtccacacattcttgaaaatcagtatacactcggaaattcgctttggtttccagtaggcgggttcatgcaacaggggagtgaaataatgcccagggctctatcaacacgctgcgtgtctggcgtgtggtgggccttcactctcattattattagcagttacactgccaaccttgccgcattcctaactgtgcaacgaatggaagtcccggtggagagcgctgacgatctggcagaccagacaaatattgagtacggcacgatccacgcgggcagtaccatgacgttcttccagaattctagataccaaacctatcagcgtatgtggaactatatgcagtctaaacagccctctgtgttcgtaaagtccacagaggaaggaattgcccgggtcctgaattccagatacgccttcctgctggagagcacaatgaacgaatatcacagacggctcaattgcaaccttacccagataggaggcttgctggacaccaaagggtatggtattgggatgcccctgggctcaccttttcgagacgaaatcaccctggccatccttcagctacaggaaaataacaggcttgagatcctgaaaagaaaatggtgggaaggagggagatgtccaaaagaagaagaccatcgagctaagggactcggtatggaaaacattggcgggattttcattgtcctgatctgtggattgataatagctgtgttcgtagccgtaatggaatttatctggtctaccaggagatctgcagaatctgaggaggtctcggtgtgccaagagatgctgcaggagttaagacacgccgttagttgtaggaaaacctcccgatctcggcgcagaaggcgccccggaggcccgtcacgagcgttactgtccctgagggccgtgcgcgagatgaggctgtccaatggaaagttgtatagcgccggtgcggggggtgatgctggtagcgctcatggtggcccgcagaggctactggatgatcccggacccccaagcggagcaaggcctgccgctccgaccccttgcacccacgtaagagtctgtcaggagtgtagaaggatccaagcactgcgggcatcgggggcaggcgctcctcccagaggattgggcgttccagccgaggccactagcccccctcgacccagacccgggccggccgggccccgcgagctggcggagcatgaatag

SEQ ID NO: 189356 - DNA, 2946 bp, Artificial Sequence
  Description of Artificial Sequence: Synthetic coding sequence
atgcccgccgagctgctgctgctgctgatcgtggccttcgccagccccagctgtcaagtgttgtcgtccctgcgcatggccgcaatcctggatgatcagactgtttgtggcaggggcgagcggctcgcacttgccctagcccgcgagcagattaacggcattatcgaggtccccgccaaagcccgcgtggaagtggacattttcgagttgcaacgagattctcagtacgagaccactgataccatgtgccagatactccccaagggagtggtgtccgttctgggcccctcctctagccccgcctccgctagcactgtctcacacatctgtggcgagaaggagattccacatataaaagttggcccagaagaaactcctcgcctccagtacctcagattcgccagcgttagcctgtacccatccaatgaggacgtgagcctggctgtgtcgaggatcctgaagagtttcaattatccttcagcctccctgatttgcgcaaaagccgaatgtctcttacgccttgaggagttggtgcgtggcttcctgatctccaaagagacactctcagttcggatgttggatgatagccgagatccgacacctcttctgaaggagattcgggatgataaggttagtactatcattatagatgccaacgctagcatttctcacttgatactccggaaggcttctgagttgggaatgacatcagcattttacaagtacatcctgactacgatggattttccaatcctccatcttgacggcattgtggaggatagtagtaacatcctcggcttttccatgttcaatacttctcaccctttttaccccgagttcgtccgcagcctcaatatgagttggcgggaaaattgcgaagcaagcacttacctgggacctgcacttagcgcagccctgatgttcgatgcggttcatgttgtagtctccgccgtccgagagttgaacaggtcgcaggagatcggggtgaaaccattggcctgcacctccgcaaatatatggccccacggaacgtccctcatgaattatctcagaatggttgagtatgatggactgacaggccgagtcgagttcaactctaaggggcagcgtacaaattatactctacgcatccttgaaaagtcaaggcagggccaccgggagatcggcgtgtggtattcaaataggactctagccatgaacgctacaacactggacataaacttgtcacagaccctcgccaataaaactctggtggtgactactattcttgagaacccttacgtgatgcgaagacccaattttcaggccttgagcgggaatgagcgatttgaggggttctgtgtggacatgctccgtgagctcgccgaactgctgagattcagatatcggctccgcttggtcgaggacggcttatatggggcccctgagcccaacggaagctggacagggatggtaggagagctcattaataggaaagcggatttggccgtggccgccttcactatcacagccgagagggagaaggttatagacttttccaagccatttatgactctggggatatccattttgtatagagtgcacatgggtagaaagcctgggtatttttctttcctggatcccttttcgcctgcagtttggctgttcatgcttctcgcttacctggccgtgtcatgcgtcctgtttctagcagctcggttgtcaccctacgagtggtataacccccacccctgcctccgcgccagaccccatatactggagaatcagtataccctgggtaattcactgtggttccccgtaggaggcttcatgcagcagggcagcgagatcatgcccagagcactttcaacaagatgtgtgagcggagtgtggtgggcctttacactgattatcatatccagttatacggcaaacctagccgccttcctgaccgtccagaggatggaggtccctgtagaaagcgctgatgaccttgctgatcagacgaacatagagtacggaactatccacgcgggctcaaccatgacatttttccagaattccaggtaccaaacataccagaggatgtggaattacatgcagtcaaagcaacctagcgtatttgtgaagtccaccgaagaggggatcgccagggttctgaacagtaggtatgccttcctgctcgagagcacaatgaatgaataccaccgccgtctgaattgcaacttgacccagattggcggcctgctggacaccaagggctatggcataggaatgccattaggctccccctttagagatgagattacactcgcaatcctgcagctgcaagagaacaaccgcttagagattctgaaaaggaaatggtgggaaggaggaaggtgccctaaggaggaggaccatagagctaaaggcctcggcatggagaatataggtgggatctttattgtattgatttgcggtctcatcatcgccgtcttcgtagcagtcatggaatttatctggtcaactaggcggtcagctgagtctgaggagacacccgcattgcatccagctgcctgccagtgcagcgcccttggaccccgcaccccactgaaagagccgtcaatgctgcttgtgaaggtcccctccacgcgcgtgcaggtcgcgttcagccgtacctccctgagacaggtgtgccctttcctgctgcaacaccagctttcatctttgtattggatccaggcgactaacgtgcagatctgctgtcacttttcttctcttaagccttcacctgacctgacatttcctccctctcaccgacccttgagtagtttgttatttactgctttggcggcagttgggggccttccagacgccagcagtttttttttcccaccgatttcttcatgtcctcccctgcaaagcgggattgggccgtgccattccacggaggctacactggtgacttccaacttccacgtttag

SEQ ID NO: 189357 - DNA, 1077 bp, Artificial Sequence
  Description of Artificial Sequence: Synthetic coding sequence
tgatgggccttcaccctgatcatcatcagcagctacaccgccaacttagccgcctttctcaccgtccagagaatggaagtgcctgtggagagtgccgacgatctggcagatcaaactaatattgagtatgggacaatccacgctggaagcacaatgacattctttcaaaattctagataccagacctaccaacggatgtggaattacatgcaatctaagcagccaagcgtgttcgtgaagagtactgaagagggcattgccagggttctgaattctagatacgccttcctcctggaaagcaccatgaatgagtaccatcgccgcctcaattgcaacctgacccaaattggcggtctgctcgacacaaagggatacggtattgggatgcccctcggatctcccttccgggatgaaatcaccctagccatcttgcagctgcaagagaataaccggttggagatcctgaagagaaagtggtgggagggcggtcgctgtccaaaggaggaggaccatcgggccaagggcctgggtatggaaaacatcggagggattttcattgtcctgatttgtggtctgatcatagccgtgttcgttgcagtgatggaatttatctggtctaccagaaggtctgcagagtcagaggagaccccagctcttcaccctgccgcgtgccagtgctcagctttaggtccgcgaactccgctcaaggaaccgtcaatgctcctggtcaaagtgcccagcactagggtgcaggtcgcattttcgcgtacctcgctgcgccaggtgtgtccattcctcctgcaacaccaactgtccagcttgtactggattcaggcaactaatgtgcagatatgctgtcacttctcaagcctgaagcctagccccgacctcacatttcccccatcccaccggcctctgtcctcattgctgttcaccgctctggccgcagttgggggactgcctgatgcttcctccttcttctttccgcctatatcctcctgccctccgctgcaatccggtattgggccctgtcacagcaccgaagccacactcgttacttcaaactttcacgtatag

SEQ ID NO: 189358 - DNA, 2769 bp, Artificial Sequence
  Description of Artificial Sequence: Synthetic coding sequence
atgagcaccatgcggctgctgaccctggccctgctgttcagctgctctgtcgcccgagccgcctgcgacccaaaaatcgtgaacatcggggccgtacttagcacgaggaagcatgaacagatgtttagggaggctgtgaaccaggctaacaaacgacacggctcttggaaaattcaactgaatgccaccagtgtcactcacaagcccaacgctatccagatggccctgtcagtctgcgaagatctgataagtagccaggtctacgccattctggtgtcccatcctccgaccccaaacgatcacttcactccaacgcctgtgtcctacaccgccggtttctatcgcatacctgtactggggttgacaactcgcatgtcaatatattccgataaaagcattcatctctctttcctaagaacagtgcctccctatagtcatcagtcatcagtgtggttcgaaatgatgcgtgtgtatagttggaaccacataattttgctcgtgtccgacgatcatgaggggcgggcggcacagaaacgtctggagaccctgcttgaggaacgtgagtccaaggccgagaaggtgctgcagttcgacccgggcacaaagaacgtaacggctctccttatggaagccaaagagctggaggcacgcgtaattattttgtctgccagcgaggatgacgccgcaaccgtatatagggccgccgccatgctgaatatgacgggcagcggatacgtgtggctggtgggcgagagggaaattagtggcaacgccctgcggtacgccccagatggtatcctgggactccagctcattaatggcaagaatgagagtgcgcacatctcagacgcggttggtgtcgttgcccaggccgtgcatgagctcctggaaaaagagaatatcacagacccccctaggggatgcgtgggtaacaccaatatttggaagaccgggcctttatttaagcgggttctcatgtcttccaaatacgcagacggtgtgacggggagggtggaattcaatgaagatggagacaggaagttcgctaactacagtatcatgaacctgcagaacagaaaactcgtgcaggttgggatctataacggaacacacgtcatccccaatgataggaaaataatttggcctggaggggaaaccgaaaaaccgcgcggttaccagatgtctacccggctcaaaattgtgaccattcatcaggaacccttcgtgtacgtcaagccaacgctgtccgacggcacatgcaaagaagagttcactgttaatggggatccagtaaagaaagtcatctgcactggccccaacgatacttctcctggaagtcctcgacatactgtacctcagtgttgctatggattctgtatagacctgcttattaagttggccaggacaatgaacttcacatacgaggtgcacttggtagcagacggcaaattcgggacacaggagcgggtgaacaactccaacaagaaggagtggaatggcatgatgggagagctgctttccggccaagcagatatgatagtggctcctttgactattaataacgaaagagctcaatatattgaatttagcaaacctttcaaataccaggggttgacaatcttggtcaaaaaagagatcccaagatcaactctcgactctttcatgcagccattccagtcaacgttgtggctgttagtgggtctgtccgtccacgtggtcgccgtaatgctatacctgctggaccgtttctcgccatttggccgatttaaagtgaattctgaagaggaagaagaagacgcattgactttgtcgagtgccatgtggttctcatggggggtgctgctgaatagcggaattggagagggggcgcctagaagcttttcagcgcgtattctcgggatggtttgggccggttttgccatgatcatagttgcctcctacaccgcgaacctcgcagcgttccttgtattagaccgacccgaggagaggattactggcatcaacgaccccaggctccgtaacccttctgacaagtttatctacgccactgtcaagcagtcaagtgtggatatttatttccgccggcaagtggaactctctaccatgtacagacacatggagaagcacaactatgaatccgccgccgaggccattcaggccgttcgggacaataaactgcacgctttcatttgggactcagccgtcctggaatttgaagcctcgcagaagtgtgatctggttaccacaggagaactgttctttcgcagtggctttggcatcggaatgaggaaggatagcccatggaaacaaaatgtcagcctgtctatcctcaagtcccacgagaatggcttcatggaagacctggacaagacttgggtaaggtaccaggagtgtgattctagatctaacgcacctgcaactctaacatttgagaatatggccggcgtatttatgctggttgcaggtggcatagtggcagggattttcctcattttcatcgagatagcttataaaagacacaaggatgctcgtagaaagcagatgcaactcgctttcgccgcggtcaacgtgtggcggaaaaatctacaggatcgtaagtccggtagagccgaaccagatccgaaaaagaaggctacctttcgcgctatcacttctaccctggccagcagttttaagcggcgacgcagcagcaaggacacgcagtatcaccctaccgacattacaggccccttgaacctatccgatccatctgtgagtacagtagtctag

SEQ ID NO: 189359 - DNA, 2730 bp, Artificial Sequence
  Description of Artificial Sequence: Synthetic coding sequence
atgagcaccatgcggctgctgaccctggccctgctgttcagctgctctgtggcccgggctgcctgtgaccctaagattgtgaacatcggagccgtgctgagcactcgcaagcacgagcagatgttcagagaagctgttaatcaggccaataagcgccacggttcgtggaaaattcagttgaacgctacctccgttacccataaacctaatgccatccaaatggccttgagcgtgtgtgaggacctcatctcttcccaagtgtacgcaatcctcgtgtcgcatccgcccacaccaaacgatcacttcacacccaccccggtctcctatacggctggtttttatagaattcctgtcctcggactgacgactcggatgtccatatatagcgacaaatcgattcatttgagctttctccgaacagtacctccctatagccaccagagctctgtgtggtttgagatgatgagggtctacagctggaaccacatcatactgctggtgtcagatgatcacgaagggagggcagcccagaagaggctcgaaactcttcttgaagaacgcgagtctaaggccgaaaaggtcctccagttcgatcctgggactaagaacgtgacggctctgttgatggaggctaaggaactggaggccagggtgataattctcagcgcctctgaagacgacgccgctactgtataccgggctgctgccatgctgaacatgacgggaagcggatacgtgtggctcgtgggagaacgtgagatctccggcaacgctctgaggtatgcacctgacgggatattgggacttcagcttattaacggaaaaaatgaaagtgctcacatctctgatgccgtcggagttgtggcccaagccgtgcacgagctcctagagaaagagaacattaccgatccgccacgcggctgtgtgggaaacacaaacatctggaaaacgggcccgctttttaaacgggtgttaatgtcaagtaagtatgcagatggtgtgactggtcgggttgagtttaatgaggatggggaccggaaatttgccaactactccattatgaatctgcagaataggaagctggttcaagttgggatttataacgggacccatgttattccaaatgaccggaaaatcatctggcccggcggcgagacagagaagccacggggttaccagatgtcaacgcggcttaagatcgtgaccattcaccaagagcccttcgtctatgttaagcccaccttatccgacgggacctgcaaggaagagttcaccgtaaacggcgatccagtcaaaaaagtgatttgtactgggccaaacgatacgtccccgggttctcctcgtcacacggtcccgcagtgttgttacggcttctgcatagaccttcttattaagctcgcacggaccatgaatttcacgtatgaggtgcacctcgtggctgacgggaaattcggaactcaggaacgtgttaacaacagcaataaaaaagaatggaatggaatgatgggggaattgctgtctggacaggcagacatgattgtggccccgctcacaattaacaatgagcgagcccagtatatcgaattttctaaaccttttaagtaccagggcctgacaatcctggtcaaaaaggagatccctagaagcacactggattcatttatgcaaccatttcagagtacactgtggttgctggtgggcctaagcgtacacgtggtcgccgtgatgctgtatttgctggataggttcagcccctttggcagattcaaggtcaattccgaggaggaggaggaggatgcactgactctatccagcgcaatgtggttcagctggggcgtcttgctcaatagtgggatcggggagggtgcccctaggagtttctcagcgaggattcttggcatggtttgggccggattcgccatgattatcgtggctagttacactgccaacttggctgcatttctggttctcgatcggccagaggagcgaatcactggcatcaatgacccaaggctgcgaaatccctctgacaagtttatttacgctaccgtgaagcaatcaagtgtagatatctattttcgtagacaggtggaactgagcacgatgtatagacatatggagaagcacaattatgagtctgcagccgaggctatccaggcagtgagagacaataaactgcatgccttcatctgggacagtgccgtccttgagttcgaggcaagtcagaaatgtgatttggtgacaacaggtgagctgttttttcgttctggctttgggattggtatgcggaaggacagcccctggaagcagaatgttagcctgtcgatcctcaagtcacatgaaaatgggtttatggaagatctggataaaacctgggtcagataccaagagtgcgatagccgttctaacgctccagccactttgactttcgagaatatggccggggtgttcatgttggtggctggaggcattgttgccgggatcttcctcatatttatcgagatcgcatacaagcgccacaaagacgccagaaggaaacagatgcagctggccttcgctgcggtgaatgtctggcgcaagaatctccaggtgggacaggccacgctgcgcggactggtcccacgggcaaggccaggccacggaccacccccgagtccaaaggcggtggcccttgcgttggcattggtagggagaaccggggctcggtctcatggccagggccagtggtag

SEQ ID NO: 189360 - DNA, 2832 bp, Artificial Sequence
  Description of Artificial Sequence: Synthetic coding sequence
atgagcaccatgcggctgctgaccctggccctgctgttcagctgctctgttgcccgagccgcatgcgatccgaaaattgttaacattggcgctgtgctgtcaacgaggaagcatgagcagatgttccgagaggctgttaaccaggccaataagcgacacggctcctggaaaatccagttgaacgctacatctgtgactcataaacccaatgccatacagatggctctgagtgtttgtgaagaccttatttccagtcaagtgtatgcaatactcgtttcccatcctcctacacccaacgaccacttcacaccaacccctgttagttacacagctggattctatcgtattcctgtgttgggccttactaccagaatgtccatctacagcgacaaaagcattcacctgtcattcctgcgaactgtgccaccatatagccaccagtcaagtgtctggttcgaaatgatgagagtgtatagctggaaccacatcattctgctcgtgagcgatgaccatgaagggcgggcggcccaaaaaaggctggaaaccctgctcgaagaacgtgagagtaagtcaaaaaagaggaactacgaaaacctggatcaactctcttatgacaacaaaaggggtcccaaagcagagaaagtgttacagtttgatcccggcactaagaacgtgacggccctgcttatggaggccaaggaacttgaagcccgtgtgataatactgagcgctagcgaagacgacgcagctaccgtgtatcgagctgccgcgatgctaaacatgactggctccgggtatgtgtggctggtcggggaaagagagattagtggaaatgcgctaaggtacgcccccgacggcatcctgggattacagctgattaatggcaagaacgaatccgctcacatcagtgacgccgtcggagtggtggcccaggccgttcatgagctcctggagaaagagaatatcaccgatccccctaggggttgcgtgggcaacacaaacatctggaaaactggacccttgtttaagcgcgtgctgatgagctcaaagtacgccgacggcgttacaggccgcgtggaatttaacgaggatggggatcggaaattcgctaactattccattatgaatctgcagaacagaaagctggtgcaggtgggcatctacaatggaacccatgtgattccaaacgataggaagattatatggcctgggggggagacggaaaagccccgggggtaccagatgtcaacaagactcaaaattgtcaccattcatcaggagccattcgtgtatgttaagccgacacttagcgacggaacttgcaaggaagagtttactgtgaacggtgatcctgtgaagaaggtgatctgcacaggaccaaatgatactagccctggatcacccaggcacacagtcccccagtgctgctacggtttctgtattgatttactgattaagctggcccgaaccatgaactttacctacgaggtccacttggtggccgacgggaagttcggaacacaggaacgtgtaaataactccaataaaaaggagtggaacggtatgatgggtgaactcctgtcaggccaggctgatatgattgtcgcccccctgacaatcaataacgagcgggctcagtacatcgagttctctaaacctttcaaataccaggggctaactattctcgtgaaaaaggaaatccctagatccactctcgactctttcatgcaaccatttcagtccacactctggctcctagtcggactgtccgtgcacgtcgttgcagtgatgctatacctgctagacagattctcccccttcggtaggttcaaggtgaattccgaagaagaggaggaggatgcacttacactctctagcgccatgtggttctcgtggggggttctcctgaattccggcattggtgagggcgcaccgcgctccttttctgctcgtattcttgggatggtctgggcagggtttgccatgattattgtggcctcttacaccgcaaacctggctgcctttttagtgctcgatagaccagaggagcggatcaccgggatcaacgatcctcgcctgagaaatccctccgataaatttatttatgccacggtaaaacagagtagcgtggatatctattttagacgccaggtggagctgtccaccatgtaccggcatatggaaaagcataactacgaaagtgccgctgaggcaatccaggccgtgagggacaataagctacacgcattcatttgggattccgctgtcttggaattcgaggcttcgcagaaatgcgatctggtcacaacaggtgagctctttttccgtagtggattcggcatcggaatgaggaaagattctccatggaaacagaacgtgtccctgtccatacttaagtctcacgagaatggcttcatggaagaccttgataagacatgggtgagatatcaggaatgtgatagcagaagtaacgctcccgccacgttgacatttgagaacatggcaggggtctttatgctggtagcaggggggatcgtcgccggcatcttcctgatattcatcgaaattgcctataagcgccacaaagatgcaagacggaagcagatgcagctagccttcgccgccgtaaacgtgtggaggaagaacctgcaagatcggaaaagcggaagggccgagccggaccccaagaagaaggccaccttccgggctataacaagtacattagcttcaagctttaaacggaggcgctcctccaaagacacccagtaccacccgacagatataacgggacctctcaatctctccgaccctagtgtgagcacagtggtgtag

SEQ ID NO: 189361 - DNA, 2769 bp, Artificial Sequence
  Description of Artificial Sequence: Synthetic coding sequence
atgagcaccatgcggctgctgaccctggccctgctgttcagctgctcagtggcacgcgccgcgtgtgaccccaaaatcgtgaatattggagcggtgttgtccacccgaaaacacgagcagatgttcagagaagctgtgaaccaggccaataagcgacatggctcctggaaaatccagctgaatgcaactagcgtcactcacaagcccaacgccatacaaatggcactctcagtgtgcgaagatctcatatccagtcaggtttacgcaatccttgtgtcacatccaccaacaccaaacgatcacttcacacccaccccggtcagctacactgcagggttttaccgcatccctgtgctcggacttactactcgaatgagtatttattccgataaatctatccatctgtcatttctcagaaccgtgcccccatacagtcaccaaagttcggtgtggttcgagatgatgcgggtatatagttggaatcacatcatcctactggtcagtgatgaccacgaaggccgggcggctcaaaaacgactcgagacattgttggaggaacgcgaaagtaaatccaagaagcggaactacgagaacttagaccaattgtcatacgacaataaacgagggccaaaggccgagaaggtcctgcagttcgatcctggaacaaagaatgtgactgcgctgcttatggaagccaaagagctcgaggcaagagtgataatcctgagcgcttccgaagacgatgctgcaaccgtgtatcgggctgcagctatgttgaatatgactggctcagggtatgtgtggttagtcggagagagggagatctcaggtaatgcccttcggtacgcccccgatgggattcttggacttcaattaattaacggaaaaaacgagtccgcccacatctccgacgctgttggcgtggtcgcacaagccgtgcatgaactcctcgaaaaggaaaacattactgaccctccgaggggctgtgtcggcaacactaatatatggaaaaccgggccgctgttcaaaagagttttgatgtcctctaaatatgccgacggtgtgactgggcgggttgaatttaatgaggatggagatcgaaagttcgccaattactctatcatgaatctgcaaaataggaaacttgtgcaggttggcatctataatgggacgcacgtcattcccaacgatagaaaaatcatatggcccgggggtgaaactgagaagcctagaggctatcagatgtcgacccgactgaagatcgtcaccattcaccaggagcccttcgtgtatgtgaagccaaccctctctgatggtacatgtaaagaagagttcacggtgaatggagaccctgtcaaaaaggtaatttgcactggtcccaatgatacaagccctggtagtccccggcacaccgtgccccagtgctgttatggattctgcattgatctattaataaagctggctaggaccatgaattttacttatgaagtacatctagtggccgatggcaaatttggaacccaggagagagttaataattctaacaagaaagagtggaatggaatgatgggagaactgctttctggtcaggccgatatgatcgtggcacccctcaccatcaataatgaaagggcccagtacatcgagttctccaagccctttaagtatcaggggttgaccattctcgtgaaaaaggagataccccgcagcaccctagatagttttatgcagcccttccagtccaccctctggctgctggtcggactgtctgtgcacgtcgtcgccgtaatgctctatcttctcgaccgattctctccatttggccgatttaaggtgaatagtgaggaggaggaggaggacgctctcacactcagctccgcaatgtggttcagttggggcgtgctgttgaactccgggattggcgaaggcgcgcctcgctctttctcagcacgcattctcggaatggtttgggccggcttcgctatgatcatcgtggcgagttacacggccaacctagcagcttttcttgtcctcgacaggccagaggagcggatcaccggtatcaatgatccccgactgcgtaatccttcagacaagttcatctacgccacggttaaacagtcaagtgttgacatctacttccgccggcaagtggagctgtccactatgtatagacacatggaaaagcacaactatgagtcagctgccgaggctatacaggccgtgcgagacaacaagctgcatgccttcatatgggattctgccgtactcgaatttgaggcttcacagaagtgcgacctcgtgaccaccggcgaactcttcttccgtagcggcttcggtataggcatgaggaaggacagtccctggaaacaaaacgtaagtctctccattcttaaatcgcatgagaatggatttatggaagacctagacaagacctgggtgaggtaccaagagtgtgactcccgctccaatgcaccagccaccctgacatttgaaaacatggccggtgtattcatgctcgtggcaggtggaattgtggcaggaatctttctaatatttattgaaatcgcctataaacgccacaaggatgcgagacggaagcaaatgcagttggcattcgcagcggtgaacgtgtggcgcaaaaacctccagtccaccgggggcggccggggggcccttcagaaccagaaggatacagtgctgcctcggcgagccattgaacgcgaagagggccagttacaactgtgcagtcgccatcgggagagctag

SEQ ID NO: 189362 - DNA, 2721 bp, Artificial Sequence
  Description of Artificial Sequence: Synthetic coding sequence
atgagcaccatgcggctgctgaccctggccctgctgttcagctgcagcgttgcgagagccgcctgtgatcccaaaatcgtgaacatcggggccgtgctgtctacaaggaaacacgagcagatgtttagggaggccgttaatcaggcaaacaaaagacatggcagctggaaaatccagctgaacgccaccagtgttacacacaagccaaatgccattcagatggccctaagcgtctgcgaggacttaatcagttcccaagtttacgccatactggtatctcatccccctactcctaacgaccacttcacacctactcctgtgtcttacaccgctggtttttacaggattcctgtgttaggccttacaacaagaatgagcatctattctgataagtctatacacctgtccttcctgcggacagtcccaccgtattcccaccaaagttccgtttggtttgagatgatgcgagtgtatagctggaatcacattatcctccttgtttccgacgaccacgagggaagggccgcgcagaaacggctggagactcttctcgaggagagggagtccaagtctaagaagcggaactatgaaaacctcgaccagttgagttatgataataagagaggccccaaggcagaaaaggtcctccaattcgatccaggcaccaaaaatgtcacagcgctactgatggaggcaaaagagctggaggcacgtgttatcatcctgtcggcttcggaagacgacgccgccacagtctatcgtgccgcggctatgcttaacatgacagggtcagggtacgtttggctcgtaggcgaacgggaaatttcaggcaatgccttgcgttacgctcctgatggcatactcgggctgcagttgataaacggaaagaatgaatccgcgcacatctccgatgctgtgggtgtggtagcccaggctgtgcacgagcttctggagaaggagaatatcaccgatccaccaaggggttgtgtcgggaataccaacatttggaagacaggtccactcttcaagcgagtcttgatgagcagtaagtatgccgatggggtcaccggtagggtggaattcaacgaggatggcgatcgaaagttcgcaaactacagcattatgaatttacagaacaggaagctagtccaggtgggcatctacaacggaacgcacgtgattcccaacgataggaaaataatttggccggggggggagactgagaagccaaggggttatcaaatgagtacacggctgaagatcgtgaccatacatcaggagcccttcgtgtatgtgaaaccgaccctcagtgacggcacatgtaaggaagagtttaccgtgaacggtgatccagtgaaaaaggtgatctgtaccggccctaatgataccagcccaggctctccgcgacacacagtgccccagtgctgttatgggttttgcattgatcttttaattaagctggctagaaccatgaatttcacatatgaggttcatctggtggctgatggcaagttcggcacacaggaaagggtgaacaactctaacaaaaaagaatggaatgggatgatgggtgaacttctgagcgggcaagcagacatgattgttgcaccactgactattaataacgaacgggcacaatacatagaattttccaagccttttaaatatcagggcctgacgatcctggtgaagaaagagattccacgctcaacactggatagtttcatgcagccctttcaaagcacactatggctgctcgtcgggttgtcagtgcacgtagtcgccgtgatgttataccttcttgacagatttagcccttttgggagatttaaggttaattccgaggaggaagaggaagacgctctcacattgtcctcagccatgtggtttagctggggcgtgctcttgaactcaggtattggcgagggggcacctcgaagcttctcagcccgcattctggggatggtttgggcaggcttcgcgatgattatcgtcgctagctatacggctaatcttgccgcattcctggtactcgaccgcccggaagaaaggattacaggaattaatgacccacggttacgcaatccatcagataaatttatctacgcaacagtgaagcagtcctcagtagatatatattttcgtcgacaggtggagctgtccaccatgtatagacacatggaaaaacataactacgaaagtgccgccgaggcgatccaagccgttcgggacaacaagcttcacgcgttcatttgggattcggcagtgttggaatttgaagccagccaaaagtgcgaccttgtgactactggggagctgttttttcgctccgggtttggcatcggtatgcgaaaagattcgccgtggaaacagaatgtgtcattgtccattctgaaatctcatgaaaatgggttcatggaagatctagacaagacctgggtacgttatcaagaatgcgatagccgatccaacgcccctgctacactcaccttcgaaaacatggctggagtgtttatgctcgtggccggcggcatagtggccgggattttccttatattcatcgaaatcgcctataagagacacaaagacgcacggcgcaagcaaatgcagctcgcctttgcagccgtaaatgtatggcgaaagaacttacaacagtatcaccccacagatattactgggcctctcaatctgtccgatccaagcgtttctaccgtcgtatag

SEQ ID NO: 189363 - DNA, 2817 bp, Artificial Sequence
  Description of Artificial Sequence: Synthetic coding sequence
atgagcaccatgcggctgctgaccctggccctgctgttcagctgctctgtagcacgcgccgcctgtgatccgaagattgttaacattggagccgttctctctacccgcaaacacgaacagatgtttcgcgaagccgtgaatcaggctaataagaggcatggcagctggaagattcagctcaatgccacctctgtgactcataaacctaacgccatacaaatggcactgtctgtgtgtgaggatttgatttcgtcacaggtctatgccatcctcgtgagccaccccccaaccccgaatgaccatttcacacccactcccgtcagctacaccgctggattttatcggatccccgtgctgggactcaccacaaggatgagcatctatagtgacaaaagcatccacctcagtttcctaaggacagtgcccccatactcgcaccagtcatcagtctggttcgagatgatgagagtatattcgtggaaccacattattctattggtgtcggacgaccacgagggaagggccgcacagaagcggctcgagaccctgctggaagagagagagagtaaggccgaaaaagtacttcagtttgaccctgggaccaaaaacgtgacagcattgctaatggaagccaaggagctggaagcaagagtcattatcctctccgcgtcagaggacgacgcagccactgtgtatcgggcggcagcaatgctgaatatgaccggttccgggtacgtgtggctggtgggcgaaagggaaatcagcggcaacgccctcaggtatgccccagacggtatcctgggattgcagctcattaacgggaaaaatgagtctgcccacattagtgatgccgtcggcgtggtggcgcaagcagtgcacgagctgcttgagaaggaaaacattaccgatcccccccggggatgcgtggggaacaccaatatctggaaaacaggccctctctttaaacgtgtgctcatgagctccaaatatgccgatggggtgacgggccgagtggaatttaacgaggatggcgaccgcaagtttgctaattattccataatgaatctgcaaaatcggaagttagttcaggttggcatttataatggcacccacgtcatccccaacgatcgtaaaatcatctggcctgggggcgaaactgagaagcccagaggataccaaatgtccacgcggttgaagatcgtgaccatccaccaagagccgtttgtgtatgtaaagcccacactcagtgatggaacatgtaaggaggaatttactgtcaatggcgaccccgtgaaaaaggtaatctgtactggaccaaatgacacatcacctgggagtcctaggcacactgtaccacagtgctgctatggtttttgcattgacttacttataaaactggccaggaccatgaacttcacctacgaagtgcacctggttgctgatggcaaatttggcactcaagagagggtgaataactccaacaaaaaagagtggaacggtatgatgggggaattactgtctggacaggcagatatgattgtggctcccttgactatcaataacgaacgggcccaatacatagaattttcgaagccttttaagtaccagggcctgacgatactagtaaagaaagaaatccctcgcagcaccctggatagttttatgcagcccttccaatccacattatggctgctggtggggctgtcggtacatgtagtggccgtgatgctgtacctcctggataggttctccccatttggaagattcaaggtcaactcagaggaggaggaggaggacgccctgacactgagcagcgccatgtggttttcctggggggtgctgctgaattctgggataggcgagggagcgcccagatcttttagcgcgcgaattcttgggatggtgtgggcgggtttcgcaatgataattgtggcttcttataccgccaatctggccgcctttctcgtgctggatcgccccgaggagcggattaccggcatcaatgatcctcgacttcgcaacccatctgacaaatttatatacgcgaccgtgaaacagagctccgtcgatatctatttccgacgacaggtcgagcttagcacgatgtaccggcacatggaaaagcacaactacgagagcgctgcagaggccatccaggctgttcgcgataataagctgcatgcctttatctgggattccgctgttctggaattcgaagccagtcagaagtgcgatttggttacaacaggagaacttttttttagatccgggtttgggatagggatgcggaaggattctccctggaagcagaacgtgagcctctccatcttaaaatctcacgaaaatggcttcatggaggatctcgataagacgtgggtgaggtaccaagaatgtgacagccgctccaatgctcccgctactctgacatttgaaaatatggccggagtgttcatgctggtggccgggggaattgtcgccgggatcttccttatctttatcgagatagcttacaaacgccacaaagacgcccggcgcaaacagatgcagcttgccttcgctgccgtgaacgtctggagaaaaaatctacaagatcggaagtccgggcgagcagagccagatccaaagaaaaaagctaccttccgagctataaccagcacgctagccagcagctttaaaagaaggagaagctcaaaggatacctcaactggaggaggacggggtgctcttcagaatcaaaaagataccgtcttgccgaggagagccatcgaaagagaggagggtcaactgcagctgtgttccagacatagagagtcttag

SEQ ID NO: 189364 - DNA, 4395 bp, Artificial Sequence
  Description of Artificial Sequence: Synthetic coding sequence
atgggccgggtgggctactggaccctgctggtgctgcccgccctgctggtttggaggggcccagctccgagtgccgctgccgaaaaaggaccgcctgccttgaatatcgcggtgatgctcggccactcacacgatgtcaccgaaagggaactgcgcactctgtggggcccggagcaggccgccggactgccacttgacgtgaacgtggtcgctttactcatgaatcggaccgatcctaagagcctaatcacccacgtatgcgatctgatgagcggcgcccggatccacggcctggtgtttggagatgataccgatcaagaggcggtagcacagatgcttgattttatctcttcccatacttttgtgcctattcttgggattcacgggggcgcatcaatgatcatggccgataaagatcccacatcgaccttctttcagtttggtgcttccatacagcagcaggccaccgtgatgctgaagatcatgcaggattacgactggcacgtgttctccctagtgactaccatctttccaggttacagagaatttataagttttgtgaagacaactgtggacaattcttttgtggggtgggatatgcaaaacgtgataacccttgatacctcatttgaggatgccaagacgcaggtacagcttaaaaaaatccattcatcagtgattcttctctactgctccaaggacgaagctgtgctgatcctcagcgaagcaaggtcgctgggactgaccgggtatgatttcttctggatcgtcccctccctggtttctggcaacaccgaactaatcccaaaggagttcccgtccggactgatcagcgtgagctatgatgactgggactattctctggaagcacgcgtgagggacggaatcggcatacttaccaccgcagcgtcctctatgctggagaagttctcttacatccctgaggccaaggcctcatgctacggacagatggagagacccgaggtccccatgcacacgctgcaccctttcatggtaaatgtcacttgggatggtaaggacctgagcttcaccgaggaagggtaccaggtccaccctcggcttgtagtgattgtgctgaataaggaccgcgagtgggagaaagtgggtaagtgggagaaccacacattatccctgcggcatgcagtctggccacgttataaaagcttctctgattgtgaacccgacgataatcatttgtcaatcgtgacgctggaagaagcccccttcgtgatagtggaagacatagatcccttaacggagacgtgtgtgagaaataccgtgccgtgtcgtaagttcgtcaaaatcaataatagcacaaacgaaggcatgaatgtgaaaaaatgttgcaaaggtttttgcattgacattctcaagaaactgagtagaacagtcaaatttacatacgacctgtacctggttacaaatggaaaacatggcaagaaggttaataatgtctggaatggaatgattggcgaagtggtctaccagcgcgccgtaatggccgtgggtagcctaacgataaatgaagaacgctctgaagtggtcgacttcagtgtccctttcgtagaaacgggtatcagcgtgatggtgagccgcagcaacggaactgtctcacctagcgcgtttcttgaacctttttccgcatccgtttgggtcatgatgttcgtgatgctgttgatagtgtccgcaattgcagtttttgtgtttgagtactttagcccggtcggctacaatcgaaaccttgctaaggggaaggccccacacggaccctccttcaccattggaaaagccatctggctgctgtggggcctcgtgttcaataacagcgtgcccgtccagaatcctaaaggcaccacttctaagataatggtcagcgtttgggcctttttcgccgtgatttttcttgcttcctacacagcgaatctagcagccttcatgatccaggaggaattcgtcgaccaggttacgggcctgtcagacaagaagtttcagcgtccacacgattactcccccccctttagatttgggactgtgccgaacgggtcaacggagcgcaacataaggaacaactacccgtacatgcaccaatacatgaccaaattcaatcagaagggggtggaagacgccttggtaagcttgaaaaccgggaaactggacgcatttatttacgatgcagccgtgctcaattacaaagccggtagggacgagggctgcaagctggtgaccattggctctgggtacatattcgccactacagggtatggtattgcactgcagaaaggttctccttggaagcgccaaattgacctggctctgcttcagttcgttggggacggtgagatggaggaactcgaaaccctttggctgaccggcatttgtcacaacgagaagaatgaagtaatgtcctcccagctcgacatagataatatggctggagtgttttatatgctcgcagccgccatggccctgtctctgatcacctttatctgggagcaccttttttactggaaattaaggttctgtttcaccggggtctgcagtgaccgcccaggactgctgttttctatctcccgagggatttattcctgtatccatggcgttcatatcgaagagaaaaaaaaatcacccgattttaacctcacaggctctcagagcaatatgctgaagctcctgcgcagtgccaaaaatatatctagcatgagtaacatgaattctagtaggatggacagcccaaagcgggcagccgacttcatccagcgaggctcactcatcatggacatggtgagcgataagggtaacctgatgtacagcgacaacaggagctttcaaggaaaggagtctatttttggggataatatgaacgaactgcaaacgttcgtggccaaccgacagaaagacaacttaaacaactacgttttccaggggcagcacccactgactctgaatgaatctaatccaaacactgtggaggttgccgttagtacagagagcaaggccaattctagacctcgtcagctgtggaagaagagcgtggacagcatcagacaagactccctaagccagaaccctgtgagccaacgggacgaagccacagctgaaaacagaacccactccctcaaatccccgcggtacctgcctgaggagatggctcactcagatatcagtgaaacatctaatcgcgcgacatgtcaccgagagcctgataattcaaagaaccataaaacgaaggacaactttaagcgatccgtagcttctaaatatcccaaggactgctcagaggtggagagaacctatttgaagacgaaaagctcctcacctagagataaaatctatacaatcgacggcgaaaaggagcccggatttcacctggatccccctcagtttgtggagaatgttactctaccagagaatgtcgacttcccagatccataccaggacccctccgagaattttaggaaaggtgactctacacttcccatgaacaggaaccccctacataatgaagaaggactctctaataatgatcagtacaagctgtactctaaacactttaccctgaaggataagggatctccccattctgagacttctgaaagatatcgccagaactctacccattgcagaagttgcctgagcaatatgccaacatatagcgggcacttcaccatgagaagcccattcaagtgcgacgcgtgtttgcgcatgggcaatctttacgacatcgatgaagaccagatgctgcaggagacaggaaatcctgcaactggcgaacaggtgtaccagcaggattgggcccaaaataacgccctgcagttacagaaaaacaaacttaggatttcccggcagcactcatatgacaacattgtggacaaacctcgagaactagatctcagtcgcccctcaaggtcaatatctttaaaggacagggagaggctactggagggaaacttttacggttccctcttctcagtgccatcaagtaagctcagcggcaagaagtcttctctgttcccacaggggctggaggactcgaaaagaagcaaatccctgcttcccgaccacacgtcagataacccctttctccattcacacagagacgaccagcgcctagtcataggacgctgtccgtctgatccttataaacactccctgccaagccaggctgtcaatgactcatatcttaggtcgtcattgcggtccacagcctcttactgcagccgcgattctagaggtcataacgatgtctacatatcggagcatgtaatgccttatgcagcaaacaagaataacatgtactcgactccccgcgtccttaattcctgctccaacaggcgggtgtacaaaaaaatgcccagcattgaatccgatgtctag

SEQ ID NO: 189365 - DNA, 4395 bp, Artificial Sequence
  Description of Artificial Sequence: Synthetic coding sequence
atgggccgggtgggctactggaccctgctggtgctgcccgccctgctggtctggagaggccccgccccaagcgctgccgccgagaaaggcccaccagcattaaacatcgccgtaatgttgggccactcccatgatgttacagagcgagagctccgcactctttggggccccgaacaggccgcaggcttaccccttgatgtcaatgtcgtcgctctgctgatgaatcgcacagaccccaagtcactcattacacacgtctgtgacctcatgagcggagccaggatccatggactggtgttcggcgatgataccgaccaggaagccgtcgcccaaatgctcgatttcattagtagccacacgtttgtgcccatcctaggtattcacgggggggcttccatgattatggctgacaaggacccaacaagcacctttttccaatttggtgccagcatccagcagcaggctaccgtgatgctcaagataatgcaggattatgactggcacgtgttctccctggtgaccactatctttccaggttatcgggagttcatcagcttcgtgaagacaacagtggacaattcgttcgtggggtgggacatgcagaacgtaatcactctcgacactagctttgaagacgccaaaacgcaggtccagctcaagaagatccattcaagtgtcatcttactgtactgctcgaaagacgaagcagttctcatccttagcgaggctcgcagtctgggactaaccggttacgattttttttggatcgtccctagcctcgtgagtggcaatacagaactgattcctaaagagtttcccagcggcctcattagtgtttcttatgacgactgggactatagtctcgaggcgcgtgtccgtgatggcatcggaatccttacaactgcggcttcatctatgttggaaaaattttcctatattcccgaagccaaggcctcttgttatggccagatggaacggcctgaagtgccaatgcacactttgcatccttttatggttaatgtcacctgggatgggaaagatctctcttttaccgaagagggctatcaagttcatccaaggctcgttgttattgtgttgaacaaagatagagagtgggaaaaggtaggcaagtgggagaaccataccttatctctaagacacgccgtgtggcccaggtacaaaagctttagcgactgcgagcccgatgacaatcacctatcgatcgtgaccctggaggaggccccattcgtcatagtggaggatatcgaccccctcactgaaacttgtgtgcgaaacacagttccctgtagaaaattcgtgaagatcaataatagtacaaatgaaggaatgaacgtaaagaagtgttgtaaggggttctgtatcgatatcctgaagaagctgtctagaacagtgaaattcacctacgacttgtatcttgtcacaaatggcaagcatgggaagaaggtgaataacgtctggaacgggatgattggtgaggtggtctatcagagggctgttatggccgtcggctccctgacaatcaatgaagagaggtccgaggtcgtcgacttctccgtgccatttgtcgagactggaatctcagtgatggtgagccgctctaacggtaccgtctcgccttctgctttcctggaacctttttcggcctctgtttgggtgatgatgttcgtaatgctccttatcgtgtctgccattgccgtcttcgtctttgagtacttttcccctgtcggctataatcggaatctggcgaaaggaaaagccccccacggcccttcttttacaatcggaaaggcaatctggcttctgtgggggctcgtctttaacaattccgtgcccgttcaaaatccaaaaggaaccactagtaagatcatggtctcagtgtgggctttcttcgccgtgatctttctggcatcctacactgcaaacctggcggccttcatgatccaagaagagttcgtagatcaagtgacggggttgtccgataagaagttccagcgcccccatgattacagcccccccttccgattcgggactgttcctaacgggtccacggagagaaatattcgaaacaactacccctatatgcatcagtatatgaccaaattcaaccagaagggtgtggaggacgcgctggtaagcctgaagacgggtaaattggatgccttcatctatgacgcagccgtgctcaactataaagcggggagggatgaaggttgtaaactggtcaccatcggatccggctacattttcgcgaccacaggctatgggatcgcactgcagaaaggaagtccatggaaaaggcagattgatctggccctgctccagttcgtgggagatggcgagatggaagagctggaaacactttggctgaccgggatctgccataacgagaagaatgaggtgatgagctcacagctcgacatagacaacatggcaggagtattttatatgcttgctgccgccatggccctgagtctaattaccttcatctgggagcatcttttttactggaagcttcgcttctgtttcacaggtgtttgttccgacaggcccggcctgttattcagcattagcagaggcatttactcatgtattcatggagttcacatcgaggaaaagaaaaagtcccctgatttcaacctcacgggctcgcagagtaacatgctgaagctgttgcggagcgccaagaatatcagttcgatgagtaacatgaactcgtcacggatggacagcccgaagcgggccgcggatttcatccaaaggggaagccttatcatggacatggtttccgacaaggggaacttgatgtactccgacaatcggtcttttcaaggcaaagaatcaattttcggagataatatgaatgaattacaaacctttgtggctaaccgccagaaggacaatctgaataattacgttttccaggggcaacatccattgaccttgaacgagagcaatcctaacaccgtggaagtggctgttagtacagaatctaaagcgaattcccgtcccaggcaactgtggaaaaaatctgttgattccatccgccaagactcactgtcgcagaacccagtctctcagcgggacgaggccactgctgagaatcgaactcactctctcaagagtccgagatatctgcccgaagagatggctcatagcgatattagcgagacctccaaccgagccacttgccacagggagcccgataattccaaaaaccacaaaaccaaagacaattttaagcgctcagtggcttccaaatacccaaaagactgtagcgaggtcgagcggacatacctcaagacgaaaagttcttctccacgcgacaagatctacactatcgatggcgagaaggaaccggggtttcatcttgacccaccccagttcgtagaaaatgtcacactgccggagaatgtggactttccagatccctaccaggacccatctgaaaacttcaggaagggcgactccacactaccaatgaatcggaaccccctgcataatgaagaaggactaagtaacaatgaccagtacaagttgtatagcaagcattttaccttaaaggacaaaggttctccccactctgaaacttcagaacggtatcgccagaacagcacgcactgtagatcctgtttgtcaaacatgcctacttacagcggccatttcacaatgaggtcaccttttaagtgtgatgcttgcctgcgaatgggaaatctctatgacatcgatgaagatcagatgcttcaggagacggggaaccccgccaccggcgagcaggtttatcagcaagactgggctcagaataacgctctccagctccagaaaaacaagctgaggatctcccggcagcactcctatgataacatagtggataaaccccgagaactcgatctgagtcgacccagcaggagcatctcactcaaggatagagagcgtttactcgaaggtaatttttacggatctctgttcagtgtcccctccagtaaactgagcggtaaaaaaagctccctcttccctcaaggcctcgaggattctaaaaggtcaaagtctttacttccagatcatacaagcgataaccccttcctccacagtcacagggatgatcagcggctggtgatcggacggtgtccttctgacccttataagcactctttgccgtcacaggcagtgaatgatagctaccttcgaagcagtctgagatcaaccgcttcttattgctcacgcgactcccgcggccataacgatgtgtacataagtgaacatgtgatgccatacgctgccaataagaacaacatgtacagtacaccgcgggtcctcaattcttgcagtaataggagggtttacaagaaaatgccaagcattgagtccgacgtttag

SEQ ID NO: 189366 - DNA, 4395 bp, Artificial Sequence
  Description of Artificial Sequence: Synthetic coding sequence
atgggccgggtgggctactggaccctgctggtgctgcccgccctgctcgtatggcggggtccagctccctcagccgctgctgagaaaggacctcctgcattaaatattgccgtaatgttggggcacagtcatgatgttacggaacgggagcttagaaccctgtgggggccggagcaggcagcaggcttgccgcttgacgttaatgttgtcgcccttttgatgaacagaactgatccaaaatctcttattactcacgtgtgtgacttgatgagcggtgccaggatccacggtttagtgtttggagatgacaccgaccaggaggctgtggctcagatgttggatttcatctcaagccacaccttcgtccctatacttggtattcacggcggagcctcgatgattatggcagataaagatcccacgtccacgtttttccagttcggcgcttccatacagcaacaggccacagtgatgctaaagatcatgcaagactatgactggcacgtcttttcattagtaacaaccattttcccgggctacagggaatttatatctttcgtcaaaactactgtggataattcgtttgtgggctgggacatgcaaaacgtgatcacactcgatactagcttcgaagacgccaaaactcaggttcaattaaaaaaaattcatagctccgtaatactcctctactgttccaaggatgaagccgtgttaatcctcagcgaagctagatcccttggcctaacgggctacgactttttctggattgtaccctcgctagtttctggcaacactgagctcataccgaaagagttcccatctggcctcatatctgtctcctatgacgactgggactacagcttggaggctagggttagggacgggatcggcatcctgactacagccgctagctcgatgctcgagaagttttcctacatccctgaggcaaaggcctcatgctacggccagatggagcggccagaggtgccaatgcatactctgcatccttttatggtgaacgttacttgggatggtaaagacttatcattcacagaagagggataccaggttcatccacgcctcgtagtgatagtcctcaacaaagatagagaatgggaaaaggttggtaaatgggagaatcataccctcagtctgaggcacgctgtgtggccgcgatataagtcattttcagattgtgagcctgacgataatcatttgtctatcgtcacccttgaagaggcgccttttgtgatcgtcgaggacatcgaccccctgaccgagacatgtgtacgaaacactgtaccctgtaggaaatttgtgaagattaataattccaccaatgaaggaatgaacgtgaagaaatgctgtaaggggttctgcatagatatactgaaaaagttaagtcggaccgttaaattcacgtatgatctgtatctggtgaccaacggcaagcatggaaagaaggtcaacaacgtatggaacgggatgatcggggaggtcgtgtaccaacgcgccgtaatggccgtcggcagtctgaccataaacgaagagcgtagcgaagtggtagatttttccgtcccgtttgtggagaccggcatttcagtgatggtctcacgatctaatgggactgtgtcccctagcgcattcttagagccattctcagcatccgtttgggtcatgatgttcgttatgttactgatcgtcagcgctattgccgttttcgttttcgagtatttctctccagtgggatataaccgcaacctggcgaaggggaaggcgccacacggccccagtttcaccattgggaaggcgatttggttattatggggcctcgtctttaataattccgtgccagtccagaatccgaagggcaccaccagcaaaatcatggtgtcagtctgggcgtttttcgctgtgattttcctcgcaagttacacggccaatctcgctgcgttcatgattcaggaagagttcgtggaccaagtgaccgggctatctgataaaaaattccagagacctcacgactactctccaccttttagatttggaacggtgcccaatggctctaccgagaggaacattcggaacaattacccttatatgcatcaatatatgacaaaattcaaccagaaaggcgtggaggatgctcttgtgagtttaaagaccgggaaactcgatgcttttatctatgatgctgccgttctcaattataaagccgggcgcgatgagggctgcaaattggtgactatcggctccggatacattttcgccactactggttatggcattgccctccaaaagggctcgccctggaaacgccagattgatctggcattgctgcagttcgttggggatggtgagatggaagaactggaaaccctctggctcaccggcatctgccacaatgaaaaaaacgaggtcatgagctcacagttggatatcgataacatggccggagtgttctacatgctggcggcagcaatggccctctccctgattacatttatttgggaacatctgttctactggaagctgcgcttttgcttcactggcgtgtgctccgaccgccctggactgctgttctcaatatcccgtgggatttatagctgtattcacggagtacatatagaagagaagaagaagagccccgactttaatcttaccgggagtcagagtaatatgttgaagctcctgagatcagctaagaacataagctcaatgtccaacatgaacagcagcagaatggactcccctaaaagggcagccgatttcatccagcgcggctctttaataatggacatggtgagcgacaagggtaatctcatgtactctgataacagatcttttcagggcaaggagtctatttttggagataacatgaacgagctccaaacatttgtggcaaaccggcaaaaggataacctcaataattatgtctttcaggggcagcacccattgacactgaacgaaagtaacccaaacaccgtcgaggttgcagtgagtacagaaagcaaagcaaattccagacctcgccaactgtggaaaaagtctgtggacagcattcggcaggactctctgtcccaaaatccagtgtctcagagggacgaagccaccgccgaaaatagaacccactctctaaaaagccctcgctacctcccagaggagatggctcactctgacatatccgaaacatccaatcgcgccacctgccaccgcgagccggataactcaaagaaccataagaccaaggataactttaaaaggagcgttgcatctaaatacccaaaggactgtagcgaagttgagagaacctacttgaagacaaagagctcaagcccccgcgacaagatttatacaatcgatggagagaaggagcccgggttccacctggacccccctcagttcgtggagaatgtcactcttcccgagaacgtggacttccctgacccctaccaggacccgtctgagaacttccgtaagggagactcgactctgccaatgaacagaaatcctctgcacaatgaggagggactaagtaacaacgaccagtacaaactatacagcaagcacttcacactgaaggataaagggtctccacactccgagaccagcgagcggtatagacagaacagcactcactgcaggtcttgcctgtccaatatgcctacttacagtggacactttaccatgcgatccccctttaaatgtgatgcatgcctgagaatgggcaacttatatgacattgacgaagaccaaatgctgcaggaaacggggaatccagctaccggggagcaggtctaccagcaggattgggcccagaacaacgccctgcagttgcaaaaaaacaaactgcgaatttcacgtcagcattcatacgataatattgtagataagccacgtgaactcgatctttctaggccttctaggagcattagcctgaaggacagggaacggctgctcgagggaaacttctacggtagcttgtttagcgttccaagctccaagctctctgggaaaaaaagctcactgttcccacaaggccttgaggattctaaacgatctaagtcattactaccagatcacacatcagacaaccccttcctacactcccatagggacgatcaaagacttgtgattggtagatgcccttcggatccatacaaacattccctgccctctcaggcggttaacgattcatatcttcgaagttctctgcgttctacagcctcttactgttcacgggactcccgcggacataacgacgtgtatatttccgaacatgtgatgccctatgccgccaacaaaaataatatgtactccacaccgcgggttctgaattcttgctcaaaccgtcgcgtttacaagaagatgccttctattgagtcggatgtttag

SEQ ID NO: 189367 - DNA, 3846 bp, Artificial Sequence
  Description of Artificial Sequence: Synthetic coding sequence
atgggccgggtgggctactggaccctgctggtgctgcccgccctgcttgtgtggaggggtcctgctccgtcagccgctgcagaaaaaggtccgcctgcacttaatatcgcagttatgttggggcactctcatgacgtcaccgaacgcgagctccggaccctgtgggggcctgaacaggcggcaggcctacctttggatgtcaacgtggtggcgctcctgatgaacaggaccgatccgaagagcttgataacccacgtttgcgatctcatgagtggggcaagaatacacgggcttgtctttggagacgatactgatcaggaagcagtagcacaaatgcttgattttatatcttctcataccttcgtaccaattctgggcatacacggtggcgcatccatgattatggccgataaggaccctacgtccaccttctttcagttcggcgcatccattcagcagcaggcaaccgtgatgctaaaaattatgcaggactatgattggcatgtgttttccctggttactaccatcttccctggatatcgtgagttcatttcctttgtgaagaccacggtcgacaattcatttgtgggctgggacatgcagaacgtcatcaccctggacacaagtttcgaggatgcaaagacgcaggttcagttgaaaaaaatccactcatcggttatcctcctgtattgttctaaggacgaggcagtgctgattctttcagaagctcgctcattgggactcaccgggtacgacttcttctggattgtaccatccttggtgtctggcaacaccgaacttattcctaaggagtttccttcaggtctgatcagcgtgtcttacgatgactgggattactccctggaggcaagagtccgagatggaatcgggatcctgacaacagccgcctcgtctatgctggaaaagttttcgtatatccctgaggctaaggcatcatgctacggtcaaatggagcgcccagaagtgccgatgcacacactgcacccctttatggtgaatgtaacatgggacgggaaagacctgtcattcactgaagaagggtaccaggtccatccgcgcttggtggtgattgtcctgaataaggaccgtgaatgggaaaaagtaggaaagtgggagaaccacacactgagccttaggcacgcagtgtggcctaggtacaaatccttctctgactgcgagccggatgataatcatctgtccatcgtaaccctcgaagaggccccctttgtcattgttgaggatatcgatcctctaaccgaaacgtgtgttcgaaacacagttccttgccgtaagttcgtcaagattaacaattccaccaatgagggaatgaacgttaaaaagtgttgtaaagggttttgcatcgacatactgaagaagctatctagaaccgtcaaattcacatacgacctctatctggttaccaacggtaaacatggcaaaaaagtgaacaatgtatggaatgggatgataggagaggtcgtatatcaacgggcagtcatggcggtgggctccctgacaattaacgaggaaaggagcgaggtagtggacttcagcgtgccattcgtcgagacgggcatttcggtgatggtgtccaggagtaacggaacagtctcgccatctgccttcctagaaccattctcagcttcagtctgggtaatgatgttcgtgatgctcttaatcgtatccgccatcgcagtatttgttttcgagtatttctcgccagttggctataaccggaaccttgccaagggtaaggctccccacgggccgtcatttaccatcggtaaggccatatggctgctttggggtctggttttcaacaactctgtgcctgtacaaaatcctaagggaaccactagcaaaattatggtatccgtttgggcctttttcgccgtaatttttctggcatcatacacggccaatcttgcagcctttatgatccaggaggaattcgttgaccaggtgacgggactcagtgacaagaagttccaaaggccacacgactactcccctcctttccgcttcgggacagttccaaacgggagcaccgagagaaacataagaaacaattacccgtatatgcaccagtatatgacgaagtttaaccagaaaggagtcgaggacgcccttgtaagtctaaagacaggcaaactcgacgcctttatttacgatgctgctgtactgaactataaagccgggagggacgaaggttgcaaactggtcaccatcggctcaggctatatatttgccactactggatatgggattgccttacaaaagggtagtccatggaagcgccagattgacctagccctcttacaatttgtgggcgatggagaaatggaggaactggagaccctgtggttgactggcatttgccacaatgagaaaaacgaggtgatgagcagccaactggacatagataatatggccggggtcttttatatgctggcagcagcgatggctttaagcctgattacctttatttgggaacacttgttttactggaaactgcgcttctgcttcacaggtgtctgtagtgataggcccggtctcctgttttctatctccagggggatttactcctgcattcacggcgtccatatcgaggaaaagaaaaagtcgcccgattttaacttaaccggatcacagtccaacatgctcaaattgcttaggtctgcgaagaatatcagttcaatgtcgaacatgaacagcagcagaatggatagccccaaacgcgctgcagatttcatacagcgggggtctctcatcatggacatggttagcgacaagggcaatttaatgtatagcgacaacagaagctttcagggcaaagagtccattttcggcgataacatgaatgagctccagactttcgttgccaaccgtcagaaggacaacctgaataattatgtgtttcaggggcaacacccgctgacactgaatgagtctaaccctaacactgtggaagtcgccgtttccactgagagcaaagccaacagcaggccccgccagctgtggaaaaaaagtgttgattctatccgtcaggactcccttagccaaaacccagtttcccaaagggatgaggccacagccgagaataggacccactccctgaagtctcctaggtacctcccggaagagatggcacactccgatatctctgaaacttcaaaccgagcgacctgccaccgtgaaccagataattcgaagaaccacaagactaaagacaacttcaagaggagtgtggcatctaagtatcctaaggattgctccgaagtagaacgaacatacctcaagactaaatcttcaagccccagggacaagatttataccatcgacggtgagaaggaaccaggttttcatttagatccaccccagttcgtcgagaacgtgacacttccggaaaatgttgacttcccggacccataccaggaccccagtgagaactttcgtaagggcgattcaacattacctatgaatagaaacccacttcacaacgaagaaggcctctctaataacgaccagtataagctctattcaaagcacttcacccttaaagataagggcagcccccactctgagaccagtgaaagatataggcagaatagtacacactgtagatcttgtttatccaatatgcccacttatagcgggcacttcaccatgaggtcaccatttaaatgtgatgcctgtcttaggatgggtaatctgtacgacattgacgaggaccaaatgttacaggaaacgggtatgaccaacgcatggctcctgggggacgccccaaggacactcaccaatactaggtgccaccctagacgatag

SEQ ID NO: 189368 - DNA, 3375 bp, Artificial Sequence
  Description of Artificial Sequence: Synthetic coding sequence
atgctgaagatcatgcaggactacgactggcacgtgttcagcctggtgacaactatcttccccggttaccgggagttcatttcctttgttaagacgactgtggataacagcttcgttggatgggacatgcaaaacgtaattacactggacacctcatttgaagacgctaagacacaggtgcagttgaaaaagatccattcgtcagtgattctactgtattgttcgaaggatgaagctgtgctaattctcagcgaagcccgttctctgggccttactgggtacgattttttttggatcgtgccctcactggtgagcggcaatacagaacttattcctaaggagtttccctccggtctcatcagcgttagctatgacgactgggattacagtctcgaagctcgagtgcgcgatgggatcgggattctcaccactgcagcaagttcaatgctggagaagtttagctacatccccgaggccaaggcctcttgctatggacagatggagcggcccgaggtaccaatgcatactctgcacccctttatggtgaatgtgacctgggacgggaaagacctgagctttacggaggagggctaccaggtgcaccccaggctggtggttatagttctcaacaaagaccgagagtgggaaaaggtgggaaagtgggagaaccataccctttcactgaggcacgctgtctggccacgatataagtctttcagtgactgtgaacctgatgataatcacttgtcgattgtcaccctagaagaggctccattcgtaattgtagaagacatcgacccgctgacagaaacctgtgtgcgaaataccgtgccctgtcgcaaattcgtgaagatcaataattccacaaacgaggggatgaatgtgaaaaaatgctgtaagggcttttgcattgatatcctgaaaaagctgagccgaaccgtcaaattcacgtacgacctctaccttgtcacgaacggcaagcacggtaaaaaagtgaataatgtttggaacggcatgattggagaggtggtgtaccagcgcgccgtaatggctgttgggtcgcttactattaatgaggagagatctgaggtggtggactttagtgtgcctttcgtcgagaccggaatttcagtgatggttagccgcagcaatggaactgtgtctccctccgccttcttggagccatttagtgcgtccgtttgggtgatgatgtttgtcatgctgctgattgtgagtgccatagcggtgtttgtgtttgagtactttagcccagtggggtacaaccggaaccttgcaaagggtaaggcaccacatggcccaagcttcacgatcggaaaggcaatatggctcctgtggggtctggtctttaacaattccgtgcccgtgcagaacccaaaaggcaccactagcaagattatggtgtcagtttgggcatttttcgctgttatatttcttgcctcttacactgcaaaccttgccgcttttatgatccaggaagagtttgttgatcaagtgacagggttaagcgacaaaaaatttcagagaccccatgactacagtcctccatttcggttcggaacagttccgaatggaagcacagagaggaatattcgtaacaattacccctacatgcaccagtatatgacaaaattcaaccagaagggcgttgaggatgcgcttgtttctttaaaaacaggtaaacttgacgcttttatttacgatgccgctgtcctcaactacaaggcagggcgcgatgagggctgtaagttggtgacgattggaagcggatacatttttgccaccaccggatatgggatagccctccaaaagggaagcccatggaagagacagatcgatctggccctgcttcaatttgtgggtgacggtgaaatggaggaactggaaacgttgtggctcaccggcatctgtcacaacgagaagaacgaagtgatgtcatcccaacttgatatcgacaatatggcaggagtcttttatatgctcgctgccgctatggctctttccctgataacttttatttgggagcaccttttctactggaagctgcggttctgctttaccggcgtgtgtagcgatcgcccaggccttttattttcaattagtcgggggatctactcctgcatccacggggtgcacatcgaggagaaaaaaaaaagtccagactttaatctaaccggatctcaatcaaacatgctgaaacttctgcgctcagcgaaaaacatttctagcatgtctaatatgaacagcagtcggatggactcccccaagcgcgccgcagacttcatccaaaggggctctcttatcatggacatggtttccgataaagggaatctgatgtactctgataatcgtagtttccaaggtaaggagtctatattcggcgacaacatgaatgaactgcaaacgttcgtggctaaccgtcagaaggataaccttaacaactacgtgtttcaaggccaacatcccctgactctgaacgagtctaaccccaatactgtagaagtcgccgtatcgaccgaatctaaagcgaacagcaggcctaggcagttgtggaagaaaagtgttgattctataaggcaggactctctgagccagaatccggtcagccaacgcgacgaggcaacagccgagaatcgaacgcattctctcaaatcgccaagatatctgcctgaagaaatggcacattctgatatctcagagacaagcaatcgggccacgtgtcaccgagagcctgacaatagcaagaaccacaaaactaaagacaactttaagcggtctgttgcatctaaatacccaaaagattgctctgaggtcgagcgaacctacctgaaaaccaagagcagtagcccacgggacaaaatttatactattgacggtgaaaaggagcccggtttccacttggatcccccacagttcgtcgaaaacgtaaccctgcctgagaatgtggacttcccagacccctaccaggatccatccgaaaattttcggaagggcgactctaccttacccatgaataggaaccccctgcataatgaagagggacttagcaacaacgatcagtacaaactctatagcaaacattttacactcaaagacaaggggtctcctcattccgagaccagtgagagataccgacagaactcaacacactgccggtcctgtcttagcaatatgcccacctacagcgggcacttcacgatgcgctcaccgttcaaatgcgatgcctgtctgagaatggggaacctgtatgatattgatgaggatcagatgttacaggaaaccggtatgaccaatgcgtggcttctgggggatgccccccgcacgttgaccaatactcgctgccaccctcgacgatag

SEQ ID NO: 189369 - DNA, 4455 bp, Artificial Sequence
  Description of Artificial Sequence: Synthetic coding sequence
atgaagccccgggccgagtgctgcagccccaagttctggctggtgctcgctgtgttggcggtttccggaagtcgggccaggtcccagaaaagtcctcccagtataggtatagccgtgattctggtcggcaccagcgatgaagtggccattaaggacgcccatgaaaaggatgattttcaccacctttcagtggtcccccgggtggaattagtggctatgaatgaaaccgacccaaagtctatcatcacccgaatttgcgatcttatgtcagaccgaaagatacagggcgtcgtgttcgccgacgatactgaccaggaggccatcgcccagattcttgactttatttctgcacagaccctgaccccaattctaggtatacacggaggaagtagcatgatcatggccgacaaagatgaaagcagcatgttcttccagttcggcccctctatcgagcagcaagcctcagtcatgctcaacatcatggaggagtacgactggtacatcttctcaattgtcacgacttatttccctggctaccaggactttgttaataaaattcggagcaccatcgaaaacagcttcgtaggctgggaactcgaggaagtcttgctcttggatatgagtttagatgacggagacagcaagatacaaaatcaactgaagaagctgcagagtccgatcatcttactttattgcaccaaagaagaggctacatacattttcgaggtcgccaactcggtggggctgaccggctatggctacacatggatcgtgccttcattggtggcaggggatacggacaccgtgcctgcagagtttcccacaggactgatcagtgtgtcctatgacgaatgggattacggtctcccggctagggtaagagacgggattgctattattactacagccgccagtgacatgttgagcgagcacagctttattcccgaacccaagtctagttgttacaatacccacgagaagcggatataccagtccaatatgctaaaccgctatctcattaatgtgacatttgagggccgcaacctttccttctccgaagacggctaccagatgcatcctaaactggtaattatcctgctgaacaaagagcggaagtgggaaagagtgggcaagtggaaggacaagagcctccaaatgaagtactacgtttggccgaggatgtgccctgaaacagaggagcaggaggacgaccacctgtcaatcgtgaccctggaggaggcacccttcgtcatcgtggaaagtgtggaccccctgtccggcacctgtatgcgaaacacagtaccttgtcagaagcggatcgtgacggaaaacaaaacagacgaagagcctggttacatcaagaaatgttgcaaaggtttttgtattgatatcctgaagaaaatttcaaaatctgtgaagttcacatacgatctttacctcgtgaccaatggaaagcatggtaagaaaatcaacgggacctggaacgggatgattggtgaagtggtgatgaaacgggcttatatggccgttggaagcctgaccatcaatgaagaacgatcagaggtggtggacttttccgtcccatttatcgaaactggtatctctgtgatggtcagccggagcaatggcaccgtgagtcccagcgctttcctggagcccttttccgcggacgtttgggtaatgatgtttgtcatgctgttaattgtgtcagccgttgcagtgttcgtgttcgagtatttttccccggttggctacaacagatgtctcgcagatggacgggaaccaggcggacccagcttcactatcggtaaggccatctggctgctttggggactggtcttcaataatagcgtacccgtgcagaatcctaaggggaccactagtaagatcatggtttcagtgtgggcattctttgctgtcatcttcctggcgtcttataccgccaatcttgcggcctttatgattcaggaggaatatgttgaccaggttagtggtctgagcgataagaaattccaacggccaaacgatttcagccctccgtttaggtttggcaccgtgcctaatgggtcaactgagcgaaacatccgcaataactatgcagagatgcacgcctacatgggtaaattcaatcagaggggggtggacgatgcactgctttccttgaaaaccgggaaactagatgcttttatctatgatgcggcagtacttaattatatggccggcagagacgagggttgcaagctcgtcaccatcggcagtgggaaggtgttcgccagtacgggatacggcattgctatccagaaggattcagggtggaagcggcaggttgatctggctattctgcaactgtttggcgatggagaaatggaagagttagaagcgctctggctcacggggatttgccacaatgaaaagaatgaggttatgtctagccagctggacatagacaacatggccggcgtgttttatatgctgggggctgcgatggcattatccctcatcactttcatctgcgagcacctcttctattggcagttcaggcactgcttcatgggagtttgctcgggcaagccaggcatggtgttctctatcagccggggtatatatagctgcattcacggggtagccattgaggaacggcagtccgtgatgaatagtcctactgcgacaatgaacaacacccattcaaacatcctacgacttctgaggactgccaagaacatggcaaatctgagcggcgtgaatggctcccctcaatcggcgctggactttatcaggcgcgagtcctcagtctatgacatctccgaacacagacgctcatttacccactcagactgtaaaagctacaacaaccccccatgcgaagaaaacctctttagcgactacatctctgaagtggaaagaacgttcgggaatctacaattaaaggatagcaacgtttaccaggaccactatcaccatcatcatcgtccccactcaattggttccgccagttccattgatggcctctacgactgcgataacccaccctttactacccaatctcgctctatcagcaaaaaacctctggacataggcctcccgtcgtctaagcacagccaattgtccgatctctacgggaaattttctttcaaaagtgatcgctactcaggccacgacgatctcatcagaagtgatgtgagcgacatctctacccacaccgtgacctatggcaatatagaagggaatgccgccaaaaggcggaagcagcaatacaaggactccctgaagaagaggcccgcttccgccaaaagcagaagggaattcgacgagatcgagctggcctatcgcaggcggcctcccagatccccagaccacaaaagatactttcgagataaagaggggctgcgcgacttctatctggatcagttcaggactaaggagaactctcctcattgggaacacgtggacctcacagatatctataaggagaggagcgatgacttcaagagggacagtgtgagtggcggcggcccctgtaccaaccgctcacacataaaacacgggactggtgacaagcatggggtagtttccggagtgcccgcaccctgggagaaaaatctgactaatgttgagtgggaggatcggagtgggggaaacttctgtcggtcctgtcccagtaaactccacaattactctacaacagtgaccgggcaaaacagtggaaggcaggcttgtattcgttgtgaggcttgcaagaaggctggtaacctgtacgatatcagcgaggataatagcctgcaggaactcgaccagcctgctgctccggtcgctgttacgtctaacgcaagcacaaccaagtatccacagagtcctactaattcgaaagcccagaagaaaaaccgcaataagttgcgaagacagcacagttacgataccttcgttgatcttcagaaggaagaggctgccctggccccacgatccgtgagtctgaaagacaaaggacgttttatggatgggtccccatacgcccacatgttcgagatgagcgcaggcgaaagtacatttgcaaacaataagtcctccgtgccaaccgcaggacaccatcaccataacaatcccgggggcggttatatgctgagtaaatctttgtatcctgatcgagtcacgcaaaacccttttatccctacctttggcgatgaccagtgcctgttgcacggcagcaagagctacttctttagacaacctactgtggctggagcctcaaaagccaggcctgattttcgggctctcgtcaccaataagccagtggtcagcgcattacatggcgccgtcccggcgcgcttccagaaagatatctgtattggaaatcagtccaatccttgcgtgccaaataacaagaaccctagggccttcaatggatcgtccaacgggcatgtatatgagaagctttcatcgatagagagtgacgtatag

SEQ ID NO: 189370 - DNA, 3702 bp, Artificial Sequence
  Description of Artificial Sequence: Synthetic coding sequence
atgggcggcgccctgggccccgccctgctgctgaccagcctgttcggtgcgtgggcgggcctgggaccgggtcagggtgaacagggtatgaccgtggcagtcgtatttagtagtagcggccccccacaggcgcagtttcgggcgcgtctgacaccccagagctttctcgacctgcccctggaaatccagcccctgactgtcggcgttaacaccaccaatccatcctcactcttaacacaaatctgcggattgttaggggccgcccacgttcacggcatcgtttttgaggacaacgtggatactgaggctgtggcccagattcttgacttcatctcgagccaaacccatgttccaatactttctatctcgggcggatccgcagtcgtgctgacgcccaaggagccgggttccgctttcctacagctaggagtgtccttggaacagcagttacaggttttgtttaaagtcctggaagaatacgactggtctgcgttcgccgtaataacctccctgcaccctggacacgccctctttctggagggcgtccgagcggtggcggatgcgtctcacgtgtcttggcggctactggatgttgttacactagagttagggcctggcggacccagagcaagaacacagaggttactgaggcaactggatgccccagtgtttgttgcgtattgtagccgcgaggaggctgaagtgctgtttgcagaggctgctcaagcgggactcgttggacctggacacgtatggctggtccccaatctagctctcggaagcactgatgcccctcctgcaacattccctgtggggcttatctccgttgtgaccgagtcatggcgactctccttaaggcagaaagtcagggacggcgtggccatactggccctgggcgcgcattcgtactggagacaacacggcaccttacctgcccccgcaggagattgccgggtgcaccctggaccagtgtcaccagctagagaggcattctacagacacctcttaaatgttacttgggagggcagagacttcagcttctctcctggcggctatctcgtacagcccaccatggtggtgattgctcttaaccgccatagactctgggagatggtcggacggtgggaacatggcgtgctttatatgaaatatccggtttggccccgctatagcgcaagtctgcaaccagtggttgactcccgacacctaacggtggccactctggaagaacggccattcgttatcgtcgaatcaccagacccagggactggcgggtgtgtccctaacacggtgccttgtaggaggcagagcaatcacacattctcatcaggagatgtggcgccatacactaaactctgttgcaagggcttttgcattgatatcctgaaaaaactcgcaagagtagtgaagttttcctatgatttatatctggtaaccaatggaaagcatggaaagcgggtaagaggagtctggaacggcatgatcggagaggtctattacaaaagggccgatatggcaataggatccttgaccattaacgaagaaaggagcgagatcgttgacttttcagtgccctttgtggagacagggattagtgtgatggtggctagaagtaatggaacagtgtcgcccagcgcctttctggagccttactcccccgcagtgtgggtcatgatgttcgtcatgtgtctaaccgtggtcgcaataacagtgtttatgttcgaatatttcagtcccgtgtcctacaaccagaatctgacacgagggaaaaaaagtggaggacctgcctttaccatcggcaagtctgtgtggctgctgtgggctcttgtattcaacaactctgtgcccattgaaaacccccgagggacaacttccaagataatggttttggtctgggcatttttcgctgttatatttcttgcatcttacacggccaacttggccgccttcatgatccaggagcagtacatagataccgtgtccgggctgtcagataagaaattccaaaggccccaggatcagtatccccctttccgctttggcacagtgcctaacggcagcaccgagaggaacatacggagtaattaccgcgatatgcatacacacatggtgaaattcaaccagaggagcgttgaggatgccctgaccagcctgaaaatgggcaaactagacgccttcatctatgatgccgcagtcctgaactacatggctgggaaggacgaaggatgcaagctggtcaccattggatccggtaaggtgttcgcaaccactggctacggcattgccatgcaaaaggatagtcattggaaacgtgcaattgatctcgcactcctgcagttcctcggcgatggggaaactcagaaattagagaccgtatggctgtctggcatttgtcagaacgaaaaaaatgaggtgatgagtagtaagcttgatatcgataacatggccggagtcttttacatgctcctggtggctatgggcctggcccttcttgtgttcgcatgggaacatttggtgtattggaaattacgccactccgtacctaatagctcacagttggatttcctgcttgctttctcccgtgggatctactcctgtttttcaggagtgcaatctctggcaagtcctccacgtcaagctagccccgatctaacagcttcttctgctcaagccagtgtcctgaagatgcttcaagctgcaagagacatggttacaaccgctggagtgagctcttccttggatagagctacacggaccatcgagaattggggaggaggcaggagagcccctccacccagcccctgtcccacccctcggagtggtccctctccctgtctacctactccggaccctccaccagagcccagcccgaccggctgggggcctcccgatggaggcagggcagcactggtcaggagggcgccacagcctcctgggagacctcctactcctggcccaccgcttagcgacgtttcaagagtctcccgccgaccagcatgggaagcccggtggccagtacggactggccactgcgggagacacctgtctgcctccgagcggcctctgtctcccgcaagatgccactactctagcttccccagagctgaccgaagcggaaggccatttctgccgctgttccccgagctggaggatcttccgctgttagggccagaacagctagcccgaagagaagccttgcttcacgctgcctgggctagggggtcacgaccacgccatgctagcctgccaagtagcgtcgcagaggccttcgctcgcccttcgagcctccctgctgggtgtactggaccagcttgcgcacgaccagacgggcactccgcttgtagaagactggcacaggcacagtccatgtgcctgcccatctacagagaagcatgtcaggaaggcgagcaggccggggcacccgcatggcagcataggcagcacgtctgtctgcacgcccatgctcatctgccattctgctggggggcagtttgcccgcacctcccaccgtgtgcgagtcacggatcttggctgagcggagcttggggccccttaggccaccgaggaaggacattgggcctgggaaccgggtaccgcgactcagggggccttgacgaaatatctcgcgtggcacggggtacacagggtttccccggtccttgcacctggcgtcggatttcatcacttgagtcagaagtttag

SEQ ID NO: 189371 - DNA, 2724 bp, Artificial Sequence
  Description of Artificial Sequence: Synthetic coding sequence
cggggccagggcggcgacacccggagcaagggcacccggcagcccgagccgcccggtgcctcgcgggaccctgcccgctcatgctgggaccctcctgtggatatgggcggagccctaggtccagccctccttctcacaagtctctttggcgcttgggccgggctgggccctgggcagggggagcagggcatgactgtcgcagttgttttctcaagttctggccccccccaggctcagtttcgagcccgcctcaccccacaaagcttcctggacttgcccttggaaatccagccactgacggtcggcgtgaacactacaaatccttctagcctcctcacccaaatctgcgggctccttggcgcggcccatgtgcacggaatcgtcttcgaggacaatgttgatacagaggcagtggcccaaatccttgacttcatctcaagccagacgcacgtcccaatactgtccatatctggcggatctgctgtggtgttaacccctaaggaacccggcagtgcttttcttcagctgggagtttccctggaacaacagctgcaggtattattcaaagtcctcgaggaatatgattggtctgcctttgctgtaattaccagcctgcatcccggtcacgcactttttctggagggggtgcgcgccgtcgccgatgcttcccacgtgtcctggaggctgctagacgtggtgacactcgagctgggcccagggggaccccgggcgcgcacccagcggctgcttcgccagctggacgctccggtgttcgtcgcatattgtagccgtgaagaggccgaagtgctctttgcggaggcggcgcaagcagggttggtaggccccggacacgtttggcttgtaccaaacctggcattgggctctacggacgctcccccagccacattccccgtggggctgattagcgttgttacagaaagctggagactgtcgctccgtcagaaggtgagggacggagtggctatccttgctttgggggcccattcttattggcgtcagcacggaacactccctgcacctgctggtgattgccgagtgcaccctggtccagtctctccagctcgtgaggctttttatcgccatctgcttaatgtgacctgggaaggacgggacttttccttttcccctggaggctatctcgtccagcccaccatggtggttattgcgctgaacagacataggttgtgggagatggtcggaaggtgggaacatggcgttctgtacatgaagtacccagtatggccccgttacagcgctagccttcagcctgtcgtggatagcagacacctcaccgtagctacgttagaagaacgtccatttgtgatagtggagtcccccgatccaggaacaggcgggtgtgtccccaatacggtcccctgtcggcgccagtctaaccacacattttcatcaggagacgtggccccatatactaaactgtgttgcaaagggttctgcattgacatactaaagaagctggccagggtcgtcaagttcagctacgacctgtacctggttacaaacggtaaacacggcaagagagtaagaggcgtctggaatggaatgatcggtgaggtgtactataagagagccgacatggctattgggtcattaaccattaacgaagagagaagcgaaattgtggacttctccgtgcccttcgtggaaaccggaatttccgttatggttgcccgctcaaacggtacggtgtctccaagcgctttcctggagccctacagtccagccgtgtgggtcatgatgttcgtcatgtgtctcaccgttgttgcaataaccgtcttcatgttcgagtatttctctcctgtgtcatataatcagaacttaactagggggaagaagtcgggcgggcctgcttttaccataggcaaatctgtctggctgctttgggccttggtattcaacaactctgtacccatcgagaatcctcgcggaaccacgtcaaagattatggttctggtatgggcctttttcgcagtgatttttctggcctcctataccgcaaacctggcagctttcatgattcaggagcaatacatcgataccgtgtccggcttaagcgacaagaagttccagaggccacaggaccaatacccccctttccgctttggtacagtgcccaacggcagtacagagcggaacatcaggagcaattatagagatatgcacacccacatggtgaaattcaaccagaggagtgtggaggacgctctcaccagtctcaaaatgggaaaactcgacgccttcatttacgacgccgccgtactgaactacatggccggaaaagatgaggggtgtaagctggtaaccattggttctggtaaagtcttcgccactaccggctatgggatcgccatgcagaaggactcccactggaagagggccatagaccttgcattgctgcagtttttgggtgacggggagacgcaaaagctagaaaccgtgtggctgtcaggaatctgtcaaaatgagaagaacgaggtgatgagcagtaaactggacatcgataatatggccggagtgttctatatgttgttggtagcgatgggtcttgcactgctggtcttcgcatgggaacatctggtatactggaagcttaggcacagtgtgcctaatagttcccagctagattttctgttagccttcagtagggtgggcgctcatccgagccctcacagacctaagttttag

SEQ ID NO: 189372 - DNA, 4011 bp, Artificial Sequence
  Description of Artificial Sequence: Synthetic coding sequence
atgcggggcgccggcggcccccggggcccccggggccccgccaagatgttactattgctcgcactggcctgcgctagcccttttccagaagaggccccaggacccggcggggctggcggacccggggggggccttggcggtgccagacccttaaacgtcgcactcgtgtttagcggacctgcatatgcggccgaggctgcgcgacttggtcctgctgtggccgccgccgttcgcagccctggcttggacgtgcgccccgtggcacttgtattaaacggttctgacccacgctcactggtgctccagctgtgcgacctcctgagcggtctaagagtacatggtgtggtattcgaggacgattcaagggcacctgccgtggcccctatacttgattttctgagcgctcagacaagcctacctatagttgcggttcacggcggagctgccctcgttctgacaccaaaggaaaaagggtcaacatttttgcagttaggatcatcaactgaacagcagctgcaggttatatttgaagtgctggaggagtacgactggaccagcttcgtggctgtgaccacacgtgctccaggccaccgggcatttttgtcttacatcgaggtgttgaccgacggatccttagtgggctgggaacataggggggcccttacactcgaccctggcgctggcgaagcagtcctcagcgctcagttgaggtccgtttccgcccagatcagactgctgttctgtgccagggaggaggccgagcctgtatttagagccgcagaggaggccggtcttaccggcagcggctacgtgtggtttatggttggtccccagctagctggaggcggcggatctggagcgccaggggaacccccactgcttccagggggagccccactgccagctggacttttcgcggtcagatctgctggatggcgcgacgacctggcgagaagagtagccgccggagttgccgtagttgctcgcggtgcccaagccctgttgcgagactacggttttctccctgaactgggccacgattgcagggctcagaatcgaactcatcgcggcgaatctctccaccgatattttatgaacatcacctgggacaatcgggactacagctttaacgaggatgggttcctggtgaatccatctctcgtcgttatctcgctgacccgcgaccgaacctgggaagttgtgggatcatgggagcagcaaactctgagactgaaatatcccctgtggtcaaggtatggacggttcctccagcctgtggacgacacacaacacctgaccgttgccaccctggaagagaggccatttgtgatagttgagcccgctgatcctatctcagggacgtgcattagggatagtgtgccctgtcgatcccaactcaatcgaacacattctcctcccccagatgcaccaagaccagagaagaggtgttgtaaaggattttgcatcgatattctgaagcggctggcccacaccattggcttctcatacgacttatatttggttacaaacgggaaacatggaaaaaagatcgatggagtttggaacggaatgataggggaagtcttttaccaaagggctgatatggctatcggcagtttaactatcaacgaggagcggtcggaaatcgtcgatttttcagtgccttttgtcgagactggcattagcgtgatggtggcaaggtctaatgggacagtgtccccttccgcttttctagagccatacagtccagccgtttgggttatgatgtttgtaatgtgccttacagtcgtggcagtgacagtgttcatttttgagtacctttcacccgttgggtacaacagatctctcgccaccggaaaaagacctggcggctctacattcacaatcggaaaatcaatttggttgctttgggcccttgtattcaataatagcgtgcccgttgaaaacccccgaggtaccacatctaagatcatggtcctggtctgggcattcttcgcagtcatcttccttgcgtcatatactgcgaacctagctgcattcatgattcaagaagagtatgtggacactgttagcggcctgagtgatagaaaatttcagcgaccgcaggaacagtatccgcccttgaagttcggtacggtgccaaacggctccacagaaaagaatatacgtagcaactatccagacatgcattcgtacatggtgcgctacaatcagccgagggtggaggaggctttaacccagttgaaagccggaaagcttgacgctttcatctatgacgcggctgttctcaactatatggccagaaaagacgagggttgcaaactcgttactataggctctgggaaagtattcgctacaacaggttacgggattgcgctccataaaggatctcgctggaagagacctatcgacctggccctgctccagtttctgggtgatgacgagattgagatgctggagcgcctgtggctgagcgggatctgccacaacgataagattgaagtgatgtcctcaaagttggacatcgataatatggccggggtattctacatgctgctcgttgccatggggctttcactgctggtctttgcctgggagcatctcgtctattggagacttcgccactgtctgggaccaacccacagaatggattttctgctggccttttcaaggggaatgtatagttgctgttcagcggaggccgcccccccaccggccaaacccccccccccacctcaacccttgccatcaccagcttacccagctcccaggcccgcccccgggccggctccatttgtgccaagagaacgcgcaagcgtcgacaggtggcgacgtaccaagggagccgggccgccagggggggccgggctggccgacgggtttcatagatactacggcccaatcgagccacaaggactggggctgggcctgggggaggcccgggctgcccctaggggtgccgctgggcgtcctctatcaccgcccgccgcccagccgcctcagaaaccccccccttcttactttgcaatcgttcgggataaagaaccagcagaaccccccgccggcgctttccctgggttcccaagcccgcctgccccgcctgccgcggccgcgactgccgttggacctccactgtgcagactcgcctttgaggacgagtcaccccccgcccctgcaagatggcctaggagcgatcctgaatctcaacctctgttgggcccaggcgctggcggtgctggtggaacggggggagctgggggcggagcccctgctgcaccacctccatgtagggcagctccaccgccatgtccgtacctggatctagagccgagtccgtctgatagcgaagactcagaaagccttggcggagcttcactcggcggactggagccatggtggtttgcggacttcccgtacccgtatgccgagcgcctgggcccacctcctggtcgatactggagcgtggacaagctgggtggttggagggccggatcctgggattatttacctccgcgctcaggccccgccgcatggcactgtcgccactgcgcctcgttagagctgcttccacccccaaggcatctctcttgcagtcacgacgggcttgacggcggctggtgggcacctcctccaccgccatgggctgccgggcctttgccgcgtaggcgggccagatgtgggtgtccccggtcccaccctcacagacctagagcctcacataggacccccgctgccgctgccccacaccaccacagacatagaagagccgcggggggctgggacttaccacctccagcccctaccagtagatccttggaggatctctcttcgtgcccccgagcggctccagcacggcgccttactgggcccagtagacacgctcggaggtgtcctcacgccgcccactggggcccccccttgccaacagccagccaccgccgtcatagggggggcgatctgggcaccagaagaggcagcgcccactttagctctttggagtctgaggtttag

SEQ ID NO: 189373 - DNA, 1116 bp, Artificial Sequence
  Description of Artificial Sequence: Synthetic coding sequence
atgagccacgagaagagcttcctggtgagcggcgacaactacccccctcctaatcccggctatcccggtggacctcaaccccccatgcccccctatgctcagcctccatacccaggcgccccttacccacaacctccgtttcagccatctccctacggccagcccggttatccacacgggcccagcccttacccccagggcggttatccgcaaggcccgtatccacaaggcggctacccacagggcccctaccctcaggaaggatacccacagggcccctatccccagggtgggtacccacagggaccttatcctcaatccccttttccacccaacccttacggacagccccaagtctttcccggccaggacccagacagtccacagcacggaaactaccaggaagagggcccaccttcttactatgacaatcaggattttcctgctaccaactgggatgataaatcaatccgtcaggcttttatccggaaggtatttctagtgctcacactgcagctgtctgtcacactaagcaccgtgagcgtctttactttcgtggctgaagttaaaggcttcgtaagggagaacgtgtggacgtattacgtctcctatgccgtttttttcatctctttgatcgtgctttcttgttgtggtgacttccgaagaaaacacccctggaacctggtggcactgagtgtgcttactgctagcctgtcatacatggtcggaatgattgcaagtttctacaacaccgaagctgtgattatggcggtggggattaccacagccgtatgtttcacagtcgtcatcttttccatgcaaaccaggtacgacttcacctcctgcatgggcgtgctgctagtatccatggtcgtgctgtttatcttcgccatcctttgcatcttcattagaaacaggattctggagattgtatatgcctcactcggcgccttgctgttcacctgttttcttgcggtggacacacaactgctattgggtaataagcagctctcactgtctccagaggaatatgtctttgccgccctgaatctgtacacggatataattaacatattcctctacatcctcacaatcatcgggcgagctaaggagtag

SEQ ID NO: 189374 - DNA, 1116 bp, Artificial Sequence
  Description of Artificial Sequence: Synthetic coding sequence
atgagccacgagaagagcttcctggtgagcggcgacaactacccccctccaaaccctggctacccagggggcccccagccgcctatgcccccttacgcccaacccccgtatcctggagcaccttatccgcagcctccgtttcaaccctcaccctatggacagccgggataccctcacggacccagcccttatccgcagggcggctacccccaaggaccgtacccacagggcggatacccacagggaccttatccacaggaaggctaccctcaggggccttacccccagggtggataccctcaaggtccttaccctcaatctcccttcccgccaaacccctatggccagccccaggtatttccaggtcaagatcccgactcaccccaacatggcaattaccaggaagagggccccccttcctactacgacaaccaagacttccccgccaccaactgggacgacaaaagcataaggcaggccttcattagaaaagtgtttcttgtactcacattacagctgtcagtaactctatccacagtttctgtgtttacattcgtggcggaggtgaaaggtttcgtccgggaaaatgtttggacctactacgtctcgtatgccgtattctttatcagcttgatcgtgctcagttgctgtggggacttcaggagaaaacacccctggaatttggtggccctttcggtgcttacagcatccctgtcatatatggttggcatgatagcctctttttataatacagaagccgtcatcatggcagtgggaatcaccaccgctgtttgcttcaccgtggtcatatttagcatgcaaactcggtatgacttcacctcctgcatgggcgtgctgctggtcagtatggtcgtcctctttattttcgccattttatgcatctttattcgtaatcgcattctcgagatcgtctatgcaagcctcggtgcattactgtttacatgctttttagccgtagacacacagctcttgctgggtaacaaacagctctctctgtcaccagaggaatacgttttcgcagctcttaatctgtacaccgacattataaacatatttctgtatattctgacgatcatcggaagggcgaaggagtag

SEQ ID NO: 189375 - DNA, 825 bp, Artificial Sequence
  Description of Artificial Sequence: Synthetic coding sequence
atgagccacgagaagagcttcctggtgagcggcgacaactacccccctccaaatcccggatatcccgggggaccccagcccccaatgcctccttatgcccagcctccttatccaggagctccctaccctcagcccccatttcagccaagcccttatggccagccgggctaccctcacgggccttctccctatcctcagggcggctacccacaaggaccctacccgcaggggggctatccacaggggccgtatcctcaggaaggctacccacagggaccatacccgcaaggtgggtacccacaggggccttatccacagtcaccgtttcccccaaatccgtacggacagccacaggttttcccgggccaggatcctgattctccacagcatggcaattatcaggaggaaggcccaccgagttattacgataatcaagatttcccagcgactaattgggatgataaatccatcagacaggcattcataaggaaggtcttcctggtgctgacgctccagctgtccgttacattgtctacagtgtcagtcttcacctttgtcgctgaggtgaaaggatttgtacgggaaaacgtctggacttactacgtcagctacgctgtgttctttatttccctcatcgtgctatcttgctgcggtgatttccgccgaaaacacccctggaatctcgtagccctgtctgtcctaacggccagcctgtcctacatggtaggtatgatcgccagcttctataacacagaggcggtaattatggctgtgggtattacgacagccgtatgtttcactgtggtcatattctccatgcaatag

SEQ ID NO: 189376 - DNA, 306 bp, Artificial Sequence
  Description of Artificial Sequence: Synthetic coding sequence
atgagccacgagaagagcttcctggtgagcggcgacaactacccccccccaaaccccggctatcccggcgggccgcagcctcctatgcccccctacgcgcagcccccctatccgggcgccccgtatccccagcctccctttcagccctctccatacggacagccaggatatcctcatggtcctagtccttatccgcagggagggtacccccagggtccctacccacaaggggggtaccctcaagggccctatccccaggaaggatatccgcagggcccatatcctcaagggggttatcctcaatag

SEQ ID NO: 189377 - DNA, 1059 bp, Artificial Sequence
  Description of Artificial Sequence: Synthetic coding sequence
atgagccacgagaagagcttcctggtgagcggcgacaactacccccctccatacccgggagccccatatccacagcctccctttcaaccctccccctatggccaacctggatatcctcatgggccaagcccgtacccccagggtggatacccccaggggccttatcctcaggggggatacccccaagggccttatcctcaagagggctaccctcaagggccatacccacaaggcggctatcctcaaggcccataccctcagtcaccttttccacccaatccctatggccagccacaggtgtttcctggccaggatcctgattccccgcagcacggcaactaccaagaggagggtccaccatcctactatgataaccaggactttcccgcgacaaactgggatgacaagtccatccggcaggcctttatcaggaaggtgttcctcgtgctcaccctacagctctccgtaacactgtctacagtcagtgttttcacattcgtggccgaggtgaaagggttcgtgagggagaacgtgtggacttattatgtctcctatgctgtgttttttataagcctgatcgtgctttcttgctgtggcgactttagacggaaacacccttggaatctggtggctctgagcgtgctgaccgcctccctgagctatatggtcggtatgattgcatcattttacaacacagaggccgtgattatggcggtcggcatcactacggccgtgtgtttcaccgtggttattttcagcatgcaaaccagatacgactttacatcatgtatgggagtcctcttggtatccatggttgtcttgtttatcttcgcgatcctgtgcatcttcatacggaatcggatccttgagatcgtgtacgcctcactgggagcattgctgtttacctgcttcttggccgtggatacacagttgctattaggcaacaagcaactgtccctatcaccggaagaatacgtgttcgccgccctgaacctctatacagatattatcaatatttttctctatatcctcacaataatcggacgtgcaaaagaatag

SEQ ID NO: 189378 - DNA, 3348 bp, Artificial Sequence
  Description of Artificial Sequence: Synthetic coding sequence
atgcggcggctgagcctgtggtggctgctgagccgggtgtgcctgttgcttcctccaccgtgcgccctggtgctggctggggtccccagctcgtcctctcatccacagccttgccagattctgaaacggattggacacgcagtacgggtgggtgctgtacacctgcaaccttggactacggcgcccagagccgcgtcgcgtgcccccgatgatagtcgagctggcgcccagcgggatgagcctgagccggggaccagacgaagccccgctccctcacccggagcccgttggctgggatccacacttcatgggcgcggtcctcccggctctcgtaagcccggggaaggtgcacgcgccgaagccctgtggccaagagatgctttgttattcgcagttgataatctgaacagggtcgagggtttacttccatacaacttgagtcttgaagtcgtaatggcgatcgaagccggcctgggtgacctgccccttctcccattcagcagcccttcatcaccttggagctctgatccattttcattcctgcaaagcgtctgccacaccgttgtagtacagggagttagtgcactgctagcatttccgcaatcccaaggggagatgatggagctggacttggttagtctggttctccatatcccagtgataagcatagtacgccatgagtttcccagggagtcccagaaccccctccacctgcagctgtctctagagaatagcttgtcttcggacgcggacgtgacagtctctatactgacgatgaataattggtacaactttagtctgcttctgtgccaggaagattggaacataactgattttctcctattgactcaaaataatagcaagtttcatctgggatccattataaatatcactgcaaatttgccatccacacaggatttactcagtttccttcagattcaactggaaagcattaaaaactcaaccccgactgtcgtgatgtttgggtgtgacatggagtcgattaggaggatcttcgagattaccacacagttcggcgtgatgcctccagaattgcgctgggtgctgggcgactcacagaacgtggaagaactccggactgaggggctgccgctgggtctcatcgctcacgggaagactacacaatctgtgttcgagcattacgtccaagatgcaatggagctcgtcgccagggcagtcgcaaccgcaacaatgatccaacccgaacttgcactcattccttcgactatgaattgcatggaagtggagacaaccaacctaacaagcgggcagtacttaagccgattccttgccaataccacctttagagggctttctgggtcaattagagtaaaggggagtactattgtgagtagcgagaataacttctttatttggaatctacagcacgacccaatgggaaaaccgatgtggactagattggggtcgtggcagggcgggaagatcgtcatggactacggaatctggccggagcaggcccagcgtcataagacgcactttcagcacccttcaaagctgcatctcagagtggtcaccctgattgagcatcccttcgtgttcacccgggaagtggacgacgaggggctctgtccagccgggcagctctgccttgacccaatgacaaacgactcttccaccctcgacagcttgttttccagtttacacagctccaacgatactgttccgattaagtttaagaaatgctgctatggctattgtattgatctgctcgaaaagatcgcagaggacatgaactttgatttcgacctttacattgtgggggacgggaagtacggagcctggaaaaacgggcactggactggcctggtgggggatctgctcagagggactgcccatatggccgtgacttcattttcaattaatactgctcgcagccaggttatcgacttcaccagtcccttcttctcgacatctctcggtatcctggtacgcactagagatacagcagcacctatcggtgcattcatgtggccccttcactggaccatgtggctaggtatctttgtggcgctccatattaccgctgtgttcctgacgctttacgagtggaaatctccatttggactgacccccaaagggcggaataggtccaaagtcttctctttcagtagcgctctcaatatttgttacgccctcctcttcggtcgcacagttgccatcaaaccccctaagtgctggaccggtaggttcctgatgaacctttgggccattttctgcatgttttgcctctcaacctacaccgccaacttggccgctgtgatggtcggagagaagatatatgaagaactgagtggaattcacgaccccaagctgcaccacccctcacaggggttccgtttcggtactgtgcgggaatcaagtgccgaagactatgtgagacagtccttcccggagatgcatgagtacatgcgacgctacaatgttcctgctaccccggacggcgtggagtatcttaagaatgatccagagaagcttgacgcttttatcatggataaagccctgttggattatgaggtctccatcgacgccgactgtaagctcctgacagtgggaaaaccatttgctattgagggctatggaatcggcctgcccccgaactcccccctgaccgcaaacatttctgaattaattagtcaatacaaatctcatggcttcatggatatgctacacgataaatggtatcgggtggtcccttgtggtaagaggtcgttcgctgtcacggagacactgcaaatgggcatcaaacacttctcaggcctgttcgtgttgctgtgcataggcttcggactctctattctcacaacgatcggagagcatatcgtctaccgcctgctgctccctcgcattaagaataaatcaaagctccagtattggctgcacaccagtcagcgtctgcaccgtgccataaacaccagtttcatagaggaaaaacagcaacactttaaaacgaaacgggttgagaagcggagcaatgtggggccaaggcagctgaccgtgtggaacacctccaatctgtcacacgacaacaggaggaagtatatcttcagcgatgaggagggacaaaatcaactcggaatccggatccatcaggacatacctctgcctccccgcagacgggaactcccagctctcagaactaccaatggcaaagctgattcactgaacgtgtctcgcaacagcgtaatgcaggaactgagtgaactggagaaacagatccaagtgatcaggcaggaactgcagcttgctgtttcccgtaaaacagaactggaggagtatcagagaacctcacgtacatgcgaatcatag

SEQ ID NO: 189379 - DNA, 3585 bp, Artificial Sequence
  Description of Artificial Sequence: Synthetic coding sequence
atggtgggcctgctgctgttcttcttccccgccatcttcctggaggtttcacttctgcctcgcagtcctggccgaaaagtgctgctggctggagcgtctagccaacgctcagtagcgaggatggacggcgacgtgattatcggcgcgctcttctcggtccatcatcaaccacctgccgaaaaagttccagaacggaagtgtggggaaatacgcgaacagtacgggatacagagggtcgaggccatgtttcatacactcgacaaaattaatgcagacccagtgctgcttcctaacatcacacttggaagtgaaatcagggatagctgctggcatagttccgtggcccttgaacagagtattgaattcattagggattcacttatctccattcgcgatgagaaggatggtataaaccgctgtctacccgacggacaatctctcccacctggacgcaccaagaaacccattgccggagttatcggcccaggcagtagttctgtcgccattcaggtccagaatctgctccaactctttgacatccctcagatcgcctacagtgctaccagcatagacctgtccgacaaaacactgtacaagtattttctccgggtggtccctagcgataccctgcaggccagagctatgctggacatcgtcaaacgctacaactggacctatgtgtccgccgtccacactgagggcaattatggcgaatctggcatggacgcttttaaggaactcgctgcgcaggagggcttatgcatcgctcactccgataagatatattccaatgctggcgaaaagtcctttgaccgcctgctgcgtaaattgagggaaagactcccaaaggcccgtgtggtggtctgcttttgtgaaggtatgacagtgaggggcttgctctctgcaatgcgcaggctgggtgtagtcggagaattcagcttgatcggctcagatggttgggctgatcgggatgaggtaatagaaggatacgaggtggaagccaacggcgggatcactataaaactacagagtcccgaggttagaagcttcgatgactattttctgaagctgcggctcgacaccaatacacgcaatccgtggtttccagagttctggcagcacaggtttcaatgtaggcttcctggccacctccttgagaatccgaactttaagagaatttgcaccggaaatgagagcctcgaggaaaactacgtgcaagatagtaagatgggttttgtcataaacgccatctacgcaatggcccacggcttgcagaacatgcaccatgccttgtgccctggccatgtcgggctgtgcgatgctatgaagcctatcgacggatctaaactcctggatttcctgatcaagtcctctttcattggagtgagcggggaagaggtgtggttcgatgagaagggcgatgcgccaggacggtatgatatcatgaacctgcagtataccgaagctaatagatatgattacgtccatgtgggaacatggcacgagggcgtactaaacattgatgattacaaaattcagatgaataaatcaggcgtggtccgttcagtatgcagcgaaccttgcctgaaaggacagatcaaggtgatcaggaaaggagaagtcagttgctgctggatctgtacagcatgcaaggaaaacgagtatgtgcaagacgagttcacttgcaaggcgtgtgacctggggtggtggcccaatgccgatctcactgggtgcgagcctattccagttcgctacctggaatggtccaacatcgagtccataatcgccatagccttcagctgcctcggcatactcgtgaccctttttgtaacactgattttcgtgctctatagggacacgccagtggtgaagtcctcctccagagagctgtgttacattatactggctggcatattcctaggatatgtttgcccattcacactcatcgccaagccaactaccacctcttgttacctccagcgacttctcgttggcctgtcatcagcgatgtgttattctgctttagtgaccaagacaaacagaatcgccagaattctcgcgggaagtaagaaaaaaatttgtactcgcaaaccccgatttatgagcgcttgggctcaggtcattatcgcttctatcttgatcagcgtgcaactgaccttggttgtgacactgattatcatggaaccccccatgcccattctgagttatccctcgataaaagaggtgtacctgatttgcaatacctccaatcttggcgttgtcgctcctctggggtataatgggctactcatcatgtcctgcacttactacgcatttaaaacccggaacgtgcccgctaattttaacgaggctaaatacatcgccttcaccatgtacaccacctgcattatttggcttgccttcgtcccgatttatttcgggtccaactacaagatcatcaccacgtgcttcgcggtcagccttagcgtcaccgtagcattgggctgcatgttcacccccaaaatgtatattataatagctaaaccagaaagaaatgtccggtccgcctttaccacttctgacgtggtaaggatgcacgttggcgatggtaagctgccgtgcaggagcaacacttttttgaacatatttcgccggaagaaggcaggcgcaggaaacgcgaactcaaacggaaagagtgtttcctggagcgagcccggtggaggacaggtgcccaagggacagcatatgtggcacagactcagcgtccacgtgaagacaaacgagactgcatgcaatcagacagccgtgattaagccacttacgaaaagctatcagggaagtggaaaatcactgacattcagcgatacttcgacaaagacattatacaacgtggaggaggaagaagatgcacagcctatcaggttttcccccccgggaagtcctagtatggtcgttcatcggagagtccccagcgccgcaaccaccccgcctcttccgtcccatttgaccgcggaggaaaccccactgttccttgctgaacccgccttgcctaaggggcttcccccaccgctgcagcagcaacagcagcctccgccccagcagaaatccttaatggaccagctgcagggcgtggtgtctaacttctctacagcaattcccgacttccatgctgttttggccggacccggtgggccagggaatggactgcggagcctctaccctcccccaccacctcctcagcacctgcagatgctcccgctgcagctgtcaacatttggcgaagaactggtttccccccccgctgacgatgacgacgacagtgaaagatttaagctgctccaggaatatgtgtatgagcacgagagagagggaaatacggaggaagacgagctcgaagaggaggaggaggatctccaggccgcaagcaagctcactcccgatgattcacccgccttaacacctccatctcctttccgcgacagcgttgcctcagggagctccgtgccctcttcaccggtgtcagagtctgtcctatgtacaccgcctaatgtctcttacgcctcagttattctcagagactataaacaatccagctccactctttag

SEQ ID NO: 189380 - DNA, 3585 bp, Artificial Sequence
  Description of Artificial Sequence: Synthetic coding sequence
atggtgggcctgctgctgttcttcttccccgccatcttcctggaggtcagcctgctgcccagatctccaggaaggaaggttctgctggcaggcgcatcgagccaacgaagcgtggctcgaatggacggagacgttatcattggcgctttgttctcagtgcaccatcagccccccgccgaaaaagtgcccgaacgcaagtgcggggagatacgcgaacaatatgggatccagcgggttgaggcaatgtttcataccctggacaagatcaatgccgatccagttctgctgccgaacatcacgctgggatcagaaatacgggacagttgctggcatagctccgtcgccttggagcagtcgatcgagtttatcagggactcgctgattagtataagggatgagaaagacggcatcaatagatgcttgccggacggacagagcctgccccctgggcgcaccaagaaacctattgctggcgtcatcggcccgggctccagctctgtggccattcaggttcagaatctactccaactgttcgacatcccccagatcgcgtactcagctacatcaatagacctctctgataagactttgtacaaatacttccttcgggtggtaccaagcgacacactgcaagccagggccatgttggacatcgtgaaacgatataattggacctacgtcagtgctgtgcatacagaggggaattacggggagtccggcatggacgcatttaaagaactggctgctcaggagggcttatgtatcgcacattctgacaagatttactctaatgcaggcgaaaagtccttcgaccgattgctgcgtaagctaagagagagactgccgaaagccagggtggtggtgtgcttttgcgagggtatgactgtgagaggactgttaagcgctatgcggcggctgggtgtggtcggggagttctccctaataggatccgacggatgggcagatcgcgacgaagtgattgaggggtatgaagtcgaggcaaacggagggattaccattaagctgcagtcgccggaggtcagaagtttcgacgattatttcttgaagttgcggttagacaccaacactagaaacccatggtttcccgagttttggcagcatcgctttcagtgcagacttcccggtcacctgcttgaaaacccaaatttcaagaggatctgtaccgggaacgagtctctcgaggagaactacgtgcaggactcgaaaatgggctttgtgatcaatgccatctacgccatggcacacggcctacaaaatatgcaccacgctctctgccctggccacgtgggactctgcgatgcaatgaaacccatcgatggaagcaagctgttggattttcttattaagtcttccttcattggcgtctctggggaggaggtgtggtttgatgagaaaggcgatgcccccggaaggtacgatatcatgaatttgcaatacacagaagctaatcgctacgactacgtgcacgtgggaacttggcacgagggggtgttgaatatcgatgattataagatacaaatgaacaagagtggggtggtccgctctgtgtgtagcgaaccgtgcctgaagggtcagatcaaggtcatcagaaaaggagaggttagctgttgttggatttgtacggcatgtaaagaaaacgaatacgtacaggacgagttcacttgtaaagcctgtgacctcggctggtggccgaacgctgacctcactggctgcgagcccatcccagtccgctacctcgagtggtcgaacattgagtccattatcgccatcgccttctcctgtttaggcatcttggtgactcttttcgttacgttgatttttgtcttgtatcgagatacacccgtggtgaagagttcgagccgcgagctctgttacataattctggctggaatcttcctgggttatgtctgtccatttactttgatcgctaagccgactactacttcgtgctacctacagaggctgttggtcgggctttcatccgctatgtgctactccgccctggtaacaaaaacaaataggattgcccgcattttggctggcagcaagaaaaagatatgtacacggaaacctcgttttatgagcgcctgggcacaggttatcattgcatctatcctgatctcggttcagcttacactggtggtgaccttgattatcatggaacctcccatgcctatcctgagttaccctagcatcaaggaggtgtacttgatctgtaacacgtccaacctcggagttgtggcccctctgggatataatgggctgctgatcatgtcctgcacatattacgcatttaaaactcggaatgtgccagcaaactttaatgaggcaaagtacatagcgttcaccatgtacacaacttgtattatttggttagcttttgtcccaatctactttggctccaattataagattatcacgacctgttttgctgtgagcctgtcagttaccgttgccttgggttgtatgtttacgcctaagatgtacattatcatcgccaaaccagagcgaaatgtaaggtctgcattcaccacctccgatgtcgtgcggatgcacgtcggggacggaaagctgccatgtagaagcaacacatttctgaacatctttcgccgcaagaaagccggcgcagggaacgcaaattccaatgggaaatcagtgagctggagcgaacccggggggggccaggtgcccaagggccagcacatgtggcaccgtttgtcggtccacgtaaaaactaatgaaacggcgtgcaatcagaccgccgtgatcaagcctctcaccaagtcgtaccagggtagtggaaagtctctcacattcagtgacacctctactaaaacattatataatgtggaagaagaggaagatgctcagccgattcggttttctcctccaggttcaccctcaatggtggtgcatcggagggtgccatcggccgccactactccacccctgccctcacacctaaccgcagaagaaacacccctctttctggctgaaccagcactcccaaaggggcttccccctcccctgcagcaacagcaacagccgcccccccaacagaagagtctgatggaccagcttcaaggcgtcgtgtccaacttttccacggctatccctgacttccacgctgtgctcgccggcccgggggggccagggaacgggctgcggtctctctatccgccacctcccccaccccagcacctccaaatgctgcctctccagctttcaactttcggcgaggagttggtttctccaccggccgacgatgatgatgatagcgaacgattcaagctgctgcaggagtatgtgtatgagcacgagagagagggtaacaccgaagaggacgagcttgaagaggaagaggaagacttgcaggcggcctccaaactcacgcctgatgactcacctgcactgacaccaccctccccattccgggactctgtcgcaagtggctcaagcgtgccctcctcaccagtgagcgagagtgtactgtgtacgccaccgaatgtgtcatacgcttccgtgatacttcgagattacaagcaatcctccagcacattgtag

SEQ ID NO: 189381 - DNA, 2721 bp, Artificial Sequence
  Description of Artificial Sequence: Synthetic coding sequence
atggtgggcctgctgctgttcttcttccccgccatcttcctggaggtgagcctcctgccccgcagccccgggcgtaaagttcttctggctggtgcctcgagccagcgatcagtggcccgaatggatggggacgttatcatcggcgccctgttttccgtccatcaccagccccccgctgaaaaggttccagagcgcaagtgtggggaaatccgtgagcaatacggtattcaaagagtcgaagcaatgtttcacaccctggataaaatcaacgccgacccggtgttactccccaacatcacactcggctcagaaataagggattcctgctggcacagttccgttgctttggagcagagcattgaatttatcagggacagtctgatttctattagagatgaaaaggatgggatcaatagatgcctgcctgatggacagtccctgcccccaggacgcacaaaaaagcccatcgcaggagtgatagggcccggttcgagcagtgtggcaatccaagtccagaacctgctgcagttatttgatataccccaaatcgcatactccgcaacttccattgatctgtctgataagactctgtacaagtactttttgcgcgtcgttccgagcgacaccctgcaagcgcgagccatgctagacatcgtgaagcggtataattggacttacgtcagtgccgtgcacacagagggtaattacggcgagtctgggatggatgcctttaaggaactcgcagcccaggaaggtctgtgtatagcccactctgataagatctatagtaatgctggagaaaaatcattcgaccgccttctaagaaagcttcgcgaaaggctgcctaaggccagggtggtggtgtgtttttgcgaaggcatgactgtacggggcctgctgtccgccatgcgcagactcggtgttgtcggggaattctctctcattggatccgatggctgggccgatcgggacgaggtgatcgaagggtacgaagtggaagctaacggcggcatcactataaagctgcagtcccctgaagtccgcagctttgacgactattttttaaaactgcgcctagacactaacacaagaaacccatggtttccagagttctggcagcaccggttccagtgccgattgcccggacatttactggagaaccctaattttaaacgaatctgcaccggcaacgagagcttggaagagaattacgtccaagacagcaaaatgggcttcgtgattaacgcaatttacgcgatggcgcacgggctgcagaacatgcatcacgccctgtgcccagggcacgtgggactttgtgacgctatgaagcctatcgacggtagcaagctgctggatttcctgattaaatcatcttttatcggcgtgtctggagaagaggtatggttcgacgaaaagggagatgccccaggtcgatacgacattatgaaccttcagtacactgaggccaatagatacgattatgttcacgttggcacatggcacgaaggcgtgctgaacatcgacgactacaagatacagatgaataagagcggagtcgtgaggagcgtctgcagtgagccttgtctgaaggggcagattaaggtgatccgaaaaggggaagttagctgctgttggatctgcaccgcctgcaaagagaacgaatatgtacaagatgagttcacatgtaaagcatgtgatctcgggtggtggcctaatgccgatttaaccggctgtgagcctatccctgttaggtatctggaatggagcaatattgaatctattatcgctatcgcattcagttgcctgggcatcttagtcactctgttcgtgaccctgattttcgtactatatcgggacacacctgtggtcaagtccagctcacgggagctctgttatataattctcgctggcatatttctcggatacgtgtgcccctttacccttatcgcaaagcccaccaccacaagctgttatctgcagcgccttctggtcggcttaagttcagccatgtgttatagcgcactagtgaccaaaaccaataggatcgccaggattctagccggaagcaagaaaaagatctgtaccagaaaacctcggtttatgtctgcctgggctcaggttatcatcgcctccattctcatatccgttcagctgactctggttgttacactcattattatggagccccccatgccaatactttcataccccagtattaaggaggtctatcttatctgtaacacttcaaacctgggcgtagtcgctccactaggatacaatggtttgctgattatgtcttgtacctactatgcttttaagacacgtaatgtccccgctaactttaatgaggcgaaatacatcgccttcacaatgtacaccacttgtattatttggctcgctttcgttcccatttactttggaagtaattacaagatcatcactacatgttttgccgtcagtctcagtgtgacggtagctctaggttgcatgttcactccgaaaatgtatataattatagccaaacctgaacgtaatgttagatctgcttttacaacgtccgacgtggtacgcatgcacgtcggcgacgggaagctgccttgtcggtcgaatacattcttaaatatctttaggcgcaaaaaagccggagcggggaacgccaagaaacgtcagccggaattttctccgacctcgcagtgccccagtgctcacgtccagctgtag

SEQ ID NO: 189382 - DNA, 2721 bp, Artificial Sequence
  Description of Artificial Sequence: Synthetic coding sequence
atggtgggcctgctgctgttcttcttccccgccatcttcctggaggtcagcctgctcccaaggtcccctgggcggaaggtgttactggcgggggcctccagccagagatccgttgcccgcatggatggcgacgtgatcattggcgccctctttagtgtccaccaccagccacctgctgagaaagtccccgaaagaaagtgcggcgagattagggaacagtatggtattcagcgggtcgaggcaatgttccatacactagataaaataaatgctgatcccgtcctcttgcccaacataaccttgggctctgagattagggacagttgctggcattcgtctgtggctcttgaacaatcaattgagtttatccgagattccctcatcagtataagagacgaaaaagacgggataaatagatgcctccccgacggccagtcattaccccctgggcgaacaaaaaagccgatagccggagttataggacccgggagcagcagcgtggcgatccaagtgcagaacttgctgcagctgttcgatattccccagatcgcctacagcgcgacatctatcgacctgagcgacaaaactctgtataagtatttcctgcgcgtggtaccctctgacaccctgcaggctcgcgctatgctcgatatcgttaagcgatataactggacttacgtaagtgccgtgcacactgaggggaattacggtgagagcggcatggacgctttcaaggagctagcagctcaagaagggttgtgtatagctcattccgacaagatctacagtaatgccggcgaaaagtcttttgataggttgctgcgtaagcttcgcgagcgattgcctaaggctcgcgttgttgtctgtttctgcgaggggatgacggtgaggggcctgctgagcgccatgaggagactgggcgtggtgggcgaattctcgctgattggttccgatggctgggctgatagggatgaagttatagagggatatgaagtggaggctaatggtggaataacaatcaagttacagtcacctgaggtgcgttcctttgacgattatttccttaagcttcggctcgataccaatacacggaacccatggtttcccgagttttggcagcacagattccagtgccgactgcccgggcacttgctggagaacccgaacttcaagcgaatctgtactggtaacgagagtttggaagaaaactacgtgcaggactccaagatggggttcgtgatcaacgccatctatgccatggcacatggactccagaatatgcatcacgcactgtgcccagggcatgtgggactgtgcgacgccatgaaacctatcgacgggtctaagttgcttgattttctcattaaaagctcgtttattggtgtatccggtgaggaggtctggttcgatgaaaaaggcgatgctcccggaagatatgatattatgaatttgcagtacactgaagccaatcggtatgactacgtccacgtgggaacttggcacgagggtgtcttaaatatagacgattataagatacagatgaacaagagtggcgtcgttagaagcgtctgctctgagccgtgcctgaaaggccagatcaaagtgatcagaaagggtgaagtctcatgttgttggatctgcacagcctgcaaagaaaatgagtacgtgcaagacgagttcacatgcaaagcatgtgacttaggatggtggcccaatgctgacctcaccgggtgcgagcccattccggtgcgttacttagaatggtctaacattgagtctatcattgctatcgctttttcctgcctggggatcttagtgacactgttcgttactctgatcttcgtattgtacagggataccccagtggtaaaatccagttcaagagagctgtgttatattattctagcaggcatctttcttggctatgtgtgccctttcaccctcattgccaaacctaccactacgagttgttatctccaacggcttctggtgggactgtcttccgccatgtgctattcagcacttgtgacaaagactaaccgaattgcgcggatcctcgctggtagcaaaaaaaaaatatgtacaagaaagccccgcttcatgtcagcctgggcgcaggtgatcatagccagcatcttgatttctgttcagctcactctcgtggtaaccttaataataatggaacctcctatgcctattttgagttatccaagtattaaagaggtctacctgatctgtaacacgtccaacctgggagttgtggctcccttaggttataatggccttcttatcatgtcctgtacctactacgcattcaagactcgcaacgttccagccaatttcaatgaggcaaagtacattgcctttacaatgtacacgacctgcataatttggctcgcattcgtccctatctacttcggttcgaattacaaaatcattaccacatgtttcgcagttagccttagcgtgactgtcgctctgggttgcatgttcacgccaaagatgtacattatcatcgccaaaccggagcgcaacgtgcgctccgcttttacaacctccgacgtggtccgcatgcacgtgggtgatgggaagctgccttgccggagcaacacgttccttaacatattcaggaggaagaaggcaggagccggaaacgcgaagaaacgtcagcctgagtttagtcccacatcccaatgccctagcgcccatgtgcaattgtag

SEQ ID NO: 189383 - DNA, 2721 bp, Artificial Sequence
  Description of Artificial Sequence: Synthetic coding sequence
atggtgggcctgctgctgttcttcttccccgccatcttcctggaggtctcattactgccccggtcccccggccggaaggtgctcctcgccggggcatcctctcaaaggtctgtcgcccggatggacggcgatgtgatcattggcgctctatttagcgttcaccaccagccgccagccgaaaaggtacccgaacggaaatgcggcgaaattcgcgaacagtatggaatccagagggtagaggcgatgttccatactcttgataagatcaacgccgacccagtgctgctgcctaacatcacactcggttctgagatccgcgattcctgttggcattcctctgtggcactggagcagagcattgagtttatccgcgacagcctgatctctatcagggatgagaaagatggaatcaatcggtgtctgcctgacgggcaatcgttgccaccgggacgcaccaagaagccaattgccggtgtgatcggtcctggatcctcatcagttgcaatccaggttcaaaatctgttgcaactcttcgatatccctcaaattgcttacagtgccacatctatcgatctgagcgacaagaccctgtacaagtactttctccgggtggttccgagcgatacccttcaggccagagccatgctggacatcgttaaacggtataattggacatacgtatctgccgtgcatacagaaggcaactacggagagtctggcatggacgcgttcaaggagctagctgcccaggaagggctgtgcattgcacacagtgacaagatctactcgaatgccggggagaaatcattcgatcggctgctgcgcaagttgagggagcggctccctaaggcgagagtggtggtatgtttttgtgaaggcatgactgtgcggggcctgttgtcagctatgcgccggttgggggttgttggggaattcagtcttattggctccgatggttgggctgatagggacgaggtcatcgagggttatgaagtcgaggctaatgggggcatcacgatcaagctgcaaagcccagaggttcgctcattcgacgattatttcctgaaactccggttggacactaacacacgcaatccttggttcccggaattctggcagcacagatttcaatgtagattgccaggtcatctcctggaaaatcctaacttcaagcggatctgcaccggaaacgaaagcctggaagaaaattatgtgcaagattctaaaatgggatttgtgataaacgcgatctacgcgatggcccatggcctccagaacatgcaccacgctctgtgtccaggtcatgttggactctgtgatgcaatgaaacccatagatggctccaaactgcttgatttcttaattaagagctcctttattggagtctctggagaagaagtgtggtttgatgagaagggcgacgctcccggtagatatgacataatgaacttgcagtacactgaagccaatcgctacgattacgtgcacgttggaacgtggcacgagggggtccttaacatagatgattacaagatacagatgaataaatcgggagtcgtgcgctctgtttgctccgagccatgccttaaagggcagattaaagttatccggaaaggagaggttagctgctgctggatctgtaccgcatgtaaggagaatgaatacgtgcaggatgaatttacttgcaaggcgtgcgacctgggttggtggccaaatgccgatttgactggctgcgaaccgattccggtaagatacttagaatggtccaacatagagtccattattgcgatcgcgttctcttgtctcgggatccttgtaacactgttcgtgaccttgatcttcgtgctgtatagagacacaccagttgtgaaatcttccagcagggagctctgctacatcatattggctggcatcttccttggttatgtgtgccctttcaccctcatcgcaaaacctacaacaacatcctgttacctgcagcgtcttttggtgggcctttcatctgcgatgtgctacagcgccctcgtcaccaaaacaaacagaattgccaggattctggccggcagcaagaaaaaaatttgtaccagaaagccgcggttcatgtcagcctgggcccaagtaatcatcgcttcaattctcatcagcgtgcagttgacactggtagttacactgatcatcatggagcctccaatgcctatcttatcgtacccttcaattaaagaggtgtacctaatttgtaacactagtaacttgggggtggtcgcaccacttgggtataatggtctgctgatcatgtcatgtacatattacgcctttaagactagaaacgttccagctaacttcaatgaggccaaatacattgcctttacaatgtatacaacctgtattatttggctcgcattcgtgcccatctacttcgggagtaattacaaaattatcactacatgcttcgcagtgagcttgagtgtgaccgttgcactcgggtgtatgttcacacccaagatgtacattattattgccaagcctgaacgaaacgtgcggagtgctttcaccacatctgacgttgtgcggatgcatgtgggggacgggaagctgccctgcagatctaacacgttcctgaatatatttcgtcggaagaaggctggggcaggaaatgctaaaaagagacagcctgaattttcaccaactagccagtgcccttcggctcacgtgcagctgtag

SEQ ID NO: 189384 - DNA, 2619 bp, Artificial Sequence
  Description of Artificial Sequence: Synthetic coding sequence
atgggcagcctgctggccctgctggccctgctgctgctgtggggcgccgtcgctgaaggcccggccaagaaggtcctgacactcgagggcgacctcgttttagggggcctgttcccagtgcatcaaaagggaggccccgctgaggattgtggccccgtgaatgagcatcggggaattcagagactagaggcgatgttatttgctctggaccggatcaaccgagacccccacctgctgcccggcgtccgacttggggcccacatcctggatagctgcagcaaagacactcacgctctggagcaggcgctggattttgttagggccagcctgagcaggggagccgatggttcccggcacatatgccctgatggaagctatgctacacacggggatgctccgacagcaatcacaggcgtgattggtggatcttattctgatgtcagtatacaggtcgcgaacttgctgaggctattccaaatcccacagattagttacgctagcacatctgcaaaattgtcagacaaaagccgatacgactactttgctcgcaccgtgccacctgacttcttccaggctaaggctatggcagagatcctgcgctttttcaattggacgtatgtgagcactgtagcctctgagggagattacggagagaccgggatcgaagcctttgaactggaggctagagcacgcaacatctgcgtggcaacttctgagaaggttgggcgggctatgtcacgtgcagcgttcgaaggggtggtccgggcactgctgcagaaaccttctgcccgggttgccgtgctgttcactagatccgaggacgctcgtgaactgctggctgcttcgcagcgcctgaatgcgagctttacttgggtggcgtccgacggctggggagctcttgagagcgtcgtcgcaggttctgaaggggcggctgaaggtgctattacaattgaactggcctcctatcccatctcggactttgcctcgtactttcagtccctcgatccttggaataattcacgcaatccttggttccgcgagttttgggagcagcgttttcgctgctcattccgccagagggactgcgcagcccattcactgcgcgcggtcccctttgaacaggagtccaaaataatgtttgttgtcaacgcagtatatgccatggctcacgcactccacaatatgcaccgagccctgtgcccgaacactacacggttatgcgacgcaatgagaccggtgaatggcaggaggctttacaaagatttcgttctcaatgttaaatttgatgctccttttcggcctgccgacactcacaacgaagttcgctttgatcggtttggggacggaatcggccggtataatatattcacatatctcagagccgggagcggccgttataggtatcaaaaagtcgggtactgggccgagggcctcactctggatacatctctgatcccttgggctagcccaagcgcaggccctctgcccgccagtaggtgctcagaaccatgtctgcaaaatgaggtaaagtctgtccaacctggcgaagtgtgctgctggttatgtatcccttgccagccatatgagtataggctggatgagttcacatgtgcagactgcggattaggctattggccgaacgcctccctgacaggctgctttgagctaccacaggaatatattcgttggggtgatgcatgggccgtgggcccggtcaccatcgcctgtctgggggcactcgccaccctgttcgtgcttggtgtgttcgtccgccataacgcgaccccggttgtgaaagcctccgggcgagaactgtgttacatcctgctcggcggagttttcctctgttactgtatgacattcatattcatagccaagcccagtaccgcggtgtgtaccctccggcgtctcggtctggggaccgcgttttccgtgtgctatagcgccctcttgacaaagaccaatcggattgcccgcatattcggcggcgctagagaaggagcccagcggccccgatttatctcacccgcttcccaggtggccatctgtctggcccttatctcaggacagctcctgatcgtagtggcttggctggtcgttgaggcaccgggcacgggcaaggagacagcccccgaaaggcgcgaagtggttacactccgatgtaatcacagggatgcttccatgctgggctccctagcttacaacgttctcctgattgccctttgcactctgtatgccttcaaaactcgcaagtgccctgaaaatttcaatgaggctaaattcattggatttactatgtacacgacgtgtatcatttggctcgcgtttttgccaatcttttatgtgacttcctcagattatagagtgcagaccacaaccatgtgcgtttctgtgtctctttctggatctgtggttttgggctgcctgttcgccccaaaattgcacattatcctgttccaaccgcaaaagaacgttgtgagccacagagctcccacatcacggttcggctctgccgccgctcgtgcgtcatcgtcgttaggccaagggagtggttcacaattcgtgcccactgtgtgtaatggccgagaggtagtagattcgacaacaagttccctgtag

SEQ ID NO: 189385 - DNA, 213 bp, Artificial Sequence
  Description of Artificial Sequence: Synthetic coding sequence
atgggcagcctgctggccctgctggccctgctgctgctgtggggcgctgttgcagaagggccggctaaaaaagtgctcaccttggagggcgacctggtgttgggtgggcttttccccgtgcaccaaaaaggcgggccagctgaagattgcggacccgttaacgaacaccgcggcatacaacgacttgaagcgatgctgttcgctctggattag

SEQ ID NO: 189386 - DNA, 2640 bp, Artificial Sequence
  Description of Artificial Sequence: Synthetic coding sequence
atgaagatgctgacccggctgcaggtgctgaccctggccctgttcagtaaaggcttcctgctctccttgggggaccacaacttcttgaggagggagattaagattgagggtgacctagtgctggggggactattccccatcaatgaaaaggggactggtactgaagagtgcggccggatcaacgaggaccgaggaatacagaggctcgaggcgatgctcttcgccattgacgaaattaacaaggacgattacctgttgcccggggtgaaactgggcgtacacattctggacacttgttccagagacacgtacgccctcgagcaaagtctggaattcgtgcgcgcatcactgaccaaagtagatgaggcagaatacatgtgtccggacggtagttacgccatccaggagaatatacccctgttgatcgcgggagttatcggcgggtcttactccagcgtcagtattcaggtggcaaatctcctccgcctgtttcaaattccccaaatctcttatgcctcaacatccgccaaactctctgacaagtcacggtatgactacttcgcacgcacagtgcctcccgacttctaccaagccaaagcaatggccgaaatcctgagatttttcaattggacctatgttagtaccgtcgcctcggaaggagattatggggagacaggtatagaggcgtttgagcaggaagcacggctcagaaatatatgcatcgcaaccgcagaaaaagtggggcgatctaatattcgaaaaagctatgacagcgtgatcagagagctcctacagaagcctaatgcccgcgtggtggtgttattcatgaggagcgacgacagccgggagcttattgcggcagcctcgcgtgccaatgccagttttacatgggtggctagcgacggctggggggcgcaggagtcaataatcaaaggttccgagcacgtggcctatggggcaatcacattagagttggcatctcagccagtgcgacagtttgacaggtattttcagtccctcaatccatacaataatcaccgaaatccctggtttcgcgatttttgggaacagaaattccagtgttctctacagaacaagcgtaatcacagaagggtttgtgacaaacacctggccatcgactctagtaattacgagcaggagagcaaaattatgtttgttgtgaacgccgtgtatgccatggcgcatgctctacacaagatgcagcgaacactatgccccaacactacgaagctgtgcgatgcaatgaaaattctggacggaaagaagctgtataaagactatttattaaagatcaattttaccgcccccttcaaccccaacaaggacgcagattcaattgtaaaatttgatacatttggggacggcatgggaaggtataatgtgtttaatttccaaaatgtgggaggtaagtactcgtaccttaaggtcggccattgggctgagaccctgtctctcgacgtcaacagtattcattggtctcgcaatagtgtgccaacaagccagtgttctgacccttgcgcccctaacgagatgaagaacatgcaacccggggacgtgtgctgctggatatgtattccatgcgaaccctatgaatacctggctgatgagtttacatgtatggactgtgggtccggtcagtggcccactgcagacctcaccggctgttatgatctgcccgaggattacatccggtgggaggacgcttgggccatcgggcccgtgactatagcttgtcttggattcatgtgcacttgtatggtggtgacagtattcatcaagcacaacaacacccccctggtgaaggcttccgggagagagctttgctacattcttctctttggcgttggcttgtcctattgcatgacgttttttttcattgctaagccttcacctgttatatgcgctcttcgtagactcgggttggggtcatctttcgcaatctgttactccgctctactgactaaaacgaactgcatcgctaggatttttgacggggtcaaaaatggcgcacaaaggcccaagtttatctcccccagtagccaggtgttcatctgcctggggctcattctggtgcagatcgtcatggtgtccgtctggctaattctggaggccccgggaacccgccggtatactctcgccgagaaacgcgaaacagttatcctaaaatgcaacgttaaagactcatcaatgctcattagcctcacctatgacgtgatcttggtgatattgtgcacagtgtacgcattcaaaactcggaaatgcccagaaaatttcaacgaagccaaatttatcggcttcacaatgtatactacatgcataatatggctcgcatttttgcctatattctacgtcaccagctccgattatcgggttcagaccactaccatgtgcatcagtgtatctctctctgggttcgttgtcttgggatgcctgtttgccccaaaagtgcatatcatcctgttccagccccaaaagaacgtcgtgacgcacaggctccaccttaataggttttccgtcagcggcacaggcacaacatacagccaatcttcggcttctacttacgtaccaactgtctgtaacggaagagaggtcctggacagtactaccagtagcctgtag

SEQ ID NO: 189387 - DNA, 1608 bp, Artificial Sequence
  Description of Artificial Sequence: Synthetic coding sequence
atgctgacccggctgcaggtgctgaccctggccctgttcagcaagggttttctgctgtccctgggcgatcataacttcctgcgtagagaaatcaagatcgagggagatctggtattaggtggactatttcctatcaatgagaagggcacaggtaccgaggagtgtggaagaatcaatgaggataggggtatccagcgactcgaagccatgttgttcgcaattgatgaaattaataaggacgattatctcctccccggcgtgaaactgggagtgcatattctggacacgtgcagcagagatacgtacgccttagaacagtccctggaatttgtccgggcatcattgacaaaagtggatgaagccgagtatatgtgccctgacggtagctacgcaattcaggagaatatccctctgctaatcgcgggagtcatcggaggaagctatagcagcgtgtcaattcaggtggctaaccttctccgtcttttccagatcccccaaatttcctacgcgagcacttctgcaaaactgtctgacaagtctaggtatgactacttcgcaaggactgtaccccccgatttctaccaagcaaaagctatggccgagatccttaggttcttcaattggacctacgtctctactgtggcttccgaaggcgactatggtgagacaggtattgaggcctttgaacaggaggcacgtcttcgaaatatttgtattgctactgcagagaaggtgggccgtagcaatatccgaaagtcttacgacagtgttatccgtgagttattgcagaaaccgaatgctagggtcgtcgtgttgtttatgaggtcagatgattcccgcgagctgatcgccgctgctagcagagctaacgcctccttcacatgggtggccagcgatggctggggcgcccaagagtctatcataaaagggtcagagcacgtggcctacggtgccatcacccttgagctggctagtcagcctgtgagacagtttgacaggtacttccagtcgctgaacccctacaataatcatagaaatccctggttcagagatttctgggagcagaagttccagtgctcattgcaaaacaaaaggaaccatagaagagtctgcgacaaacacctggccatagactcctctaattatgagcaggaaagtaaaattatgtttgtcgtgaatgctgtgtatgccatggctcacgccctgcacaagatgcagaggaccctttgtcctaacactaccaagctctgtgatgcaatgaaaatattagatggaaagaaactctacaaggattacttgctgaaaatcaatttcaccggggccgatgataatcacgttcacctgtgccagcctgagtggctgtgcggtctgggcttgtttgtctgtacccaggggagtcaccatcctgtctcaacacccgaggagtgctgccacactcaaacggccccgcagcaagtacagtgccagtggaattgggaccatatcctgagtgtcttgtgtaaacacgtctgtgcaaacggtgttcagtgggcaggcagtccgaggctgcaccacctgattagcgtcatcgtgaactgtagttccgtgctagtgttcctggactgttag

SEQ ID NO: 189388 - DNA, 264 bp, Artificial Sequence
  Description of Artificial Sequence: Synthetic coding sequence
atgaagatgctgacccggctgcaggtgctgaccctggccctgttctctaaggggttcctgctgtccctaggagatcataactttcttaggcgggaaattaagatcgaaggcgacctggtgcttggaggcctgttcccaatcaacgaaaaggggactggtactgaggaatgtggccgtatcaatgaagatcgcggcattcagcgcctggaggcgatgttgtttgcgatcgatgagataaataaggacgattatttgctgccttag

SEQ ID NO: 189389 - DNA, 1614 bp, Artificial Sequence
  Description of Artificial Sequence: Synthetic coding sequence
atgaagatgctgacccggctgcaggtgctgaccctggccctgttctccaaaggattccttctgtccctgggtgaccacaacttcctccggcgcgaaatcaaaatcgaaggggacctagtgctgggaggattgtttcccatcaatgagaagggcaccgggaccgaggaatgtggccgcatcaatgaagatcgggggatccagcgcttggaggctatgctgtttgcgatcgatgagattaataaggacgactacttattacccggcgtgaagttaggagtgcacatcctcgatacttgctcccgtgatacttatgccctggaacaatccctggaattcgtgcgtgcgagcctgacaaaagtagatgaggcggagtatatgtgtcctgatggttcttacgccatacaggaaaacatccccctcctaattgctggcgtcattggagggagttacagttcagtgtctatccaggtggctaatttacttcgactgtttcagatccctcagatctcttacgcctctacatcggcgaaactatccgataagagccgttatgactacttcgccaggaccgtgccacctgacttttaccaagccaaagcaatggccgagatccttaggtttttcaactggacctatgtgagtacagtggctagcgaaggcgattatggggagacagggattgaggctttcgagcaggaagcccgcctgcggaacatctgcatcgccactgctgagaaggtggggagatctaacatcagaaagtcctatgactcggttatcagagaactcttgcaaaagccaaacgctcgagtggtggtgctcttcatgcgtagcgacgacagtagagaactgatagcagccgcgtcgagggcaaacgcctcctttacatgggttgcatcagacggttggggggcccaggagagtattatcaaagggtccgagcatgtagcctatggggccataaccctcgagctcgccagccaacctgtacgacagttcgatcgctattttcagtccttgaacccctataataaccatcgaaacccgtggttcagggatttttgggagcagaagtttcaatgttcgctgcagaataaaaggaaccaccgccgtgtttgcgataagcatctcgccatcgattcttcaaattacgagcaagagtccaagataatgtttgtcgtgaatgcagtatatgccatggcacatgccctgcacaaaatgcagagaaccttgtgtcctaacaccactaaactgtgcgacgctatgaaaattctcgatggtaagaagctgtacaaggattatctactgaaaattaacttcaccggcgccgacgataaccacgtgcatttgtgccaacccgaatggctctgtggcctcggactctttgtatgcacccaaggctctcaccatcctgtctccacgccagaggagtgctgtcacacacagaccgccccccagcaggtacagtgccaatggaattgggatcatatcctgtccgtgctgtgcaagcacgtgtgcgcaaacggggtccaatgggccggatcccctagactccaccacctaataagcgtgattgtcaattgctccagcgtgctcgtctttctggactgttag

SEQ ID NO: 189390 - DNA, 246 bp, Artificial Sequence
  Description of Artificial Sequence: Synthetic coding sequence
atgaagatgctgacccggctgcaggtgctgaccctggccctgttcagcaaaggatttctcctgtcactgggggatcacaactttctccgccgagagattaagatcgagggtgatttagtgctgggaggactcttcccaatcaatgaaaaaggcaccggcacagaagagtgtggcaggatcaacgaggatagaggcattcagcgactggaggccatgctttttgcaatcgacgagatcaacaagtag

SEQ ID NO: 189391 - DNA, 2256 bp, Artificial Sequence
  Description of Artificial Sequence: Synthetic coding sequence
atgagccagagccccggcgccggcagccccccccccctgccccccagatctgcccctgtaccagcacggagctgtaggtgcgaggtggccaacctcttacgcctgtttcagattccccagatttcttatgcttctacttctgccaagctgagcgacaaaagccggtacgactatttcgcacgcacagtgccccccgacttttaccaggccaaagccatggccgagatcctgcggttttttaactggacgtacgtgtctaccgttgcatcggaaggggactatggagaaactggaatcgaagcctttgagcaggaggcccgcttgcgcaatatctgcattgcaactgcggaaaaggtggggcggtcaaacattagaaagtcttacgacagtgttattagggaactgttgcaaaaacctaacgcaagagtcgtggtcctgtttatgaggtccgatgattcaagggagctcatcgctgccgctagccgggcaaatgcttcttttacctgggtcgcctcagatggctggggggctcaggagagcatcataaaaggttccgaacacgtagcatatggagctatcacattggagttagcctcacagcctgttagacagttcgatagatacttccagagtctgaacccatataacaaccaccggaatccttggtttcgggatttttgggagcagaaattccagtgttcactgcagaataagcggaatcacagacgagtctgtgataaacatttggccatcgattcttctaactacgagcaggagtcaaagattatgttcgtggtcaacgctgtgtatgcaatggcacatgccttgcataagatgcagaggaccctctgcccaaatactaccaagctctgtgatgcaatgaaaatcctcgacgggaagaagctgtacaaagactatctgttgaagataaactttacagctccttttaatccgaacaaagacgccgatagcatagtcaaattcgacacattcggagacggaatgggacgctacaatgtcttcaatttccagaatgtcggagggaagtattcctaccttaaagtcgggcactgggccgagacgctgagtcttgatgtgaattccatccactggtcacggaactccgtgccaacttcccagtgctccgatccctgtgccccgaatgagatgaaaaacatgcagcccggggacgtctgctgttggatatgtatcccttgcgagccatatgagtacttagccgatgaatttacctgtatggactgcggttcaggccagtggccaactgcagatttgacaggctgttacgatctgcccgaggactatattcgctgggaggatgcctgggccatcggcccagtaactatcgcttgcctggggtttatgtgcacctgtatggtggttacggtgtttatcaagcacaacaacacacccctggtcaaagcttctgggcgggaattatgctacattctgctgttcggtgtgggcctctcatactgcatgacatttttcttcatagccaagccctctccagtgatctgcgcgcttagacgattgggcctcgggtcctcgttcgctatttgttattcggccctgttgaccaaaacaaattgtatcgcaagaatcttcgatggcgtcaagaacggagctcagcgtcctaaatttatcagcccatcatctcaggtcttcatatgccttggccttatcttagtgcaaatcgtcatggtgtctgtgtggcttatcctggaagctccagggaccagacgatataccttggccgagaagcgcgagaccgtgatactgaagtgtaacgtaaaagacagctccatgctcatcagccttacttatgatgtcattctggtgattttatgcaccgtttacgcattcaaaacaaggaagtgccctgaaaatttcaacgaggctaagttcattggattcaccatgtacacaacatgtatcatttggttggctttcctccccattttctatgtaacctcatccgattatagagtacagactacaacaatgtgtatcagcgttagcctgagcggcttcgtcgtcctaggatgcctgtttgcaccgaaagttcacatcatccttttccagccccagaagaatgtggtaacccaccgactgcacttaaacaggttttccgtttcaggcacaggaacgacttatagtcaaagttcagcaagcacatatgttcctactgtctgcaacgggcgggaagtcctggattctactacttcctctttgtag

SEQ ID NO: 189392 - DNA, 1416 bp, Artificial Sequence
  Description of Artificial Sequence: Synthetic coding sequence
atgcggcggaccaaccacgagcccgagcccggctgccggctgaccgcagccgccgccaccgccgtgtcttccagtagttgtcaggagctctccgtgcgtgcacctttcaacccaaataaagacgcagatagtatagtcaaattcgacacctttggagatggcatgggtcgctataacgttttcaactttcaaaacgttggcgggaagtactcatatctgaaagtcggtcactgggcggagaccctcagtctggatgtaaacagcatccactggtctagaaatagcgtcccaacaagccaatgttccgacccttgcgcacccaacgaaatgaaaaatatgcagcccggcgacgtttgctgttggatctgcatcccctgtgagccatatgaatatttagctgacgaatttacctgcatggattgcggctctggccagtggcctacggctgacttgaccggctgctacgatctccccgaagattatatccggtgggaagatgcctgggccattggccccgtcactatcgcctgcctgggatttatgtgtacttgcatggttgtgaccgtgttcatcaaacataataacactcctctggtgaaggcttccggccgtgagctctgctatatcctcctgtttggggttgggttgtcttactgcatgacattctttttcatcgctaaaccctcgcctgtaatttgcgctctccgaaggctcggtctcgggtccagctttgcaatatgttattcagccctgcttactaagactaactgcatcgctcggatctttgatggggtgaaaaacggggctcagagacccaagtttatatctccaagttcgcaggtcttcatatgcctgggtctgattcttgtgcagattgttatggtatctgtatggctcatccttgaggcccccggcaccagacggtataccctggcagaaaaacgagagacggtgatacttaaatgtaacgttaaggactcgtctatgctcatcagcttaacctatgacgtcatcctcgtgattctgtgtacagtttacgccttcaagactcggaaatgccctgaaaattttaacgaggctaagtttatcggattcaccatgtatacaacatgtatcatctggctagcttttctacctattttttatgtgaccagtagtgactacagggtgcagactaccaccatgtgtatctctgtgtcactgagtggatttgtggtgctgggatgtctgttcgcgcccaaggtgcacatcatcctgttccagcctcaaaaaaacgtggtgactcatcgactgcacttgaaccgtttttctgtgagcggtaccggtacaacctatagccaaagcagtgcgagcacatatgtcccaacagtttgcaatggtcgggaagtgctggattcaactaccagttccctgtag

SEQ ID NO: 189393 - DNA, 2391 bp, Artificial Sequence
  Description of Artificial Sequence: Synthetic coding sequence
atgcccgcctgggagcccggcgtggccgccagctgcggctggcgggcacctccctgcagtcccctgcggctgtgcatcgccccccacccatgcacccctccttcctcccaccaagggaacttaacatgccggctgccaccccgatcattcgggttctgtcgatgtgtgtgggtacggactagggggccaagcctgcccggtgagcaggtctctttggcggctcatgagtccgagggcgctgccgcccagttaggcagcagccctgagattgatcctcggagaccccggtgtctgttgccggaatctgcccagattccacagatctcctatgcctcgacggcccctgatttgtccgacaatagccgttacgactttttttcccgagtcgtcccttctgacacgtaccaagcccaggcaatggttgacatcgtgagggccctgaaatggaattatgtgagcacagtagcgtccgagggctcttacggcgagagcggcgtggaggcttttatacagaagtccagggaagacgggggcgtgtgcattgcccagtctgtgaaaatcccaagagaaccaaaagccggggagttcgataagatcatccggaggctgctggaaactagcaacgcgcgtgcagttattatcttcgccaacgaggacgatatccggagagtcctggaggcagcacgccgcgctaaccaaaccggtcattttttttggatgggatccgattcatggggctccaagattgcccccgtgctgcatttggaggaagtggcagagggcgccgtgactattttgccgaagcggatgtcggtaagagatcgtgaacgcatcgggcaggattccgcatacgaacaggagggaaaggtccaatttgtgattgatgccgtgtacgccatgggacatgcactacacgccatgcatagagatctgtgcccgggacgcgtgggcctatgcccccgcatggaccccgttgatggcacacaacttctgaagtatatccgtaacgttaattttagtggaatagccggcaaccctgtaactttcaatgaaaacggcgatgctcccggcaggtacgacatctaccagtaccaactcagaaacgacagtgcagaatacaaagtcataggctcgtggacagaccatttacatctgcggatcgaacgaatgcactggcccgggagcgggcagcagctaccacgatcaatatgttccctcccatgccagcctggagagagaaagaagaccgtcaaaggaatgccatgttgctggcattgtgagccctgtactggctatcagtatcaggtggatagatacacttgcaaaacatgcccatatgatatgcggccgacggagaacagaacaggctgtagaccaataccaattatcaagctggagtggggttctccatgggcagttctgcccctgttcctggccgtcgtgggcatcgccgccaccctgtttgttgttatcactttcgtgcgttacaatgatacgccaatcgtgaaggcctctggcagagaactaagctatgttttgctcgccggcatctttctttgctacgccacaacttttctcatgatcgccgagccagacctgggtacctgctccctgaggcgaattttcctggggctcgggatgtctataagttacgccgctctgctgacaaaaactaatcggatttaccggatttttgaacaaggcaagagaagcgtatctgcgccgaggtttatctcgccagcaagtcagttagctataacatttagcctgatctcgctgcagctgttgggcatctgcgtgtggttcgttgtggaccccagccattccgtagtggactttcaggatcagagaaccctggaccccagatttgccagaggggtgctcaagtgcgatatctcagatcttagtttaatctgtctgttgggctactctatgctcctcatggtaacatgcactgtctatgcaattaagacccgaggggtccctgagacgttcaacgaagcaaagcctattgggttcaccatgtatacgacctgcattgtctggcttgcttttatcccaatcttctttgggactagccaatctgcagacaagttgtatatccagacaacaactctaacggtaagcgtgtcactgagcgcctctgtgagtttgggcatgctgtatatgccaaaggtctatattattttgttccacccagagcaaaatgtgcccaaacggaaacgcagccttaaagctgtggtcacagccgcaactatgagtaacaagttcacccagaagggaaactttcgccctaatggagaagccaaatctgaactctgcgagaatctagaggcgcctgcacttgcgacgaagcaaacttacgtgacgtacactaatcatgctatctag

SEQ ID NO: 189394 - DNA, 2739 bp, Artificial Sequence
  Description of Artificial Sequence: Synthetic coding sequence
atgcccggcaagcggggcctgggctggtggtgggcccggctgcccctgtgcctgttgctttccctctacggcccttggatgccctcctcattaggtaaaccaaaaggccatcctcatatgaacagtatcagaatcgatggcgacatcactcttggcgggctgttccctgtccatggccggggatccgaaggtaagccttgcggcgagcttaagaaagagaaaggaattcatcggctagaggctatgttattcgccctggaccgaatcaacaacgaccccgacctcctccctaatatcacactgggggcccgaatcctggatacttgctctcgggacacccacgctttggagcagtctctaaccttcgtgcaagcgctgatcgaaaaagacgggaccgaggtacgctgcgggtctggtgggccgccaataattactaaaccagaaagggtggtcggtgtgattggggcctctggaagctcagtttcaatcatggtggcgaacatcctcagactctttaaaatcccccagatttcatacgcgagtactgcaccggacctgtctgataacagccgatacgactttttcagccgtgttgtgccatctgacacttaccaagcccaggccatggttgatattgtgagggccctgaaatggaactatgtttccacggtagcttcagagggttcatacggtgagagtggagtcgaggcctttatacagaagagccgggaggatggcggggtgtgcatcgcccaatccgtgaaaattccgagagagcctaaagctggcgagtttgacaaaattatccggagactgctggagacaagtaatgccagggccgtcatcatttttgcgaatgaagacgatatcaggcgcgtgttagaggccgctaggcgcgctaatcagacagggcacttcttctggatgggctctgattcatgggggtccaaaatcgctcccgtactgcatctggaagaagtggctgagggcgcagtgaccatcctcccgaaacgcatgtccgtacgtggttttgaccggtacttttcgagtcgcacccttgataacaaccgacgcaacatatggttcgccgagttctgggaagacaacttccattgcaagctgtccaggcatgccctcaagaaagggagccatgtgaagaagtgcacaaacagagagaggataggacaggattccgcatatgagcaggagggaaaggttcagttcgtgatcgacgctgtgtatgccatggggcacgcacttcacgcaatgcatcgagatctctgccccggtagggtggggctgtgcccgcggatggacccagttgacggtacccagctgctgaagtatatcaggaacgtgaacttctcagggatcgcaggaaatccagtgactttcaatgaaaatggcgatgcacctggccggtacgacatttaccagtatcagttgagaaatgacagtgccgagtacaaagtaattggctcgtggaccgatcacctacacctccggatagagcggatgcactggcctgggagtggccagcaattgcctcgatcgatctgctcactgccctgccagcctggcgagaggaagaaaacagtgaaagggatgccatgctgctggcactgcgagccatgtactggataccagtaccaggtagacaggtacacttgcaaaacttgtccctacgatatgcggccaactgaaaacagaactggctgcaggcccatcccaattatcaagttagagtggggcagcccctgggctgtcttgcctcttttcctggccgtggtgggcatcgccgcaaccttgtttgttgtcatcactttcgtacgttacaatgacacccccattgtaaaggctagtggacgcgagctttcttatgttctcttagcagggatctttctgtgctacgccacgacattcctcatgatcgcagagcccgacttggggacctgctcactaaggaggatctttttgggcctaggcatgtctatttcatatgctgcactgctgaccaagacaaaccgcatctaccgtatcttcgagcaaggtaaacgcagcgtaagcgcacctcgattcataagtcccgctagtcaattggctattaccttctccctcatctcgctgcagctcctggggatttgtgtttggttcgtggtggacccatcccactcagtggtcgactttcaggaccagcggacactggatccgagattcgcacgaggagtgctcaagtgcgatatttctgacctgtcgttgatttgcctgctaggctactctatgctcctgatggttacctgcactgtatatgcaataaaaacaaggggtgtgccggagacctttaacgaggccaagccaatcggctttacaatgtatacaacttgcatcgtgtggcttgcctttattcctatttttttcggcacctcacagtccgcagataaactctacatccagaccaccacgttgaccgtgtccgtcagcttgtctgccagcgtctcactaggcatgctttacatgcctaaggtgtacattattcttttccatcccgagcagaacgttcctaagcggaagcgaagtctcaaagctgtggtgacagcagccacgatgtcaaacaaattcactcagaaaggtaattttcggccaaatggggaggcaaaatcagagctgtgcgaaaacctagaagccccagcactggcgaccaaacagacttatgtgacctacaccaatcacgccatctag

SEQ ID NO: 189395 - DNA, 2319 bp, Artificial Sequence
  Description of Artificial Sequence: Synthetic coding sequence
atggtgcagaccctgcccaagctgttcccccacgacggcgccaagagaaaaaagcgaacgctgagaacctcagggccatgcttcgggggcgggggccagatcccacagataagctatgccagcacggccccagatttgtctgacaatagtcgatatgatttttttagtagagtggtccccagcgatacgtatcaggctcaggctatggtcgatattgtgagggccctgaagtggaactacgtctcaaccgtggccagcgagggctcatatggggaatccggggtcgaagcctttattcagaagtcgcgggaagatggaggggtgtgcatcgctcaaagcgtgaaaatcccccgggagcctaaggcgggggaattcgataagattatcaggcgacttctcgaaaccagcaacgctcgggctgttattattttcgctaacgaagacgacatacgccgtgtcttggaggccgcccggcgggccaatcaaacaggccattttttctggatggggtccgactcctggggaagcaagattgcacctgtcctccacctcgaggaggtcgctgagggggccgtgacaatacttcccaaacggatgtcggtgcgcggttttgatcgatacttcagctctaggacactcgataacaaccgccgaaatatttggtttgccgaattctgggaggacaactttcactgcaagctctctcgtcacgcactcaaaaaggggagccatgtgaaaaaatgcactaaccgcgagagaataggtcaggactctgcctatgaacaagagggcaaggtccaattcgtaatcgatgccgtttatgcgatgggtcacgcccttcatgctatgcacagagacctctgccctggccgcgtgggcctgtgccctcggatggacccagtggacggcacacagctgttgaaatatataaggaatgtcaatttctccgggattgccggaaaccccgtgactttcaatgaaaatggcgatgcacccggcaggtatgatatctatcaatatcagctgagaaacgatagcgctgagtataaagtcataggcagctggactgaccatctccatctgcggatcgaacggatgcactggcccggaagcgggcaacagctgccgcgctcaatctgctcattgccctgtcagcccggcgagaggaaaaaaacggtcaagggaatgccatgttgttggcactgtgagccttgcaccgggtatcagtaccaggtggatcggtacacatgtaaaacttgcccgtatgacatgcgtcccacagaaaatcggaccgggtgcaggcccattcccataatcaaactcgaatgggggagcccttgggccgttctgccgctttttttggcagtcgtcggcattgcagctaccctatttgtcgtcattacattcgtcagatacaatgatactccgatagtgaaagcaagtgggagggaactatcttacgtgcttctcgctggaatctttctctgttatgctaccacatttctgatgattgccgagcctgatttggggacgtgctccctccgaagaatcttccttggtctgggcatgagcatctcatatgcagcactcctaaccaaaaccaatcggatataccggatcttcgagcagggaaagcggtctgtctccgcgcctagattcattagtcctgccagtcagctcgccatcacttttagtcttatctccctgcaattgttgggaatctgcgtttggttcgtggtcgacccgagtcactctgttgtcgattttcaagaccagcgaacattggacccccgcttcgccagaggagtgctcaagtgcgacatcagcgacctaagcctaatctgcttgctgggctactccatgttgctcatggtgacgtgtaccgtctatgctattaagacacgaggtgtgcctgagaccttcaacgaagccaaaccaatcgggtttacaatgtataccacatgcatcgtgtggcttgcctttatcccaattttctttggcacctcacagtccgctgataagctctatatccaaactaccactcttacggtatcagtctcacttagcgcaagcgtcagcttaggcatgctgtacatgcccaaagtgtatataattctctttcaccccgagcaaaatgttccaaaacgcaaaagatcgctaaaggccgtggtgaccgccgcaacaatgtccaataagtttactcagaagggcaactttcgcccaaatggagaggctaagagcgaactgtgtgagaatctagaggcgcctgctctcgctaccaagcagacctatgttacctacaccaaccacgcgatctag

SEQ ID NO: 189396 - DNA, 2340 bp, Artificial Sequence
  Description of Artificial Sequence: Synthetic coding sequence
atggccgtgcccctgggcgccccctgctgggccagcgccctgcccgcgtgggcgccgccaggcttgccccacaggagtctcttaaccaggctcctgagccaacacgtgaagcctgctaagattcctcagatctcttacgcaagtactgcccctgacctaagcgataactctaggtacgactttttcagtcgtgtggtaccgtcagacacgtatcaagcccaagcaatggtggatattgtgagagcactgaaatggaactatgtgagcactgttgcgtctgaggggagctacggcgaatcaggggtcgaagcctttatccaaaagtcacgcgaggacggcggtgtgtgcatagctcaatccgtcaaaatcccacgggaacccaaggctggggagtttgacaaaataatccgcagactgttggaaacgtccaacgcacgggctgtgataatctttgcaaacgaagacgatatccggagagtgcttgaagcagcaaggcgtgcgaaccaaacaggccacttcttctggatggggagtgacagttgggggtctaaaatcgctcctgtgctgcacctggaagaggtcgctgagggggccgtgacaatacttcctaagagaatgtcagtgcgaggcttcgatcgctattttagttccagaaccttggataacaacagacggaacatctggttcgcagagttttgggaggacaactttcactgcaagttatctagacacgccctgaagaagggctcccatgtgaaaaaatgcaccaacagggagagaattggtcaggactcggcatacgaacaggagggcaaagtccagttcgtaatagatgctgtgtatgccatgggacatgccctgcatgcaatgcatcgggacctgtgtcccggacgcgtgggcctctgcccaaggatggatcctgtagatggcacccagctccttaaatacattcgtaatgtgaacttctcaggtatcgctggaaatcctgtcacatttaacgagaatggcgacgccccggggcgctacgacatttaccagtaccagttacgaaatgattccgcagagtataaggtcatcggtagctggaccgatcatcttcatcttcggatcgagcggatgcattggcctggctcaggccaacagttgcccaggtccatttgttccttaccttgccaacctggggaacgaaaaaaaaccgtaaaagggatgccatgttgttggcattgtgaaccgtgcactggataccagtatcaggtcgatcgctatacttgtaaaacttgcccgtatgacatgcgcccaactgagaatcgaaccggatgcaggccaataccgatcattaaacttgaatggggaagcccatgggccgtgctgcctctctttctggctgttgtggggatcgctgcaactttattcgtggttatcacctttgtacgatataacgatacccctatcgttaaggcctctggacgggaactgagctatgtgctgctggctggtattttcttgtgttatgccacgacattcctgatgatcgcggaacccgacttaggcacctgtagcctcagacgcatctttctagggctcggcatgtcaatctcttacgcagcgctgctaaccaagacaaatcgaatttaccgcatatttgaacaggggaaaaggagtgttagtgcgccacgcttcattagccctgcaagtcaacttgctatcactttctctctgatttccctgcaactgttggggatttgcgtttggttcgtagtggacccaagtcatagtgtggtggacttccaggaccaacgtactttagatcctagattcgcaagaggggtcctgaagtgcgacatctctgatctctcactcatttgcctcctcggttatagtatgctgcttatggtcacatgcacagtgtatgcaatcaaaacccgcggtgtccccgagacatttaatgaggccaagcccatcgggttcacgatgtacactacctgcatcgtctggctcgctttcatcccaatcttttttgggacctcacagtctgccgataagctgtacatccagacgacgactctgaccgtctccgtttctttaagtgcctctgtgtctctgggtatgctgtatatgccaaaggtgtacataattctctttcacccggaacaaaatgttcccaaacggaaaaggagcctcaaagctgtcgttacagcggctacaatgtctaataaatttacccaaaagggtaacttcaggccgaacggcgaggctaagtccgagctctgcgaaaatttggaagcgccagccctggctaccaaacaaacttatgtgacttatacgaaccacgctatctag

SEQ ID NO: 189397 - DNA, 2739 bp, Artificial Sequence
  Description of Artificial Sequence: Synthetic coding sequence
atgcccggcaagcggggcctgggctggtggtgggcccggctgcccctgtgtttgctgctgtccctctacgggccgtggatgccgtcctctctcgggaagccaaaggggcacccacatatgaacagcatccgaatcgatggcgatatcacactcggcggcctgtttccggtgcatggccgtgggtccgaaggcaagccgtgcggagaactaaagaaagaaaaaggtattcatcggctggaggcaatgcttttcgctctagacaggattaataatgatcccgaccttttgcctaacataaccctgggcgcgcgcatcctcgacacatgcagtcgggacacccacgccctggagcagtccctgacttttgtgcaggcactgatcgaaaaagacggcaccgaggttagatgtggctcaggaggccctccaataataaccaaacccgagagagttgtaggcgtcatcggcgcttccggctcgagtgtgagcatcatggtggccaatattctgaggctgttcaagattcctcagatcagttacgcttctacagcgcctgatctcagtgacaacagcagatacgacttcttctcccgcgtggttccatctgacacctaccaggcccaagccatggtcgacatcgtccgggcgcttaagtggaattatgtaagcacagtcgcttcagaaggatcttacggtgaatcaggcgttgaggcctttatccaaaagtctcgggaagacggcggggtttgtattgcacaatccgtgaagataccacgggagcctaaggcaggggaattcgacaagataataaggcgcctactggagactagtaatgcaagagccgtgatcatctttgccaacgaggacgatattcgcagggtgcttgaagccgcgagacgagctaatcagacagggcatttcttctggatggggagcgacagctggggaagcaagattgcccccgttctgcacctggaggaagtggccgagggagccgtaaccattctgccgaaacgaatgtccgtccggggctttgataggtatttttcctctagaacattagacaacaaccgccgcaatatctggttcgcggaattctgggaggataacttccattgtaagttatcccggcacgccctgaaaaaggggtcgcacgtgaaaaagtgcacaaatagggaacgaatcgggcaagattctgcctacgaacaggagggaaaggtccagttcgtgatcgacgctgtctatgctatgggccacgccctacatgccatgcacagagacctgtgtccagggcgcgtgggcctgtgtcctagaatggatcctgtcgatgggacacaattattaaagtacatccgaaatgtcaattttagcggaatagccgggaatccggtgactttcaatgagaacggcgatgcacccggaagatatgacatctaccagtatcagctacgcaacgatagcgctgagtataaggtgattgggagctggactgatcacctccacttgagaatagagagaatgcactggccgggttccgggcagcagctgccccgcagcatttgttccctgccttgccaaccaggcgagagaaagaagactgttaagggtatgccttgttgctggcattgcgaaccctgtacaggatatcagtatcaggtcgacagatacacgtgtaagacttgcccttacgacatgaggcctaccgagaatcgcactggctgcagacccatccccattattaaactagagtggggctctccatgggcagtgcttccgctttttctcgccgtggtcggtattgctgccactctgttcgtggtgatcacatttgtgaggtacaacgataccccaatcgtgaaggccagtggcagagagctgagctatgtacttctcgcgggcatcttcctgtgctatgcgaccacattcctcatgattgcggagccagacctaggtacttgtagtcttagaaggatcttcctgggcctcggtatgtcaatcagttacgcggctctacttactaagaccaatcgcatttacagaatcttcgaacaaggtaagaggtctgttagcgctccgaggtttatatctccagcttctcagctggctatcactttttccctcatcagcttacaactccttggcatatgcgtgtggttcgttgttgatccttctcacagcgttgtggactttcaggatcagcgcacactggatcctcgcttcgcccggggcgttctaaagtgcgatatctccgacctgtcccttatctgcctgttagggtatagcatgttgctcatggtcacatgcaccgtgtacgctattaaaacacggggggtccccgaaacctttaacgaagcgaagcctatcggtttcactatgtatactacttgcatagtgtggctcgctttcattcctatattcttcggtacttcgcagtcagccgacaaactttacatccagacaactacgctaaccgtgtccgtctccctgagtgctagtgtgagtttaggaatgctgtacatgccaaaggtttacatcattctgtttcacccagagcagaatgtgcctaagcggaagcgcagccttaaagcggtcgtgactgccgccaccatgagcaataagttcactcagaagggcaattttcggcccaacggagaagccaagtccgagctgtgcgagaatctggaggcacctgccctggccacgaagcagacatatgtcacctacacgaatcatgcgatttag

SEQ ID NO: 189398 - DNA, 2232 bp, Artificial Sequence
  Description of Artificial Sequence: Synthetic coding sequence
atgagctgcaagatcccccagatcagctacgccagcaccgcccccgatctgtccgacaatagccgatatgacttcttttcaagggtggtcccgtcagatacttatcaggcccaggcaatggtcgacatcgtgagggccctaaaatggaactatgtgagcacagtggcatctgagggttcttacggcgagtccggagtcgaagctttcatacagaaatcacgggaggacggaggcgtgtgtatagcccaatcagtgaagatccccagggaaccaaaggcaggagaattcgataaaatcatcagacgcctgctggagaccagcaatgctcgggccgtaattatcttcgcgaatgaagacgacatacgccgtgtcctcgaagccgctaggagggccaaccagaccggccatttcttttggatgggatccgactcctggggcagcaaaatcgcacccgtgcttcatctcgaggaggtagctgagggggcagtgacaattcttcccaagcgaatgtctgtgcgggggtttgatagatacttctcttcccgcacgttagataataaccggcggaacatatggttcgctgagttttgggaggataactttcactgcaaactctcccgccatgcgttgaaaaagggttcgcacgtgaagaaatgtactaatagggaaaggattggacaggactccgcgtatgagcaggagggcaaggtgcaattcgtgatcgacgctgtctacgccatggggcacgccctgcacgctatgcatcgagatctatgtcccggaagagtgggcctgtgccccaggatggacccagttgatgggactcagcttctaaaatatatccgtaacgtcaacttttcaggaatagccggaaatccagttacgtttaatgaaaatggtgacgccccagggcgctacgacatataccagtatcaactgagaaatgacagcgcggagtacaaagtaatcgggtcctggaccgaccatctccacttgcgaatcgagagaatgcactggccgggaagcggtcagcagctgcccagatcaatctgctccctgccttgtcagcctggggagcggaagaagaccgtcaaaggcatgccatgctgctggcactgcgagccgtgcaccggataccagtaccaagttgaccgatacacatgcaagacgtgtccgtacgacatgagacccacagagaaccgaactggttgcagacccattcccatcatcaaattggaatgggggagcccttgggctgtgcttcccttatttctcgccgttgtcggcatcgctgcaaccctcttcgtggtgattacatttgtaaggtataacgataccccaattgttaaggcatcagggagggagttgtcttacgtgttactggccggaatctttctgtgctacgctacgacattccttatgatagccgaacccgatctgggaacctgtagtcttaggagaatcttcttgggactcggaatgagcatttcttacgccgctctgctgactaagactaacagaatatatcggatttttgaacagggcaaacggagtgtgagcgctcctagatttatcagcccagcaagtcagctggccataaccttttccctaataagcctgcagcttcttgggatctgcgtctggttcgtggtggacccaagccattccgtggttgacttccaggaccagcgaacattggacccgcggtttgcccggggggtgctgaaatgcgatatcagcgacctctccctgatctgtctcctagggtactccatgctgctcatggtaacgtgcactgtctatgcaattaagacccgtggtgtccctgaaacattcaatgaagcgaagcctataggattcacgatgtatacaacatgcatcgtgtggctggccttcatccccattttctttggaacaagtcaaagtgctgataagctctacattcaaaccacgaccctgaccgtgagtgtgagcctatctgcctctgtttccctgggaatgctgtacatgcccaaagtgtacatcatccttttccacccagagcaaaacgtgccaaagagaaagcgcagtctgaaagccgtggtgaccgccgccaccatgtctaataagtttacacagaaaggcaattttcgcccaaacggcgaagcaaaaagcgagctgtgtgaaaacttagaagcaccggcccttgccactaagcagacttacgtcacatatacaaatcacgccatttag

SEQ ID NO: 189399 - DNA, 1776 bp, Artificial Sequence
  Description of Artificial Sequence: Synthetic coding sequence
atgggcagcgacagctggggcagcaagatcgcccccgtgctgcacctggaggaggtcgccgagggcgccgtgaccatcctgcctaaaagaatgagcgtgaggggctttgacaggtatttcagcagccgaactctcgataacaaccgcagaaacatctggttcgcagagttttgggaagataacttccactgtaaactgagtcgccatgcccttaaaaaagggagccacgtcaaaaaatgcaccaacagggaaaggatagggcaggactccgcctatgagcaagaagggaaagtgcagttcgtgatagacgcggtgtacgccatgggacatgctctgcacgccatgcatcgagacttgtgccccggtcgggtcggcctgtgccctcgcatggaccctgtggacggcacgcagctgctcaaatacatccgtaatgttaacttctcaggtattgcaggtaatcccgtcactttcaacgagaatggagacgcgcccgggagatatgacatctaccagtaccagttgaggaacgacagcgctgagtataaggtcatcggcagttggactgatcatctgcatttgcggatcgagagaatgcactggccaggttcgggccagcaactacccagatccatttgtagcttgccatgtcaacccggcgagcgcaagaagaccgttaagggcatgccatgctgctggcactgtgagccatgtactggctatcagtatcaagtcgatagatacacgtgtaagacatgtccttacgatatgcgccccacggaaaacagaactggctgccggcccatcccgatcatcaaactcgaatggggctccccttgggcagttctcccactttttctggctgttgtgggcattgcagctaccctctttgtagtgatcacctttgtaaggtataacgacacacctatagttaaggcgtccggcagagagctgtcatatgtgctacttgccgggatattcctttgttatgccacaacattcctgatgatcgccgaacctgacctgggcacctgttcattgcggcgaatctttctgggcctaggtatgtccatctcttatgcagcattgctcacaaagacaaatcgcatataccggatcttcgaacagggcaaaaggtctgtctctgctcccaggttcatctcacccgcctctcagttggcgattaccttctctctgatatccctgcaactcttgggaatctgtgtctggtttgtcgtggacccttcccactctgtagtcgatttccaggaccagcgaaccctggaccctcgatttgcacgcggagtcctgaagtgcgacatcagcgacctgtctctgatctgtctgcttggatactccatgctcctgatggtgacatgtacggtctacgcaatcaagactaggggagttccagagaccttcaatgaggccaagcctatcggctttactatgtatactacatgcattgtttggctggcatttatccccatattctttggcactagccagagcgccgataaactctatatacaaacaactacgctgacagtgtctgtctcattgagcgcctctgtttccctgggcatgctgtacatgcctaaggtatatataatcctgtttcaccctgagcagaatgtgccaaagaggaagaggagtctgaaggccgtggtaaccgccgccaccatgtccaacaaattcacacaaaagggcaatttccggccgaacggtgaggccaagtctgaattgtgcgagaaccttgaggcccctggcagcagctag

SEQ ID NO: 189400 - DNA, 2364 bp, Artificial Sequence
  Description of Artificial Sequence: Synthetic coding sequence
atggagcccgccggcgagcggttccccgagcagcggcaggtgctgattcttttgctgctgctcgaagtgacactcgccggctgggagccacgacgttacagtgtgatggaggaaacggagcgagggtcttttgtggctaacttggcaaatgacctgggcctgggggtgggagagcttgctgaacgcggcgcacgcgtggtctcagaggacaacgagcagggtctgcagctggatctccaaacaggtcagcttatcctcaatgagaagctggaccgggagaaactctgtggccctaccgagccctgcataatgcatttccaggttcttctgaaaaagcctctggaggtgttccgcgcagaactgttggtgactgatatcaatgaccatagccctgaatttccggagcgggagatgacattgaaaattcctgagacctcatccttaggaacagtgtttccactgaaaaaggctcgagacttggacgttggcagcaataatgtgcagaattataacatttccccaaactctcatttccacgtgtcaactcgtacacggggggatggcagaaagtaccctgagcttgtgcttgacactgagctagatcgcgaagaacaggctgagttgcgactgaccctaactgcagtggatggcgggtcaccaccccgcagcggaacagtccagatactcattctggtacttgacgcaaatgataatgctcctgaatttgttcaagcactgtacgaggtgcaagtgccagaaaacagtccagtcgggagcctcgtggtgaaagtttccgcacgcgatttagacaccggaacgaacggagagatctcatattcgctgtattatagcagccaggagatcgataaacccttcgaactctcctccctcagtggagagatacgcctgatcaagaagttggatttcgaaaccatgtcttcatacgatctagatatagaggcaagcgatggggggggtctcagcggtaagtgcagcgttagtgtgaaggtactcgatgtaaatgataattttcctgagctcagcatctcctcactgacatcccctatccccgaaaacagccccgagacagaagtcgccctatttcggatccgggacagggacagcggtgagaatgggaagatgatctgttcgatccaggatgatgtcccctttaagttgaagccctcagtggagaacttctatcggcttgttacagaaggcgcattggaccgagaaaccagagcagaatataacataactatcaccatcaccgacttgggcactccacggcttaaaaccgagcagtctatcactgtcttagtatctgatgttaatgacaatgcacccgcattcacgcaaacctcgtatacactattcgtccgtgaaaacaattcacccgccctgcacattggctcggtcagcgccaccgatcgggactcaggtactaatgctcaggtaacttattctctgcttccaccgcgtgatcctcacctgcctctaacctccctggtgagcatcaacactgataacggccacctgttcgcactccagtcgcttgattatgaggctttgcaggccttcgaatttcgagtcggcgccactgataggggattccctgcccttagctccgaggctctggtgcgtgtactggtgctggacgcaaacgacaatagcccttttgtgctgtaccctctacagaatggatccgctccatgcaccgaactcgtcccgcgagcagctgagcccggctacctggtgacgaaggtggtcgccgtggatggagactcaggacaaaacgcttggctgagctaccagctgcttaaggctaccgaacccgggctgtttggtgtctgggctcacaacggggaggtgaggaccgccagactcctcagcgaaagggatgtggcaaaacaccgacttgtggtgctggtgaaggacaacggggaacctccccgcagcgcgactgccactctgcaggttctcctggttgacggtttttctcaaccttatctccccctgccagaggccgcccccgcccaggctcaggctgatagccttaccgtctatttggtcgtggctctggcatccgtatctagtttgtttttgttttctgtgttcctgtttgttgctgtgaggttgtgtcggagaagtcgggccgcgtccgtagggcgttgtagcgtcccggaggggcccttccctggtcatctggtcgacgtctccggcaccggcacactgagccagtcttaccagtacgaagtgtgtctcacgggtggtagcgagagtaacgattttaagtttctgaagcccatttttccaaacattgtgtcccaagactcccgaaggaaatccgaatttttagaatag

SEQ ID NO: 189401 - DNA, 3276 bp, Artificial Sequence
  Description of Artificial Sequence: Synthetic coding sequence
atgcagctggacggcctgcaggccctgtgctggggcagcctgttcaggacccagctggttcccgtatacgtcgcagttttacctagcccacagccctgcatcccccccacgtgtaccgctttcactgagttctcgggcccactggccaaacatcattcgttccaacctttccaagtggccgcccccgccggtccccgtagccctcctcaaccattccaccttccctcagtttcccaagttcatgccacacacctgctgtgcccggtgagagtgctcggacccccctatccacccagtctagaattgttgaccagcattcattcaccagctgttctaccagcccctcagattcctcagatttcatacgcctctacagcccctgagctctcagattctacacgatacgacttctttagccgtgtggtgccgcccgactcataccaggctcaggctatggtagatatcgttagggccctgggatggaattacgttagcacactggccagtgagggtaactacggagagtccggtgtggaagcatttgtacagatcagccgcgaggctggagagctgggggcacctaggcatcagggagtgtacatcgtgtgggcgcggggacctcagctcggtcagaagcagaaggacggtggaccaagaagcatgctgggaagaggttgtctggcgggagcaccgtgcggtcgggacctgtttgtattagatgattctgcccttcctcaagcttggcgccgcgtacaagcccgcctccacccatgtagacccttctcacaacccacacagagctcagccgccgtggccagatggagtataaagatcccccgggagccaaagcctggagaattctctaaggtgatcagaaggctgatggagaccccaaatgcccgcggtataatcatctttgccaacgaggatgacatcagccctgccccaacgcgccgtgtgcttgaggctgctaggcaggctaaccttaccggtcatttcctttgggtgggctccgattcatggggcgctaagaccagccctatcctgtccctcgaggacgtggccgtaggcgccataaccatcctgcccaagcgcgcttccatagatggtttcgaccagtactttatgacccgcagcctcgaaaacaacagacgaaacatatggttcgccgaattttgggaggaaaattttaattgcaagctaacttcatctgggactcagagcgacgactctactagaaagtgtacaggagagtcttgccctggatggaccggagaagagcgaataggccgtgactccacgtatgaacaagaagggaaggtgcagttcgtgatagacgccgtgtacgctatagcccatgctctgcactcgatgcaccaagctctgtgccccggccataccgggctctgtcctgccatggagcctaccgatggtcgaatgttattgcaatatatccgatgtcccctccagtggcttaatcggatcccattatgtgagtggccgcgtagggtgaggcccttcttctgtcaatggacgctcggcctgctgtctagctgtggttatgtgaacaacgctgccgtaaacgttgcggtgcaggccttcttggctacactgttaagcagcctgtcctctatctaccccggagtggagctgttgggccatgtgttcaacctgcttcggcgcctgcacacggtcttctgttccgggtgttccttgtttccaccaaccgttcacaaaggctccgccggtacccctgtaatgtttaatgagaatggagatgctcccggacgttacgatattttccagtatcaagccactaatgggagtgcatcctccggaggatatcaggccgttgggcagtgggccgagacactgcgtttggatgtttccgtgcagactgagcctcaagtcggtatgggacccgggtcgaggaggcagactccacagccggtcttttgtgccagccaggtagaggcattgcagtggagcggcgatcctcatgaagtgccgagctctttatgttcgctcccatgcggacccggggagagaaagaagatggtgaaaggggtgccctgctgttggcactgtgaagcctgcgacggatacaggttccaggttgacgaattcacgtgtgaggcttgtccaggcgatatgcgcccaacacccaaccatactggatgcagacccacaccagtcgttcggttatcttggagctctccgtgggccgccccaccactgctgctcgcagtcctgggaatcgtggccactacgacagtagtggctaccttcgttcggtacaacaatactccgatcgtcagagcttcaggcagagaattatcctacgtgcttctcaccggcatcttcctgatttacgctatcactttcctcatggtcgctgagccaggcgcagccgtgtgtgctgcccgccggctgttcctcggtctggggacaacactgtcctacagcgctcttctgaccaaaaccaaccgcatttacaggatattcgaacagggaaaacgttctgtaaccccccctccgtttatcagtcccaccagccaactggtgatcacattttcgcttacttcactgcaaatcaacgccgtgttccgtgtgacactcttctatttcggtagtttgcaatggcattacctgtcaagcttgcaagcactgccttcaggcgacctgtccgtgcagcacctttcagcctctgtatctctgggcatgctgtactccaaaagtaaaacacccgtcgacctcgaggtgggaagcgagccttgggggtacttgggcgacggcgtgctgcaggccgaacactggggagagggaagaggggactggccacatgtaaaggttatggtggtcgtgtatcagagctcactggtttactacatgaagcaggctcaggccggaagggtgaaaaccgaactcctgaaggtcgctcaccaccaggttgctaagtccgtacctgaagaaagccagattgtggtccttcatttggtgacagcaggttatgttgatatggccatccgaactaccagggcctcattacatcttatgcccttgactcttgtcccaggagccgccgccgaggtgaacgaaacccaagttgctgctcgcttaggcccggggtcaactgtcgggacctaccaggtggtggtggtactgatgagaagcttgcagatcgataaaacgaccaaccagctcagcctggagacttgcttttcaggcatccaggggttccttgccagtgtaaacagcctggtgatggataaatag

SEQ ID NO: 189402 - DNA, 2634 bp, Artificial Sequence
  Description of Artificial Sequence: Synthetic coding sequence
atggcccggccccggcgggcccgggagcccctgctggtggccctgttgccactggcctggctggctcaggccgggctggctagagcagccggcagtgtcagactcgcgggaggcctgaccctgggagggcttttcccggtgcacgctagaggcgcggccggccgggcctgtgggcagttgaagaaggaacagggtgtccatcggttagaggcaatgctgtatgcacttgaccgggtcaacgctgacccggaactcctgcctggggtccggctgggagccaggttgctggatacctgtagtagggatacctatgctctcgagcaagcacttagcttcgtgcaggcattaatccggggaaggggagacggagatgaagtgggcgtgcgctgtcctggtggagtccctcccctgaggccagcaccacccgagagagtggttgctgtcgttggtgcgtctgcttccagtgtgtctatcatggttgctaatgtactccgcctgttcgccattccccagatctcgtatgccagcacagcccctgaactcagcgactcaactaggtatgatttcttctcacgggtggtaccaccagactcttaccaggcccaagccatggtggatatcgtccgagctttgggttggaattacgtcagtactctggcctcggaggggaactatggcgagagcggtgtggaggcgtttgtccagatttctagggaagctgggggcgtttgcatcgctcagtcaatcaaaatacccagggagcctaaacccggcgagttcagtaaggtgattcgcagattaatggagacccctaacgcgcgcgggattatcatattcgccaatgaggacgacattcgcagggtgctcgaagccgcacgccaggcgaacctcacagggcactttttgtgggtagggtcagacagctggggagccaagacctctccaatccttagtctggaggacgttgctgttggcgcaatcaccatcttacccaagcgtgcctcgatagatgggttcgatcagtacttcatgactagaagtctggagaataataggcgtaacatttggttcgcagagttttgggaagaaaactttaattgtaaattgacaagctcaggaacacagagcgacgactcaacgaggaagtgcacgggggaggaaagaattggtcgagattcaacatatgagcaagaagggaaagtgcagttcgtgattgatgccgtgtacgccatagcgcacgctctccacagcatgcaccaggctctgtgcccaggacatacagggttgtgccccgcgatggagcccaccgatggccgtatgttgctgcagtacattagggcggtccgctttaatggtagcgcaggtacgcctgttatgtttaacgagaacggcgacgcccctggcagatatgacatcttccaataccaggctacaaacggttctgccagttctggaggctaccaggcggtggggcaatgggccgaaaccctgcgactggacgttgaggccctgcagtggtctggagatccccacgaggtgccttcctccttatgttcactaccctgcggacctggcgagcgcaaaaagatggttaagggagttccttgctgctggcactgcgaagcctgcgatggttacaggtttcaggtggatgagttcacttgtgaagcctgtcctggcgatatgagaccaacacccaatcacacaggctgccggccgacgcccgttgtgcggctgagctggtccagtccctgggccgcccctccgctcctcctagcagtgcttggcattgtggctacaactactgttgtcgccacttttgttcggtacaataataccccgatcgtgagggcctctggaagggaactgagctacgtactgctgaccggcatattcctgatttatgctatcacctttctgatggtggccgagcctggcgcggccgtgtgcgccgctcgtagattgttcctgggtctgggcaccacattatcatatagtgcactcctgaccaaaaccaaccgtatctatcgcatctttgagcagggcaagcgctccgtcactccgcctcctttcatatccccaacatcacaattggttattacctttagcctgacttcattgcaggtggtcggaatgatcgcatggttgggtgcacgccctccccactcagtgattgattacgaggagcaaaggactgttgatccagagcaggctcggggcgtcctgaaatgtgatatgtccgacctttcactgatcggctgtctgggatattctctgctgctcatggtgacctgcactgtctacgccattaaagctcgtggggttcccgagacgtttaatgaggccaagccaattggctttaccatgtatactacgtgcatcatttggctcgctttcgtaccaatttttttcggcactgctcagtcagcagaaaagatatacatacaaacaaccaccctcacagtgtccctctctctgtctgcctccgtttctctcgggatgttatacgtgcctaagacctacgtaatcctcttccatcccgaacagaatgtacagaagcgaaagaggtcgctgaaggcgacttccaccgtggcagccccaccaaaaggcgaggatgccgaggcccataagtag

SEQ ID NO: 189403 - DNA, 2748 bp, Artificial Sequence
  Description of Artificial Sequence: Synthetic coding sequence
atggtgcagctgcggaagctgctgcgggtgctgaccctgatgaagttcccttgttgtgtcctggaagtgctactctgcgctcttgcagcagccgctcgcgggcaggaaatgtacgcccctcattccatccggattgagggagacgtgacattgggtggactcttccctgtccacgccaagggaccatcaggggtaccatgcggtgacattaaacgggagaatggcatccataggctagaggccatgctatacgctctcgatcagatcaactctgatccaaacctgctgcctaacgtgaccctgggagcccgcatcctcgacacctgcagtagagatacgtatgcgcttgagcagagcttaacatttgtgcaggccttgattcagaaggacacctcagatgtgcgatgcaccaacggtgaaccccccgtctttgtgaagccggaaaaggtggtcggcgtgatcggggccagtggctcctcagtgtccataatggtcgcaaatatcctcagactcttccagatccctcagattagctacgcctcaaccgccccagaactgtctgatgatcgcaggtatgatttctttagtcgcgtggtccctcccgatagcttccaagcacaagctatggttgatatcgtgaaagctcttggttggaattatgtgagtactctcgcatctgagggcagctatggagagaagggggttgaatccttcacccagattagtaaagaggctggtggcttgtgcatcgcccagtctgtgcggattccgcaggaaaggaaggaccggactatcgacttcgatcgaatcattaagcagttgttagacacccccaacagtagagccgtggtgatcttcgccaatgatgaggacatcaagcagattctcgctgcggctaaaagagccgatcaggtcggccatttcctttgggttggttcagatagctgggggtcaaagatcaatccattgcatcagcatgaggatatcgctgaaggagcgatcaccattcagccaaaacgggctaccgtggagggctttgacgcctactttacctcacggacccttgaaaataatagacgaaacgtctggttcgcagagtattgggaggagaattttaattgcaagcttaccattagcggcagtaagaaggaggacactgatcggaagtgcactgggcaggaacgtataggtaaggacagtaactatgaacaagagggaaaggtacagttcgtaattgatgctgtttacgctatggcccatgccttgcaccacatgaataaggacctgtgtgcggattataggggagtgtgtccggagatggagcaagcgggaggaaaaaagctcttgaagtacatacgaaatgtgaacttcaacggttcagcaggcactccggtgatgttcaataaaaacggggacgctcccgggcgctatgatatctttcagtaccagaccaccaacacctccaatccaggctatcgactgattggacagtggactgatgagctgcaactgaatatcgaagacatgcaatggggtaaaggcgtaagagaaatacctgcatcagtctgcacgttgccttgtaagcccgggcagcgcaagaaaacccagaagggaaccccctgttgctggacatgcgaaccatgtgacggctaccagtatcagttcgacgagatgacatgtcagcactgtccctacgatcagcggccgaatgaaaataggaccggatgtcaagatattcccattatcaagctggagtggcacagtccatgggccgtcatacctgtcttcctcgccatgcttggaattattgcaaccatcttcgtcatggccacctttattagatacaacgacaccccaattgtgcgcgcctcaggacgcgaactttcatatgtcttgctgacgggtattttcctttgctatataattactttcttaatgattgccaaaccagacgtggctgtgtgcagtttccggcgcgtgtttctcggcctcggcatgtgcatatcctatgctgctctgctcacaaagaccaacaggatttacagaatcttcgaacagggcaagaaatcagttacagcgcccaggctaattagcccaacttcacaactcgccatcacttcatcccttataagtgtgcaactgttaggcgtctttatctggttcggcgtcgaccctccaaacattatcattgactacgatgagcataaaacaatgaatcctgagcaagcccgcggagtcctaaagtgcgacataacggatctgcagatcatctgttcattgggatactccattctgctgatggtcacttgtacagtctacgccatcaagacacggggagtgcccgaaaactttaatgaagcaaaacctatcggcttcacaatgtataccacctgtattgtctggcttgcttttatccccatcttctttggtaccgctcagtcagccgaaaagctgtacatccaaactaccaccctcaccatctcgatgaatctcagcgcctccgtagcattagggatgttgtatatgcccaaagtctatatcattatttttcacccagagcttaatgtccaaaagcggaaacggtcattcaaggctgttgtcactgcagccactatgtcatctcgtctctcacataagcctagcgaccgccccaacggcgaagcaaaaaccgagctgtgcgagaatgttgatcccaattcgcctgctgccaagaagaaatatgtgtcatataataacttggttatatag

SEQ ID NO: 189404 - DNA, 2721 bp, Artificial Sequence
  Description of Artificial Sequence: Synthetic coding sequence
atggtgcagctgcggaagctgctgcgggtgctgaccctgatgaagtttccctgctgcgtgctggaggttctcctgtgcgcgctggctgccgccgcaaggggccaggagatgtatgctccacactccatccgaatcgaaggagacgttacactcggaggcctcttcccagttcatgcaaagggaccgagcggcgtgccctgcggggacattaaacgcgagaacggaatccataggctggaggccatgctgtatgcactggaccagataaatagtgatcctaatctgctccccaacgttacccttggcgctcgaattttggacacgtgcagtagggatacttacgcactggagcaatcccttacctttgtccaagccttaattcagaaggacacttcggatgtcaggtgcaccaacggagaaccccccgtgttcgttaagcctgaaaaagtggtcggggtgattggtgctagcggaagctccgtgtccattatggtggcaaatatcctcagactctttcagataccacagatctcctatgcctcaacagcccccgagctgagcgacgacagaaggtacgactttttctcaagggtggtgcctcctgactcatttcaggcacaggctatggtggatattgtgaaagccctcggctggaactacgttagtaccttagcctctgaggggagctacggcgaaaagggagtggaatcttttactcaaatctctaaggaggcaggaggactttgcattgcgcagtcagtgcgtatccctcaagaaaggaaagataggactattgacttcgatcgtattatcaagcagctgctggacacgcctaattccagagctgttgtcatctttgctaatgacgaagacatcaaacagatcctagccgcggccaagcgggccgaccaagtcggccattttctctgggtggggtcggatagttgggggagtaagatcaaccctctgcaccagcacgaagacattgcagaaggagctatcaccatccagcccaaaagagccacagtggagggtttcgacgcctacttcacgtctagaactttggagaataacaggaggaatgtgtggttcgccgaatattgggaggagaatttcaactgcaagctcacaatctccggctcaaagaaagaggatacagaccgtaagtgtaccggacaagagcgaatagggaaggattctaactatgagcaggagggcaaggtgcagtttgtcatcgacgctgtctacgccatggctcatgctctgcatcatatgaataaagatctttgtgcagactacaggggagtctgtcctgagatggaacaagcgggtggaaaaaagctacttaagtatattcgaaacgtgaattttaacggctctgccggcacgcccgtcatgttcaataaaaacggcgatgctcctggcagatacgatatctttcagtaccagacaaccaacacgtccaatcccgggtatcgcctgatcggccagtggacagacgagctgcagctgaatattgaggacatgcagtggggcaagggggtccgagaaatccctgcgagtgtgtgtacccttccttgcaaaccagggcaacggaagaaaacccaaaaaggaacaccttgttgttggacctgtgagccctgtgacggctatcagtaccagttcgatgaaatgacctgccagcattgcccctacgatcagcgacctaatgagaaccgtaccgggtgccaggatatccctattataaagctggaatggcactcgccctgggctgtcatccccgtctttttggcaatgctgggaataatcgcgaccattttcgtgatggcaacctttatccgatacaacgacacacctattgtgagggcctcaggtagagagctgtcctatgtgctcctgaccgggattttcttatgttatatcatcaccttcctgatgatagcaaaacccgatgttgccgtttgcagtttccgcagggtgttcttagggcttgggatgtgtattagctacgcggctctcctgactaagaccaatagaatctaccgtattttcgagcagggcaaaaagtccgttactgcgccccgacttatttccccaacatctcagttggctattacttctagtctgatctccgtccagcttttgggcgtgtttatctggtttggtgtggaccctccgaacattattatcgactacgatgagcacaaaactatgaaccctgagcaagcaaggggtgtactcaaatgcgacatcacagatctgcaaatcatttgctcacttggatacagcattctactgatggtgacgtgcaccgtctacgccattaaaaccagaggggtcccagagaacttcaacgaggcaaaaccaattggctttactatgtatacaacttgtattgtttggcttgcttttattcccatttttttcggcacagcacagtcagccgagaagctttatatccagactaccactctcacgatttccatgaacctgtctgcttctgtggctctgggaatgttgtatatgccaaaggtctacatcatcatctttcatcctgaactgaacgtgcagaagagaaagcgttcatttaaggccgttgtgacggcagcaaccatgtcaagtcgattgtcacacaagccgtccgatcggcctaacggcgaggcgaaaactgaactatgtgagaacgtcgaccctaacagtgaaaagtgcaactgttattag

SEQ ID NO: 189405 - DNA, 2769 bp, Artificial Sequence
  Description of Artificial Sequence: Synthetic coding sequence
atggtgcagctgcggaagctgctgcgggtgctgaccctgatgaagtttccttgttgtgtcctggaggtactgctgtgcgccctggccgccgccgcgaggggtcaggagatgtacgcccctcactcaatccgcattgagggtgatgtaactttgggcggactatttcccgtccacgctaaaggcccatcaggcgtcccttgcggagacataaagagggaaaacgggatacacaggctggaggccatgctctacgcactggaccagatcaactctgatcccaatctcctgccaaatgtgacactaggagcccggatccttgacacctgtagtcgtgacacttacgctctcgagcagtctcttactttcgttcaagctttaatacagaaggatacttctgatgtcaggtgcactaacggggagcccccggtttttgttaaacctgagaaggtcgtaggagtgatcggggcatcgggtagcagcgtatccatcatggtagccaatatcctgaggctgtttcaaattccgcagatatcatatgcctctactgcccctgagctaagcgacgatagaaggtacgatttcttctcacgagtggttccccctgactccttccaggcccaggcgatggttgatatagtaaaagccctggggtggaactatgtgagtacgctcgctagcgaggggtcatacggagaaaagggggtggaatctttcactcagattagcaaggaggcagggggcctctgcatcgcccaaagtgtccgcattcctcaggaacgcaaggacagaacgatcgattttgataggattatcaagcagcttctggatacaccgaactcacgagcagtagtaatctttgccaacgatgaagatatcaagcagatcctggccgctgcaaaacgagcggaccaagtcgggcactttctatgggtcgggagtgattcttgggggagcaagattaacccccttcatcagcatgaagatatcgccgagggcgccattaccatccaacccaagagagccaccgtcgagggcttcgatgcttattttaccagcaggaccctcgaaaataaccggcggaacgtctggtttgcagaatactgggaagagaacttcaactgcaaactcacaatcagtggttctaagaaagaagacactgatcgaaaatgcaccggacaggagcgcattggtaaggactctaactacgagcaggaaggaaaggtgcaattcgtgatcgacgcagtctatgccatggctcatgcacttcaccacatgaacaaagacttatgtgccgactatagaggggtgtgtccagagatggagcaggcgggcggaaagaaactcctgaaatacatcaggaacgtcaatttcaacggctccgctggcacacccgtgatgtttaataaaaacggcgatgctcccggtcgctacgacatcttccagtaccagacaacaaataccagtaacccaggataccgcctgatcggccagtggacagatgagttgcaactgaacatcgaggatatgcagtggggtaagggggtccgcgagatccccgccagcgtctgcacactgccctgcaagccagggcagcggaagaagacccagaagggcacgccttgttgctggacatgtgaaccttgcgacgggtatcaatatcagttcgatgaaatgacttgtcaacactgtccttacgatcaaaggccaaacgaaaataggactggctgtcaggacatcccaatcataaagctggaatggcattccccctgggccgtaattccggttttcttggccatgctgggcatcattgccaccatttttgtgatggcaacctttatcaggtacaacgatacacccattgtcagggcctccggcagagaactgtcatacgtcctgttgacagggatattcttgtgttacattattacatttttgatgatcgcgaagcctgatgtggccgtgtgctcgttcagaagggtgtttttaggactggggatgtgtataagctatgccgcactgctgaccaaaaccaatcggatatacagaatcttcgaacagggaaagaaaagcgtgactgcccctcggctgatcagccccacctctcagctcgcgatcactagctctcttatttcagttcagctcctaggagtctttatctggttcggggtggaccccccaaatatcattattgattacgacgagcataagactatgaacccagagcaagctcggggagtgttgaaatgtgacattacagatttgcagataatttgctccctgggctacagcattctcttaatggtgacctgcacagtctacgcaatcaagactcgcggcgtacctgaaaatttcaacgaggccaagcccatcggtttcacaatgtataccacttgtattgtttggctggcctttattccgatcttcttcgggacagctcagagtgcagaaaaactctacatccagacaactaccttgacgatctccatgaatctttcagcatctgtcgcccttggaatgttatatatgccaaaggtttatataatcatcttccaccccgagctgaatgtgcagaagaggaagcggagctttaaggcagtggtcactgctgctaccatgagtagcaggctatcccacaagccctccgatcgacctaacggcgaggcgaagactgagctgtgcgagaatgtggatccaaataattgtatcccaccagtgagaaagtcagtgcaaaaaagcgtcacctggtatactatccctccaacggtttag

SEQ ID NO: 189406 - DNA, 2736 bp, Artificial Sequence
  Description of Artificial Sequence: Synthetic coding sequence
atggtgcagctgcggaagctgctgcgggtgctgaccctgatgaagttcccctgttgcgtgcttgaggtgttgttatgtgcactggcggctgctgctcgcggtcaagagatgtatgcgccacactcaatcaggatcgagggagacgtgacactcgggggtctgttccccgttcacgctaaagggccctctggagtgccttgtggcgatatcaaacgcgaaaatgggatccatcgccttgaggccatgctctacgcacttgatcaaatcaacagtgaccctaacctgctaccaaacgtgaccctgggggcacgaattctggacacatgctctagagacacctacgccttagaacagtctctgacatttgtgcaggccttaattcaaaaggatactagtgacgtgaggtgcaccaacggagaaccccctgtatttgtcaaaccagagaaggtggttggggtgatcggggcttcaggctcaagcgtgagcatcatggtggccaacatcctgaggcttttccagattccccagatctcatacgcatcaacggctcccgaactatctgatgataggagatacgatttcttctcgagggttgtcccccccgattctttccaggcccaggctatggtcgacatagtgaaggctctgggatggaactacgtctcgacattggcctcggagggctcctatggcgagaaaggcgtagagagtttcacccaaatttccaaggaggccggtgggctgtgtatcgcccagagtgtccgcatcccgcaggagaggaaagacaggacgattgatttcgatagaattattaaacagctcctggacacaccaaacagcagagccgtcgtcatctttgccaacgacgaagacatcaagcagatactggccgccgccaaaagagccgatcaggttgggcatttcctttgggtcgggagcgattcttggggatcaaaaatcaatcccctacatcagcatgaagacattgccgagggtgccattactatccagcccaaacgggcaaccgtggagggctttgacgcatatttcacctcccgtactctcgagaacaaccgccgaaatgtgtggtttgctgagtactgggaagagaacttcaactgcaagttaaccatctcggggtcaaaaaaagaggacactgatcggaagtgtaccggccaggagcgtatcggaaaggatagcaattatgaacaagagggtaaagtgcaatttgtgattgatgccgtgtacgctatggctcatgccttgcaccatatgaacaaagacctctgtgccgattatcggggcgtttgccccgagatggagcaggccggcggcaaaaagctgctgaagtacattagaaatgtcaactttaacgggtccgccggcacaccagtgatgttcaataagaatggcgacgcacccggtcgctacgacatattccaatatcagacaacaaatactagtaacccagggtacagactaatcggacaatggacagatgaactccagcttaatatcgaagacatgcagtggggcaaaggggttagggaaatacctgcatccgtctgtaccctgccctgtaaacctggccaacgcaaaaagacccagaaaggtactccttgttgttggacctgcgagccatgtgatggatatcagtaccaatttgacgagatgacctgtcagcattgcccctatgatcaacgcccaaacgaaaaccgcactgggtgtcaagatatacctattataaagttggagtggcattctccatgggctgtgatccccgtgttcctcgcgatgctcgggataatcgctacaatttttgtgatggccactttcattcgttataacgatactcctatagtgcgcgcctccggtcgagaactgagttacgtcctgctgactggaatcttcctttgttacattatcacattcctgatgatcgccaaaccagatgtcgcagtttgcagttttaggagggttttcctgggattaggaatgtgtatctcctatgcagcacttctgaccaagactaatcggatctaccgtatctttgagcaaggcaaaaagtcggtaactgccccacgtctgatttcccctacctcacaacttgcaattactagtagcctgatttcagtgcagctcttgggggtctttatttggtttggcgtcgacccacctaatatcatcatcgattacgacgagcacaagaccatgaaccccgaacaggcaagaggcgtcttgaaatgcgatatcacagacctgcagattatttgctctctcggctatagtatacttctgatggttacctgtactgtgtatgccattaaaaccagaggcgttcctgaaaattttaacgaggcaaagccaattggatttacgatgtacacaacttgtatagtgtggctggctttcatccccattttttttggaactgctcagtcggcagaaaagctctacatccaaaccaccaccttgactattagtatgaacctgtccgcgagtgtggcgctgggaatgctttacatgcccaaagtttacatcattatttttcaccccgaactgaatgtgcaaaaaagaaagcgaagcttcaaagctgtcgtaacggctgccacaatgtcctctcggctgtcccacaagcccagcgatcgtccaaacggcgaagcaaagacagagctctgcgagaatgttgatccgaatatcaccagtgaagatttgagccttcataaggaagattag

SEQ ID NO: 189407 - DNA, 2475 bp, Artificial Sequence
  Description of Artificial Sequence: Synthetic coding sequence
atggtgcagctgcggaagctgctgcgggtgctgaccctgatgaagttcccttgttgcgtgctggaggtcctactgtgcgccttagccgctgcggctagaggtcaggagatgtacgctccccattctattcgtatcgagggggacgtgacactcggtgggttatttcccgtgcatgccaagggtccgagcggagttccgtgtggcgatattaaacgtgagaacggtattcataggctggaagcaatgttgtatgccctggatcaaatcaactcagatccaaatcttttacctaacgtcacactaggggcccgcatcctcgacacatgctcacgagacacctatgccttagaacagagtctaacctttgtgcaggccctaattcagaaagacacttccgatgttcgctgtaccaatggcgaaccgcccgttttcgtgaaaccagagaaagttgttggagtcattggagcctcgggatctagcgtgtctattatggtggctaatattctgagacttttccagataccacagatctcctacgctagtaccgcccctgaactgtctgacgatagacgttatgattttttctcaagagtggtgccacccgactccttccaggcacaggcaatggtcgacatcgtaaaagctctcgggtggaattatgtatccacgttagcttcagaaggttcctatggggagaagggtgtagaaagcttcacgcagatttccaaggaagccggcggcctctgtatagcccagtcggtgcggattccccaggaacggaaagatagaaccatagactttgaccgcatcatcaagcaactgctggatactcccaattcccgcgcagtggtgattttcgccaacgacgaggacattaagcagattcttgccgccgcaaagcgcgctgatcaagtgggtcacttcctgtgggtgggaagtgacagttggggatcaaagattaaccctttacaccagcacgaggacatcgccgaaggcgccataaccattcaacctaaacgcgccacagtagagggcttcgatgcctacttcacgtctagaacattggagaataatagacgcaatgtctggtttgccgagtactgggaggaaaattttaattgtaaactgaccatatccggatctaagaaggaggacaccgaccggaagtgtaccgggcaggagagaatcggaaaggacagcaattatgaacaggaagggaaggtacaatttgttatagatgccgtgtatgcgatggcacacgccctccatcatatgaataaggacctgtgcgcagattacaggggcgtttgccccgagatggagcaggcaggcgggaagaaactgcttaaatatattaggaacgtgaatttcaatggagatgccgggactcctgttatgttcaataagaatggggatgctccaggtcggtacgacatctttcagtaccagaccaccaacaccagtaaccctggttatcggctgatcgggcaatggaccgatgagctccagctgaatatagaggacatgcagtggggtaaaggcgtacgcgagatccctgcctctgtgtgcaccctcccatgcaaacccggacagcgaaaaaagacccagaaggggaccccctgttgctggacctgtgaaccctgcgacggataccaatatcagtttgatgaaatgacttgtcagcattgtccatacgaccagaggcctaatgagaataggacgggttgccaggatatccctatcataaagctggagtggcattcaccatgggctgtaatcccagtcttcctagcaatgctaggaatcatcgccactatcttcgttatggctacttttatccgatataatgacaccccgatcgtgcgagcctccggcagagaactctcgtatgtgctgctaaccggaatattcctctgctacataattacgttcctgatgatcgccaaaccagatgttgcagtatgcagctttcgtagagtcttccttggccttggcatgtgtatatcttacgcagcattactgacgaagaccaacaggatttatagaatcttcgagcaggggaagaagtccgttacagctccacggttgatcagccctacctcacagctggcaattacttcttccttgattagcgtgcaactcttgggagttttcatatggtttggggtggaccctcccaatatcatcatcgactacgatgagcataaaacaatgaaccctgagcaggcacgcggggtgttgaagtgtgacatcaccgatctccagataatctgcagtctgggctactcaattctcctcatggtaacatgtacggtctatgcaattaagaccaggggcgttccggaaaacttcaacgaggccaaacccatcggctttaccatgtatacaacatgcattgtgtggctcgctttcatcccaatctttttcggaaccgcacagtccgccgaaaaagttattctctgctgtatcagctag

SEQ ID NO: 189408 - DNA, 2775 bp, Artificial Sequence
  Description of Artificial Sequence: Synthetic coding sequence
atggtgcagctgcggaagctgctgcgggtgctgaccctgatgaagtttccttgttgtgttcttgaagtgctactctgcgcgcttgccgctgcggcacgcggccaggagatgtatgcaccccatagtataagaatcgaaggagatgtcaccttaggaggcctctttcccgttcatgcaaagggcccttctggcgtcccctgcggggacattaagcgcgaaaacgggatccaccgactggaggctatgctttatgctttggaccagatcaattctgacccaaatttgctacccaatgtgacgctgggcgctcgaattttggatacgtgctctagagatacgtatgcgctagagcagagcctgacttttgtgcaggcgttaattcaaaaagacacttccgatgtcaggtgcacaaacggagagccgcctgtgtttgtcaaacccgagaaggtggtcggcgtgattggagccagcggctccagcgtgtccataatggtagctaacattctcagactgtttcagatccctcaaattagctacgccagcacagcaccagaacttagtgatgatcgtcgatacgatttcttctctagggttgtgccccccgattcgttccaagcccaggccatggtggacattgtcaaagcccttggatggaattacgtctccactctagctagcgagggaagctatggagagaaaggggttgagagttttacgcagataagcaaagaggccggggggctctgtattgctcagtcagtgcggataccacaagagcgcaaagaccggaccattgacttcgaccgaattatcaagcagcttctagacacaccaaatagccgggccgtggttattttcgccaatgacgaggatatcaaacagattctagcagcagccaagagggccgaccaggtcggccatttcctctgggtgggctcagacagctgggggagcaagatcaaccccctccaccaacacgaggacatcgccgagggagccataacaatccaaccaaagcgggctacggtcgagggtttcgatgcttatttcacctctcgcactttagagaacaataggcgcaacgtctggtttgccgaatattgggaagagaattttaattgtaaactgactatctccggcagtaaaaaggaggatacggatagaaaatgtaccggacaagagcgtataggcaaagactccaattatgaacaggaagggaaggtccaatttgtcatagatgccgtctacgctatggctcacgccctgcatcacatgaacaaggatttatgcgctgactaccgcggcgtgtgcccagagatggagcaggctggaggtaaaaagttgctgaaatacattcgtaatgtgaattttaacggatctgccggcacgccggtgatgttcaacaagaacggggatgcgcccgggcgatatgatatttttcagtatcagactacaaatacttccaacccagggtaccgactgataggtcaatggaccgacgaattacagttgaatatcgaggacatgcaatggggcaaaggggttcgagagattccagcttctgtgtgcactctgccatgcaaacccgggcagcgcaaaaagacccagaaaggaaccccttgttgttggacttgtgagccctgtgatggttaccagtaccagttcgacgagatgacatgccagcattgtccatacgaccagcgtcccaacgagaataggactggctgccaggatatcccaatcatcaagctggagtggcattccccctgggccgtgataccagtcttcctggctatgctgggaattatcgctaccatattcgtgatggctactttcatacgttacaacgacacccccatagtaagagctagcggccgagagctttcgtacgtgttactgactggcattttcctgtgctatataatcaccttcctcatgattgcaaagccagacgtggctgtgtgttcctttcgccgtgtattcctgggacttgggatgtgcatcagctatgccgcactcttgacaaaaacaaacaggatctaccggattttcgagcagggcaagaaatcggtgaccgcgcccagactgatctctcccacttctcaacttgccatcacgtctagcctcattagcgttcagctgctgggtgtgttcatctggtttggtgtcgacccaccaaacattatcatcgattacgacgagcataagaccatgaaccccgagcaggccaggggagtgctcaaatgcgacattaccgatttgcaaatcatatgctccctgggatacagcattctcctgatggtgacatgcacagtttacgcaatcaagacacgtggagtgccagagaatttcaacgaggctaagccaattggcttcacaatgtatactacgtgtatcgtgtggctggccttcattccgattttttttggcacggcacagtctgcagaaaagctgtacatccagaccactactcttactatctccatgaacctgagcgccagtgtcgctcttgggatgctctacatgccaaaggtgtatataatcatctttcatcccgagctgaacgtgcagaaacgtaagagatcgttcaaagccgtggtcactgctgccactatgtcaagtagactgtcccataagccctcggaccggccaaacggtgaggctaagaccgagctttgcgaaaacgttgatccaaacatctttttttttgggtgcacagtggagctgggcctccactttaaactcacatttagcagaaaccagagcaatctgtag

SEQ ID NO: 189409 - DNA, 2727 bp, Artificial Sequence
  Description of Artificial Sequence: Synthetic coding sequence
atggtgtgcgagggcaagcggagcgccagctgcccctgcttcttcctgctgactgctaagttctattggatcctcacaatgatgcagagaacccactcccaagagtacgcacacagcatcagggtggacggcgacatcattcttggcggtttgttccccgtacatgctaagggagagcgcggggtgccatgcggcgagctcaagaaagagaaaggaatccaccgcctggaagcgatgctctatgcgatcgaccagattaataaggaccccgatctcctaagcaacatcaccctgggagtcagaatcttagatacctgctcacgcgacacttacgctctcgaacaaagcctgaccttcgtgcaggcgttgatcgaaaaggatgcttccgatgtcaagtgcgcaaatggcgaccccccaatcttcacaaaacctgacaaaatcagtggggtgataggagcagccgcctcgagcgtatctataatggtagccaacatcctgagactgttcaagataccccagattagttacgcttcaaccgcccccgaactgagcgataatacccgctacgacttcttcagtagggttgtgcctcctgacagctaccaggcccaggcgatggttgacattgtcactgcattgggttggaattatgttagcacattagcctcagaggggaactatggggaatcgggcgtcgaggctttcacacagatcagccgcgagattggaggcgtctgtattgcacaaagccagaagatccccagggagcccagacctggcgagtttgaaaagataattaaacggctgctcgagactcctaatgccagggccgtgatcatgttcgccaacgaggacgacattaggagaatcctggaagccgccaagaaactgaatcaatccggtcacttcttatggattgggtccgactcatggggcagtaagatcgcacctgtgtaccagcaggaggaaattgcggaaggtgctgtaactatcctgccgaagagggcctccattgacggtttcgatcgatattttagatcgcggaccctggccaataaccggcggaatgtgtggtttgccgagttctgggaagagaattttggctgcaaactcggttctcacggcaagcgtaacagccacattaagaagtgtactggcttggagcgcatcgcgcgagattctagctatgagcaggaaggcaaagttcagtttgtcatcgatgctgtgtactctatggcctatgcattgcacaacatgcataaggacctgtgcccaggctatatcgggctgtgcccgcggatgagtaccatcgacggcaaagagctgctcggatacattcgagcggtcaacttcaatggctccgctggtacccccgtcaccttcaatgagaacggtgatgcaccagggcgatatgatatttttcagtaccagataactaacaagagcaccgaatataaggttattggtcactggactaaccagctgcatttgaaggtagaggacatgcagtgggcacaccgggagcacacacaccctgccagtgtttgctcacttccttgtaaacctggagagcggaagaagaccgtcaagggcgtgccatgttgctggcattgcgaacggtgtgagggctacaactaccaggtcgacgagctgtcgtgtgagctgtgcccattagaccagcgacctaacatgaaccgcacagggtgtcaactgattcccataatcaagctggagtggcactccccatgggccgtggtgcccgtgttcgttgcaatcctgggtatcattgccaccacttttgtcatcgtgactttcgttaggtataatgacacaccaatcgttagggcatctggtcgcgaactctcatatgtgctgctcaccggtatcttcttatgctactccattactttccttatgattgccgcacctgatactattatctgctcctttcgaagagttttcctcggcctcggcatgtgtttttcctacgctgccctgctgacaaagactaatcggattcataggatctttgagcagggcaaaaaatccgtcaccgcccccaaattcatcagtccggccagtcaactggtcattacgttctctcttatcagtgtgcagcttttgggggtattcgtttggttcgtggtggatcccccacacattataattgattacggtgaacaacgaactttggaccccgagaaggccaggggggtgttgaagtgtgacatttccgacttgtctctgatttgctccttagggtactccatcttgctcatggtcacctgtacggtttacgctattaaaacccggggagtgcccgaaactttcaatgaagccaagccgatcggattcaccatgtacactacgtgtataatatggttagcattcatccctatctttttcggcactgcacagtcagctgaaaagatgtatatccagacgacaactctgacggtaagcatgtcactctccgcttccgtttctctcgggatgctttacatgcctaaagtctatataataatcttccacccagagcaaaatgtccagaagcggaaacgttccttcaaggcagtagtgaccgctgcaacgatgcagtcaaaattgatccagaagggaaacgaccgccccaatggtgaagttaagtctgaactttgtgagtccctggagacaaacacatcctccaccaagactacctacatctcttatagtaaccactctatttag

SEQ ID NO: 189410 - DNA, 2727 bp, Artificial Sequence
  Description of Artificial Sequence: Synthetic coding sequence
atggtgtgcgagggcaagcggagcgccagctgcccctgcttcttcctgcttacagctaagttttattggatcctcaccatgatgcaacgaactcacagccaggagtatgcgcatagcatccgcgttgacggcgatatcattctgggcggtttattccccgtgcacgccaagggagagaggggggtgccatgcggggaactgaaaaaagagaagggaatacaccggttagaggctatgttatacgcaatcgaccaaatcaacaaggaccctgacctcctcagcaatataacactaggcgtccgaatcttagatacttgttcccgtgatacctacgcactcgagcagagcctgacatttgtgcaggccttgatcgaaaaggacgcgtcagacgtgaagtgtgcaaatggggacccacccattttcaccaaaccagacaaaatatccggggtgatcggcgccgctgcttctagtgtctccatcatggtcgcgaacattctgaggctgtttaaaatcccccagatctcatatgcatctacagcccccgaactgtccgacaacacaagatatgacttcttctctagagtcgtgcctcctgactcctatcaggcccaggcaatggtggacatcgtcaccgccctcggctggaattatgtgtccacattggccagcgaaggcaactatggagagtcaggcgtggaagcatttacacaaattagccgggagattggaggagtgtgcatagcacaaagccaaaagatcccaagagagcccagacccggcgaatttgaaaagataatcaaacgcctgctcgagacacctaacgcccgggctgtcataatgtttgcaaatgaggacgacattcggcgcatccttgaggcggctaagaaactgaatcagagcggacattttctctggataggaagcgacagttggggctcaaaaatcgccccagtctaccagcaagaggaaatagccgagggcgcagttacaatcctgccaaaacgcgcctcaattgatggttttgaccgctatttccgctcaaggacactggccaacaaccgtcgaaatgtctggtttgctgaattttgggaggagaatttcggctgcaagctaggcagtcatggaaaacgtaactcacatatcaagaagtgcactggactggaacgcatcgccagagactcaagctacgagcaggaggggaaagttcagtttgtgatagatgccgtatactccatggcttacgcgctgcataatatgcacaaagatctgtgtccaggttatattggtctgtgtccaagaatgtctacgatcgacgggaaagaactgctggggtacattcgcgccgtgaatttcaacgggtccgcaggtacccctgtcactttcaatgaaaatggagacgccccaggtaggtatgatattttccagtaccagataaccaataagagcaccgagtataaggtaatcggacactggaccaatcagttgcatctgaaagtggaagatatgcagtgggcccacagagaacatactcacccagcttctgtgtgtagcttaccctgcaagccaggagagaggaagaaaactgtgaaaggtgttccttgctgttggcattgcgaacggtgcgagggctacaactaccaggttgacgaacttagctgtgaattgtgcccattagaccaaaggccgaacatgaacaggaccggatgccagctgatacccattatcaagctagaatggcattctccatgggcagtcgtgcccgtgttcgtggccatccttgggatcatcgctactacatttgttattgtcaccttcgtccggtacaacgacacacccatcgtgagggccagtggcagggagctcagctatgtactgctgactggcattttcctttgctactctatcacgtttttgatgatcgccgcaccagatacaataatttgttcttttaggagggttttcttaggattaggaatgtgcttctcgtacgcggcactcctgacaaagacaaataggatacatcggatttttgagcaaggcaaaaagtcagttaccgcaccaaagtttatttccccggcttcgcagctggtaatcacctttagcttaatttccgttcagcttctcggggtctttgtctggtttgtcgtcgaccctccccacatcataattgattacggcgaacagagaacgctggatcccgagaaggcacgcggagtactgaaatgcgacatctctgacctctctcttatctgcagtcttgggtatagtatcctcctcatggttacgtgcacagtctatgctatcaagacccggggcgtcccagaaacatttaacgaagcaaaacccatcggattcacaatgtataccacctgcattatctggctagccttcattcctattttcttcggaaccgcacagtccgcagaaaagatgtatattcagaccacaacattgacggtttcaatgtcactttccgcttccgtgtccctgggtatgctatacatgccaaaagtctacatcatcatctttcacccagagcagaacgtgcaaaaaagaaagcggtcctttaaggccgtggtgaccgcagcgaccatgcagagcaaactcatccaaaaggggaatgaccgaccaaacggtgaggtgaaaagcgagctgtgtgagtcattggagacaaactcaaagtcaagtgtggaattccctatggtgaagagtggcagtacctcatag

SEQ ID NO: 189411 - DNA, 1506 bp, Artificial Sequence
  Description of Artificial Sequence: Synthetic coding sequence
atggtgtgcgagggcaagcggagcgccagctgcccctgcttcttcttactgacagctaagttctactggatcctcaccatgatgcaacgtacccactcccaggagtacgcccactctatacgggtagatggtgatattattctcggaggtctttttcccgtccatgcgaagggtgagcggggcgttccgtgtggagagctgaagaaggaaaagggtattcataggctcgaggccatgctgtatgccatcgatcagatcaacaaagatcccgatctcctgtccaacatcacactcggagtgaggatcctggacacctgctcacgggacacctacgccttagagcagagtctgacctttgtgcaagctctgatcgagaaggacgcatcagacgttaagtgcgctaacggtgacccccccatctttacaaagccagacaagatcagcggagtgataggggccgccgcgtcttcagtgagcatcatggttgccaacatcctgcgactgttcaaaattcctcagataagctacgcttcaacagcccccgagctgagcgacaatacccgctatgacttcttttctcgagttgtcccccctgacagctaccaggcccaagccatggtcgatatcgtaacagctctagggtggaattatgtctcaactctagcttcagagggcaactacggggagtccggggtggaagcatttacgcaaatttctcgcgagattggaggggtgtgcatagctcagagccagaagatccccagggaacccagacccggagagttcgagaagatcattaaaagactgctcgagaccccgaatgcccgagccgtaatcatgtttgccaatgaagatgatataagaagaattctcgaagcggccaagaagcttaaccagtcaggccatttcctgtggatcgggtctgattcttggggtagtaagatcgccccagtgtatcagcaggaagaaattgctgagggcgccgtgaccattctccctaaaagagccagtatcgacggatttgatcgatattttcggtctcgcaccctagcgaataatcggagaaatgtttggtttgctgagttttgggaggagaacttcgggtgcaagttgggatcacacgggaaacgtaacagtcatatcaaaaaatgtactggattagagcggatcgcacgcgacagctcctacgagcaggaggggaaggtgcagtttgtgattgatgctgtgtactctatggcctacgctctccataacatgcacaaagatctgtgccctggatacataggtctgtgtccacgcatgtcaaccattgatggaaaagaacttttgggctatatccgcgcagttaatttcaacggatgtagacgcggaatccagatgagcctgccttggccaactttatttactccctccttctcatcttcctgggcggtcctcgccctcctgtccctgctgatgaaaacagaaatgttacttgatgtgatgatttcatccagcatcaaatag

SEQ ID NO: 189412 - DNA, 63 bp, Artificial Sequence
  Description of Artificial Sequence: Synthetic coding sequence
atggtgtgcgagggcaagcggagcgccagctgcccctgcttcttcctgctgaccgccaagtag

SEQ ID NO: 189413 - DNA, 2727 bp, Artificial Sequence
  Description of Artificial Sequence: Synthetic coding sequence
atggtgtgcgagggcaagcggagcgccagctgcccctgcttcttcttgcttacagccaaattctattggatattgaccatgatgcaaagaacccatagccaggaatatgcgcattccatcagggttgacggggacataatcctgggcggacttttccccgtgcatgctaagggggagcgcggcgtgccctgtggcgagctgaaaaaggaaaagggcatccatagattggaggctatgctgtacgctattgatcagataaacaaggaccctgatctgctgtccaatatcacccttggcgttaggattctcgatacctgctcccgtgacacatacgctttagagcagtccttaacttttgtccaagcactcattgaaaaggacgccagtgacgtgaaatgtgcaaacggcgatcccccaatcttcacgaagcctgacaagatttcaggagtgattggggccgccgcctcttcagtgtccatcatggtggcaaatattttgcggctgttcaagataccccagatttcctatgccagcaccgcaccagagctttcggacaatacacggtacgacttcttctcccgggtggtacctccggactcatatcaggcgcaagcgatggtggacatcgtcaccgccctcggctggaattacgtgtcgacacttgcctccgagggcaactacggggagagcggagtggaagcatttactcaaatatctcgggagatcggaggggtctgtattgcccagtcgcaaaagattccaagagagccccggcctggggagtttgaaaagattattaaacggctcctggaaactcctaacgcccgtgctgtgataatgttcgcaaatgaggatgacattcggaggatcttagaggccgctaagaagcttaaccagtctggccacttcctgtggattggatcagattcatggggaagtaagatcgcccccgtttatcagcaagaggagatcgcggagggagccgtgactatcctgcctaagcgagcgagtattgacggattcgatcgctattttaggagtaggaccttggccaacaaccgacgaaatgtctggttcgcagaattctgggaagagaacttcgggtgtaagctaggtagccacggtaagaggaatagccacatcaagaaatgtacaggattggaaagaatagccagagactctagttatgaacaggaaggcaaggtccaatttgtgattgatgcagtgtactccatggcgtatgccctgcataacatgcataaggacctctgtccaggctacattgggctgtgtcctcgcatgtcgacaatcgatggcaaagaactcttagggtatattcgggcagttaacttcaacggatccgccgggacaccagtgacatttaatgaaaatggcgatgcacctggcagatacgatatttttcagtaccaaattacgaataaaagcacagagtataaagtcatcgggcattggacaaaccaactccacctcaaagtcgaagacatgcagtgggcacatcgcgagcacacccatcccgcaagtgtgtgttccttgccatgcaaacccggcgagcgcaaaaagaccgtcaaaggggtgccttgctgctggcattgcgagcgctgcgaaggatataattaccaagtggacgagctgtcttgcgaactctgtcctctggatcaaaggccaaatatgaaccgcaccggttgtcagctgattcctatcatcaagctggaatggcactcaccttgggccgtggttcccgtgtttgtcgcgattctgggcattattgccacgacctttgtgatcgtgacgtttgtccggtataacgatactcccatagtccgggcatcaggtcgggagctttcttatgtcttactgacgggtatctttttgtgttactcaattacattccttatgattgcagctccggacacaatcatctgtagctttaggagggtgtttctcggtctggggatgtgcttcagttacgcggccctgctgaccaagacaaacaggatccatcgaatctttgaacaaggcaaaaagtctgtgaccgcgcctaaatttataagccccgcctcacaactggtgattacatttagcctaatttctgtgcagctactgggagtcttcgtgtggttcgtggtggatcctccccacataattatcgactacggtgagcagaggaccttagatcctgagaaggctaggggagtcctgaagtgcgatatcagtgacctgagtctgatctgctctctgggctacagcattctcctgatggtgacgtgcaccgtctacgccataaaaaccaggggggtgcccgaaacctttaacgaagctaaaccaattggattcacgatgtacacgacctgcatcatctggctggccttcatcccaattttctttggcactgctcaaagtgccgaaaaaatgtacatccagactacaacacttacagtgtccatgtcactgagcgcctcggtatctcttgggatgctctacatgcccaaagtttatatcattattttccatccggagcagaatgtgcagaaaaggaagcggagcttcaaggccgttgtgacagccgccaccatgcagtctaaacttattcagaagggcaacgaccggcctaatggagaagtgaagagtgagctgtgcgagtctctggagaccaacacttccagtactaagaccacttacatttcgtattcaaatcactcaatctag

SEQ ID NO: 189414 - DNA, 885 bp, Artificial Sequence
  Description of Artificial Sequence: Synthetic coding sequence
atggtgtgcgagggcaagcggagcgccagctgcccctgcttcttcctgcttaccgctaagttttactggatccttacaatgatgcagcgcacacatagtcaggagtatgctcactctattcgtgttgacggggatattatcctcggggggttattcccagtgcacgcaaaaggggaacggggcgtgccatgcggggagctcaagaaggaaaaggggatccaccggcttgaggcaatgctgtatgccattgaccagattaacaaggacccagatcttttaagtaacatcactctgggcgtacgcattctcgatacctgttcacgcgatacctacgctctggagcagagccttaccttcgtacaggcactcatcgaaaaggacgcatctgacgtcaagtgcgccaacggagatccgccgattttcacaaagcctgataaaatctctggcgtaattggcgccgcagcctcgtccgtgtctatcatggttgctaatatcctgcgcctattcaaaattcctcagatatcctatgcgtcaaccgcaccagagttatcggacaacacccgatacgatttttttagtagagtggtacctcctgactcgtatcaagctcaggccatggttgatattgtaacggccttggggtggaattacgtttcaactctagcaagcgaaggaaattacggagaatcgggggtggaagcatttacgcagataagtagggaaattgggggtgtctgtatcgctcagtcccagaagattcccagggagccaaggcccggagaatttgagaagatcatcaagcgcctcttggagacgccaaacgcccgagctgtgattatgttcgcaaacgaagacgacattcggaggatcctcgaggccgcatag

SEQ ID NO: 189415 - DNA, 1122 bp, Artificial Sequence
  Description of Artificial Sequence: Synthetic coding sequence
atgaccaccagcgccagcagccacctgaacaagggcatcaagcaggtttatatgtccctgccccagggcgagaaagtgcaggctatgtacatttggattgacggcactggggaaggcctacgatgtaagaccaggactcttgactctgagcccaagtgtgtcgaagaactgccagagtggaatttcgatggctcctcaacattgcagtctgagggctctaactccgacatgtacttagtgccagccgcaatgttcagagatccgtttcgtaaggatcccaataagctggtcctttgcgaggtgtttaaatacaacagaagacccgctgaaacaaatcttcggcacacatgtaaaagaataatggacatggtcagcaaccagcatccttggtttggcatggaacaggaatatactttaatgggtacggacggacacccctttggatggccttctaatggattccccgggccccaaggaccctactactgcggggtcggggccgacagggcttacggtagggatattgttgaagctcactaccgtgcctgtctctacgccggtgtgaaaattgcagggactaacgccgaggtgatgccagcacaatgggaattccagattggaccttgcgaggggatttccatgggcgatcatctgtgggttgcccggttcattttgcaccgcgtctgtgaggattttggcgtgatcgctacttttgatccaaagcctattccggggaattggaatggagccggctgccacacgaacttttctactaaggctatgcgcgaggaaaacggtctcaaatacatagaagaggcgattgagaagctctcgaaacggcaccagtatcacatccgcgcctacgaccctaaaggggggcttgacaatgcccgaaggctgactggcttccatgagacgtcaaatattaatgacttctccgccggcgtagccaatagaagtgccagcatcagaatccccagaacggttgggcaggagaagaaaggatactttgaggaccgtcggcctagtgcgaactgcgaccccttcagtgtaaccgaagcgttgataagaacctgtctgttgaatgaaaccggcgatgagccatttcagtacaaaaattag

SEQ ID NO: 189416 - DNA, 1122 bp, Artificial Sequence
  Description of Artificial Sequence: Synthetic coding sequence
atgaccaccagcgccagcagccacctgaacaagggcatcaagcaggtttacatgtcactgcctcagggagaaaaagttcaagccatgtacatttggatcgacggaactggtgaaggattgcggtgtaaaactcgaactctggatagcgagccaaagtgtgtggaagagttacccgagtggaatttcgatggcagctccacactccagtcagagggatctaacagcgatatgtatcttgtccctgcagccatgtttcgcgatcccttccgtaaagatcctaataagctggttctgtgtgaagtgtttaaatacaaccggaggccagcggaaaccaacttgcgccacacatgtaagaggattatggatatggtgagcaaccagcacccttggtttggaatggagcaggagtacacgctgatgggtacagacggacatccatttggttggccaagtaatggcttccccggccctcagggcccctactactgtggcgttggtgcagacagagcatatggccgagacattgtagaggcacattaccgggcctgcttgtacgctggggtgaagattgccgggaccaacgcagaggttatgcccgcccagtgggagtttcagatcggtccctgcgaagggattagtatgggcgatcacttatgggtggcacgcttcattctgcaccgcgtatgtgaggactttggtgtaatcgctacgtttgacccaaaacctattcccggcaattggaatggtgcaggttgccacacaaacttttctacgaaggctatgcgtgaagagaacgggcttaaatatatagaggaagcgatcgagaagctgtcaaagcggcatcagtaccatatccgagcttacgaccccaagggcggcttagataatgcgcggcgcttgacaggattccatgagacctcgaacataaacgatttttctgccggagtcgctaatagatctgcttccatccgtattcctagaactgtcggtcaggaaaaaaagggctatttcgaggatcgtcgaccctccgcaaattgcgatcccttcagcgtgaccgaagctttgattagaacttgtttgcttaacgagacgggcgacgaaccattccagtacaagaattag

SEQ ID NO: 189417 - DNA, 1122 bp, Artificial Sequence
  Description of Artificial Sequence: Synthetic coding sequence
atgaccaccagcgccagcagccacctgaacaagggcatcaagcaggtgtacatgtcgttgccccagggagaaaaggtacaagccatgtatatatggattgatgggacaggcgagggccttcgctgcaaaacaaggacactggacagcgagccaaaatgcgtggaagaattgccggagtggaatttcgatgggagctctaccctgcagtccgagggatccaactctgatatgtacttagttcccgccgccatgtttcgggatccgttccggaaagatcccaataaactggtcctgtgtgaggtgttcaagtataatcgtaggcccgcggaaaccaacctccgacatacctgcaagcgcattatggatatggtgagtaatcaacatccctggttcggaatggaacaagagtacaccttgatgggtactgatggtcaccctttcggatggccaagcaatggtttcccaggccctcagggtccctattactgtggcgttggggcagatcgggcgtacggtcgtgatattgttgaggcacattatagagcatgcctctacgctggtgtcaaaatcgctggtacaaacgcagaggtaatgccagctcagtgggaattccagattggcccatgtgagggaatatctatgggagaccatctttgggtcgccagatttatccttcaccgggtttgcgaggactttggcgtcattgccaccttcgatccgaagccaatccccggaaactggaatggggctggctgtcatacgaattttagcacaaaagcaatgagggaagagaacgggctgaagtacatcgaagaggccatagagaaattaagcaagagacaccagtatcacattagagcctatgatcccaaggggggactcgataacgctaggcgcctcactggcttccacgagacttctaatattaacgacttttcagctggggtcgcgaaccgcagcgcctccattcgtattccaagaacggtcggacaagaaaagaaaggatattttgaggaccgaaggccttcagctaattgcgatcctttttctgtaacagaggccctgatccgcacctgtcttttgaacgagacaggcgacgagcctttccagtacaagaattag

SEQ ID NO: 189418 - DNA, 1122 bp, Artificial Sequence
  Description of Artificial Sequence: Synthetic coding sequence
atgaccaccagcgccagcagccacctgaacaagggcatcaagcaggtctatatgtctctccctcagggcgaaaaagtacaggcaatgtacatttggatagacggcactggagaaggactgaggtgcaagacccgtacactcgacagtgaacccaaatgtgtggaagagctgccggaatggaatttcgatgggtcttccaccctgcaatcagagggctcaaatagcgacatgtatctggttccggccgccatgttcagagatcctttcagaaaagatcccaacaaactggttctttgtgaagtgtttaagtacaatcggcggccagccgagaccaatctgaggcatacgtgcaaaagaatcatggatatggtgtccaaccagcatccctggtttggcatggaacaggagtacactcttatgggtacagacggacacccctttgggtggccgtcaaatggtttcccgggaccccagggaccttactattgcggggtgggagcagaccgcgcttacggtagggatatagtagaggctcactatcgagcttgtttgtatgccggagtgaagatcgccgggaccaatgccgaggttatgccggcgcagtgggaattccagattggtccgtgcgaggggatttctatgggcgaccacctctgggtggcacgattcatcctccacagggtgtgtgaggatttcggggttatcgccaccttcgatcctaaaccaatcccgggaaactggaatggcgccggttgtcacacgaatttcagtaccaaagcgatgcgagaagaaaatggtttgaagtacatcgaggaagctatcgaaaagctctcgaagcggcatcagtatcacatccgagcttacgaccctaaaggaggcctcgataatgctcggagactcacaggtttccacgaaacctccaacataaacgactttagtgccggggtggctaatcggtctgcttccatccggattccaagaaccgtgggccaggagaagaagggctatttcgaggacaggcggccctccgcaaactgcgaccccttctccgtcaccgaggccttgatcaggacttgccttttgaacgaaacaggcgatgagccctttcagtacaagaactag

SEQ ID NO: 189419 - DNA, 702 bp, Artificial Sequence
  Description of Artificial Sequence: Synthetic coding sequence
atgaccaccagcgccagcagccacctgaacaagggcatcaagcaggtttatatgtcgctgccacagggggagaaagttcaggctatgtatatttggatcgacgggaccggcgaaggcttacgttgtaagacacgcacactggactccgagccaaagtgcgtggaagagttacctgagtggaacttcgatggatcatcaactctgcagagtgagggaagcaacagtgatatgtacctcgtgcccgctgccatgttcagggatcctttcaggaaggatcccaacaagctggtgctctgtgaggtgttcaagtataacagaagaccggcagagacaaacttgaggcatacctgtaagagaatcatggatatggtctctaaccaacatccttggtttggtatggagcaggaatacaccttgatgggcaccgatggacacccttttggttggccatctaacggtttccagggaccccgagtgcatatcactgtggtgtgggaacagacagagccaatggctggtacctcctggaggcctatcacgggcccagcatgcatgcttgaatcacggctgagaggactaatgccgagatcatgccttccatcaggaaatttcagacttgacctcgtcaaagagtccgcctgggaaataatctcaggctggcctgtctctagctgtattgtctgcgtgaagacgctcgaatag

SEQ ID NO: 189420 - DNA, 678 bp, Artificial Sequence
  Description of Artificial Sequence: Synthetic coding sequence
atggaccagcaggccatctacgccgagctgaacctgcccaccgactctgggcccgaatcttcaagtccaagctcacttcctcgggatgtctgccagggctcaccatggcaccagttcgctttgaagctcagctgtgccggcattattctgttggtgctcgtggtaacaggactgagcgtgagtgtgacgtcacttatacagaagtcctcaattgagaagtgcagtgttgacattcagcagagtaggaacaagactactgagcgacccggcctcctaaactgccctatttattggcagcagctccgcgagaaatgtctgctgttctcccataccgtcaacccgtggaacaacagtctcgccgactgttccaccaaggagagcagcctgttgctgatcagagataaggatgagctgatccatacacaaaatctgatccgtgataaggccattctcttttggataggactcaatttttcgctgagtgagaaaaactggaagtggatcaacggctcatttctcaacagcaatgacctggagataaggggggacgccaaagaaaactcttgtattagcattagtcagacctccgtctattcagagtactgttcaaccgagataaggtggatctgccaaaaggagctgactccagtgaggaacaaagtgtacccggattcctag

SEQ ID NO: 189421 - DNA, 825 bp, Artificial Sequence
  Description of Artificial Sequence: Synthetic coding sequence
atgggcaccgacagccgggccgccaaggccctgctggcccgggcccggacactccacttacaaaccggcaacttgctcaactggggtcgcctgagaaagaagtgtccatccactcacagtgaggaactgcatgactgtattcagaaaacactgaatgagtggtcttctcagataaaccccgatctcgtgcgtgaatttcccgatgttcttgaatgcacagtgtcccacgccgttgagaagattaacccagatgagcgggaggagatgaaagtgtcagccaagcttttcattgtagaatccaactcaagtagctccactcgaagcgccgttgatatggcctgtagcgtcctgggagtggcccaactggactctgttattatcgcctcaccaccgattgaggatggtgttaatctgtccctggagcacctgcagccatattgggaagagcttgagaacctcgtgcagtccaagaagatcgtggctatcgggacctccgacttggacaagacgcagttggagcaactctaccagtgggctcaggtgaagcctaattctaatcaggtgaatctcgcgagctgttgcgttatgcctccggacttgacagccttcgcaaaacaattcgatatccagctcctgacccacaatgatcctaaagagctcctaagcgaggcaagtttccaggaagccctccaagagtctatcccagatatccaggctcatgagtgggttccactctggctgctgcgatactccgtgatagtgaagtcacgtggcattattaagtccaagggctatatactccaggctaagcgccgggggtcctag

SEQ ID NO: 189422 - DNA, 1341 bp, Artificial Sequence
  Description of Artificial Sequence: Synthetic coding sequence
atggccgcccggaagggccggcggcggacctgcgagaccggcgagcccatggaggccgaaagcggtgatacctcatctgaaggtcctgcgcaagtttacctgcctggcaggggccctcctctgagagagggcgaggagctggtgatggatgaggaggcctacgtgctgtatcaccgcgcccaaaccggcgccccctgtttatcctttgatatcgtgagagatcacttaggggacaatcggaccgagctgccgcttacgctgtatctctgcgccggaacacaggcagaaagcgcccaaagtaataggctcatgatgctccggatgcacaatcttcacggcaccaagccacctccctcagaggggtcggatgaggaagaggaggaggaggacgaggaggatgaagaggagagaaagccgcagctggagttggctatggtgccccactacggtggcattaaccgtgtgcgagtctcttggctcggggaggaaccagtggcaggcgtgtggagtgaaaagggtcaggtcgaggtgttcgcgttgagacggctcctgcaggtggtggaagagcctcaggcccttgctgctttcctccgcgacgagcaggcccaaatgaagcctattttttcttttgctgggcacatgggcgaaggctttgctttagactggtctccaagggtaacagggcggctccttaccggcgattgccagaagaacatccacctctggactccgactgatggtggttcttggcatgtcgatcagaggccattcgttggccacacacggtccgtggaggaccttcagtggagccctaccgaaaacacagtatttgcttcctgctccgccgatgcgagtattaggatatgggatatccgagccgcccccagtaaagcctgcatgctgactacggctacagcccatgacggtgatgtcaatgtcattagctggtctcggcgcgaaccattcctgctgtccggaggcgacgatggggcccttaagatttgggacctccgccagttcaagtccggctccccagtggccacctttaagcagcatgttgccccggtcacatccgtggaatggcaccctcaggattctggcgtttttgccgcctccggggccgatcatcagataacccagtgggacctcgctgtcgagagagatccagaggccggggacgttgaggcggacccaggcctagctgatcttccacaacagctgctgtttgtacaccagggggagaccgagcttaaagagttgcactggcacccccaatgtcctggtttgctcgtgagcactgccctgtcagggtttactatctttcggaccatctctgtatag

SEQ ID NO: 189423 - DNA, 1572 bp, Artificial Sequence
  Description of Artificial Sequence: Synthetic coding sequence
atgcagcgggccgccgccctggtgcggcggggctgcggcccccggaccccgtctagttgggggcggagccaatcatccgccgccgccgaggcaagtgccgtgctgaaagtgaggcctgagaggtccagaagggaacgcatcctgactctggagagcatgaacccccaggttaaggccgtggagtatgccgtcagagggcccatcgtgttgaaggccggcgagatcgagctggaactgcagaggggcattaagaagccgttcaccgaggtgatcagggctaatattggtgacgctcaggcaatgggacagcagccaatcacatttctgcgtcaggtgatggccctgtgcacatatccaaatctgctggattcaccttcgtttccggaagatgctaagaagcgcgcacgaaggatattgcaggcatgtggtgggaattctctcggatcctattctgcttcacagggggttaactgtatacgtgaagacgtggcagcatacattacacgcagagacggcggagtaccagctgaccctgacaatatttatctgacaaccggtgcaagcgacgggatttctactatcctgaagatactggtgtcaggcggcggcaagtccagaaccggagtgatgatccctattccccagtacccattgtactctgctgtgattagtgaactggatgccatacaggtaaattactatctagacgaggaaaattgttgggccctgaacgtgaatgaactgcgaagagcagtgcaggaggcgaaagatcattgcgaccccaaagttctttgtattattaatccaggaaaccctacaggacaagtgcagtcaagaaagtgcattgaggatgttatccacttcgcctgggaagagaaactgtttttgttggctgacgaggtgtatcaggataacgtatactcaccagattgtagatttcacagttttaaaaaagttctgtacgaaatgggaccagagtacagtagtaacgttgaactggccagctttcactccacttccaagggatatatgggcgaatgcgggtaccgtggggggtacatggaagtgattaatctgcaccccgagatcaaagggcaattggtgaagctactgtccgtcaggctgtgccctcccgtgtctggccaggccgccatggatattgtggtgaaccctcctgtagctggcgaagagtccttcgaacagttcagccgagaaaaggagtcagtgttgggcaatctggcgaaaaaggccaagctcaccgaggatctgttcaaccaggtaccaggaatacactgcaaccccctacagggagctatgtatgcgtttccccgaatttttatccccgcaaaggctgtggaggccgcccaggcacatcaaatggccccagatatgttctattgtatgaaacttctggaagagacgggcatatgtgtggtgcccggctcaggattcggccagagggagggcacataccatttccgaatgaccattttaccaccggtcgagaagctgaaaactgttctccagaaagtcaaagatttccacattaactttctcgagaaatacgcttag

SEQ ID NO: 189424 - DNA, 1272 bp, Artificial Sequence
  Description of Artificial Sequence: Synthetic coding sequence
atgggccagcagcccatcaccttcctgcggcaggtgatggccctgtgtacctacccaaatcttctagattcaccaagctttcccgaagatgcgaaaaagagagctaggaggatcctccaggcttgcggcggcaatagccttggctcatacagcgcttctcaaggagtgaattgtatcagagaggatgtggccgcgtatattacacgccgagacggaggcgtacctgccgatcctgataacatctacctaacgactggagcctccgatgggatatcgactatcctgaagatcctggtctctggaggcggcaaaagtcgcaccggagtgatgatcccgattccacaataccccctttacagcgctgtgatcagtgaactcgacgctattcaggtcaattattatcttgatgaagaaaactgttgggcgcttaatgtaaacgaactgcggcgcgctgtgcaggaagctaaggaccactgcgacccaaaggtcttgtgcattatcaaccccgggaatcccacggggcaagtgcagtcccggaaatgcatcgaggatgtaatacactttgcatgggaggagaagctctttctgctcgccgacgaagtctaccaggacaacgtatatagtcctgactgtcgcttccatagctttaagaaggtgctgtatgaaatgggcccggagtatagctccaatgtggaactcgctagctttcactcaacctcaaagggatacatgggcgagtgtggctataggggaggatatatggaagtgattaatcttcaccccgagataaagggccagcttgtgaagttgctgtctgtgagactgtgtccccctgtaagcggccaagccgccatggatattgtggtcaaccctcctgtggctggagaggagtccttcgagcaattctcacgtgagaaggagtcagtgctgggaaacttagcaaagaaggctaagctgactgaggacctatttaaccaggtgcccggtatccattgtaacccattacagggagctatgtacgccttcccgcgcatcttcattccagccaaagcagtggaagccgcccaggcccaccagatggcacccgacatgttttattgcatgaaactgctggaggagaccggcatttgcgtagtacccggcagcggcttcggacagagggagggcacctaccatttcagaatgactatattaccccctgtcgagaagttgaagaccgttctccagaaagtcaaggactttcacatcaacttcctcgaaaaatatgcttag

SEQ ID NO: 189425 - DNA, 1242 bp, Artificial Sequence
  Description of Artificial Sequence: Synthetic coding sequence
atggccccccccagcgtgttcgccgaggtgccccaggcccagcccgtgcttgtgttcaagctgacagccgattttcgcgaggatcccgacccgagaaaagtcaatttgggagtcggggcctaccggaccgacgactgccatccttgggtgctgccagtggtgaaaaaggttgagcagaagatagccaatgacaactcgctcaatcacgaatacctgccgattcttggcttggccgagtttagaagctgtgcttccagacttgcccttggcgatgatagtcccgcccttaaggagaagagggtcggcggcgttcagagtctgggcgggacaggtgccctccgcattggggcagactttctggcaaggtggtacaacggaacgaacaataagaatacccctgtgtatgtctcatccccaacatgggagaaccataacgcagtgttctcagcagcgggattcaaagacatacggtcatataggtactgggatgcagagaaacgcggtctggacttacaaggattcctcaacgacttagagaatgctcctgagttttctatagtggtgctgcatgcgtgcgcccacaatccgaccgggattgaccccactcccgaacagtggaaacagatcgcctcagttatgaaacacaggttcctttttcctttttttgattccgcctaccaggggtttgcctctggcaacctggaacgcgatgcctgggctattcgttatttcgtctccgaagggtttgagtttttctgcgctcagtctttcagtaaaaattttgggttgtataatgaacgcgtaggcaacctgacggtggtcggcaaagagccggaaagtatcctgcaagtgttatcccaaatggaaaagatagtcaggatcacttggtctaacccacccgcccagggagcgagaatcgtggcctctaccttatctaatccggaactgtttgaagaatggaccgggaatgttaaaacgatggctgatcgcattctcaccatgagatcggagctgagggctcggctggaagcactgaaaactccaggaacttggaaccatataaccgaccagattggaatgttttcctttaccggcctgaatccaaagcaagtggagtatttagtgaatgagaagcatatctatctcttgccgagcggccggatcaatgtgtcaggcttgaccactaaaaacctcgattacgtcgccacgagcattcatgaagccgtcacaaaaattcagtag

SEQ ID NO: 189426 - DNA, 1101 bp, Artificial Sequence
  Description of Artificial Sequence: Synthetic coding sequence
atggccccccccagcgtgttcgccgaggtgccccaggcccagcccgtactggtctttaagctgactgcggactttagggaagatcctgatcctagaaaagtcaacctcggggtcggcgcctatagaaccgatgattcccccgccctaaaggaaaagcgggtgggaggggtgcagtcactcggaggcacgggagctttaaggattggagcagattttttagcgcgttggtacaacgggacaaacaataagaacaccccggtgtacgtctcatcaccaacatgggaaaatcacaacgctgtgttcagtgccgcaggcttcaaggatatacgaagttacagatactgggatgccgaaaaacgcggtctcgacctccagggctttctcaatgacctggaaaatgcccccgagttcagcattgtagtcttgcacgcctgtgcacataacccgacaggcatcgatccgacgcctgaacaatggaagcagattgcctcagtgatgaaacatcgttttctgttcccatttttcgattccgcataccagggtttcgcgagcgggaacttggagcgggatgcttgggccatacggtacttcgttagcgagggtttcgagttcttctgcgcccagtctttctcaaagaactttggactctacaatgagagagtcggaaatctgaccgtagttgggaaggaacccgaatccatcttgcaggttctgagtcagatggaaaaaattgtcagaatcacttggagtaaccctcccgcccagggagcccgcatagttgcctctactctgtcgaatcccgaattgtttgaggaatggacgggcaacgttaagacgatggccgatcgcatactcacaatgcgcagtgaactgagggcccggctggaggccctcaagaccccaggcacgtggaatcacatcactgaccagattgggatgtttagttttacaggcctaaaccctaaacaggtagaatatctcgtgaatgagaagcacatctacttattgccctccggaaggataaacgtctctgggctcaccactaagaatctggattatgtcgctacctctatccatgaagccgtgacgaaaatccaatag

SEQ ID NO: 189427 - DNA, 1179 bp, Artificial Sequence
  Description of Artificial Sequence: Synthetic coding sequence
atgcaggtgtggagcccctggaagggcgccatgtgcccccggccccacaaaccagcctaccggaccgacgattgccacccatgggtattgcctgtggtgaaaaaagttgagcagaaaatcgccaatgataactcacttaatcacgagtatctcccgatactggggcttgccgaatttcggtcctgcgcctcaagactcgccctcggtgatgactctcccgcactcaaggaaaaacgtgtaggcggcgttcagagccttggcggcacaggagctctcaggataggagccgactttctcgcacgctggtacaatggcacgaacaacaaaaacacgcccgtgtacgttagtagtccgacatgggagaaccacaatgcagtgttcagtgccgcaggatttaaagatatccggagctacagatattgggacgcggagaaacgcgggctggatctgcagggcttcctgaacgacctggagaatgcgccagaattctccatcgtggttcttcatgcatgcgcacacaaccccaccggcattgatcccacccccgaacagtggaaacagatcgcctctgtgatgaagcaccggttcttatttcctttctttgacagtgcttaccagggatttgcgtcaggcaacctggaaagagacgcgtgggctatccgttactttgtttctgaaggatttgaattcttctgcgcccagtcgttcagcaaaaacttcggactttataatgaacgggtgggaaacctgaccgtagtgggaaaggagcccgaatcgattctgcaggtcctgtctcagatggaaaaaattgtaagaattacctggtccaaccccccagcccaaggcgcccgtatcgtagccagcactctctctaatcccgagcttttcgaagaatggactggtaatgtgaaaactatggctgatcgaattttgactatgaggtccgaattacgcgcgagattagaggccttgaagacgcccggaacctggaaccatataaccgaccaaatcggcatgttctcttttacaggactcaacccaaaacaggtcgagtatcttgtgaacgaaaagcacatctacctgctcccaagcgggagaattaacgtcagcggcctcaccaccaagaacctggattatgtggctacatccattcatgaggccgtcactaagatccagtag

SEQ ID NO: 189428 - DNA, 1293 bp, Artificial Sequence
  Description of Artificial Sequence: Synthetic coding sequence
atggccctgctgcacagcggccgggtgctgcccggcatcgccgccgccttccatccagggctagctgccgccgctagtgccagagctagttcgtggtggacacacgtggaaatgggtccacccgatcccattctcggcgttactgaggcattcaaaagagacacgaacagcaagaagatgaacctaggggtcggcgcctatagagatgacaatggaaaaccttacgtactcccatctgttaggaaggctgaagcccagattgccgccaaaaacctggacaaggaatacctgcccatagggggcctcgctgaattttgcaaggcctccgcggagctcgcattgggcgagaattctgaagtcctcaagtctggccgatttgttactgttcagaccattagtgggaccggcgccctgcgaataggcgcctccttcttacagagattttttaagtttagtagagacgttttcctcccgaagcccacatggggtaatcatacccccattttcagggatgctggaatgcagttgcaagggtatcggtactacgaccccaagacctgcgggtttgattttactggggccgtggaggatatcagcaagatacctgagcagagcgtcctgcttctgcacgcatgtgcacataatccaacaggcgtggaccctcgaccagagcaatggaaggagatcgctaccgtcgtcaaaaaacggaatctgttcgcattttttgatatggcataccaagggtttgcatcaggtgacggcgataaggatgcatgggctgtccggcacttcatcgagcaggggatcaatgtgtgtctgtgccagtcctatgcaaaaaacatgggcctctatggtgagcgcgttggcgcgttcaccatggtttgcaaagatgccgacgaggccaagcgcgtcgaatcgcagctcaagattcttattagacccatgtactcgaacccccctctcaatggagcccgcattgccgccgctattcttaatactcctgaccttcgcaagcagtggctgcaggaagtcaaagttatggctgacaggattattgggatgagaacccagttggtatccaacctcaaaaaagaaggctctactcacaattggcagcacatcacggaccagatcggaatgttctgttttaccgggctgaagcccgagcaggtcgaaagactgatcaaagagttcagcatttacatgaccaaggatggcagaatcagtgttgccggagtgacttccagcaatgtggggtatctcgcccatgctatccaccaagtgacgaaatag

SEQ ID NO: 189429 - DNA, 570 bp, Artificial Sequence
  Description of Artificial Sequence: Synthetic coding sequence
atggccctgctgcacagcggccgggtgctgcccggcatcgccgccgcgtttcaccccgggctcgcagcggcagcctcagccagagcctcatcctggtggacgcacgttgagatgggcccacccgatcctattctaggggtgacagaggctttcaaacgggataccaattccaagaagatgaatctcggagtaggtgcctatcgggatgataatggcaaaccttatgtgctcccatccgtgcggaaggccgaagctcaaattgccgccaaaaacctagacaaggagtacttgcctataggcggattagctgagttttgtaaggattttctgagctcagctgagatgtctttctgccccaatcagcccggcgagacaacacacccatcaagcggcatgctcgcgtgtagttataaggttatcggaatcatgaccccacggctggccgtgctcacatcccaggccttatggaggatcttccagaagtaccagagccgagtgttctttttttgtatgcctgcccccaccattccacgtgagtggacacgggtgcgcaattcagggagaaagtag

SEQ ID NO: 189430 - DNA, 1164 bp, Artificial Sequence
  Description of Artificial Sequence: Synthetic coding sequence
atggccctgctgcacagcggccgggtgctgcccggcatcgccgccgcgttccacccaggcctggcggctgctgcctcagctagagcctcctcgtggtggacccatgtggagatggggccccctgaccctattctgggtgtcacggaagcatttaagcgcgatacaaactccaaaaaaatgaatctgggcgtcggggcctacagagacgacaacgggaagccctatgtgctcccatccgtcaggaagttcgtgacggtccagacaatctcaggcacaggggcattgcgcatcggcgcgtcgtttcttcagaggttcttcaagtttagccgcgacgttttcctgccaaagccaacatggggaaaccacacaccaatctttcgcgacgccggcatgcaactccaaggatatcgttattatgacccgaaaacctgtggcttcgacttcaccggtgccgtggaagacatttcaaagatccctgagcagtcagtgctcctcctacacgcctgtgcacacaacccaacgggcgtggacccccgcccggagcaatggaaagaaatcgccactgttgtgaagaaacgaaatctatttgcatttttcgacatggcttatcagggcttcgctagtggtgatggggataaagacgcatgggccgtccggcacttcatcgaacagggcatcaacgtatgcctgtgtcagagctatgccaagaatatggggctgtatggcgagagggtcggtgccttcactatggtgtgcaaggacgccgatgaggccaagcgcgtggagagccagctgaagatattgatcagaccaatgtactccaatccccccttgaacggggctaggatcgcggctgccattcttaatacgcctgacctgaggaaacaatggttacaggaagtcaaggtgatggcggacagaataatcggcatgcgtacccaattggtgtctaatctgaaaaaagaaggaagtacgcacaattggcagcacataactgaccagatcggcatgttctgcttcactggccttaagccagagcaggtggagcggttgatcaaagaattcagtatttatatgactaaagacggaagaatttccgttgccggcgtaacatcatctaacgtcggctacctggcacacgccatccaccaggtaaccaagtag

SEQ ID NO: 189431 - DNA, 1491 bp, Artificial Sequence
  Description of Artificial Sequence: Synthetic coding sequence
atggccagcagcaccggcgaccggagccaggccgtgcggcacggcttacgtgcaaaggtgctgacgctcgatgggatgaacccccgggtccgcagagtagaatacgccgttcggggtcccattgtgcagagggccctggagttggaacaggagctgcgtcagggggtgaaaaaacctttcactgaagttattcgtgctaacattggcgatgcacaggctatgggtcaaagaccaatcacgttcttgcgccaggttctggccctttgcgttaatcctgacctactaagttccccaaattttccagatgatgccaaaaagcgtgctgagaggatcctccaggcctgcggggggcacagccttggagcatattccgtgtcatcggggattcaattaattagggaggatgtagcccggtacatcgaaaggcgggacgggggcatccccgccgaccccaataatgttttcctgtctacaggtgcctcagatgccatcgtgactgtgttaaaattgttggtcgccggggagggccacaccagaaccggtgtgttgattcccatcccgcaatatccgttgtactccgccactcttgccgagctgggcgcagtgcaagtggactactacttagacgaggagcgcgcctgggctcttgatgtagcggagctgcatcgggcgctggggcaagcacgggaccattgccgcccccgagccttatgtgtgataaatccagggaaccccacgggccaggtacaaactcgcgaatgtatcgaagccgttatcagatttgcttttgaagagagactattcttgctggccgacgaggtgtatcaagataacgtctacgccgcaggctcccaatttcatagctttaaaaaggtgttaatggagatgggccccccttacgccgggcagcaggaacttgcaagctttcacagcaccagcaaaggctatatgggggagtgtggtttccgtggaggatatgtggaggtcgttaatatggatgcggcagtgcagcaacagatgctaaaactgatgtcagtgaggctttgtccccctgtgcctggacaagccctgctcgatcttgtcgtgagtccccccgctcctactgacccgtccttcgcccagttccaggcagagaaacaagccgttctggcagaactggccgcaaaagctaaactgacagaacaggtgttcaatgaagcccccggaattagttgcaacccagtacagggagcaatgtatagcttcccccgcgtgcaattgcccccccgcgctgtcgagcgggctcaggaattgggattggccccagacatgttcttttgcctacgtttactcgaagagaccggcatctgtgtggtgcctggatccgggttcgggcagagagaaggcacctatcacttccggatgaccatactaccaccactggaaaaactccgtcttttactggaaaagctgagtcgctttcacgctaaattcactctggaatactcatag

SEQ ID NO: 189432 - DNA, 1491 bp, Artificial Sequence
  Description of Artificial Sequence: Synthetic coding sequence
atggccagcagcaccggcgaccggagccaggccgtgcggcacggcctaagagcaaaagtccttacgctggacgggatgaaccctagggtgagaagagtggagtacgccgttcggggaccaattgtccagcgggcgctggagctcgaacaggagctgcggcaaggggtgaagaagcctttcactgaggtgatccgcgctaacataggcgacgctcaagcaatgggccagcgaccaattaccttcctccgacaagttttagcactgtgcgttaaccctgaccttctgagcagtcccaacttccccgatgacgctaagaaacgggctgagcgcatcttgcaggcctgtggggggcactctctgggtgcgtactccgtgtccagcggcatccagctaattagggaggatgtggcccgctatattgaaaggcgggacggcggcattccagccgaccccaataacgtcttcttgtccaccggcgcttctgatgcaattgtgacagtgctgaagttattggtcgcaggagagggccatactcggaccggcgtcctgatccccatcccacagtacccactttactccgccactttggccgaactcggagccgttcaagtggattattatctggatgaagagcgggcgtgggctctggacgtggcggagcttcacagagccctggggcaggctagggatcattgtcgcccccgagcactttgcgtaataaaccctgggaatccaactggccaggtgcagacacgggaatgtattgaagctgtcattcggttcgcctttgaagagcgcctctttcttctggctgacgaggtctaccaggataacgtttatgctgccggctcacagttccacagcttcaaaaaggtgctgatggaaatgggcccaccgtacgcgggccagcaggagctcgcatcctttcactcaacatctaaaggttatatgggagagtgcggtttcaggggaggctatgttgaggtggtcaatatggacgcagcagtgcagcagcagatgctgaagttaatgtccgtgcgtctttgtccaccagtccccggccaagccctgctggatctggtggtcagtccaccggcaccaactgatccatcattcgctcagttccaggcagagaaacaggctgtcctcgccgagctggctgcgaaggccaagctgactgagcaagtgtttaacgaggcaccagggatctcttgtaacccagttcagggcgccatgtactcctttccaagagttcagctcccccctcgggcagtcgaacgggcacaggagctgggtctcgctccagacatgtttttctgtttacgtctgctggaagagaccggcatctgcgttgtgccagggagcggctttgggcaacgtgagggaacttatcactttcggatgaccattcttccccctctcgaaaagctaagattgctgttagagaagttgtcccgtttccatgccaagtttacactagaatactcgtag

SEQ ID NO: 189433 - DNA, 2010 bp, Artificial Sequence
  Description of Artificial Sequence: Synthetic coding sequence
atgatgcggctgcggggcagcggcatgctgcgggacctgctgctgcgctcacctgctggggtcagcgctacccttagaagggcacagccactggtgaccctttgcaggaggccccgcggtggtggtagacctgcagcagggccagctgcagccgccaggctgcatccatggtggggcgggggtggatggccagccgaaccacttgctagagggttatcgagctctccttcagagatactgcaggagcttgggaaagggagtacccacccccagccgggcgtctcaccaccagctgctcccgcagcccccggtcctaaagatgggccaggagagactgacgcctttggcaacagcgaaggcaaagagctggtagcgtctggcgaaaacaagatcaagcagggcttattaccatctcttgaggatcttttgttctatactattgcagaaggtcaagaaaagattcccgtgcataagtttattacagcccttaaatcaacaggtctgaggacgagcgacccaagactgaaggagtgtatggatatgctgcgactcaccctccagactacttctgacggtgtcatgctcgataaggatcttttcaagaaatgcgtgcaatcaaacatcgtgcttctaacccaggcctttcggaggaagtttgtcattcccgatttcatgtcgtttacgtcacatattgatgagctgtatgagagcgctaagaagcagagcggcggtaaagtggctgactatataccccagctcgctaaattttcacccgacttgtggggagttagcgtctgcaccgttgacggacaaagacactccacaggtgataccaaagtgcccttttgtctgcaatcctgcgttaaaccacttaagtacgcaatcgccgtaaacgacctcgggactgagtatgtgcatagatatgttggaaaagagcccagcgggctgcgctttaacaagctattcctgaatgaagatgataagccccacaatccaatggtgaatgcaggcgcaattgtcgtaacttcactcattaagcagggagttaataacgcagaaaagtttgattacgtgatgcagttccttaacaaaatggcgggcaacgagtatgtgggcttcagcaacgctacgttccagtccgaacgggagtctggggaccgcaacttcgccatcggatactatctaaaagagaagaagtgctttccagaggggacagatatggtgggcatattggacttctattttcaactttgctccatagaggtgacatgtgagagtgcttccgttatggcggcaaccctggccaatgggggcttctgtcctattacaggagagcgcgttctgtcccctgaagctgttcggaatacactctcactgatgcatagttgtggaatgtacgacttctcgggtcagtttgccttccacgttggcctgccagccaaatcaggagtggccggaggcattctacttgtcgttccaaacgtgatggggatgatgtgctggtcaccacctctcgataaaatgggcaactcagtgaagggcatccacttttgccacgacctagtctcgttgtgcaatttccataattacgataacttgcgccactttgccaagaagctagaccccaggcgggaaggcggagaccagagggtcaaaagcgtgatcaacctgttattcgctgcttatactggagatgtctcagccctgagacgattcgccctgtccgcaatggatatggagcagcgggactatgacagcaggactgcacttcatgttgctgctgctgaaggtcacgtcgaagtcgtcaaattcctactagaggcttgtaaggttaacccattccctaaggaccgctggaacaacacaccaatggacgaggccctccattttggtcatcatgacgtgttcaagatacttcaagagtaccaggtccagtataccccccaaggtgacagcgataacggaaaggagaaccagactgtgcataagaaccttgatggtctgctctag

SEQ ID NO: 189434 - DNA, 1797 bp, Artificial Sequence
  Description of Artificial Sequence: Synthetic coding sequence
atgatgcggctgcggggcagcggcatgctgcgggacctgctgctgcgctccccagcaggagtatctgccaccctcaggagagctcagccgctagtcactctctgcagaaggcccaggggagggggaaggccggctgcgggtcctgctgctgctgccagactgcacccctggtggggaggtgggggatggccggccgaacccttagccaggggactgagtagctcaccctcagagattctccaagagctgggcaagggatcaacgcacccacaacctggagtctctcctcccgccgcccctgccgctcccggtcccaaggacgggccgggcgaaaccgatgccttcggcaactccgaaggtaaagaattggtagcctcaggtgagaataagattaagcagggattactgcccagcttggaggacttgctattctacacaatcgcagaagggcaggagaaaatcccggtccataagtttatcactgctctcaagagtactggactgcggaccagtgaccctcgacttaaggagtgcatggacatgctgaggttgactctgcaaaccacttccgacggagtaatgctggacaaagacctgttcaagaaatgcgtacagagcaatatcgttcttttaacccaggctttcagacgaaagttcgtgattccagattttatgagtttcacctcccacatagatgagctgtatgagtccgccaagaaacagtcaggtggaaaagtcgcggactacattcctcaattagctaagttctcaccagatctctggggtgtcagcgtctgtacagttgacgggcagcggcatagtactggagacaccaaagtaccattctgcctgcagagctgtgtgaaaccactgaaatacgcaattgctgtgaacgacttgggcactgaatacgtacacaggtacgtggggaaagaaccctctggcctgaggtttaataaattgtttctcaatgaagacgataagcctcataacccgatggtgaacgctggagcaattgtggtgacctctcttattaagcagggcgttaacaacgcggaaaaatttgattatgttatgcagttcctgaacaagatggcaggcaacgaatacgtgggattcagtaatgccaccttccagagtgagcgagagagtggcgataggaacttcgcaatcggctattacttgaaggaaaaaaagtgcttcccggaggggacagacatggttggcattctggacttctacttccagctgtgttctatagaagtgacctgtgagtccgcatcagtgatggctgctacattggccaacggggggttctgccccatcaccggggagagagtgctgtcacccgaggccgtgagaaacacactgtctcttatgcatagttgcggtatgtacgacttcagcggacagtttgcttttcacgtcggcttgccagctaaaagcggagtagcaggaggaattcttcttgtagtcccaaatgtgatgggtatgatgtgctggtcgcctcctttagacaagatgggaaatagcgtgaaggggattcacttttgccatgatcttgtgagcctgtgtaattttcacaactacgacaatctgcgccactttgctaagaagctggaccctcggcgcgagggaggcgaccaacggcattcatttggcccacttgactatgaatcactccaacaggagcttgccttaaaagagaccgtatggaaaaaagtaagcccagagtctaacgaagacatctctaccaccgtcgtgtacagaatggaatccctgggagagaaatcttag

SEQ ID NO: 189435 - DNA, 525 bp, Artificial Sequence
  Description of Artificial Sequence: Synthetic coding sequence
atgggcatgatgtgctggagcccccccctggacaagatgggcaactctgtaaaggggatccacttctgccacgatttagtttcgctatgcaactttcataactacgacaatttacggcactttgcaaaaaagctcgaccctcggagagagggcggagatcaacgcgtcaagtctgttatcaacctgttgtttgctgcctatacaggggacgtcagtgcacttaggcggttcgcactgtccgcaatggatatggaacagcgcgattatgactctcgcactgccctgcacgtggcagctgcggaggggcatgtggaagttgtcaagttcctgctggaggcctgtaaggtgaatccatttcccaaggatagatggaacaatacccctatggacgaggcactccacttcggccaccatgacgtcttcaagatcctgcaggagtatcaggtgcagtatacccctcaaggcgattcagacaacggtaaggagaaccagaccgtccataagaaccttgatggcctcctgtag

SEQ ID NO: 189436 - DNA, 1809 bp, Artificial Sequence
  Description of Artificial Sequence: Synthetic coding sequence
atgcggagcatgaaggccctgcagaaggccctgagccgggccggctcacactgcggcagaggcggttggggacatcccagtagatcgccgctgctgggaggtggagtgcgtcaccatctgtccgaagcggccgcccagggaagagaaaccccccattctcatcagccccagcatcaggatcacgatagttctgagtctggaatgttatctcggttgggggatctgcttttttatacgatcgctgaaggccaagagaggataccaatacacaaattcaccactgccctgaaagccactggacttcagaccagcgacccccgtctgcgagactgcatgtctgaaatgcacagagtggtccaggagagttcatctggcggtctcctagacagagatctctttagaaagtgtgtctcgagtaacattgttctgctcacacaggcatttcgcaaaaaattcgtcatcccggattttgaagaattcaccgggcatgtcgatcgtatcttcgaagatgtgaaagagctcaccgggggcaaagttgctgcctacatccctcagctggctaaaagtaacccggacctgtggggcgtctccctttgcacagtggacgggcagagacattccgtcggccataccaagatccccttctgtctgcaatcttgcgttaagccactcacttacgccatatcaatatctactcttggcaccgattacgtgcacaaattcgtgggcaaagagccatccggcctgcgctataacaagctctcgctcaatgaggagggaattccacataacccaatggttaacgcaggagccattgtcgtgtctagcctgatcaagatggactgcaataaggccgagaaattcgatttcgtgctgcagtatttgaataaaatggcgggaaacgaatacatgggcttttccaacgctacctttcagtctgagaaggagaccggggatcgcaactatgctatcggttactaccttaaggagaaaaaatgctttccaaagggtgtcgacatgatggcagccctggatctctactttcagctgtgttcagtagaggtcacctgtgagtccggctctgtcatggccgcaacactagccaatggaggcatttgtccgatcactggcgagtctgtgctatcagcagaggcggttcgaaacacactttcccttatgcacagctgtggcatgtacgatttctcaggacagtttgcattccacgtcggcttgcccgccaagtcagcagtgagtggcgctattctgcttgtggtgcccaatgtcatgggaatgatgtgcctgagccctcctctcgacaaattgggcaacagccaccggggcacgagcttctgccaaaagttggttagcctcttcaacttccataactacgataacctgagacattgcgccagaaaattggatcctcgtcgcgagggcgcagaaattcggaataaaacagtcgtgaatctcctgttcgcagcgtattcgggggacgtgtcagctttgaggcggtttgcgctcagcgccatggacatggagcagaaagactatgattctcgaacggctctccacgtggcagctgccgaaggacacattgaagtcgttaagtttcttattgaggcctgcaaggttaacccgttcgcaaaagatcgatggggcaatatccctcttgacgatgctgtgcagttcaaccatctcgaagtggtgaagttgcttcaggattaccaggacagttataccctgtccgaaacacaggccgaagcagcggcagaagcgctctctaaggagaacctggaaagcatggtgtag

SEQ ID NO: 189437 - DNA, 534 bp, Artificial Sequence
  Description of Artificial Sequence: Synthetic coding sequence
atgcggagcatgaaggccctgcagaaggccctgagccgggccggctctcactgtggccgagggggctggggccatccatcccgatcacccctgctcggtggcggggttaggcaccatctgtctgaggccgctgctcagggccgcgaaactcctcactctcaccagccgcagcaccaggaccacgactcatccgagtccggaatgctgtctcgcctaggcgacctgttgttctatacaattgctgagggccaggagaggatcccaattcacaaattcaccactgcactcaaagcaaccggcctgcagacatccgatccccgcctcagggactgtatgtctgagatgcaccgggtggtccaggagagcagtagtggtggattgttggaccgagacctatttcgcaagtggcagccaacgtcgttgagctggccatcacagacgcagacttgtggggtttctccatgcgccttatggatggtcaacgggacactgtgggccacgcagcgatcgccctcagcctgcagtccagtctag

SEQ ID NO: 189438 - DNA, 2049 bp, Artificial Sequence
  Description of Artificial Sequence: Synthetic coding sequence
atgtgcggcatcttcgcctacatgaactaccgggtgccccggacccggaaagaaatcttcgagactctgattaaaggcttgcaaagactcgagtaccggggttatgatagcgccggcgtggcgatcgatggcaacaatcatgaagtgaaggagagacatattcagcttgtaaaaaaacgcgggaaggtcaaagctctcgatgaggaactctacaaacaagattcaatggatctcaaggtcgagttcgaaacacacttcggcattgcacatacccggtgggctactcacggagtgccctctgcagtcaattcccaccctcagcgcagtgataagggtaatgagtttgtggtcattcacaatggcattataacaaattacaaggacttgcggaagttcttagaatctaaagggtacgaattcgagtcagagacagatacagaaaccatcgcaaaacttataaagtatgttttcgataaccgcgagaccgaagatattacgtttagtacactagttgagcgcgtcattcagcagctggagggcgcatttgccctggtctttaagagtgttcattatccgggcgaagccgttgctactcgacgcggctcacccctcctcattggggtccggtcaaaatataagctgagtaccgaacaaatccccatcctctaccgcacatgcacgctggagaatgttaagaatatctgtaagacccgcatgaaacgtcttgattcctcagcctgcttacatgccgttggagacaaagctgtcgaattcttcttcgcctcagacgcctccgccataattgaacacaccaacagagtgattttcttggaagacgatgatattgccgccgtggccgatggaaaactgtctattcatcgagtgaaacggagtgcctctgacgaccccagtagagccattcagaccctgcaaatggaattgcagcaaatcatgaaggggaacttcagcgcctttatgcagaaggagatattcgaacagcccgaaagcgtgttcaatacaatgagaggccgagtgaattttgaaaccaacactgtgctcttgggtggcctgaaggatcatctaaaggagatcaggcgatgtcgtcgattgattgtgatcggatgcggtacctcttaccatgctgcagtggctacccgccaggtgctggaggagctgactgagttgcccgtgatggtagaactggccagtgattttctcgacagaaacacacccgtgttcagggatgacgtgtgcttttttatctcccaaagcggagagacagcggacacactgcttgccctgaggtactgtaaggatcggggggcgttaactgtgggagtgaccaacacagtgggctcatccatttcccgggagactgattgcggcgtacatataaatgcgggacccgaaatcggagtggcctccactaaagcgtacacaagccagtttatctcactcgtgatgtttggtctgatgatgtccgaggacagaataagcctgcagaatcgcaggcaagagataatccgggggttgcgatcacttcctgagctgatcaaggaagtacttagcctggaggagaagatacacgatctggcattagaactttatacacagcggtcactgctcgttatggggaggggctacaattacgccacttgtctggagggggcccttaagattaaagagattacatacatgcatagcgaaggaattttagccggggagctgaaacatgggccacttgcccttatcgataaacagatgcctgtcatcatggttatcatgaaggatccttgttttgccaaatgtcagaatgcccttcagcaggtgaccgccagacagggtcggcccattatcttatgttctaaagacgacaccgagtctagtaagtttgcttacaaaaccattgaactaccccataccgtcgactgcctgcagggcatactctcagttatcccactgcaactgttgtccttccacctcgccgttctccggggatatgacgtggatttcccaagaaacctggccaaatctgtgacagtggagtag

SEQ ID NO: 189439 - DNA, 1086 bp, Artificial Sequence
  Description of Artificial Sequence: Synthetic coding sequence
atggccggcggccggcaccggcgggtggtgggcaccctgcacctgttattattggtggctgctctgccctgggcctctcgcggcgtgagtccttccgcctcagcatggcccgaggagaaaaactatcaccagcctgctattctgaactcttcagccttacgccagatcgccgaaggcacatcaatctcagagatgtggcagaatgatttgcagcccctgctgattgagcgatatcctggtagtcccgggtcttatgccgctcgacagcatatcatgcagcgtattcagcgactgcaagctgactgggtactggagatcgacacatttttgagccaaacaccttatgggtacaggagtttctccaacatcatcagcacactgaatcctactgcgaaacgccatctcgtcctggcatgccactatgatagtaagtacttcagtcactggaacaacagggtttttgtcggcgctaccgattccgcagtaccctgtgcaatgatgttggaacttgctcgcgcactggacaaaaaattgctgagcctgaagacagtgtcagattccaaacctgatcttagtctgcagctcatattctttgatggcgaagaggctttcctgcattggtctccacaggatagcctgtacggaagtagacacctggctgccaagatggccagcactcctcacccccccggtgcaaggggaacaagccagctgcatgggatggacctccttgtcctgcttgacctaattggcgctcccaatcccacctttcccaatttctttccaaacagtgccaggtggttcgagcggctgcaagccatagagcacgagcttcatgagctgggattgcttaaggatcattccctggaaggccgctacttccagaactatagttatggaggtgtgatccaggatgaccacatccctttcctgcgaaggggtgtccccgttctccacctgatcccttcacctttccccgaggtatggcatactatggatgacaatgaagagaatctcgacgagtcaaccatcgataatctgaacaagatcctacaagtgttcgtgctggaatatctgcacctgtag

SEQ ID NO: 189440 - DNA, 939 bp, Artificial Sequence
  Description of Artificial Sequence: Synthetic coding sequence
atggccggcggccggcaccggcgggtggtgggcaccctgcacctgctgctgctcgttgccgctttgccttgggcctcccgcggggtttcacctagcgcttctgcctggcctgaagaaaaacatataatgcagcgcatacaaaggttgcaagcagactgggtgctggaaatcgatacctttcttagtcagaccccgtacgggtacagatcgttctccaacattatctcgaccctgaacccaactgccaagcggcacctggtgttggcttgccactatgacagcaagtacttttcacactggaacaaccgggttttcgtgggcgcaactgactccgccgtgccatgcgccatgatgctggagttagctcgcgctctggacaaaaagcttctctcactgaaaactgtctccgactctaagccagatctgtcactgcagctgatcttttttgacggcgaagaggccttcctgcattggtcgccccaagactccctctacggtagcagacacctcgccgcaaagatggcatcaaccccccatcctccaggtgctcgtggtaccagtcagttgcatggcatggacctcttggtgctattggacctgattggggcaccaaacccaaccttccccaacttttttcctaactccgcccgctggttcgagcgcttacaggcaatcgagcacgaactgcatgaacttgggctgctgaaggatcactctctggagggtagatactttcagaattatagctatggtggggtgatccaggacgaccacatccctttcctacgcagaggcgtccctgtgcttcacctgattcccagcccgttccctgaagtttggcatactatggacgataatgaggagaacctcgacgagagcacaatcgacaatctcaacaagattcttcaggttttcgtgttagagtatctccatctctag

SEQ ID NO: 189441 - DNA, 2328 bp, Artificial Sequence
  Description of Artificial Sequence: Synthetic coding sequence
atggccgccctggacagcctgagcctgttcaccagcctgggcctgtcagaacagaaggctcgggagacactgaagaattccgctctgagtgcccagttaagagaagcagccacccaggcccagcagacactgggctccacaattgataaggcgaccggcattctcctgtatgggttagcctctcgacttagagacacccgcaggttgtcttttctggtgtcctatattgctagtaaaaaaattcatactgagccccagctgtccgctgccctggaatacgtaagaagccatccacttgatcccatagatacagtcgattttgagcgcgagtgcggtgttggcgttatagttacacccgagcagattgaggaggcagtggaggctgcaataaatagacacaggcctcagttactcgtggagaggtatcacttcaacatggggctcctgatgggcgaagctcgggcagtgctaaagtgggctgatggcaaaatgatcaaaaacgaggtcgacatgcaggtactgcacctcttgggtccaaaattagaggctgacctggaaaaaaaattcaaggtggcgaaggcccggctcgaagaaactgaccggcggaccgccaaagacgttgtggaaaacggcgagacagcagatcaaaccctgtccctcatggaacagttacgtggagaagccctgaagttccataaaccgggggagaattacaagacaccagggtacgtggttacaccacacacaatgaatcttcttaaacagcatctggagatcacaggcggccaagtccgcacccgattcccacccgaacctaacggaattctgcacattggacacgctaaggccatcaatttcaactttggctatgcgaaagcgaataatgggatttgcttcctgcgatttgacgacactaaccctgagaaggaggaagctaagtttttcactgccatctgcgatatggtcgcatggctgggctacacaccatataaggtaacatatgcaagcgactacttcgatcagctttatgcctgggcagtagaactgattagacgtggtttggcctacgtgtgtcatcaacgcggcgaggagttaaaagggcataatactcttccatctccatggcgggacaggcccatggaggagtcactcctgctgttcgaggcaatgcgtaagggcaaattctccgaaggggaagccaccctgcgaatgaagcttgtaatggaagatggtaaaatggaccctgtcgcgtaccgagtgaagtacaccccccatcatcggaccggcgacaaatggtgcatctatccaacgtacgattatacacactgcctgtgcgactcgatcgagcacattacccattcactttgtacgaaagagttccaggccagacgttcttcatacttctggctctgcaatgcactggacgtctattgcccggtgcagtgggaatacggcaggctcaatttgcactacgctgtggtgtcgaaacggaagatcctgcagttggtcgccactggagctgtgagagactgggacgatcctaggctgtttaccttaaccgctctccgacggagaggttttccccccgaggccattaacaacttctgcgctagagtgggtgtgacagttgcccagaccaccatggaaccacatttgctggaagcatgcgtccgggatgtgctcaacgatacggcccctcgggcaatggccgtgctcgaatcccttcgcgttattataacgaacttcccggcggccaaaagcttggacatccaggttcccaacttccctgccgatgagactaaaggattccaccaggtgccattcgctccgatagtgttcatcgaacgaacagactttaaggaagagccagagccaggatttaagcgactcgcctggggacagcccgtcggcttgcgtcacaccggttacgtcattgagctccagcacgtggtgaaggggccatctggatgtgtagagtccttggaagtcacttgccgaagagcagatgcgggagagaaaccaaaggccttcatacactgggtgtcgcagcccttgatgtgcgaggtgcgactctacgaaaggctcttccaacataagaacccagaggaccctactgaagtgcctggcggattcctttcggacctaaacctcgcttctcttcacgtggtcgatgctgctctcgtggattgttccgtggcgcttgccaagccattcgacaaatttcaattcgaacgcctcgggtatttttcagtggacccagactctcatcagggtaagttggtgttcaacagaactgtaactctgaaagaagatcccggcaaagtgtag

SEQ ID NO: 189442 - DNA, 2295 bp, Artificial Sequence
  Description of Artificial Sequence: Synthetic coding sequence
atggccgccctggacagcctgagcctgttcaccagcctgggcctgtcagaacagaaagcacgggaaaccctcaaaaattctgccctcagtgcacaactcagagaggcagcaacccaggcacagcagacactaggatctaccatagacaaagctactggaatccttctttatggcctagcctcgaggttaagagacaccaggcgcctgagttttttggtgtcatacatcgcaacagcactggaatatgtccgaagtcaccctctagaccccattgatactgtggacttcgagcgggagtgcggtgtgggcgtcattgttacaccagagcagattgaagaggccgtggaagcggcaataaaccggcacaggccacagctgctcgtggagcggtatcactttaacatgggcctgttaatgggtgaagcaagggccgtgctcaaatgggccgatggtaagatgattaaaaacgaagtggatatgcaagttcttcacctgctgggccctaaactggaagccgatctggagaaaaagttcaaggttgccaaggcccgacttgaggaaaccgaccgccgaacggccaaggacgttgttgagaatggggagactgcagaccagaccctcagcctgatggagcagctgcgcggagaagccctgaaatttcacaaacccggggagaattacaaaactcctggctacgtcgtcacgccccacacgatgaatctgcttaaacaacacctggagattacaggcgggcaagtgcggacaaggtttcctccagagcccaacggaatcctccacattggacatgccaaggctattaatttcaactttggttatgcaaaagccaataacggtatctgctttctgaggttcgacgacactaatccggaaaaggaggaagcaaagttcttcactgccatctgtgacatggtagcttggttgggctacaccccctataaagtaacctacgcctccgactacttcgaccagttgtatgcgtgggccgtggaactcatcaggcgcggactggcatacgtgtgccaccaacggggagaggagctgaaagggcataacacccttccctctccatggcgggatagaccaatggaagagagcttgcttctgttcgaggctatgcggaaagggaagtttagcgagggtgaagccacgctgcgaatgaagctggtaatggaggacggcaagatggatcccgtagcatacagggtaaagtacacgccccaccacagaaccggcgacaaatggtgtatttaccctacatacgactatacccattgcttgtgtgatagcattgagcacatcactcacagcctctgcaccaaggaattccaagcaaggcgttcgagctatttttggctgtgcaacgccctggatgtgtattgccccgtccaatgggaatacggtcgcctaaatctgcattacgcagtggtgtccaaacgaaagatcctgcagctggttgccacaggcgcagtaagggactgggatgatccgcgccttttcactcttacagccctcagaagacgcgggtttccgcctgaggctatcaataacttttgcgcccgcgttggggtaacagtggctcagactaccatggaacctcacctgctggaagcctgtgtgagggacgttctgaatgacaccgctccaagggccatggctgtcctggaatctctgagagtcattatcaccaatttccccgccgccaagtccctggacattcaggtacctaactttcctgcagacgagactaaggggtttcatcaggtacccttcgcccctatcgtttttattgagagaaccgactttaaggaagagccggaacccggcttcaaacgccttgcttgggggcagcccgtcgggcttagacacacagggtatgtgattgagcttcagcatgttgtgaaagggcctagtggctgcgtggaatccctggaggtgacttgccgccgggccgatgctggagagaaacctaaggcttttatccactgggtgagccagccgctgatgtgtgaagtgcggctatacgagcggctgtttcagcacaagaaccccgaggacccgacagaagtgccgggagggttcctatctgaccttaatctagccagtttgcatgtggttgacgctgctctcgtggactgctccgtggccctcgcaaagccattcgacaagtttcagtttgaacgcttaggctacttttccgtggacccagactcccaccagggtaagctagttttcaatcgaacagtcactttgaaagaggaccccggcaaagtatag

SEQ ID NO: 189443 - DNA, 849 bp, Artificial Sequence
  Description of Artificial Sequence: Synthetic coding sequence
atgcccacctgccggctgggccccaagttcctgctggtgagcggcgtgagtgcaatggccgcccttgactcactgagcctcttcacatcattagggctgtccgaacagaaagcccgcgagaccctaaaaaattcagcactttcagctcagcttcgtgaggccgctacacaggcccagcagacactcggcagcacgatagacaaggccaccgggattttgctttatggactcgccagccgactgcgggacacccggaggctgtccttcctggttagttatatcgcaagcaagaaaatccacaccgagccgcaactctccgccgcccttgagtacgtgcgctctcatccccttgatcccatcgacacagtggattttgagagagaatgtggagtcggagtaattgttacacccgagcaaattgaagaggccgtggaagcagcaatcaaccgacacagacctcagctgttggtcgagcgctaccatttcaacatgggtctcctgatgggagaagctagagcggtcttgaagtgggcggacgggaaaatgatcaaaaatgaggtggacatgcaggtactgcacctcctcgggcccaagctggaggctgatctagagaaaaaattcaaggtggcaaaggcccgcctggaagaaacagatcgccgaacagcaaaagacgtggtggagaacggcgaaacagctgatcagacgttatctctaatggaacagctgcgtggcgaggccctaaagttccacaagccgggaacctatcccgtcccagcccgcacccagtggaatcctgcatattggacttgccagtctcatcaattccaactctggctgtgccaggtttag

SEQ ID NO: 189444 - DNA, 2874 bp, Artificial Sequence
  Description of Artificial Sequence: Synthetic coding sequence
atgaacttcgccgagcgggagggcagcaagcggtactgcatccagaccaaacacgtggcaatactgtgcgctgttgtagtgggtgtgggattgatcgttggcctggccgtgggactaacacgctcatgcgatagtagcggagatgggggtccaggaacagcacccgctccatcacacctaccaagtagtacagcttcacctagcggaccccccgcgcaagatcaagatatctgtcctgcctccgaggatgagagtggtcagtggaagaatttccgcttacctgattttgtgaaccccgtgcactacgacctacatgttaagccactgcttgaggaagacacgtacaccggaaccgtgtccatctccattaatttgtccgccccaacacggtacctgtggctccatcttagggagactcggattacacggctgcccgaattaaagagaccttcaggtgaccaggtccaggtgcgccggtgttttgaatataagaagcaggagtacgtggtggtggaggcagaagaggaactgactccctcctctggtgacggcctgtacctgctaacaatggaattcgctggatggcttaacgggtctttagtgggattttacagaacaacctacaccgaaaacggccaggtaaagagtattgtagccactgaccacgagcctactgatgccaggaagtcgtttccctgctttgatgagcccaacaaaaaagctacttatacaatttctatcacccatccaaaggaatacggtgccttaagtaacatgcctgttgctaaggaggagtcagtggacgataaatggacaagaacaacctttgaaaagagcgtgcccatgtcaacctatctggtctgttttgctgttcatcagtttgacagcgttaaaagaatcagcaactccggaaagcccctgaccatatacgtgcagcccgaacaaaaacacacagcagagtacgcagccaatatcaccaaaagcgtattcgactatttcgaggaatattttgccatgaattactccttgcctaaactcgacaagatagccattcccgacttcggaaccggcgctatggagaattgggggcttatcacctaccgggaaacaaacttgctgtacgaccccaaagaaagtgcctcaagcaaccagcagcgggtggccaccgtcgtggctcacgagctcgtgcatcaatggttcggtaatatcgtgacaatggattggtgggaggacctctggctcaacgaaggctttgccagcttcttcgaatttcttggagtcaatcacgcggagacagattggcagatgcgtgatcagatgctgttggaagatgtgttaccggtacaggaagatgattctctgatgagtagtcatccaattattgtaacagtgaccacccccgacgagatcaccagcgtgtttgatggcatttcctactccaaaggttcaagtattctcaggatgctggaggattggattaagcctgagaactttcagaaaggctgccagatgtacttagagaagtatcagtttaagaatgcaaaaaccagcgacttttgggctgccctagaggaagccagtcggctgcctgtcaaggaagttatggatacatggacacgacagatgggctatccagtgctgaatgtcaacggggttaagaacatcacccagaaacgtttcctcttagacccccgggccaatccctcccagccaccaagcgatcttgggtatacctggaatattccagtgaagtggacggaggataacatcaccagctccgttttattcaaccgctctgaaaaggaaggcattacactcaacagctctaatcctagtggtaatgcatttcttaagataaatccagatcacatcggcttctatcgggtaaactacgaggtggcaacctgggacagtattgcaactgccctgtcattaaaccataaaacttttagcagtgcagacagagcctctctgatcgacgatgcatttgcgctggcacgggcccagctgcttgactacaaagtggcgctgaaccttactaagtatctgaaacgggaagaaaatttcttaccctggcagcgggtgatctcagccgtcacatacatcattagcatgttcgaagacgataaggaactctacccaatgattgaggagtattttcagggccaggttaaacctatcgcagactccctgggctggaacgacgccggtgaccacgtgactaagctcctgaggtcctcagtgctgggattcgcctgcaaaatgggcgatcgagaggctcttaataatgcgtcaagccttttcgagcaatggcttaatgggacggtcagcttgcccgtcaacctacgcctcctagtttatcggtatgggatgcagaacagcggcaacgagatctcatggaactatacactggagcagtaccagaagacatcccttgcccaggagaaagaaaagctgttatacgggctggcatctgtcaagaatgttacattgctttcacgctacctagacctgctgaaagatactaatctaatcaagacccaggacgtgttcactgtaatcagatatatctcttacaatagttacggcaagaacatggcatggaactggatccagctgaattgggactacctggtaaatcgctacacactcaacaaccgaaacttaggtaggatcgtaaccattgcggagccttttaacaccgaactccagttatggcagatggaaagctttttcgcaaagtatccacaagccggcgccggagagaagccacgcgagcaggtgctggagaccgtgaaaaacaatatcgagtggctgaagcagcaccgaaacacaatccgggaatggttcttcaacctattagaatcaggatag

SEQ ID NO: 189445 - DNA, 4539 bp, Artificial Sequence
  Description of Artificial Sequence: Synthetic coding sequence
atggccaccctgagcctgaccgtgaacagcggcgacccccccctgggcgctttactggcagtagaacacgtcaaagatgacgtcagcatcagtgttgaggaggggaaagaaaacatcttacatgtgtccgagaacgtgattttcaccgatgtcaatagcattctgagatacctggcaagggtggccaccacagcgggcttgtatggctccaatctgatggaacacacggagatcgatcactggctggaatttagtgccacaaagctgtcctcttgcgattcttttacatccacgattaatgagctcaaccactgcctgtccctccggacctatctggtggggaacagtttgagcctggcagatctttgtgtttgggccacccttaaggggaacgctgcctggcaggagcagttaaagcagaaaaaggcgcctgtgcatgtgaaacgttggttcggcttccttgaggctcagcaggccttccaatcggtgggtactaagtgggatgtcagtaccactaaagccagggtagcccccgaaaaaaagcaggatgttggcaagttcgtggaactgcccggcgctgagatgggcaaggtgactgtgaggtttcccccagaggcttccggttatctacatattggtcacgccaaggccgccctgctgaaccagcattaccaggtgaacttcaaaggcaaactgataatgagatttgacgacacaaacccagaaaaagaaaaggaagattttgagaaagtgatcctggaggatgttgcgatgctgcacatcaagcctgaccagtttacctatacgtccgatcacttcgagaccatcatgaagtacgccgagaagctgattcaagagggcaaggcttatgtggatgatactccagcagaacagatgaaagctgagagggagcagagaattgacagtaagcaccgcaagaaccctattgagaagaacttacaaatgtgggaggagatgaagaaaggctcgcagttcggccagagctgttgtcttcgggctaagattgatatgagtagtaataacggctgtatgcgagacccaacgctgtacaggtgtaaaattcagccacatccccggacagggaacaaatacaatgtctatccaacctacgatttcgcctgtccgatcgtggacagtattgagggcgtcacgcacgcgctgcgcactaccgagtaccacgaccgcgatgaacagttctattggattattgaggcacttggcataagaaaaccctatatctgggagtatagtcgcttaaacttgaataatacggttcttagtaagaggaagcttacttggttcgtgaatgagggcctcgtagacggttgggacgatccgcgttttcccactgtgcgcggcgtgcttcggcggggcatgacagtggaggggctgaagcaattcatagcggctcagggaagcagccggtcagtggtgaatatggaatgggacaagatttgggccttcaacaagaaggttattgaccccgtggcccctcggtacgtggcactgctcaaaaaggaagtgatccctgtcaacgttccagaggctcaggaagagatgaaggaagtagctaaacaccctaaaaatccagaggtgggcctaaaaccggtttggtactcacccaaagtgttcattgaaggtgctgacgctgaaactttctccgagggtgaaatggttacattcattaactggggtaacctcaatataactaagatacataagaatgccgacgggaagattatttcactagacgctaaattgaacctggagaataaagactacaaaaagacaaccaaggtcacctggctggctgaaaccacgcacgccttgcccattcccgtgatttgcgtcacttacgagcacctcatcaccaagcctgtgctcggaaaggacgaggactttaaacagtatgttaataaaaattccaaacacgaagagttgatgctcggcgacccctgcttgaaggatctgaagaaaggagatattattcagctgcagcggcgcggtttttttatctgcgatcagccatatgagcccgtcagtccctactcatgtaaagaagccccgtgtgtcctgatctacatccctgacggccacactaaggagatgccgacatcaggcagcaaggagaagacaaaagtggaagccaccaagaatgaaacaagcgctcccttcaaagaaaggcccacgccgtcactaaataataactgcacgacttcggaggatagtctggtgctatacaatagagtcgccgttcagggtgatgtcgttagagagttgaaagctaagaaggcgcccaaggaggatgtcgatgctgctgtgaagcagctcttgtccctcaaagctgaatacaaagagaaaacgggccaagagtacaagcccggaaatcctccagccgagatcggacagaatatttcttcaaattcaagcgcatccatccttgaatccaaaagtctctatgacgaagtggctgcgcaaggcgaggtcgtgcggaaactcaaagctgagaaatcacccaaggctaagatcaatgaggcagtggaatgcttgctgtccctcaaggcgcagtacaaagaaaagactgggaaagagtacattcccggtcaaccgcctctgagccaatcatcagacagctcacctacaaggaactcagagcccgctgggctcgagacgccagaggccaaggttctgtttgacaaagttgcctctcagggagaagtggtgcgcaaactgaagacagaaaaagctcccaaagaccaggtggacatcgctgtgcaggaactcctgcagttgaaggcacaatacaagtctctgatcggggtagagtataaacccgtgtccgccaccggggcggaggataaggacaaaaaaaaaaaggagaaagagaacaaaagtgagaaacagaataagccccaaaaacaaaatgatggccagcggaaggatccctctaagaaccaaggtggaggcttatccagttccggggcgggggaggggcaaggtccaaagaaacagacgcggctcggacttgaagcaaaaaaggaggagaatctggcagattggtacagccaggtgataacaaaaagtgagatgattgaatatcacgatatctcagggtgttatatcttaaggccttgggcctacgccatttgggaggccataaaggatttctttgacgccgagatcaagaagctgggagtggagaattgttatttccccatgttcgtgtctcaaagcgcactcgaaaaagaaaagactcacgtagcagattttgctcccgaggtggcgtgggtgaccaggtccggcaagaccgagcttgctgaacccatagccatcagaccgacctcagagaccgtcatgtacccagcttatgcaaagtgggtgcaatcacaccgggacctgcctatcaaactgaatcagtggtgtaatgtggtgagatgggagtttaaacatccccagccattcttgaggacaagagagtttctttggcaagagggacactccgctttcgctaccatggaggaagctgccgaggaggtgctccagatacttgatctctacgcccaagtctacgaggaacttctggccatcccagtggttaaaggaagaaagacagaaaaggagaaatttgcaggaggtgactatactaccaccatagaggcatttatctcggcctcgggcagggctatccaaggggggacgtctcaccatctggggcaaaattttagcaagatgtttgagattgtcttcgaggaccccaaaatcccgggcgagaagcagttcgcctatcaaaacagttggggcctgaccacacgcacgatcggagttatgacaatggtgcatggcgacaatatgggccttgtgttgcctccacgcgtcgcttgcgtccaagtggtgataatcccttgtgggatcacaaacgctctgagcgaggaagacaaagaggcactgatcgccaagtgcaacgactataggcgacgtctgctctcagtaaatatcagagtccgggccgatctgagagacaactatagcccgggatggaaattcaaccactgggaactgaagggcgtcccaattagactcgaagtgggtccaagggacatgaagagttgccagtttgtggcagtcaggcgagacacaggtgaaaagcttaccgtcgctgaaaatgaagcagagacaaagctccaagccatcctggaggacatccaggtgaccctcttcacccgcgcaagcgaggatttaaaaacacacatggttgtggctaacaccatggaggatttccaaaaaattcttgacagcgggaaaatcgtccagatacctttttgtggagagatagattgcgaagactggatcaaaaagaccactgctcgggatcaggatctggagcctggcgcgccatctatgggtgctaagagtctttgtattcccttcaagcccctatgcgagctgcagcccggggccaagtgtgtgtgtggcaaaaatcccgcaaaatactatactctgtttgggcgctcctattag

SEQ ID NO: 189446 - DNA, 2964 bp, Artificial Sequence
  Description of Artificial Sequence: Synthetic coding sequence
atggccaccctgagcctgaccgtgaacagcggcgacccccccctgggggctctcctcgctgtggagcatgtaaaggacgatgtcagcatctctgtggaggaaggaaaggagaacatcttgcatgtaagcgaaaatgtcattttcacggatgtaaactctattttacggtatctggctcgcgttgcaaccacggctgggctttatggaagcaacttgatggagcatacggagatcgaccattggttagagttttctgccaccaaacttagttcatgcgactccttcacctctactatcaacgagctgaatcattgcctatccctgcgcacgtatctggtcggcaatagtctgtctctggccgatctctgcgtctgggcaactttaaagggtaatgcagcctggcaggagcagctgaagcagaagaaggcccctgttcatgtgaaaagatggttcggcttcttagaagcacagcaagcatttcagtcggtcggcaccaaatgggacgtcagcacaaccaaggctcgcgtggcgccagaaaagaagcaggatgtgggcaagtttgtcgagctacccggcgccgaaatggggaaggtgactgtgagattccccccagaagccagcggttacctgcacataggccatgcaaaggctgctcttctcaaccaacactaccaagtaaatttcaaggggaagcttattatgagattcgatgatacgaatcctgaaaaggagaaggaagactttgagaaggtgattaagagcgtcgtgatgacgttgtgtcagaagtccattaaggtgaccggcttgcccaacacatttatggtgatcctggaggacgtcgcaatgctgcatattaagcccgaccagttcacgtacacttctgatcacttcgagaccattatgaaatatgccgaaaagctcatccaggaggggaaagcctatgtcgatgatacgcccgccgaacagatgaaggctgaacgagagcagagaatcgatagcaagcacagaaagaatcccattgagaagaatcttcagatgtgggaagagatgaagaaaggttctcagttcggtcagtcctgttgtctgcgcgcaaaaattgacatgtccagcaacaatgggtgcatgcgggaccccaccctgtacaggtgcaagatacaaccccatcccagaaccggaaataagtataatgtttatcccacatatgatttcgcctgccccattgtcgactctatcgaaggcgtgacgcatgcacttcgcactacggagtatcatgatagggatgagcaattctactggatcattgaagctctgggaattcggaagccctatatctgggagtattctaggctgaacttgaataatacagtcctctctaagcggaagctgacctggttcgtaaatgaaggacttgtggatggctgggatgatccaagattcccgaccgtgcggggagtccttcgccgagggatgaccgtggagggtttgaagcagtttatagccgcccagggctcctcacggagcgtggtgaacatggaatgggacaagatatgggccttcaataaaaaagtgatcgacccggtcgctccccggtacgtagccctgctgaaaaaggaagtgatcccggtgaatgtaccggaagcccaggaggagatgaaggaggtcgccaaacacccgaagaatcccgaagtggggctcaagcccgtttggtattcacctaaggtgttcattgaaggagctgacgctgagacattctctgagggggaaatggtgacctttattaactggggtaacctgaatataactaagatccataaaaatgccgacggcaagattatttcactggatgctaagctgaatttagagaataaggactataagaagactacgaaggtcacctggctggccgagacaactcacgccctgccaatacccgtgatttgtgtgacctatgaacatctgataacgaagcccgtgctggggaaggacgaagacttcaaacaatacgtgaataaaaacagcaaacatgaggaactaatgcttggcgacccctgcctcaaagacctcaagaaaggcgatattattcagctgcagaggcgtggctttttcatatgcgatcagccatacgaaccggtgagcccttacagttgtaaagaggcgccctgtgttctcatttacatcccagacggccataccaaagagatgcccacttccggatcaaaagaaaagacaaaggtggaggcaacgaaaaatgaaacatccgccccatttaaggagagaccaacacctagtctgaataacaactgcaccacctcagaggattccctagtcctgtacaaccgtgttgctgtccagggcgatgttgtaagggagctgaaagccaaaaaggcaccaaaagaggacgtggacgccgcagtgaagcagctcttgtcattgaaagctgaatataaagagaaaaccgggcaggagtacaagcccggcaaccctcctgctgaaattggccagaacatcagcagcaattcatcggcctccatcctcgagtctaagtctctgtatgacgaggtggcagctcagggtgaggttgttcgcaaactgaaggcagaaaaatctcccaaagcgaagattaacgaggcggtggaatgtctgctgtctcttaaggcccaatacaaggagaagactgggaaggagtacattccaggccagccccctttgtcgcagtcaagcgactctagccctactcggaatagcgaaccagcagggttggagaccccagaggccaaagtcctgttcgataaggttgcttctcagggggaagtggtgcgaaaactgaagaccgagaaagcccctaaggaccaagttgacatagccgtacaggaactcctgcaacttaaggcccagtacaaatccctgatcggcgtcgagtacaagccagtttccgcaactggagctgaagacaaggataaatag

SEQ ID NO: 189447 - DNA, 2928 bp, Artificial Sequence
  Description of Artificial Sequence: Synthetic coding sequence
atggccaccctgagcctgaccgtgaacagcggcgacccccccctgggggcccttctggccgtggagcatgttaaagacgatgtgtccatttcggtggaggaaggcaaagagaatatcctccacgtgagtgaaaatgtaatcttcactgacgtcaattccatccttcggtaccttgctcgagttgccacaacagctgggctgtatggttcaaatctgatggagcacacagaaattgaccattggttggaattcagtgcgaccaaactgtcctcgtgcgattctttcacgtctacgatcaatgagttaaaccactgcctgtccctgaggacctaccttgtcgggaactccctgtccctagccgacctgtgcgtttgggctaccttaaagggaaacgctgcttggcaggaacagttgaagcagaagaaggccccagtccatgtcaaaagatggttcggttttttggaagcacagcaggcgtttcaatccgttggaaccaagtgggacgtcagcaccacaaaagctcgcgtggctccggagaagaagcaggacgtgggcaagttcgtggagttacccggtgccgagatggggaaagtgacagtccggtttcctccggaggcttccggctatctacacattggacacgcaaaggccgcattgctcaatcagcactatcaggtcaattttaagggcaagttaatcatgcgatttgacgatacaaacccagaaaaggaaaaggaggacttcgaaaaggtgatcttagaagacgtggctatgctccatatcaagccagatcagtttacttacacttcagatcattttgagactatcatgaaatatgcggagaaacttatccaagagggaaaggcctatgtcgacgacaccccggcagagcagatgaaagctgagcgtgagcaaaggattgactccaaacacagaaagaatcctattgaaaagaacctgcaaatgtgggaagaaatgaagaaagggagtcagttcgggcagtcttgctgcttacgggcgaaaatagacatgtcttcaaacaatggctgtatgcgcgaccctactctgtaccggtgcaaaattcagccccacccaagaaccggcaataagtataacgtgtatcccacatacgattttgcttgccccattgtggattcaatcgaaggggtcacacatgccttgagaacgacggagtatcacgacagagacgagcagttttactggatcatcgaagctctgggaatccgcaagccgtacatctgggaatactcccgcctgaacctgaacaatactgttttatcgaagagaaagctgacttggttcgtgaacgaaggtctggttgatggatgggacgaccccagatttccaaccgtccgaggagtcttacgccgtgggatgactgtcgagggtctgaagcagtttatcgccgcccagggatctagccggtctgtggtcaatatggagtgggataagatctgggcctttaacaaaaagctccgggcactgtgcaagaaagtcatcgatcccgtggctcctcgctatgtggcactcctgaagaaggaagtcatacctgtcaacgtgcctgaggcacaggaagagatgaaggaagtcgctaagcacccaaaaaacccagaagtgggcctgaagcccgtgtggtattcgcctaaagtgtttatcgaaggagccgatgctgaaactttctctgagggcgagatggtgacttttatcaactggggcaacttgaacattaccaagatccataagaatgctgacgggaaaataatctcactggatgcgaaactgaacctggaaaataaggactataaaaagaccactaaggtgacatggttagctgaaacaacacacgctttgcctatacccgtgatttgcgtgacctatgaacatctgataacaaagcctgtcctgggaaaagacgaggatttcaaacagtacgtgaacaaaaactctaaacatgaggaacttatgctcggcgacccgtgcttgaaagatttgaagaagggggatattattcagctacagagacgggggttttttatttgcgaccagccatatgagccagtctcaccgtatagttgtaaggaggccccttgtgttctcatttacatccctgatggtcacactaaagagatgccaacttcaggttccaaggagaagaccaaggtcgaggcaacaaagaatgagaccagcgcccccttcaaggagaggcccaccccatccctaaacaataattgtacgacatccgaggactcactcgtactgtataaccgcgtggctgtccagggcgatgttgtgcgggagctgaaggctaagaaggcccccaaggaagacgtggacgccgccgtaaagcagctcttgtccctgaaggctgagtacaaggagaagacaggtcaggaatacaaaccgggaaacccacctgcagaaattggacagaatataagctctaatagttccgcaagtatcttggaaagcaaatccctctacgacgaagtggcggcacaaggcgaggtggtgagaaaactgaaagcggaaaagtctcctaaagccaagatcaacgaagccgtcgaatgcttactgtcgcttaaggcccagtataaagaaaaaacggggaaagagtacatcccgggacagccaccactgtcccaatcttctgactcttcaccgaccaggaattcagagcccgctgggctggaaaccccagaagctaaagtgttgttcgataaggttgcttcccaaggcgaggtcgttcggaaactaaaaactgaaaaggctcccaaggatcaagttgatatagctgttcaagagctgctccagttaaaagcccagtacaagagtcttattggggtggagtataagccagtgagcgctacaggcgcagaggataaggacaaaaaaaagaaggaaaaatag

SEQ ID NO: 189448 - DNA, 1572 bp, Artificial Sequence
  Description of Artificial Sequence: Synthetic coding sequence
atggccgccctgctgcggcggctgctgcagcgggagcggcccagcgctgcctcaggccggcccgtcgggaggagagaagctaatctggggactgacgcaggcgttgccgtccgtgtgcggttcgcacctagcccaacagggttcctccacttgggcggacttaggaccgctctttacaattacatatttgcaaagaagtaccaaggctccttcatactgaggctggaagacaccgaccagacccgggttgtccctggcgccgccgagaacatcgaggacatgctcgagtgggcaggcatccctcccgatgaatctcctcgccggggaggccctgccggcccttaccaacagagccagcgtctggagttgtacgctcaggccacagaggcgctgctgaaaacaggagccgcttacccatgtttttgttccccccagcggctcgagctgctgaaaaaagaggccctgaggaaccatcaaacgcctcggtatgacaaccgctgtcgaaatatgagtcaggaacaggtggcacagaaactagccaaggatcccaaacctgcgatcagatttcgactggagcaagttgtacctgccttccaggacctggtctacgggtggaatcgccacgaggttgcttccgtcgagggggatcctgttataatgaaaagcgatggtttccctacataccatcttgcgtgcgttgttgacgatcatcacatgggcatcagccatgtgctgcgcggctccgaatggctggtgtccaccgcaaagcacctccttctgtatcaggcgctcggttggcagcccccgcactttgcccacctgcccttgctactgaatcgggacggcagcaaactgtccaaacggcaaggagatgtgttcctcgaacattttgctgccgacggattcctgccagattccttattggatatcattaccaattgtggatcaggatttgccgagaaccagatggggcgtaccctcccagagcttatcacacagtttaacctcacccaagtgacctgtcattctgccttgctggatctggaaaagctgccagaatttaatcgcctccatcttcaacgtctcgtctccaacgagagccagaggaggcagttagttggtaagcttcaggttctggtcgaggaagccttcggatgccaactgcaaaatcgggatgtcctcaaccctgtgtatgtggagaggatactgctgctccgccaaggtcacatctgccgcctgcaggatctagtctcaccggtgtatagttatctgtggacacggcccgcagttggcagagcccagctggatgccatcagtgagaaagtggatgtgatcgccaagcgcgttttgggcctgcttgagcgctcctccatgtcactcactcaagatatgctgaatggtgagctcaagaagctatccgaaggcctcgagggtacaaaatatagcaatgtgatgaaacttctccggatggctctatcgggtcagcagcagggtcctccagtcgccgaaatgatgctggctttaggcccaaaagaggtgagggaaaggatccagaaggtagtgagcagctag

SEQ ID NO: 189449 - DNA, 1572 bp, Artificial Sequence
  Description of Artificial Sequence: Synthetic coding sequence
atggccgccctgctgcggcggctgctgcagcgggagcggcccagcgccgcaagtggccgtccagtgggaaggagagaggcaaatctggggaccgacgctggggttgccgtgagggtacgcttcgcaccctcccccaccggattcctgcacctaggtggcctgagaacagccctttataactatatattcgccaagaagtaccagggaagtttcattctcagactggaggatactgatcagacccgcgtagttcccggagcagccgaaaacatcgaggacatgttagagtgggcgggcattcctccagacgaatctcccaggcgcgggggccccgcggggccctatcagcagagtcagcggttggaattgtacgctcaagctacggaggccctgctgaagaccggtgccgcctacccctgcttttgctctcctcaacgcctggagctgcttaagaaagaagccctgcgcaaccaccagactccccgatacgacaaccgctgtaggaatatgtcccaggaacaggtggctcagaagctggccaaggatcctaagccagccatccgtttccgcctggaacaggtggtgcccgcctttcaggacttggtttacggctggaatcggcatgaagttgcttcagtggagggggatcccgtcatcatgaaaagcgacggttttcccacctatcacctggcttgtgtggtcgacgaccaccatatgggcataagtcacgtgctccggggaagtgaatggctggtgtcaacagccaaacacctgctgctctatcaggcactcgggtggcaacctcctcacttcgcccatcttcccttactcttaaaccgagacggaagcaagttgagtaagcgacagggcgatgttttcttggaacattttgcagcagacggtttcctccctgactctctgcttgatatcattactaactgcggcagcggatttgcagagaaccagatgggcaggactctgccggagttaatcacccagttcaacctgacccaggtaacgtgccacagtgctctcctggacctggaaaagctaccagagttcaacagacttcatttgcagagattagtgtctaatgaatcacaaagaaggcaactagtgggcaaactgcaagtgctggtggaggaggctttcggttgccaactacaaaatcgtgatgtcctgaaccccgtctatgtcgaacggattctccttctccgccagggacacatctgtcgtcttcaagatttagtgagcccagtgtactcctacttatggacccgccctgccgtgggaagagctcagctggacgctatctctgagaaggtggatgtgattgccaaacgagttctcggactactggaacgcagttctatgtccctgacccaggatatgctgaacggggaactgaagaaattgagcgaagggctagaaggtaccaaatactccaatgtgatgaaactgctacggatggctctctccggacagcagcaggggcccccggttgctgagatgatgctggcactgggcccaaaggaagtcagagagcgaattcagaaagtggtttccagttag

SEQ ID NO: 189450 - DNA, 321 bp, Artificial Sequence
  Description of Artificial Sequence: Synthetic coding sequence
atggcccaggagttcgtgaactgcaagatccagcccggcaaggtggtggtattcatcaaaccaacttgcccatactgtagacgagcacaggaaatcttaagccagctgccaatcaagcagggtctgcttgagtttgtagacatcacagccactaatcataccaatgagatccaagactatttgcagcagctcaccggagcaaggactgtgcccagggtgtttattgggaaggactgtatcggaggctgtagcgacctcgtgagtttgcagcagtctggcgagctgcttactaggctgaaacagatcggggctctccagtag

SEQ ID NO: 189451 - DNA, 321 bp, Artificial Sequence
  Description of Artificial Sequence: Synthetic coding sequence
atggcccaggagttcgtgaactgcaagatccagcccggcaaggtggtcgtgtttatcaagccaacttgtccctactgccggcgggcacaagagatcctatcccagctcccaattaaacaggggttactagagtttgtagacattactgctacaaatcataccaacgaaatccaagattaccttcagcagctgaccggcgctcggacggtgcctagagtgttcatagggaaggactgcatcggcggctgttcagacttagtaagcctgcagcagtccggagagctgctcaccagattgaaacaaattggtgcactgcaatag

SEQ ID NO: 189452 - DNA, 321 bp, Artificial Sequence
  Description of Artificial Sequence: Synthetic coding sequence
atggcccaggagttcgtgaactgcaagatccagcccggcaaggtggtagtctttatcaagccaacttgcccctactgccgaagggctcaggagattctgagtcagctgccaatcaagcagggcttactggaatttgttgacattacagccacgaaccatacaaacgagattcaggactatctccagcaattaaccggagcaagaacagtaccccgggtattcattggcaaagactgtattggtggttgttcagacctcgtctccctccagcagagcggagagctgctgactcgcttgaaacagatcggcgccctacagtag

SEQ ID NO: 189453 - DNA, 321 bp, Artificial Sequence
  Description of Artificial Sequence: Synthetic coding sequence
atggcccaggagttcgtgaactgcaagatccagcccggcaaggtggtggttttcatcaaacctacctgtccttactgtaggcgggcacaagaaattctgtcgcagctacccatcaagcagggactgctcgaattcgttgacatcaccgcaactaaccacactaatgaaatccaggactaccttcaacaattgacgggagcccgcaccgtgcctcgagtgtttatcggcaaagattgtattgggggctgctccgacctcgtgtcactacagcagagcggggaactgctcactcgccttaagcagattggcgccctgcagtag

SEQ ID NO: 189454 - DNA, 321 bp, Artificial Sequence
  Description of Artificial Sequence: Synthetic coding sequence
atggcccaggagttcgtgaactgcaagatccagcccggcaaggtggtggtctttattaagcccacttgcccatattgccggcgcgctcaagagattttgtcccagctccccatcaaacagggactgctcgagtttgtggatatcaccgccactaaccacaccaacgaaattcaggactacctacaacaacttaccggcgctcggacagtgcccagggtgttcattgggaaggattgcattggcggatgctcggatctcgtgtctctgcagcagtccggagaattgttgacacggctgaagcagattggcgccctccaatag

SEQ ID NO: 189455 - DNA, 495 bp, Artificial Sequence
  Description of Artificial Sequence: Synthetic coding sequence
atgatctggcggcgggccgccctggccggcacccggctggtgtggagccgcagcgggtcagctggctggctggatcgggccgctggagcggccggagccgctgccgccgctgcctccgggatggagagtaacacttcctcgagcctggaaaacctcgcaaccgcaccggtgaatcagatccaggagaccattagcgataattgcgtcgtcatattctccaagacatcctgttcctactgtactatggcaaagaaactgtttcacgacatgaacgtcaactacaaagtcgtagaactagacttgctggagtacggtaaccaatttcaggatgcactgtacaagatgaccggcgagcgtactgtgcctaggatcttcgtgaacggcacatttattggcggcgctactgacacccacaggttgcataaggagggaaagctgctgccactggtgcaccaatgttacctcaaaaagtctaagcgcaaggagttccagtag

SEQ ID NO: 189456 - DNA, 498 bp, Artificial Sequence
  Description of Artificial Sequence: Synthetic coding sequence
atgaacccccgggacaagcaggtgagccggttcagccccctgaaggatgtttacacgtgggttgccctcgccggcatccagcgtagcggaagccctggacgcacgcggagcgccgcaagacgaatggagagcaatacaagttcctccctcgaaaatttggcgaccgccccggtgaatcagattcaggagacgattagtgacaattgtgtggttattttctccaaaacgtcatgctcctattgcactatggccaagaaactcttccatgatatgaatgttaactacaaggtcgtggagctcgacttattagaatacggcaaccagttccaggacgctctgtataaaatgacaggcgagcgtaccgttccaaggatttttgtgaacggcacattcatcgggggcgcaaccgatacccataggctacacaaggaggggaaactgcttccactggtgcaccagtgctacttgaagaagtctaaacgcaaggagttccaatag

SEQ ID NO: 189457 - DNA, 1008 bp, Artificial Sequence
  Description of Artificial Sequence: Synthetic coding sequence
atggccgccggcgccgccgaggccgccgtggccgccgtggaggaggtcggatcggcggggcaattcgaagagctcctccggcttaaggcgaaatcgttactcgtggtgcatttttgggccccttgggccccgcagtgcgcacaaatgaacgaggtgatggccgaattagcaaaagaattgcctcaggtgtcgtttgtaaaactggaggctgagggggtccctgaagtgtccgaaaaatacgaaatctctagcgtgcctaccttcctgtttttcaagaattcccaaaaaatcgatcgactggacggcgcgcacgccccagagctgaccaagaaagttcaaagacatgcatccagcggcagctttctgcccagcgcgaacgaacatcttaaggaagatcttaatctccgcctcaaaaagctaacacacgcagcaccgtgtatgttgttcatgaaggggacccctcaggaacctcgctgtggctttagcaaacagatggtggaaattctgcacaaacacaacatccagttctccagtttcgacattttctcagatgaagaagtccgacaagggctgaaggcctactccagttggcccacatacccccagctgtatgttagcggcgagctgataggaggccttgacatcatcaaggagcttgaggcttccgaagaactcgatactatctgcccaaaggcacccaaattagaagaacgactgaaggtgctgacaaacaaggccagcgtgatgctcttcatgaagggaaacaaacaggaagccaaatgcgggttttccaaacaaatcctggagatcctgaatagcaccggcgtcgagtacgagacctttgacattctggaagacgaagaggtgaggcaggggctcaaagcctattccaattggcccacgtatccccaattgtatgttaagggcgaacttgtgggcggtttggacatcgtcaaggaattaaaggagaatggggagcttctccccatcttaagaggtgaaaattag

SEQ ID NO: 189458 - DNA, 1008 bp, Artificial Sequence
  Description of Artificial Sequence: Synthetic coding sequence
atggccgccggcgccgccgaggccgccgtggccgccgtggaggaggtcgggtctgccggccagttcgaggagctgttgcgtttgaaagcgaagagccttctggtcgtgcatttctgggccccatgggcgccccagtgcgctcagatgaacgaagtcatggcggaacttgcaaaagagctgcctcaagtttcttttgtgaagctggaggctgagggagttcccgaggtgagcgaaaagtacgagatatctagcgtcccaacattcctcttctttaaaaatagccaaaagatcgatagactcgatggtgctcatgcccccgagctgacgaaaaaggtccaacgacatgccagctctgggtcttttttgcctagcgcaaacgaacatttaaaggaggacctgaatctgcggttaaaaaaactcactcacgccgccccatgcatgctgttcatgaaaggtactccccaggagcccagatgcggattttccaagcagatggttgagattttgcacaagcataacatccagttctccagctttgatatctttagcgacgaagaggttagacagggtttaaaggcttacagttcgtggccgacatacccccagctatacgtgtctggagagctcattggcggattagatattatcaaggagcttgaggccagcgaagagttagataccatctgccccaaagctcccaaactcgaagaacgcctgaaagtgctgactaacaaagcaagcgtgatgctgtttatgaaaggcaacaagcaggaagctaagtgcggatttagcaagcagatactggagatcctgaacagtacgggggtggagtacgagacctttgacatcttagaagacgaagaggtcagacagggactgaaggcctactcaaactggccaacatacccccaactgtacgtgaagggcgaactggtgggagggctcgatatagttaaagaacttaaggaaaacggggaactactgcccatcctgcgtggggagaactag

SEQ ID NO: 189459 - DNA, 1008 bp, Artificial Sequence
  Description of Artificial Sequence: Synthetic coding sequence
atggccgccggcgccgccgaggccgccgtggccgccgtggaggaggtgggaagtgctggccagtttgaagaactcctgcggcttaaggccaagtctctgcttgtcgtacacttctgggccccttgggctccccagtgtgcacagatgaatgaggtgatggctgaactggcaaaagaattgcctcaggtgagctttgtgaaactcgaagcagaaggtgttccagaggtctctgagaagtatgagatatcctccgttccaacttttctcttctttaagaacagccagaagatcgaccggcttgacggcgctcacgctccagagctgacgaaaaaggtacagcggcacgcttccagcgggagcttcctgccatcagctaacgagcatttgaaggaagatctgaacctcagattgaagaaactcacccacgctgctccctgcatgctgttcatgaagggaacaccccaggagcccagatgcggatttagtaaacagatggtcgagatactgcataaacataatatacagttctctagctttgatatattctcggatgaggaagtgcgccagggtctgaaggcatacagttcgtggccaacctacccccagctgtacgtcagtggcgagcttatcggtggactggacattattaaagagctggaagcaagtgaggaactggatactatttgcccaaaggcacctaaattggaggaacgccttaaagtcctcactaacaaggccagcgtgatgctgttcatgaaaggtaacaaacaagaggctaagtgtggatttagcaagcagatactagagatacttaacagcactggagttgagtatgaaacctttgatatactggaggatgaagaggtgagacaaggactaaaggcatatagcaattggccgacctaccctcaactgtacgtaaaaggggagctcgtgggcggcctggatatcgtgaaggagctgaaggaaaacggcgaactcttacccatactgaggggcgaaaactag

SEQ ID NO: 189460 - DNA, 474 bp, Artificial Sequence
  Description of Artificial Sequence: Synthetic coding sequence
atgagcggcagcctgggccgggccgccgccgccctgctgcggtgggggagaggagccgggggaggcggcctctgggggcccggtgtgcgagcagcaggaagtggcgcgggcggcggagggtccgcagagcagctggacgcccttgtgaagaaagataaagtggtcgtttttcttaagggcactcctgaacagccgcaatgtggcttttcgaatgccgtggtgcagatcttgaggctgcacggagtaagagattacgccgcgtataatgttctggatgatcctgagctacgccaaggaataaaagactactccaattggcctactatcccccaggtatacctgaacggggagttcgtgggggggtgcgatatccttctccagatgcaccagaatggagacctcgttgaggagttaaagaaactgggcattcattctgctctcttggacgagaagaaggaccaggatagcaaatag

SEQ ID NO: 189461 - DNA, 873 bp, Artificial Sequence
  Description of Artificial Sequence: Synthetic coding sequence
atgctgaagcgggagatgaagcccgagagcgaccggccccggaaggtccggtttaggatcgccagtagccattctggaagagtgctcaaggaggtttacgaggatggacagccatccggttcgctcgattcagagtgtgcttcaatatgtggcattgatgggctgggcgacagtgacgggcagcaaaatggccacatcgaatccgagggcgacgagaatgagaacgatcaggattccttactggtgctcgctagggccgcctcagagaagggatttggcacacgccgggtgaatatcctgagcaagaacgggaccgttagaggtgtcaagtataaggtgagcgccggccaggccctttttaacaacctcaccaaagtgttacagcagccaagcaccgaccttgagttcgatagagtggtcatttacacaacctgcctgcgggtcgtacggacaaccttcgagcgttgcgaactggtccgcaagattttccaaaatcacagggtgaaattcgaagaaaaaaacatagcccttaatggcgagtacggaaaggaattggatgagcggtgcagaagagttagtgaagcaccttccctgccagtggtgtttattgacgggcactacctgggtggcgctgaaaaaattcttagcatgaacgaatctggcgagctccaggacattctcaccaagattgaaagagttcagcatccccatgaatgcccgtcctgtggtggcttcgggttcctcccttgtagtgtttgccacggctctaaaatgtccatgtttaggaattgcttcaccgactctttcaaggctcttaagtgtaccgcatgcaacgagaacggactgcagcggtgcaaaaactgcgctggctag

SEQ ID NO: 189462 - DNA, 828 bp, Artificial Sequence
  Description of Artificial Sequence: Synthetic coding sequence
atgagccactgcagcagccgggccctgaccctgctgagcagcgtgtttggcgcctgcggcctgttgctagttggcattgcggtaagcaccgattattggctctatatggaggagggcactgtcctccctcagaatcaaactaccgaggtaaagatggctctccatgccgggctgtggagagtctgtttcttcgcaggaagggagaaaggtagatgcgttgcttccgagtactttttggaacccgaaataaatttggttactgaaaacactgagaatatacttaagacagtccgtaccgccacccctttccccatggtctcactgtttctggtcttcactgcctttgtgatatctaacattggccatatccgcccccagcggaccatcctggctttcgtgagcgggatcttttttatattgagcggcctctccctggtggtcggcctcgtgctatatatctcctccatcaatgatgaagtgatgaatcgacccagtagctcagagcagtacttccactaccggtacggctggtccttcgcctttgcggccagcagctttttgctcaaagagggcgctggcgtgatgtccgtgtacttatttacaaagcggtacgccgaggaggaaatgtaccggccccatccagccttctatcgtccacgactgtctgattgtagcgactactctggacaattcctacagccggaagcctggcgacgagggcgctcaccgagtgatatttcttccgatgtcagcatccaaatgactcagaactaccctcctgcaatcaaataccccgaccacctccacatcagcacttctccctgctag

SEQ ID NO: 189463 - DNA, 987 bp, Artificial Sequence
  Description of Artificial Sequence: Synthetic coding sequence
atggccctgcggggcgtgagcgtgcggctgctgagccggggccccggtctgcacgtattacgcacctgggtctcatctgcagctcagactgctagccgccctgaattcgactggcaggacccactggttctggaggagcagctgacaacagatgagatactcataagagacacgtttcgaacctactgtcaggagcgtcttatgccccgaattcttctcgctaatcgtaacgagggctatgggtgtgcaggagtgtcttcagttgcctatgggctgcttgcaagggaactcgagagagtggacagtggataccgcagcgcaatgtccgtgcagagtagtctagtcatgcaccccatttacgcctatggcagtgaagagcagcgccagaagtatctaccacagctggccaaaggagaattgctgggctgctttggcctaactgaaccaaattccggatccgatccgtcctctatggaaacgcgcgcacattacaacagttcgaacaaatcctacacactgaatggcactaagacctggatcactaatagtccaatggccgacctgttcgtggtttgggcacgatgcgaggacggttgcatacggggctttcttctcgagaaaggaatgaggggactatccgccccgcgtatccaaggtaagttttcccttagagccagcgccactggcatgatcatcatggatggggtggaagtccccgaggaaaacgtgctccccggtgcttcttccctcggcggaccattcgggtgtttaaataatgcaagatatggcatcgcctggggcgtcctgggcgccagcgaattctgcttacatacagcacgacagtatgccctggacagaatgcagtttggagtgcctctagctcggaatcagctcatacagaaaaagctggcagatatgttaacagagattacgttaggcttacatgcatgcctgcaacttggccggttgaaggatcaagacaagtag

SEQ ID NO: 189464 - DNA, 1185 bp, Artificial Sequence
  Description of Artificial Sequence: Synthetic coding sequence
atgcggagcagcagcggcacccccagcgcccccaccgcccggcgggatagctgtctcgcctcttgctggccaattgctaccaaaagcctcgccctgttacctcgccttgagtgcagcgggacgattcttgcacactgcaagttctgcctgccaggttcatccgattcgccggcaagcactcctctggtggctggtattacaggctatggctgcgcaggagtttcaagtgtggcctatggactgcttgcacgagaacttgagagggtggactctggatataggagcgccatgtctgtacaatcctccctggtaatgcaccctatttacgcgtacgggagcgaggagcaacggcagaagtatctgccccaactggccaaaggcgagctgcttggctgttttggcctgaccgagccaaactcaggctctgatccatcttcaatggaaacccgagcacactataactccagtaataaaagctatacactaaatggaaccaagacgtggattactaacagcccaatggctgatctcttcgtggtgtgggcccgctgtgaagacgggtgcatcaggggctttcttctggagaagggtatgagaggtctgtccgccccacggatccagggcaaattcagcctgcgggcctccgccactggaatgattattatggatggcgtagaggttcctgaagaaaacgttctccccggcgcgagcagcctcgggggaccgttcgggtgcttgaacaatgctaggtatggaatcgcctggggagttttgggagcgtctgaattttgtctccacaccgcaagacagtacgcgttggatagaatgcagtttggagtgcccctggctaggaatcagttaatccagaagaaactggccgatatgctgacggagattacccttggattacatgcctgcttgcagctgggaagactgaaagatcaagacaaagccgcacccgaaatggtcagtctcctgaaacggaacaattgtggtaaagccctcgacatcgcacggcaggcacgggacatgctcggaggtaacggcatttcagacgaataccacgtgatccggcatgctatgaacttggaggcggtcaacacctacgagggaactcacgatatccacgcacttatcctggggagggcgattacggggattcaagctttcaccgcctcaaaatag

SEQ ID NO: 189465 - DNA, 1287 bp, Artificial Sequence
  Description of Artificial Sequence: Synthetic coding sequence
atggccctgcggggcgtgagcgtgcggctgctgagccggggccccggcctgcatgtgcttcgtacttgggtttcttccgccgcccaaacagaaaaagggggccgcacacagagccagctcgcaaaatcgtcacggcccgagtttgactggcaagacccactggtgcttgaggaacagctcaccactgacgagattctgatccgcgacaccttcagaacatactgccaggaaaggctgatgcctaggatactcctggctaatcggaacgaagtgtttcaccgggagataatatcggagatgggcgagctgggggtcctcggaccaaccataaaagggtacggctgtgccggggttagcagtgtggcctacggtctgctcgccagagagctggaacgagtggacagcggataccgcagtgctatgtccgtgcagagcagcctagtgatgcatccgatctacgcgtacggaagcgaggaacagcggcagaagtatctgccccagctcgctaagggtgagctcctgggctgcttcgggctcacagaacccaactctgggagcgatccctcaagtatggaaactagagcccactataatagttcaaacaagtcttacactctgaacgggacaaagacctggattacgaattcaccaatggctgatctgtttgtggtgtgggcccggtgcgaggatggctgcatccggggatttctgctcgagaaggggatgcggggcttgagcgctcctcggatccaaggaaaattctcgttaagggcatcagccacaggtatgataatcatggacggagtggaagtgcctgaggagaacgtcctgcccggtgcgtcaagtctgggcggcccgttcggatgtttaaataatgctcgatatggaatcgcatggggtgtgttgggcgcctccgagttctgcctccacaccgcacggcagtatgcccttgaccgaatgcaatttggggttccgctcgctagaaaccagttgattcagaagaagctggctgacatgcttacggaaatcactctcggacttcacgcctgtctacagttgggacgccttaaggatcaggacaaggctgcccctgaaatggtctctctgttaaagaggaataattgtgggaaggctctggacatcgccagacaagcaagagacatgctgggggggaatgggattagcgacgaataccacgtgattcggcacgcgatgaatctggaagctgtgaacacctacgaggttgtccagatgtgctctctaaagagacggtggaattccctatag

SEQ ID NO: 189466 - DNA, 297 bp, Artificial Sequence
  Description of Artificial Sequence: Synthetic coding sequence
  Description of Combined DNA/RNA Molecule: Synthetic coding sequence
atgtgcgccgcccggctggccgccgccgccgccgccgcccagagcgtgtatgcattttccgcccgtcctcttgccggtggggagcccgtgtctctggggtcattgcgtggaaaggttttacttattgagaacgtcgcgtcactgugaggaaccacagtgcgagattacactcagatgaatgaactgcagcggaggctaggtcccagggggctggtcgtgctcgggttcccttgtaatcaatttgggcaccaggttagacgagccgaacgcgggggagcaggggctgacgtccagtag

SEQ ID NO: 189467 - DNA, 612 bp, Artificial Sequence
  Description of Artificial Sequence: Synthetic coding sequence
  Description of Combined DNA/RNA Molecule: Synthetic coding sequence
atgtgcgccgcccggctggccgccgccgccgccgccgcccagagcgtgtatgcattctctgctcggccactggctggtggggagccagtatctctcggctcacttcgcggtaaggttcttctcattgagaatgtggcttctctgugaggtaccaccgttcgagactacacacagatgaacgagctccaaaggcgcctaggccccagaggcctggttgtcctggggtttccctgcaatcaattcggtcatcaggaaaatgcgaagaacgaggagattcttaattccctcaagtatgtcagaccaggcggagggtttgaaccaaacttcatgctttttgagaaatgtgaagtgaacggcgctggtgcacatccattattcgctttcttgcgggaggccctcccagccccaagcgacgacgccacagccctcatgaccgatccgaagcttattacttggagtcccgtgtgtcggaacgacgtggcgtggaatttcgagaagttcctcgtgggccccgacggagtgccgctccgccgttattccagacgcttccaaactattgacatcgagcccgatatagaggccctgcttagccagggaccatcttgtgcatag

SEQ ID NO: 189468 - DNA, 573 bp, Artificial Sequence
  Description of Artificial Sequence: Synthetic coding sequence
  Description of Combined DNA/RNA Molecule: Synthetic coding sequence
atggccttcatcgccaagagcttctacgacctgagcgccatcagcctggatggggagaaagtcgacttcaacaccttcagaggaagggctgtgctcattgaaaacgtggcttcccttugaggcaccacgacgcgggatttcactcagcttaatgaactccagtgcagatttccacgcagactggtcgtactgggtttcccttgcaaccagtttgggcaccaggagaattgccagaacgaggaaatcctgaatagtttgaaatatgtcaggccaggagggggttatcagccaacgttcacattggtgcaaaagtgtgaggtgaatggacagaatgagcacccagtgtttgcctatctgaaggacaagctcccttacccatatgatgaccctttctccttgatgactgatccaaaattgatcatttggagtcctgtccgacgcagtgacgtggcctggaactttgagaaattcctcataggcccagagggagaaccgttcaggcgatacagccggacatttccgactatcaacatagagcccgacattaagagacttctcaaagtggccatatag

SEQ ID NO: 189469 - DNA, 594 bp, Artificial Sequence
  Description of Artificial Sequence: Synthetic coding sequence
  Description of Combined DNA/RNA Molecule: Synthetic coding sequence
atgagcctgggccggctgtgccggctgctgaagcccgccctgctgtgtggtgctttagctgcgcctggccttgcaggaactatgtgtgcctctcgggacgattggagatgtgcaagatccatgcacgagttctccgccaaggacatcgacggtcatatggtcaacctagacaaataccgagggttcgtctgcattgtcaccaatgtagcgtctcagugaggtaagaccgaagtgaactatacacagctggtcgatctccatgctcgatacgctgaatgcgggctgaggatcttggcattcccttgcaatcagttcggcaaacaagagccaggaagcaatgaggagatcaaggaatttgcagccggttataacgtgaaattcgacatgttttctaaaatctgtgtcaatggggatgacgcccatccgctgtggaaatggatgaagatccagcctaagggcaagggaattttaggcaacgccataaaatggaattttactaagtttctaatagataagaacggctgcgtggttaagcggtacgggccaatggaagagcccctggtgattgaaaaagaccttccgcactacttttag

SEQ ID NO: 189470 - DNA, 666 bp, Artificial Sequence
  Description of Artificial Sequence: Synthetic coding sequence
atgaccacccagctgcgggtggtgcacctgctgcccctgctgctggcctgcttcgtgcagactagtccaaaacaagagaaaatgaaaatggactgccacaaggacgagaaggggacaatctatgattatgaagctattgctcttaacaaaaacgagtacgtgagctttaagcagtacgtcggcaaacatatactgtttgtgaatgtggctacatactgcggactcaccgctcaatatcccgagctgaacgcattacaggaagaactgaagccttatgggctggtcgtgctggggttcccatgcaaccagttcgggaagcaggaacctggcgacaataaggagatcctccccggtctgaaatacgtgagaccgggaggaggtttcgtgcctagcttccaactttttgagaagggcgacgtgaacggcgagaaggagcagaaggtgtttagctttttaaagcacagctgcccacacccctccgagatactcgggacctttaaaagcatttcctgggatccggtgaaagtccacgacatcaggtggaacttcgagaaattcctcgtggggccagatggtatccctgtgatgagatggtctcaccgggccacggtctcatccgtcaagaccgatatcctagcttatcttaagcagttcaaaacgaagtag

SEQ ID NO: 189471 - DNA, 303 bp, Artificial Sequence
  Description of Artificial Sequence: Synthetic coding sequence
atgaccacccagctgcgggtggtgcacctgctgcccctgctgctggcatgttttgtgcagacctcacctaagcaagaaaagatgaagatggattgccacaaggacgagaaaggtactatttacgactatgaggctatcgccctgaacaagaatgagtacgtgtcctttaaacagtacgtgggtaaacacattctttttgtgaacgtggctacgtattgtggcctgaccgctcaataccctggcatgtccgtgcagggagaggacctgtacctcgtgtcatcctttcttcgcaaaggcatgtag

SEQ ID NO: 189472 - DNA, 573 bp, Artificial Sequence
  Description of Artificial Sequence: Synthetic coding sequence
atggccgagaagacccagaagagcgtgaagatcgcccccggcgccgtagtttgcgtggaaagcgagattaggggagacgtgaccatcgggccccgcacagtgattcacccaaaagcgcgcatcatagctgaagccggcccgatcgtgatcggcgaaggaaacctgatagaagagcaggcactcatcataaacgcctacccagacaatataacccccgacactgaggatccagaacctaagcccatgatcattgggacaaacaatgtattcgaagtgggctgctactcccaggcaatgaagatgggagacaataacgtgatcgagtccaaagcttacgtgggcagaaatgtgattttgacctccgggtgtattatcggtgcttgttgtaatttaaataccttcgaagttatccccgaaaacacagtcatctacggggcagactgcctgcgccgtgtacagacggagaggccccagccccagactctgcagcttgacttcttgatgaaaattcttcctaactaccatcatctgaagaagactatgaaggggagtagcactccggtgaagaattag

SEQ ID NO: 189473 - DNA, 1440 bp, Artificial Sequence
  Description of Artificial Sequence: Synthetic coding sequence
atggcctgccggcaggagccccagccccagggccccccccccgccgctggagcggtggcctcgtatgattacctggtcattgggggggggagtggaggtttggcctctgcgcgccgcgcggcagaactgggcgcccgcgctgccgtagtcgaaagccataaactcgggggcacctgcgtcaacgtgggatgcgtccccaaaaaggtcatgtggaacaccgccgttcacagtgagttcatgcatgaccacgcggactacgggttcccaagttgtgaggggaagttcaactggagggttataaaggaaaaaagggatgcctacgtttcaagacttaacgccatttaccagaataacctgacaaagtctcacatagaaattatccgcgggcacgctgcctttaccagcgaccctaagccaacaatagaggtaagcgggaaaaaatataccgccccccacatcctcatagctactggaggaatgccctccaccccacatgagtcgcagattccaggcgcctctctcggtatcactagtgacggattctttcaacttgaagagctgcccggacggtccgttattgtcggtgccggctacattgctgtcgaaatggcagggatactgagtgctcttggatccaagacctccctcatgattagacacgataaggtactgcgcagctttgactcaatgatttcaaccaactgcaccgaagagctggagaatgccggtgtggaggtgctgaagttctcacaagtcaaggaggtgaaaaaaacgctttccggcctggaagtgagtatggtcactgccgtgcctgggaggctgcctgtcatgaccatgatccctgacgtggattgtctgctgtgggccatagggcgggtacctaatacaaaggatctgtcgctaaataaactcggaattcaaacagatgataaaggacatattattgtcgatgaatttcagaacaccaatgtgaagggcatttacgcggttggagatgtgtgcggcaaggccttgctaactcctgtggccatcgccgcgggtcggaagctcgctcaccgtttgtttgagtataaagaagactccaagctggactataacaatatccctacggtggtgttttcccacccaccgattggcactgtcggtcttactgaggatgaggcaatacacaagtacggcattgagaacgttaaaacctattctacttcttttacaccaatgtaccacgctgtcactaagcgaaagacaaagtgtgtaatgaagatggtctgtgcgaataaggaggaaaaggtggtaggcatccacatgcaaggtctgggttgtgacgaaatgcttcaggggttcgccgtggctgtaaagatgggtgcaaccaaggccgattttgacaatactgtggccatccatcctacatcatcagaggagcttgtgacccttcggtag

SEQ ID NO: 189474 - DNA, 1323 bp, Artificial Sequence
  Description of Artificial Sequence: Synthetic coding sequence
atggccctgctgccccgggccctgagcgccggcgccggccccagctggagacgagcggcgagggccttcagagggttcctgttgcttctgccggaaccagccgcattaacgagagctctatcccgcgccatggcctgtcgtcaggaaccccaaccacagggacccccacctgcggccggcgctgttgcctcttacgattacttagtaatcggaggaggctctgggggccttgcctccgccaggagggctgcggaactcggcgccagggctgctgtggtggagtcgcacaagcttggcggtacatgtgtgaacgtgggctgcgtgcctaagaaggttatgtggaatacggccgtgcactctgaatttatgcacgatcacgcggattatggtttcccatcatgcgaaggtaaattcaactggcgcgttatcaaggagaaacgcgacgcctacgtgtccagattaaacgctatttatcagaataacctgaccaagagccacattgagatcatccggggccacgccgccttcacatctgatccaaaaccaaccattgaggtctccgggaagaagtataccgcccctcacattttaatagctactgggggaatgccttcaacaccccatgagagtcagattcctggtgcgtctctggggatcacgagtgacggcttcttccagctcgaagagctgccgggtcgcagtgtgattgtgggagccggatacatcgctgttgaaatggcaggaattctcagtgctctgggctctaaaactagcctcatgatcagacacgacaaaggtattcaaacggacgataaggggcatattatcgttgatgaattccaaaatactaacgtgaaaggaatatacgctgtgggtgatgtttgtggtaaggcccttctcacccctgtggcaatcgctgctggccggaaactggcgcaccgactgttcgagtataaagaagattctaagctggattataacaatattccaaccgtggtgtttagtcatcctcccattgggacagtcggactgacagaagacgaagcaatccacaaatatggcatcgaaaatgtgaaaacatacagcaccagctttacacccatgtaccatgcagtcactaagcgaaagaccaaatgtgtgatgaagatggtgtgtgccaataaagaagagaaagttgtgggtattcacatgcagggactggggtgtgacgagatgcttcagggattcgctgtggccgtcaagatgggcgccacaaaagcggatttcgacaacaccgtggcgattcaccctaccagcagtgaggaacttgtcacactgcgatag

SEQ ID NO: 189475 - DNA, 1410 bp, Artificial Sequence
  Description of Artificial Sequence: Synthetic coding sequence
atggccctgctgccccgggccctgagcgccggcgccggccccagctggaggcgcgctgcacgcgctttcaggggcttcctattgctgttgcctgagcccgcagcactgacaagggccctctctcgcgccatggcctgtagacaggaaccccagcctcagggcccgccccctgccgctggtgcagtggcctcttacgattatttggtcattggagggggcagtggaggtctagccagcgcaagacgggcagccgagctgggcgcgcgcgccgcggtggtagaatcacacaagctgggaggaacatgcgtcaatgtgggttgcgtgcccaagaaagtcatgtggaacaccgctgtgcactctgagtttatgcatgatcatgcggactatggttttccatcatgcgagggcaagttcaactggcgggtcatcaaggagaaacgagatgcctacgtatcccggctcaatgccatctatcagaacaacctgacgaaatctcacattgagatcatccggggccatgctgcattcacatcggacccaaagccaacaatagaggtgtctggcaaaaagtacactgcccctcacatcctcatagccaccggggggatgccgtccacgccacatgagagccagatcccaggagctagcctgggaatcacctctgacgggttcttccagctggaggaattgccaggaaggtcggtcattgtgggcgcaggttatatcgctgtcgagatggctggaatcctcagtgccttaggcagtaagactagcctgatgattagacatgataaagtattgagaagttttgactcgatgatttcaaccaattgcaccgaagagttggagaatgctggtgtagaagtgttgaagtttagccagggaatacaaaccgatgacaagggccacatcattgtcgacgaattccagaacacaaatgtaaaagggatttatgcagtcggagacgtttgtgggaaagcactgctgacgccagtggctattgctgctgggaggaaactggctcacagattgttcgagtacaaagaggactctaaactggattacaataatatacccactgtggtgtttagccacccgcctatagggaccgtggggctcacggaggacgaagcgatccacaagtacgggattgagaatgtcaagacgtactccacaagctttactcctatgtaccacgctgtgacgaaaagaaaaaccaagtgcgtgatgaagatggtttgtgctaacaaagaggagaaggtggtaggcatacacatgcaagggttagggtgtgacgaaatgctccagggatttgctgtcgccgtcaagatgggcgccaccaaagccgacttcgacaacaccgtagcgatccatcccacttctagcgaagagcttgtgacattaagatag

SEQ ID NO: 189476 - DNA, 1482 bp, Artificial Sequence
  Description of Artificial Sequence: Synthetic coding sequence
atggccctgctgccccgggccctgagcgccggcgccggccccagctggcgccgcgccgcccgggcatttaggggctttttgctgttgctgccagaacctgccgctctcacccgtgccctaagtagggcaatggcctgcagacaagagcctcaaccccagggcccacctccggcagccggggccgtcgcatcctatgactatctcgtcatcggcggtgggtccggcgggctggcctctgccagaagggctgccgagctgggggcacgggctgccgtggtggaaagccacaagcttggaggcacatgtgttaatgttggatgcgtcccaaaaaaggtaatgtggaacactgccgtgcacagcgaatttatgcatgaccacgcagactatgggttccccagttgcgaggggaagtttaactggagggttattaaagagaaacgtgatgcgtacgtgtcaaggcttaacgctatctaccaaaacaatcttaccaaaagtcacatcgagataatcaggggccatgcggccttcacttccgacccaaaaccaactatagaagtttccggcaaaaagtacacagctcctcatattctgattgccaccggtggcatgccatctaccccccacgagagccagatccctggagcctcccttgggattacgtccgacggattcttccagttggaggaactgcccgggagaagcgtgatcgtcggagcaggctatatcgcagtcgagatggccggcattctgtctgccttgggtagtaaaacaagtctgatgataagacacgataaagtgaaagaagtcaagaaaacgttgagcggactcgaagtgagcatggtgacggccgtacctggcaggctgcctgttatgacaatgataccagatgtcgattgcttgctgtgggccatcggtcgggttcccaataccaaggacctcagtctgaataagcttggcattcagacagacgacaagggacacataatagtcgatgaatttcagaacaccaatgttaaaggcatctatgccgtcggggacgtgtgtgggaaggcactgctaacgcccgtcgccatcgcggccgggcgcaaacttgcccaccggttgtttgagtacaaggaggatagtaaacttgactacaacaatatcccaactgtggtgtttagtcacccgccaatagggactgtgggtttgacggaggacgaagctatccataaatatggcatcgaaaacgtaaaaacgtatagcacctcctttacacctatgtaccatgccgtcactaaaagaaagacgaaatgcgttatgaaaatggtctgcgctaacaaagaagagaaggtcgtagggatacacatgcagggcctcggctgtgatgagatgttgcagggctttgcggtagcagttaagatgggcgcaactaaggcggactttgacaataccgtggctatccatccaacatcctccgaagagttagtgaccctgcggtag

SEQ ID NO: 189477 - DNA, 669 bp, Artificial Sequence
  Description of Artificial Sequence: Synthetic coding sequence
atggccgagaagcccaagctgcactacttcaacgcccggggccggatggagtccacccggtggctactcgctgctgccggagtggagttcgaggagaagttcatcaaatctgctgaggatctcgacaaactgcgtaatgacgggtatcttatgttccagcaagtgccgatggtcgagatcgatggaatgaaactggtgcagacccgagcgattttgaattatattgcgtctaagtacaacctgtacggaaaggatataaaagaaagggcacttattgacatgtacattgagggaattgccgatctgggggagatgatactgctgctgcccgtatgtcccccagaggagaaggacgctaaattggccctgatcaaggagaaaataaaaaatagatactttcctgcatttgaaaaagtgcttaaatcccatggacaggactatctggttggcaacaagctgtctagggctgacatacacctggttgagttactatattacgtggaggagcttgactcaagtctgatctcgtcatttcctctgctgaaggcattaaagacgcgcatatctaacctacccactgttaagaaatttttgcagcccggaagcccgagaaagcccccaatggatgaaaagtctcttgaggaagccagaaagattttccgattttag

SEQ ID NO: 189478 - DNA, 669 bp, Artificial Sequence
  Description of Artificial Sequence: Synthetic coding sequence
atggccgagaagcccaagctgcactacagcaacatccggggccggatggaatctattcgatggctgctggcagctgctggtgtagagtttgaagagaagtttattaaatccgcggaggaccttgataagctgcgcaatgatggctacctgatgttccagcaggtgcccatggttgaaattgacgggatgaaactggtccagacacgtgcgatactgaattatatcgcctccaagtacaatctctacggaaaggacatcaaggaaaaagctctcattgatatgtatatcgaagggatcgccgaccttggcgagatgattctgcttctgcccttcagccagcctgaagagcaggacgccaaacttgccttaatccaggagaaaaccaagaaccgctactttccagccttcgagaaggtgctaaagagccatggccaagactacctcgttggaaacaagctgtccagagccgacatacaccttgtggaactactttactacgtggaggagttagatagctcgctgatttcctcttttccgcttctcaaggcgctcaaaacccgcatttccaacttaccaaccgtaaagaagtttttacagcctggttcccccaggaaaccccctatggatgagaagagcctcgaagagagcagaaagattttccgcttctag

SEQ ID NO: 189479 - DNA, 729 bp, Artificial Sequence
  Description of Artificial Sequence: Synthetic coding sequence
atgctgctgctggccccccagatgctgagcctgctgctgctggccctgcctgtgctggcctcaccagcatatgtggcacccgcgcctggccaggctctacaacagactgggatcgtcggcggacaggaggcacccagatccaaatggccgtggcaagtctctctcagggtaagaggtccctactggatgcatttctgcggaggaagtcttatacacccacaatgggtgctaaccgctgcacactgtgttgagcccgatattaaggatctggcggccctgagggtgcagctccgggagcagcatctgtactatcaagaccagcttctgcctgtgtccaggatcatcgtgcaccctcagttctacattatacaaaccggggctgatatcgctctcctggaacttgaagagcccgtgaacatcagttcacatattcacaccgtgactctgccccctgcgtctgagacattccccccaggtatgccgtgttgggttactggatggggcgatgtagataataacgtgcacctacctccgccctaccctctgaaagaagtggaggtgcctgtcgtcgaaaaccacctgtgtaatgcggagtaccacacgggcttacacactggtcatagcttccagatagtacgagatgatatgttgtgcgccgggtcagagaatcatgattcgtgtcagggagacagtggcggccccctagtctgtaaagtcaacggaacgtag

SEQ ID NO: 189480 - DNA, 519 bp, Artificial Sequence
  Description of Artificial Sequence: Synthetic coding sequence
atgttccagcaggtgcccatggtggagatcgacggcatgaagctggttcagactcgtgccattttgaattacatcgctagcaagtataatctgtatgggaaggacattaaggaaagggcgctgatcgacatgtacacggagggcatggcggatcttaacgagatgattctactgctgccactttgccgccccgaagaaaaagatgccaaaattgccctgattaaggagaaaaccaagagtcgttattttcctgcttttgaaaaggtgcttcaaagtcatgggcaagactaccttgtcggaaataagctgtcacgggctgatatttcccttgtggaactattgtattacgtcgaagagctggatagttctttgatctcaaacttcccgcttctaaaagcccttaaaacaagaatttcaaacctgcctactgtaaagaagtttcttcaacccggctccccacggaagccccctgctgatgctaaagcactggaggaggcccgtaagattttccggttctag

SEQ ID NO: 189481 - DNA, 327 bp, Artificial Sequence
  Description of Artificial Sequence: Synthetic coding sequence
atgttccagcaggtgcccatggtggagatcgacggcatgaagctggttcaaaccagagctatcctgaactacatagcaagcaagtataacttgtacggcaaagacattaaggagcgcgccctcatcgacatgtacactgagggaatggcggatcttaacgagatgattctcctgctgccattatgtaggcctgaagagaaggacgccaagatcgcactgattaaggagaaaactaaaagcaggtactttccggcatttgaggcggatatttccttggtagagctgctctattacgtcgaggagctggacagttcactgatctcgtag

SEQ ID NO: 189482 - DNA, 669 bp, Artificial Sequence
  Description of Artificial Sequence: Synthetic coding sequence
atggccgcccggcccaagctgcactaccccaacggccggggccggatggaatctgttcggtgggtcctggctgccgcgggcgtggaatttgatgaggaatttctagagacaaaggaacagttgtataagcttcaggacggaaatcatctgttgttccagcaagtgccaatggtggaaattgacggaatgaaactggtgcagaccaggagcatattacactacattgcagataaacacaatttattcgggaagaatctgaaggaacgaactctcatagacatgtacgtggaaggaacactggatctcctggagctgctgataatgcatccctttctgaaacccgatgaccaacaaaaggaagtcgtgaacatggctcagaaggccatcatccgctatttccccgtgttcgagaaaattctcagaggccacggacagagctttctggtggggaatcagctgtccttggccgacgtgatcctgctgcagactatcctggcccttgaagaaaagatcccaaacatcctgtcagcattcccctttctgcaagagtacacagtgaagctcagtaatatacctactattaagcgtttcctggagccaggatccaaaaagaagcctccacccgatgagatctatgtgcgcaccgtttataacattttccggccatag

SEQ ID NO: 189483 - DNA, 390 bp, Artificial Sequence
  Description of Artificial Sequence: Synthetic coding sequence
atgtacgtggagggcaccctggacctgctggagctgctgatcatgcaccctttcctcaagcctgacgatcagcagaaggaggttgtgaacatggcacagaaagccattatacgttacttccctgtcttcgaaaagatcctccgcggacacggccagtccttccttgtgggaaatcagctgtccctggctgacgtgatactcttgcaaaccatcctggccctggaggagaaaatacctaatatcctttctgccttcccttttctgcaggagtatacagttaaactgtccaatatcccaaccattaagaggttcctggaacctgggagtaagaaaaagccaccgccggatgagatctacgtcagaaccgtgtataacatcttcaggccatag

SEQ ID NO: 189484 - DNA, 669 bp, Artificial Sequence
  Description of Artificial Sequence: Synthetic coding sequence
atggccgcccggcccaagctgcactaccccaacggccggggccggatggagtccgtgagatgggtgctggcggctgccggagtggaattcgatgaggagttcctagaaaccaaagagcagttgtacaaactgcaggacggcaaccacctgctgtttcaacaggtccctatggtcgaaattgatggtatgaagttagtgcagacacgcagcatactgcattacattgctgacaagcacaacttgttcggtaagaacctcaaggagaggaccctcattgatatgtatgtggagggcacacttgacttgttagaactcctcataatgcacccttttcttaagcctgacgaccaacagaaggaggtggtgaatatggcacagaaggctatcataagatattttccagtcttcgagaaaatcctgcggggtcacggacagtctttcctcgtgggtaaccagctttcactcgcagacgtgatcttgctgcaaacaatcctagcactggaagaaaagatcccaaatatcctctctgctttcccctttctgcaagagtacacagttaagctcagcaacattcccactattaagagatttctcgaaccaggctcaaagaaaaagccaccacccgacgagatctatgtcagaacagtgtacaatatctttcggccctag

SEQ ID NO: 189485 - DNA, 270 bp, Artificial Sequence
  Description of Artificial Sequence: Synthetic coding sequence
atgtacgtggagggcaccctggacctgctggagctgctgatcatgcaccctttcctgaagccagatgaccagcaaaaggaagttgtcaatatggcacagaaggctattatcagatattttccagtctttgaaaaaatactgcgcggacatgggcagagttttttagtgggaaatcagctcagtctggccgacgtgatactgcttcagacaattctcgccctggaggagaaaattccgaacatcctgagcgcattcccttttctacaatag

SEQ ID NO: 189486 - DNA, 390 bp, Artificial Sequence
  Description of Artificial Sequence: Synthetic coding sequence
atgtacgtggagggcaccctggacctgctggagctgctgatcatgcaccctttccttaaacccgacgaccaacaaaaagaagtggtgaatatggctcaaaaggccatcatccggtacttccccgtattcgagaagatactgcgcggacatggtcaatctttcctcgtggggaaccagctctcactggccgatgttatcttgctgcaaactattctggccctggaggagaaaatccccaacatcctgtctgccttccccttcttgcaagagtacactgtgaagctgtccaatattccgaccattaaacggtttctggagcccgggagtaagaagaagcctcctccggatgagatctacgtgaggaccgtatacaatatctttcgtccatag

SEQ ID NO: 189487 - DNA, 669 bp, Artificial Sequence
  Description of Artificial Sequence: Synthetic coding sequence
atggccgagaagcccaagctgcactacagcaacgcccggggcagcatggagtctattcgctggctgctggccgcagcgggggtggaactggaggagaaatttctggaatcggctgaggacctggacaagctaagaaacgacgggtccctgctgttccagcaggtgcctatggtggagattgacggtatgaaactggttcagacacgggccatacttaactacatcgcctcaaaatacaatttgtacggaaaggacatgaaggagcgtgccctgatcgatatgtatactgagggaatagttgacctgactgaaatgattctcctactgctcatttgccagcccgaggagcgggacgctaaaacagccctggttaaggagaaaattaagaatcgatacttccctgccttcgaaaaagttctcaagagtcaccggcaggactatctggtgggaaacaaacttagttgggctgatattcacctagtggagctcttttactatgtagaggagctggatagtagtctgatttcgagctttccattgctaaaggcccttaaaacaaggatctccaaccttccaaccgtgaagaaattccttcagcctggaagccaaaggaagccgcctatggatgagaagtccctcgaggaagctagaaagatcttcagattctag

SEQ ID NO: 189488 - DNA, 669 bp, Artificial Sequence
  Description of Artificial Sequence: Synthetic coding sequence
atggccgagaagcccaagctgcactacagcaacgcccggggcagcatggagtcaatacgctggctcttggctgccgctggtgtagagctggaggagaaattcctcgaatcagcggaagaccttgacaagctgcgcaatgacggctcactgctctttcaacaggttccgatggtggagattgatggtatgaagttagttcagactagagccatcctgaattatatcgccagcaaatacaatctatacggcaaagacatgaaggagagagctcttatcgacatgtatacagaggggatcgtcgaccttaccgaaatgattctcctgttactgatctgccagcctgaggagcgggacgcgaagacggccctcgtcaaggaaaaaattaaaaaccgatattttccagcttttgagaaggtgctgaaatcccataggcaggattacctggttggcaataagctgtcctgggctgacatccatttggtggagttgttctactacgttgaagagctggactctagccttatctccagcttcccacttctgaaggctctgaaaaccaggatctctaacctcccgactgtgaagaagtttttgcaaccaggctcccagcgaaagccgcctatggacgagaaaagcctggaggaggcccgtaaaatctttcggttttag

SEQ ID NO: 189489 - DNA, 657 bp, Artificial Sequence
  Description of Artificial Sequence: Synthetic coding sequence
atgcccatgatcctgggctactgggacatccggggcctggcccacgccatccggctgttgctggagtacacagacagctcatacgaagaaaagaagtacaccatgggggacgcccctgattatgaccgcagccagtggttgaatgagaagttcaaactaggactcgatttcccaaatctcccctacctgatcgacggagctcacaaaattactcagtccaacgctatcctctgctacatagctaggaaacataacctctgcggcgaaaccgaagaagaaaaaattcgtgtggatatcctggaaaaccagacaatggataatcacatgcaacttggcatgatatgttataaccccgagtttgagaagctgaagcctaaatacttagaagagttacccgagaagctcaagctctacagcgaatttctcggtaagcgtccctggttcgctggaaacaagatcacattcgtggacttcctagtgtatgatgtcctcgacttacatcggatcttcgagcccaagtgtttggatgctttccctaatctaaaagacttcatctcacgtttcgaaggtcttgagaagatttctgcctatatgaagagcagccgcttcctccctagacctgtgttttcaaaaatggccgtctggggcaataagtag

SEQ ID NO: 189490 - DNA, 546 bp, Artificial Sequence
  Description of Artificial Sequence: Synthetic coding sequence
atgcccatgatcctgggctactgggacatccggggcctggcccacgctatcagactgctgcttgagtacaccgattcatcatatgaagaaaagaaatacacgatgggggacgctccagactatgatcgtagccaatggctcaatgaaaaattcaaactgggcttggacttcccaaacctgccctacctaattgatggggcccacaagattacacagagcaacgccatcttgtgctatattgccaggaaacacaacctctgcggcgaaacagaggaggagaagatccgcgtggacattctagaaaaccaaacaatggacaatcacatgcagttgggcatgatctgctacaacccagagtttgagaaactaaagcccaagtatctggaggagctgcccgaaaagttgaaactatacagcgagttcctcggaaagcgtccatggtttgctggtaataaaggactcgagaagataagtgcctatatgaagtcttccagattcctgccccgccctgtcttctcaaaaatggctgtttggggcaacaagtag

SEQ ID NO: 189491 - DNA, 450 bp, Artificial Sequence
  Description of Artificial Sequence: Synthetic coding sequence
atgcccatgatcctgggctactgggacatccggggcctggcccacgcaattcggctgctgctggaatatacagactcctcttacgaggagaagaaatacaccatgggggacgccccggattatgacaggtcccaatggctaaatgagaagttcaaactgggattagatttccccaaccttccttatttaattgatggggctcataaaatcacccaatccaacgccattctgtgctacatcgcccgaaaacacaacctgtgtggggagaccgaagaagaaaagatcagagtcgatatccttgaaaaccagaccatggacaaccatatgcagctgggaatgatttgttataaccccgaattcggcctagagaagatcagcgcatacatgaaatcatccagatttctccctcgcccggtctttagtaagatggccgtttggggaaacaagtag

SEQ ID NO: 189492 - DNA, 714 bp, Artificial Sequence
  Description of Artificial Sequence: Synthetic coding sequence
atgcccatgatcctgggctactgggacatccggggcctggcccacgcaatcaggttgctgctcgaatacaccgacagttcctatgaagagaaaaaatataccatgggtgacgcaccagactacgaccgctctcagtggctcaacgaaaagtttaaactgggcctggactttccaaatggcatgctgggctcacttgtagctcagctgtctttcgccggattcccttccatccaactgccttacttaattgacggtgctcacaagatcacccaaagcaacgcgattttgtgttatattgcacgaaagcacaacctgtgcggagagacagaggaggagaaaatacgcgttgatatcctcgagaatcagaccatggataaccacatgcagctggggatgatatgttacaatccagaattcgaaaagctgaaaccaaagtatctggaggagttacccgagaagctgaaactgtactcggagtttttgggcaagcggccttggtttgctggcaataagattaccttcgtcgactttctggtgtatgacgtgctggacctacacagaatttttgaaccaaagtgcctggacgcatttccaaatctgaaggattttatcagccggttcgagggtctcgaaaagatctcagcatatatgaaatcaagccgctttctccctcgccctgtctttagtaagatggctgtgtggggtaataagtag

SEQ ID NO: 189493 - DNA, 657 bp, Artificial Sequence
  Description of Artificial Sequence: Synthetic coding sequence
atgcccatgaccctgggctactggaacatccggggcctggcccactccattagactgctgctggaatatacagacagctcttatgaggagaaaaaatatactatgggagacgcccccgactacgatcgatcccagtggctcaatgagaaattcaagctgggcttggacttcccgaacctgccttatcttattgacggtacccacaaaataactcaatctaacgccattttgcgctatatcgcccggaaacataacctgtgtggagaaagtgagaaagagcagataagggaagatatactggagaatcagtttatggactcacgaatgcagctggctaagttatgctatgatcccgacttcgagaaactaaaacccgaatatctccaggccctgcctgagatgctgaaactatacagccagtttctggggaagcagccttggttcctgggcgacaaaattaccttcgtggacttcatcgcatacgatgtactggaacggaaccaggttttcgagcctagttgtctagacgccttcccaaacctgaaggattttatcagccggttcgaggggcttgagaaaataagcgcttatatgaaatcttcgcgcttcctgcctaggcccgtcttcactaagatggcagtgtggggcaacaaatag

SEQ ID NO: 189494 - DNA, 540 bp, Artificial Sequence
  Description of Artificial Sequence: Synthetic coding sequence
atgaccctgggctactggaacatccggggcctggcccacagcatccgtcttcttctggagtatacagattccagctatgaggagaaaaaatatacaatgggggacgcacccgattatgacaggtcccaatggctgaacgagaagttcaagctgggcctggactttccaaacctgccttatctcatagacggcacacacaaaattacacagtccaacgcaatattgagatacattgccagaaaacacaatctgtgcggagaatcagaaaaagaacagatacgcgaggatatcttagagaaccagtttatggacagccggatgcagctagcaaaactctgttacgatccggactttgaaaaactcaaaccagaatatctccaggccttgcctgaaatgctcaagttgtactctcagtttctcggtaagcagccatggtttttaggcgacaagggactggagaagatttcagcctatatgaaatccagcagatttcttccccggcctgtctttacaaaaatggcggtctggggaaacaaatag

SEQ ID NO: 189495 - DNA, 264 bp, Artificial Sequence
  Description of Artificial Sequence: Synthetic coding sequence
atggacagccggatgcagctggccaagctgtgctacgaccccgacttcgaaaagctgaagccagagtatctgcaggctctgcccgagatgcttaagttgtactctcaatttctcgggaagcagccatggtttttaggcgacaagatcacctttgtagactttatagcatacgatgtgttggaacgaaaccaggtcttcgaacccagctgcctggacgccttccccaatttaaaggattttatttctcggtttgagcacagttag

SEQ ID NO: 189496 - DNA, 576 bp, Artificial Sequence
  Description of Artificial Sequence: Synthetic coding sequence
atgcccatgaccctgggctactggaacatccggggcctggcccactcaattaggcttctgctcgagtataccgatagcagttatgaagaaaagaagtatactatgggggatgcccccgactatgatagaagccagtggttgaacgaaaagttcaagctaggcctggatttccctaatttgccctatttaattgacggtacgcataaaataactcaaagcaacgcgattttgcgctacatagctcgaaagcacaatctctgcggcgaaagcgaaaaggagcagattagggaggatattttggaaaaccaattcatggatagtcgtatgcagttggcaaagctctgctacgaccccgactttgaaaagctcaagcccgagtacttgcaggccctgcctgagatgcttaagttgtacagccagttcctgggaaagcagccctggttcttaggtgataagatcacatttgtggacttcatcgcctatgacgtactcgagagaaaccaggtcttcgagccatcctgcctcgacgccttccccaacctgaaggatttcatttctcgctttgagcatagttag

SEQ ID NO: 189497 - DNA, 576 bp, Artificial Sequence
  Description of Artificial Sequence: Synthetic coding sequence
atgcccatgaccctgggctactggaacatccggggcctggcccacagcattaggctgcttttagagtataccgactcttcctatgaagaaaaaaagtatacaatgggggatgcccccgactatgatcggagtcaatggctgaatgaaaaattcaaactaggtctcgacttcccaaaccttccgtacctgatcgacggaactcacaagatcacacagtctaatgcaattttgcgatacatcgccagaaagcataacctgtgcggcgagtccgagaaggaacagatccgagaggacatcttggaaaatcagtttatggacagtcgaatgcagctggcgaagctgtgctatgatcctgacttcgaaaaactcaaacctgagtacttgcaggccctgcccgagatgctgaagttgtactcgcagttcttgggtaagcagccttggtttctcggcgataaaatcaccttcgtggattttatcgcctacgatgtgctggaacgcaatcaggtgttcgagccttcctgcctggatgcctttcccaaccttaaggatttcatcagccgattcgagcacagctag

SEQ ID NO: 189498 - DNA, 678 bp, Artificial Sequence
  Description of Artificial Sequence: Synthetic coding sequence
atgagctgcgagagcagcatggtgctgggctactgggacatccggggattggctcacgcgatccgcctgttgctggaattcacagacacatcctacgaggaaaaaagatatacctgcggagaagcaccggactatgataggagccagtggctcgacgtcaagtttaaactcgacctagattttcctaacctgccatacctgctagacgggaaaaataagatcacgcagagtaacgctatcctgagatacattgcacgaaagcacaacatgtgcggagagacagaggaggaaaaaatacgcgttgatatcatagaaaatcaagtgatggactttcgaacacagcttattcggttgtgttactcctcagaccacgagaaactgaaaccacagtacctcgaagaactgcctggccagctaaagcaattcagtatgttcttggggaaattcagttggttcgcaggggagaagctcactttcgtggattttctgacttacgacatcctggatcagaatcgaatttttgatcccaagtgcctggacgagtttcccaatctcaaggccttcatgtgccgattcgaagctctggagaaaatcgcagcttacctgcagtctgatcaattttgtaagatgcctatcaacaacaagatggctcagtggggcaataagccagtttgctag

SEQ ID NO: 189499 - DNA, 678 bp, Artificial Sequence
  Description of Artificial Sequence: Synthetic coding sequence
atgagctgcgagagcagcatggtgctgggctactgggacatccggggtcttgctcacgcgattagattactgctggagttcacggacacctcatacgaggaaaagaggtatacctgcggcgaggcacctgactatgacaggtcccaatggctggatgtgaagttcaagttggatctggacttccctaacttgccgtacctcctggacggtaagaacaagatcactcagagcaatgccatactgcgctatatcgcaaggaaacacaacatgtgcggagaaacagaggaagagaagatacgggtagatattatcgagaaccaggtcatggatttccgaacccagctgattcgcttatgctattcttccgaccacgagaaattgaaaccacagtacctggaagagttgccaggacagctcaaacagttctccatgttcctgggcaaattcagttggttcgctggggagaaattgacttttgtggattttcttacatacgatatactggatcaaaaccggatctttgatccaaagtgtctggacgagttccccaacctgaaagcctttatgtgcaggttcgaagcactcgaaaagatcgccgcttacttacagagtgaccagttttgcaagatgccaatcaataataagatggctcagtggggaaacaagccagtctgttag

SEQ ID NO: 189500 - DNA, 678 bp, Artificial Sequence
  Description of Artificial Sequence: Synthetic coding sequence
atgagctgcgagagcagcatggtgctgggctactgggacatccggggtttggcacatgctattaggctgctgctggagtttacggatacttcgtatgaggaaaaacggtatacctgcggcgaggctcccgattatgacaggagtcagtggttagacgtgaaatttaaactggatctagatttccccaatctaccttatcttctggacggtaaaaacaaaattacccaaagcaacgctatcttaaggtatattgcaagaaagcacaacatgtgtggggagaccgaggaagagaaaataagagtcgacatcattgagaatcaggttatggacttccgtacccagttgatcaggctgtgctactcatcagatcacgagaagctgaagccacaatacctggaggaattacctggacaactcaagcagttctcgatgtttttgggcaaattctcatggttcgcgggcgaaaagctaaccttcgtggactttctcacctatgacatcctggaccagaaccgcattttcgaccccaaatgccttgacgagttccccaacctcaaagcattcatgtgccgcttcgaggctctcgagaagattgctgcttaccttcagtccgatcagttctgtaagatgcccatcaataataaaatggcccaatgggggaacaagcccgtgtgttag

SEQ ID NO: 189501 - DNA, 588 bp, Artificial Sequence
  Description of Artificial Sequence: Synthetic coding sequence
atgagcatgaccctgggctactgggacatccggggcctggcccacgccatacggctcctgcttgaatacaccgatagctcatatgaagagaaaaagtacacaatgggagacgcccccgattatgatcgcagccagtggttgaacgagaagttcaagctgggcctggattttcctaacctcccctatctgattgatggcgcacacaagatcacacagagcaatgccatcctctgctacattgctcgtaaacacaatctttgtggtgagactgaggaagaaaaaatcagggtggatatcctagaaaaccaggccatggatgtctctaaccagctggctcgggtctgttactctccagactttgagaaactgaagcctgaatacctggaggagctgcctacaatgatgcagcacttcagccaatttcttggcaagcgaccttggttcgtaggcgataagatcactttcgtggattttcttgcatatgatgtgttggatctgcataggatctttgagcccaactgcctcgatgccttcccaaatttgaaagatttcatcagccgcttcgaagtgagctgtggtataatgtag

SEQ ID NO: 189502 - DNA, 474 bp, Artificial Sequence
  Description of Artificial Sequence: Synthetic coding sequence
atgagcatgaccctgggctactgggacatccggggcctggcccacgctattcggctcctgctggaatataccgatagttcttacgaggagaagaaatacacaatgggggatgctccggactacgaccgcagtcagtggctcaacgagaaattcaagctgggcttagatttccccaatgagaagcttaaacctgagtacttggaagagctgccaaccatgatgcaacacttcagtcaattcctagggaaacggccctggtttgtcggagacaagatcacttttgtggactttcttgcctacgacgttctggatctgcatcgtatcttcgagcctaattgcctggatgcctttccaaacctgaaggacttcatatctcggttcgaagggctggagaagatctccgcatacatgaaaagctccagatttctgcctaagccactatatactcgtgttgccgtttggggcaacaaatag

SEQ ID NO: 189503 - DNA, 609 bp, Artificial Sequence
  Description of Artificial Sequence: Synthetic coding sequence
atgctgggcagcctgctggcccagctgagcttccccggcttcccctccatccaactcccatacctcatcgatggcgcccataagatcactcagtccaacgccatcttgtgttacatagcacgcaaacataatctctgcggcgagaccgaggaagagaagattagagtggatatcctggagaaccaggcaatggatgttagcaatcagttggcacgggtgtgctattccccagacttcgaaaagcttaagcccgaatatctggaagagttgcctaccatgatgcagcactttagccagtttctgggaaaaagaccttggtttgtcggtgacaaaatcaccttcgtggacttcctggcctatgatgtgctcgacctgcacagaatctttgagcctaactgccttgatgcgttccccaacttaaaggacttcattagtagatttgaagtcatgcctccctcctcgtttctgttcgacgccccgtgctctgtgacttcctttcagatgctaagccagagttggtcctatattaaaaacaacctccaccttctgagtgcaggattcatgcccggtacactaccctccacgctgtacctgtcgtgcggtatctag

SEQ ID NO: 189504 - DNA, 657 bp, Artificial Sequence
  Description of Artificial Sequence: Synthetic coding sequence
atgagcatgaccctgggctactgggacatccggggcctggcccacgccattaggcttctgcttgaatatactgacagctcttatgaagagaagaagtacaccatgggtgatgcacccgattacgaccggagccagtggctcaacgagaaatttaaactcggtttggactttcccaacctgccctatctgattgacggagctcataaaataactcaatccaatgccattttgtgttatattgccagaaagcacaatttgtgcggtgaaaccgaggaggagaaaatccgggtagacatcctggaaaatcaagctatggatgtgtccaatcagcttgcccgggtttgctactcgcccgatttcgaaaaactgaagccagaatacctcgaggagctgcctacgatgatgcagcacttcagtcagtttcttgggaaacgaccatggttcgtgggtgacaaaattactttcgtcgatttcttggcctatgacgtgttggacctgcatcgcatctttgagcctaactgcttagacgcgttcccaaacctgaaagacttcatctccaggttcgaaggtctagaaaaaatcagcgcttatatgaaatcctcacggttcctgcctaagcccctgtataccagagtggctgtatgggggaataaatag

SEQ ID NO: 189505 - DNA, 657 bp, Artificial Sequence
  Description of Artificial Sequence: Synthetic coding sequence
atgcccatgaccctgggctactgggacatccggggcctggcccacgcaattcgccttctgttggagtatacagattcaagttatgtcgagaaaaagtacacactcggagacgcacctgactatgaccgatcccagtggcttaatgaaaagtttaagttaggcttagacttccctaatctgccttatctgatagacggcgcccacaagatcacacagagcaacgcaatcctgaggtacatcgcccgcaagcataatttgtgcggagagaccgaggaagagaagatccgcgttgacatattagagaaccaggtgatggataatcatatggagctggtgcggctctgttatgaccccgactttgagaagctaaaacctaaatatctggaagagttgccggaaaagctcaaactgtattccgaatttctgggaaaacgcccttggtttgctggcgataagattacctttgtcgattttcttgcatatgacgtactagatatgaagcgcatcttcgaacctaaatgtctcgacgcatttcttaatttaaaagacttcatctcaagatttgagggtcttaaaaaaattagcgcctacatgaagtcctcccagtttctccggggcctgctgtttgggaaaagtgctacctggaatagcaagtag

SEQ ID NO: 189506 - DNA, 714 bp, Artificial Sequence
  Description of Artificial Sequence: Synthetic coding sequence
atgcccatgaccctgggctactgggacatccggggcctggcccacgcaatcaggcttctgttggagtacactgactcttcatacgtggagaagaaatacacactcggtgatgcccccgactacgaccggtctcagtggcttaacgagaaatttaagctgggactggattttccaaatggcatgcttgggagcctggtagctcagctgagctttcctgggtttcccagcatccagttgccatacctgatagatggcgcacacaaaatcacacaaagcaacgctatattaagatacatcgcccgcaagcacaacctgtgtggcgaaaccgaagaggagaagatcagggttgatattctggagaaccaggtgatggacaatcacatggagttggtgcgcctctgttatgatccagattttgaaaaactgaagccgaagtaccttgaagagttgcccgaaaaactgaaactgtatagcgaatttctcggcaagagaccatggtttgcaggggataagataacgttcgtcgacttcctggcttatgatgtcctcgatatgaagcgcattttcgagcctaagtgcctggatgccttcctcaacttaaaagactttattagccgattcgagggtctaaaaaagatctccgcttacatgaagagcagccaattcctcagggggctcctgttcggcaaaagcgccacttggaattccaaatag

SEQ ID NO: 189507 - DNA, 609 bp, Artificial Sequence
  Description of Artificial Sequence: Synthetic coding sequence
atgctgggcagcctggtggcccagctgagcttccccggcttccccagcatccagctgccatatctcattgacggggcacataaaatcacgcagtcaaacgctatcttgagatacattgctcggaagcataatttgtgcggggaaactgaggaggagaagattagagtggacatcttggaaaaccaagtaatggacaaccacatggaattggtgaggctttgctacgacccggacttcgaaaaactcaaacccaagtacctggaagaactccctgaaaagttgaagctttacagcgaattccttggcaagaggccctggttcgccggcgataaaataacttttgtggactttttggcttatgacgtattagacatgaaaaggatatttgaacccaaatgcctcgacgcctttctcaatctgaaagatttcatttccaggttcgaagtaatgcccccaagctcctttctgttcgatgctccttgctcctttcttagctttcagatgctcagtcaaagttggtcctacaccaaaaacaattcctacgtgctgagtacaggtttcatgccagggattatgccgtccacattgtacctcagctgccggatctag

SEQ ID NO: 189508 - DNA, 627 bp, Artificial Sequence
  Description of Artificial Sequence: Synthetic coding sequence
atgagcggcgagagcgcccggagcctgggcaagggcagcgccccccccggtccagtgcctgagggaagcatcagaatctattccatgagattttgtccatttgctgaacgaaccaggctggtgctgaaagcgaaaggcatccgacatgaggtcataaatattaatctgaaaaataagcccgagtggttcttcaagaagaatccttttgggttagtgcccgtgctggagaactcccagggtcaattgatatatgagtcagctattacctgtgagtatttggatgaggcttaccctggaaagaaactgctccccgacgacccatatgaaaaggcatgtcagaagatgatattagagcttttttcaaaagtgctgactaacaagaaaacaacattcttcgggggaaacagtatctctatgatcgactacctcatatggccatggtttgagcgtctcgaggcgatgaaattgaacgagtgtgtggaccacactcctaaactcaagctttggatggccgccatgaaggaggatccaacagtgagcgcccttttaacctccgagaaagactggcagggattcctggaactgtacctccagaactcgcccgaggcctgcgactatgggctgtag

SEQ ID NO: 189509 - DNA, 726 bp, Artificial Sequence
  Description of Artificial Sequence: Synthetic coding sequence
atgagcggcgagagcgcccggagcctgggcaagggcagcgcccccccgggacccgtccccgaggggtccatccggatctatagtatgcgcttctgcccctttgcagaacgcacacgacttgtgctgaaagcaaaaggaattcgtcatgaggtgattaacattaatctgaaaaataagcctgagtggtttttcaagaagaatccattcgggctcgtgccggtcctggagaattctcagggacagctcatctacgaatccgccataacatgcgaatatctggatgaagcctatccaggcaagaagcttcttcccgatgatccatacgaaaaagcatgccaaaagatgatcctggagctcttttcgaaggtcccctcccttgtcggaagtttcatccgaagtcagaataaagaggactatgccggccttaaagaggagtttcggaaggaattcacaaagctggaagaagtacttaccaataaaaagactaccttttttggcgggaacagcataagcatgatcgactacttaatttggccctggttcgagcgcttagaagctatgaagctgaatgaatgtgtggatcataccccaaaactgaagctgtggatggccgctatgaaggaggatccaactgttagcgccctgctgacatcagagaaagattggcaaggattcctggagctgtacctgcagaatagcccagaagcctgtgactatggactgtag

SEQ ID NO: 189510 - DNA, 543 bp, Artificial Sequence
  Description of Artificial Sequence: Synthetic coding sequence
atgcggttctgccccttcgccgagcggacccggctggtgctgaaggctaaggggatcagacatgaggtgatcaacatcaacctcaagaacaagccggaatggttttttaaaaaaaatccctttgggttagtgcccgtcctcgaaaattcacaagggcagctgatctatgagtcggccatcacctgcgagtatctcgatgaagcatatcccggcaaaaaattgttgcctgacgacccatatgaaaaggcttgtcaaaagatgattttggagctcttcagtaaagttctgaccaataaaaagacaaccttcttcggaggcaactccatttcaatgattgattatcttatctggccatggtttgagaggctggaagctatgaagttgaacgagtgcgtggaccacacccccaagcttaagctctggatggcggccatgaaagaagacccgacggtctctgcactcctcactagcgagaaagattggcagggattcttagagctgtatctacagaattccccagaggcttgtgattacggactttag

SEQ ID NO: 189511 - DNA, 603 bp, Artificial Sequence
  Description of Artificial Sequence: Synthetic coding sequence
atgcggttctgccccttcgccgagcggacccggctggtgctgaaggcaaagggtattcggcatgaagtgatcaatataaacctcaagaacaaaccagagtggtttttcaagaaaaatcccttcggtctggttcctgtactggagaactctcagggccagctaatatatgagtccgctatcacgtgtgagtatctggacgaagcttacccagggaaaaaacttctgcccgatgacccctacgaaaaggcctgccaaaaaatgatactagagttgttctctaaagtgcctagccttgttggcagcttcatccggagccagaacaaggaagactatgcagggctaaaggaggaattcagaaaagagtttacaaagctcgaggaggtcctgactaacaagaagacgaccttttttggtggcaacagcatttctatgattgactatctgatttggccttggtttgagcgcttagaagcaatgaagttaaatgaatgcgtagaccacactccaaagctcaagctgtggatggctgcgatgaaggaggacccgaccgtgtccgcgctgttgacctccgagaaggactggcagggctttctggaattatag

SEQ ID NO: 189512 - DNA, 642 bp, Artificial Sequence
  Description of Artificial Sequence: Synthetic coding sequence
atgcggttctgccccttcgccgagcggacccggctggtgctgaaggcgaaaggcatccggcatgaggtgattaacatcaacctgaagaataagccggaatggttttttaagaagaatccttttgggctcgttcccgtcctcgaaaactcccaggggcagttaatttacgagtcagctattacctgcgaatatctggatgaggcctatcctggtaagaaactccttccggatgacccttacgagaaagcctgtcagaagatgattctcgaactgttctcaaaggtcccaagcctcgtgggcagcttcattagatctcagaataaagaggattatgcggggctcaaagaggagttccggaaagaatttaccaaactggaagaggttctcaccaataagaaaaccaccttttttggcgggaactccatctccatgattgactacttgatctggccctggttcgaaaggctggaggcgatgaagctgaatgagtgcgtggaccacactccaaagctgaagttgtggatggccgccatgaaggaagatccaacagtgagcgcgctgcttacctctgaaaaagactggcagggctttctggagctttaccttcagaacagccctgaagcctgcgactatggactgtag

SEQ ID NO: 189513 - DNA, 732 bp, Artificial Sequence
  Description of Artificial Sequence: Synthetic coding sequence
atgagcggcgacgccacccggaccctgggcaagggcagccagccccccgggccagtgcccgaaggactgattcggatatactccatgcgattctgtccttatagccatcgtacacggctggtgctgaaggcaaaggatattcggcacgaggtggtcaatatcaaccttagaaataaacctgagtggtattatacaaagcacccatttggtcatatcccagtcttagaaactagtcaatgtcaactcatctacgagagcgtgattgcctgcgaatacctggatgacgcctaccccgggagaaagctctttccgtacgacccctacgagcgcgcaagacagaaaatgctgctggagttgttttgtaaggtaccacatctcacgaaggaatgtttagtggccctgaggtgtggaagagagtgtaccaacctaaaagctgccctgagacaagagtttagcaatttggaggagatactcgagtaccaaaacaccaccttttttggaggaacttgcatctctatgatcgactacttgctttggccatggttcgagagactagacgtctacggcatcctggactgcgtgtcacacacccctgcactgagactgtggatctccgctatgaagtgggatcctactgtgtgcgctctgttgatggacaaaagcatcttccagggcttcctgaatctatatttccagaataatcctaacgcctttgacttcgggctgtgttag

SEQ ID NO: 189514 - DNA, 648 bp, Artificial Sequence
  Description of Artificial Sequence: Synthetic coding sequence
atgcggttctgcccctacagccaccggacccggctggtgctgaaggctaaggatattaggcatgaggtggttaacatcaacctcagaaacaagcccgaatggtactataccaaacatccctttggacacatccccgtgctcgaaaccagccagtgccaactgatctacgagtccgtcattgcttgcgagtatcttgacgatgcctaccctggtagaaagctgtttccatatgatccatacgaacgcgctcgccagaaaatgctgttggagctgttctgtaaggtgccccacttgactaaagagtgcctagtggctttgcgctgtggcagagagtgcacaaacctgaaggctgctctgagacaagagttctccaacctggaagagatcctggagtatcaaaacactactttctttggcggcacatgtataagcatgattgattacctgctctggccgtggttcgagcgcctggacgtctacggcatactcgattgtgtgagccacaccccagctttacgcctgtggatttctgccatgaagtgggaccctactgtgtgtgccctgctgatggacaagtccatttttcaaggatttcttaatctttacttccagaataatccaaatgcattcgattttgggctgtgttag

SEQ ID NO: 189515 - DNA, 732 bp, Artificial Sequence
  Description of Artificial Sequence: Synthetic coding sequence
atgagcggcgacgccacccggaccctgggcaagggcagccagcccccgggcccagtgcccgaaggactcattagaatttactcgatgcgcttctgcccctattcacaccgtaccaggctcgtgctgaaggctaaagacattcgtcacgaagttgtcaatatcaacctaagaaataaacctgagtggtattacactaagcatccattcggtcacatccctgtcctagagaccagtcagtgccaactgatctacgagtccgttattgcttgcgaatacctggatgatgcatatcccggtagaaaactcttcccctacgatccttacgagcgggcaagacagaagatgctacttgaacttttctgtaaagtcccacacctgacgaaggagtgtttagtggccttacgatgcggtagagagtgcaccaaccttaaggctgcgctcaggcaggagttttctaacctggaggaaatactggagtaccagaacaccacattctttggcggaacatgtatctccatgatcgattacctgctgtggccatggttcgagcgtctggacgtgtacggcatcctcgattgcgtgtcacacacgcccgctctccggctgtggatcagcgccatgaagtgggatcccacagtgtgtgcgctcctaatggataaatccatttttcagggctttttgaacttatacttccagaacaatcccaatgctttcgacttcgggctctgctag

SEQ ID NO: 189516 - DNA, 501 bp, Artificial Sequence
  Description of Artificial Sequence: Synthetic coding sequence
atgagcggcgacgccacccggaccctgggcaagggcagccagcccccaggccccgttcctgagggattgattaggatctactccatgcgcttttgcccttatagccaccggacacggctcgtacttaaggcaaaagatatccgccacgaggtggtgaacatcaatctaagaaacaagccagaatggtactacacaaagcacccttttgggcacatcccggtcctggagactagtcaatgtcagctgatctatgaatctgtgattgcatgtgaatatttggacgacgcataccccggacggaaattattcccctacgacccttatgaaagagcacgccagaagatgctccttgaactcttttgtaaagtgccccatctgacaaaggagtgtctcgtcgccctcagatgtggcagggagtgcacaaacttaaaggccgccctgcggcaagagttcagcaaccttgaagaagataggaagaagcggaaattcattcctggctag

SEQ ID NO: 189517 - DNA, 366 bp, Artificial Sequence
  Description of Artificial Sequence: Synthetic coding sequence
atgcggttctgcccctacagccaccggacccggctggtgctgaaggccaaagatatccgtcacgaggtcgttaacatcaacctgaggaataaacccgaatggtactatacgaaacaccccttcggccacatccccgtgttagaaacttcacagtgccagctgatctatgaatctgtgatagcctgtgagtatttagacgatgcttaccccgggcgaaagctgtttccttacgatccctacgagagggccagacaaaagatgttgctggagctgttctgcaagctgtgtgagccacatgcttccccagccgcactggacatttcccatgaggtcggtccccactccctgtgttcgtcccacggatag

SEQ ID NO: 189518 - DNA, 630 bp, Artificial Sequence
  Description of Artificial Sequence: Synthetic coding sequence
atgagcggcgacgccacccggaccctgggcaagggcagccagccccccggccctgtgccggaaggtctgattcgcatctatagcatgaggttttgtccatacagccacagaacccggttggtgctgaaggcaaaggacattcggcatgaggtggtcaatatcaacttgcgtaacaaaccagagtggtattacaccaaacatccgtttggccatatccccgtgctggagacctctcagtgtcagctgatttatgaaagcgtcatcgcatgtgagtacctggacgatgcctatccaggcaggaagctgtttccgtacgacccctacgaaagagcaaggcaaaagatgttgctagaactgttttgtaagattctcgaataccagaacactaccttcttcgggggaacatgcatcagcatgatcgattaccttctgtggccttggttcgagaggctggacgtctacggcattttagattgcgtgtcgcatacacccgcactgagactgtggatctccgcaatgaagtgggaccctacggtttgcgctcttctcatggacaaatccattttccagggcttcctgaatttgtacttccaaaacaatccgaacgcgtttgatttcgggttatgttag

SEQ ID NO: 189519 - DNA, 723 bp, Artificial Sequence
  Description of Artificial Sequence: Synthetic coding sequence
atgggcctggagctgtacctggacctgctgagccagccctgccgggcagtttatattttcgcaaaaaagaatgatatcccgttcgaattacgtattgtcgatctgatcaaagggcagcacctgagcgatgccttcgcccaggtcaaccctctcaagaaagtgccagctttaaaagatggcgacttcaccctcaccgaaagtgtagccatcctgctgtatcttaccaggaagtataaggtccccgactactggtaccctcaggacctgcaagccagggcccgggtggatgaatatctcgcctggcagcacaccactttgcgccgaagctgcctgcgggccctgtggcacaaggttatgtttcctgtgttcctcggcgaacctgtgagtccccagaccctagctgctaccctggccgaacttgatgtgactttgcagctccttgaagataagtttctccaaaataaggcctttctgaccggacctcacatctccctggcagatctagtcgcaattaccgaacttatgcatcccgtgggtgccggatgccaagtgtttgagggaagacccaaactcgccacatggagacaacgcgtggaagcggcagtcggtgaggatctttttcaggaggcgcacgaggtgattcttaaagcaaaagattttccacccgctgatcccaccattaaacagaaactcatgccatgggtgttggcgatgataaggtag

SEQ ID NO: 189520 - DNA, 486 bp, Artificial Sequence
  Description of Artificial Sequence: Synthetic coding sequence
atgggcctggagctgtacctggacctgctgagccagccctgccgggccgtatacattttcgctaaaaagaacgatattcccttcgagcttaggattgtagacttgattaagggtgtaatgtttccagtgtttctgggggagccagtgtcccctcaaactttggcagccacgcttgctgagctcgatgttacactgcaacttctggaggataaatttttgcagaacaaggcattcctgaccggaccccatattagtctggccgaccttgtcgccattactgaacttatgcaccctgtgggcgctggttgtcaagttttcgagggtcgcccaaagctcgcaacatggcgacagcgagtggaagcagcagtgggagaagacctcttccaggaggcgcatgaggtgatcttgaaagcgaaagacttccccccagcagacccaaccataaagcagaaactaatgccttgggtgctcgccatgatccgctag

SEQ ID NO: 189521 - DNA, 369 bp, Artificial Sequence
  Description of Artificial Sequence: Synthetic coding sequence
atgttccccgtgttcctgggcgagcccgtgagcccccagaccctggccgccacattggccgagttggacgtgacattgcagctgctggaagataagtttctgcagaataaggccttccttacaggacctcatatatccctcgccgacctcgtggcaattactgaactgatgcaccccgttggcgcggggtgccaggtgttcgagggaagacctaagttagccacgtggagacagcgggtggaagcggccgttggcgaggatctgtttcaggaggcccacgaggtgattcttaaagccaaggactttcctccagcggacccgactatcaaacagaaactgatgccatgggtgttggccatgatcagatag

SEQ ID NO: 189522 - DNA, 198 bp, Artificial Sequence
  Description of Artificial Sequence: Synthetic coding sequence
atgggcctggagctgtacctggacctgctgagccagccctgccgggctgtctacatattcgccaagaagaatgatatcccttttgaactgagaatcgtcgacctaatcaagggtcagcatctgagcgacgcatttgcccaagttaatcccttgaagaaagtacccgccctgaaagacggggacttcacactgacatag

SEQ ID NO: 189523 - DNA, 219 bp, Artificial Sequence
  Description of Artificial Sequence: Synthetic coding sequence
atgggcctggagctgtacctggacctgctgagccagccctgccgggcagtttacatcttcgccaagaaaaatgatattccattcgaactgaggatcgtagacctgattaaggcaagggggtgctggttgccctcactgaggcgcccaacccaggcagggcacatggctgcagctcgcggcggcagttctggcggtggacctttaccgggggggccttag

SEQ ID NO: 189524 - DNA, 405 bp, Artificial Sequence
  Description of Artificial Sequence: Synthetic coding sequence
atgcccttcctggagctggacaccaacctgcccgccaaccgggtgcccgctggtttggaaaagcggctctgtgctgccgcagcctccatcctcggtaagcctgcggacagagttaacgttacagtgcgccccggactcgctatggcattgtcagggagtacggagccctgcgcgcaattgtccatctcatccatcggggttgtgggcacagcggaagataatcgctcccatagcgcccattttttcgagtttctgacgaaagagttggccctgggccaagacaggttcccaaccgtgctctcaacgagccccgccgcccacggaggccctaggtgcccgggcgagatcattgaaggaaaaaaatcatgcctaaacgaggaggccctgttcatttactttatatag

SEQ ID NO: 189525 - DNA, 831 bp, Artificial Sequence
  Description of Artificial Sequence: Synthetic coding sequence
atgcccgtgcccgccagctggccccacccccccggccccttcctgctcctgaccttgctgctgggtttaactgaggtagcaggagaggaggagcttcagatgatccagcctgagaagcttctgcttgtaactgtcggaaagaccgctacactgcattgcactgtgacatccctgttacccgttggtccggtgctttggtttcgcggggtgggccccgggagggagctgatttacaaccaaaaagagggacacttcccccgcgtgaccaccgtgtcagatctcaccaaacgcaacaatatggatttttcaatacgcatctcgtcaattacccccgcagatgtcggaacctactactgcgttaaattccgtaaaggttcaccggagaacgttgagttcaagtccggcccaggcacagaaatggcactgggcgctaaaccctctgcccctgtggtcctcgggccagctgcaagaaccacgcccgagcatactgttagtttcacatgcgaatcacacggattctcgcctcgcgacatcacgctcaagtggtttaagaatggcaacgagctcagcgactttcagacaaacgtggaccccaccggacagtccgtggcttattccattcgttccacagctagggtggtactggacccctgggatgtccgctctcaagtgatttgtgaggtagctcatgtgacgctacagggcgacccactgcgcgggaccgccaacctcagtgaggctattagagggcctgcctctagcctgaccgccctcctgcttattgcagtcctgctggggccaatttatgttccatggaagcagaagacctag

SEQ ID NO: 189526 - DNA, 1092 bp, Artificial Sequence
  Description of Artificial Sequence: Synthetic coding sequence
atggccaccaactggggcagcctgctgcaggacaagcagcagctggaagagctagcacgtcaagcggtggaccgcgcgctcgcggaaggggtcctgctgagaacctcccaagagcctacctccagcgaagtcgtcagttatgccccatttaccttgttcccatctttggtaccttcagctctgctggagcaggcttacgccgttcagatggacttcaatttgcttgttgatgcagtctctcagaacgctgcttttcttgaacagactctctctagtgcgttagtgcttttaattgcacaggaaaaagaacgtaacatcttcgatcagcgggcaatagagaacgaactgctcgccagaaatatccatgtcatccgaagaacttttgaggatattagtgagaaaggctctctcgatcaggacagaaggttgttcgtcgacggtcaggaaatcgccgtggtgtacttcagagatgggtacatgcccaggcaatattccctgcagaattgggaggctcgactgctgctggaacgaagtcacgccgccaaatgcccggatatagcaactcagctcgccgggaccaaaaaggttcagcaggaactgagccgccctggaatgctggaaatgctgctacccgggcagcctgaagcagtggcccgccttcgagctactttcgctggcctgtattctttggacgtgggagaggagggcgatcaggccatcgccgaagctctggccgcccctagcagattcgtgctgaagcctcagcgcgagggaggtgggaacaacttgtatggtgaggagatggtgcaggcattgaagcagttaaaagattccgaggaaagagcctcctacattctcatggagaagatagaacctgagcccttcgagaactgtctactgcggcccgggtcacccgccagggtggtgcaatgtataagcgagttagggatctttggcgtctacgtccgtcaggaaaagactctagtcatgaataagcatgtgggacatctcctgcgtaccaaagccattgagcatgccgatggcggggttgccgcgggggtggccgtgttggataatccctatcctgtgtag

SEQ ID NO: 189527 - DNA, 1041 bp, Artificial Sequence
  Description of Artificial Sequence: Synthetic coding sequence
atgttccagcggagcgccgacggcagccccgccctgaagcagatcgagatcaacacaatctccgcatcctttggggggctggcgtcccgtactccagctgtccatagacatgttctgagcgtgttatccaaaacaaaagaggcagggaagatcctgtcaaacaacccttccaagggtctggcactcgggatcgccaaggcttgggagctatacggttccccaaacgccttagttctgctgattgcccaggaaaaggagcgcaacatatttgatcagcgagccatcgaaaacgagctgttggcccggaatatccatgtcatccggcgaacatttgaggacatcagcgagaaaggctcactcgatcaggatagacgcctcttcgtggatgggcaagaaattgcggtggtatacttcagagacggttacatgcccagacagtactctcttcagaattgggaggcaaggcttctgttggaaagaagtcatgccgctaagtgtccggacatcgccacccaactggccggcaccaagaaagtgcagcaggaactgtcgaggcctggcatgttagaaatgctgctgcctggacagcccgaggcggtggccagattacgtgccacctttgctgggctctatagcttggacgtgggagaggagggtgaccaggctattgccgaagctttagccgcacccagcagattcgttctaaaaccccagagagaaggaggcggaaataacctgtatggtgaagaaatggtacaggcactcaagcagttgaaggattcagaggagagggcaagctacattctgatggagaagattgagcctgaaccattcgaaaactgtcttttgcgtcctggcagtcccgccagggttgtgcaatgcatctcggaattaggaatatttggcgtgtacgttcgacaggagaaaactcttgttatgaacaaacacgttggtcacctcttgcggacaaaagctattgagcatgccgacggcggcgtggcagccggagttgcggttctagacaatccataccctgtgtag

SEQ ID NO: 189528 - DNA, 768 bp, Artificial Sequence
  Description of Artificial Sequence: Synthetic coding sequence
atgagcagcatcggcaccggctacgacctgagcgccagcaccttctctcccgatggacgcgtcttccaggtggaatacgcgatgaaggctgtggagaattcaagcaccgcaatcggaatacgatgtaaggacggcgtggtgttcggggtggaaaaactggttctgagcaagctgtacgaggaaggtagtaataagcgattatttaatgtcgatcgccacgttgggatggctgtggccgggctcctggccgatgcgcgatctcttgctgacatcgcaagagaagaggccagcaattttcgatccaactttggctacaatattcctctaaagcatctcgcagaccgggtggccatgtacgtgcacgcttacactctctatagcgccgttaggcccttcggatgtagcttcatgttgggatcttatagcgtgaatgacggagcccaactatacatgatcgacccatcaggcgtgagttacggctattgggggtgtgcaatcggaaaagccagacaagcagctaagactgagattgagaaactgcagatgaaagagatgacatgccgagacattgtaaaggaagtcgccaagatcatttatatcgtgcatgatgaggttaaggacaaagctttcgaactcgagcttagctgggtgggcgagctcacgaatggacggcacgagattgttccgaaagatatcagggaggaggccgaaaagtacgcaaaggaaagcttgaaggaggaggatgagtctgatgatgataacatgtag

SEQ ID NO: 189529 - DNA, 525 bp, Artificial Sequence
  Description of Artificial Sequence: Synthetic coding sequence
atgcaggccggcaagcccatcctgtacagctacttccggagcagctgtagctggcgggtgcggatcgcactggctctgaaaggcatagactacgaaaccgtgccaatcaacctgattaaagacggaggtcagcagttctccaaggactttcaggcacttaacccaatgaaacaggtgcctactctcaagatcgatgggatcacaatccaccagtccaacctgagcgtgctaaagcaggtcggcgaggagatgcagctgacttgggcccagaatgctattacatgcggttttaacgcactggaacagatactgcagtccacagctggcatttattgtgtgggcgacgaagtaactatggcagatctgtgcttagtgcctcaggtggctaatgcggagagattcaaggtggacctgactccatatcccacaattagctctataaacaagcggctgctcgtcctggaagcctttcaggtatctcatccttgtaggcagccagacacaccgaccgagctgagggcctag

SEQ ID NO: 189530 - DNA, 486 bp, Artificial Sequence
  Description of Artificial Sequence: Synthetic coding sequence
atgaagcaggtgcccaccctgaagatcgacggcatcaccatccaccagagtctcgccattattgaatacttagaagagatgcggcctacacctcggttgctgccacaggatccaaagaagagggcaagcgtgagaatgatttctgatcttattgccggcggcatccagccgctccaaaacctgagcgtgttaaagcaggtgggggaggagatgcagctaacatgggcacagaatgccattacatgtgggtttaacgcactggaacagattttacaatccacagctggcatctattgtgtgggcgatgaggtcaccatggccgacctgtgtttagttccccaagttgccaacgcagaacgcttcaaggtggacctgaccccctatccaactataagttctatcaataagaggctactggttctggaggcttttcaagtgagccatccctgtcgccaaccagacactcctactgagttgagggcctag

SEQ ID NO: 189531 - DNA, 486 bp, Artificial Sequence
  Description of Artificial Sequence: Synthetic coding sequence
atgaagcaggtgcccaccctgaagatcgacggcatcaccatccaccagtccctcgccatcatcgagtatctcgaggaaatgagacctaccccccggttgctccctcaggacccaaaaaagagagcatcggttcggatgatcagcgacctcatcgcaggcgggatccaacccctccagaacctttctgttctgaagcaagtaggcgaggagatgcagttgacttgggcccagaacgccatcacttgtggtttcaacgccctggaacaaatcctgcaatctacggccgggatttattgcgttggtgacgaagtcacgatggccgacctgtgtcttgtccctcaggtggctaacgcagagcgcttcaaggtagatttgacaccctaccctacgatctcttctatcaacaaaagactgttagtcctcgaagcattccaggtgtcccatccgtgcaggcaacccgatacccccaccgaactcagagcctag

SEQ ID NO: 189532 - DNA, 180 bp, Artificial Sequence
  Description of Artificial Sequence: Synthetic coding sequence
atgaagcaggtgcccaccctgaagatcgacggcatcaccatccaccagagcctcgcaatcatcgagtacctggaagagatgaggcctacgcctaggcttctgccacaggacccaaagaagagggcctccgtgcgcatgatcagtgatctcatcgccggggggatccagcctctccaatag

SEQ ID NO: 189533 - DNA, 117 bp, Artificial Sequence
  Description of Artificial Sequence: Synthetic coding sequence
atgaagcaggtgcccaccctgaagatcgacggcatcaccatccaccaaagtcttgctattatagaatacttagaagagatgagacctaccccccgcttactgccacaggacccatag

SEQ ID NO: 189534 - DNA, 486 bp, Artificial Sequence
  Description of Artificial Sequence: Synthetic coding sequence
atgaagcaggtgcccaccctgaagatcgacggcatcaccatccaccagagcctcgcaattatagagtacctggaggagatgagaccgactcctcggctgctgccacaagatcccaaaaaacgggcctctgtccgtatgattagtgatcttattgcaggggggatacaacccttacaaaacctcagcgtgcttaagcaggtgggcgaagaaatgcagcttacgtgggcccaaaatgccattacatgcggcttcaatgcactcgaacagatccttcagagtacagcagggatctattgcgtgggtgacgaggtcactatggcagacttgtgcctggttccacaagttgctaacgccgagaggttcaaagtcgacctgacgccatatcccaccatctccagtattaataagcggttacttgtgctggaagccttccaggtttcccacccatgtaggcagcccgataccccaactgagctacgagcatag

SEQ ID NO: 189535 - DNA, 387 bp, Artificial Sequence
  Description of Artificial Sequence: Synthetic coding sequence
atggccggcaacctgctgagcggcgccggccggcggctgtgggactgggttcccttggcctgtcgttccttcagcctgggggtccccagattgattggaatcagactcactctgccccctccgaaagtagtcgataggtggaatgaaaaaagggccatgttcggggtatacgacaacataggaattttggggaattttgagaagcaccccaaggagctgattcgcggccccatctggctgcggggatggaaagggaacgagctgcagagatgcattagaaaaagaaagatggtcggatctcgtatgtttgccgatgacctgcataatctcaacaagagaatacggtacctctataagcactttaatcggcacggcaaattcaggtag

SEQ ID NO: 189536 - DNA, 783 bp, Artificial Sequence
  Description of Artificial Sequence: Synthetic coding sequence
atggaggagatgcgggaccccagcaagatcaagtggggcgacgccggcgcagaatacgtggtcgagtcaactggggtcttcacaaccatggagaaggctggagctcatctgcagggtggggccaagagagtcattatatcagcaccgtccgcagacgcgccaatgttcgtcatgggcgtcaaccatgagaagtacgacaattcgttaaagatcatatcaaatgcaagttgtacaaccaattgtcttgcccccctcgcaaaggttatccacgacaattttggtattgtggaggggcttatgacaacagtacatgctataacggcaacacagaaaacagtggatggaccatctggcaagctgtggcgggacggcaggggggctctgcagaacattattccggcatctaccggtgccgcaaaggccgtcggcaaagtaataccagagctgaacggtaaattaacaggcatggcatttagggtgccaaccgccaacgtcagcgtcgtcgacctgacttgtcgtctagaaaaaccagccaaatacgacgacatcaagaaggttgtcaagcaggcctctgaggggcctttgaaggggatcctggggtacacagaacatcaagtagtgtcatccgactttaattcggacacacatagtagcacgtttgatgccggcgccggtatcgccctgaacgatcacttcgtcaaactcatttcctggtatgacaatgaatttggctattccaatcgtgttgtggatctgatggcacacatggcctctaaggagtag

SEQ ID NO: 189537 - DNA, 882 bp, Artificial Sequence
  Description of Artificial Sequence: Synthetic coding sequence
atggtgtacatgttccagtacgacagcacccacggcaagttccacgggacagttaaggccgaaaacggcaaactcgtcattaatgggaaccccattacaatatttcaggagagagacccatccaaaatcaagtggggagatgccggcgctgaatatgtcgttgagagtacaggcgtgttcaccacaatggagaaagctggcgctcaccttcagggaggagccaagagagtaatcatctccgcccctagcgctgatgctccaatgttcgtaatgggagttaaccatgaaaagtatgacaactccctgaaaatcatctctaacgcctcgtgcacaactaactgtctggcccctttagccaaggtcatacacgacaacttcggaatcgtggaggggctgatgacaacggtccacgctatcacagcaacacagaaaacagtggacggaccgtcaggtaagctgtggcgggacggaagaggagcacttcagaacatcatcccagcctcaaccggggcagcgaaggctgtcgggaaggtcatcccagagcttaacggcaagctcactgggatggcttttcgggtgccgaccgccaacgtcagcgtggtcgatctgacttgcagacttgaaaaaccagcaaaatatgatgacattaaaaaggtagtgaaacaggcaagcgaaggcccactgaagggcatcttgggctataccgagcaccaagtagtctccagcgacttcaattctgacacgcactcttcaaccttcgatgcaggcgcgggcattgcactgaacgatcattttgtgaagctgatcagctggtatgataatgagttcggatacagtaaccgcgtcgttgacctcatggcccatatggctagtaaagaatag

SEQ ID NO: 189538 - DNA, 1008 bp, Artificial Sequence
  Description of Artificial Sequence: Synthetic coding sequence
atgggcaaggtgaaggtgggcgtgaacggcttcggccggatcggcaggctagtgacgagagcggcattcaatagtggcaaagtagacatagtggctattaacgacccatttattgatctgaactatatggtatacatgttccagtatgacagtacccatgggaaattccatggaacagtgaaagccgagaacggaaaacttgtgatcaacggtaacccaatcaccatatttcaagagcgcgaccctagcaagatcaagtggggagacgccggagccgagtacgttgtggagtctacgggggtctttacgaccatggaaaaggccggcgcccatctacagggaggagctaagagggtgattatctccgccccctcagctgatgcaccaatgtttgtgatgggcgtgaatcatgaaaagtatgataacagcttaaaaattatcagtaatgcttcctgtactaccaattgcctggctcccctggccaaagtcatccatgataatttcgggatcgttgaaggcctcatgaccacagtccatgccatcaccgctactcagaagacggtagacgggccatctggcaaactctggagagatggccgaggcgctctgcagaacatcatccctgcttctacaggcgccgccaaagctgtgggcaaggtaatcccagagttaaacgggaaactgaccggcatggcattcagagtcccaactgccaacgtcagcgtggtggacttgacttgccgacttgaaaaaccggcgaagtacgatgacattaaaaaggtggtaaagcaggcctcggagggaccattaaagggcattctcgggtacaccgagcaccaggtggtgtccagcgatttcaactctgatacacactcatcgaccttcgacgcaggggccgggatcgcattgaatgatcatttcgtgaagttaattagctggtatgataatgagttcgggtacagcaatagggtggttgatttaatggcccacatggcaagcaaagagtag

SEQ ID NO: 189539 - DNA, 1008 bp, Artificial Sequence
  Description of Artificial Sequence: Synthetic coding sequence
atgggcaaggtgaaggtgggcgtgaacggcttcggccggatcggccggttagttacccgtgccgcattcaactccggcaaagtagatatagtcgccatcaacgatcctttcatagatctgaactatatggtgtacatgttccagtatgacagcactcacgggaagtttcacgggacagtgaaagccgagaacgggaagctggtcattaacgggaaccccattacaatctttcaggagagggatccttcgaaaatcaagtggggcgatgccggcgccgaatatgtcgtggaaagtaccggcgtcttcacaaccatggaaaaggctggcgcccacttacagggcggggcgaaacgcgtgattatttctgcccccagtgcggatgccccaatgtttgtgatgggtgtgaaccacgaaaagtacgataacagcttgaagattatctctaacgcatcgtgtaccacgaactgtctggcacccctggcaaaagttatccatgataactttggcattgtggagggcttgatgaccactgtgcatgccataaccgccacccagaagacggtggacgggccttccgggaagctctggagagacggccggggggccttgcagaatatcatccctgccagcactggggcggctaaggcggtgggcaaggtaattcccgagctcaacggcaagctgaccgggatggcattccgggttcccaccgcaaacgtgtccgttgttgacctcacgtgtcgcctggaaaagcccgcgaagtacgatgacatcaagaaggtggtgaaacaggcttctgaagggcctttgaagggtatcctcggctatactgagcaccaggtggtgtcttcagactttaattcagatacacattcttccacatttgatgctggggccggcatcgcgctgaacgatcattttgtgaagctgattagttggtatgataacgaatttggctatagcaaccgagtggtcgacttaatggctcacatggcaagcaaagaatag

SEQ ID NO: 189540 - DNA, 648 bp, Artificial Sequence
  Description of Artificial Sequence: Synthetic coding sequence
atgggcaaggtgaaggtgggcgtgaacggcttcggccggatcggcaggctggtaactagagccgcctttaactccggtaaagtagacatcgtggcaattaacgaccccttcattgacctgaactatatggtctacatgttccagtacgactcaacgcacggaaagttccacggcacagtgaaggccgagaacggcaagttggttatcaacggcaacccaattacgatatttcaggaacgtgacccaagtaagatcaagtggggtgacgcgggagctgaatatgtggtggagtctaccggggttttcacaacaatggagaaggcaggagcccacctgcaaggcggagccaagagggtgataatatccgccccttccgccgacgctccgatgttcgtgatgggcgtcaaccacgagaaatatgacaattcacttaagatcatcagcaatgcctcttgtacaacaaactgtttggccccactggctaaggtgatccacgataattttggcatagtggaaggcctcatgacgacagtgcatgcaattacagccactcaacgcgaggcacattggcacggactcccttgtccgcactgtcagcgagtgagcggcggacccgaccttccatctagaaagacctgccaaatttag

SEQ ID NO: 189541 - DNA, 675 bp, Artificial Sequence
  Description of Artificial Sequence: Synthetic coding sequence
atgaccctgttccacttcggcaactgcttcgccctggcctacttcccttactttattacctataagtgctccggcttatccgagtacaatgcattctggaagtgcgtccaagccggcgtgacgtacctgttcgttcagctctgcaaaatgctctttttagctacattcttcccgacctgggaagggggaatctatgattttattggggagttcatgaaagctagcgtggacgttgctgacttaataggacttaatctggtgatgtctcgaaatgcaggtaaaggcgagtataagatcatggtggcggctctcggatgggccaccgcagaactgattatgagtcggtgcatcccactgtgggtgggggctcggggtattgaattcgactggaagtacatccaaatgagtatcgattctaacatctccctagtgcactatatcgttgcctccgctcaggtctggatgataacacggtacgatctgtatcacaccttccgcccagcagtgctattgctgatgtttctgtctgtgtataaagcctttgttatggagacatttgtgcatctgtgctcactgggaagctgggctgcattgctcgccagagcagtcgtgacaggcctgctcgcgctgagcactctggcactgtacgtcgcagtagtgaatgtgcactcatag

SEQ ID NO: 189542 - DNA, 1104 bp, Artificial Sequence
  Description of Artificial Sequence: Synthetic coding sequence
atggccgccgccctgcaggtgctgccccggctggcccgggcccccttgcacccactcctttggcggggctcagttgcgcgcctggcctcctcaatggctctcgccgagcaggccaggcaactgttcgagtccgccgtaggggccgttctccccggtccaatgcttcaccgcgcattgtcacttgaccctggcgggcggcaactgaaagtgcgcgataggaattttcagctgcgtcagaacctgtacttggttggatttggcaaggccgttctgggcatggcagccgcagccgaggaacttctgggacagcatctggttcagggagtgatatcggtgccaaagggaatccgagctgcgatggaaagagcaggcaagcaggaaatgctcctgaagccacattcgagggtacaggtctttgagggcgccgaagacaacctcccagatagggatgctctgcgtgccgctttggctattcaacagcttgccgagggcctgaccgcagacgatctcctgctggtgttaatatctggcggtggtagcgccctcttgcctgccccaatcccccctgtaaccttagaagaaaagcaaacgctgactagactcctggcagcacgtggcgcgacaatacaggaacttaacacgatccggaaagcactgtcccagctaaagggcgggggactggcccaggcggcctatccagctcaagtagtctcactgattttgagcgacgtggtaggtgaccctgtggaggtgattgcttccggccctacagttgctagttcccacaatgtgcaggactgcctgcacatcctgaacagatacgggctgcgcgcagcactcccacggagcgtgaagaccgtgctgtctcgggccgacagcgatccgcatggacctcacacatgtggacatgtgttgaacgtgattattgggtcgaatgttctggccctcgccgaggcacagagacaggcggaggcgttgggctaccaggcagtagtattgtcagccgcaatgcagggatggggcactccagccgctcatagggatgaccgttaccaatgtcacggacaccccccactcgtccctgccgcttccgtcatggcctag

SEQ ID NO: 189543 - DNA, 705 bp, Artificial Sequence
  Description of Artificial Sequence: Synthetic coding sequence
atggccgccgccctgcaggtgctgccccggctggcccgggcccccctgcacccacttctgtggcgaggcagcgtcgcaagactcgcctcatcaatggccttggccgagcaggcccgccaactgtttgaatcagctgtgggagccgtgctgccaggccctatgctgcatcgggcactgagtctggaccctggggggagacaactcaaggtgagggaccgcaactttcagctccgtcaaaacctgtatctcgtcggcttcggcaaggctgtcctgggaatggcagctgcagccgaggaactacttggacagcacctggtgcagggcgtcatctccgtgcccaagggcattcgcgcagctatggaacgtgcaggtaaacaggaaatgctccttaagccccactctcgggttcaggtctttgagggagcagaggataatctgcccgaccgggacgccttgcgtgccgccctcgccattcagcagctagcggaaggcctgaccgctgatgacttgctgttggtgctcatcagtgggggagagccccaccctgttagatgtgggggaggtccatgtgggggcgattgtcaatggccgcatagagggcagtttccgcaatgtgctcgcttacctgcttacccacagtcactgcgtcctccgtgttctcccgccaccttctgcgaggactgtgcggtctctgggcggctttag

SEQ ID NO: 189544 - DNA, 1374 bp, Artificial Sequence
  Description of Artificial Sequence: Synthetic coding sequence
atggccgccgccctgcaggtgctgccccggctggcccgggcccccctccatcccctgctgtggagggggagcgtcgcacgtctggcatcttcgatggcactagcggaacaggccaggcaactgttcgaatctgccgtgggagcagtgttaccaggaccaatgctgcatagagctttgtccttagatccgggggggcgccaactgaaggtgcgtgacagaaactttcagctccggcagaacctttatcttgtcgggttcgggaaggcagtcctggggatggctgcggcagctgaagagctgctgggacagcacctggtgcagggtgtcatctcagtgcccaaaggaatccgggctgcccccataccgcctgtgacgcttgaggagaaacagacattgacccgcctcctggccgcaaggggcgccactattcaggaactcaatacaatcagaaaagctctctctcaacttaaggggggcgggctcgctcaggcagcctaccccgcgcaggtcgtctccttgatcctttctgacgtcgtcggcgaccctgtggaagtgattgcatccggacccactgttgcaagcagccacaacgtccaagactgtctgcatatcctgaatcggtacggattgcgcgcagctttgcctaggtctgtaaaaaccgtgttgtctcgagcggatagtgaccctcatggtcctcatacttgcgggcacgtacttaacgtgatcatcggttcgaatgtgctagccctggctgaggcacagcgccaggcggaagctctgggttaccaggctgttgtcctttcagcagccatgcagggcgatgtgaaatctatggcacaattctatggacttctggcgcacgtcgcacggacccggcttacaccttccatggccggcgcttccgtcgaggaggatgcacagctgcatgagttagccgccgagctgcagattcctgatctacagctggaagaagcgttagaaaccatggcatgggggcgcggtcccgtctgcctgttagcggggggggagcctaccgtccaattacagggatccggtcgtggcgggcgtaaccaggagctcgccctgcgtgtgggggccgaacttcgaagatggcccctgggaccgattgacgttctctttttatctggagggactgacggccaagacggacctacagaggccgcaggcgcctgggtaaccccagaactggcctctcaagccgcagctgaaggacttgacattgctaccttcctcgcgcacaatgacagccatactttcttctgctgtctgcagggcggcgcccatctcctgcacacaggcatgactggcaccaacgtgatggatacccacctgttgttccttcggccgcgatag

SEQ ID NO: 189545 - DNA, 1572 bp, Artificial Sequence
  Description of Artificial Sequence: Synthetic coding sequence
atggccgccgccctgcaggtgctgccccggctggcccgggcccccctgcatccccttttatggagagggtccgttgccaggctcgcatcttctatggccctggcagaacaggcccgacagttgttcgagagtgcagtgggcgctgttctcccaggaccgatgttacatcgggctctcagcctggatccgggcggaagacagcttaaagtcagggaccgcaactttcagctgagacagaatctatacctggtcgggtttggcaaagcagttctcggcatggccgcggcggcagaggagttacttggccaacacttagtgcagggcgtgatttcggtgcctaaggggattcgagccgcaatggaacgtgcagggaagcaagagatgctgttgaaaccacacagtcgtgtacaagtgtttgaaggggctgaggataacctgcctgatagagacgccttgcgggccgccctcgccatacagcaattggctgaaggactcacagccgacgaccttctgcttgtgctgatctcaggaggagggagcgcactccttcctgcccctattcctcctgtgactctggaggagaagcagactctgactagactgctggccgcacggggagctaccatacaggaactcaacaccatccgaaaagcccttagtcagctaaagggggggggcctcgcgcaggccgcctatcctgctcaagtcgtgtcccttattcttagtgacgtggttggggacccggtcgaagtcatcgcaagcggtccaacggtggcctccagccataacgttcaggactgcctgcacatccttaatagatatggccttcgggccgccttgccacgctctgtgaaaactgtactcagtagggctgattcagacccccacgggccacacacctgtggccacgtcctgaatgtcattattgggtcaaacgtcttggccttggctgaagctcagcgccaggctgaagccctggggtatcaggctgtggtcctcagcgccgctatgcagggcgatgtcaaatccatggcacagttttatggtctcctggcccatgtcgcccgaacacgcctgacaccgagcatggcgggtgcttctgtggaggaggacgctcagctgcacgagctcgctgctgagctccagatccccgacctccaactggaggaggcactggagaccatggcctgggggaggggcccagtatgcttattggcagggggcgaacctaccgtgcagcttcaaggcagtggtagaggcgggagaaaccaggaacttgccctaagagttggggcagaattacgccgctggcctttgggccctattgatgttttattcctgtcgggaggaacagacggtcaggacggcccgaccgaggctgcaggcgcctgggtgacgccggagcttgctagtcaagcagccgctgaaggattggatattgccacattcctggcacataatgacagccatacattcttctgttgtctgcaagggggtgcacatttgctgcatactgggatgaccgggacgaatgtgatggatacacatcttctcttcctcaggcctagatag

SEQ ID NO: 189546 - DNA, 852 bp, Artificial Sequence
  Description of Artificial Sequence: Synthetic coding sequence
atggagctgctgctgagccagagctgcatctggtggcccatggtgggggaaggtaggacaatcataagctgcggaatcaaggcaatggagaggtcaggtaactacctcatatggctacaaaaaggagaaatgcttttgaagcctcactcgagggtccaggtgttcgagggagctgaagacaacctgcccgaccgcgacgcactgcgtgcagcactggccatccagcaactggctgagggtctcaccgcagacgacctgctgttagtgcttatcagtggaggtggatcagcgctcctccccgctcccatcccgcctgtaacactcgaggagaagcagacccttacgaggctcctggccgcccgtggcgcaacgattcaagaattaaatactatcagaaaagccctctctcagctcaaagggggcgggctcgcacaggcggcttatcctgcacaggtggtaagcctgatcctgtctgacgtggtgggagacccggttgaagtgattgcttctgggcccactgtagcctccagccataacgtccaggactgcctgcatatcctgaaccgttatgggctgcgggctgcactccctcgttcggtcaagactgtgttgagtagagccgattcagacccacatggaccacacacctgtggtcacgttctgaatgtaattatcggctcaaatgtattggctctggccgaggcccagcgccaggccgaggcactcggatatcaagctgtcgtactgtctgctgccatgcaaggatggggcacaccagccgcccatcgcgacgataggtaccagtgtcacgggcatccccctcttgtgcctgctgcctcagttatggcctag

SEQ ID NO: 189547 - DNA, 723 bp, Artificial Sequence
  Description of Artificial Sequence: Synthetic coding sequence
atgctgctgaagccccacagccgggtgcaggtgttcgagggcgccgaggataacctccccgaccgcgatgctttgcgtgcggcactagccattcagcagcttgcggagggactaacagcagacgatctgttgctggtgctgatcagcggaggcggctccgctttgctgccggcccccatcccgcccgtgacactggaggagaagcagacgcttacgaggcttctagctgcccggggggcgacaatccaggagctgaacaccattcggaaagccttatcacagctgaaggggggaggccttgctcaggctgcttacccagctcaggtggtcagcttgattctatccgacgtcgtgggggatcctgtggaggttatcgccagtgggcctacagtggcgagcagtcacaacgtgcaggattgtctgcacatcctgaatcggtacgggctgcgcgccgcgctgcctcgctccgttaagaccgtcctctcccgggcagactccgatcctcacggacctcacacttgtggacacgtactaaacgtcataatagggagtaatgtcctggcgttggcagaagctcagcgtcaggcagaggcccttggctaccaggcagtggtgctgagtgccgcaatgcaggggtggggcacacctgcggcccaccgtgatgataggtaccaatgccacggacacccgcccctggtgcccgccgcgtccgttatggcttag

SEQ ID NO: 189548 - DNA, 618 bp, Artificial Sequence
  Description of Artificial Sequence: Synthetic coding sequence
atggccgccgccctgcaggtgctgccccggctggcccgggcccccctccacccactactttggcgcggatctgtcgcacgattggcttcatcaatggccctcgcggaacaggcaaggcaacttttcgagtccgccgtaggggcagtcctccccgggccaatgctgcatagggcactgtccctcgatcccggtggccgccagctgaaagttcgcgataggaactttcagttgcgccaaaatctttatctggtgggctttggcaaagccgtgctgggcatggccgccgctgccgaggagcttttgggtcaacacctcgtccagggcgtcattagcgttcctaaggggatcagggcggcaatggaaagagccggaaagcaagagatgctgttaaagccccattctagagtgcaagtctttgaaggagccgaggataacttgcccgacagagacgccctgcgggcggccctggcaatccagcagctcgctgaaggcttgacggctgatgatctcctgctcgtcctgatctctgggtggggaacacctgccgcgcatcgcgacgaccggtaccagtgccatgggcacccccccctagtgcccgccgccagcgtcatggcatag

SEQ ID NO: 189549 - DNA, 705 bp, Artificial Sequence
  Description of Artificial Sequence: Synthetic coding sequence
atggccgccgccctgcaggtgctgccccggctggcccgggcccccctccacccgctcctatggaggggttccgtggctcgcctggcctcaagtatggccttggcagagcaggctagacagctttttgagtccgcagttggggcagtgctgcccgggcctatgctgcatagagctttaagcctggacccaggcggacgccagcttaaggttcgggacaggaatttccaactgcggcaaaacctgtatctggtgggctttggaaaggctgttttagggatggccgctgccgcagaggagctgctcggtcagcacctagttcagggtgttattagtgttccaaagggcatacgagctgctatggaacgagccggaaagcaggagatgcttctcaagccgcactcccgggtgcaggtgttcgaaggtgccgaagataacctgcctgaccgtgatgctttaagggcagctctagccatccagcagctcgcggaaggtttaaccgcagatgacctgctactggtgttgataagcggtggggaacctcatcccgtgcgttgcggaggcggaccctgcggcggggactgtcaatggccccaccgggggcagtttccacagtgcgccagacttccagcatatccacagtccctgaggcccccttgttcgcccgccacgttctgtgaggactgcgccgtgtctggcagactctag

SEQ ID NO: 189550 - DNA, 285 bp, Artificial Sequence
  Description of Artificial Sequence: Synthetic coding sequence
aagatcctggacgccatgaaccgggactgcggcatccccctgagccacctccaggtggacgggggaatgacaagcaataagattctgatgcagcttcaagccgacattctgtatatccctgtagtgaagcctagcatgcccgagactactgccttgggagcagcaatggccgctggggccgccgagggggtgggggtttggagtctcgagccggaggacctgagcgcggtgactatggagaggttcgaaccacagatcaatgccgagggaaccttcaaagagtag

SEQ ID NO: 189551 - DNA, 1662 bp, Artificial Sequence
  Description of Artificial Sequence: Synthetic coding sequence
atggccgccagcaagaaggccgtgctgggccccctggtgggcgccgtcgaccaggggacaagtagcacaagatttttagtttttaattccaaaactgcagaactgctgtcccatcaccaagtggagattaagcaggagtttcctcgtgaaggctgggtggagcaagaccccaaggaaatactgcatagcgtgtacgagtgtattgagaaaacctgcgagaaactggggcagctgaatattgatatttccaacatcaaggcaataggagtgtccaatcagcgggaaacaacagttgtctgggacaaaattactggcgaaccgctatataatgcagtggtctggcttgacctaaggactcagtccacagtggagagcctatcaaagcgaatcccaggcaacaataactttgtgaaatccaaaactggtttgcctctttcaacatacttctcagcagtgaaactgcgatggctgctggataatgtacgtaaagtgcagaaagctgtcgaagagaaacgggcgctttttgggacaattgactcatggttaatctggagcctcaccggcggcgtcaacggaggcgtgcactgtactgacgtcactaacgctagtcgtactatgctgttcaacatccacagtctggaatgggataagcaactatgcgagttttttggcatccccatggagatccttccaaatgtgcgaagctcctccgaaatatatggattaatgaaagctggggccctagaaggcgtgccaatcagcggctgcttaggggaccagagcgccgcactggtgggccagatgtgcttccagatcggacaagctaaaaatacatatggaaccggctgtttcctgttgtgtaacaccggccataaatgtgttttttccgaccatggcttgttaacaaccgtggcttacaagctcgggcgggacaagccagtctactacgcgctcgagggcagtgtggctatcgcaggtgccgtgatcagatggctgcgcgacaacctcggcatcatcaaaacaagcgaagagatagaaaagctggcaaaagaggtgggcacatcttatggctgctactttgtaccagcttttagtggcctttacgctccctactgggaaccctcagctcgcggcattatttgcggccttactcaatttactaataagtgtcacattgccttcgccgcactggaagcggtgtgcttccagactagggagattcttgatgccatgaatcgcgattgtggaattccactgagtcacctgcaggtggatgggggcatgaccagtaataaaatcctgatgcagctccaggctgacatactgtacattccagtagttaaaccatccatgcctgagactaccgctttgggtgcagccatggctgccggcgcagccgagggagtcggagtatggtccctggagccagaggacctaagtgcagttaccatggagcgttttgaaccgcaaatcaacgcagaggagtccgaaattcgatacagcacctggaagaaggccgtcatgaagtctatgggctgggtgactactcagtcccctgaaagcggagacccttccatattctgtagtctccccctcgggttcttcattgtctccagcatggtcatgttgatcggcgcaagatacatctcggggatcccctag

SEQ ID NO: 189552 - DNA, 1575 bp, Artificial Sequence
  Description of Artificial Sequence: Synthetic coding sequence
atggccgccagcaagaaggccgtgctgggccccctggtgggcgccgtcgaccagggcacatccagtactcggtttctggtgttcaattctaaaaccgccgagctgctctcacatcaccaagtcgagattaagcaggagttcccaagggaaggttgggtggagcaggatcctaaggaaatacttcacagtgtctacgagtgcatcgaaaagacttgcgagaaactgggtcagctgaacattgatatctccaacatcaaagctattggagtgagcaaccagcgtgaaacaacagttgtatgggacaagattacaggagagccactctataacgcagttgtttggcttgacctccgcacacagagtactgttgagtcccttagtaagagaatccccgggaataataactttgtcaagtcaaaaactggattgcctttgtccacctattttagcgccgtgaagctgcggtggttgttagacaacgtcagaaaggtgcagaaagctgtggaggaaaaaagagccctgttcggtaccatagattcttggctgatttggtctttgacaggcggcgtgaatggtggtgtgcattgtaccgatgtgaccaatgctagcagaactatgctgttcaacatacacagcttggaatgggacaaacagctctgcgagttttttggaattcctatggaaatcttgcccaatgttaggagcagtagcgagatctatggtcttatgaaagcgggcgccttagagggtgtacctattagcggatgcctgggagatcaaagtgcagcactggtgggacagatgtgcttccagatcggacaggcgaaaaatacgtacggaacgggatgcttcctcctttgtaataccgggcacaagtgtgtcttcagcgatcacggattactcacgacagttgcatacaagcttgggcgagacaagccggtgtattatgccctcgaaggtagcgtggctattgcaggagctgttatcagatggttaagagataacctgggtatcatcaaaacttccgaagagatagaaaagctcgccaaggaagttgggactagctacggatgttatttcgtgccggccttctctggattgtatgcgccttattgggagcccagtgcccgggggatcatctgcggtctgacgcagttcacgaacaagtgccacattgcgtttgctgcgctagaagccgtatgtttccagacaagagagattctcgacgcaatgaatcgcgactgcggaatcccattatcccatttgcaggtagacggaggcatgacctctaacaagattctgatgcagctgcaggcagatatcctgtatatccccgtcgtgaagccctccatgccggagactactgcccttggagcagcgatggcggccggagccgccgaaggcgtcggagtttggtccctcgagccagaggacctgagcgcggttactatggagaggtttgagcctcagatcaatgccgaggaaagtgagattcggtactccacttggaaaaaagctgtgatgaagtctatgggctgggtcaccactcaaagcccagaaagtggcatcccctag

SEQ ID NO: 189553 - DNA, 1593 bp, Artificial Sequence
  Description of Artificial Sequence: Synthetic coding sequence
atggccgccagcaagaaggccgtgctgggccccctggtgggcgccgtggatcagggtacctcaagcacaagatttcttgtctttaacagtaagaccgcggagctgttatctcaccatcaggtagagattaagcaagaattcccgcgcgaagggtgggtggagcaggacccaaaagagatcctgcacagcgtgtatgagtgcatcgaaaagacctgcgaaaaactgggtcagctgaatatcgatatctccaatataaaagctattggcgtgtcaaaccaaagagagactactgttgtgtgggataagattaccggcgaaccactgtacaacgccgtggtctggctcgacttaaggacacagagcacagtggagtcgctgtcgaagcgcatcccggggaacaacaactttgtgaaaagcaaaacgggtctgccgcttagtacatatttcagtgccgtcaaacttaggtggctgttggacaacgtccggaaagtgcagaaagctgtggaagaaaaacgggcattgttcggaacaatcgattcctggctgatttggagcctcactggtggtgttaatggaggcgtccactgtacagacgttacaaacgcaagtcgaacgatgctgttcaatatccactctttggagtgggacaagcagctatgcgaattcttcggcattcccatggaaatcctccctaacgtccgctcatccagtgagatctacggactgatgaaaatttcccactctgtgaaggctggcgccctggaaggcgtgcccattagcggatgtctcggcgaccagtctgccgccctggttggacagatgtgttttcagatcgggcaagcaaagaacacgtatggcactgggtgtttcttactgtgcaacaccggtcacaaatgcgtcttctccgatcacggactgctaacaacagtagcctacaagctgggacgagataagcccgtatattacgctcttgagggtagtgttgcaatcgctggagccgttattcggtggctgcgcgacaatctgggaattataaaaacttctgaggaaatcgaaaagctcgcaaaggaggttggcacaagttatggatgttactttgtgcctgccttttcaggcctctatgccccatattgggagccttccgcccgcggaatcatctgtggtcttacacaatttactaataagtgccatattgcctttgccgcgctggaggcagtttgttttcaaacccgagagatcctagatgccatgaatcgcgattgcgggatccctctttcacaccttcaggtggacggtggtatgacaagcaacaaaatactgatgcagctgcaagccgacattctatatataccagtcgtgaaaccttcgatgcccgaaactacagccctgggggcggcgatggccgcaggtgcggccgagggtgtcggtgtatggtctttagagcctgaggacctgtcggcggtcaccatggagcggtttgaacctcaaatcaatgcagaggaatcagaaattagatactccacttggaagaaagccgtgatgaaatccatgggatgggttacaacccagtcccccgagtctggaatcccgtag

SEQ ID NO: 189554 - DNA, 1065 bp, Artificial Sequence
  Description of Artificial Sequence: Synthetic coding sequence
atgctgttcaacatccacagcctggagtgggacaagcagctgtgcgagttctttgggatccctatggagattctgccaaacgttcggagttcttccgaaatttatggattaatgaaaatttcccattcagtcaaggcaggcgccctcgagggagtacccattagcggttgtctgggagaccagagtgctgctctggttggacagatgtgtttccagattggacaagcaaaaaacacttatggaactggctgctttctgttatgcaatacaggccacaagtgtgtttttagcgaccacgggcttctaacgaccgtggcgtacaaactagggcgagataagcctgtttattatgcactcgaagggtcggttgccatcgcgggcgctgttatacgatggctgagagataacctgggaataatcaagacaagcgaggaaattgaaaagcttgccaaagaagtgggcacttcttacggatgctatttcgtcccagctttttccggattatacgccccatattgggagccatctgcccgcggtatcatttgcgggctgactcaatttacaaacaagtgtcacatcgctttcgccgcactcgaggcagtctgtttccagactagagagattcttgatgctatgaacagggactgcggcattcccctttcacatttgcaggttgacggtggaatgacaagcaataagattctgatgcagctccaggcggatatactgtacataccagttgttaaaccaagcatgcccgagactaccgctctgggtgcggcaatggcagccggcgcagccgaaggcgtcggcgtgtggtcactggaaccagaggatctctctgctgtaactatggagaggtttgagcctcagattaatgcggaagagagcgaaattagatacagcacctggaaaaaggcagtcatgaaaagcatgggatgggtgacaacacaaagccctgaaagcggggacccatcaatattctgcagcttgcctctcggattctttatcgtgagcagtatggttatgcttatcggagcccgatatatatccggcattccatag

SEQ ID NO: 189555 - DNA, 1104 bp, Artificial Sequence
  Description of Artificial Sequence: Synthetic coding sequence
atggcctacctggacaacttcaagaccaacgcccggcacttcatcctgtttgtcaatatctcaagccttacaggtggcgttaacgggggggtccactgtaccgacgtgacaaatgccagccgaacaatgctctttaacatccactccctcgagtgggacaagcagttatgcgagttcttcggcatacctatggagatcctgcccaacgtcagaagcagctccgaaatttacggattgatgaaaattagccactccgttaaagcgggagccctggagggggtacccataagcgggtgtctgggggatcagagcgccgccctggtggggcagatgtgcttccagatcggccaggcgaagaacacttacggcactggctgcttcctgctctgtaatactgggcataagtgtgtgtttagtgaccatggccttttgaccactgttgcgtacaaattgggccgcgacaagcccgtctactacgctttggaggggagcgttgctatagccggggccgtaatccggtggctcagggacaacctgggcatcataaagacatctgaggagatagagaagctggccaaagaggttggcacgtcatatgggtgttactttgtgccagcgttcagtggattgtacgcgccctactgggagccctcggcacgaggaattatttgcggactgactcagttcacgaataagtgccacatcgcctttgccgccctagaagctgtttgtttccagacccgtgagatcctcgacgccatgaatagagattgcgggatccctctcagtcatcttcaggtggatggagggatgactagtaataagatcctcatgcagcttcaagcagacatactctatatccctgtggtgaagcctagtatgcctgagacaacggctttgggagccgcaatggcagcgggggcggcagagggtgtaggtgtgtggagcctcgaaccagaggacctgagcgcagttacaatggaacgttttgagcctcagattaatgcagaggaaagcgagatacgctacagtacttggaaaaaagctgtgatgaaatcgatgggatgggtgacaacacagtccccggagtctggcatcccatag

SEQ ID NO: 189556 - DNA, 1680 bp, Artificial Sequence
  Description of Artificial Sequence: Synthetic coding sequence
atggccgccagcaagaaggccgtgctgggccccctggtgggcgccgtggaccagggtaccagctctacacgcttcctggtgttcaacagcaaaaccgcggaactgctttcacatcatcaggtggaaattaaacaggaattcccaagggaaggttgggtcgagcaggaccccaaagagatactccatagcgtgtacgaatgtattgaaaagacgtgcgaaaagctgggccaactgaacattgatattagtaatatcaaagctattggagtgagtaaccagagagagactacagtggtttgggacaaaattaccggcgagcctttatacaatgccgtcgtgtggctggacctgagaacgcaaagtaccgttgaatccctgtctaagaggatccctgggaataataattttgtgaagtctaagactgggctcccactgtcgacttactttagcgcggtgaagctcagatggcttttggacaacgttagaaaagttcagaaagccgtcgaggaaaagagggcactcttcggcacaatagacagttggttgatatggagtctgacaggaggggtaaacggaggcgtgcactgtactgatgtgacaaacgcctcaagaaccatgctgtttaatatacattccctcgagtgggataagcagctgtgtgagttctttggcattcctatggagattctgcccaatgtgcggagcagcagcgagatctatggactcatgaccattcacaattcaaagaaggcaggggccctggaaggagtgcctatctccggttgcttaggcgaccagtccgccgcactcgttggccagatgtgttttcagataggtcaggccaaaaatacttacggtactggctgtttccttctttgtaatacaggacacaagtgtgttttcagcgaccatgggctgttgacaacggttgcttataaactcgggagagataaacccgtctactacgcacttgaaggctctgtggcaatcgccggagccgtgatcagatggctcagggataaccttggcatcatcaagacaagtgaggagatcgagaagcttgccaaggaagtgggtacctcctatgggtgttatttcgtgcctgcttttagcggactctacgccccttactgggaaccttccgcacgagggatcatttgtggactgacccaatttactaacaaatgccacatagccttcgcagctcttgaagccgtgtgcttccagacccgcgagattctggatgccatgaatagggattgtggcatccccttgtctcatctccaggtggatggcggtatgactagtaataagattctaatgcagcttcaagccgacatcctgtacattcctgtggtaaagccatcgatgcctgagacgaccgctctcggtgctgcaatggccgcaggggccgcggaaggtgtgggagtctggtccctcgagcctgaggacctctctgccgttaccatggaaagatttgagccccagatcaatgcagaagagtcagaaatccggtatagtacctggaagaaagcggtaatgaagtctatgggctgggtcacgacacaatcacctgagagtggtgatccaagtatcttctgtagcttgccactgggcttctttattgtgagttcgatggttatgctgataggagcccgatatatctcgggcatcccttag

SEQ ID NO: 189557 - DNA, 1662 bp, Artificial Sequence
  Description of Artificial Sequence: Synthetic coding sequence
atggccgcccccaagaccgccgccgtgggccccctggtgggcgccgtagtgcagggaactaactctacaaggttccttgtgttcaacagcaaaacggccgaattactgagccatcacaaggtggaactcacacaggagttcccgaaggaagggtgggttgaacaggaccccaaagagatactgcagagcgtttatgaatgtattgcccgaacatgcgagaaactggatgaactcaatattgacatttccaacatcaaggctgtcggtgtgagcaatcagcgagagactacggtcatttgggacaagctgacaggggaaccactgtacaatgctgtggtctggctggacctaagaacccagaccactgtggaagacctcagcaagaagattcctggaaacagcaattttgtgaagtccaagaccgggttaccattgagcacctactttagcgccgttaaattgagatggatgctcgataacgtcaggaatgtgcaaaaggcagtggaagagggcagagccctgtttggcaccatcgacagttggctgatctggtcactgactggtggtgtcaatgggggggtccattgcaccgatgttaccaacgcaagtcgaacaatgttgtttaatatacacagcctcgaatgggacaaggagctctgtgatttcttcgagatacccatggacttacttccaaatgttttttcctcatcagagatatatggactgattaaaaccggagcactggaaggggtgcccatcagtggttgcctgggggaccaatgtgccgccctggttggccaaatgtgctttcaggaaggacaagctaagaacacatacggaaccggatgtttcctcttatgcaatacggggcgtaaatgtgtattctctgaacacggactattgaccactgtagcatataaactgggacgggagaagcccgcatactatgcactggaggggtcagttgccattgctggagcagttatccgttggctgagggacaatctcggcataattgagacttcaggggacattgagagactggctaaggaagtgggcacttcatacgggtgttattttgttcccgcgttctctggcctttacgccccatactgggaaccaagcgcgaggggtatcctctgtggactaacacagttcacaaataagtgtcatatcgcctttgcagccctggaggcagtgtgctttcagacacgcgaaatactggaagctatgaatcgggattgtggaatacctctccgtcacctgcaagtcgacggcggcatgactaacaataaggtcctcatgcaactccaggccgatatcctccatatccctgtgatcaagcccttcatgccagaaaccacagctctaggagccgcaatggctgctggagccgcagaaggggtgtctgtgtggagccttgagcctcaagctctgagcgtgctgcgaatggaacgattcgaaccgcaaatccaggcaactgagagcgaaatcagatacgccacatggaaaaaggccgtgatgaagagcatgggctgggtgaccagccagtcccccgaggggggggatcccagtatcttctcgagtctccctcttggattctttatcgtttccagcatggtgatgctgataggcgccaggtatatcagtggagtgccatag

SEQ ID NO: 189558 - DNA, 1050 bp, Artificial Sequence
  Description of Artificial Sequence: Synthetic coding sequence
atggccagcaagaaggtgtgcatcgtgggcagcggcaactggggctcggccattgctaagattgtaggcgggaacgccgcgcaactggcacaattcgatcccagggtcactatgtgggtcttcgaggaggacattggtggaaagaagttgactgagataatcaatactcagcacgagaacgtgaaatacctgccaggccacaagctgcctccaaatgtcgttgccgtgcctgacgttgtccaagcggcagaagacgctgatatactaatctttgtggtaccccaccagttcatcggcaagatttgcgaccagcttaagggccatctgaaggcaaatgctactggtattagtttaataaagggcgtggatgagggtcctaacggcctcaaactgatatctgaggttataggagaaaggctgggcatccctatgagcgtcctcatgggggccaacatcgcatctgaagttgctgatgagaaattctgtgaaaccacaatcgggtgtaaagacccggcgcagggacagctactgaaggaactcatgcagacaccaaattttcgcattacagtggtccaggaagtggataccgttgaaatttgtggcgcccttaagaatgtagtagccgttggcgccggattctgtgacggcctcgggtttggcgataacacgaaggccgccgtgattcggctgggattaatggagatgatagctttcgcgaagctcttttgcagcggaccagtgagctctgccacgttcctggagagctgtggggtggccgatctcatcactacatgctacggagggcgcaatcgtaaggtcgctgaagcgttcgccaggactggcaaaagcattgagcagttggaaaaggaactcctgaacgggcaaaagctgcagggccccgagaccgctcgggagttatatagcatcttacagcataaggggttagtagacaagttccctctgttcatggcagtgtataaggtatgttatgagggccagcccgtgggggagttcatccattgtcttcagaaccatcctgagcatatgtag

SEQ ID NO: 189559 - DNA, 981 bp, Artificial Sequence
  Description of Artificial Sequence: Synthetic coding sequence
atgcagacccccaacttccggatcaccgtggtgcaggaggtggacaccgttgaaatctgtggggccctgaaagtccgcggcgctcaacgacaactctggggagaggagaaggctcctaaggaggtctggctctccagcgcaagactccaggtcctgcaggcgctcaccatcgagcagtggtttcctttcccaactatgagccacgcttatagacgatcctgccgctctaaggctcgcgcgattcaagctgactacagttcctctgacagggggccaccctgtagctgcccaattctcgccccctgcggcacccctcacccactggcgcccggaggtcaaggcgacaaggagatgcctagattgatgggtgacaaaacatcgctgacccctaggcagacaaatgggcagaactatggatcctggactgccgtggacggcctgtacaacggtatggtgcggtgggaagaccaattggaaaggagagttgttttcagaaaatgtccaaggggcgggagtatggggcagggcctgcggaagggagttcagcagggaggaaagcctcgaggaggtagcaggctgctgaagggccacaccctctacctcagcagtgccgtaggtgtgaccgctgacgaaatgagtatgcgagggctgcatatgggcccaatcggagggggattatttacttatgatctgcactctttcaaaaacgtagtagctgtgggagccggcttttgtgacgggctgggattcggtgacaatactaaagctgccgtgatacgcctggggcttatggagatgatcgcatttgccaagcttttctgctccggtccagtgagtagcgctacctttttggagtcctgcggggtggccgatctgataacgacctgctatggtggccgcaatcgcaaggtggcagaggccttcgcccgcactggtaaggtgggcccagggagacgggaaaatcgaggtgctgcactatag

SEQ ID NO: 189560 - DNA, 1056 bp, Artificial Sequence
  Description of Artificial Sequence: Synthetic coding sequence
atggccgccgcccccctgaaggtgtgcatcgtgggcagcggcaactgggggagcgccgtggccaagatcatcggtaataacgtgaagaagctccagaaattcgccagcactgtcaaaatgtgggtgtttgaagagacagtgaatggacgtaaactaaccgatatcattaataatgatcacgaaaatgtgaaatacctgccagggcataaactgcccgaaaatgtggttgcaatgtccaacctgagcgaggcagtgcaggacgcagatcttttagtattcgtgatcccccaccagttcatccaccggatttgcgacgaaattactggccgcgtgccaaagaaggccctgggcataacccttatcaaagggatcgatgaaggccctgaagggctgaaactcatttcagacattatacgcgaaaaaatgggaatcgacatttcagtgctaatgggagccaacatagccaatgaagtggcagcagaaaagttctgcgaaacaaccattggatccaaggttatggaaaatggacttctgtttaaagaactgcttcagacgcccaacttcaggatcacagtcgtagacgacgctgataccgtggagttatgtggggcccttaagaatatcgtggccgtcggggccggcttttgtgacgggctccgatgtggagataacacaaaggccgccgtcattaggttgggcctcatggagatgatagctttcgccagaatcttttgtaagggacaggtatcaaccgctactttcctcgagtcctgtggcgtcgcggacctgatcaccacgtgttatggcggtcgtaataggcgcgtcgctgaggcattcgccaggaccggaaagaccattgaagaactggagaaagagatgcttaacgggcaaaagctgcaggggccacagacgtcggcagaagtgtacagaatactaaagcaaaaggggctgctagataaattccccctgttcacagcggtctaccagatctgctatgaatccaggccagtgcaggagatgctgagctgcttgcagtctcatcctgagcacacgtag

SEQ ID NO: 189561 - DNA, 1860 bp, Artificial Sequence
  Description of Artificial Sequence: Synthetic coding sequence
atggagagcagcagcagcagcaacagctacttcagcgtgggccccacgtctccttcggctgtcgtgctcctgtattctttgtccaaagagtctctccagtccgtagatgtgttgagggaggaggtatctgagattctggacgaaatgtctcacaagttgcgacttggcgcaattcggttttgcgcctttaccttgtcaaaggtgttcaaacaaatattctctaaggtctgtgttaacgaggaaggcatccagaagctgcagcgggcaatacaggaacatccagttgtgcttcttccgtcccaccgctcctatatagatttcctgatgttgtctttcctgctatataactatgacctgcccgttcctgtcattgcggccgggatggatttcctgggtatgaaaatggtgggggagttgttgcgtatgagcggggccttctttatgcgcaggacttttggaggcaacaagctctactgggctgtgttctctgaatacgtcaaaaccatgctcaggaatgggtacgctccagtcgagttcttccttgagggtacgcgctccagatctgctaaaactttaactccaaaatttggtctcctaaatatcgtcatggagcctttctttaagcgtgaggtgtttgatacctaccttgtccctatttccatctcctatgacaagatccttgaagagacactgtacgtgtatgagctgctgggggtaccaaagcctaaggaatccactaccggcctgctaaaggccaggaaaattctcagtgagaatttcggttccatccacgtgtatttcggcgaccccgtgtctctcagaagcctggcggcgggacgaatgtcaaggagttcttacaatttagttcctcgctacatcccccagaagcagagtgaagatatgcatgccttcgttaccgaggtcgcatacaagatggaactgctgcagatcgagaacatggtgcttagcccctggacccttatcgtggcggtccttctgcaaaatcgacccagcatggactttgatgcgcttgtagaaaagaccctgtggctgaaaggtttgactcaggcgttcgggggtttcctgatctggcctgacaacaaacccgccgaagaagtggtcccagcgtccatattgcttcattctaacatagccagcttagtgaaggatcaggttatccttaaggtcgatagcggagacagcgaagttgtggacggcttaatgcttcaacacattactttgttgatgtgcagtgcttatcgcaatcagcttttaaacattttcgttaggccttctctggtggccgtggcacttcagatgactcccgggtttcgcaaggaggatgtctactcatgcttcagattcctgcgggatgtgtttgcagatgaatttatctttttacctggcaataccctaaaagactttgaggaggggtgctaccttctttgtaaatccgaagccattcaggtcacaaccaaggacattctcgtcaccgagaaaggcaacacggtactcgagtttcttgtggggttattcaagccgttcgtggaaagctaccagattatctgcaagtacctgctaagtgaagaggaggatcattttagtgaggagcagtacctagctgctgtccgcaagttcacaagccaattactggatcagggtacgtcccagtgttacgatgtgctctctagtgatgtgcaaaagaacgcgctggccgcctgcgtgcggttgggtgtggtggaaaagaaaaaaattaataacaactgtatctttaatgtgaatgagcctgctacgacaaagcttgaagaaatgctgggatgcaagactccaattggaaagcctgcgacagctaagctttag

SEQ ID NO: 189562 - DNA, 2043 bp, Artificial Sequence
  Description of Artificial Sequence: Synthetic coding sequence
atggagagcagcagcagcagcaacagctacttcagcgtgggccccacttctccctccgcagttgtccttctctactccaaagagctgaagaaatgggacgaattcgaggacattctcgaggagcgtcgccacgtgagtgatctgaaattcgccatgaaatgctacacacctctagtctataagggtatcaccccatgtaaaccgatcgatatcaagtgctctgtcctgaactctgaagagattcactacgtgatcaagcaattgagtaaggaatctctgcaatccgtagacgtccttagggaggaggtgtcagaaatactcgatgagatgagccataaacttcgtttgggagctattcgcttctgtgcgttcacactctctaaggttttcaaacagatttttagtaaagtgtgcgtgaacgaagaaggtatccaaaaactgcaacgggcaatccaggagcacccggtggtcctgttgccctcccaccggagttatatagatttcctgatgttaagttttctcctgtacaactatgacctccccgtgccagttatcgcagctgggatggatttcctgggcatgaaaatggtaggggaactgctcagaatgagtggcgccttttttatgcgtaggacttttggcggaaataaattgtactgggcggtttttagtgagtacgtgaagacaatgctgaggaacgggtacgctcccgtggaattttttttggaaggtacacggagtagatcagctaagactctgaccccgaagtttgggttactgaatatagttatggaacctttcttcaagagggaggtgtttgacacatacctggttccaattagcatctcctacgacaaaatccttgaggagaccctttatgtgtatgagcttctcggcgtgcctaagcctaaggagagcaccactggtctgctgaaggctcgcaaaatactgtcagagaatttcgggtccattcacgtgtattttggggacccggtttctctgaggtccttagcagccggcaggatgagcaggagcagttacaatctggtcccacgatacattccccagaagcagtctgaggacatgcacgcctttgtcacagaggtcgcctacaaaatggagctcttacagatcgaaaacatggttctcagcccctggacactcatcgttgccgttctgctgcaaaataggcccagcatggacttcgacgcgctagtcgagaagacgctgtggcttaaaggccttactcaggcgttcggagggttcttaatctggccagacaataagcccgcggaagaggtggtgcctgcttccatacttctgcactccaatatcgcatcacttgtcaaggaccaggtgatccttaaagtggacagtggtgattctgaggtggttgatgggctcatgctgcagcacattactttgttgatgtgttcagcctataggaaccagctgttgaatatcttcgtcaggcccagtctcgtggccgtcgcacttcagatgacaccgggtttccgaaaggaggacgtatattcatgcttcagattcctgagagacgtatttgctgacgagttcatctttctgcctgggaacaccctcaaggactttgaggagggatgctacctactctgtaagagtgaagccatccaggtaaccacaaaagatatcctggtaaccgaaaaaggtaatacagtgctcgaattcctcgtgggcttgtttaaaccctttgtcgagtcgtaccagattatatgtaagtacctgctgtccgaggaagaagatcacttctctgaagagcaatacctcgcggccgtgagaaaatttaccagtcagcttctggatcagggcactagccagtgttatgacgtcctgagcagtgatgtgcagaagaatgcacttgccgcgtgcgtaagactgggcgtcgttgaaaagaaaaagatcaacaacaattgtatttttaacgttaacgagcccgccaccacgaaattagaagaaatgttaggatgtaaaaccccaatagggaagccggccacagctaagctgtag

SEQ ID NO: 189563 - DNA, 1764 bp, Artificial Sequence
  Description of Artificial Sequence: Synthetic coding sequence
atggagagcagcagcagcagcaacagctacttcagcgtgggccccacatcaccgtccgcggtcgtccttttatacagtaaggaactgaagaaatgggacgaatttgaggatattctggaagaacgcaggcatgttagtgatctgaagtttgctatgaagtgttacacaccactggtgtataagggtatcacaccctgtaagcctatcgacattaagtgttccgtcctgaattccgaggaaatccactatgttattaaacagctatcaaaagaatccctgcagtcagttgatgttctccgcgaggaggtgagcgaaatccttgatgagatgtctcacaaactccgtctcggtgcaatacgtttttgcgccttcaccttaagtaaggtgttcaagcagatattcagtaagctgcagcgcgctattcaggagcaccctgtagtcctacttccttctcatcggagctatatcgatttcttgatgctgtcgtttctcctgtacaactatgatctccccgtcccggttatagcagctggaatggatttcctgggcatgaagatggtcggtgagctcctgcgtatgagcggcgcctttttcatgcgccggacatttggcggcaataagttgtactgggctgttttcagtgagtacgtcaagactatgctaagaaacggatacgcccctgtggaattctttctggaggggacccgaagtcgtagcgcaaagacattgaccccaaaattcggactgctcaacatagtcatggaaccttttttcaagcgagaagtgttcgacacctaccttgtgcctattagcatcagttatgataagatcctagaggaaacactctatgtgtacgaattactcggggtgccgaaacccaaagagtcaactaccggtctgcttaaagcccgaaaaattctgtccgaaaacttcggatccattcatgtatattttggcgatcctgtgtctttacgctcattagctgcaggccgcatgagtcggtcgtcatataatctggtacctcgatacattcctcagaaacaaagcgaggacatgcatgcattcgtcaccgaagtggcctacaaaatggagctcctgcagattgagaatatggtgcttagtccgtggactctcattgtggcagttctgctccaaaataggcccagtatggacttcgatgcgctcgtggaaaagaccctgtggctaaaaggactgacacaagcctttggtgggtttctgatctggcctgacaacaagccagcggaggaggtcgtcccagccagcattctcctacactcaaatattgcttccctagtgaaggatcaggtgatcctgaaggtagattctggcgattctgaggttgtagatggccttatgttgcagcacattaccctattaatgtgctctgcctataggaaccaattacttaacatttttgtgcgcccttctctggtcgctgtggcactgcagatgacccccggatttagaaaagaggacgtgtactcttgcttcaggttcctccgcgacgtgttcgcagatgagttcattttcctcccaggtaacacgctcaaagatttcgaagagggctgctacctcctgtgcaaatcagaagcaatccaggtaactacgaaagatatcctagtaacagagaagggcaacacagtgctggaatttctggtgggcttgttcaaaccattcgttgagtcttatcagatcatttgtaagtatcttctgtcggaggaagaagaccacttttctgaatag

SEQ ID NO: 189564 - DNA, 669 bp, Artificial Sequence
  Description of Artificial Sequence: Synthetic coding sequence
atggagagcagcagcagcagcaacagctacttcagcgtgggccccaccagccccagtgccgtggtgcttttatatagcctctccaaagagagtcttcagtcagtggatgttctgcgcgaagaggtgtctgaaattttggacgagatgtcccataagctgcgactgggcgcgattcggttctgcgcgttcaccctgagcaaggtattcaaacagattttctcgaaggtgtgtgtcaacgaagaaggcattcagaagcttcagcgtgcaatccaggaacaccccgtggtactgctgcccagccaccggagctacatagattttttgatgctgtccttccttctgtataattatgacttaccagtgcctgttattgccgctggaatggacttcttggggatgaagatggtgggagaactgttacgcatgagcggtgccttctttatgcgccggactttcggcgggaataaattatactgggccgtgttctcggaatatgtcaaaaccatgctgaggaacggatacgctcctgtggagttcttcctcgaagggacacggagtcgtagcgcaaagactctgacccctaagtttggcttactgaacatcgtgatggagccatttttcaaacgcgaagtattcgacacgtatctcgttcctatcagcatttcatag

SEQ ID NO: 189565 - DNA, 870 bp, Artificial Sequence
  Description of Artificial Sequence: Synthetic coding sequence
atgagccggaacagccggaagaccatcggcaaggtgcgggtggactacattatcattaagccccttccagggtactcctgtgacatgaagtcaagtttcagcaaatactggaaacccaggatacctctggatgtaggccacagaggagccgggaattccaccaccacggcccaactggcaaaggtgcaggaaaacactatcgcctctctgcggaacgctgcttcacacggggctgccttcgtagaattcgatgtgcacctgtcaaaggactttgtgcctgtggtgtatcatgacctgacatgctgtctcacaatgaagaaaaacctctggttccgtagaaagatacccttccagaaaatcagccacttcctgctcctgagatgggttagacagaagcagaacaagtaccccattctcttcctcacccaggggaaatcagagatttatccagaacttatggatcttcgtagtcgaacaacacccattgcgatgagttttgctcaatttgagaatttgctcggaatcaatgtccacacagaggaccttctgcggaacccttcctatatccaggaagccaaggcaaagggcctcgtcatcttctgctggggagacgatactaacgatccggagaatcgtaggaagttaaaggagcttggggtcaacgggctgatttacgaccggatctacgattggatgcctgagcagcccaatatctttcaggtggagcagctggaacggcttaaacaagagctaccggagcttaaaagttgtctgtgccccaccgtaagccgcttcgtgccatcctcgctgtgtggcgaatccgacatacacgtcgacgccaatgggattgataatgtggagaacgcctag

SEQ ID NO: 189566 - DNA, 2019 bp, Artificial Sequence
  Description of Artificial Sequence: Synthetic coding sequence
atgacccccagccaggtggccttcgagatccggggcaccctgctgccaggtgaagtgttcgccatctgcgggagctgcgacgccttgggtaattggaacccacagaacgcagtcgcccttctccccgagaatgataccggcgagtccatgttgtggaaggccaccatcgtgctgtcaagaggagttagcgtacaataccgctactttaaagggtactttttagagccaaaaaccataggcggcccttgccaagtgatcgtgcataaatgggagactcatctgcagcctcgctctatcacccccttggaaagtgaaatcataatcgacgatgggcagttcggaattcataacggggtcgagaccttggattccgggtggctgacatgtcagactgagatcaggctgaggctgcactattcagaaaagccgcctgtgtctattactaaaaagaagctgaagaaatctagattcagagtaaagctaactttagaaggcttggaggaggacgacgatgaccgggtttccccaactgtgcttcacaagatgagcaactctctggagatctcactgatcagtgataacgaatttaaatgccgtcattctcagcctgaatgtggttacggactgcagccagatcgctggacagagtactccatccagaccatggagccggacaatctggagctgatatttgacttctttgaggaagatttgtctgaacacgtcgtacagggagatgccttacccggccacgtcggaaccgcatgcctgcttagttccactattgctgaaagcggtaagtcggccggcatattgaccctccccatcatgtcccggaatagtcggaagaccatcgggaaggtgcgcgtagactatatcatcatcaaacctctgcccggatactcctgtgatatgaaatcaagcttttcaaaatattggaaaccacggattcctctcgacgtcgggcatcgcggggcaggaaactctacaaccaccgctcagctggccaaagtgcaggagaacactattgcctccttgcggaacgccgcatctcatggagctgccttcgtagagttcgatgtccatctgagcaaagacttcgtgcccgttgtgtatcatgacctgacatgttgtctgactatgaagaaaaagtttgatgcggacccagtcgagcttttcgagatcccggtgaaggagttgactttcgaccagctacaactgctgaagctcacccatgtcaccgctcttaagtcaaaagacaggaaagagtccgtggttcaggaagaaaacagcttttctgagaatcaaccctttccttctctgaagatggtactcgaatctctgccagaagatgtaggatttaatattgagatcaagtggatctgtcagcagcgggatggtatgtgggacggtaatctgtctacatactttgatatgaacctgtttctggacatcatacttaagacagttctagagaattctgggaaaaggcgaatcgtgttttcttcttttgacgcggacatctgcaccatggtccggcagaagcagaacaaatatcctatcctcttcctgacccagggaaagtccgagatctacccagagttgatggacttgcgttccagaactacacctatcgcgatgtcattcgcccagtttgaaaatctgctgggtataaacgttcatacggaagacctactcaggaacccatcctacatacaggaggccaaggccaaagggttagttattttctgctggggagatgacacaaacgatcccgaaaataggagaaagcttaaggagcttggtgttaatgggcttatttatgatcgcatttacgattggatgcctgagcagccaaatatcttccaggtggagcaattggagcgcctgaaacaggagcttcccgaactgaagagctgtctgtgtccaacggtgtcccgcttcgtcccgtcttccttatgcggcgagagcgacattcatgtggacgcaaatgggatcgataatgtcgaaaacgcttag

SEQ ID NO: 189567 - DNA, 795 bp, Artificial Sequence
  Description of Artificial Sequence: Synthetic coding sequence
tgatgcgacatgaagagcagcttcagcaagtactggaagccccggataccactggacgtgggtcatcgcggtgctggaaactcgacaacaacagcccagcttgcaaaggtgcaggaaaataccatcgcctctcttcgcaacgcggcttctcacggggctgcctttgtggagttcgacgtccatttgtctaaggattttgttccagtggtgtaccacgatctgacctgctgccttaccatgaaaaaaaatctgtggttccggagaaaaattccttttcagaaaattagccactttctgctgctcagatgggtcagacagaagcagaataaataccctattcttttcctgactcagggtaaatctgagatctatccggaactaatggatctgaggagcaggacaacaccaatcgcaatgagcttcgctcagtttgaaaacctattgggaattaacgtccataccgaggacctgctgcgaaacccaagctatattcaggaagctaaggctaaaggtttagtcatattctgctggggggacgacaccaacgacccagagaacaggagaaaactgaaagagctaggcgtgaacgggttaatctacgataggatatacgactggatgcccgaacagccaaatatcttccaggtagagcagctcgagaggctgaagcaagaactgcccgagctgaagtcttgcttgtgtcccactgtaagccggtttgttccctcctccctctgcggtgagagcgatattcatgtcgatgccaatggcatcgataatgtggaaaatgcctag

SEQ ID NO: 189568 - DNA, 996 bp, Artificial Sequence
  Description of Artificial Sequence: Synthetic coding sequence
atgtggctgtgggaggaccagggcggcctgctgggccccttcagcttcctgcttctagtcctgctgcttgtcacaaggtcacctgtgaatgcctgtttgcttacaggatcccttttcgtgctgcttagagtattcagttttgaaccagtgccctcttgcagagccttacaggtgctgaaacccagagaccggattagcgccatcgcccatcgcggcggatctcacgacgcgccagagaataccctggccgccatacggcaagcagcgaaaaatggcgccaccggagtcgaacttgacatcgagtttacttcagacggaattcccgtgttaatgcacgataacactgtggacaggaccactgatggaacagggcgtctctgtgatctgacctttgagcagatccgtaagctcaatcccgcggccaaccacagactgaggaatgactttccagacgaaaagattccgactctcagggaggccgttgcagaatgtcttaatcacaatctcacaattttctttgatgttaagggccacgcccataaagccacagaggctctcaagaaaatgtatatggagttcccccagctgtataataactccgtcgtgtgttcctttctgccagaagttatatacaaaatgcgacaaaccgaccgtgatgtcataacagctctcacccaccgcccctggtcccttagtcacaccggggacggaaaacctagatacgacaccttctggaagcacttcatttttgtgatgatggatatcctgttggactggagcatgcacaatattctctggtatctatgtgggatctctgcatttctcatgcaaaaggactttgttagtcctgcatatctgaaaaagtggtctgccaaaggaatccaagtggtcgggtggactgtgaatacctttgacgaaaagtcgtactatgagagccatctgggatcttcctacataaccgattcaatggtcgaggattgcgagccccacttttag

SEQ ID NO: 189569 - DNA, 1818 bp, Artificial Sequence
  Description of Artificial Sequence: Synthetic coding sequence
atggtgcggcaccagcccctgcagtactacgagccccagctgtgcctgagctgtctcacaggcatttatgggtgccggtggaaacgataccagcgatcccatgacgacactacgccttgggagagactctggtttctgctgctgacattcaccttcggtttgactctaacatggctgtacttctggtgggaagtgcacaatgattacgacgagttcaactggtatttgtacaaccgcatgggctactggagcgactggcctgttccaatactcgtgactactgctgccgcgttcgcctatattgccggccttctggtgctggcgctgtgtcacattgcggttggccagcaaatgaacctgcactggctgcacaagatcggcctcgtagttatcctcgctagcaccgtggttgccatgagcgccgtggcccagctctgggaagacgaatgggaagtcttgttgatatcactgcagggcaccgcgcccttccttcatgtgggcgcagttgccgcggtgacaatgctgtcctggatcgttgccggacagtttgcccgggctgagcgtacgtcctcccaagtcaccatactttgtaccttcttcactgtagtgtttgcactctatttagcgcccctgacaatttctagtccatgtattatggagaaaaaagacctgggccccaaacccgccctgatcggccataggggtgcaccgatgctcgctcccgagcatactctcatgagctttcggaaagctctggaacagaagctgtatggactgcaggctgacatcacgatatctctggatggggtcccattcctaatgcacgataccacactccgcaggacaactaacgtggaagaggagttcccagagctggcccgaaggcccgcgtcaatgctcaactggacaaccctgcagaggctgaatgcaggccagtggttccttaaaaccgaccccttctggaccgctagctcactttctcccagcgaccatagagaggctcagaaccagtccatctgctctcttgccgaactgttggagctcgctaaaggtaacgccaccttgcttctcaacttgagggatccacctagggagcatccatatcgatcttccttcatcaatgtaaccctggaggccgtccttcacagcggcttccctcagcaccaggtcatgtggctccccagtcggcaacgcccactggtgcgcaaagtggcccccgggttccaacagacctctggcagcaaggaggcagtggcatccttgcgccggggtcacatccagaggcttaatttaagatacacacaggtgagcagacaagaactcagagattacgcctcttggaatttgagcgttaacctctacacagtcaatgctccttggctgttcagccttttatggtgtgctggagttccgtctgtcacctcagacaatagccacgcgctttctcaagtacctagccccctctggattatgccacctgacgaatactgtttaatgtgggtgactgcagacctcgtaagtttcacattaatcgtggggatctttgtgctccagaagtggcgtttggggggcatacgctcctacaatcccgaacagatcatgttgagcgctgctgtgaggaggaccagtagagatgtatccattatgaaagaaaagctgattttctccgaaatctccgatggggtcgaagtctctgacgttctcagcgtgtgctctgacaacagttacgatacatatgcgaactccactgccactcctgtcggacctagaggtggaggcagtcacacaaaaaccctgattgagcgcagcggccgctag

SEQ ID NO: 189570 - DNA, 1461 bp, Artificial Sequence
  Description of Artificial Sequence: Synthetic coding sequence
atggtgcggcaccagcccctgcagtactacgagccccagctgtgcctgagctgcctgaccggaatctacggatgccggtggaaacgttatcagcgctctcacgacgacaccacccctggtaccgcacctttcctccacgtgggtgcagtcgcagcagtgactatgctgtcttggattgttgccggtcagtttgctcgggcggagcgtacatctagtcaggttactatcctatgtacctttttcacggtggtgttcgccttgtaccttgccccacttactatctcatctccgtgcatcatggagaaaaaggacctgggccccaagcccgctctgatcggacacagaggcgcccccatgctagcccctgaacacacacttatgtcattccggaaggctttggagcaaaaactgtatgggttacaagccgacattacaatttccctggacggggtccccttccttatgcacgacactacacttcggagaactacaaacgtggaggaggagtttcccgagctggctcgccgccctgcctcgatgctgaattggaccaccttacagcgcctgaatgccgggcagtggtttctgaaaacggatccgttctggaccgctagcagtttaagcccttctgaccatagagaagcccagaaccagtccatatgctcactggcagaactgctggaactagctaagggaaacgctactctgcttctcaatctaagggaccccccgcgcgagcatccctatcggtcctcttttattaatgtcaccctggaagctgtcttacactcaggttttccgcaacatcaggtcatgtggctgccttcaaggcagcggccactggtccggaaggtcgcacctggttttcaacagacttccggcagcaaggaggcagtcgcgtcactgaggcgtggacatattcagaggctgaatttgagatatactcaggtgtcacgccaagagcttagggattatgcatcctggaacctgtctgtgaacctgtacaccgtcaacgcaccttggctcttctcactgctgtggtgcgccggggttccctctgtgacaagcgataattctcatgccctctctcaggtgcccagccctctctggatcatgccacctgacgaatattgtctcatgtgggtaaccgccgatttagtgtcctttaccctcatcgtggggattttcgtgctccagaaatggcggcttggcgggattcggtcctataatcccgaacaaattatgttgtctgcagctgtgcgccgaacctctagggatgtgtccatcatgaaagaaaagctaattttcagtgaaatctcagatggcgttgaagtatcagacgttctaagtgtctgctctgataattcttacgacacatacgcaaattccacggcaacacccgtgggaccacggggcgggggctctcatacaaaaacattaattgagcgctctggcagatag

SEQ ID NO: 189571 - DNA, 408 bp, Artificial Sequence
  Description of Artificial Sequence: Synthetic coding sequence
atggtgcggcaccagcccctgcagtactacgagccccagctgtgcttgtcatgcctgactggcatctatgggtgcaggtggaaacgttatcagagaagccacgacgatacgactccatgggaacggttatggttcttactgttgactttcacattcggactgaccttgacatggctctatttttggtgggaggtgcataatgattatgatgaatttaattggtatctgtacaacagaatgggatactggtcagattggccagtgcccatactggtaaccactgcggcagccttcgcttacattgccggcttactcgtgctcgccctgtgtcatatcgctgtgggtcagcagatgaatttgcactggctccacaaggcctcttccggtctgcctctgtctcccctgtag

SEQ ID NO: 189572 - DNA, 1404 bp, Artificial Sequence
  Description of Artificial Sequence: Synthetic coding sequence
atgagcgccgtggcccagctgtgggaggacgagtgggaggtgctgctcataagcctccagggcaccgctccatttctgcacgtaggagccgtggcagccgtgaccatgctttcttggatcgtggccggccagttcgcccgggcagagaggacttcgagccaggtgaccatactttgcactttcttcactgtagtttttgccttgtaccttgcgccactgaccatctccagtccatgtataatggagaaaaaagatctagggcccaagccagctcttattggacataggggcgcgcccatgttagctcccgagcacactttaatgagcttcaggaaggcactggaacaaaaactgtacggcctgcaggccgatattacaataagcttggacggggtacccttccttatgcacgacaccaccttgcgcaggacaacgaatgtagaggaagagttcccagagctagccaggaggcccgccagcatgctgaattggactacactgcagcgtctcaatgcgggccagtggttcctgaagactgacccgttttggaccgcaagctctctgtcgccttctgatcatagagaagcacaaaatcagtccatctgttccctggccgagctgctcgaacttgcgaaagggaacgccacactgcttttgaatcttagagatcccccgcgggagcatccataccgttcatcgttcataaatgtcacattggaagcagtgcttcacagtggcttcccccaacatcaagtgatgtggctgcccagcagacagagaccactggtccggaaggtcgcccccggcttccagcagaccagtgggagtaaggaagctgtggcgtctttgcgtcggggccacatacagcgtctgaatctgagatatactcaggtgtcacgacaggagctgagagactatgcgtcttggaatctgagtgttaacctgtatacagtgaatgcaccatggctgtttagcttgctgtggtgtgctggagtaccgagcgtcaccagcgataattcgcacgcactctcccaagtgccaagcccactttggatcatgcctcccgatgagtactgtctcatgtgggtaactgcagacctcgttagtttcaccctaatcgtcggtatatttgtgctgcaaaaatggaggctgggaggcattcgctcttacaacccggaacaaatcatgctgagcgctgcagtacggcgtacctcgcgtgacgtgtcaatcatgaaggagaaactcattttctcagaaatttctgacggagtggaggtgagcgacgtgttaagcgtgtgttccgacaactcctacgacacctacgctaattctacagccacccctgtggggccccgcggcgggggctcccataccaaaacgctgatcgagcgaagtgggcggtag

SEQ ID NO: 189573 - DNA, 1818 bp, Artificial Sequence
  Description of Artificial Sequence: Synthetic coding sequence
atggtgcggcaccagcccctgcagtactacgagccccagctgtgcttgtcatgtctgactggaatctacgggtgcaggtggaaaaggtatcagcgcagccatgacgacacaaccccctgggagcggttgtggttccttctgttgacctttacgttcggcctcacgctcacctggctatatttttggtgggaggtgcacaacgattacgacgagttcaactggtatctctataaccgcatggggtattggtctgactggcctgttcctatcctcgttactacggccgccgcctttgcgtacatcgccgggctgttggtgctggcattgtgtcatatcgcagtgggccagcaaatgaatctccactggcttcataaaataggcctggtggtgatacttgcctccacagtggttgcaatgtccgccgtggctcaactgtgggaggacgagtgggaggtgctacttatttccctgcagggaacagcccctttcctccacgtcggcgccgtggccgccgtcacaatgctctcttggattgtggctggccagtttgcgcgcgcagagcgaacttcgagtcaggtgaccatactctgcacctttttcactgtggtgttcgccctctatctcgccccactcacaatcagtagtccatgcattatggagaagaaggatctggggccgaaacccgccctgataggccaccgaggagcgcctatgctcgccccagagcacacgctgatgtcttttaggaaagccttagagcagaaactctacggcttacaggctgatatcaccatctccctggacggcgtaccttttttgatgcatgatactaccctccggcggacgactaatgtggaagaagagtttccagaacttgcacgccgcccagccagcatgctcaattggactacactgcagaggctcaacgccggtcagtggttcttaaagacagacccattttggaccgcttccagcctgtccccatcagaccaccgagaggcccaaaatcagtctatttgcagcctcgccgaactccttgagttggccaagggaaatgcgaccctgttgctgaatctgcgcgaccctccccgcgaacatccttaccgaagctctttcattaacgtcactctggaggctgtgctgcatagtggattccctcagcaccaagtgatgtggctcccatcacgacagcgcccgctggtccggaaagtagctcctggtttccagcagacctccggctctaaggaggccgttgctagcctgcgacgtggacatatacaacgcttaaatttgcgatacactcaggtgtcacgacaggagctacgagactacgcctcttggaacctgtccgtgaatttgtacacagtgaatgctccttggctgtttagcttgctgtggtgtgccggcgtgcctagtgtcacatccgacaactctcacgccctcagccaggtcccaagcccgctgtggatcatgccaccagatgaatattgcctgatgtgggtcaccgccgatcttgtgagcttcacactgattgtcggaatttttgtgctgcagaaatggcgtctgggcggtatccgatcttataacccagagcaaataatgctgtcggctgccgttcggagaacttctagagatgtctccattatgaaggaaaaattgatcttcagcgagattagtgacggtgtcgaggtgagcgacgtattgtcagtatgctccgataactcttatgatacctacgcgaattcaacagcaactccagttggacctcggggcggcggaagtcatactaagaccctcatcgagagatctgggcgctag

SEQ ID NO: 189574 - DNA, 222 bp, Artificial Sequence
  Description of Artificial Sequence: Synthetic coding sequence
atggtgcggcaccagcccctgcagtactacgagccccagctgtgcctttcatgtctgaccggaatatatggttgtagatggaagcgttaccagaggtcccacgatgatactaccccctgggagcggctgtggtttctgctgctcactttcactttcggcctgacgctgacgtggctgtacttctggtgggaagttcacaacgactacgacgagttcaactag

SEQ ID NO: 189575 - DNA, 1461 bp, Artificial Sequence
  Description of Artificial Sequence: Synthetic coding sequence
atggtgcggcaccagcccctgcagtactacgagccccagctgtgcctgagctgccttaccggaatttacggctgcagatggaagcgctaccagaggagccacgatgacacgacgcccggcacagcccccttccttcacgtgggggcggtggccgcagtcacaatgctgtcgtggatcgtcgcaggccagttcgctcgcgcggagcgaacatcctcccaggtcactattttgtgtacattttttaccgtggtgttcgctctgtatctagctccccttaccatctcctcaccgtgcatcatggagaagaaagacttggggcccaaacctgccctgatcggacatcggggagcacctatgctggcccccgagcacacactcatgtctttccggaaggcgctagagcaaaagttatacggacttcaagccgacatcacgatttctcttgatggggttcctttcctcatgcatgatactacactcagaaggactacgaacgtggaggaagagtttcctgagctggcccgcaggcctgcctctatgctcaattggactacattgcagcgcctgaacgcgggccagtggttcttaaagaccgacccattttggactgcatctagtctttcccccagcgatcaccgtgaagcacaaaaccagagcatttgttctctagccgagctactggaactggccaaggggaacgccacactgctgcttaatctgagggaccccccacgagagcatccctatagatccagcttcatcaatgttactctagaggctgttcttcactcagggtttcctcaacatcaggtcatgtggctaccatcccgccaacgccccttagtgcgcaaggttgctcccggcttccaacagacaagtggatccaaagaggcagtcgcctctcttcggcgcggacacatccaaagacttaacctgcgttacacacaggtgagccggcaggagctcagagattatgcttcttggaacctatccgtcaatctctacacagtgaacgccccctggctgttcagtctgctgtggtgtgctggcgtgcccagcgtgacatcagacaactcacacgccctctctcaagttcccagcccgctctggatcatgcctccagacgagtactgtctcatgtgggttacagcggacttggtgtcattcacactgatcgtggggatattcgtgctccagaaatggcgactggggggcattagatcatacaaccctgagcaaatcatgctgtccgctgctgtgaggcggaccagccgggacgtcagcatcatgaaagagaagctcattttcagcgagatcagtgatggcgtcgaagtgtccgatgttctttctgtgtgttctgacaactcttacgatacttacgccaattcaaccgccacccccgtcggtccccgggggggaggatcacataccaagaccctgatcgaaagaagtggccgctag

SEQ ID NO: 189576 - DNA, 1083 bp, Artificial Sequence
  Description of Artificial Sequence: Synthetic coding sequence
atgagcttccggaaggccctggagcagaagctgtacggcctgcaggctgacatcacgatcagcctcgacggagtgccattcctaatgcacgacactacactccgtcgaaccaccaatgtggaggaggaattccctgagttggcgaggagacccgcctcaatgctcaattggaccaccctgcagagattaaacgctggtcaatggttcctcaaaaccgacccattttggaccgcctcctctctgtctccaagcgatcaccgagaagctcaaaatcagagtatttgcagtctggccgaactactggagctcgccaaaggcaacgccactctgctcctgaatctccgcgatcccccacgggaacatccttaccggagttcgttcattaacgtgaccctggaggccgtgctgcactctggtttccctcagcaccaggttatgtggctgccctcacgccagagacctctggttagaaaagtcgccccaggtttccagcagacatctgggtcaaaggaagcggtagcctctctgagacgagggcatattcaacggctcaatttgagatatacgcaggtgagcagacaggagctccgggactacgccagttggaatctgtctgttaacctttatacagtgaatgccccatggctcttctccctgctgtggtgtgccggggtgccaagcgtcacaagcgacaattctcatgcactctcgcaagttccctctcctctatggatcatgcctcctgacgaatattgccttatgtgggtaacggcagacctggtcagctttaccctcatagtgggtatattcgtgcttcaaaaatggcgactaggggggatcagaagctacaatccagagcagataatgctgagtgctgcggttaggcggacctcacgggatgtgagtataatgaaggaaaagctcatatttagcgaaatttctgatggcgtcgaagtgtcggacgttctgtcagtgtgctcagacaattcgtacgatacctatgccaattctaccgcaactcccgtgggacctcgaggaggcggctcgcacacgaagaccctcattgagagatctggccgctag

SEQ ID NO: 189577 - DNA, 1272 bp, Artificial Sequence
  Description of Artificial Sequence: Synthetic coding sequence
atgctgcgggtgcggtgcctgcggggcggcagccggggcgccgaggccgtccattacattggatctaggctaggcagaacactgacggggtgggttcaacggacttttcagagcacacaggctgcaaccgcaagttctcgtaactcttgcgccgctgacgacaaagcaacggaaccactgccaaaagactgtccggtgagcagttacaatgaatgggatccacttgaggaagttattgtcggccgggctgagaacgcatgtgttcctccatttacgatcgaagttaaggcaaatacttatgaaaaatactggcccttctaccagaagcagggaggacattactttcccaaggatcacttgaaaaaagctgtcgctgagatcgaagaaatgtgcaacatactgaagactgagggcgtgacagttagaagacccgatccgatcgattggagcttgaaatacaagactccagacttcgaaagtacagggctgtatagtgccatgccccgagacatcctgatcgtggtgggaaacgaaatcattgaggcccctatggcctggcgcagcaggttctttgagtacagggcttatagatctataatcaaagattacttccatcggggtgccaagtggacgacggcgccgaaacctactatggctgatgaactgtacaatcaggactacccaatccactctgtggaggacaggcacaagcttgctgcacagggtaagtttgtgaccactgaatttgaaccgtgtttcgatgccgccgattttattcgcgccggtcgagacatcttcgctcagcggagccaagtcactaattacctgggcatcgaatggatgcggcgccacttggcccccgactacagggtgcacatcatctccttcaaggacccaaacccaatgcatatcgacgctacgtttaacataattggacccggcatcgttctttctaacccagatcgcccgtgtcaccagatagacctcttcaagaaagccgggtggaccattattacacctccaacccctattattcccgatgatcaccccctgtggatgtcctcaaagtggctgtcaatgaacgtcctgatgttggatgagaaacgcgtcatggtcgacgcaaacgaggtccctatacaaaaaatgttcgaaaagctgggcatcacgaccataaaagtgaacatcagaaatgcaaattctttggggggcggatttcactgttggacgtgcgacgtgcgcaggcggggtactctgcagagctatcttgactag

SEQ ID NO: 189578 - DNA, 1176 bp, Artificial Sequence
  Description of Artificial Sequence: Synthetic coding sequence
atgctgcgggtgcggtgcctgcggggcggcagccggggcgccgaggctgttcactatatcgggtccaggctgggacgcacgttgacaggctgggttcaacgtactttccagagtacacaggccgccacagcctcctccagaaattcctgcgccgctgatgataaagcgaccgagcctctgcccaaggactgtccggtatcaagttacaacgagtgggatccattggaggaggtcatcgttggcagggctgagaacgcctgtgttccaccatttactatcgaagtcaaagccaatacctacgagaagtactggcctttctaccagaagcaaggtggacactactttcccaaagaccatcttaaaaaggccgtggccgagatagaggaaatgtgtaacattctgaagactgagggggtgaccgtaagacgacccgatccgattgactggtcccttaagtataagaccccggacttcgagtcaacgggtctgtattccgcaatgcccagagatatactgatcgtcgtggggaatgagatcatcgaagctccaatggcctggcggtccaggttcttcgaatatcgagcctacaggagtataatcaaagactacttccatcgtggggccaagtggacaaccgctccaaagcctactatggccgacgaactctacaaccaggattatccaatccacagtgttgaagaccgtcacaagttggctgcacagggaaagttcgtgaccaccgagtttgaaccatgcttcgatgctgccgactttataagagctggaagggacattttcgcgcagagatcacaggtgaccaactaccttggcatcgagtggatgagaaggcatctcgctccagactatcgcgtgcacatcattagctttaaggatcccaatccaatgcatatagacgctacgtttaacattatcgggccaggaatagtcctctcgaatcccgatcggccatgtcatcagattgatctcttcaagaaagccggatggaccatcataacgcctcccactcctatcatccctgacgaccaccccttgtggatgtcctccaagtggctttccatgaacgttctcatgctggatgagaaacgagttatggtcgatgccaatgaagtgcccatccagaagatgtttgaaaagctcggcatgtataataagtag

SEQ ID NO: 189579 - DNA, 1260 bp, Artificial Sequence
  Description of Artificial Sequence: Synthetic coding sequence
atgtggcccggcaacgcctggcgggccgccctgttctgggtgccccggggtcggcgagcacagtctgctctggcacaattaagggggatcctagagggcgaacttgaaggcatccggggagctgggacctggaaatccgagagagtgataaccagtcgacaagggccccatatcagagtcgacggagtgtccggcggaattctcaatttctgtgccaacaactaccttggcctctcttcacatccagaggtgatccaggctggcctccaggcattggaggagttcggtgccggtctgagctctgtgcggtttatttgtggcacccagtccattcataaaaacctggaggcgaagattgcacggttccaccagagggaagatgcgatactgtatcctagctgctacgatgcaaatgctggactgtttgaagccctgttaacacccgaagatgcggtactgtccgacgagctcaaccacgccagcatcatcgatggaattaggctatgcaaggcccacaaatatcggtatcgtcacctggacatggccgacctggaagctaagctccaggaggctcagaagcataggctgcgcctagtggccaccgacggagcattcagtatggacggggatatcgcccccctccaagagatctgttgcctggcttcgcgttatggggccttagttttcatggatgaatgtcacgccacagggttcttgggccctacaggcaggggtacagacgaactgttaggtgtcatggatcaagtaactatcattaattctactcttgggaaggccctgggaggagctagtggaggatataccacagggcctggccctcttgttagccttctgcggcaaagggcccgtccttaccttttcagtaactccctgcccccagcggtcgttggctgtgccagcaaagctctggatctgctgatgggttcaaacactatcgttcagagtatggccgctaagacgcaacggttccggtcaaaaatggaggccgcggggttcaccatttctggagcctcacatccaatctgccccgtgatgttaggcgacgccagactggcatctaggatggcagatgatatgcttaagaggggcattttcgtgattggtttttcttatcccgtggtgccgaagggcaaggcccggatccgcgtgcaaatctcagctgtgcatagcgaagaggacatcgaccggtgtgtcgaggcttttgttgaggtagggagactccatggagcactgccatag

SEQ ID NO: 189580 - DNA, 1338 bp, Artificial Sequence
  Description of Artificial Sequence: Synthetic coding sequence
atgtggcccggcaacgcctggcgggccgccctgttctgggtgccccgcgggcggagggcccagtccgccctggctcagttgcgcggaatccttgagggtgagctagagggaatccggggagcaggcacgtggaagagtgaacgtgtcattacgagcagacagggcccacatataagagtggacggcgtaagcggtggacccggaaccgttatattcccaggcctcccgttgccccatctcagctgctgcattcacctgctctctttcaccagcggtatccttaacttctgtgccaacaattatctgggactctcgtcgcatcccgaagtgattcaggcaggtctccaagccttagaggagtttggagctgggctgagttctgtccgtttcatctgcggcacacaatccatccacaaaaacttggaggcgaagatcgctcggttccatcagcgtgaagacgccatactttatccctcatgctatgatgccaacgcagggctctttgaggctctcttaacccctgaagatgctgttttgtccgacgagttgaatcatgcaagtattattgacggaatccggttgtgcaaggcccataaatatcgttatcgccatctggacatggccgacttggaggccaaactgcaggaggcgcaaaagcatcgactcaggcttgtggctacagatggggctttttccatggatggcgacattgcccctcttcaagaaatctgttgtctggcttctcgctacggcgccctggtctttatggatgaatgtcacgccactggatttctgggtcccactggtcgaggtaccgacgagctgcttggcgtaatggaccaggtcaccattattaattctacactgggcaaggccttgggaggtgcttcaggcggatacaccactgggccgggccctctcgtgtctttgctgcgccagcgagcgagaccctatctattctccaactcactgcctccagcagttgtcggctgtgcctctaaggccctggacttactgatgggatcgaacacaattgtccagtcaatggctgccaagacgcaacggttccgctccaaaatggaggcagctgggtttacgatctctggagcatctcaccccatctgtcctgtcatgctaggcgatgctcggctggcctctagaatggctgacgacatgctgaaacgtgggattttcgtgattggtttcagttatcccgtggtgcctaaaggaaaggctcgcattcgagttcaaatttccgccgtgcactcagaagaagatattgatcggtgcgtggaggcctttgtggaagtaggacgtctgcacggggccctcccctag

SEQ ID NO: 189581 - DNA, 744 bp, Artificial Sequence
  Description of Artificial Sequence: Synthetic coding sequence
atgtggcccggcaacgcctggcgggccgccctgttctgggtgccccgaggccgacgggcacagagcgcactggcccagctgagaggaatcctagaaggagaactggagggaataagaggtgcggggacttggaaatccgagcgcgtcattaccagtcgacaggggccacacatcagagtcgatggcgtctctggtggccctgggacagtcatattcccggggcttccactgccccacctttcttgctgtatacaccttttgtcttttacttctggcatcctgaatttttgtgcaaacaactacctggggctgtcgagtcacccagaagtgatccaggccggactacaagctctagaagaatttggagctggattatcctctgtgcgcttcatatgcggtactcagtcaattcataaaaatttggaagcgaagatcgctaggttccaccaacgtgaggatgctatcctgtacccatcatgctatgatgccaatgcagggttgtttgaggcgctgctgactcccgaggacgcagtgttgtcagacgagctcaaccatgcctctatcattgacggtatcagactatgcaaagcgcacaagtacagatacagacacctcgacatggccgatctcgaggccaaactgcaggaagcccaaaagcatcgattacgactggtcgccactgacggcgccttccacggttggcgccacagaacccctgccggcgaccttctgcccaggttatag

SEQ ID NO: 189582 - DNA, 522 bp, Artificial Sequence
  Description of Artificial Sequence: Synthetic coding sequence
atggccctgcgggtggtgcggagcgtgcgggccctgctgtgcaccctgagggccgtgcccagtcccgccgctccatgtccacccaggccatggcagctaggagtcggggccgttcggacgctcaggacgggaccagccctgcttagcgtacgcaagttcaccgagaagcacgaatgggtgacaactgagaatggcatcgggaccgtcggcattagtaattttgcccaagaagcactcggagacgtggtgtactgctctctgcctgaagtcggaaccaagctgaataagcaagacgagtttggagctttggaaagtgtgaaggcagcatccgaactgtactctcccctcagcggagaagtgacggaaatcaatgaagcgttagctgaaaaccctggactcgtgaacaaaagttgctacgaagatggctggcttattaagatgacactgagcaacccatctgagctcgacgagttaatgtcagaggaggcctatgagaaatacatcaaaagtatcgaagagtag

SEQ ID NO: 189583 - DNA, 3063 bp, Artificial Sequence
  Description of Artificial Sequence: Synthetic coding sequence
atgcagagctgcgcccgggcctggggcctgcggctgggccggggcgtcgggggtggacgaagactggcagggggatcaggcccctgctgggctcctagaagtagagacagttcctccggcggcggggatagtgcagccgcaggcgcttcgcggcttctggagcggctgcttccaagacatgatgacttcgcccggcgccatataggccccggcgataaggatcagcgagagatgctgcaaactcttggactggcttctattgacgagctcatcgagaaaactgtgccagccaatatccggcttaagagacccctgaaaatggaggaccccgtctgcgaaaacgagatcctggccactctccacgcaataagcagcaagaaccaaatttggagatcgtatattggcatgggttactacaattgttctgttccacagactatactgcgcaacttgttggagaacagtggctggatcacccaatacactccttaccagcccgaggtcagccaggggcgtctggagtcactcttgaattatcaaaccatggtgtgcgatattacagggctggacatggctaatgctagcctgctggacgaaggcacggctgccgcagaagctctccagctgtgttatcgccataacaagaggaggaagttcctggtcgatcccaggtgccatccacagactattgccgtcgtgcagacccgggcaaagtatacaggagtgttaactgaactcaaacttccatgcgaaatggacttttctgggaaagacgtatccggggtactattccagtaccccgatacggaaggaaaggtggaggatttcacagagctggtagaacgtgcacaccagagtggctctctcgcatgctgtgcgacagatctgctggccctctgcatccttcgaccccctggggaattcggcgttgacattgcactcgggtctagtcaaaggttcggtgttccacttggatacggaggacctcacgcagccttctttgccgtgcgggagtctttagtgagaatgatgcccggacggatggtcggggtgactcgtgatgccactgggaaggaagtataccgattggccctccaaactagggaacaacatatacggcgcgacaaagccacatcaaatatctgtacagcacaggccttactcgccaatatggcagccatgtttgctatatatcacggcagccatggcctcgagcacattgccaggagagtccataacgcaactctcatcctctctgagggtttgaaaagagcgggccatcagttgcagcatgatctgttctttgacactttgaagattcagtgtggctgttctgttaaggaagttttggggcgcgccgcccagagacagataaacttccggcttttcgaagacggaactttaggaatatcccttgacgagaccgtgaacgaaaaagatcttgatgatctcctgtggatatttggctgtgaaagcagcgcagagttggtcgcggagtccatgggcgaggagtgtagaggtatccctgggtccgtcttcaaaaggacatccccctttttgacgcaccaggtcttcaattcctatcacagcgagacgaatattgtacgctatatgaagaaactcgaaaacaaagatatcagccttgttcattccatgattcccctgggaagttgtacaatgaagctcaatagcagtagtgaactggcacccatcacatggaaagaatttgccaatatccatcccttcgttcccctggatcaggctcagggctaccagcagttgttccgcgagctcgagaaggatttgtgcgaattgacaggatacgaccaagtgtgtttccagccaaatagtggagcccagggcgagtacgctggcctggccacaattcgcgcctacctgaaccagaagggcgagggtcaccgaactgtatgtctcatccccaagagcgcacatgggactaatcccgctagcgcccacatggccgggatgaaaattcagccagttgaagtcgacaaatacggaaatattgatgcagttcacctgaaagccatggtggataagcacaaggagaatctcgccgctattatgataacctacccatccacaaatggcgtgtttgaagaaaatattagcgacgtgtgcgatctgattcaccagcatggcggccaagtgtacctggacggagcaaacatgaacgcccaggtgggcatttgcagaccaggcgatttcggcagcgatgtctctcatttgaatctgcacaagacattttgtattccccacggcggagggggacctggtatgggccctattggagtgaagaagcaccttgctccattcctgcctaatcatccagtgatctcactgaaaagaaacgaggatgcttgtcctgtaggtacggtctccgccgctccttgggggagcagtagcatcctgccgatttcctgggcctatattaagatgatgggaggtaagggactgaagcaagccactgagacagctattcttaacgctaattacatggccaaacgccttgaaactcactatagaatcctgttccgcggcgcacgcgggtatgtcggtcatgagttcatcctggatactaggcccttcaagaagtctgcgaacattgaggcagtggatgtggccaaacggttgcaagactacggattccatgcccccacaatgtcatggccggtcgcagggaccttgatggtggagcccacagagtccgaagacaaagccgaactggaccgattctgtgacgctatgatcagtatccgccaggaaatagcggacatagaagaaggacgtatagaccctagggttaatcccttgaagatgtcccctcacagtctcacatgcgtcacgtctagccattgggacaggccatattcccgagaagttgctgccttcccccttccgttcgtcaagccagagaacaagttctggccaacgatcgcccgcatcgacgacatatatggggaccagcacctggtctgcacatgtccccctatggaggtatacgagtcacctttttcagagcagaagagggcctctagctag

SEQ ID NO: 189584 - DNA, 888 bp, Artificial Sequence
  Description of Artificial Sequence: Synthetic coding sequence
atggtggacagcgtgtaccggacccggagcctgggcgtggccgccgaagggctccctgaccaatacgcagacggagaggccgcacgagtttggcagctgtatataggtgacacgaggagccgaacggccgagtacaaggcttggttactgggccttcttagacaacatggatgtcagcgtgtgttggatgttgcttgcggtacaggagtggattcaatcatgctggtggaagaggggttctccgttacaagcgtagacgccagtgataagatgcttaaatatgctcttaaagagcgttggaatcgacgtcacgaaccagcattcgacaaatgggtcatcgaggaggccaattggatgacactggataaggatgtgcctcaatctgctgagggcggatttgatgcagtgatctgcctggggaactcatttgctcatctgccagattgtaagggcgaccagtcagaacacaggcttgcactgaagaacatcgccagtatggtgagggcaggcggattactagtcattgaccatagaaactatgatcacatcctctccacggggtgcgcacccccagggaagaatatttattacaagtccgatctgacaaaggacgtcactacctcagtgctgatcgtgaataataaagcgcacatggtgacactggactatactgttcaggtacctggggccggacaggatgggtcccccggcctctccaaattccgtctgagctattaccctcactgccttgcctcctttacggaattactgcaagcagccttcggcgggaagtgccaacacagcgtcctgggcgattttaagccctacaaacctgggcagacgtacataccatgctactttatccacgttctcaagcggacggactag

SEQ ID NO: 189585 - DNA, 1350 bp, Artificial Sequence
  Description of Artificial Sequence: Synthetic coding sequence
atgtacagcttcaacaccctgcggctgtacctgtgggagaccatcgtgtttttcagcctggcagcctcgaaggaggcagaggccgctcggtccgcccctaaacccatgtctcccagtgatttcctggacaagctgatgggcaggacttctggttatgacgcccgaattcgcccaaatttcaagggccctccggttaatgtcagctgcaacatctttattaattctttcgggtcgatcgccgaaacaacaatggattaccgggtgaatatctttctccgccagcagtggaacgatcctcgcctggcatataacgagtatcccgatgactcgttggatctggacccttctatgctagattctatctggaagcccgacctgttttttgctaacgagaagggcgctcattttcatgagatcacaaccgacaataaactcctccgtatatcaaggaacggcaatgtactgtatagcattagaattaccttgaccctggcttgtcccatggacctgaagaactttccaatggatgtgcagacttgtattatgcaattggagtcctttggatataccatgaatgacctcatcttcgagtggcaggagcagggagcagttcaggttgcggacggcctgacacttccccagttcattctgaaggaagagaaggatcttaggtactgtacaaagcactacaatacaggtaagttcacctgcatagaggctaggtttcacttggaacggcagatggggtattatctgatccaaatgtacatcccctccttacttatcgtgatccttagctggatctcattctggatcaatatggacgctgccccagcccgcgtgggcctcggcatcaccacggtactgacaatgacaacacagtcctccggttctagggcgagtctgcctaaggttagctacgtgaaagccatagatatctggatggcagtgtgcctgctgttcgtctttagtgcactcctcgagtacgccgccgtaaacttcgtaagccgccagcacaaagagctgctgaggttcaggcggaagagacgacatcataaggaggacgaagcgggggaaggccgcttcaatttctccgcctacggaatgggccctgcatgcctccaagcaaaggatggaataagtgtcaaaggggcaaataatagcaacacaactaacccccctcctgccccgagcaaatcacccgaggaaatgcgtaagctgttcattcagcgcgccaagaagatagacaagataagtcgtatcggtttcccaatggcatttctcatattcaacatgttttactggatcatatataaaatagtccgaagggaggatgtccataaccagtag

SEQ ID NO: 189586 - DNA, 1374 bp, Artificial Sequence
  Description of Artificial Sequence: Synthetic coding sequence
atgtacagcttcaacaccctgcggctgtacctgtgggagaccatcgtcttcttcagcctggccgcctcgaaggaagctgaagccgccagaagcgcccctaaacctatgtccccatcagattttcttgataagttgatgggtcggacctccggttacgatgcacgcattaggcccaacttcaagggcccccccgttaacgtgtcttgcaatattttcatcaactccttcggctcaattgccgagacaactatggactaccgagtcaacattttcctccgtcagcaatggaacgatcctcggcttgcctacaatgaatatcccgatgacagtctggacctcgacccgtcaatgctcgacagcatttggaaacctgacctatttttcgccaacgagaagggggcccacttccatgagataactaccgataacaaactgctgcggatctccaggaatggcaacgtactctattcaattcgcatcactctgactctggcatgccccatggatctgaaaaattttcctatggacgtccagacctgtattatgcaacttgaaagcttcggatacacaatgaacgatctgatttttgaatggcaggaacagggtgcggtgcaggtagctgacgggcttaccctgcctcagtttattctcaaagaggagaaggatctgcgctattgcacgaagcactacaacaccggcaaatttacttgcatagaagcccgcttccacctcgagcgtcagatgggttattatctgatacagatgtatatcccttctctgttgatcgtgattctgagctggattagcttttggatcaacatggatgccgcacctgctagagtgggcctcggcataacaaccgttctgaccatgacgacacagtctagtggaagtcgggcgtcactgcccaaagtgagctacgttaaagccattgatatctggatggctgtatgcctcttgttcgttttctcagcattgttagaatacgccgccgtaaatttcgtttcccggcaacacaaggagctgttgcgattccggcgcaagaggaggcaccataagtcaccaatgctgaacctgttccaggaggacgaggccggggaagggcgatttaatttctctgcatatggcatgggacctgcatgtcttcaagccaaagatggtatatcagttaaaggagccaataattcaaatacgaccaatcctcctcccgccccgtccaaaagtcccgaggaaatgagaaaactgttcatacagcgcgctaagaagattgacaaaatctccagaattgggttcccaatggcttttctgatttttaacatgttctactggatcatctacaagattgtgcgcagggaagatgtacacaaccagtag

SEQ ID NO: 189587 - DNA, 1101 bp, Artificial Sequence
  Description of Artificial Sequence: Synthetic coding sequence
atggactaccgggtgaacatcttcctgcggcagcagtggaacgaccctcgactggcctataatgaatacccagacgacagcctggacttggacccctccatgttggatagcatttggaagccagacctgtttttcgctaatgaaaagggagcccacttccacgagatcactactgacaataaactgctgaggataagccgaaacgggaacgtgctatactcaatccggatcaccttaacgctggcctgcccgatggacctcaagaattttcccatggatgtgcagacctgtattatgcagttagagagttttggatatacgatgaatgatttaatttttgagtggcaggagcagggagcggttcaggtcgcagatggcctgactctcccccagttcatccttaaagaggagaaggacctccgatactgcacaaaacattataacactggcaaattcacttgcatagaagccagatttcacttggagaggcagatggggtattatttaatacagatgtacatccctagtctgctcatcgttatactgagctggatctccttctggattaacatggacgcagcccccgcacgcgtgggcctggggattacaacagtactaacgatgacgacccagtcgagtggctctagggccagcttacctaaagtctcatatgttaaggccatcgacatatggatggcggtttgcctgcttttcgtgttcagtgccttgctcgagtacgccgctgtcaattttgtatcccggcagcacaaagaactgcttcgtttccgcagaaaacggcgccatcataaagaggatgaggctggggaggggcggttcaatttttctgcatacgggatgggacctgcttgtcttcaggccaaggacggcatctctgtcaaaggtgccaacaattctaatactactaatcctcctccagccccctccaaatctcccgaggagatgcggaagctcttcatccagcgtgccaaaaaaatagacaagatttcccggattggcttccctatggcctttctgatcttcaatatgttttactggattatctacaaaattgtgcgaagggaggacgtccacaatcaatag

SEQ ID NO: 189588 - DNA, 309 bp, Artificial Sequence
  Description of Artificial Sequence: Synthetic coding sequence
atgagcgcccgggtgcggagccggagccggggccggggcgacggccaagaagctccagacgtcgtcgccttcgtggccccaggggagtctcagcaagaagagcccccgaccgacaatcaggatattgagcccggccaagagagagaaggcactcctcccatcgaggagcggaaggtagagggcgattgtcaggaaatggatttggaaaaaactcgttcggaaaggggggacggaagcgacgtcaaagaaaagaccccaccgaacccaaaacacgcaaagacaaaggaagctggagacggccagccgtag

SEQ ID NO: 189589 - DNA, 1359 bp, Artificial Sequence
  Description of Artificial Sequence: Synthetic coding sequence
atgaaccggcagctggtgaacatcctgaccgccctgttcgccttctttttggaaacaaatcactttagaaccgctttttgtaaggaccacgatagccgcagcggaaagcaacccagccaaacgttatcgccaagcgactttctcgacaaactgatggggcgcacctccggatacgatgcccggatcaggccaaatttcaagggcccccctgtgaatgtgacttgtaatatcttcatcaacagcttcgggtccatagctgagacaacgatggattacagggtgaacatttttcttaggcagcagtggaacgacagtaggctagcctattccgagtaccccgacgacagcctcgatctggatccgtctatgttggatagcatttggaaacccgacttattcttcgccaatgagaagggcgccaatttccatgatgtgaccacggacaacaagcttcttcgcatttccaagaatggcaaggtcctgtacagtattcgtttgaccctgacactgtcctgccccatggatctaaagaactttcctatggatgtccagacttgtacaatgcagctggagtcttttgggtatactatgaacgatttgatctttgaatggctgtctgatggcccagttcaggtggccgagggactgacactgccccagttcatcttaaaggaagagaaagaattaggctattgcactaaacactacaatacgggtaagtttacatgcattgaggttaagtttcatttagagagacagatgggatattacctgatacagatgtatattccaagcttactgatcgttattctcagttgggtctctttttggataaacatggacgctgcccctgcacgagtggcactgggcatcacgactgttcttaccatgaccacgcagagttcaggctcacgcgcttcgttgcccaaggtctcatacgtgaaagctattgacatctggatggcagtgtgcctgctgtttgtgtttgcagccctattagaatatgccgccgtcaatttcgtgtctaggcagcacaaagagtttttgagattgcggcgaaggcagaagcgccagaacaaagaggaggatgtcacccgcgagtctcgattcaatttctccggatacggaatggggcactgcctgcaggtgaaggatggcacggcagtgaaagccactccggccaaccctctgccccagcccccgaaagatggcgacgctatcaagaaaaagttcgtggacagagcaaagaggatcgacacaatctcccgagcagcttttcccttggctttcctcatctttaacatcttttattggataacatacaagataattcggcacgaagacgtccataagaaatag

SEQ ID NO: 189590 - DNA, 648 bp, Artificial Sequence
  Description of Artificial Sequence: Synthetic coding sequence
atgaacctgcacatgcggatgaccgccttctgcaaggaccacgactcccgctccggcaaacagcctagccagacactctcgccaagcgattttttagacaagctaatgggaaggacctctgggtatgacgcccggattaggcctaatttcaagggaccacccgtcaacgtcacatgcaacatcttcattaattcttttggaagtgttaccgagaccaccatggactatcgtgtgaacatcttcctgcgccagcaatggaacgactccagactcgcttactctgagtatcctgatgatagcctggatcttgacccgagtatgttagattccatatggaagcccgatcttttctttgccaacgagaaaggtgccaactttcatgacgttacaaccgacaataagctcctgaggatcagtaaaaatggaaaggtcctgtacagtatccgcttaacgctgaccctgagttgccccatggatctgaagaattttcccatggatgtccagacctgtaccatgcaactggaatctttcgggtatacgatgaatgatctgatctttgagtggttgtccgacggaccggtacaggtggccgaaggcctgacccttccacagtttattctcaaggaagagaaggagctcggctattag

SEQ ID NO: 189591 - DNA, 1092 bp, Artificial Sequence
  Description of Artificial Sequence: Synthetic coding sequence
atggactaccgggtgaacatcttcctgcggcagcagtggaacgactccaggctggcatattctgaatacccagatgatagcctcgatttagacccctcaatgctagatagtatctggaaaccagatctctttttcgctaatgaaaagggtgctaactttcatgatgttacaaccgacaataagctgttaagaatctctaagaacggcaaggtcctgtatagcatcagactaactctgaccctgtcatgccctatggatctcaaaaatttccctatggatgtccagacctgtactatgcagctcgaatcatttggatataccatgaacgacctgatctttgaatggctaagcgatggaccagttcaggttgccgagggccttacgctgccgcagtttattctgaaagaggaaaaagaacttgggtactgtaccaagcattacaacacgggcaaatttacctgtatcgaggttaagtttcacctcgaacggcagatgggctactacctcattcagatgtatattccaagtctgctgatcgtgattctgtcgtgggtgagcttttggattaacatggacgcggccccagctagggtggcgctgggcatcactacagtgcttacaatgacaacccagagcagcggctctcgcgcctctttacccaaggtctcttatgtgaaagcaatagacatttggatggcggtgtgtctgctctttgtattcgccgctttgctcgaatacgctgccgtgaatttcgtttccagacagcataaggagtttcttcgcctgcgccgccggcagaaacgtcaaaataaagaggaggacgtgacgcgggaatcgaggttcaatttctcagggtatggaatgggtcattgcttgcaggtgaaggacggcaccgcagtgaaggccacgcctgccaatcctctgccccagcccccaaaggacggggatgcgattaaaaagaagtttgttgaccgggccaaaagaattgatacaataagcagggcggcatttccactggcatttctgatcttcaacattttttactggataacctacaagattatcaggcatgaagacgtccataaaaaatag

SEQ ID NO: 189592 - DNA, 1395 bp, Artificial Sequence
  Description of Artificial Sequence: Synthetic coding sequence
atggcccacgtgcggcacttccggaccctggtgagcggcttctacttttgggaagccgccctcctgctctctctggtggcaaccaaagaaaccgactctgcaagaagccgatcagcccctatgtcacctagcgactttctggacaagctaatgggccgcaccagcgggtatgacgctaggatcaggccaaactttaaggggcctcctgtcaacgtgacttgcaacatcttcatcaactcttttggctccatcgctgagactactatggactatcgggtgaatatttttctccggcaaaaatggaacgatcccaggctggcatatagcgagtatcctgacgacagtctggacttggatccatctatgctggattccatctggaaacccgatctgttttttgctaatgaaaaaggggccaacttccacgaggtgactacggacaataaattgctacgaatttttaaaaatggcaacgtgctctatagtatccgcctgaccctgaccctgtcctgccccatggatctgaagaactttccaatggatgtccagacgtgcattatgcagttagaaagcttcgggtatacaatgaacgatttgatcttcgaatggcaagatgaagctccggtgcaagtggctgagggacttacactgccacaatttctgctgaaggaggagaaggatctgaggtactgtactaagcattataatacagggaaatttacctgcatcgaggttcggttccacctggagaggcagatggggtactacctgatccagatgtacatcccaagtctgttgattgttattctttcttgggtctccttctggataaacatggacgccgcccctgcccgagtggctcttggcattaccaccgtgctgacaatgaccacgcagtccagcgggtctagggcaagtctccccaaggtgagctacgtcaaggctatagatatttggatggctgtctgtttactctttgtcttctcagcactgctggagtacgcagccgtaaatttcgtctcgagacagcataaagaacttctgcgattccgccgtaagcgcaaaaacaaaactgaagcttttgcgctggagaaattctatagatttagtgacatggatgatgaggtcagagagagccgattcagttttactgcttacgggatgggcccatgcctccaggctaaggatggcatgaccccgaaaggccctaaccaccccgtgcaggtaatgccaaaatccccagatgagatgagaaaggtgtttattgatagggcaaagaagatagacactatctccagagcctgttttccactggccttcctgatatttaacatattctattgggtgatctacaagatcctgagacacgaagatatacaccagcaacaggactag

SEQ ID NO: 189593 - DNA, 1350 bp, Artificial Sequence
  Description of Artificial Sequence: Synthetic coding sequence
atggcccacgtgcggcacttccggaccctggtgagcggcttctacttttgggaagcagcgctgctgttatcactcgtggcaaccaaggaaaccgactccgcacggagtcgcagcgcccccatgtccccctccgatttccttgataaattaatggggcgcacttctgggtatgacgctcggattaggcccaattttaaagggccccctgttaacgtaacttgcaacatatttattaatagcttcggctcaatcgccgagacaacaatggactaccgggtcaacatcttcctgaggcagaagtggaatgaccccaggctcgcatatagtgaatatccagacgactcattggatctcgatcctagtatgctggattccatatggaaacccgacctgttcttcgccaacgagaaaggcgctaacttccacgaggttacaacagataataaattgctcaggatattcaagaacggaaatgtgctgtacagtatcagacttaccctgacgcttagttgccccatggacctgaagaacttccccatggacgtgcagacttgtattatgcagctggaatcttttggctatactatgaacgacttgatcttcgagtggcaggacgaagctcccgtgcaggtcgccgaaggcctgacgttgccgcagtttctgcttaaggaagaaaaagacctgcgttattgtactaagcactataacacaggaaagttcacatgcatcgaggtgcgttttcatctggaacgccagatggggtactatctgatccaaatgtatatcccttccctactgatcgtaatcctgagttgggtgtccttctggattaacatggacgctgccccggccagagtcgccctcggcatcacgactgtgctcactatgactactcagtcctccggatctagggcaagcctccccaaggtcagttatgtaaaggctatagatatatggatggcagtttgcctgctgttcgtgttttcagctctgctcgaatatgccgcagtgaacttcgtgtctcggcagcacaaagagctgttaagatttcggcgtaaaagaaagaacaaagatgacgaagtccgggaaagcaggttcagctttacggcttacggcatgggcccttgcttacaagccaaagatggcatgacccccaaaggccccaatcaccctgtgcaagttatgcctaagtcccccgacgaaatgcggaaggttttcatagatagggcaaagaagatcgacacaattagccgcgcttgtttccctctcgcctttttaattttcaatatattttattgggtcatctataagattctgagacatgaggacattcaccagcagcaggattag

SEQ ID NO: 189594 - DNA, 1494 bp, Artificial Sequence
  Description of Artificial Sequence: Synthetic coding sequence
atgaagttcctgctgaccaccgccttcctgatcctgatcagcctgtgggtggaggaagcatactcaaaagaaaaatctagtaagaaaggcaaggggaagaaaaaacaatatctttgtccctcccagcagtccgctgaggatctagcccgtgtgccggcaaactccacctctaatatattgaaccgcctgcttgtgagctatgaccccagaataagacccaacttcaaaggcattcctgtagatgtcgttgttaatatcttcataaattcatttggaagcatacaggaaaccacaatggactatagggtcaatatttttttgcgtcagaagtggaatgaccctcggctgaaattgccatcagacttccggggtagcgatgcccttacagtggaccccaccatgtacaaatgtctgtggaaacctgacctgtttttcgccaatgagaaaagtgctaacttccatgacgtgacacaagagaacatactcctgtttatatttagggacggggacgtgcttgtttctatgcggctcagcataaccctgtcctgtcccttagatcttaccctgtttccaatggatacccagagatgcaagatgcagctggagtcttttggatatacgactgacgatctccgttttatttggcagtccggagaccctgtgcaactcgaaaagatcgctttgcctcagttcgatatcaaaaaggaagacatcgagtatggaaactgtactaagtactataagggaacagggtactacacatgcgtggaagttatcttcaccctccgccgacaggtcgggttctatatgatgggcgtttatgccccaactctgctgatagtggtcctgtcctggctgtctttctggatcaatcctgatgccagcgccgcaagagttcccctcggcatcttctccgtgctatctctggcgtcagaatgtacaaccttggctgctgagttgcctaaagtctcctatgtgaaggcgcttgatgtatggctcattgcgtgtcttctgtttggatttgccagtttggtagagtatgccgtcgttcaggtgatgttgaataatcccaagagagtcgaggccgagaaagccaggatcgctaaggcagagcaagcggatgggaaggggggcaacgttgcgaagaagaacaccgtgaacgggactggtacccccgttcacatttccactttacaagtaggcgaaactcgttgcaagaaggtatgtactagtaagtcagatttaaggtctaacgatttttccatcgtgggttcactccccagagactttgaattgtcaaattatgactgctacggcaagcctatcgaggtgaataatgggctgggcaagtcccaggcaaagaataataaaaagccacctcccgcgaaacctgttatcccgacagccgcaaagcgtatagacctgtatgcacgggcattatttcctttttgctttttgtttttcaacgtaatttattggtctatctacctgtag

SEQ ID NO: 189595 - DNA, 1494 bp, Artificial Sequence
  Description of Artificial Sequence: Synthetic coding sequence
atgaagttcctgctgaccaccgccttcctgatcctgatcagcctgtgggtggaagaggcttattctaaagagaaatcgagtaagaaggggaaaggcaagaaaaagcaatatctgtgtccctcacagcaatccgctgaagacctagctcgcgttccggccaattccacatctaatatcctgaacaggctgctcgtctcttatgacccgagaataagacccaattttaaagggattcccgtcgacgttgtagtgaacatctttatcaatagcttcggctctatccaggagaccacaatggactatagggtaaatatattcctgagacagaagtggaacgatccacgcctcaaactgccttctgattttcgcggcagtgacgcactcactgtggacccaaccatgtacaagtgcctatggaagcccgacctgttctttgctaatgagaaatctgccaatttccacgatgtgacccaggagaacatactgttgttcattttccgagatggtgatgtacttgtctcaatgcgcctttcaatcaccctttcctgccctctggaccttacactattcccaatggacactcagcgctgcaagatgcagcttgagagtttcggatacactaccgacgaccttaggttcatatggcaaagcggggatcctgtgcagctcgagaagatcgccctcccgcagttcgacataaaaaaggaggatatcgagtatggcaactgcacaaagtactacaaggggactggctattacacgtgtgtagaggtgattttcacacttagacgccaggtgggcttctatatgatgggtgtgtatgctccgaccctgcttatcgtggtgttgagttggctgagtttttggatcaacccggatgctagtgcggcacgagttccactggggatcttctcggttctgtctttggcaagtgaatgcactaccctcgcggctgaacttccaaaggtgtcatacgtgaaggccctcgacgtgtggctaatcgcgtgcctactttttggattcgcatccctggtggaatatgctgttgttcaggtgatgctgaacaatccaaagagggtcgaggccgagaaggctcggatagctaaggctgagcaagcggatggtaagggaggcaacgtggctaaaaagaataccgtgaacggcacgggaactccggtccacatttccactctgcaggtaggcgaaacacggtgtaaaaaggtgtgcacctcaaagagcgacctgagatcgaatgacttttccatcgtgggttctctaccacgcgattttgaactatcaaattacgattgttatggcaaacccatagaagtcaacaacggcctgggaaaatcacaggctaagaataataagaagccgcctcctgcaaagcccgtcattcccacagcagcgaagcgcatagacctgtacgcaagggcattgttcccattctgctttttgttctttaatgtgatctattggtcaatttatctatag

SEQ ID NO: 189596 - DNA, 912 bp, Artificial Sequence
  Description of Artificial Sequence: Synthetic coding sequence
atgaagttcctgctgaccaccgccttcctgatcctgatcagcctgtgggtggaagaagcttattctaaggagaagtctagcaaaaaaggaaaggggaaaaaaaagcagtatctctgccctagccagcaatctgccgaagacctcgctagggttcctgctaatagcacctctaatatcctcaatagacttctagtgtcctacgaccctaggatcagacccaactttaagggcattccagttgacgtggtggtgaacatattcattaactctttcggatccattcaagaaacaaccatggactaccgggtgaacatctttctgcgccagaagtggaatgatcccaggcttaagctgccctctgacttccgcggcagcgatgcactgaccgtggacccaacgatgtacaaatgtctgtggaaacctgatctgtttttcgcaaatgaaaaaagtgctaacttccatgatgtcacccaggaaaacatcctgttgttcatttttcgcgatggcgacgtgctggtcagcatgcgactatctattaccctgagttgtccgctggacctcactctgtttccgatggatacccagaggtgtaaaatgcagttagaatccttcggttatactactgatgacctccgcttcatctggcaaagcggcgatcccgtgcagctggaaaaaatagccttgccacagttcgatatcaaaaaagaagacatcgaatacggcaactgtaccaagtattataaaggcactggctactatacatgtgtcgaagtgatcttcacgttgcggaggcaggtcgggttctatatgatgggagtctacgcaccaacactgctgattgttgtactcagctggctcagcttctggatcaatcccgacgcatccgccgcacgcgttcccctggggtggtag

SEQ ID NO: 189597 - DNA, 492 bp, Artificial Sequence
  Description of Artificial Sequence: Synthetic coding sequence
atgatgctgcccctgcagggcgcccagatgctgcagatgctggagaagagtcttcgaaagtcccttcctgcttccttgaaggtgtacggaaccgtcttccatatcaatcatggtaaccccttcaatttgaaagcagtggtggacaaatggccagacttcaacactgtggtcgtgtgcccacaggaacaagacatgaccgacgaccttgaccattatacaaacacctatcagatatactctaaagacccgcagaactgccaggagtttcttggctcccccgagcttattaattggaagcagcacttgcagatccagagttcacagccatccctgaatgaggcaattcaaaatttggcggccatcaaatctttcaaagtcaaacagacacagagaattttgtatatggctgctgagacagcaaaggaattaactccttttttgttgaaaagtaaaattctctccccgaacgggggtaaacctaaagcaatgtag

SEQ ID NO: 189598 - DNA, 891 bp, Artificial Sequence
  Description of Artificial Sequence: Synthetic coding sequence
atgatgctgcccctgcagggcgcccagatgctgcagatgctggagaagtctctgagaaagtcgttgccagcttctctcaaggtctatggtaccgtgttccatattaaccatggtaacccattcaacttgaaggccgttgttgataaatggcctgatttcaatactgtggtcgtgtgccctcaggagcaggacatgacagatgatttggatcattatacaaacacttatcagatctatagcaaggacccgcagaactgtcaggagttcctgggttctcctgagctgatcaattggaaacagcatttgcagattcagagctcacagccttccttgaacgaggccattcagaacctagcagcaattaagtcctttaaagttaagcaaactcagcgcattctatacatggcagctgaaactgctaaagaattgacgccgttcctgctgaagtctaagatcctgtcaccaaacggagggaagcctaaagctataaaccaggaaatgttcaagttgagcagcatggacgtcactcacgcacacttggtgaacaaattctggcacttcggcggcaacgaacggagccagcggttcatagagagatgcatccagacctttcctacttgctgcttgctagggccagagggcaccccagtgtgttgggacctcatggatcagaccggagaaatgaggatggccggaacgcttcctgaataccgcctgcatggcttagtcacctatgtgatctacagccacgcccagaaactgggcaaattagggtttcccgtgtattcccacgtggattacagtaatgaggctatgcagaaaatgtcttacacactgcagcacgtcccaataccgcggtcttggaaccagtggaactgcgttcccctctag

SEQ ID NO: 189599 - DNA, 891 bp, Artificial Sequence
  Description of Artificial Sequence: Synthetic coding sequence
atgatgctgcccctgcagggcgcccagatgctgcagatgctggagaaatctttgagaaaatcgctgccagcatcactaaaggtgtacggtaccgtgtttcatattaaccacgggaacccgtttaatttgaaggccgtggtcgataagtggcccgacttcaacaccgtggtagtctgccctcaggagcaagatatgactgatgacctggaccattatacgaatacttaccagatctactctaaggaccctcagaactgccaagagtttctgggatctccggaactaattaactggaaacagcacctgcagatccagtcaagccaaccatcactgaatgaggccatccaaaacctagccgccattaaatccttcaaagtgaagcagactcagaggattttgtatatggctgccgaaacagccaaggaactgacccctttccttctgaaaagcaaaatccttagccccaacggaggtaaacctaaagcgattaaccaagaaatgttcaagcttagctctatggacgtgacccacgcccatttggtcaataagttttggcatttcggcggcaatgagcggtctcagcggttcatcgaaagatgtatccagacctttcccacttgctgcctgctaggaccagagggcactcccgtctgttgggatctgatggatcagacaggcgaaatgcgaatggccggcaccctccccgaatacaggctgcacgggctggttacttatgtgatctacagccatgcccaaaagcttgggaaactgggcttcccagtctacagccacgtggattacagcaatgaagcgatgcaaaagatgtcttatacgctgcagcatgtgcccattcccaggtcttggaatcaatggaattgcgtgcccctgtag

SEQ ID NO: 189600 - DNA, 2022 bp, Artificial Sequence
  Description of Artificial Sequence: Synthetic coding sequence
atgcccctgaaccggaccctgagcatgagcagcctgcccggcctggaggactgggaggacgagtttgacttggaaaatgctgtactgttcgaggtggcctgggaggtggccaacaaggtgggtggcatctatactgtgctgcagacaaaggcgaaagtgacaggagacgaatggggggacaattactttttagtggggccctacactgaacagggcgtgaggacacaggtggagctgctggaggcaccaacacctgctttgaagcgcacactagattctatgaactccaaggggtgcaaatttctagcacagtctgaggaaaaacctcacgttgttgcacactttcacgagtggctggccggggtcgggctctgcctgtgcagagcccgccgcttaccggtggctaccattttcactacccatgctaccctcttggggcgctacctttgcgccggggctgtggacttctataataacttagaaaacttcaatgtcgacaaggaagctggcgaaagacaaatctatcacagatactgcatggaacgcgccgccgctcactgtgctcacgtattcaccacagtatctcagataactgcaattgaggcgcaacacttactgaaacgcaaacctgacatcgtcacgccaaatggcctgaacgttaaaaaattctccgccatgcacgagttccagaacttgcacgcccagtctaaggctcggattcaggaatttgtcaggggtcacttctacggccaccttgacttcaatcttgataagacactgtacttctttatcgcaggacggtacgaattttccaacaagggcgcagatgtattcttagaagcactcgcacggttgaactacctgctgagggtgaatggatcagagcagaccgtcgtggcatttttcattatgcctgcgcgcactaacaactttaacgtggaaaccctgaaaggacaagcggtccgaaagcagctatgggacacagctaataccgtcaaagaaaaattcggcagaaagttatatgagtctctgcttgtggggtctctgccggatatgaataaaatgctagataaagaagatttcaccatgatgaagagagcaattttcgccacgcaacggcagtccttcccaccagtgtgcacccataatatgctcgatgattcatcggacccgattttgactactattagacggataggactttttaacagttctgcagacagggtgaaggttatcttccaccctgaatttctgagttccacgtctcctttactccccgtggattacgaagaatttgtgcgcggctgtcacctgggcgtcttcccctcctattatgaaccctggggatatacaccagccgagtgtacagtgatgggtataccctctatctctacaaacctgtctgggtttggatgcttcatggaagaacacatcgcagatccttccgcctatggtatttatatcctggacaggcgctttcggagtctggatgattcctgttcacagcttacatctttcctgtattcattttgccagcaatcccggcgccagcgaatcattcaaagaaatagaaccgaacggctgtccgacttgctggactggaagtacctggggagatactatatgtctgctagacacatggccctgagcaaggcatttcctgagcactttacctatgaacctaatgaggctgacgcagcgcaaggttacaggtatcccagaccagcctctgtcccgccatcccccagtctgagcaggcactcatcgccccatcagagtgaggatgaggaggatcccagaaatgggcccctcgaagaagatggtgaacgatatgacgaagacgaggaagccgccaaagatcgaagaaatatccgggcccccgaatggccacgtagagcctcttgtacgtcttccacgagcggcagcaagcgcaattcagtagacaccgctacctcttcaagcctttctactccatccgaaccattatcaccaacatcgagtctgggagaagaaagaaattag

SEQ ID NO: 189601 - DNA, 2214 bp, Artificial Sequence
  Description of Artificial Sequence: Synthetic coding sequence
atgcccctgaaccggaccctgagcatgagcagcctgcccggcctggaagactgggaggacgaatttgatctagaaaatgccgttctgttcgaagtagcatgggaagtcgcaaacaaggtgggaggaatctatactgtcttacagacaaaagctaaagtaaccggcgacgaatggggagacaactacttcctggtggggccatacacagagcagggcgtgcgcacccaggttgagctgctcgaagcaccaacgccggccttaaaaagaactcttgatagcatgaattcaaagggatgcaaggtgtattttggcaggtggctgattgagggagggccgctggttgtcctgctcgatgttggagcctccgcctgggcccttgaacggtggaaaggggaactgtgggatacttgcaatatcggcgtcccatggtatgatcgcgaggcaaacgatgcggtgctgttcgggttcctgacgacctggttcttaggggagttccttgcccagagcgaagaaaagccacacgttgttgcccactttcacgaatggttggctggtgttgggctgtgtctctgcagagccaggcgacttcccgtggcaaccatcttcaccacacatgccacgctgttgggaaggtatctatgtgcgggcgctgtggacttttacaacaacttggaaaatttcaatgtggacaaagaagccggcgaacgccaaatctatcaccgatactgcatggagagagctgcagcccattgcgcgcatgtgttcaccaccgtctcacagatcacggctattgaagcccaacacctgcttaagcggaagcccgatatcgtcacaccaaacggattgaatgttaagaagttctcggctatgcatgagttccagaacctgcatgcccaatctaaggcccgaatccaggagtttgtccgaggtcacttttacggacatctggactttaatctggataagacattatattttttcatcgcgggccgttacgaattttcaaacaaaggggcagatgtgttccttgaagctcttgcacgactaaattatctgctcagagtaaacggtagtgaacagacggttgtcgcattcttcatcatgcctgctagaacgaataactttaacgtcgagacgctcaaaggacaggccgttcgcaagcagctgtgggatactgccaatacagtgaaagagaaattcggaagaaagctctacgaaagcctgctagtcgggtccctgcccgatatgaataagatgttggacaaggaggatttcacgatgatgaagagagcaatcttcgccacacagcgccagagctttccacccgtctgtactcacaacatgctggacgacagttcagaccctattctgactaccattaggagaatcggcctgtttaattcctctgcggaccgagtgaaggttatctttcatcccgagttcctgagcagtacgtccccactcttgccagtggattacgaggagttcgtgagagggtgccacctgggggtttttccttcctactacgagccatggggctacacccctgccgagtgtacggtgatggggatcccctctatcagcaccaacctgtcaggattcggatgttttatggaggaacatatagccgatccttccgcatacgggatttacatcctcgataggagattccgcagcttggatgatagctgcagtcagctcacgagctttctttactcgttttgccagcagagcagacggcaaaggattatccagcgtaacaggaccgaaaggctgagcgacctgctagattggaagtacctggggaggtactatatgagtgcccggcatatggctttgtctaaagcgttcccagagcacttcacatatgagcccaacgaggccgatgcggctcagggataccgctatccacgcccagccagcgtgcctccgagcccatccttgtcccggcatagtagcccacaccagagcgaggatgaagaagacccaagaaatgggcccctggaagaggatggtgagcgctatgacgaggacgaggaagcagcaaaggacagaagaaatatcagggcacccgagtggcctaggagagcttcatgcacttcctctacgagcggaagtaagagaaattcggtggacaccgccacatcatccagcctgtcgacgccttctgagcccttatcccctacctcctcactgggcgaggaacgaaactag

SEQ ID NO: 189602 - DNA, 708 bp, Artificial Sequence
  Description of Artificial Sequence: Synthetic coding sequence
atgaacagcacctggcggacccagtgcagcagcaagtggcccggcagatggttgacaagagtttactttggtagatggcttattgagggaggaccgctggtggtcttactcgacgttggggccagtgcctgggcgcttgaacggtggaaaggcgagttatgggacacttgcaacataggggtcccatggtacgaccgcgaagctaacgatgcagtcctgtttggttttctcaccacatggttcctcggagagttcttggctcaaagcgaggagaaaccgcatgtggtggcccatttccatgaatggctagctggtgtaggtctgtgtctgtgcagagctcgtcggttgcccgtagccaccatttttactacacatgccactctcctgggacgatacttgtgcgcaggggctgttgatttttataacaacctagagaattttaatgtggataaggaagccggggaacgccagatctaccatcgttactgcatggagcgtgctgctgcgcattgtgcgcacgtttttacgaccgtctcgcagataacagcgatcgaggctcaacacttgttgaagcgcaagcccgggatctggacctctacatggacccgcccctatacatcgctgtctccagcggctatgtcatctcccactcgagtcctcaccagctcctggagacactggctaggctctacaatctgttctgagtag

SEQ ID NO: 189603 - DNA, 1974 bp, Artificial Sequence
  Description of Artificial Sequence: Synthetic coding sequence
atgaacagcacctggcggacccagtgcagcagcaagtggcccggccggtggctgactagagtgtacttcggacgatggttgatcgagggaggccctctagtcgttctgctggatgtcggagccagcgcgtgggctttagaacggtggaaaggtgaactgtgggatacatgcaacatcggagtaccctggtacgatcgcgaggcaaatgacgccgtgctcttcggcttcctgactacctggttcctgggagagtttttggctcaatctgaagagaaaccacacgtagtggctcacttccatgaatggttggcaggcgttgggctatgtttgtgccgggcccgtcggttgccagttgctacgatctttactacacatgccacgttgctggggcgatacctctgtgccggggcagtagacttttataataatctggagaactttaacgtcgacaaagaagcaggcgagaggcaaatttatcatcggtactgtatggagagggccgctgcgcattgcgctcacgtcttcacaaccgtgtcacagattactgcaattgaggctcagcaccttctcaaaagaaagcctgatatcgtgacaccaaacggcctgaacgttaagaagttctcagctatgcacgaatttcagaacttacacgctcagtcgaaagctcggatccaggaattcgtgcgaggacacttttatggccatctagactttaacctagataaaacactgtacttcttcatcgccggcaggtacgagtttagcaataaaggagcagacgtgtttcttgaagcactggctcggctgaactacctgcttcgcgtcaatggctctgaacagacggtggtcgcattcttcattatgccagcccgcaccaataatttcaacgtcgaaactctcaaagggcaggccgtccgcaagcaactgtgggataccgctaataccgtgaaagaaaaattcggccggaagctctacgaatcccttctggtgggtagtttgcctgacatgaataagatgctcgataaggaggattttaccatgatgaaacgcgctatatttgcgacacaacgtcagtccttcccacccgtgtgcacccataacatgcttgacgactccagcgatcccatactgactactattcgccggatcgggttgttcaactccagcgccgacagagtgaaagtaattttccaccctgaattcctgtccagtaccagcccattgttgcctgtggactacgaggagtttgtccgcgggtgccacctcggtgtgttcccaagctactatgaaccttggggttatactcctgcggagtgtacggtcatgggaatcccgagcatcagcacgaatctgagtggatttggctgttttatggaggagcacatcgccgatccttccgcatatgggatttatatcctggatcgccgattccggtcgctcgatgacagctgcagtcaactaacctcttttctctatagcttctgccaacagtcacggaggcagcgtattatccagcgcaatcgcaccgaaagactgtccgatctcttggactggaaatacctaggaagatactatatgtcagctagacacatggcactgtcaaaggccttccccgaacactttacttacgagcccaatgaagcagacgctgcccagggttacaggtatcccaggcccgctagtgtacccccaagccctagcctgagtcgtcatagctctcctcatcagtccgaggatgaggaggatccacgtaacgggccgctggaagaagatggcgagcgatatgacgaggatgaggaagctgctaaggataggcgaaatattcgcgcaccggaatggccgcgaagagcctcatgcacctcctctacctctgggtctaaacgcaattcggtggatacagcgacaagctcgtcactgtctactccctctgaaccactgtctccaacatcttctttaggcgaggagagaaactag

SEQ ID NO: 189604 - DNA, 1113 bp, Artificial Sequence
  Description of Artificial Sequence: Synthetic coding sequence
atgcccgcccggaccaacaacttcaacgtggagaccctgaagggccaggccgttcggaaacaactgtgggacactgccaacacagtgaaggagaaatttggtagaaaactgtatgagagcctgttggtgggcagcctgcccgatatgaacaagatgttggataaggaggatttcaccatgatgaagcgcgctatcttcgccacgcagcgacagagctttccaccggtttgtacccacaacatgttggacgattcgagcgatccgattctgaccactataaggcggataggcctgtttaatagctcagcggatagggtcaaagtcatctttcatccagagtttctctcttccacctccccactgctgcctgtcgactacgaggagtttgtgcgcgggtgtcacctaggtgtctttccttcctattacgaaccgtgggggtacactcccgctgagtgcacggttatggggatcccgtcaatcagtaccaacctgtccgggtttgggtgctttatggaggagcatatcgcagatccctccgcatatggaatatacattttagacaggcgctttagatccctggatgatagttgtagccagctgaccagcttcctctatagcttttgtcagcagagtcggcggcagagaatcatacagcggaacagaacagagaggttaagcgatcttctagattggaagtatcttggaaggtattacatgtctgctcgtcacatggccctgtcaaaagcatttcctgaacatttcacatatgagcccaacgaggctgacgcggcccaggggtaccgttacccccgccccgccagcgtcccaccttcccccagtctttctcgacacagttctccacaccaatctgaagacgaagaggatccacggaacggacccctggaggaggacggggagcgatacgacgaagatgaggaggcggccaaggacaggcggaacatcagagctcccgagtggccccgccgggcgagctgtactagctccactagcggttccaaaaggaacagcgtagataccgccaccagctccagcttgtctacacccagcgagccactgtcccctacttcaagtctaggcgaggagagaaattag

SEQ ID NO: 189605 - DNA, 1002 bp, Artificial Sequence
  Description of Artificial Sequence: Synthetic coding sequence
atgaccgaccaggccttcgtgaccctgaccaccaacgacgcctacgccaagggagccctcgtgctgggttcgtccctgaagcagcacagaacaactcgccgactagtggtactggctacccctcaggtttctgactccatgaggaaggtactggagacggttttcgacgaggtcataatggttgacgttttagattctggagactcagcccatcttaccctcatgaagagacccgaactcggcgtgacattgaccaaacttcattgctggtctctcacacagtacagtaagtgtgtcttcatggacgccgacactctggtgctggctaatattgatgatttgtttgaccgagaagaactgtccgccgccccagatcccggctggcccgattgtttcaattcgggagtgtttgtatatcagccaagcgtagagacctacaatcagctgctccacctggcatctgagcagggctccttcgacggaggggaccagggtatcctgaacacattcttcagctcatgggccacgactgatatcagaaaacacctgccgtttatctacaatttaagtagcatttcgatatattcctatctccccgcctttaaagtcttcggcgccagtgctaaagtggtacattttctcggcagagtgaagccttggaattacacatacgacccaaagactaaatccgtgaagtccgaagcacacgacccgaacatgactcaccctgagttcctgatcctgtggtggaacatcttcactactaacgtgttgcctctgctgcaacagttcgggctggtgaaggacacttgttcttatgttaacgtcgaggacgtgtctggcgccatttctcaccttagcctgggggagattcctgcaatggcccagccgttcgtttcatctgaggagcggaaagagcgctgggaacagggccaggctgattatatgggagctgactcatttgacaacataaaaaggaagctggacacttatttgcagtag

SEQ ID NO: 189606 - DNA, 1053 bp, Artificial Sequence
  Description of Artificial Sequence: Synthetic coding sequence
atgaccgaccaggccttcgtgaccctgaccaccaacgacgcctacgccaagggggctctcgtgctgggatccagtctcaagcaacatcgcaccacaagaagacttgttgtgctggccaccccacaagtctccgacagcatgcggaaagtgctggagaccgtgtttgatgaggtaattatggtcgatgtcttggacagcggagactctgcccatctcacattgatgaagaggcccgagcttggtgtcacacttactaagctccattgttggtccctgacccaatactctaaatgcgttttcatggacgccgatacgttagtgctcgcaaacattgacgatctcttcgatagagaagaactgagcgccgctccagatcctgggtggccggattgtttcaactccggggtgtttgtgtaccagcctagcgtcgaaacttataaccagctgttacatttagcctctgagcagggctccttcgacggaggagaccagggtatccttaataccttcttcagcagttgggcgacaactgacattagaaaacacctgcccttcatatacaatctgagctcaatcagtatttactcctacttaccggcttttaaagtcttcggcgctagcgcaaaagtcgtgcatttcttgggtcgcgtgaagccatggaactatacctatgaccccaaaacaaagtcagtgaaaagtgaggctcacgacccaaacatgactcaccctgaatttctaatcctgtggtggaacatttttaccaccaacgttctcccactgctgcagcagtttggtctcgtgaaagatacctgcagctacgtaaacgtcctgtccgatctggtgtacaccctcgccttctcctgcggcttctgcaggaaagaggatgtctcaggggctatctcacatctcagcttaggcgagatcccagctatggctcagcccttcgtgagctccgaagagagaaaggaacggtgggaacagggccaggccgactacatgggagccgattccttcgataacattaaacgcaagctggacacgtacctgcagtag

SEQ ID NO: 189607 - DNA, 840 bp, Artificial Sequence
  Description of Artificial Sequence: Synthetic coding sequence
atgaccgaccaggccttcgtgaccctgaccaccaacgacgcctacgccaaaggggctctggtgctcgggtcatctcttaagcaacacagaacgacacgaagactcgtcgtgctggccacaccccaggtaagcgatagtatgagaaaagtcctggagaccgtttttgacgaagtgatcatggtggatgtgctggacagcggggacagtgcccacctcactcttatgaagcgccccgaactgggggtcacactcactaaattgcactgttggagtcttacccagtattccaaatgtgtttttatggatgctgacacactcgtgttggcaaatattgatgatttgtttgacagagaggagctgagtgcagccccagaccctgggtggccagactgtttcaactctggagtgtttgtctaccagccttctgtcgaaacttacaatcagcttctccacttagcttcagagcaggggagcttcgacggaggcgaccagggtatccttaatacctttttttccagttgggcgaccacagacattcgcaaacatcttccttttatctacaacctgagctccataagcatctacagctacttgccggctttcaaggttaaaatgtctcaggaaccataccacatatgcccactaggtcggagtcaactttggcatagcaggctgtacccccggaaaaacggacgtaacgatggtaatcgggcccgtctgatcatttgggaacaaattccactcactaccagcagaggcaacctgaccctaacatcaagtcggaatacagctttcttctgcgagcacatccacttcacctctcttgtgtctgatacttag

SEQ ID NO: 189608 - DNA, 1398 bp, Artificial Sequence
  Description of Artificial Sequence: Synthetic coding sequence
atgagcgagaccgagttccaccacggcgcccaggccggcctggagctcttaaggtcgagcaactctcctacctctgcttcccagtcagccggaatgacagtcaccgatcaggccttcgtgaccttagctactaatgacatctactgtcagggcgctttggttttaggacagagtttgcgacgtcatcgcctcacaaggaaactggtggtgctgattaccccccaagtttcctcacttttgcgagttattctgtcaaaggtgttcgatgaggttatagaggtgaacctgattgatagtgccgattacatccatctggcttttctgaagcgaccagagctgggactgactttaacaaaactccactgttggacccttactcactattccaaatgcgtgtttttggacgctgatacactggtcctctccaatgtcgatgaactgtttgacagaggcgagttttctgctgcgccagaccccggttggcccgactgcttcaatagtggcgtattcgtattccagccgagcctccacacccataagctgttacttcagcacgccatggagcacgggtcgttcgatggggctgatcagggactgcttaattctttcttccggaattggagcaccaccgacatccacaaacacctcccattcatttataatctgtctagcaatacgatgtacacgtactccccggccttcaagcagttcggtagcagcgccaaagttgttcactttctgggcagcatgaagccatggaattataagtacaatccccagtctggatccgtgctggagcagggctcagccagcagttctcagcaccaggcagccttccttcatttatggtggacagtgtatcaaaataatgtgttgcccctgtataagtcggtgcaggctggcgaagccagagccagtccgggccatacactgtgtcactccgatgttggtgggccctgtgcagacagtgccagtggcgttggggaaccttgcgagaactccacccccagcgcgggtgtgccttgcgctaactcccccctgggttctaaccagccagcccagggcttgccggagcctacacagatagttgatgagacgctgtccctgcccgagggcagacggtccgaggatatgatagcctgccccgaaacagagacacctgcagttatcacatgtgatccactgtcgcaaccctcgccgcaacctgcggacttcaccgaaaccgagaccattctggttgatctggcagtatcagtcagtcagatctcaattgaagagaaggtgaaggagctctcaccagaggaggagcgccggaagtgggaggaggggagaatcgattatatggggaaggacgcattcgcccggattcaggaaaagctcgaccgcttcctacaatag

SEQ ID NO: 189609 - DNA, 1506 bp, Artificial Sequence
  Description of Artificial Sequence: Synthetic coding sequence
atgagcgagaccgagttccaccacggcgcccaggccggcctggagctgcttcgatcctccaatagtcctacaagtgcctcccagagtgcaggcatgactgtcacagatcaagcctttgtcacacttgccacaaacgatatctactgccagggagccctcgtgctcggccagtccttgcgacgccaccgattgacacggaagctcgtggttctgatcaccccacaggtgtctagcttgctgcgggtaatcttgagcaaggtgttcgatgaggttattgaagtgaatctgatagacagcgcagattacatccacctcgcattcctaaagcggccagaactcggactcaccctcaccaagctgcactgctggacccttacgcactactctaaatgtgtctttctcgatgctgacacactagttctgtcaaacgtcgatgaactattcgatagaggcgaattctcagccgcacccgatccgggatggccagactgtttcaactccggcgtttttgtgttccagccctctcttcacacccacaagctactgctgcagcatgccatggagcatggatcattcgacggagccgaccagggccttctgaattctttttttagaaactggtctacaaccgatattcataaacacctcccgtttatttacaacctgagcagcaataccatgtatacatacagtcccgcatttaaacagttcgggtccagcgctaaggtcgtccactttctgggctccatgaaaccatggaactacaagtacaaccctcagtcggggagcgtacttgaacaaggttcagccagctcatctcagcaccaagcagcctttttgcacctttggtggacagtctatcagaacaacgtgctacctctgtacaaaagcgtgcaggccggagaggctcgcgcatccccaggacatacactgtgtcactctgacgttggggggccatgcgccgacagtgcgagtggcgtgggggagccttgcgagaatagtactcctagcgctggggtcccctgcgccaattcgccactcggcagcaaccagcctgcccagggattgccagagccaacacagatcgtcgacgagacactgtctcttccagagggcaggcggtctgaggatatgatcgcatgcccagaaaccgagactcccgccgttataacttgtgatccactttcccaaccatccccccagccggccgacttcactgaaaccgagactatacttcaaccagctaataaggtggagagcgtttccagtgaagagacatttgagccctctcaagagttaccagcggaggctctcagagaccctagtcttcaagatgctctcgaagttgatttagcagtgtccgtgagtcagattagcatcgaagaaaaagttaaggaactgtcaccggaagaggaaagaagaaagtgggaggagggcaggatcgactacatgggtaaagatgcctttgcccgcatccaagaaaagcttgacagatttcttcagtag

SEQ ID NO: 189610 - DNA, 1413 bp, Artificial Sequence
  Description of Artificial Sequence: Synthetic coding sequence
atgagcgtgaccgaccaggccttcgtgaccctggccaccaacgacatctattgccaaggcgctctggtactaggtcagtccctgcgccggcaccgactgacaaggaagttggtggtactgattacaccacaagtctcaagccttctgcgggtcatactgtctaaggtttttgatgaagtgatagaagtgaatcttatcgactcggccgattacatccatctggccttccttaaaagaccagaattagggcttactctgaccaagctgcactgctggacactgactcactattcaaaatgtgtttttctggacgctgatacattggttctgtcaaacgttgatgaattgttcgatagaggcgaattctctgccgcgccggaccccggatggcctgactgcttcaattccggggtgttcgtttttcagccttcgcttcatacacataaacttcttctgcagcatgccatggaacacggctcctttgacggcgcggatcaagggctcctcaatagtttcttccggaactggtccacgacagatatccacaagcacttaccgttcatttacaatttgtcgtcaaacacaatgtacacctactcgcccgccttcaagcagtttggttcatcggcgaaggttgtacactttctgggatccatgaagccttggaattacaaatataatccacagtctggctccgtgctggagcaaggcagcgcctctagtagccaacatcaagcagcttttttgcatctttggtggactgtgtatcagaataacgtgctcccactgtacaagtcagtgcaggccggagaggcccgcgcttcccctggccatactctctgccattctgacgtgggaggaccgtgtgccgatagtgccagcggggtaggagagccttgcgagaattcaacacccagcgcaggtgtgccttgtgctaacagccccctgggctccaatcaaccagcccagggactgcccgagccgacacagattgtcgatgaaactctaagccttcccgaaggtcgcagatccgaggatatgattgcatgccctgagactgaaactcctgcagtgatcacgtgcgacccgctgtctcagccttccccacaacccgcagattttacagagacggagaccattctgcagcctgccaacaaggtggagagtgtctcttctgaagaaaccttcgagccctcccaggaactccctgccgaagccttacgagacccctcactgcaggacgcgctggaggtggacttggcggtgtcggtatctcaaatcagcatcgaggagaaggttaaggagctgagccctgaagaggagcgacggaagtgggaggaggggcgcattgattacatggggaaggatgctttcgctcgcattcaggaaaagctggacaggtttttacagtag

SEQ ID NO: 189611 - DNA, 417 bp, Artificial Sequence
  Description of Artificial Sequence: Synthetic coding sequence
atgagcgtgaccgaccaggccttcgtgaccctggccaccaacgacatctactgccaaggcgcacttgtacttggccaaagcttgaggaggcacagacttacacgcaaattggtggtccttatcaccccacaagtcagtagcctgttgagagttatcctgtcaaaggttttcgatgaagtcattgaggtcaacttgatcgactctgcagactatattcatcttgcctttctgaaacggcctgagttaggcctgacactaacgaaactccattgctggaccctgacacactattccaaatgcgtgtttctggacgccgatactctcgtgctgagcaatgttgatgagctttttgaccgtggcgaattcagtgccgcgcctgatccaggctggcctgactgcttcaatagcggcgtgtag

SEQ ID NO: 189612 - DNA, 1293 bp, Artificial Sequence
  Description of Artificial Sequence: Synthetic coding sequence
atgagcgagaccgagttccaccacggcgcccaggccggcctggagctcctgcggtcaagcaactcaccaacttcagcatctcagtcagctggcatgaccgtgacagaccaagctttcgtgactctggctaccaacgacatttattgtcagggagcccttgtgctgggccaatccttgcgccgacaccgtctgaccagaaaactggtcgtgctcattactccacaagtttccagtctgcttagagttatcctgagcaaagtgtttgatgaagtgatcgaagtgaatttgatcgatagcgcagactatattcacctagcgttcctgaagcgcccagagttaggtttgaccctgaccaagttgcactgttggaccctgacacattatagcaagtgcgtgttcctggacgccgacacattagtcctctcaaatgtggatgaactctttgaccggggcgaattctccgctgcacctgaccctggatggccagattgcttcaactctggcgtttttgtattccagccttcgctgcacacacataaactgctactgcagcatgctatggagcacggctcttttgacggagctgatcagggcctcctcaattccttttttcggaactggtcaacgacagacatacacaagcatctgcctttcatctataatctgtcctccaacaccatgtacacttacagccccgccttcaaacagttcggttcgagcgcaaaggtcgtgcacttcttggggagcatgaagccatggaactacaaatataacccccagagtggtagcgttctggagcaaggcagcgcctctagctctcagcaccaggcggccttcctccacctctggtggaccgtctaccaaaacaacgtgctgcccctgtacaagagtgtgcaggctggcgaggctcgcgcttcccctggacatacgttgtgtcattccgacgtcggcggtccatgcgcagactctgcatccggagtgggggaaccgtgtgagaatagcaccccttccgccggggtgccctgtgcaaactctcccttgggcagtaatcagccagcgcagggattgcctgaacccacacagatcgtggacgagaccctgagcctgcccgagggcagaagaagcgaggatgtggacttggccgtatcagtatcacagatttccattgaagagaaggtcaaagagctgtctcccgaagaggagcgtagaaagtgggaagagggccgaatagactatatggggaaggacgcctttgcacggatccaggagaagctcgatagatttctacagtag

SEQ ID NO: 189613 - DNA, 354 bp, Artificial Sequence
  Description of Artificial Sequence: Synthetic coding sequence
atgtacggcaagatcatcttcgtgctgctgctgagcgacacccacaagagagacacctacgctgctaccccccgtgcccacgaggtgtcagaaatctccgtgagaaccgtttacccgcccgaggaggagacaggagaaagagttcagctggctcatcatttttcggaacccgagattactctgattatcttcggagtgatggctggagtcattgggactatcctcttgattagctacggcattcgacgactgatcaagaaaagtccctcagatgtgaaaccattacccagcccggatactgatgtgccgttatcgagcgtggagatagagaacccggaaacgtctgatcagtag

SEQ ID NO: 189614 - DNA, 453 bp, Artificial Sequence
  Description of Artificial Sequence: Synthetic coding sequence
atgtacggcaagatcatcttcgtgctgctgctgagcgagatcgtgtctatcagcgcgttgagtactacagaagtggctatgcacacttcgacatcttcttcggttaccaaaagctatatttccagtcagaccaatgatacacacaagagggatacctacgcagcaacaccacgggcgcatgaggtaagtgaaatctccgtaaggacggtgtacccacccgaggaggaaaccggggagagagttcagcttgcacaccacttctccgagcccgagattaccctgataattttcggcgttatggctggggtgataggaactatcctactgatctcttacgggattcggcgccttatcaagaaaagcccttctgacgttaaaccactgcctagtcccgataccgacgttcccctatcctcggtcgaaattgaaaatcccgaaacgtccgaccagtag

SEQ ID NO: 189615 - DNA, 189 bp, Artificial Sequence
  Description of Artificial Sequence: Synthetic coding sequence
atgtacggcaagatcatcttcgtgctgctgctgagcgagatcgtgtcaatcagtgctttatccacaacagaggtggcaatgcatactagtacatcctcttccgtcacaaaatcctacatctctagtcagaccaacggagaacgggtacagcttgcgcaccacttcagtgaaccagacttccacaattag

SEQ ID NO: 189616 - DNA, 357 bp, Artificial Sequence
  Description of Artificial Sequence: Synthetic coding sequence
atgtacggcaagatcatcttcgtgctgctgctgagcgagatcgtgagcatcagcgccttaagtacaacagaggttgccatgcacacatcaacgtcatcatcagttactaaatcttacatttcctcgcagacaaacggtgaacgggtgcagctggctcaccacttttctgagccagagatcacactgataatctttggagtgatggccggcgtgatcgggaccattctgctgatcagttatgggatccgccgtttaatcaaaaaatcgccaagcgatgttaagcctctgccttcacctgacactgacgtacctctgagctctgtggagatagagaaccctgagactagtgaccagtag

SEQ ID NO: 189617 - DNA, 414 bp, Artificial Sequence
  Description of Artificial Sequence: Synthetic coding sequence
atgtacggcaagatcatcttcgtgctgctgctgagcgagatcgtgagcataagcgcgcttagtacgacagaagtcgccatgcacacttccacttcctcctcggtaaccaagtcttacatcagttctcagaccaatgacacacataaaagagacacttatgcggccacaccacgagctcatgaggttagcgagatctcagtccgtacagtataccccccagaggaggaaacagaaataaccctgattatattcggagtcatggcgggagtaattggaaccatactgctcatcagctatgggataaggcgcctgatcaaaaaaagtccctcagatgttaaacctctgccctctcccgacacagacgtaccgctgtcatctgtggagattgagaaccctgagacttctgaccaatag

SEQ ID NO: 189618 - DNA, 258 bp, Artificial Sequence
  Description of Artificial Sequence: Synthetic coding sequence
atgtacggcaagatcatcttcgtgctgctgctgagcggcgagcgggtccagctggcacaccatttttccgagccggagattacactgatcatctttggtgttatggcgggagtaatcgggaccattctgctgatctcatacggcattcgtcgactgataaagaaatcccctagtgacgttaaacctcttcctagccccgataccgacgtgcccctgtcctcagtggagattgagaaccctgaaacttccgaccaatag

SEQ ID NO: 189619 - DNA, 375 bp, Artificial Sequence
  Description of Artificial Sequence: Synthetic coding sequence
atgcacaccagcaccagcagcagcgtgaccaagagctacatcagctcacagaccaatgacacacataaaagggacacttacgcggcgactcccagagcccacgaagtgtctgagattagtgtaagaacagtgtacccccccgaagaggagacgggcgagcgggtccagttggcgcatcatttctccgagcccgaaataacattgatcatttttggggtgatggctggcgtcattgggactatcttgctgatttcttatggcatcaggcgactgatcaagaaatccccttctgacgtaaagcctcttcccagtcccgataccgacgtgcctttaagttccgtggaaatcgaaaatcccgagacctctgatcaatag

SEQ ID NO: 189620 - DNA, 276 bp, Artificial Sequence
  Description of Artificial Sequence: Synthetic coding sequence
atgtacggcaagatcatcttcgtgctgctgctgagcgagatcgtgtccatttctgctctctcaaccaccgaggtcgccatgcacacatccacctcctcctccgttaccaagtcctacattagcagtcagacgaacggcgagacaggccagttagtacatcggttcacagtaccggcgcccgtggtaatcatccttattatcctctgcgtaatggccggaatcattgggaccatcctgttgatcagctattccatccgcaggcttatcaaggcgtag

SEQ ID NO: 189621 - DNA, 276 bp, Artificial Sequence
  Description of Artificial Sequence: Synthetic coding sequence
atgtacggcaagatcatcttcgtgctgctgctgagcgagatcgtgagcatcagcgctctctccacaaccgaggttgctatgcatacatctacaagttccagtgtgacgaaatcctacataagttctcagaccaatggtgaaaccggacagctggtacaccgtttcaccgttccagcaccagtagtgatcatcctgattatcctgtgtgttatggcaggcatcattgggacgatactgttgatctcatatagcatccgacgactgatcaaagcctag

SEQ ID NO: 189622 - DNA, 177 bp, Artificial Sequence
  Description of Artificial Sequence: Synthetic coding sequence
atgtacggcaagatcatcttcgtgctgctgctgagcggcgagaccggacagcttgtgcatcggtttaccgtgccagcccccgtcgtcattatactgattatactgtgtgtaatggctggaataatcggtacaattcttctcatctcctattccatcagacggctcattaaagcctag

SEQ ID NO: 189623 - DNA, 387 bp, Artificial Sequence
  Description of Artificial Sequence: Synthetic coding sequence
atgtggagcacccggagccccaacagcaccgcctggcccctgagcctggaaccagatccgggcatggcctctgcatcgactacaatgcataccacaacaatcgctgaacctgaccccggcatgtctgggtggcccgatgggcgaatggagacctcgacaccaacaataatggatatagtcgtgattgccggggttattgctgccgttgcgatagtgctggtgtccctactctttgttatgttgcgatacatgtatcgacacaagggaacttaccatacaaacgaagcaaagggcaccgaatttgccgagtccgccgacgccgctctgcagggtgacccggcactgcaggacgcaggtgactccagtaggaaggaatatttcatttag

SEQ ID NO: 189624 - DNA, 324 bp, Artificial Sequence
  Description of Artificial Sequence: Synthetic coding sequence
atggccagcgccagcaccaccatgcacaccaccaccatcgccgagcccgatccaggcatgtctggctggcccgatggccgtatggaaacatcaacaccaaccattatggacatcgtggtgatcgccggagtaatcgccgcagttgccattgtgctggtttctcttctgtttgttatgctgagatacatgtatagacacaaggggacttaccatacaaatgaagcgaagggcaccgagttcgctgaaagcgccgacgcagcgctgcagggcgatcctgctctacaagatgccggagactcttcccgcaaagaatactttatctag

SEQ ID NO: 189625 - DNA, 330 bp, Artificial Sequence
  Description of Artificial Sequence: Synthetic coding sequence
atgtggagcacccggagccccaacagcaccgcctggcccctgagcttggagccggaccccggtatgagcggctggcctgacgggaggatggagacgagcaccccgactattatggatatcgtcgtcatcgccggcgtgattgctgccgtggccattgtgttagtgagtctgctattcgtcatgctcaggtatatgtaccgccataaggggacataccataccaatgaagccaagggcacagaatttgcggaatcagccgacgcggcactgcagggcgaccccgcgctccaggacgccggagactctagccgaaaggagtactttatctag

SEQ ID NO: 189626 - DNA, 237 bp, Artificial Sequence
  Description of Artificial Sequence: Synthetic coding sequence
atgtacggcaagatcatcttcgtgctgctgctgagcggcatcgtgtccatttctgcctcctctacaaccggagtggcaatgcatacttccacaagtagctccgtcaccaagtcctacatctcttcccagacgaatgggataacactgatcaattggtgggccatggcacgtgttatctttgaagtcatgctggtggttgtcggtatgattatactcattagttattgcatcagatag

SEQ ID NO: 189627 - DNA, 168 bp, Artificial Sequence
  Description of Artificial Sequence: Synthetic coding sequence
atgtacggcaagatcatcttcgtgctgctgctgagcggcatcgtgtccatatccgccagctcaacaacaggagtagccatgcacacatctaccagtagttcggtcaccaagtcatatatcagctcccagaccaacggggagcgggggcaactggttcaccgcttctag

SEQ ID NO: 189628 - DNA, 237 bp, Artificial Sequence
  Description of Artificial Sequence: Synthetic coding sequence
atgtacggcaagatcatcttcgtgctgctgctgagcggcatcgtgagcatatcggcctcgtcaacaacgggcgttgccatgcatactagcacctcatcaagtgtgacaaaaagctacatctcctctcagacaaatgggattacgttgattaattggtgggcgatggcaagggtaatttttgaggtcatgttagtggtagttggcatgattatcctgatctcctactgcatcaggtag

SEQ ID NO: 189629 - DNA, 180 bp, Artificial Sequence
  Description of Artificial Sequence: Synthetic coding sequence
atgtacggcaagatcatcttcgtgctgctgctgagcggcatcgtgtccattagtgcttcaagcaccactggcgttgcgatgcatacctccacaagcagttccgtcaccaaatcctacatatcctcacaaaccaacgggtgcgtgatcggtaacattatttgctcagataagtcaaagtag

SEQ ID NO: 189630 - DNA, 1605 bp, Artificial Sequence
  Description of Artificial Sequence: Synthetic coding sequence
atgccccacctgatggagcggatggtgggcagcggcctgctgtggctggctctagtgtcttgtatcctgacacaggcatccgccgttcagagagggtacgggaatccaatagaggcttctagctacgggctcgaccttgactgcggcgcgcccggcacccccgaagcacacgtctgcttcgacccgtgtcagaattacactctgctcgacgaacctttcagatcaactgagaactctgccgggtcccaggggtgcgataagaatatgtccggatggtaccgttttgtgggggagggcggtgtgaggatgagcgagacttgtgtacaggtgcacagatgtcaaacagacgctccaatgtggctaaatgggacacatcctgccctgggtgatgggattaccaaccataccgcatgcgcacattggagcgggaactgctgtttttggaagacggaggttctggtgaaagcctgtccaggggggtaccatgtgtatagactggagggcaccccatggtgcaacctgagatattgtaccgaccccagcacagtggaggacaaatgtgagaaggcttgcaggcctgaggaggaatgcctggcattaaattccacctggggttgcttctgtagacaggatttaaattcttcagatgtgcattccctgcagcctcagttggattgcggcccacgggaaatcaaggtaaaggtagacaaatgtctccttggaggcctgggtctgggcgaggaggtgatcgcctatctgagagacccaaattgctcctccatcctgcagacggaggaacgaaactgggtgagcgttacatccccagtccaggctagcgcctgccggaatattctggaacgcaatcagacccacgcgatttacaagaatacacttagcttggtgaacgacttcattatcagagatactatattgaatatcaatttccagtgcgcatacccccttgatatgaaggtgagcctacaggctgccctgcagccaattgtttcaagtctcaacgtgtcggtcgacggtaacggggaattcatcgtgcgtatggccttatttcaggaccaaaactatacaaatccttatgagggcgacgccgtggagctgagcgttgaatccgtgctatatgtgggagccatcttggaacagggcgatactagccgcttcaatctggtgttgcgaaattgctatgcaactcccaccgaagataaggctgacttggtgaaatacttcatcattaggaacagttgctccaaccagcgagactccacaatccacgtggaggagaacggacagtcctcagagagtagatttagcgttcagatgttcatgtttgccggccattatgacttagtgtttctacattgcgaaatccacctctgtgactctctgaacgaacagtgccaaccaagttgtagtcgcagccaggtaaggtctgaggtacccgccattgacctcgccagggtgttggacctaggacccattactaggcgtggcgcacagtcaccaggcgtgatgaatggcacgccgagcacagccggatttttggtggcctggccaatggtgctgctaacagttttgctggcctggttattttag

SEQ ID NO: 189631 - DNA, 1164 bp, Artificial Sequence
  Description of Artificial Sequence: Synthetic coding sequence
atgccccacctgatggagcggatggtgggcagcggcctgctgtggctggcactagttagctgcatcctcacacaggcgtctgctgtacaaagagacccctccaccgtggaggacaagtgcgaaaaggcatgccgaccagaagaagaatgtctcgcactgaacagcacctggggatgtttctgcaggcaggaccttaatagctccgatgtccatagtctccagccccagctcgactgcggacctagggaaatcaaagtgaaagtggataaatgtcttctgggtggtctgggactgggggaggaggtgatagcctacctgcgggatcccaattgtagctcgatcttgcagaccgaagagcggaattgggtgagtgtgactagccctgtgcaagcctcagcgtgccgcaatatcctcgaacgcaatcagacccacgctatctataagaacactctaagccttgtgaacgattttataattagagacaccatcctcaatatcaactttcaatgcgcctatcccctggatatgaaggtcagtctgcaggcggcactgcagcccatcgtgagtagcctcaacgtgagtgtcgacgggaacggcgagtttatcgtccgaatggccctattccaggatcagaattacaccaatccttatgaaggcgacgcggttgagttgagcgtggaaagcgtgctctacgtcggtgccatcctagagcaaggtgacactagtaggtttaaccttgtgctcaggaactgctacgccactccaacagaagataaggctgatctagtgaaatactttataatacgaaatagctgttcaaatcaacgcgattctactatccatgtcgaggaaaatggtcaaagcagcgagtccaggttcagcgtgcagatgtttatgtttgcaggccactacgacctcgtgtttctgcattgtgaaatacatctgtgcgactcactgaatgaacaatgtcagccaagctgttctcgatcacaggttcggtctgaggtccctgccatcgatttggcccgggtgctggatctcgggcccatcacaaggagaggggcccaaagccccggtgttatgaatggcacaccatccacagctggctttttagtcgcctggccaatggtgctcctaaccgtcctgcttgcgtggctcttctag

SEQ ID NO: 189632 - DNA, 1173 bp, Artificial Sequence
  Description of Artificial Sequence: Synthetic coding sequence
atgccccacctgatggagcggatggtgggcagcggcctgctgtggctggctctggtatcctgtatcctaacacaagctagcgcggtccagagggtcccccgcgatccaagtaccgtggaggataaatgcgagaaagcttgtcggcccgaggaggagtgcctggccttaaattccacctggggctgtttctgccgccaggacctcaattcaagcgacgttcacagcctgcaaccgcaactggattgcggacctagagagataaaagttaaggttgacaagtgtctcctggggggacttgggctgggtgaggaggttattgcctaccttagggaccctaactgcagttccatcctacagacggaggaacggaattgggtttccgtgacctcccccgtgcaggcatctgcctgtagaaacatcctggaacgaaatcagactcatgcaatctataaaaacacactttctctggtgaacgattttattattcgggatacaatacttaatattaacttccagtgcgcctaccccctggatatgaaggtttctttacaggctgccctgcagcctatcgtcagttcactcaatgtctccgtcgatggaaacggtgaatttattgtccgcatggccctgtttcaggaccagaactatacaaacccttatgagggcgacgccgtggagctctctgtggagtccgtcctctatgtcggcgccatactagagcagggggatacatccaggtttaacctcgtgttgagaaattgctatgccacacccactgaggataaggcagacctcgtcaagtattttattattcgcaacagttgttctaatcaacgcgattctaccattcacgtagaagagaacggacagagtagtgaatcacgtttctccgtccagatgttcatgtttgcgggccactacgatcttgtatttctgcactgcgagatccacctgtgcgacagcctaaatgaacagtgtcagccgtcatgctctcgttctcaggtcaggagcgaggtgcccgctatcgacctggcccgagtgctggacctaggaccaataacacgccggggggctcagagtcccggcgtaatgaatgggactcccagtacagcagggttcctggtggcatggccaatggtactgctcaccgtcctgttggcctggctgttttag

SEQ ID NO: 189633 - DNA, 1614 bp, Artificial Sequence
  Description of Artificial Sequence: Synthetic coding sequence
atgccccacctgatggagcggatggtgggcagcggcctgctgtggctggccctcgtgtcttgcattttaacacaggcctctgctgttcagcggggttacggaaacccgatagaagctagttcttatggcctcgacctcgactgtggcgctccaggtacgcctgaagcacacgtttgtttcgacccctgtcaaaactacaccctcctcgatgagccctttcgctcaactgaaaactccgccggttcgcagggctgcgataagaacatgtctggctggtaccggtttgttggcgaaggaggggtgagaatgtctgaaacctgtgttcaggtgcaccggtgtcaaacagatgccccaatgtggctgaatggcactcaccccgccttaggcgacggcattaccaaccacacagcctgtgcgcattggagcggaaattgttgcttctggaagaccgaggtactggttaaagcctgtcctgggggatatcatgtataccggctcgaaggaacaccatggtgcaacctgaggtattgcaccgttccgcgtgacccgtcaaccgttgaggataagtgtgaaaaggcatgtcgccccgaggaggagtgtctcgctttgaactctacctgggggtgcttttgtaggcaggatctcaattcctctgatgtgcactccctgcagccgcaactcgattgtggtcccagagagattaaagtgaaggtggacaagtgcctcttgggtggcctaggattgggtgaagaggtcattgcatatcttcgggatcctaactgttcatcaatactgcagacagaggaaagaaactgggtgtcagtgaccagcccagtgcaggctagtgcttgccgcaacatccttgagcggaatcagacccatgcgatctataaaaataccttgagcctagtgaacgattttattatccgcgacactatcctcaacattaactttcaatgtgcctaccccctggatatgaaagtatctcttcaggctgcacttcagcccatagtctcatcgctgaacgtcagtgtggacggcaacggagagttcattgtacgcatggctcttttccaagatcaaaactataccaacccatatgagggcgacgccgttgagctctctgtcgaatcagtcctgtatgttggagccattttagagcagggagatacatcccggtttaacttagtgctgagaaattgttacgcaacaccaactgaggacaaagctgatctcgtcaaatacttcatcattcgtaactcatgctcaaatcagcgggacagcactatccacgtcgaagaaaacggccagtctagcgagtctcggttcagcgtgcagatgtttatgttcgcagggcactacgatctggtattcctgcactgcgaaatacacttgtgcgactctctaaacgagcaatgccagccgtcctgctcacgatcccaagtgcgaagcgaggtccctgcaattgacctcgcaagggttctggatctgggccctattacccgccggggggctcaaagccctggggtgatgaatggcactccatccacagcagggttcttggttgcctggccaatggtgctgctcacggtgctgctcgcctggctgttttag

SEQ ID NO: 189634 - DNA, 1548 bp, Artificial Sequence
  Description of Artificial Sequence: Synthetic coding sequence
atgaagatcaagtgcgagaagagccggacccagagcagcgcccagcacgttcagcatagcgcccattcgaccatcgtttgccgcaagcactcacacaacgccgaaacagctggaagggtagatatcgtgcgtggaggccctttctttcaccaccccctccgcaagtggctcatttcaccccctctgaacaagccgagcgtatggcccagaacccctatcatccccgtacatcaactccgccgggatacctgggtaggaaattgcaataagaagacagctcactcccgtcttcactcgcatggctggcccgaggaagaacggtttgtattcagttccgagctgcacggcaagtctgcctattctaaggtgacatgtatgcctcacctcatggagcgcatggttggaagtgggctcctgtggctcgccctggtgagctgtatcctgacccaggcatctgctgttcagagggaccaccttgatcctagtactgtggaggataaatgcgaaaaggcctgtcgtcctgaagaggagtgcctggctctgaactccacatgggggtgcttttgccggcaggatctaaatagttcggacgtccattctttacaaccgcaactcgactgtgggccaagggagataaaggtgaaagtagataaatgtttgctggggggtctggggctgggcgaggaagttattgcttacctgagagacccaaattgcagttccattctccaaacggaagagaggaactgggtttcagtgactagtcctgtacaggctagtgcctgtagaaacatactggagcgcaaccaaactcacgcaatctacaaaaatacactgagcctggtgaacgattttatcatacgagacaccattctcaatattaactttcagtgcgcatacccactggacatgaaggtctccctgcaggccgccctccagcccattgtaagtagcttgaacgtttcagtcgacggtaatggggagtttatcgtgcggatggccttattccaagatcagaattatacgaatccgtacgagggtgacgctgttgaactgtccgtggagagcgtcctgtatgtgggcgcaatcctggagcagggcgacacatctcggttcaatctagtgttgcgcaactgttacgccacacctaccgaggacaaggctgacctggtgaaatacttcataattcgcaacagctgcagtaatcaaagagattcaacaattcacgtggaagaaaacggtcagtctagcgaatctcgttttagcgttcaaatgtttatgttcgctgggcactatgatcttgtcttcttacactgtgagatccacttatgcgacagcctgaatgagcagtgtcaaccctcgtgctccagatcccaggtcaggagcgaagtgccagccattgacctggcgcgagtcttggacttggggcccattacgagaagaggggcccagagccctggggtgatgaacggtactccttctaccgctgggtttctggtggcatggcctatggtgcttttgaccgttttgctggcctggcttttttag

SEQ ID NO: 189635 - DNA, 1959 bp, Artificial Sequence
  Description of Artificial Sequence: Synthetic coding sequence
atgcccctgctgctgctgctgctgctgctgcccagccccctgcacccccatccaatctgcgaagtgtctaaggtcgcatcccacctggaagtgaactgcgacaagcggaatctgacagcactgccaccagatcttcccaaagatacaaccatattgcacctgtctgaaaatttgctgtacaccttctcgctcgcaactttgatgccttacacaaggctgacacaactgaacctggatcggtgcgagctgactaagttacaggtcgacggcaccctgcctgtccttggcactctcgacctttctcacaaccagctgcagagcctaccgttgttgggccagacactgccagccctgactgtgctggatgtgagttttaatagactgacaagcctcccgctaggggccctacgcgggttaggcgagttgcaggagctgtatctgaaagggaatgaattgaagaccctgccccccggactgcttactcccactcccaagctggagaagctcagtctcgcgaataataatctcaccgagctacctgctggactcctgaatggactcgaaaatctggacaccctactgttgcaggagaactcgctgtatacaatccctaagggcttttttgggtctcatctcctaccttttgcctttctacatgggaacccctggctgtgtaactgcgaaatcctctatttccgccgctggctgcaagataatgctgagaatgtgtacgtgtggaagcaaggcgtggacgtcaaggctatgacaagtaacgtggcctcagtccagtgcgataattcagataaattcccagtgtacaagtaccccggaaaagggtgtcctactctgggcgacgagggcgacacagatttgtatgactattaccctgaggaggataccgaaggagacaaggtgcgcgccacgcgcactgtggtgaaatttcctacaaaggcccatactactccatggggactcttctattcttggtctactgcatctttagatagccagatgcccagctctttacatccaacgcaggaatcgactaaggagcagactacctttccacctcggtggacacctaacttcaccctgcacatggagagtattactttctcaaagacaccaaaatccacaactgagccaacccccagcccaaccacaagcgaacccgttcccgaaccagccccaaacatgacgacacttgagcccacccctagccccactaccccagagcctacttctgaacctgcacccagtccgaccacaccagaaccaacatcagaacctgcaccaagccctacgactcccgagccaacctctgaacctgccccaagccccacaaccccagagcccaccccaatccctactatcgcaacttcaccaacaatacttgtgagcgctacttcacttattaccccaaagtctacctttctcaccacgacaaagcctgtctctcttttggagtccactaagaagactatccccgagctcgaccagcctccgaaactgcggggagtgctccaaggccatctggaaagcagcagaaatgatccatttctgcaccccgacttctgttgcctgctgcccttggggttctacgtgctcgggctgttctggctcctgtttgctagtgttgtgttgattcttctcctaagctgggtggggcatgttaagcctcaagccctcgattctggccagggtgctgcactgaccactgctacgcagactacccacctcgagctgcagagaggcaggcaagttaccgttccacgagcgtggctgctttttctaaggggctcccttcctacgtttcgatcatccctgttcctttgggtgcggcctaatggcagagtgggtcctctggtggcaggccggagaccatctgccctctctcaagggcgcggtcaggatctgctgtctacggtgtccatacggtacagcgggcattccctttag

SEQ ID NO: 189636 - DNA, 1881 bp, Artificial Sequence
  Description of Artificial Sequence: Synthetic coding sequence
atgcccctgctgctgctgctgctgctgctgcccagccccctgcaccctcaccctatttgcgaagtgtctaaggtagccagccacttggaagtgaattgtgacaagcggaatctcaccgcactcccacctgatcttcccaaggatactactatcctccacctctctgagaaccttctatacacattctctcttgctactctcatgccatacacacgacttacccagctgaacctggatcgatgcgagctgaccaaactgcaagtcgatggtacgctgccggtcctgggtactctcgacttgtcccataaccagctgcagtcactcccactattaggccaaacactgcccgctctgacagtgcttgacgtaagctttaatcgtctgacctcactgcccctgggtgcccttagaggcttaggtgagttgcaagaactgtaccttaaaggcaacgagctgaagactctgcccccgggactcctcacacccacaccaaaattagaaaaactatcactggctaacaataacctgaccgagctgccagctggactccttaatggcttggagaatctagatacactcctgctccaggagaactccttatatactatccctaagggtttctttggatctcacctgctaccctttgctttcttgcatggtaacccatggctctgtaactgtgagattctttacttcaggagatggctgcaagacaatgctgagaacgtgtatgtgtggaagcagggagttgacgttaaagccatgacgagtaatgtcgcaagcgtgcagtgtgacaacagcgacaagttccccgtttataaatatccagggaaagggtgccctacactgggtgacgagggcgatactgacttatatgattattaccccgaagaagacactgagggggataaggtgagggccactcgcaccgttgtcaaatttccgacaaaagctcacacaaccccatggggcctgttttactcgtggtccactgccagtctggactcccagatgcctagctctctgcatcctactcaagagagcacaaaagaacagacgacctttcctcctagatggactccaaatttcaccctgcacatggagtcgatcaccttttctaagactcccaaatctacaactgaacctaccccaagcccgactacctccgagccggtgcccgagccggcccccaatatgaccacccttgaacctacaccatccccgacaactcctgagcccactagtgagcccgcaccttccccaaccaccccagagcccacacccatccctacaatcgcgaccagccctacaatcctagtcagcgctacatccctgatcactccaaaaagtacattcctcaccactactaagcctgtgagcttgctggaaagtacaaaaaagacaattcccgaactggaccagccccctaagctgcgcggcgtgttgcagggccacctcgaaagctcccggaatgaccccttcctccaccccgatttttgctgtctacttccgctgggcttttacgtactggggttgttctggcttttgttcgcatccgttgtattgattcttctactgtcttgggtcgggcatgtaaagccccaggccctcgacagcggacaaggagcggccctgacgactgcaacccagactactcatttagagctacagcgggggcggcaggtgaccgtgcctcgtgcttggcttctcttccttagaggatcattacccacctttaggagtagcctgttcctatgggtcagacccaacgggcgggtcggtccattagtggcgggcaggcgccctagcgctttgtcgcaggggcggggccaagacctgctgagtactgtgtccattcggtattccggccatagcctatag

SEQ ID NO: 189637 - DNA, 621 bp, Artificial Sequence
  Description of Artificial Sequence: Synthetic coding sequence
atgggcagcggcccccggggcgccctgagcctgctgctgctgctgttggcacccccaagccgacccgctgccgggtgccctgccccatgcagttgtgcagggaccctggtggattgtgggagaaggggcttaacctgggctagcttgcccacagcgtttccagtagacacaaccgagttagtcctaacgggcaacaatctcacagccctgccccccggtctccttgatgctctccctgcgctgagaaccgcccacctgggggccaacccctggcggtgtgattgtaggttggtccctctcagggcgtggttggctggtcggccagaacgtgccccttaccgagacctgcgctgtgtggccccacctgcccttcgtggtcgactgcttccatacctggctgaggatgagctgcgcgcagcttgcgcgcccggcccactgtgttggggggccttggccgcccaattagctctcctgggattagggttacttcatgcacttctgctggtcctgctgctgtgtaggctgcgcagactgcgggcccgcgcccgggcacgtgctgcagcaaggttgtccctcaccgacccactggtggcagaaagagcgggcactgatgagagttag

SEQ ID NO: 189638 - DNA, 1230 bp, Artificial Sequence
  Description of Artificial Sequence: Synthetic coding sequence
atgatccccagccggcacaccatgctgcggttcctgcccgtgaacgccgcctcgtgtcctggcgacagaaggacaatgcttgttaacgtggccgcgggagtacgagttctgagggtgcctttacgagccggtgggtcagggagtctgtccgggcttcgcccacctgcgatcgtgtgctatctccccctgcaacgggcctccgcctccggactattcctagccagaccgcagcattgcggtcggtgtggaagggggagagggggtgccgccctttctctcggcagtcctgcttatgcctctaggtgtagggtatccagagccgccgtttttagtccatgggcacctgtctctctcgagagcggacgagcgcccggctgcagtctggggcgcccgggtctgcggggtgccttggtggtttggctgcaactcggggaaacctgggtgaggctcaggggtgatttccagccggcctgcggggtggtcagagtcgaaaggcttgcaggctaccgggatgccggacatcaagggctggacggtgcaggccctgctgtatgggtcttgcgcgacgtggcccaggttcccgcagacaggagcgcatattgcggggctagtctggccggtccaagaggggccctttctctgttgctgttacttctggctcccccctccaggcccgcagccggctgcccagcaccttgctcatgtgccggcaccctcgtggactgcgggcgacggggtttaacctgggcctccctacctactgcctttcccgtagacacaacagagctggtcctcacagggaacaatcttacagcgttgcctccaggtttactggatgcgttgccggctctgagaaccgcccatctaggggccaatccttggcgctgcgactgtcgcttagtgcctctgcgggcatggcttgccggccgccccgagagagctccataccgcgacctaagatgtgtcgccccccctgctctacgcggaaggttgctgccctatttagcagaggacgagctgagggccgcctgcgcacccggtccactgtgttggggggccctcgccgcccagctagctctgctcggacttggcctgctgcatgcgctgctgcttgtcctcctgctgtgtagactgaggagactgagggcccgggcccgggccagggctgccgcccgactgtcgttgactgaccccctcgttgccgagcgcgctggtaccgatgagtcgtag

SEQ ID NO: 189639 - DNA, 534 bp, Artificial Sequence
  Description of Artificial Sequence: Synthetic coding sequence
atgcccgcctggggcgccctgttcctgctgtgggccaccgccgaggccaccaaggattgtccaagcccctgcacctgtcgagctctggaaaccatggggctctgggtagattgcaggggtcatggactgaccgcccttccggccctgcccgcgagaaccaggcacctgctgctggctaataattccctgcagagcgtgccgcctggggcctttgaccatctgcctcagctgcagaccctcgatgtcactcaaaacccctggcactgtgattgctccctgacttatctccgcctctggctcgaggaccgaacccccgaggccctactgcaagtccggtgcgcgtccccgagcctggcggcacatggaccattggggaggttaaccgggtatcagctgggctcctgtggctggcagctccaggcctcctgggtgcggccaggcgtcctatgggatgtggcactcgtggccgtagccgcccttgggctcgccctgttggccggcctcctgtgtgccactactgaggctcttgattag

SEQ ID NO: 189640 - DNA, 987 bp, Artificial Sequence
  Description of Artificial Sequence: Synthetic coding sequence
atgaagcccgccatggagaccgccgccgaggagaacaccgagcagagtcaggaaagaaaagtaaactcccgggcagaaatggagatagggcgttaccactggatgtatcctggctctaaaaaccaccagtatcacccagtccctacactcggcgatagagcgagtccactaagttccccaggctgctttgaatgctgcatcaagtgccttggaggagttccctacgccagtctagtggcgacgatactgtgtttcagtggcgttgcgctcttctgcggctgtggccacgtggcattagccggaaccgttgcaatcctggagcagcatttcagcaccaacgccagcgatcatgcattgctctcggaagttatacagctgatgcaatacgtgatctatgggatcgcaagcttcttctttctctatggaattattctgcttgctgaagggttctatactactagcgcagtcaaggagctgcacggggagtttaaaaccaccgcttgcgggaggtgcatatctggaatgtttgtgtttcttacatatgtactcggcgtggcatggctcggtgtcttcgggtttagtgccgtccccgtctttatgttctataacatctggagtacttgtgaagtgattaaaagccctcagaccaatggaaccacaggagtcgagcaaatttgcgtcgacatcaggcagtacgggatcattccatggaatgcctttcctggcaaaatctgcgggtccgctctcgaaaatatctgcaatacgaatgaattctatatgtcctaccacctgttcatcgttgcatgtgctggggctggcgcaactgtgatcgctctaatccacttcctcatgatcctgtcttcaaattgggcctatctgaaggacgcttccaaaatgcaagcttatcaggacattaaagccaaggaagaacaggaactgcaggacatccagagtagaagcaaggaacaactgaatagttatacatag

SEQ ID NO: 189641 - DNA, 918 bp, Artificial Sequence
  Description of Artificial Sequence: Synthetic coding sequence
atgaagcccgccatggagaccgccgccgaggagaacaccgagcagagtcaggaacggaaggttaattctcgtgctgagatggagataggtaggtatcactggatgtatccaggcagcaaaaatcatcagtaccacccggtgcccaccctcggcgacagggccagcccactatcaagtccaggatgtttcgagtgttgcatcaagtgtttgggaggagtcccgtacgctagcctggtggcaacgatcttgtgcttctccggagtcgcacttttttgtggatgcggccacgttgcccttgcaggcacagtagcaatactcgagcagcatttttccaccaatgcatcagatcatgctctattgagcgaggtgatccagctaatgcagtacgtcatttacgggatcgctagtttcttcttcctgtatggaataattctgttagctgaaggattctatacgacaagcgcagttaaagaattacatggtgaattcaaaacgactgcttgcggtagatgcatctccggcatgttcgtattcctgacttacgtgctaggcgtggcatggctgggtgtgttcgggtttagtgctgtgccagtgtttatgttttataatatttggagcacgtgcgaagtgataaaaagcccacaaaccaatgggacaaccggggtggagcaaatctgcgttgacataagacagtatggcataattccatggaatgcctttcctggcaagatatgtggaagcgcccttgagaacatctgcaacaccaacgaattctacatgtcttatcacctcttcattgtggcctgcgcaggtgcgggcgcaactgtgatcgcccttttgatctacatgatggccactacctataattacgcagttctcaaattcaagtctcgagaagattgctgcaccaagttctag

SEQ ID NO: 189642 - DNA, 798 bp, Artificial Sequence
  Description of Artificial Sequence: Synthetic coding sequence
atgaagcccgccatggagaccgccgccgaggagaacaccgagcagagccaggagcgtaaaggatgtttcgagtgttgtattaaatgtctggggggggtgccttacgcttccctcgtggcaactattctgtgcttctctggagtggcgcttttctgcgggtgcggccatgttgccttggctggcacggtagccatccttgaacagcacttttctaccaacgcatcagatcacgctttgctctcagaagtgatacagctaatgcagtacgttatctatgggattgcctccttcttttttctgtacggtattatccttctcgcagaggggttttatactacttccgcagtgaaagaattgcacggagaatttaaaactacagcctgcggtcgatgcatcagtggaatgtttgtctttctgacgtacgtgctcggggttgcttggctgggtgtgtttggctttagtgctgtgccggtgttcatgttctacaacatctggtcaacctgtgaggtcattaaatcaccacaaacaaatggcaccaccggtgtggaacagatctgtgtcgatattagacagtacggaatcattccctggaacgccttccctggtaaaatctgcggctctgccctggagaatatatgcaacaccaatgagttttacatgagttatcacctgttcattgtggcttgtgcaggagccggagctacagtgatagcattgctgatttatatgatggctactacgtacaattatgcggttcttaaattcaaatcccgggaggactgctgcactaaattctag

SEQ ID NO: 189643 - DNA, 540 bp, Artificial Sequence
  Description of Artificial Sequence: Synthetic coding sequence
atgcagtacgtgatctacggcatcgccagcttcttcttcctgtacggtatcatcctgcttgccgagggcttttacacaacctccgccgtgaaggagttgcatggcgagtttaagaccacagcgtgtggccgttgtataagcggtatgtttgtgtttctgacctatgtcctgggcgtggcctggctgggtgtgttcggctttagtgccgtgccagtgtttatgttttacaacatatggagcacctgtgaggtgataaagagtccacagacaaatggaactactggagttgaacaaatatgtgtggacataaggcagtacggcataataccctggaatgcttttccaggaaaaatctgcggctcagccttggaaaatatctgtaatacaaatgaattttatatgtcttatcatctcttcattgtggcctgtgccggggcaggggcaacagtgattgccctcctcatatatatgatggcaacaacatacaattatgcggtgctgaagttcaagtcccgcgaagactgttgcacgaaattttag

SEQ ID NO: 189644 - DNA, 741 bp, Artificial Sequence
  Description of Artificial Sequence: Synthetic coding sequence
atgggctgcttcgagtgctgcatcaagtgcctgggcggcgtgccctatgcctcacttgttgccaccatcctatgtttctccggggtggccttattctgtgggtgcggacatgtggccttggcagggactgtggcaattcttgagcagcacttctctaccaatgctagcgaccatgctctgctgagcgaagtcatccagctaatgcagtatgtgatttatggtatagcgagctttttcttcctctacggaattatcttactggcagagggcttctatacgacttcggcagtgaaggaattgcatggcgagtttaagacaaccgcttgcggtcgctgtatctctggcatgttcgtgttcctaacatatgtgctgggcgtagcttggctcggagtcttcgggttctctgccgtgccagtcttcatgttttacaatatctggtccacatgcgaggttataaaatcccctcagaccaatgggacaacaggcgtagagcaaatctgcgtggacattcgccaatacggtatcatcccatggaatgcctttcctggcaagatctgtggatccgcattggaaaatatctgcaataccaatgagttctacatgtcctaccacctattcatcgtcgcttgtgctggtgcaggggctacagtaattgcactgctgatatatatgatggctaccacatacaactatgccgtgcttaaattcaaaagtcgagaagattgctgtactaaattttag

SEQ ID NO: 189645 - DNA, 324 bp, Artificial Sequence
  Description of Artificial Sequence: Synthetic coding sequence
atgaagcccgccatggagaccgccgccgaggagaacaccgagcagagccaagagagaaaaggatgtttcgagtgttgtatcaaatgcctcgggggagtcccatacgcctcgttggtcgccacgattctttgcttttccggcgtggcactcttctgtggctgtgggcacgttgccctagccggaacagtggccatcttagagcagcatttttctaccaatgccagcgatcacgctctcctgtccgaggtgatccagctgatgcagtatgttatctacggaatcgcaagcttcttctttctctatggcattatcctactcgcttag

SEQ ID NO: 189646 - DNA, 909 bp, Artificial Sequence
  Description of Artificial Sequence: Synthetic coding sequence
atggagatcggccggtaccactggatgtaccccggcagcaagaaccaccagtaccaccctgtaccaactctaggtgatcgagcaagccccctcagcagccccggctgcttcgagtgctgcattaaatgcctgggtggcgtaccatatgctagtctcgtggctacgattctgtgctttagcggcgtggccctattctgtgggtgtggccacgtagccctcgcaggtactgtggccatcctcgagcagcatttttccaccaacgcatctgatcatgccctacttagcgaagtcattcaattgatgcagtatgtcatctacgggattgcgagctttttcttcctgtacggaatcatcctcctggccgaggggttctacaccaccagtgcagtcaaagaactacacggtgaattcaaaacaactgcctgcgggcggtgcatctcaggaatgtttgtttttctgacttacgtgttaggcgtagcctggctgggcgtttttggctttagcgctgtcccagtgttcatgttttacaatatctggagtacctgtgaggtcatcaagagcccacagactaatgggacaacaggggtggagcagatttgcgtagacatccggcagtatggaattataccgtggaatgctttccctggtaaaatctgtgggagcgccctggagaacatttgcaatactaacgagttttacatgtcctatcacttgttcattgtggcgtgcgctggcgcaggcgccactgtgatcgcattaatccactttctgatgatattatctagcaactgggcatacctgaaagacgcgagcaagatgcaagcctatcaggatataaaagccaaggaagaacaagagctgcaagacattcagagcagatcaaaagagcagctgaacagttatacatag

SEQ ID NO: 189647 - DNA, 1863 bp, Artificial Sequence
  Description of Artificial Sequence: Synthetic coding sequence
atgagccccagccccaccgccctgttctgcctgggcctgtgcctgggccgcgttccagcccagtccggaccactcccaaaacctagcttacaagctctgccctcatccctggttcctctcgagaaaccagttaccttgagatgtcaagggccccccggagtggatctctatagactcgaaaaactgtcctcaagcagatatcaggaccaggcagtcctgttcattcccgcaatgaagcggagtcttgcaggtcggtatagatgttcttaccagaacggctcactgtggtctttaccaagtgaccagctggagcttgtagcaacaggagtgttcgccaaaccttccctctccgcacagcccggccccgccgtatcaagcggaggcgatgtgaccctgcagtgtcagactagatatggcttcgaccagttcgcactgtacaaggaaggagatcctgccccctacaagaatcccgagcgatggtatcgcgcaagtttccccatcatcaccgtcaccgctgctcacagcgggacctatagatgctattcattctcaagccgggacccctacctctggagcgcgccaagtgatcccctcgagctggtggttaccggtacctccgtcaccccctccaggttaccaactgaaccaccaagcccagtggccgaatttagcgaggccactgccgaactcactgtgagctttaccaacgaggtgtttactaccgaaacatctaggtccattacagctagccccaaggagagtgatagcccagccggggaatcctgtcctcctgtgttacaccaaggccagcccggccctgacatgcctcgtggctgcgatcctaataaccccggaggcgtgagtgggaggggcctagcacaacctgaagaggctcccgcagcccaggggcaaggatgcgccgaggcggcgtccgcgcctccagcaccaccagcggatcccgagatcaaacgcggatctggttggcgccctacagggtgcagccagccgcgtgttatgttcatgactgctgagcctcaagctcgtagctaccctcgggagggctcttggcatgggcgacggctcaaagattggcgggtgtggtcagtcgaggcgggcggacagcgcctccagctgtggaagagggggcatgcagcaagcagctggtgctccatcagagagccctttgggcagtgcttatcagtttgccttccactgtgcctgcgtgccccttcaatttgggacggacggaatctttggcgccctcatcctcctccttgcacactgtggatgacatggtacccagggtggaccacctattggccattgtccagcacaagtttaatctgggctcccgatggcagccttcggtttcccgctcttagggtcgactctgtcccctcctccgtgcagaatccacccgttctgccctttgggccgctgtgtagctgcctggtgtttccacgaaatagccacccccactcgatatcacactgtggactgacaaacttgctgagctccctacggaccggtctggcaggctctctaggcatgagcttcatattcctgtctgtaaagttggctaggtgcccactcccgttcacgctagaaaataagattagcctgtgtaatatggtaaaacctcacctgtaccaacagaacaaaaagacacagaagcttgctagatgtggcggcgcgagcctctacagccaacagctccgaggcctgcggtgggagaatggactatccctgggaggacgggggtgttccgagttacggtcccaccattgtactctggccagggtcaccaaacctgattttgtatcaaagaatactggtatgaatatgtccattacacttatatag

SEQ ID NO: 189648 - DNA, 966 bp, Artificial Sequence
  Description of Artificial Sequence: Synthetic coding sequence
atgagccccagccccaccgccctgttctgcctgggcctgtgcctggggcgggtgcccgcccagtccgggcccctccccaagccgtctttgcaggcactcccatcgtctcttgtgccgctggagaaacccgtaacactccggtgccagggtcctcccggcgtggacctctatcgcctggagaagctgagctcatcaagataccaagatcaggctgttctgtttatccccgcaatgaagcgctccctggccgggaggtacagatgtagttaccagaacggctccctttggtccctgccttccgatcagctggagcttgtcgctaccggggtattcgcaaaaccaagtctgagcgcccaaccgggacctgcagtaagttccggaggagacgttacattgcaatgccagacgcgttatgggttcgatcagttcgcgctatacaaagagggtgatccagctccctacaagaatcccgagaggtggtacagagcctcctttcctatcatcacagtgaccgccgctcattctggtacttatcgttgttattcctttagcagcagggacccttacttatggtctgcaccctcggatccgctcgagctagtggtgaccgagtttagcgaagccacggctgaactgaccgtctccttcaccaatgaagtgttcactactgagacatctcgttctatcactgcaagtcccaaagagtctgattcgcccgccgggcccgcgcggcagtactacactaagggcaacttagttagaatctgcctgggcgctgtcattctcataattctcgctggatttttggccgaagactggcatagtcgtcggaagaggctgcggcaccggggtcgtgcagttcagaggcctctccctccactgcctccccttcctctgacaaggaagagcaatggaggccaggacggtggcaggcaggatgtgcactcccgaggcctttgcagctag

SEQ ID NO: 189649 - DNA, 1020 bp, Artificial Sequence
  Description of Artificial Sequence: Synthetic coding sequence
atgagccccagccccaccgccctgttctgcctgggcctgtgcctgggtagagtacccgctcagagcggtccactgccaaaaccctcattacaggctctcccgtcgagcctggtgcctttagaaaagccggtcacactgcgctgccaagggcctccaggagtggacctctatcgtttggagaagctctctagctctaggtaccaagaccaggccgtcctctttattcccgccatgaaacgctccctagctggcaggtatcgatgctcctatcaaaatggcagcctatggagtcttcctagcgaccagctggaattggtcgcaacaggtgtattcgcgaaaccgagcctgtccgcccagcctggccccgcagtgtctagtggcggggatgttacactgcaatgccagacacgctatggattcgaccagttcgctctgtataaagagggcgatcctgccccctacaaaaacccagagagatggtacagggcatcgtttcctattattaccgtcaccgccgctcattcaggcacatatcggtgttactcattttctagtcgggatccttatctgtggtcggctccttctgatccgctagaattggtcgtcactggcacttctgtgacacccagtcgcctgccaacggaacctccctcgcctgtggcagagtttagtgaagccacagctgagctgaccgtatccttcactaacgaggtgtttacgacggagacttcaagatccatcaccgcttcccccaaagagtccgactctcccgcagggcctgcccgtcagtactatacaaaaggtaatctggtgcgcatctgtctcggcgccgtaatcttaattatcttggctgggttcctggcagaagactggcattcaaggcgtaagcggctgaggcacagaggccgtgcagtgcagcgtcctctgcctccattgcctcccctgcccctgacaagaaagtctaacggcggccaggacggtggcagacaggacgtgcacagtcggggactgtgctcctag

SEQ ID NO: 189650 - DNA, 1866 bp, Artificial Sequence
  Description of Artificial Sequence: Synthetic coding sequence
atgggcctgctgagcgaccccgtgcggcggcgggccctggcccggctggtgttgcgcctgaacgctcccctctgtgtactctcctatgtggctggcattgcatggtttctggccctggtctttccgccacttacccaaagaacttacatgagtgagaacgcgatgggctctactatggttgaagagcagttcgcaggaggtgacagggcgagggctttcgcgagagacttcgccgcccatagaaaaaagtcaggagccctccccgtggcctggttggaaaggaccatgcgctccgtggggcttgaggtatacacacagagcttttcaagaaagctgcccttcccagatgaaactcatgaacgttatatggtatccggaacaaatgtgtacggaatccttagagctcccagggccgcgtcaactgagtccctcgttctcaccgtcccctgcggaagcgatagtaccaacagccaggccgttgggctcctgctcgcgctagcggcgcacttcagagggcaaatttactgggccaaagacatcgtgttcctggtcaccgaacacgatctgttgggcactgaagcttggctcgaggcctatcacgacgtgaatgtgactgggatgcagtcaagcccccttcagggaagagctggagctatccaagccgctgtggccctggagctgtctagtgatgtcgtgacctccttggatgtagctgttgaaggtcttaacgggcagctgcccaacctggatctactaaatctgttccagacattttgccagaagggcggactcctctgcacacttcaaggaaagttacagcccgaagattggacctcattggacggaccgctacaaggacttcaaacgctgctgctgatggtgcttcgccaggcgagtggtcggccacacggttcgcacgggcttttcttgcgctatcgggtcgaggccctgaccttgagggggatcaattcttttcggcagtacaagtacgacttagtagcggtcggtaaggcattggaagggatgtttcgcaaactgaatcatctgctggagagactccatcagagttttttcctgtaccttcttccgggcctgagccgttttgtgtctattgggctttacatgcctgccgtgggtttcctccttttggtgctgggtctaaaagccctggagctttggatgcaattacacgaggctggaatgggattggaagagcctggcggagcacccggaccctcagtcccacttcctcccagccagggcgtgggcctagcgtctctggtggctccactcttaatttcccaggctatgggtttggcgctgtacgttcttccggtcttgggacaacacgtagccactcagcacttccccgtagcagaggccgaggctgtagtcctgactctcctcgctatctacgccgctgggctcgcccttccacataacacacatcgggtggtgtctacccaggcccctgataggggatggatggcgctcaaactagtcgcgctcatctacctagcgttacagttagggtgtattgcccttactaatttctctctcggttttctactcgctaccaccatggtgcctacagccgctctggctaaaccgcatggccccagaaccttgtatgccgccttactggtactcacttcacccgccgctacacttctcggtagtctgtttctgtggcgagagctgcaggaagcgccactctctctggcggagggctggcagttgttcttagccgctctcgcacagggcgttctcgaacatcacacttatggcgccctgttgttccctttgctatcactgggcctgtacccctgttggctgttgttctggaacgtgctgttctggaagtag

SEQ ID NO: 189651 - DNA, 1686 bp, Artificial Sequence
  Description of Artificial Sequence: Synthetic coding sequence
atgggcctgctgagcgaccccgtgcggcggcgggccctggcccggttggttttgcgtctgaatgctcccctttgggctttgcctgttgcttggctggaaagaaccatgagatcagtcgggcttgaagtgtatacacagtcattctcaagaaagctacctttccccgacgagactcacgaacggtatatggtgagtggcacaaatgtgtatggcatcctgagagcgcctagggctgcctcaacagaatcgctggtattaaccgtgccgtgcggtagcgattcaacgaatagccaggccgtgggcctcctcctggctctggctgcccactttcgggggcaaatttattgggccaaagacattgtgtttcttgtgacggagcatgatctgctcggcaccgaagcatggcttgaggcctaccacgacgtcaatgtcactggaatgcagagcagtccgctacagggcagggccggggctatacaggccgcagtcgctctcgaactgagcagcgacgtggttacaagtctggatgttgcagtggaaggtctgaatggtcagctccctaatttggacctgctgaatttatttcagaccttttgtcagaagggaggtctgctgtgtacgctccaaggcaaacttcagcccgaagattggacctccttagacgggccgcttcaggggctgcaaaccctgctcttgatggtactccggcaggccagcggacgcccgcacggctcccatgggctattccttcgatatcgagtggaggctctgacgctgaggggcataaattcatttcggcaatacaagtacgatttggttgctgtaggtaaggccctggaggggatgttccggaaactcaatcacttgctagagcgactccaccagagtttctttctgtacctcctaccaggcctgtcgcgctttgtctccatcggcctgtatatgccggcagtagggtttcttttactcgtgctcggcctgaaggcacttgagctgtggatgcagctgcacgaagccggaatgggcctggaggaaccaggaggggccccaggaccctccgtcccactcccgcctagtcagggggtggggctggcctctctcgtggcacccctccttatttcgcaagctatgggattagccttgtacgtccttcccgtcttggggcagcatgtggccacgcagcacttcccagtggcagaggcagaggccgtggtactgactcttctggctatctacgccgcggggctggcccttccccataacacacaccgcgtggtctcaacccaggctcctgatcgtgggtggatggcgctcaaactggtggcacttatttacttagccctgcagctgggatgtattgccctgactaacttttcgctcgggtttcttttggcaactactatggtacctaccgccgctctggccaaaccacatggaccccgaactttatatgcagctctgttagtcctgacttctcctgctgccacactactcggctcactgtttctctggagagagctccaggaagctccattaagtctcgccgagggatggcagctgttcttggccgccctcgctcagggggtattggagcatcatacctatggggccctcctattcccactcctgtcgctcgggctgtacccttgttggctattgttctggaacgtcctcttctggaaatag

SEQ ID NO: 189652 - DNA, 555 bp, Artificial Sequence
  Description of Artificial Sequence: Synthetic coding sequence
atgaaggccctgggcgccgtgctgctggccctgctgctgtgcggcagaccgggcagagggcagacccagcaggaggaggaggaagaagacgaagatcacggtcccgatgactacgatgaagaagacgaagacgaagtagaagaagaggagaccaatcgactgcccggcggaagatccagagtccttttacgatgttacacttgcaagtcacttccccgtgacgagcgctgtaatctcactcagaactgttcccatggacagacgtgcaccactctgattgcccatgggaataccgagtcaggcctgctgacaacacactccacctggtgcactgactcttgtcaacctatcacgaaaacagtggagggaactcaggtgactatgacatgttgccaatcgagcctctgtaacgtgccgccatggcaatcctctcgcgtccaggatccgaccgggaagggcgccggcggcccccgggggtcctccgagaccgtgggcgcggcgctgctgctcaatctcctggctgggttgggcgcaatgggcgccagacgcccatag

SEQ ID NO: 189653 - DNA, 582 bp, Artificial Sequence
  Description of Artificial Sequence: Synthetic coding sequence
atgggcaagcagaacagcaagctgcggcccgaggtgatgcaggacctgctcgagagcactgacttcactgaacacgagattcaagagtggtacaaaggattcctgcgcgactgcccgagtggtcatctgagtatggaagaattcaaaaagatctatgggaacttctttccgtatggcgacgcctctaaattcgccgagcatgtgtttaggacattcgatgctaacggtgacgggactattgatttccgggagtttattatcgccctgtccgtgacatctaggggtaaacttgaacaaaagctaaaatgggcgttctcaatgtacgaccttgacggaaacggttacattagtaaagccgaaatgctcgagatcgtccaagccatttacaagatggtgtcgagcgttatgaaaatgcctgaggacgaaagcactccagagaagaggacggagaagatcttcagacagatggatactaacagagatgggaagctgtctttggaagagttcatacgcggcgccaagtccgatccgtctatagtgagattacttcagtgtgatccatcgtccgcaggacagttctag

SEQ ID NO: 189654 - DNA, 756 bp, Artificial Sequence
  Description of Artificial Sequence: Synthetic coding sequence
atgagcgcctacggcatgcccatgtacaagagcggcgacctggtgtttgccaagttaaagggctacgctcactggcctgcccgaatcgagcatatgacacagcccaatagatatcaagtcttcttcttcggaacgcatgagaccgcctttctttccccaaagcgtttattcccatacaaggagtgcaaggagaaatttggcaagcctaacaaacgccgcggattttccgccggcctgtgggaaatagaaaataaccccaccgtccaggcaagtgattgcccactcgcgagcgagaagggatctggggacggaccatggccggaacctgaagctgcagagggggatgaggataaaccgacccacgcaggagggggcggtgatgagctgggcaaaccagatgatgataaacctaccgaagaggagaagggccctctcaagagaagcgccggtgaccccccagaagatgcccctaagaggccaaaagaggctgctcctgatcaggaggaggaggccgaggctgagcgagctgcggaagccgaacgcgcagctgccgcagcagcagctacagccgtggatgaagagagtcctttcctggtggccgtcgagaacggctccgccccatctgaacccgggctggtctgtgaaccccctcagcccgaggaagaagaactccgcgaggaggaagttgccgacgaagaggcctctcaagaatggcacgctgaggctcccgggggaggtgacagagattcgctttag

SEQ ID NO: 189655 - DNA, 531 bp, Artificial Sequence
  Description of Artificial Sequence: Synthetic coding sequence
atgagcgccttccggctgtggcccggcctgctgatcatgctgggcagtctgtgccaccgaggctccccatgtggccttagcacacacgtggaaatagggcaccgcgctctggagtttctacagctgcataatgggagggtgaactatagagaactactccttgaacatcaggacgcttatcaggctggcatcgttttccccgactgcttctatccctctatatgtaagggagggaagtttcacgacgttagtgagtccacccattggacgcccttcctgaatgcctctgtgcattacatcagagaaaactatccgctgccttgggaaaaagacaccgagaaacttgttgcgttccttttcggaatcacctcacatatggcagcagatgtgtcatggcattcccttggcctcgagcaggggttcttgcggaccatgggcgctatcgatttccacggatcgtattcagaggctcactccgctggggacttcggaactgtttatctacatcttttaaacttcctggttgtttag

SEQ ID NO: 189656 - DNA, 831 bp, Artificial Sequence
  Description of Artificial Sequence: Synthetic coding sequence
atgaacagcaagcggatgctgctgctggtgctgttcgccttcagcctcatgttggtggaacggtatttcagaaaccatcaggtagaggaactacgcttaagcgattggttccaccccagaaagaggccagatgtgatcacgaagactgattggctcgcccccgtcctttgggaaggcactttcgacagaagggtactggagaaacactacaggagaaggaatattactgtcggcttggccgtgttcgcaaccgggcggtttgcggaagagtaccttcgcccctttctgcattctgccaacaaacattttatgacaggctaccgcgtgatcttttacattatggtagatgctttttttaagttacctgatatcgaaccttctccattgcggacgttcaaagccttcaaagtcgggaccgagcgttggtggttggacggaccgctggttcatgtaaagtcactcggcgaacacattgctagtcacatccaagacgaagtcgacttcttgttctctatggccgccaatcaagtctttcagaacgaattcggtgtggagacgcttggccccctagtcgcccagctgcacgcatggtggtactttcgaaatacaaagaacttcccctatgagcggcgccccactagtgctgcgtgtatcccctttggccaaggtgacttctactatggaaatctgatggtgggagggacgccccataatatcctggattttataaaggaatacctgaatggggtgatccatgacattaaaaatggactgaatagcacttatgaaaaacatctgaataaatacttttaccttaataagcctacatag

SEQ ID NO: 189657 - DNA, 2166 bp, Artificial Sequence
  Description of Artificial Sequence: Synthetic coding sequence
atgctgccccggggccggccccgggccctgggcgccgccgccctgctcttgttgctgctgttgcttggatttcttctctttggcggtgatttaggatgtgagcggcgcgaacccggagggagggctggcgctcctggttgttttcccggacctctgatgcccagagtgcctccggatggaaggctccgacgagccgctgccctggacggcgatcctggcgctggccctggagaccacaatcggtctgactgcgggccccagcctccaccacctcctaagtgtgagcttctccacgtggctattgtgtgcgccgggcataatagttcacgcgacgttataacgcttgtgaaaagcatgctgttttatcgaaaaaacccccttcatctccacctcgtgaccgatgcagtggcccgcaatatcctggagacactgttccatacatggatggtgccagccgtacgcgtgagcttctaccacgctgatcagttaaagccacaagtttcctggatccccaacaagcactacagcggcctctacggcctcatgaagctggtgctgccatccgctttgcccgctgagctggcacgggtgatcgtgctggataccgacgtaactttcgctagtgatatctcggagctctgggcactgtttgcacattttagcgatacacaggccattgggctcgtcgagaaccagagcgactggtatctcgggaacctgtggaagaaccatcggccttggcccgcactggggcggggattcaacacaggtgtgatcctattgcggcttgatcggctcaggcaggccggttgggaacagatgtggaggttaactgccagacgtgagctactgtctcttcccgcaaccagtctggctgatcaggacatcttcaacgcagtgatcaaagaacaccctggcttagtgcagcgcctcccctgtgtttggaacgttcagctgagcgaccacacacttgctgagcgctgctactctgaggcctcagacctgaaagtgatccactggaactccccaaaaaaactcagggttaagaacaagcatgtagaatttttccgcaacttttatttaactttccttgaatacgacggcaatttgctgcgccgagagctgtttgtctgccctagccagcccccgccaggggccgaacaacttcagcaggcactagcccagttagacgaggaagatccctgcttcgaattcagacagcagcagctgaccgtgcaccgtgtgcatgtcaccttcttgccacacgaaccaccacctccgcggcctcacgacgttactctagtcgctcagctcagtatggaccggcttcaaatgctggaagcactgtgtcgccactggcctggccctatgtctcttgccttgtatcttaccgatgcagaagcacaacaatttctgcactttgtcgaagctagccctgtgctggcagcccgccaggacgtggcctaccacgtagtctatcgcgaaggtcctctgtacccagtgaaccagttaagaaacgttgctctcgcacaggcactaactccatacgtgttcctctcggatatagattttttgccagcttatagtttgtacgactatctgcgggcgtcaatcgagcagctgggactgggatcccgtcgtaaagcagctctggtcgtgccggcatttgaaacccttaggtatcgcttttccttcccccactctaaagttgagctgctggctctgctggatgccggcactctgtatactttccgctatcatgagtggccacgaggccacgcacccaccgattatgcacggtggcgtgaggctcaggcaccttaccgcgtgcaatgggccgccaactacgagccctatgtagtggtgccgcgcgactgtccacgctacgacccaaggttcgttggcttcgggtggaataaggtcgcccatattgtggagcttgacgcccaggaatatgagctactcgtactgcccgaagccttcactatccacttgccacatgcgccatccctggacataagccgtttcaggtcctctccaacttatcgagattgtctgcaggctctgaaggacgagtttcaccaagacctctctcgccaccatggggccgcggcgcttaagtatcttccagctctgcagcaacctcagtcacccgccaggggctag

SEQ ID NO: 189658 - DNA, 870 bp, Artificial Sequence
  Description of Artificial Sequence: Synthetic coding sequence
atgtggcggctgaccgcccggcgggagctgctgagcctgcccgccactagcctggctgaccaggatatttttaacgcagttatcaaagagcatcccggacttgtgcaaaggctcccatgcgtgtggaacgtacagctgtccgaccatacactggctgagcgatgctatagcgaagcatctgatctaaaagtgatacattggaatagccccaaaaaactccgggtcaagaacaagcatgtcgagttcttccggaacttttacctcaccttcctggaatacgatgggaatcttctgcggcgcgagttattcgtgtgtccgtcacaaccaccccctggagcagagcagctgcagcaggcccttgcccagctagatgaggaggatccctgttttgagttccgccagcagcaattaaccgtgcatcgcgttcatgtcaccttcctcccccacgaaccgccgccaccacgcccccacgacgtaaccctggtcgctcagctctctatggatcgcctgcaaatgcttgaggccttatgccggcactggcccggaccgatgagtcttgctctgtatctcaccgatgccgaggctcagcaatttcttcatttcgtggaggcctcccccgtcctggccgctagacaggatgtagcttaccacgtggtatacagggagggcccactgtaccctgtaaaccagctgcggaatgtggctcttgcccaggccctgacaccgtatgtgttcctgtctgatattgattttctgcccgcctattccctttacgattacctgcgcgaggcccgggccgggttcaacagcagtagcacttgcggctgtgcccatccgtctcaccaggcaaggtggccgatggtggtgtag

SEQ ID NO: 189659 - DNA, 2166 bp, Artificial Sequence
  Description of Artificial Sequence: Synthetic coding sequence
atgctgccccggggccggccccgggccctgggcgccgccgccctgttactcctccttttgttactcgggtttcttctgtttggaggggatctaggatgtgagaggcgcgaacccgggggaagagcaggggcgccaggctgttttcccggccccctgatgccacgagttccgcctgacggacgactccgccgtgcggctgctctggatggcgatcctggtgccggccccggtgatcacaacaggagtgactgtggaccacagccacccccaccgccaaagtgtgagctgttgcatgtagctattgtgtgtgccggacataactcctctagggatgttatcactttagtcaagagtatgttgttctacagaaagaatccacttcacctccacctcgtgaccgatgcagtggcccggaatattctggagaccctcttccatacgtggatggtgccagcagtgcgcgtgagcttctatcacgccgatcagctcaagccccaggtgagctggattccgaacaagcactattctggactctacggactcatgaagcttgtgttacctagtgctcttcctgcagagctggctagggtgatcgtgctcgacactgatgttacgttcgcctctgacatcagtgaactgtgggccctgttcgcacatttttcagatacccaagccatcggcctggtggaaaaccagtccgattggtatttgggaaatttatggaagaatcaccggccctggccggctctagggagaggctttaataccggggtgatccttctccgccttgatcgactgcgccaggccggctgggagcagatgtggagattgacagcgcgaagagagctgctgtcattacccgcaacatctctcgccgatcaggatatctttaatgcagtgattaaagagcatccaggcctggtgcaaagactgccctgtgtttggaatgtccagcttagtgatcatacgctcgctgagaggtgctactcagaggctagcgatctgaaagttatacattggaacagtccaaagaagctgcgagtcaagaacaaacatgtagagttcttcaggaacttttatctcaccttccttgaatatgatggcaacctgttgaggcgggaactgttcgtctgtccatcccaaccgcctcctggtgccgaacagctgcagcaagccctggcacagctggacgaagaagacccttgtttcgagtttaggcagcagcagctcaccgttcatagagtgcacgtcactttcctacctcacgagcccccaccccctaggccacacgacgtaaccctcgtcgcacaactgtccatggaccgactgcagatgttagaagccctgtgtcggcactggccgggaccgatgagtctggccctctacctgacagatgcagaggcccagcagttcctgcattttgtggaggcttcaccggtactagcagcccgtcaggatgttgcctaccacgtggtgtatagggaagggcctctctatccggttaaccagctacgcaatgtcgccctagcccaagctctgacgccttatgtgtttctgtccgacatcgacttccttcctgcgtattccctttatgattatctgcgtgcaagtatcgaacaactagggctgggctctagacgcaaagctgcgctcgttgtgccagcgttcgaaacgttaagatacaggttcagcttcccgcactctaaagtcgagctcctggctctcctggatgcaggaacgctatacacgtttagatatcacgaatggccacggggacatgctcccaccgattacgcccgatggcgcgaggcgcaagctccttatcgggtgcagtgggcggctaattatgaaccttacgtggttgtaccccgggactgtccaagatacgatcctcgctttgttgggtttgggtggaacaaggtggcacacatcgtggagctggacgctcaggaatatgagctcctcgtcttaccagaggcttttacaatccacctacctcacgctccttccctggatatatctcgctttcggtcctcaccgacatacagggactgtctgcaagcactaaaggacgagtttcaccaggacctctcacgccatcatggtgcggcagctctgaagtacttaccagctcttcaacagcctcaatcaccagcccggggctag

SEQ ID NO: 189660 - DNA, 2166 bp, Artificial Sequence
  Description of Artificial Sequence: Synthetic coding sequence
atgctgccccggggccggccccgggccctgggcgccgccgccctgctgctgcttctcctcctactgggttttctcctcttcggtggagacctcggatgcgaaagacgcgagccaggcgggagagccggggcaccggggtgcttcccaggccctctgatgccacgtgtgcctcctgacggtcggttacgacgggcggctgctctggacggtgatccaggcgctggaccgggtgaccacaatcggtccgactgtggcccgcagccacctccacctcctaagtgcgagctcctccacgtggctatcgtttgcgctggacataactcatcacgagatgtgatcaccctggtcaaatctatgttgttttatcgaaaaaacccattgcacctgcacctggttacagatgccgtggccaggaacattctcgagacactgtttcacacatggatggtgcccgccgtcagagtgtctttttatcacgcagaccaactcaagcctcaggtaagctggattcccaataagcactattcaggactgtacgggctaatgaaacttgtcttacctagcgcgctgccggctgaactggcgcgcgtcattgtgctggatactgatgtgacttttgcatccgacatcagtgagttgtgggccttgtttgcccatttcagcgacacacaggctattggtttggtggagaaccagagtgactggtacctgggtaatctgtggaagaatcacagaccatggccagcactggggcggggctttaacaccggagtaattctgttgcggctagacaggctcagacaagcaggctgggagcagatgtggcggcttacagctagaagagaactcctgagcctgcctgccacatcgcttgccgatcaggacattttcaacgcggtgatcaaggaacaccctgggttagtgcagcggcttccttgcgtctggaatgttcagctctctgatcataccctggctgagaggtgctactctgaagcctcagatctgaaggtgatccattggaacagtccaaaaaagctccgagtcaagaacaagcacgtcgaatttttccggaatttttacctgacattcctagaatatgacggaaacctgctgaggcgggaacttttcgtatgcccctctcagcccccaccgggggccgagcaactgcagcaagcccttgcccaactagacgaggaagacccgtgtttcgaattccgacagcagcagctgactgtccacagagtgcatgtaactttcttgcctcacgagccacctccacctaggcctcatgacgttacgcttgttgcgcagttgtctatggaccggctgcagatgctggaggcgctctgtcggcactggccaggtcccatgagcctcgcattgtacttgacggacgccgaagcccagcagttcctgcattttgtggaagcctcccccgtgctcgccgcccgacaggacgtcgcctatcacgtggtctacagagaaggtcccctgtacccagtcaatcaactgcgcaacgtggctctggcccaggctttgacgccttacgttttcttatccgacattgattttctgcctgcttactctctatatgactaccttcgtgcatcaatagagcagttgggactcggctcgcgccgcaaggccgcccttgtggtgccagccttcgaaactctcagataccgtttcagtttcccccattcgaaggttgagctactcgcgctattggatgcagggaccctgtatacttttcgataccacgaatggccgcgagggcacgcccccactgattatgccaggtggcgcgaggcgcaggccccttatcgggttcagtgggctgccaactacgagccctacgtggtcgtgccgagggattgtccgcgatacgacccacgctttgttggatttggatggaataaggttgcccacatcgtcgaactcgacgctcaagaatatgaactcctggtcctcccggaggcattcaccatccacctacctcacgcaccgtctctcgatatttcacgctttcggagcagccccacataccgggactgtttacaggcccttaaggatgagttccaccaagacctgagccggcatcacggcgccgcagcgctcaagtacttacctgcactgcaacagcctcaaagccctgctcggggttag

SEQ ID NO: 189661 - DNA, 2073 bp, Artificial Sequence
  Description of Artificial Sequence: Synthetic coding sequence
atgctgccccggggccggccccgggccctgggcgccgccgccctgcttttgctccttctcctcctcgggttccttctgtttgacgggaggctgcgtagggccgccgccctggacggcgaccctggggcaggacccggcgaccacaatcgctcggactgtggaccccagccaccccctcccccgaaatgtgaactcctgcatgtcgcgattgtctgtgccggtcacaattcatcaagagacgtgatcactctcgtgaaaagtatgttgttctatcgcaagaaccccctgcacttacatctggttacggacgcagtagcgagaaatatcttggagaccctgttccatacctggatggtccccgctgtcagagtgtccttctaccatgccgatcaattgaagccccaggtcagttggatccctaacaagcattactctgggttgtacggcttgatgaaattggtgcttccatccgccctgcccgccgaactcgcccgggtgattgtgctggatacagacgtaacattcgccagtgatatctctgagctgtgggcattattcgcgcattttagtgatacgcaggccatcggtcttgtggagaatcagtcagattggtatctcggcaacctgtggaagaaccaccgcccctggcctgccctgggtaggggtttcaacactggggtgattctgctgcgactggatcggttgcgccaggccgggtgggagcagatgtggaggctgaccgctaggagggaactgctctcacttcccgcaacaagtctggccgatcaggatatatttaatgctgtgatcaaggagcacccaggccttgttcagagactgccatgcgtgtggaatgtccagctgagtgaccacactttggccgaacgttgttattccgaagcctccgatttgaaagtgatccactggaactcccccaagaagttaagagttaagaacaagcacgtggaattcttcaggaacttttaccttaccttcctggagtatgatggaaatctgcttagacgtgaattgttcgtgtgcccaagtcaacctccgccgggagctgagcagctgcaacaggccctggcacagctggacgaggaagatccctgttttgaatttagacagcagcagcttaccgtgcacagagttcatgttacatttctgcctcatgaacccccacctcctcgtccccacgacgtaacacttgttgctcagctgagtatggatcgccttcagatgctcgaggccctctgccggcactggcccggcccaatgtctttggctctctacctcactgatgcagaagcgcagcagtttttgcattttgtagaggctagccctgtattggccgcgagacaagatgtagcctatcacgtggtgtaccgtgagggccctctgtaccctgtgaaccagcttcggaatgtagccctggctcaggcactcaccccatatgtgttcttgtccgacatcgactttcttcccgcttactcactgtacgattatctgcgcgccagtatcgaacagctcgggctgggctcccgccggaaggccgccctggtcgtgcccgccttcgagactctgcggtataggttctccttcccacactccaaagtcgagctgctcgctctactggatgcaggcactctgtatacattcagatatcatgagtggcctagaggccatgccccgacagattatgcccggtggcgggaggcacaggcaccctacagggtgcagtgggctgccaattacgaaccgtacgtcgtggtacctagagattgcccccgctacgatcccagatttgtgggattcgggtggaacaaggtcgcacacatcgttgaactcgatgcccaggagtacgagctgcttgtgctccccgaggcttttactattcacctaccccatgcccccagtctggatatctctaggttccgcagcagtcccacttatagagattgtctccaagccctgaaggacgagtttcatcaggatctctcaagacaccacggggctgccgccttgaagtatttgcccgctttgcagcagccccagagtccagcgcgcgggtag

SEQ ID NO: 189662 - DNA, 1122 bp, Artificial Sequence
  Description of Artificial Sequence: Synthetic coding sequence
atgagcatcctgatcatcgaggccttctacggcggcagccacaagcaactggtggacctccttcaggaggaattgggagattgcgtggtgtataccttgccagccaagaaatggcactggagggcaagaaccagcgctctctacttcagtcaaactattccaatatccgagcactaccggaccttgttcgctagctctgtgctgaatttgacagaactggccgctctgaggcctgatcttgggaaattgaagaagattctatatttccacgagaaccagctgatctatcctgtgaagaagtgccaggagcgcgacttccagtatggatataaccagatcctatcctgcctcgtggctgatgtggttgttttcaattccgtgtttaatatggaatcttttctcacatctatgggtaaatttatgaagctgatccccgatcaccgtcctaaggacctggagtctatcattaggcctaagtgccaagtgatttatttccccatacggtttccagatgtttccagattcatgccaaagcacaaaacaacccacctgaaaaaaatgctgggactcaagggcaacggcggcgcggtgctgagcatggcgttgccctttcaacccgaacagcgagactcagaagacctgctcaaaaactttaacagtgaatgtgatacccactgcgggttagatacagcgcggcaggagtatctagggaactccttgcgccaagagagcgacctgaagaagtcaaccagtagcgacaacagctccagccaccacggggaaaacaaacagaatctgacagtggacccatgtgatatcctgggaggagtcgacaatcagcaaagactgcttcatattgtgtggccccacaggtggttagaggctgtatactgcggctgctatccgttgtgtcctaaggatctggtctaccccgaaatctttcccgcggaatacctctactcgactccagagcagctcagcaaacgtttgcagaatttttgcaagcgacccgacatcatcagaaagcatctctacaaaggcgaaatcgcccccttctcctgggcagccctgcacgggaagtttcgttcccttctgaccacagaaccacgcgaggacctctag

SEQ ID NO: 189663 - DNA, 1377 bp, Artificial Sequence
  Description of Artificial Sequence: Synthetic coding sequence
atgagcatcctgatcatcgaggccttctacggcggcagccacaagcagttggttgatttgctgcaagaagagttgggggactgcgtggtatatacactcccagctaaaaaatggcattggagagctcgcacctcggccttatactttagccagacaatccccatatcagagcattatcgtacgctcttcgccagctcagttctgaatttgacagagttagccgctttacggcctgatttggggaagttaaagaagatactgtacttccatgaaaatcagctgatctaccccgtcaaaaagtgtcaggagcgtgatttccagtacggctacaatcaaattctgtcatgcctggtggcggacgtggtcgtttttaacagtgtctttaatatggagtcatttctgacatccatggggaagttcatgaagctcattcctgaccatagaccgaaagatctcgagtctattattcggcccaagtgccaggtaatatactttcctatcaggtttcccgatgtgagtaggttcatgcctaagcacaagaccacccatctcaagaagatgcttggacttaaaggcaatggcggagctgtgctgagcatggccctccccttccagccggagcaacgcgacagtgaagaccttctcaagaattttaacagtgagtgtgacacacattgtggcctggatactgccagacaggagtacctcggcaattcgctgcgtcaggagagtgaccttaaaaaaagcacctcatccgataattcatcctcgcaccacggcgagaataaacagaacttgacagtcgacccctgtgacatcctgggtggggtagataatcaacagcgtttgctccatattgtatggccccaccgctgggagcatgataaagacccagagtcattctttaaggtgttaatgcacctgaaggatctgggacttaattttcacgtctctgtcctcggcgagactttcacagatgtgccggacattttcagcgaggcaaaaaaggcactgggctcctccgtgctgcattggggatatctgccatctaaagacgactatttccaggtcctgtgcatggcagacgtagtgatctcgactgccaagcacgaattttttggcgttgcaatgctcgaagctgtctactgtgggtgttacccactgtgtccaaaagacttagtctatcccgaaattttccctgcagaatatctgtacagtacccccgagcaattgtccaaacgccttcagaatttttgtaagagaccagatatcatacggaaacatctgtacaaaggtgaaatcgccccattctcctgggccgcactccacggcaaattccgatctttactaacaacggaaccaagagaggatttgtag

SEQ ID NO: 189664 - DNA, 1122 bp, Artificial Sequence
  Description of Artificial Sequence: Synthetic coding sequence
atgagcatcctgatcatcgaggccttctacggcggcagccacaagcagctggtggacctcttgcaggaagaattgggcgactgtgtggtatatacacttccagccaagaagtggcattggagggctcgcacgtctgccctgtatttcagtcagactatacctattagtgagcactaccggacactgtttgctagtagtgtgctcaatctgactgagctggccgcactgagaccagacttgggcaaattaaaaaaaatcctgtatttccatgagaaccagctgatatatccagttaagaagtgtcaggagagagatttccagtacggttacaaccaaattctttcttgcctggtggccgatgtcgtcgtcttcaattctgtatttaatatggaaagctttttaacgagtatgggcaaatttatgaaactcatacccgaccataggcctaaagatttggaatcgatcatcagaccgaaatgccaggtgatatatttccctatccggtttccagatgtttcccgattcatgcccaagcataagacaacacatctgaaaaagatgctcgggttgaaagggaacgggggtgcagtgttatcgatggctctacctttccagcccgaacagagagattctgaggatctgcttaagaatttcaacagcgagtgcgatacccactgcgggctggatactgcacgccaggaatacctcggaaactcactccgacaagaaagcgaccttaaaaaaagcaccagcagcgataattcatcctctcaccatggggaaaacaaacagaatctcacagttgacccctgcgacatcctgggcggggtggacaatcaacagcgcttgcttcatatcgtctggccgcacaggtggctggaagccgtctattgtggctgctacccactctgcccgaaggatctcgtttacccagaaattttccccgctgagtatctttattctactcctgaacagttaagtaagagattgcagaacttctgtaagcgcccagacatcattcggaaacacctttataagggcgagatagcaccgttttcctgggctgcactgcatgggaagtttagatcactgcttacaaccgagcctagggaggacttatag

SEQ ID NO: 189665 - DNA, 1377 bp, Artificial Sequence
  Description of Artificial Sequence: Synthetic coding sequence
atgagcatcctgatcatcgaggccttctacggcggcagccacaagcagctggtcgatctcctccaggaagaattgggagactgcgtggtctacacacttccagctaaaaagtggcactggagagcccgcaccagtgccttatatttttctcagaccatccctatctccgagcactaccggaccctgtttgccagttccgttctgaacctgacagagttagccgctctgcgccctgatctgggcaaactcaagaaaatcctttactttcatgaaaatcagttgatatatccggtaaagaaatgccaagaaagagatttccagtatgggtataaccagatcctgtcttgtttggtagctgacgtggttgtgttcaattccgtctttaacatggagagctttttaacctcgatgggaaaattcatgaagctgatcccggaccaccgccccaaagacttggagagtataatccgaccaaaatgtcaggtgatctacttcccaatacgcttcccagatgtgtctagattcatgccgaagcataagacaacacacctgaaaaagatgctaggtttgaagggaaacggaggagccgtgctctccatggcccttccctttcagccagaacagagagacagcgaggacttactgaagaatttcaactctgagtgcgacacccactgtgggctggacacggcccgccaggaatatctggggaatagcctcaggcaggagagcgacctgaagaaatctacatcgtctgacaattccagctctcaccacggtgaaaacaagcagaatcttaccgtggatccatgcgacatccttggcggggttgacaatcagcagaggctgctgcatatcgtgtggccccatcggtgggagcacgacaaggacccagagtcgttctttaaagtcctaatgcaccttaaggatctgggtctcaattttcacgtgtctgtgctgggcgagactttcacagacgttcctgatattttcagtgaggctaagaaggccttgggcagttctgtgttacattggggttaccttccctcaaaggacgactatttccaggtgttgtgtatggctgacgtcgttatcagcactgctaagcacgagttctttggcgtggcgatgttggaagcggtgtattgcggatgttatccactttgccccaaagaccttgtttatcctgagatatttcccgccgaatacctatactccaccccagaacagctatccaaaagactacagaacttctgtaaaagaccggatattattcgcaaacacctctataagggggagatcgctccgttctcctgggctgcactgcacggtaagtttcgctccttactgacgacggagcctcgggaggacctgtag

SEQ ID NO: 189666 - DNA, 1377 bp, Artificial Sequence
  Description of Artificial Sequence: Synthetic coding sequence
atgagcatcctgatcatcgaggccttctacggcggcagccacaagcagctggtagatttgctccaggaagagctaggcgactgtgtagtttatacactgcccgcaaagaagtggcactggcgagcacgcacctccgcactatatttctcccaaactatccccatctcggaacactaccgaacgctctttgcctcgtccgttctgaatctgacagaacttgctgctctgaggcctgaccttggcaaactcaaaaagatattgtattttcacgaaaatcagctgatctatcccgtgaagaaatgccaggaacgtgatttccagtatggatacaatcagatcctctcttgtctggtggcagatgtggtggttttcaatagcgtgttcaacatggagtccttcctcacttctatgggtaagttcatgaagctgatccccgaccaccggcctaaggatcttgaatcaattattcggcccaaatgccaggtgatctatttcccgatacgatttcccgacgttagcagatttatgccaaaacacaagaccactcatctaaagaaaatgcttggactcaaagggaacgggggcgccgtgctatcaatggcgcttccattccaacccgagcagcgggattctgaagaccttttaaaaaatttcaattccgaatgcgatacccactgtggcttagataccgcaaggcaggaataccttgggaatagcctgcgccaggaaagcgatcttaaaaagagtacgtccagtgataacagtagcagtcaccatggggaaaacaaacagaacctgacggtcgatccatgtgatattctcggcggggttgacaatcagcaaaggttgctacacatcgtatggccccatcgatgggagcacgacaaggacccggaaagttttttcaaagtgctgatgcatctcaaggacttaggcctcaactttcacgtgtcggttttgggagagacgtttaccgatgtccctgatattttctccgaggccaaaaaagctttgggaagtagtgtactccattggggctaccttccttcaaaagatgactactttcaggtgttgtgcatggccgacgtcgtgatatcgaccgcgaaacatgaatttttcggcgttgcaatgcttgaagccgtctattgcggatgttatcccctttgccccaaggacctcgtgtaccccgaaattttcccagccgaatacttgtatagcacacctgaacagttgtctaagcgccttcagaacttttgtaagcggccagacattatacgcaagcacttgtataagggcgaaatcgctccatttagctgggcggccctgcacgggaaattcagaagcctgctgacaacagagccgcgagaagatctttag

SEQ ID NO: 189667 - DNA, 300 bp, Artificial Sequence
  Description of Artificial Sequence: Synthetic coding sequence
atgagcatcctgatcatcgaggccttctacggcggcagccacaagcagctggtagaccttctgcaggaagaactcggtgattgcgtagtgtacacactgccagcgaaaaagtggcattggcgggcccgaacctcagccctctacttcagccagacaatccccatatcggagcactatagaacactgtttgcgtcgagtgtcctcaatctgactgaactcgctgctttgcggcccgaccttggaaaactgaaaaagattctatacttccacgaaaaccagttgatataccccgttaagtag

SEQ ID NO: 189668 - DNA, 522 bp, Artificial Sequence
  Description of Artificial Sequence: Synthetic coding sequence
atgagcatcctgatcatcgaggccttctacggcggcagccacaagcaactggtagatctcctgcaggaagagcttggcgattgcgtggtgtacaccctgccagctaaaaaatggcactggcgggcgcgcacctccgctttatacttctctcaaacgattccgatctctgaacattataggacgctatttgcctcttcagtgctgaatttgacggagcttgccgccctgagaccggacctcggcaaattgaagaaaatcttgtactttcatgaaaaccagttaatctaccctgttaaaaaatgtcaggagagggatttccagtacggctacaatcagatcctctcctgcctcgtcgcggatgtggtggtgttcaactccgtgttcaacatggagtcctttttaacatctatggggaagtttatgaaactgatacctgatcatcgccccaaagacctggagtccataatccgcccaaagtgccaggttatttacttccccatcaggttcccagacgtgtcatag

SEQ ID NO: 189669 - DNA, 1377 bp, Artificial Sequence
  Description of Artificial Sequence: Synthetic coding sequence
atgagcatcctgatcatcgaggccttctacggcggcagccacaagcagctggtagatctgttacaggaggagctgggggactgcgtggtgtacactctgccagctaaaaaatggcactggcgcgcaaggacaagcgccctgtatttctcacagaccattccaatcagcgaacactataggacactgttcgcaagctccgtgctgaatcttactgagctcgcagctctcaggcctgaccttgggaagctcaagaagattctctatttccatgagaaccaattgatctaccctgtaaagaaatgtcaggagagggacttccagtacggttacaatcagattctctcttgcctggtcgccgatgtggtggtcttcaactccgtatttaatatggaatccttcctaacgtctatgggtaaatttatgaaactgatacccgatcacaggcccaaggatctggagtccatcattaggccgaagtgccaggtgatctatttccccattagattccctgatgtcagcagattcatgcctaaacacaagactacacatcttaagaagatgttgggccttaagggcaatggcggcgccgtgctgagcatggcactcccttttcagcctgagcagcgagatagcgaagatcttctgaagaactttaactcagagtgcgatacacactgtggtcttgacactgcgcgccaggaatacttgggcaactctctgcggcaggaaagcgatctgaagaaaagcacaagcagtgataacagctcctcacaccacggcgagaataaacagaacttaactgtcgacccttgtgatatcctgggaggagtggacaaccaacagaggctactccatatcgtttggccccaccggtgggaacatgataaggaccccgaatccttctttaaggttctcatgcacctcaaggacctggggttaaacttccacgtatccgttttgggcgaaactttcacggatgtccctgatattttttcagaagccaagaaggcactgggctcatcggtgcttcattgggggtatctcccctcaaaggacgattacttccaggttctttgcatggctgacgtggttataagcacagcaaaacacgagttttttggcgtcgcgatgctcgaagctgtgtattgtggatgctacccattatgccccaaggatttagtctatccagagattttccctgcagagtatttatactcaacccccgagcagcttagcaaaagattgcaaaacttttgcaagcggcccgacattattaggaaacacctgtacaaaggggaaatcgctccgttctcgtgggccgccctacacggaaagtttcggagcctgttgaccactgagccccgggaagatctctag

SEQ ID NO: 189670 - DNA, 2220 bp, Artificial Sequence
  Description of Artificial Sequence: Synthetic coding sequence
atgcccagcccccggcccgtgctgctgcggggcgcccgggccgccctgctgctgctcttgccccccagactccttgcccgcccctcgctgctattgaggcggtctctgtctgcggcctcttgtccgcccatctccctgcccgcggctgcctctcggtcttcaatggatggtgccggcgcagaggaggtgttggcacccctgaggttagccgtcaggcaacagggcgatctcgtgagaaaattaaaggaggataaagccccacaggtggatgtagataaggctgttgccgagttgaaggcgaggaagcgcgtgttggaagcaaaggaacttgctctgcagcccaaagatgacatcgtggatcgcgctaaaatggaagatacacttaaacgtagattcttttacgaccaagcttttgcgatatatggtggtgtttcaggcctctacgattttggtccagtggggtgtgcactgaaaaacaacatcattcagacctggcggcagcattttatacaggaagagcagatcctggaaatcgattgcacaatgctgactccagaacccgttttaaaaacgtcgggtcacgtggacaagtttgctgacttcatggtcaaggatgtgaaaaacggagagtgttttcgagccgaccatctcttgaaagctcatctgcagaagctgatgagcgacaagaaatgttctgtcgagaagaagagcgagatggaatcagtcctcgctcagttagacaattatggtcaacaggagttggccgatctgttcgtgaattacaatgtaaaatcgcccattaccggcaacgatctgagtccaccagtttcctttaacctcatgttcaaaacatttatcggtccgggagggaatatgccaggatacctgcgccctgagaccgcacagggaatttttctgaattttaaaagactgttggaatttaatcagggcaaattgccatttgctgccgcccagataggtaacagcttccgcaatgagatcagcccgaggagtggtttaataagagttcgggagtttaccatggccgagattgaacacttcgtggatccctcggaaaaagatcaccctaagttccagaacgtagccgatttgcatctctacctgtacagcgcaaaggcccaggtgagcggtcagtccgcaagaaagatgcggttgggggatgctgtggaacagggtgtcattaataataccgtgttgggatatttcattgggagaatctacttgtacctaactaaggtgggaataagccccgataagctgcggtttcgccagcatatggaaaatgagatggctcattacgcgtgtgactgttgggacgccgagtccaagacctcgtatgggtggattgagatcgtcggatgcgctgaccgttcttgctatgacctttcatgtcatgcacgtgccaccaaggtccctctcgtggcagaaaaaccactgaaagagcccaagacagttaatgtggtgcaatttgaacccagcaagggcgcaatagggaaagcttacaagaaagacgcgaagttagtaatggagtacttggcaatctgtgacgagtgttacatcacagaaatggaaatgctgttgaacgagaaaggagagtttaccatcgagacagagggcaaaacctttcagcttacaaaggatatgattaatgtaaagcgatttcaaaagactctttatgttgaagaggtcgtaccaaatgtgattgaaccgtcattcggactgggacgtattatgtacactgtgtttgagcacacattccacgtcagagagggcgatgaacagcgcaccttcttctcctttcctgcagttgtcgcccctttcaagtgttctgtgctgcccctgagccagaatcaggaatttatgccattcgttaaagagctcagtgaggccctgacccgacacggagtgtctcataaagtggatgacagtagtgggagtattgggcgtaggtatgcaagaaccgatgagatcggcgtggcctttggggtgaccattgattttgatactgttaacaaaacaccgcacactgccacattgagagatagagattccatgcgccagattagagccgaaatatccgagcttccttccatcgtacaggaccttgccaacggaaacattacttgggcagatgtagaagcccgatacccattgttcgaaggccaggaaacagggaagaaggagaccatagaggagtag

SEQ ID NO: 189671 - DNA, 555 bp, Artificial Sequence
  Description of Artificial Sequence: Synthetic coding sequence
atggccgagccccagccccccagcggcggcctgaccgacgaggccgccctgtcctgctgctctgatgctgatccatcaactaaggactttctgctgcagcaaacgatgctacgcgtgaaggaccctaagaagtccctggatttttacacccgggtgctggggatgaccttgattcagaagtgtgacttccccattatgaagttttccctctactttctggcctacgaagacaagaacgatatccctaaagagaaagacgagaagatagcctgggcattatccagaaaggccactctcgaattgacgcataactggggaaccgaagatgatgagacccagtcgtatcacaacggtaactccgatccaagagggttcggtcatatcggcatcgccgtgcctgacgtttatagcgcctgtaaaaggtttgaggaacttggcgtgaagttcgtaaaaaaacccgatgacgggaagatgaaagggctggctttcattcaggacccagacggctactggattgagatcctgaatcctaacaaaatggccacccttatgtag

SEQ ID NO: 189672 - DNA, 987 bp, Artificial Sequence
  Description of Artificial Sequence: Synthetic coding sequence
atgcggcccgtgcggctgatgaaggtgttcgtgacccggcggatcccagctgaggggcgggttgccctggctcgggctgcagactgcgaggtggagcagtgggacagtgatgaaccaatccctgccaaggagctggaaagaggcgtagctggagcccacgggctgctgtgtctgctctccgaccatgtggataagcgaatactggacgccgccggagctaacctgaaggtgatctcaaccatgagcgtcggcattgatcatctcgcccttgatgaaataaagaaacgggggatacgggttgggtatactcctgacgtgctaaccgacactaccgccgagctggcagtgagtctgcttcttaccacttgtcgacggttacccgaggcaatagaggaggtcaaaaacgggggctggacaagctggaaacccctctggctgtgtggatacggattaacgcagagcacagtgggcatcattggattggggagaatcgggcaggcaatcgcccggaggcttaagccttttggcgtgcagcgttttttgtacactgggcggcaacctagaccagaagaagccgccgaatttcaggctgagtttgtgagtacaccggagctagccgcgcaaagcgacttcatcgtcgtggcctgctccttgacccccgcaaccgagggcctgtgcaataaagatttcttccaaaagatgaaagagaccgctgtgtttatcaacatcagcaggggtgatgtcgtgaatcaggatgacctttaccaggctctcgcttccgggaaaatagccgcagccgggctggacgttacctcccctgagcctcttcctaccaatcacccgctactgaccttaaaaaattgtgtgatcctaccccacattggatccgccactcacaggacacgcaataccatgagcctattagccgcgaataatctccttgcaggcctgaggggcgaaccaatgccaagcgaactcaaactgtag

SEQ ID NO: 189673 - DNA, 1188 bp, Artificial Sequence
  Description of Artificial Sequence: Synthetic coding sequence
atgcggcccgtgcggctgatgaaggtgttcgtgacccggcggatcccagctgagggtagagttgctctggccagagcggctgactgtgaagtcgaacagtgggatagtgatgaacccatccccgccaaggaacttgagcggggggttgccggggcccacggcctgctttgtctgctgagcgaccatgtggacaaaagaatcctggatgccgcaggtgccaacctgaaagtgatatccacaatgtcagtcggtatcgaccaccttgctcttgacgaaatcaagaaacggggcattcgcgtcggctataccccagatgtgctgaccgacacgacggctgagcttgccgtgagccttctgctgaccacatgtcgtagacttccagaagctatcgaggaagtgaaaaacggtggttggacgagctggaagccactctggctgtgtggttacggccttacacaatcgactgtcggcattattggcctgggcaggatcggccaggcgattgccagacgtctcaagccttttggtgtccagagattcctctataccggacgtcagcccaggccggaagaagccgctgagttccaagcagagttcgtcagtacaccagagctggcggctcaatctgatttcattgtggtcgcatgctctttgacaccagctaccgagggtctatgcaataaggacttctttcagaaaatgaaggaaacggcagtctttatcaacatctccaggtatcctcgcgcaacgctcccttcaaagcccggcgaagaacccagcccactcctgccttcaggagactttctgcctcgaggcttactagtgcgtccccaagccgaactagccggattccacaagccaaacaaccaattgagaaattcttgggaatatacacgtccaccctacagggaggaagaacccagtgaatgggcatggccagtgtgtttttccgccgtcgctcctacaaggagaggactggctcactccagcgtcgcctccggtagcgtccctagagagcccctccaggctcattaccccccccctcagcgcgccgggttggaggatctgaaggggccgttggaagcagcatcacacacagccgagcctggcttcgtgtggctttggttcagcgatacactgaatctgatgctgttagggggacaaaccctcaaattaacctggtcctag

SEQ ID NO: 189674 - DNA, 759 bp, Artificial Sequence
  Description of Artificial Sequence: Synthetic coding sequence
atgctgggcggcgtgcccaccctgtgcggcaccggcaacgagacctggaccctactagcactcggtcaagctatcgctcgacggctgaagcccttcggcgtgcagaggtttttgtacacaggacgacaaccacgtccggaggaagccgccgagttccaggccgaatttgtctctaccccagaacttgccgcccagtctgactttattgtggtggcgtgctccctaactccagctaccgagggcctgtgcaacaaggacttcttccagaaaatgaaagagaccgccgtttttatcaacatctctcgttacccgcgtgccacattacccagcaagccaggcgaggagccttcccctcttctcccaagcggggactttcttcctagaggtctcttggttagacctcaagctgaactggcaggtttccataagcccaataatcaattgcggaattcctgggagtatactcggcccccctaccgggaagaggagccctctgagtgggcttggccggtctgtttttcagcagttgctcctacaagaaggggattggctcactcaagtgtggcttctgggagcgtgccccgcgaacctctgcaagcgcattatcccccccctcagcgtgcagggcttgaagacctgaagggacctctggaagccgcctctcatactgcagagcctggtttcgtttggttgtggtttagtgatacactgaatctcatgctcctaggtgggcagacgcttaagctcacgtggtcctag

SEQ ID NO: 189675 - DNA, 1677 bp, Artificial Sequence
  Description of Artificial Sequence: Synthetic coding sequence
atggagctgcgggcccggggctggtggctgctgtgcgccgccgccgctctggtggcttgcgctagaggcgaccccgcttcgaaatcccgaagctgcggggaagtgagacagatttacggcgcaaagggtttctccctgtccgatgtccctcaggctgagatcagcggcgaacacctgcggatttgcccccagggatacacttgttgcaccagcgagatggaagaaaacctggccaacagatcccatgctgagttagaaacagccctgagggattctagcagagttctccaagctatgttagccacacagctacggagctttgacgaccactttcagcatctcctgaacgactctgaaaggacccttcaagccactttcccaggggcattcggggagctctacacacagaatgcacgcgcatttcgcgatctgtattctgaactgcgcctatattatagaggagccaacctccacctcgaggagacacttgcagaattttgggcacgactgttagaacgcctctttaagcagctgcatcctcaattactcctgcctgatgactatttagactgcctgggtaaacaggcggaagccttgcggcctttcggggaagccccccgcgagctgaggctgagggccactcgggcattcgttgccgctcgcagcttcgtccaaggattaggggtcgcatccgacgttgtgaggaaagtggctcaggtccctctcggtccagagtgttcgcgcgccgtcatgaagcttgtttactgcgcacactgcctgggtgttcctggagctaggccctgtccagactattgcaggaacgtgctgaaaggatgcttggcaaatcaggccgatttggatgccgagtggcggaacctgctggatagtatggtccttattacggataaattctggggaaccagtggggttgagtccgtcatcggctctgttcacacctggctagctgaagctatcaatgcactacaggacaaccgagatacactcacggccaaggtgatccaggggtgtggcaaccctaaagttaatcctcagggtcctggccccgaagagaaacgcagaagaggcaaactcgcacctcgcgaacggcccccgtcaggcacgcttgaaaaactggtctccgaggcaaaggcccaactcagagacgttcaggatttctggatctctctccctggaacgctgtgttctgaaaagatggccttgagtaccgcgagtgacgaccgatgttggaacgggatggctcgaggccgttatcttccagaagtaatgggggacggtttggctaatcagatcaacaacccagaagtggaagtagacatcacgaaaccagacatgaccataagacagcagatcatgcagctgaagataatgaccaacaggttaagatctgcatataacgggaacgatgtggattttcaggatgcgagcgatgacggatctggatccgggtctggagatggctgtctggacgacttgtgtagcagaaaagtcagcaggaagagctcaagctcccggacccccctgacacatgcactccccggcctctccgagcaggagggacagaagacatcagcggcatcctgccctcagccccccacattcctgctgccactgctcctctttctcgctttgacagttgcgaggccgcggtggcgttag

SEQ ID NO: 189676 - DNA, 1743 bp, Artificial Sequence
  Description of Artificial Sequence: Synthetic coding sequence
atggccggcaccgtgcggaccgcctgcctggtggtggccatgctgctgagcttggattttccggggcaggcccagcccccaccaccgcccccagacgccacatgtcaccaggtgagatctttcttccagcgactgcagcccggactaaagtgggtacccgagacccctgtcccaggcagcgatctgcaagtttgccttcccaaggggcctacctgctgcagcaggaaaatggaggagaagtatcagttaaccgcccggctgaatatggagcaacttttacagagcgcaagtatggagctgaagttcttaatcattcaaaatgctgccgttttccaagaagccttcgagatcgtggtccgccacgcaaaaaattatactaacgcgatgttcaagaataactacccatcactaactccccaggcattcgaatttgtcggagagttcttcactgacgtctctttgtatatacttggaagcgatattaacgtagacgatatggtgaacgagttattcgatagcctgttcccagttatttacacccagctcatgaacccaggcctgccagacagcgcactggacattaacgagtgcttacggggggcgagaagggacttgaaggtcttcgggaattttccgaaactaattatgactcaggtctctaaatcactgcaggtgaccaggatttttcttcaggcacttaatctgggcattgaagttatcaacacaacagatcacctgaagttcagtaaggattgtggccgaatgttaactaggatgtggtactgcagctactgtcaaggactaatgatggtcaaaccttgcggtggatactgtaacgtggtaatgcaggggtgcatggcaggggttgtggaaatcgacaaatactggcgtgagtacattcttagtctggaagagctagtgaacggtatgtacagaatttatgacatggagaatgtactcctcggtcttttttcaacaatccatgattctattcaatacgtacagaaaaatgccggcaagctgacgaccaccatcgggaagctgtgcgcccattctcagcagcggcaatatagatctgcctattatcccgaggatctgttcatcgataagaaagtgctgaaggtggctcatgtagaacacgaagagacccttagcagccgaagaagagaactgatccagaaactgaaatcatttatcagcttctattcagcgctgcccggctacatctgttcccatagccctgtcgccgaaaacgacacattgtgctggaatgggcaggagctggtggagagatatagtcaaaaagccgcccggaacggtatgaagaatcaattcaatctccacgaactgaagatgaaaggtccggagccagtcgtctcacaaataattgataagctcaaacacattaaccagctcctgaggaccatgtccatgccaaaaggaagggtgctcgataaaaatctggatgaggagggttttgaatccggtgactgcggggatgatgaggatgaatgtatcggaggctcaggcgacggaatgattaaggttaaaaaccaactccgctttttggccgaactcgcctacgatttggatgtcgacgacgcccctgggaattctcagcaagctactcccaaagataacgaaatctccacctttcacaatcttggtaacgtgcactccccactcaagctgttaacatccatggcaatttctgttgtatgtttcttctttctggtacactag

SEQ ID NO: 189677 - DNA, 1812 bp, Artificial Sequence
  Description of Artificial Sequence: Synthetic coding sequence
atggccggcaccgtgcggaccgcctgcctggtggtggccatgctgctctccctggattttccgggacaggcccagcctccgcctcccccacccgacgccacctgccaccaggtcagatcattcttccagcgactgcagccgggccttaagtgggtgcccgaaactccagtgccaggaagcgatttacaggtgtgccttcctaaaggacccacgtgctgctctcggaagatggaggagaagtatcaactgaccgctaggctaaatatggagcagctgctccagtccgcctctatggagctgaagtttttgattatccagaacgctgcagtgttccaggaagcctttgagattgtcgtacgtcacgccaagaattataccaacgcaatgtttaagaataattacccttcccttacacctcaggccttcgagtttgttggagagtttttcactgatgtttcattgtatatccttggttctgacataaatgttgacgatatggttaatgaactctttgactccctatttcccgtcatttatacgcagttgatgaatccaggactgccagatagtgcacttgacatcaacgagtgtctgcgaggagcccgcagagacctaaaggtgtttggaaatttcccaaaattgataatgacacaggttagcaaatctttgcaggtgactagaatcttcttgcaggccttaaacctggggatcgaagtgatcaacaccaccgatcaccttaagttctctaaggactgcggaaggatgcttacacggatgtggtactgttcttattgccaagggctgatgatggtaaaaccctgtggaggctattgtaacgtcgtcatgcaaggatgcatggcgggggtggtcgagatcgataaatactggcgcgagtacatattgtcccttgaagagttagtgaatggtatgtaccggatatatgatatggagaacgtcctgctcgggttattctccacaatccacgactctattcaatacgtccaaaagaacgctggcaagttgaccaccacggaaactgagaaaaaaatctggcactttaaatacccaatcttttttctctgtattggtctggaccttcaaattggaaaactgtgtgcccattcacagcagcggcagtatcgctctgcgtactaccctgaggacctgttcattgataaaaaagtgctaaaggtggcgcacgttgagcacgaggaaactctatcctcccggcgtcgcgagttaattcagaaactgaagtcttttatttccttctattctgccctcccggggtacatttgtagtcattcaccggttgccgagaatgacacgctatgctggaatggtcaagagctcgtggagaggtatagtcagaaagcagctcggaacgggatgaaaaatcaattcaacctccacgagctgaaaatgaagggacctgagcccgtggtgagccaaataatagataaactaaagcacatcaaccaacttttgcggaccatgtctatgcccaagggacgggtactggacaaaaaccttgatgaagagggtttcgagtcgggagactgtggcgacgacgaggacgagtgtatcggaggatccggagacggcatgatcaaggtcaagaatcagctgagattcctcgcagaactggcatacgatctggatgtggacgacgcaccgggtaactcccagcaggccactcctaaagacaacgagattagcacctttcataacctgggcaacgtgcactcaccactgaagttgctgacctcaatggccatctccgtggtctgtttcttcttcctagtacattag

SEQ ID NO: 189678 - DNA, 771 bp, Artificial Sequence
  Description of Artificial Sequence: Synthetic coding sequence
tgaaagccctgcggcggctactgcaacgtggtgatgcagggctgcatggccggagtggtagaaatcgataaatattggcgggagtatattctgagtctggaggagttggttaatggaatgtatcgtatttacgatatggaaaacgtgcttctggggttattcagtaccatccatgacagcatccagtatgttcagaaaaacgccggaaaactgacgacaaccattgggaaattgtgcgctcactcccaacaaagacagtacaggagcgcctattaccctgaagatctctttattgataagaaagttctgaaggttgcccacgtagaacacgaagagaccctaagttccagacgtcgggagctcatccaaaagctgaaatctttcatctcgttctattcggcgttgcctggttacatctgctctcactcccccgtcgccgaaaatgacaccttatgctggaacgggcaggagctggtggagagatattcccagaaggctgctcggaacggtatgaagaatcaatttaatttgcacgagctgaagatgaaaggaccggagccagtagtgagtcagataatcgacaaacttaagcacatcaatcagcttctgcgcactatgagcatgccgaagggccgcgtactagacaagaatctggatgaggagggtttcgaatcaggcgactgcggagatgacgaggacgaatgtattggcggatctggcgatggaatgataaaggtgaaaaaccagctccggtttttggccggcaactag

SEQ ID NO: 189679 - DNA, 1581 bp, Artificial Sequence
  Description of Artificial Sequence: Synthetic coding sequence
atggccggcaccgtgcggaccgcctgcctggtggtggccatgctgctgagtctggactttcctggtcaagcccagcctccgcccccacctcccgacgctacctgtcaccaggtccgctcattcttccaaagattacagccgggtctgaagtgggtgcctgaaactcctgtccctgaggccttcgaaattgtcgtacggcacgctaaaaattacacaaacgccatgtttaaaaataactatccatcgctgactcctcaagcttttgaatttgtcggtgagtttttcacagatgtgtccctttacatcctaggatccgacatcaatgtcgacgacatggtcaacgaactgttcgattccctgtttcccgtcatatatacgcaactgatgaaccccgggctccctgattcggctctcgacattaacgagtgtctacggggcgcacgccgtgatctcaaagtgttcgggaactttcccaaactgatcatgacacaggtctctaaaagcctccaggtaacaagaatctttctgcaggcgctaaatctgggcatcgaagtgattaacaccaccgatcatctcaaatttagcaaagactgtggaaggatgcttacaaggatgtggtattgttcttattgccagggactgatgatggtgaaaccttgcggcggctactgcaacgtcgtgatgcaggggtgtatggccggtgtggtcgagatagataagtattggagggagtacatcttgagtctagaggagctagtgaatggtatgtaccggatttatgacatggaaaatgtgctcctgggcctgttctctaccatccatgactctatccagtatgtgcaaaaaaatgcagggaaactcacaactaccatcggcaaattatgcgcacattcacagcagcgtcagtaccgatcagcctattacccagaggatctattcatcgacaagaaagtgctcaaagtggcccacgttgagcatgaggagacactctccagccgcaggcgcgagctgatacagaaactcaaatccttcatttctttttattctgccctgccaggttatatttgctcccattccccagtcgcagaaaacgacactctctgttggaatggccaggagctcgttgaacggtatagccagaaagcagcccgtaatgggatgaagaatcagtttaaccttcacgaactgaaaatgaaggggcccgaacctgtggtttcacagattatagacaagcttaagcacattaaccagctgctgcggacaatgtccatgcctaaagggcgcgttctagataaaaacctggacgaagagggatttgagagcggtgattgtggagacgacgaggacgagtgtatcggcggcagcggggatgggatgataaaggtcaagaatcaactgcgctttctcgccgagttggcctatgatttggacgtggatgacgccccaggtaattctcagcaagccacaccaaaggacaatgagatctcgacttttcacaatttagggaatgttcactctcctctcaagctgctaaccagcatggccatttcagtcgtatgtttcttcttcctggtgcactag

SEQ ID NO: 189680 - DNA, 1671 bp, Artificial Sequence
  Description of Artificial Sequence: Synthetic coding sequence
atggcccggttcggcctgcccgccctgctgtgcaccctggccgtgctgtcagccgcactgcttgcagccgaactaaagtccaagagctgtagtgaggtgcgccgcctctacgtttccaaggggtttaacaagaatgacgcaccactgcatgagattaatggcgatcacctgaaaatatgccctcaggggtcaacgtgctgctctcaggaaatggaggagaaatactcccttcagagtaaggacgatttcaagtccgttgtgtccgagcagtgtaatcacctgcaggccgtgtttgcctctcgctataagaagtttgatgaattcttcaaggagctgctggaaaatgccgagaagtcccttaacgatatgtttgtgaaaacatatggccacctgtatatgcagaacagtgaattattcaaggatctctttgtcgagctaaaacggtattatgtcgtgggaaatgtcaacttagaagagatgttgaatgatttctgggcccgcctgctggaaagaatgttccggctggtgaattcacaataccacttcaccgacgagtatcttgagtgcgtttccaaatatacagaacagttgaagccttttggagacgtgcccaggaagctgaaattacaggtgactcgcgcttttgttgcggctcgcacattcgcgcagggccttgcggtcgccggtgatgtggttagtaaagtgtcggtggtgaatccaaccgcccaatgcacgcacgcccttttgaagatgatctactgtagccattgcagagggcttgtgaccgttaagccttgttacaactactgcagcaatattatgagaggttgtcttgcaaatcagggcgatctagactttgagtggaacaattttattgatgctatgctgatggttgccgaacggcttgaaggcccctttaatatcgagagcgtcatggatcctatcgacgtgaaaatcagcgacgccataatgaacatgcaggacaattcggtgcaagttagccagaaagtcttccaggggtgtgggcctccgaagcctttgccggctgggcggatcagccgcagtatcagcgagagcgcgttcagtgcccgcttccggccacaccaccccgaagaacgaccgactaccgctgccggtaccagtctggaccggttggtgaccgatgtcaaagagaagctgaagcaggcaaagaaattttggtcttcattgccctccaatgtttgcaacgatgaacgcatggccgccggcaacggtaacgaggacgattgctggaatgggaaaggtaagtcaaggtatttgtttgcagtgacagggaacggccttgccaaccaagggaataaccctgaggtgcaggtggacacttctaagccagacattctgatacttaggcaaatcatggcccttcgagtaatgacctccaagatgaaaaatgcctacaacggcaatgatgtggacttcttcgacatatccgacgaaagctcaggagaagggagcggctcaggttgcgaataccagcagtgcccctccgaattcgactataacgccacagatcacgctggtaaaagtgccaatgaaaaggcagatagtgccggagttaggcccggggcccaggcatatttactgacagtgttttgtatcttatttttggtaatgcagcgtgaatggcgatag

SEQ ID NO: 189681 - DNA, 1461 bp, Artificial Sequence
  Description of Artificial Sequence: Synthetic coding sequence
atggaggagaagtacagcctgcagagcaaggacgacttcaagagcgttgtcagtgagcagtgcaaccacctgcaagctgttttcgccagcagatataaaaaattcgacgagttctttaaagaattactggagaatgcagaaaagtcactcaatgatatgtttgtcaagacatatggacacctatatatgcaaaactctgaattatttaaggacctcttcgtggagcttaagcgctactacgtcgtcggtaacgttaatttagaagaaatgttgaatgatttctgggcacgtctgctcgaacgaatgtttaggttagtaaattctcagtatcacttcaccgacgagtacctcgagtgcgtgagcaagtacacagaacagcttaaaccctttggagatgtgcccagaaaacttaagctacaagtcactagggctttcgtcgcggctaggacgtttgcccagggactggcagtggcaggggatgtagtgagcaaagtttcagtggtgaatcctactgcgcagtgcacccatgcgctcttaaagatgatttactgctcacactgccgcggtctggtgaccgtgaagccatgctataattattgttctaatatcatgaggggctgcctagccaaccagggtgacctcgacttcgagtggaataatttcatcgatgcgatgcttatggtggctgagaggttggaaggtcctttcaatattgaatccgtgatggacccgatagatgtgaaaatcagcgatgccattatgaacatgcaggataatagcgtgcaagtatcgcagaaagtcttccaagggtgcggtccacctaaaccgttgcctgcaggaagaatctcgcgatcaatcagtgaatctgcattctcagctagatttcggccacatcaccccgaagagcggcccacaactgcagctggaacctcattggaccggctcgtgacagacgtcaaagagaaactgaagcaggctaagaagttctggtcctccttgccctccaacgtgtgtaatgatgagcgcatggcagctgggaacggaaatgaggacgactgttggaatggcaaaggcaagtctcgatatctcttcgccgttactggaaatgggcttgcaaatcaagggaataatcctgaggtgcaagtggacacatctaagcccgacattctgatccttaggcagatcatggcactacgcgtgatgacaagcaaaatgaagaatgcatacaatgggaacgacgtggacttcttcgatataagtgatgaaagctctggggaaggcagcggtagtggctgcgagtaccagcagtgcccttccgagttcgactacaatgccactgaccacgctggcaagtccgcgaacgaaaaggcagacagcgcaggcgttcgcccgggcgcccaggcttatctgctgaccgtgttttgtattctgttcctcgtcatgcaaagagagtggcgatag

SEQ ID NO: 189682 - DNA, 1653 bp, Artificial Sequence
  Description of Artificial Sequence: Synthetic coding sequence
atggcccggttcggcctgcccgccctgctgtgcaccctggccgtgctgtcagccgcgctactggccgcagagttaaagtccaagtcatgctccgaggtgaggaggttgtacgtttctaaaggtttcaataaaaacgacgccccgctccacgaaattaatggagaccacgaggaccttagtccgggtttctatctgctcttgagcagggatggaggctacagcctccagtcaaaagacgatttcaaatccgtcgtaagcgagcagtgtaaccatctccaggccgtgttcgcctctcgatacaaaaagttcgacgagttcttcaaggagctcctagagaacgccgaaaaatcactgaatgatatgttcgtgaagacatacggccatctgtacatgcagaactctgagttgttcaaagatctgttcgtggagctgaaacgatattatgtcgtgggtaatgtcaacctcgaagaaatgctgaacgacttctgggcccgccttctcgagaggatgttccgcctggtaaattcgcagtaccatttcaccgacgagtatctggagtgcgtctctaaatacaccgagcagcttaaaccattcggagacgtgcctagaaagctcaagctccaggttacccgggcattcgtcgccgcccgcacatttgcccagggattggccgtagctggagacgtcgtctccaaagtatccgtcccaagctgtacccacgccctgctcaaaatgatctactgctcgcactgtaggggccttgttactgtgaaaccttgttacaactactgttctaacattatgagaggctgtcttgcaaatcagggcgatctcgacttcgagtggaataacttcatcgatgctatgctgatggtcgcagagcgcctggagggcccattcaatattgagtccgtcatggacccaattgatgtgaagatttccgacgccattatgaatatgcaggataacagcgtacaggtctctcagaaggtgttccaaggctgtggcccccccaaacccttgcccgccggccgcatcagccgtagtatctccgagtcagcttttagcgctcgatttcggccacatcaccctgaagagcgtccgactacagcggccggcacctctctggacagactggtgactgatgtcaaagaaaagttaaaacaagccaagaaattctggtcatcattacccagcaatgtttgcaacgacgaacggatggctgccgggaatggcaacgaagacgattgttggaatggaaagggcaagagcaggtacctctttgcggtcacaggcaacggactggcaaaccaaggaaataaccccgaagtccaggtggatacctctaaacctgatatacttatcctcagacaaattatggctttgagggtaatgacgagtaaaatgaaaaacgcttacaatggcaacgacgtcgacttttttgacatttccgatgagagttccggagaaggcagcggaagcgggtgtgaataccaacaatgtccatcggaattcgactacaacgccactgaccacgcgggcaaatcagccaacgaaaaggccgattctgcaggtgtgagacccggagcacaggcctatctcttgaccgtcttctgtattctattcctcgtgatgcaaagggagtggcgttag

SEQ ID NO: 189683 - DNA, 1719 bp, Artificial Sequence
  Description of Artificial Sequence: Synthetic coding sequence
atggacgcccagacctggcccgtgggcttccggtgcctgctgctgcttgcattggttgggagcgctcgatcagagggggtccagacctgcgaggaagttagaaagcttttccagtggcgcctgctgggcgcagtccgagggctgccagacagtccaagggcaggccctgacttacaggtttgtatttctaagaaaccaacttgctgcacccggaaaatggaggaaagatatcagatcgccgccaggcaggacatgcagcagttccttcagacgagctcgagtaccttgaagttcctaatcagcagaaacgcggcggcttttcaggagacattggagacactgattaagcaggccgaaaactatacctccatcctgttttgttccacttaccgaaacatggccttggaagctgccgccagtgtgcaggagttctttacggacgtcggcctgtacctgttcggcgcagatgttaaccctgaagagtttgtgaatagattcttcgatagccttttccccctcgtgtataaccacctcattaaccctggggtgacagacagtagtttggagtatagcgagtgtatccgaatggcccggagagatgtcagcccctttgggaacatacctcagagggtgatgggacagatgggcaggagtctgctgcctagcaggacttttcttcaggcgctgaatctgggtatcgaggttattaataccactgactatttacacttttccaaggagtgtagccgggcattgctgaagatgcagtactgtccccactgccaaggtttagcattgacgaaaccttgtatgggctactgccttaatgtcatgaggggttgcctcgcacatatggcagaacttaaccctcattggcatgcctatatacggagcctcgaggagttgagcgatgctatgcacggcacatatgacattgggcacgtgcttctcaatttccatctcttagtgaacgatgccgtccttcaagcccacctgaatgggcagaaacttctggaacaagtgaataggatttgcgggcgacccgtgcgcacaccgacccaatcaccaaggtgctccttcgaccagtctaaggaaaagcatggaatgaagacaaccacgcgcaactcagaggagactctcgctaatcgaaggaaggaattcattaacagcctaaggctctatcgcagcttctacggcggcctcgcagatcagctctgtgcaaacgagcttgcagccgcagacggtctgccttgttggaacggggaggacatcgtgaaaagctacactcaaagggtcgtggggaatggcattaaggcacaatcaggcaacccagaggtgaaggtgaaaggcattgaccccgttattaatcagataattgacaagctcaagcatgttgtgcaattgttgcagggccgctcccccaagcccgacaagtgggagttactgcaactaggttccggcggcggcatggtggaacaggtctccggtgattgtgacgatgaggatgggtgtggaggatccggcagcggcgaggtgaaacggacactgaagattacagactggatgcctgatgacatgaattttagcgacgtcaagcagatacaccagactgacacaggttctacgctggataccacgggggccggctgcgcggtcgctacagaaagtatgactttcacactgatctctgttgtgatgctcttgcctggtatctggtag

SEQ ID NO: 189684 - DNA, 1668 bp, Artificial Sequence
  Description of Artificial Sequence: Synthetic coding sequence
atgcccagctggatcggcgccgtgatcctgcccctgctgggcctgctactgtctctgcccgcgggcgcagacgttaaagcccgctcgtgtggggaagttcgccaggcgtacggcgccaaagggttctctctggccgatatcccctatcaagaaatcgcgggggagcatctgcgcatttgtccccaggagtatacctgttgcacaacagagatggaggataaattatctcagcaatcgaagctggagtttgagaaccttgtggaagagacgagtcacttcgttagaaccacctttgtgtcccgccacaagaagttcgatgaatttttcagggaactcctggagaatgccgaaaagtccctgaacgacatgttcgttagaacttatgggatgttgtacatgcagaactcggaggtgtttcaggacctcttcacggagctgaagagatactacaccggaggcaatgtaaacctggaggagatgctgaatgacttctgggcgcggctgctggagcgaatgttccagcttattaaccctcagtaccatttctctgaagattatctggagtgcgtgagcaagtacacagaccagctcaaaccctttggtgacgtgccccggaaacttaaaattcaagtgacacgcgcgtttatagctgcacgaaccttcgtgcagggactcacggttggccgtgaggttgctaatagggtaagtaaggtctctcctacgcctgggtgcatccgcgctctaatgaagatgctttactgtccctattgccgcgggctgcccacagtgagaccttgtaataactattgtctgaatgtaatgaaagggtgtctagcaaaccaggctgatctcgacacggagtggaacttgttcattgatgccatgctacttgtagctgagcggctggaagggccctttaatattgagtccgtgatggatccaattgacgttaaaatctccgaagccatcatgaacatgcaggaaaactctatgcaggtctctgctaaggttttccagggatgtggtcaacccaagccagcaccagctctacgctcggctagatcagcgcctgagaacttcaacaccagattccgcccctataacccggaggaaagacccaccaccgctgcaggaacctcgctggatcgtctagtgaccgacattaaggagaagttgaagctcagcaaaaaagtttggagtgccctgccctacacaatttgcaaggacgaatcagtaaccgcaggaacctcaaatgaggaagaatgttggaacggacactccaaggctcgatacctgccagaaattatgaacgatggcctaacaaaccaaataaacaatcctgaggtggacgttgacatcaccaggccagacacattcatcaggcagcagataatggcattgagggtgatgactaataaacttaaaaatgcctacaacgggaacgatgtgaatttccaggatacaagcgacgagtcttctggcagtgggtccgggtcaggctgtatggacgatgtctgtcctacggagttcgaatttgtcactacggaggcgccagccgtggaccctgacagacgggaagtagattcctccgctgcccagagaggccactctctgcttagttggagcctgacttgtatcgttttggcactgcagcggctgtgtcggtag

SEQ ID NO: 189685 - DNA, 582 bp, Artificial Sequence
  Description of Artificial Sequence: Synthetic coding sequence
atgcagagcctgatgcaggcccccctgctgatcgccctgggcctgctgttggctgcacccgctcaggcacatcttaagaaaccttctcagctgtcgagtttttcctgggataattgtgacgaggggaaggaccccgccgtgatcaggtccctgacattagaaccagaccccataatcgtgcccggaaacgtcacactgtctgtaatgggctctacctccgttccactgtcaagtccactgaaagtcgacctggtgctcgagaaagaggtggccgggctgtggatcaagatcccctgcacggactatatcggaagttgtacgtttgaacacttttgcgacgtcttagatatgctgattccaacaggagagccatgtccagaacctcttcgaacgtacggactcccttgccactgcccctttaaagagggtacttatagcctgccaaagtccgagtttgttgtgccagatctcgaactacctagttggctgaccacagggaactatcgcatcgaaagtgttctgtcaagctccggcaaaagactgggatgcattaagatcgcagcaagcctcaagggcatctag

SEQ ID NO: 189686 - DNA, 1140 bp, Artificial Sequence
  Description of Artificial Sequence: Synthetic coding sequence
atgggctgcctgggcaacagcaagaccgaggaccagcggaacgaggagaaagctcaaagggaggccaacaaaaaaattgagaagcaattgcagaaagataaacaggtatatagggcaacacaccggctcttattgctgggcgctggagaaagcggtaagtctactatagttaaacagatgagaatcctccacgtcaacggatttaatggggatgagaaggcaacgaaagttcaggatataaagaataaccttaaggaggctattgagacaattgtagctgccatgtccaacctggttcccccagtagagcttgccaatcccgaaaaccaattccgtgtagactacatcctatcagtgatgaacgtgccagatttcgactttcctcccgagttctacgagcacgccaaggcgctttgggaggacgaaggggttagagcctgttacgagcgctctaatgagtatcagctgatcgactgtgcccagtacttcctcgacaaaatagacgttatcaagcaagcagactacgtgccctcagatcaggatctgctgcgctgcagagtcctcacctcaggcattttcgaaacgaaattccaggtagacaaggtgaattttcatatgtttgacgttggaggccagagagatgagcggcggaagtggattcaatgcttcaatgatgtgacagcaattatcttcgtggtggccagcagtagctataatatggttattagagaggataaccagactaaccgtcttcaggaagctctcaatttattcaagtctatctggaataatcggtggctgcggaccatcagtgtaattctgttcctcaacaagcaggaccttctcgctgagaaggtgctggctgggaagtcaaaaattgaagattactttcctgagtttgcccggtatacaacccctgaggatgcaaccccagagccaggagaagaccctcgtgtgacccgcgccaaatattttatcagagatgagttcttaaggatctccacagcatccggtgacggaagacactactgctacccccacttcacctgcgccgtggatacggagaacatacggcgtgtgtttaacgattgcagagacattatccagcgaatgcaccttcgacagtacgagctgttatag

SEQ ID NO: 189687 - DNA, 1143 bp, Artificial Sequence
  Description of Artificial Sequence: Synthetic coding sequence
atgggctgcctgggcaacagcaagaccgaggaccagcggaacgaggaaaaggctcagcgcgaggcaaacaagaagatcgaaaagcagctgcaaaaggacaagcaggtgtatcgggcaacacacagactgttgctccttggagcgggcgaaagtggtaagtcgaccatcgtgaaacagatgcggattttgcacgtgaatggtttcaacggggattcagagaaggccaccaaggtgcaagacatcaaaaataacctgaaggaagctatcgagacaatagtggccgccatgtcaaaccttgtccctcctgtggagctggccaatccagagaaccagtttcgcgtcgactatatcctttcagtcatgaatgtccctgatttcgactttccccctgaattttatgagcacgccaaggccctgtgggaggatgagggggttcgagcctgctacgagcgtagtaacgagtatcaactgattgactgcgcccagtacttcctcgacaagatcgacgtgattaaacaagccgactatgtgccaagtgatcaggaccttctacggtgccgggtgttgacttctggcatcttcgaaactaagtttcaggtggacaaggtcaactttcatatgtttgatgtagggggccagagagatgagcgcaggaagtggattcagtgcttcaacgatgtaacggccatcatctttgtcgtggcctcttcatcctacaacatggtgataagagaggataatcagacaaacaggctccaagaagcccttaatcttttcaagtccatatggaataacaggtggctgagaacgatctccgtgatactcttcctgaacaagcaggacctcctggccgaaaaggtgctggcaggtaaatctaagatagaagattatttccccgaatttgctcggtacactacaccagaagacgcaaccccagaaccaggcgaggacccaagagtcacaagagcaaaatatttcattcgggacgagttcctccgcatctccacagcaagtggcgacgggcgccactactgctaccctcatttcacctgtgcagtagacacggagaatattcgccgtgtgttcaatgactgccgtgacattattcagagaatgcatctgagacagtacgagctgttgtag

SEQ ID NO: 189688 - DNA, 738 bp, Artificial Sequence
  Description of Artificial Sequence: Synthetic coding sequence
atggaccggcggagccgggcccagcagtggcggcgggcccggcacaactataacgacctgtgtcctcccatcggacgtagggccgccactgccctgctgtggttgtcttgctcgatcgctctcctcagagcgttggccacctccaacgcacgcgcacaacaacgtgctgccgcacaacagagaaggtctttcttgaatgctcaccataggtccggcgctcaggtgtttcctgagagcccagagtctgagagcgaccatgagcacgaggaggcagacctggagctttccttgccagaatgcctagagtatgaggaagagttcgactacgaaacagagtccgagaccgagtccgaaattgagtcggagaccgacttcgaaacagaaccagagaccgcacctaccaccgaacccgaaaccgaacctgaagacgaccgcggtccagtggtgcccaaacactctacatttggacagagtcttacccagcgccttcacgctctcaagcttaggtcccccgatgcatccccatcccgggccccaccctcaacacaggagcctcagtcgcctcgagaaggcgaggagttgaagcctgaggacaaggacccacgcgacccggaagaaagcaaggagcccaaagaagagaaacagcgccggaggtgcaagccaaagaaacccacgagacgcgatgcgtcaccggaatcaccttcaaaaaagggccctattccaattcgcagacactag

SEQ ID NO: 189689 - DNA, 1188 bp, Artificial Sequence
  Description of Artificial Sequence: Synthetic coding sequence
atgggctgcctgggcaacagcaagaccgaggaccagcggaacgaggaaaaggcccagcgtgaggccaacaagaagatcgagaaacagcttcagaaggataaacaagtgtatcgggccacccatagactcttgcttcttggcgccggcgagtctggcaaaagcaccatcgttaaacagatgcgaatcctacacgttaacggttttaatggagagggcggagaggaggatccgcaggcagccagatccaactctgacggctcggaaaaggccaccaaggtccaagatatcaagaacaacctaaaggaggcaatcgaaacaattgtcgcagccatgtccaatctagtcccaccagtcgagttggcaaatcccgagaatcagttcagagtagattacatactgtctgtaatgaacgttccagattttgactttcctcctgaattttacgagcacgcaaaagctctctgggaggacgagggtgtccgtgcctgctatgaacgatctaacgagtatcagctgattgactgcgcccagtattttctggacaaaattgacgtaattaaacaggctgactacgtcccgagcgaccaagacttgctgcggtgcagggtgttgacaagcggaatcttcgagacgaagtttcaagtggataaagtaaacttccatatgttcgacgtgggagggcagcgggacgagagacgcaaatggattcagtgcttcaacgacgtgacggctattatcttcgtcgttgctagctctagttacaatatggtgatccgcgaagataaccagaccaatagattacaggaagcgctgaatctcttcaaatcgatttggaacaatcgctggttacgcacgatcagtgtgattcttttcttgaacaagcaggacctcttagccgagaaagtactggccgggaagagcaagatagaggactatttccctgaatttgccaggtatactacaccagaagacgcgactcccgagcctggcgaggatcccagggtgacccgtgccaagtattttattagagacgaatttctgaggatctccactgccagtggcgatggtcgacactattgttatcctcacttcacgtgtgcagtggacacggagaacattcgcagagtcttcaatgattgtcgggacatcattcagcgcatgcacttacggcaatacgagctgctctag

SEQ ID NO: 189690 - DNA, 738 bp, Artificial Sequence
  Description of Artificial Sequence: Synthetic coding sequence
atggaccggcggagccgggcccagcagtggcggcgggcccggcacaattacaacgacctctgcccacctattggaaggagagcagctactgcactgctatggctgtcctgtagcattgccctcttgcgagctctcgctacctcaaacgcgcgggcacaacaacgggctgctgcccaacagcggcgcagctttctcaatgcacatcaccggagcggggcacaggtgtttccggaatcccctgagagtgagtccgatcacgagcacgaggaggccgacctggaattgagtcttccagaatgtctcgagtacgaggaagagtttgattatgagaccgaatccgaaacggagagtgagatcgagtctgaaacagactttgagactgaacccgaaactgctcctacgaccgagcccgaaaccgagccggaagatgaccgtgggccagtggtacctaagcacagtacctttggacaatcactcactcagcgccttcatgcattaaagctgagatcccccgatgcttccccctcacgggctccacctagtacccaagaaccacagtcccctagggagggcgaggaactcaagccggaagataaggaccctcgcgaccctgaggagtcaaaagagcccaaggaggagaagcaaagaagaagatgtaaacctaaaaagccaactcgccgggacgccagtcccgagtcgccatccaagaagggtcccattcccattaggcgccactag

SEQ ID NO: 189691 - DNA, 483 bp, Artificial Sequence
  Description of Artificial Sequence: Synthetic coding sequence
atgggctgcctgggcaacagcaagaccgaggaccagcggaacgaggagaaagcccaacgcgaggccaataaggaggacaaccagacgaaccggctccaggaagcccttaacctgttcaagtcaatctggaacaataggtggctccgcactatttcagtgattctgttcctaaataagcaggacctgctcgcggagaaggtgctggctggtaaaagcaagatagaggattactttccggaattcgcaagatataccacgcctgaggatgctactcccgagccgggtgaggatccccgagtgacaagggccaagtatttcataagggacgaatttctaagaatatcgacagcgtccggagatggccgccactattgctatccccattttacttgcgcagtcgatacagaaaacatacgccgtgtgtttaacgactgcagggatattatccagcgaatgcatttaaggcaatatgagttgctgtag

SEQ ID NO: 189692 - DNA, 1185 bp, Artificial Sequence
  Description of Artificial Sequence: Synthetic coding sequence
atgggctgcctgggcaacagcaagaccgaggaccagcggaacgaggagaaggcgcagcgggaggccaacaaaaaaatcgagaagcaattgcaaaaagataagcaggtgtaccgcgccacgcacaggttactccttctgggtgctggggagagtggaaaaagcaccatcgtcaagcagatgagaattcttcacgtgaatgggttcaatggtgaggggggtgaggaggatcctcaagccgctcggtcaaattctgacggggagaaagccaccaaagtgcaagatataaaaaacaacctcaaagaggccatagaaaccatagttgccgccatgagcaacctcgtgcctcctgtagagctcgctaaccccgagaaccagttccgtgtggactatattttatctgttatgaacgtccctgatttcgattttcctccagagttttatgagcacgccaaggctttatgggaagacgagggtgttcgcgcttgttacgaacgctccaacgagtatcagttgattgattgtgcccagtactttctggacaagattgacgtgatcaagcaggccgactacgtgccttccgaccaggacctgctgagatgccgggttctgacaagcggtatcttcgaaaccaaattccaagtggacaaggtcaactttcacatgttcgacgtgggagggcagagggatgagcgcagaaaatggattcaatgtttcaatgatgtgacggctataatcttcgtggtggcttccagcagctacaatatggtcatccgtgaggataatcagacaaacaggctgcaggaagcactcaatctttttaagagcatctggaacaataggtggcttaggaccatctctgtgatcctgtttcttaacaagcaggacctgttagccgagaaagttctggccggcaaatctaaaatagaggactactttcccgagtttgctcgatatacaacccctgaagatgctacccccgaacctggggaggaccctagggtgactagggccaagtatttcataagagatgaattcctccggatctccaccgcttccggcgatggacgccattactgctacccacattttacctgcgctgtggatactgaaaacatcagacgcgtgtttaatgactgtagggacatcattcaacggatgcatctgcggcagtatgagttactgtag

SEQ ID NO: 189693 - DNA, 1143 bp, Artificial Sequence
  Description of Artificial Sequence: Synthetic coding sequence
atgggctgcctgggcaacagcaagaccgaggaccagcggaacgaggagaaggcacaaagagaggctaataaaaaaatagaaaagcagttgcaaaaggacaagcaagtctatcgagccactcatcgcctgctgctcttgggcgcaggcgagagcgggaaaagcaccatagtgaagcaaatgagaatacttcacgtcaatggattcaacggcgatagcgagaaggctactaaagttcaagacatcaagaataacttgaaagaagccattgaaaccatcgtcgcagcgatgagtaatctggtccctcccgtggagctggcaaatccggagaatcagtttcgggtggactacatcctgtccgtgatgaatgtcccagactttgatttcccgcccgagttttacgaacatgccaaagccctttgggaggatgagggcgtccgcgcatgctatgagaggagcaatgaatatcagctcatagactgtgcacagtactttctagacaagatcgatgtcatcaagcaggcggactatgtcccaagcgatcaggatctcctgcggtgtagggtgctcacgagcggaatctttgagactaagttccaggttgacaaggttaattttcacatgttcgacgtcggaggacagcgcgatgagcggagaaagtggatccaatgcttcaacgacgtgactgccattatttttgttgtcgcctcatcttcctacaacatggtgatccgagaagataaccagaccaaccgtctgcaggaagccctgaatctgttcaagtcgatctggaataaccgctggttgcgcacgatatccgtgatactgttcttgaacaaacaagatctgctcgcggaaaaggtacttgccgggaagtccaagatcgaggactacttccctgaatttgcccggtatactaccccagaagatgccacccctgaacctggcgaggaccctagagtcacccgggctaagtattttattcgggatgagtttctcaggatcagcactgcatctggagatggacgacactactgttacccacatttcacatgcgccgttgacacggagaacatcagacgagtttttaacgattgtagggacattattcagcgcatgcatttgcgccagtacgagctcctgtag

SEQ ID NO: 189694 - DNA, 738 bp, Artificial Sequence
  Description of Artificial Sequence: Synthetic coding sequence
atggaccggcggagccgggcccagcagtggcggcgggcccggcacaactataatgatttatgtcccccaatcggacgcagagctgctaccgcattactgtggctcagctgttccattgcgcttcttcgagctctggccacgtcaaatgcacgggcacaacagagggctgcagcacagcaaaggagatcctttcttaacgctcatcaccgcagtggtgcacaggtctttccagagtcacccgagtccgagagcgaccatgaacatgaagaggctgatctcgaactgtctcttccagaatgcctggaatatgaggaggagtttgactacgaaaccgaatccgaaactgagtctgaaatcgagtcagaaactgactttgaaactgagccagaaactgcacccactaccgaacctgaaactgaacccgaagacgacagaggccccgttgtccctaaacactccaccttcggtcagtccttgacccaaaggctgcacgctctgaagctgaggtcccctgatgcttctccttcaagagctcctccctcaactcaagagccacagtccccccgagagggagaggagctcaagcccgaagacaaagacccccgtgatcccgaagaatcaaaagagcctaaagaagagaagcagcggcggagatgtaagcctaaaaaacctacccggcgtgacgcctcccccgagtccccctcaaagaagggaccaattccaatacgccgtcattag

SEQ ID NO: 189695 - DNA, 3114 bp, Artificial Sequence
  Description of Artificial Sequence: Synthetic coding sequence
atgggcgtgcggaactgcctgtacggcaacaacatgagcggccagcgtgacattccacccgagatcggggagcagcctgagcagcctccactggaggctcccggggccgcagcacccggcgctggccctagcccagccgaggagatggagaccgagcccccccataacgagcctattcccgtggagaacgatggggaggcctgcgggccacctgaagtgagtcgccctaactttcaggttttgaatcctgcgttcagggaagctggtgctcatggaagctattctccgccgcctgaagaagccatgccgttcgaagccgagcagccatctctgggagggttttggcctaccctcgaacaaccagggtttcccagtggggtccacgcaggtctagaagctttcggcccggcactgatggagcccggcgcgttttccggggcacgaccaggtctgggcggttactcaccccctccagaagaagcaatgccctttgagtttgaccagccagcgcaacgcggctgcagtcagcttctacttcaagtgccagaccttgctccagggggacctggcgctgctggcgttcccggagccccccctgaagaaccccaggctcttcgccctgctaaggctgggagcaggggaggatattcaccacctcccgaggagaccatgcctttcgaattagacggcgagggatttggtgatgactctccaccacctggtctctcccgggtgatcgctcaggtcgatggctctagtcaattcgccgctgtggccgcctcatcggcagtgcggctcacccccgcagccaatgcaccacctttgtgggtacccggagcaattggctccccttcacaggaagccgtacgtccaccgagtaattttaccggctcgtccccgtggatggaaatcagtgggcctccttttgagatcggctccgccccagctggagtcgacgataccccagtcaatatggactctccccccattgcactagatggaccacctataaaagtgtcaggggccccggataaaagagaacgggctgagcgcccaccagtggaagaggaggccgcagagatggagggggctgctgacgccgctgagggcgggaaggtgccatctcccgggtatggatcgcctgcggcgggggccgcctctgccgacacagccgcacgcgccgcgccagcagctccagctgacccagattcgggcgcgactccagaagaccccgatagcgggactgcacctgccgaccccgactctggcgctttcgcagccgaccccgatagtggcgcagctcctgcagcaccggctgacccggacagtggggctgctccagacgcccccgccgaccccgacagtggcgcggctcctgacgccccagcagatccggacgccggagctgccccagaggcacctgccgctcccgccgctgcggaaaccagagcagctcatgttgctccagcggcgccagacgccggcgctccaaccgcccccgctgcaagtgcaactcgcgctgcacaggtgaggcgagctgcgagcgctgccccggcatcgggcgctagacgtaaaatacatctccggcccccttctcccgagattcaagctgccgatccgccgactccgcgccctactcgcgccagcgcgtggcgtggcaaaagcgagtcctcgaggggtagacgggtgtattatgatgagggcgttgccagctctgacgacgacagttctggggacgaatccgatgatggtacatcaggctgccttcgctggtttcaacacaggagaaaccgacggcgtcgcaaaccacagagaaaccttcttcggaacttcctggtacaagccttcgggggatgtttcggtagatctgagtccccccagcccaaagctagccggtcccttaaagtgaagaaagttccgctggccgagaaacggaggcagatgcgcaaggaagctcttgaaaaacgcgctcagaagcgcgccgagaaaaagcggagcaaacttatagacaagcagttacaagacgagaagatggggtacatgtgtacccacagactgctgcttctgggcgccggggagagcggcaagagcaccattgttaaacagatgagaattcttcacgtcaatggatttaacggagagggcggagaagaggacccccaggcagcacggagtaactccgacggcgagaaggcaaccaaagttcaggatattaagaataacctcaaggaggccatcgaaaccatcgtggccgccatgtccaacctggtacctcccgtagaactggcgaaccctgagaaccagtttagggttgactatattttgagcgtgatgaacgtgccggatttcgactttccccctgagttctacgagcacgctaaggccctatgggaggatgagggtgtgcgggcttgctacgaacgcagcaatgagtaccaattgattgattgtgcccaatattttctggataagatagatgtcatcaagcaggctgattacgtaccatcagatcaggatttgctgcggtgcagggtcctgacgtccggtatttttgagactaaatttcaggtggacaaggtaaatttccatatgttcgatgtggggggccagagagatgaaagaaggaagtggatccaatgtttcaacgatgtgactgcaattatttttgttgtggccagttctagctataacatggtgatcagagaggacaaccagaccaataggctgcaagaggccctgaacctcttcaaaagcatctggaacaaccgctggctgagaacaatcagtgtgatactgttcctcaacaaacaggatttgctcgccgaaaaagttttggcaggcaaatccaaaatcgaggactatttccctgaattcgccaggtacaccaccccagaggacgcgactcctgagcctggagaggatcccagggtgacccgagctaaatatttcatccgtgacgagttcctgaggatctcgaccgcaagtggcgatgggaggcactattgctaccctcattttacatgcgctgttgacacggagaacatcagacgggtgtttaacgactgtcgtgacatcattcaacgaatgcacctgcgccagtatgaactcctgtag

SEQ ID NO: 189696 - DNA, 342 bp, Artificial Sequence
  Description of Artificial Sequence: Synthetic coding sequence
tgaaccaccgagcccgagaccgagcccgaggacgaccggggccccgtggtgccaaaacattccacctttggacagagtctgacacagcgcttacatgctcttaaacttcgctctcctgacgcttctccgagtagagcccctccaagcacccaggagccccagagcccccgcgagggtgaggaactgaagcctgaagacaaggacccccgggacccggaggagtcaaaggaaccgaaggaggaaaaacagagacggcggtgcaaacccaaaaaacccacacggagggatgccagcccagagtcaccaagcaagaaggggcctatccctatccgccgccattag

SEQ ID NO: 189697 - DNA, 501 bp, Artificial Sequence
  Description of Artificial Sequence: Synthetic coding sequence
cccgagagcgagagcgaccacgagcacgaggaggccgacctggagctctccctgcctgagtgcttagaatacgaggaggagttcgattacgagactgaatctgaaactgagagcgagattgaaagtgagactgattttgaaacagaacccgagaccgcccccaccaccgagccagagacggaacctgaagacgatagaggccccgtagttccaaagcactctaccttcggccaatcccttactcagcgcctgcatgccttgaagttaagatcgcccgacgcatctcctagccgcgccccaccttcaacacaggagccccagagtccccgggaaggcgaggaactgaagcccgaagataaagatccacgggatcccgaggagtctaaggaacccaaggaagagaaacagagaaggaggtgcaagccgaagaagcccacacgccgcgacgcgtcccctgaatcaccctccaagaagggacccatacccataagaagacattag

SEQ ID NO: 189698 - DNA, 5580 bp, Artificial Sequence
  Description of Artificial Sequence: Synthetic coding sequence
atggtggacaagaacatctacatcatccagggcgagatcaacatcgtcgtcggagccattaaacgaaacgctagatggtcaacacacactccactggacgaggaacgcgaccccctcctgcactcattcggacatctgaaagaggtcttgaatagcattactgagctctctgaaattgaacctaatgtgttcctgcgaccattcttggaggtgatccggtccgaagataccacaggtcccattaccggtctcgcgcttacaagcgtgaataagtttctgtcctatgccctcatcgacccaacccacgagggaactgccgaggggatggagaacatggctgacgccgtgactcacgcaagattcgtgggaacggaccctgcgtcagacgaggtcgttcttatgaaaatcctgcaagtacttcgcaccctcctactgacccctgtgggggcccacttgactaatgaatctgtgtgtgagataatgcaatcttgctttagaatctgttttgaaatgcggctgagtgagctactgaggaaaagcgctgaacatacgctggtggatatggtacagctgctgttcactcgcctgccccagttcaaagaagagcccaagaattacgtcgggacgaacatgaagaagttaaagatgcgggccggagggatgagtgacagtagcaaatggaaaaaacagaaaagatctcctagaccaccacggcacatgacaaaagtcacaccaggatccgagttacccactcctaacgggactacgttgtctagcaacctgactggtggaatgccctttatagatgtaccaactccaatcagcagcgcctcttcagaggccgcatcggccgtcgtgagtcctagcactgatagcgggctggagtttagttcacaaacaacttctaaggaagatctcacagatttggaacagcccggatcccctgggtattctactgcgacagagcctggttcatctgagttgggagtgccggagcagccggaccttcaagagggaacgcacgttgagaagtcccagtctgcctcagtggaaagcatccccgaagtgctagaggaatgtacaagccccgccgaccactccgattctgccagcgttcatgatatggattacgttaacccgaggggtgtgcgcttcacacagtcaagccagaaggagggaacggccctggtgccctatggcttgccttgcattcgtgagttgttccgctttcttatctctctcaccaacccccatgatcgacacaactctgaagtgatgatccatatgggactccatctgctgacggtcgcccttgaaagcgctccagtggcccaatgccagaccctccttggcctaataaaagacgaaatgtgtagacatttgttccaactgttaagtatcgaaaggctcaatttgtacgctgcatctcttagggtctgctttctgctttttgagagtatgagagagcatctcaaatttcagatggagatgtacatcaaaaagctgatggaaatcatcactgtcgagaatcccaagatgccatacgagatgaaggagatggctctagaggccatcgttcaactgtggagaattccatccttcgtcactgaactttatattaattacgattgcgattattattgttcaaacctcttcgaagagctaacgaagcttttgagcaagaatgcttttcctgtaagcgggcagctttataccacccatctgctaagcttggacgccttgcttactgtcattgattctaccgaagcccactgccaggcaaaggttttgaactcattgacccagcaggaaaagaaggagactgctcggccctcctgcgagattgttgatggcacaagggaggcatccaacacagaacgaactgctagtgatggaaaggcagtggggatggcctctgacattcccggactccacctacctggcgggggcaggctgccccctgagcatgggaaaagcggctgtagtgatttggaagaggcagttgatagcggcgcagataaaaaatttgcccgaaaacctcccagattttcgtgtctgttacccgaccctcgggaacttatcgaaattaagaataagaagaaacttctgatcactggcacagagcaattcaaccagaagcctaaaaaagggatccaattcctccaagaaaagggcttacttacgatccctatggacaatacggaggtcgcgcagtggcttcgagagaacccccggctggataagaagatgatcggtgaatttgtgtcagatagaaagaatatagatttactcgagtcctttgtttcaacttttagcttccagggcctgagattggatgaggccctccgcttgtaccttgaagcattcaggctgcccggagaggccccagttattcagcgacttctggaggctttcaccgaacgctggatgaattgtaatgggtcaccattcgcaaactccgacgcatgtttcagtctggcttatgcagtgattatgctcaatacggaccaacataaccataatgtaagaaagcaaaatgccccaatgactttagaagaattccgtaagaacctcaagggagtgaacggcggaaaagattttgaacaggacatactggaggatatgtaccatgctatcaagaacgaggagatcgtcatgccggaagagcaaaccgggctcgtgcgagagaactatgtgtggaacgtgttactccaccgcggggcaaccccggagggcatcttcctgcgtgttcctaccgcaagttacgatctcgacctgtttaccatgacgtggggaccaaccatagccgctctaagttatgtgtttgacaagagcttagaggagacaataatccagaaagcaattagcgggtttcgtaagtgtgctatgatatccgcccattacggactttctgacgtcttcgataatttaataatcagcctatgtaagttcaccgcccttagtagcgaatcaattgaaaacctaccatcagtctttggatctaatcctaaagctcatattgctgccaaaaccgtgtttcatctggcacatcggcacggagacatcctgcgggagggatggaaaaatattatggaggccatgcttcagctttttagagctcaactcctgccgaaagccatgattgaggtggaggactttgtggacccgaatggaaaaatctccttgcagagagaggagacgccgtctaacaggggcgaatctactgtgctgtctttcgtaagctggttgactctgagtggacctgaacaaagttcggtgcgcggacctagcaccgagaatcaggaggcgaagcgggtggctctcgaatgcattaaacagtgcgaccccgaaaagatgatcacagagtctaagttcctgcaactggagtctttgcaggagctgatgaaggctcttgtgagtgtaacccccgatgaagagacttacgatgaggaagacgcggccttctgcctagagatgttactgagaattgtgctggaaaatcgcgacagagtcgggtgcgtttggcaaaccgtgcgcgaccacctataccatttgtgcgtgcaagctcaagatttctgttttttggtagagcgcgcagtcgtgggcctcttgagattggctattcgcctgctccgtagggaagaaattagcgcgcaggtgttactttcgctgcggatcctgctgctgatgaaaccaagtgtcttgtcaagggtgtcccatcaagtggcttatggactgcacgagctacttaaaactaacgctgcaaatattcattccggagatgactgggccaccctctttactctgctcgagtgcatcggctctggggtgaagcctcctgccgctctgcaggctaccgcgcgcgctgacgctcctgatgctggcgctcaaagtgatagtgagcttccatcctatcaccaaaatgacgtttctttggatcgaggctatacctcagactccgaggtgtatactgatcacgggcgaccaggcaagatccacagatcggcaactgatgctgacgtggtgaattctggatggctcgtggtgggaaaggacgacgttgataactctaaacctggcccatccagacctggaccctcccccctcattaaccaatattctctcacagtaggactcgacttaggacctcatgataccaaaagcttacttaaatgtgttgagtctctgagctttatcgtgcgcgatgccgctcacatcacacccgataactttgagttgtgcgttaagacgctgcggatcttcgtggaagcgtctttgaatggcggctgtaagagtcaggaaaagcgtgggaagagccataagtacgacagtaaaggcaaccggtttaagaaaaaatcaaaggagggaagcatgttgcgacgccctcgcacgagctcccagcacgcatccaggggagggcagagtgacgacgacgaggatgagggggtccccgcatcctaccacaccgtgtccctgcaagtttctcaagacctgttggatctgatgcatacactgcataccagagccgcgtcaatttatagttcttgggccgaggagcaacgccatctggagaccggcgggcaaaagattgaagcagatagcaggacactctgggcccactgctggtgtcccctgctgcagggcatcgcatgtttgtgttgcgacgcaaggcgccaggtgcgcatgcaggcccttacatatttacagcgcgcacttctagtgcatgacttgcaaaagttagatgctctggaatgggaatcttgcttcaataaagtgttatttccccttctgacaaaattattagagaacatttcccccgccgacgtgggaggaatggaagagacacggatgcgggccagcactctgctgtcaaaagtgttcctccagcacctgagcccattgttgtctctgtcgaccttcgctgctttatggctgactatcctcgactttatggataagtacatgcacgccgggagtagcgaccttctatcagaggcgatcccagagtctctaaagaatatgctgctcgtaatggataccgccgagatcttccatagcgctgacgcccgaggtggtggaccctctgcgctttgggagatcacctgggaacggatcgattgttttctgcctcatcttcgagacgagctgtttaagcagactgtgatccaggacccaatgcccatggaaccacaaggtcagaaaccactggcatccgctcacctcacaagcgccgccggcgacacacggacacccggacacccccccccccccgagatcccctctgagttaggtgcctgtgacttcgaaaagcctgaatcaccgagagctgcctctagcagcagcccaggcagtcccgtggcctcttctccttcaagactgtctcctaccccggacgggcccccacctttggctcagccccctctcattctgcaacccctggccagcccactgcaggtgggtgtgccccccatgacactccctataatcttaaatcctgctctcatcgaggctacttctccagttccacttttagctaccccccgacctaccgatcccattcctaccagtgaggtgaactag

SEQ ID NO: 189699 - DNA, 1749 bp, Artificial Sequence
  Description of Artificial Sequence: Synthetic coding sequence
atgggcggcagcagccccgtgaccagcaaggccatcgtggacgccgatggtcgaatttacatccgtaactggcaagggggtatcctctccggcggattcgagaaaaatcctaaaccaatctttactgagggcaagaaccagctggagatccagaacctgcaggaagactgggatcacttcgagcctttgctgagttcacttctgagacgaatgcctgaattggagaccctggagattatgaagttagttaattgtccagagacatttactccggatatgagatgcattatgggagagagtccagccgtacagggctattttgtactcgctgggatgaacagcgccggcctatcattcggcgggggagctggcaaatatctggccgagtggatggtgcacggctatccgtctgagaatgtatgggagctggatcttaagcgctttggggcgctgcaaagttcaaggacgtttctgcggcaccgagtcatggaagttatgcctctaatgtacgacttgaaagtccctcggtgggactttcaaacaggcaggcagctgagaaccagtccgctgtacgatcggttagacgcacagggggcccgctggatggagaagcatgggtttgaaaggccaaagtacttcgttcccccagacaaggaccttctggccctcgaacagtcgaagacattttacaagccagattggttcgatattgttgaatcagaggtgaaatgttgtaaggaagccgtgtgcgttattgacatgtctagcttcactaagttcgagatcaccagcaccggagatcaggccctagaggtcctgcagtatctcttttccaacgaccttgatgttccagttggtcatatcgtccataccgggatgctcaacgagggcggaggttacgagaacgactgctcgattgctcgactgaataaaagaagtttttttatgatttcaccaacagaccagcaagtgcactgttgggcttggctgaaaaaacatatgcctaaggattccaatctgctcctagaggatgtgacctggaaatataccgccttaaatctcattggccctagggcagtggacgtcttaagcgagctatcatacgcccctatgacaccagaccattttccgtctttgttctgcaaagagatgtctgtaggctatgctaatggcatccgcgtgatgagtatgactcataccggagagccgggctttatgctctatatcccgattgaaggcatggatttcatcggcagagacgctttactgcaacaaaagcaaaatggggtgtacaaacggttgacaatgtttattttggacgatcacgacagcgacctggacctgtggccgtggtggggagagcccatttataggaacggacagtacgtgggcaaaaccacttcctctgcctattcttacagcctcgaacgccatgtgtgtctgggcttcgtgcacaactttagcgaagatactggcgaagagcaagttgtgacagccgatttcattaacagaggcgagtacgaaatcgacatcgcaggatatcgttttcaggccaaagctaagctgtatcccgtggcaagcttattcacccagaaacgaagaaaagatgatatggagctgagtgccttcttagctctcccacccccccctcctaacatccattctggtttgttctttccctcccatcctagcctgtctttttcctggtggcaagaagtctgtctgacaggacaaaagcaagctccgtag

SEQ ID NO: 189700 - DNA, 3540 bp, Artificial Sequence
  Description of Artificial Sequence: Synthetic coding sequence
atggccgcctgcggccgggtgcggcggatgttccggctgagcgccgccctgcatttgttactgttgttcgcagccggggccgaaaagttgccagggcagggcgttcacagtcaaggacaagggccgggcgcaaacttcgtatctttcgttgggcaggcgggtggaggtgggccagctggccaacagcttccccagctgccccaaagcagtcagctgcagcaacagcagcagcagcaacagcagcagcaacagccacagccaccccagcccccatttcctgctggtgggcctcctgctaggaggggcggcgcaggcgccggtggtggctggaagctcgcagaggaagagtcttgtcgcgaagacgtaacacgggtctgtccaaaacacacatggtccaacaatctggcagtgcttgaatgtctccaggacgtgcgagaacctgaaaatgagataagttcggactgtaatcacctactgtggaactacaagctaaacctcacaactgaccctaaattcgaatctgtggcacgagaagtctgtaagtctacaataaccgagattaaggagtgcgccgacgagcctgtgggtaagggatatatggtgtcatgtttggtagatcaccgcgggaacatcactgagtaccagtgtcaccagtatatcaccaagatgacggcgattatttttagcgattaccgacttatttgcggatttatggacgactgcaaaaatgacatcaatatattgaaatgcggctcaattaggctcggagaaaaggatgcccacagccagggtgaagtggtgtcctgcctggagaagggcttggtcaaagaggcagaggagagagaaccaaagatccaggtatccgagctgtgcaaaaaagccatccttagggtggccgagctttcatcagatgattttcacttggatcgccacctctactttgcctgtcgcgacgacagggaaaggttctgcgagaacactcaggccggcgagggacgggtttataagtgtctcttcaatcacaaattcgaggaaagtatgagtgagaaatgcagagaggcacttacaacacggcagaagctgattgcacaggactacaaagtttcgtattcactggctaaatcttgcaagagcgacctgaagaaatatagatgcaatgtggagaatctcccccgctctcgcgaggcgcggctgtcctacttactcatgtgcttggaaagtgcggtacacaggggtaggcaggtaagttccgagtgtcaaggtgagatgctagactaccgccgaatgttaatggaggacttttcattatcaccagagatcatactgtcttgtaggggagagatcgagcaccactgtagtggattacatcggaaaggtcgcaccctgcactgcttaatgaaggtcgtgagaggtgagaagggcaacctcggcatgaactgccagcaagccctccagaccctgatccaggaaacagatccaggcgctgattatagaattgaccgcgcacttaatgaagcctgtgagtcagtcatccagaccgcctgtaaacatatccgctctggagaccctatgattctgagctgcctgatggaacatctttacaccgaaaagatggtagaggactgcgagcacagactgctggagttacagtacttcattagccgcgactggaaattggacccagtgctgtaccggaagtgtcaaggtgacgccagtcgactttgccatacgcacggatggaatgagacgagcgagtttatgccacaaggagctgtcttctcctgtctgtatcggcacgcctaccgcaccgaagaacagggtcggcgattgtctcgggagtgtcgcgccgaagtgcagagaatccttcaccagagggctatggacgtgaaactggatccagctctgcaggacaagtgccttatagacctgggcaagtggtgctccgagaagaccgagacggggcaggagctggagtgcctgcaggatcatctggatgatttagtagtggaatgcagggacattgtgggtaatctgaccgaactagaaagcgaggacatacagatcgaagctcttctaatgcgtgcctgtgagcccataatccaaaacttctgtcatgatgtggccgacaatcaaattgacagtggggacttaatggaatgtttgatccaaaacaagcaccagaaagatatgaacgagaagtgcgccataggtgtgactcacttccagttggtgcaaatgaaggatttcagattctcctacaaatttaaaatggcttgcaaggaggatgtgttgaaattgtgcccgaacataaaaaagaaggtcgatgtggtcatttgcttgtctaccactgtccggaacgacaccctgcaagaagccaaggaacaccgagtgtcactaaaatgtcgccgccagcttcgggtggaggagctggagatgaccgaggatatacggcttgaaccagatctgtacgaggcttgcaaatccgacatcaagaacttctgcagtgccgttcagtacggcaatgctcagataattgaatgtctaaaagagaataaaaagcagctcagtacaagatgtcaccagaaggtcttcaaactccaggagaccgaaatgatggaccccgagctggactacaccctgatgcgcgtgtgtaagcagatgattaagagattctgccctgaggccgattccaaaaccatgctgcagtgtctgaaacagaataagaactcggaactcatggaccccaagtgcaaacagatgatcaccaagcgccaaattactcagaacaccgattacagactcaaccctatgcttaggaaggcatgtaaggccgacatccccaaattttgtcacgggattctgactaaggctaaggacgacagcgagttggaggggcaggtcatatcatgtcttaaattacgatatgcagatcaaagactgagttctgattgcgaggatcaaattcggataataatccaggagagtgccctggattaccgattggatccccagctgcaattgcactgctcggatgagattagcagcctgtgtgccgaagaggcagccgcgcaagagcagaccgggcaggtggaagagtgcctgaaggtgaacctcctgaaaattaagaccgagttatgcaagaaagaagtgctcaacatgctgaaagagtcgaaagccgatatttttgtcgaccccgtgctccacacagcctgtgcgctcgacatcaagcatcactgcgccgctattactccaggcagggggaggcagatgtcctgcctcatggaggctctggaggataagagggtccgtctgcagccagaatgcaagaagagactcaatgatcggatcgagatgtggtcttacgctgcaaaagtggcacctgccgacggatttagcgatctcgcaatgcaggtaatgacctccccaagcaaaaattacattcttagcgtgatctcagggtccatctgtatactgtttctcatcggtcttatgtgcggtcgcatcacaaagcgtgtcacaagggagttaaaggaccgatag

SEQ ID NO: 189701 - DNA, 3579 bp, Artificial Sequence
  Description of Artificial Sequence: Synthetic coding sequence
atggccgcctgcggccgggtgcggcggatgttccggctgagcgccgcacttcacctgctgttacttttcgcggccggtgcggaaaaacttcctggccagggtgtgcactcacagggccaaggacccggcgccaatttcgtgtcctttgtgggccaagccggaggggggggcccagctggccagcaactgccccagctgccgcagtcaagccagctccagcagcagcagcagcagcagcagcagcagcagcagcctcaacctccacagcctcctttccccgcgggaggacctccagcccggaggggcggcgccggcgctggcgggggctggaagttagccgaagaggagtcttgccgcgaggacgtcacccgagtctgccctaagcatacatggtctaacaatttggctgtactcgagtgtcttcaggatgttcgggagctcctgtggaattacaagctgaatctcaccacagatcctaagtttgaatctgtcgctcgggaggtctgcaaaagcaccatcactgagatcaaggaatgtgccgacgagccagtgggcaaagggtatatggtctcctgtctggtcgaccacagggggaacatcaccgaataccagtgtcaccaatatatcaccaagatgaccgccattatcttctctgactacagattgatctgcgggttcatggacgattgtaagaacgacattaacatcctgaagtgtggctccatccgcctcggggaaaaggacgcacacagtcagggagaggtagttagttgtctggagaaggggcttgtgaaggaggcagaagagagggaaccaaaaatacaggtctcagaactctgcaaaaaagctattctgagggtggcggagctgtcatccgatgactttcatcttgatcggcatctttactttgcttgtagagacgaccgggaacgtttctgtgagaatacccaggccggcgaaggcagagtgtacaaatgcctgttcaaccacaaatttgaggagtcgatgagcgaaaagtgtagggaagcgctaaccacaaggcagaaactcatagctcaagactataaagtgagctatagtctcgcgaaatcttgtaaaagcgatttgaagaagtatcgatgcaacgttgagaatttgcccagaagcagggaagccagactgagctatttgctcatgtgcctggagtctgccgtgcaccgaggaagacaggtgtcctcagagtgccagggcgaaatgctcgactacaggcgaatgcttatggaggatttttccctgtcgcccgagattatcctcagttgccggggggagatcgaacatcactgctccggtctgcatagaaaaggcaggacattgcactgcctaatgaaggtagttcgaggggaaaagggaaatctaggaatgaactgccagcaagcccttcagaccttaatccaagagacagaccccggggcagattaccgtatcgatagagcgcttaatgaggcctgtgagtccgttattcagactgcctgcaagcacatccgctcaggcgatccgatgatcctttcatgtctgatggaacatctgtacacggagaaaatggtcgaggactgcgagcatcggttgctggagctccagtactttattagtcgggactggaagctggaccctgtgctgtaccgaaagtgtcagggtgacgccagccgactttgtcacactcatggatggaacgagacgtctgagttcatgccacaaggagccgttttcagttgtctataccgccatgcttataggaccgaggaacaggggagacggttgtcccgcgagtgccgagctgaggtccaaagaatcctgcaccaaagagctatggacgtgaaactcgatcccgccttgcaggataaatgtctgatcgaccttggcaaatggtgttcagaaaagactgagacaggacaagagctagaatgtctgcaagaccatcttgatgacctcgtggtggagtgtcgcgatattgtgggtaatttaactgagctggaaagcgaggacatccagatcgaggctttgctcatgcgtgcctgtgagccgatcattcagaacttctgccatgatgttgccgacaatcagattgactcaggggacctgatggaatgcctgatccagaacaaacaccaaaaggacatgaacgaaaagtgtgccataggggtgactcattttcagttagtgcaaatgaaagacttccgttttagctacaaattcaagatggcttgtaaagaggatgtgttaaaactgtgtcctaacatcaaaaagaaggtggacgtcgttatctgcctgtccactaccgttaggaatgatacgcttcaggaggctaaggagcatcgtgtctctcttaagtgccgcaggcagttgcgcgtagaagaacttgaaatgacagaagatataaggctagaaccagacctatatgaggcttgtaaaagtgacatcaaaaatttttgcagcgctgtgcaatatggaaacgcccagataatcgaatgtttgaaagaaaacaaaaaacagctgtctactcgatgccaccagaaggtgttcaagctgcaggaaactgaaatgatggaccctgaactagattatacactcatgcgtgtgtgtaagcagatgatcaaaaggttctgcccagaagccgactcaaagactatgctgcagtgtttaaagcagaataaaaacagcgaactgatggacccaaagtgtaagcagatgatcactaagcgacaaattacacagaacaccgattaccggcttaatcccatgcttaggaaggcttgtaaggcggatattcccaaattttgccacggcatcctgacgaaagcaaaggatgatagtgaactggagggacaggtgatcagctgtctcaagttgcgatatgccgaccagaggttgagctccgattgcgaagatcagatacggattatcatccaggagtctgcactggactaccgactcgatccccaactgcagctgcactgtagcgatgagatcagttccctctgcgctgaagaggcggccgcccaggagcaaacaggacaagttgaagagtgtttaaaggttaacctgctcaagataaaaaccgagctttgcaaaaaggaggtcttaaatatgcttaaggagtccaaggcggacatctttgtcgatcccgtgttacacacagcttgcgctctggacattaagcaccattgtgccgctattacaccaggtaggggcagacagatgtcctgcctgatggaggccctggaggataaacgggtccgcctccagcctgagtgtaagaaaaggttgaatgatagaatcgaaatgtggtcctatgctgctaaggtggcgccagcagatggatttagtgacctggccatgcaggtgatgaccagccccagcaagaattacatactgtccgtgatatctggaagtatctgtatcctgtttttgatcggccttatgtgcgggagaatcacaaagagagtgacccgggagctgaaggatagactgcagtaccgtagcgagaccatggcatacaaaggtttggtgtggagtcaggatgtgaccggatcccccgcctag

SEQ ID NO: 189702 - DNA, 2091 bp, Artificial Sequence
  Description of Artificial Sequence: Synthetic coding sequence
atgggcaacggcatgtgcagccggaagcagaagcggatcttccagactctcctgttgctcaccgtcgttttcggctttctctatggggcgatgctgtattatgagctgcagacccagctgaggaaagctgaagctgtagcgctgaagtatcagcaacaccaggaatccctctccgcacagctccaggttgtttacgagcaccggtctaggcttgagaagagtctgcagaaggagcgcctggaacataaaaaagcaaaagaagacttcttggtgtacaagctagaagcacaggagaccctgaataaggggcgccaagacagcaatagtcggtactctgctctgaatgtgcagcatcaaatgttaaaatcccaacacgaggagcttaagaagcagcactccgatctggaggaagagcaccgaaagcagggcgaggatttttcccgtaccttcaacgatcacaagcagaaatatttacagctccagcaggaaaaagagcaggagttgtctaaactgaaggagactgtgtacaatctccgggaagaaaacagacagctcaggaaggcccatcaggatatccacacccagcttcaggatgtcaaacagcagcataaaaatctcctgagtgaacatgaacagttggtcgtcaccctggaagaccacaaatcagcgctagccgcagcccagacccaggtggcggagtataaacagcttaaagataccctgaatcgcattccaagtctcaggaagcccgaccccgctgaacagcagaatgtcacacaggtcgcccactccccccagggttataacactgcgagggagaaaccgactcgtgaggtccaagaagtctcccgaaacaatgacgtgtggcagaaccacgaggccgtgccaggtagggcagaagatacgaaactttacgctcctactcataaagaggctgagtttcaggcgccgcctgagcccatacagcaagaagtggaacgcagggaaccggaggagcaccaggtggaggaggagcaccgaaaagcattagaagaagaggagatggaacaagtaggccaagccgaacatcttgaggaggagcatgacccttcaccggaagagcaggatcgcgagtggaaggagcagcatgaacagagggaggctgccaacctactggagggccacgctcgggccgaggtttacccttccgcaaagcccatgataaaattccaatctccttatgaagagcagttagagcagcagagactggccgttcaacaggtggaggaggctcagcagctgcgagagcaccaggaggccctgcaccaacagcgcttgcaaggccacctcctgcggcagcaagaacaacaacaacagcaagttgcgagggagatggctctccagcggcaggcagaattagaagagggaagacctcaacaccaagagcagttaaggcagcaggcccattacgatgccatggataacgacattgtgcagggggctgaggaccaggggattcagggggaagaaggcgcctacgaacgcgataatcaacatcaggatgaagccgagggcgatccggggaatcgccacgagccccgggagcaagggcctcgcgaagcagaccctgagtctgaagcagacagggctgctgttgaggatatcaacccagctgacgatcctaacaaccagggagaagatgaatttgaggaagccgaacaggtgagggaggagaacctcccagacgagaatgaggagcaaaaacagtcaaatcagaaacaagaaaacacagaggtcgaggagcatctggtgatggccggcaaccctgaccaacaggaagacaatgtggatgagcagtatcaagaggaggcggaagaagaagtgcaggaagatcttactgaggagaagaagagggagctcgaacacaatgccgaggagacctacggtgagaatgacgagaatactgacgataagaataacgatggcgaggagcaggaggtccgggacgacaacagaccaaagggcagggaggaacattacgaagaggaagaggaagaggaggaagatggcgctgcagtggccgagaagtcccataggcgggccgaaatgtag

SEQ ID NO: 189703 - DNA, 897 bp, Artificial Sequence
  Description of Artificial Sequence: Synthetic coding sequence
atgaccagcctgacccagcggagcagcggcctggtgcagcggcggacggaagcgtcgaggaacgccgcagacaaagagcgagcagccggcggaggtgccgggagtagtgaagacgacgcccaatcacggagggatgaacaggatgatgatgataagggggacagtaaggaaactagactgacactgatggaggaggtcttgctactgggcttgaaagatcgcgagggatacacaagcttttggaacgattgtatatcttccggcctgagaggctgcatgctcatcgagctagccttgcggggcagactgcagctcgaggcctgcggtatgagaaggaagagcctgctgacaaggaaagtaatttgtaagtccgatgctcccacaggcgatgtgttgcttgatgaggccctgaaacatgtgaaagaaacacagcctcccgaaactgtgcaaaactggatcgaacttctgagcggagagacctggaatcctctgaagctgcactatcagctcagaaacgtgagagagcgactggctaagaacctggtcgagaaaggcgtcctcacaaccgagaaacagaacttcctgttatttgatatgacaacccatccgctaacaaacaacaatattaaacaaagactgatcaaaaaagtccaggaggctgtcctggataagtgggtgaacgacccacatagaatggatagaagactgctggcactgatctacctcgcccacgcgagcgacgttctggagaatgccttcgccccgcttctggatgagcaatatgatctagccaccaaaagggtgcggcagctcctcgacctggacccagaggtagagtgcctcaaagccaacacgaacgaggttctgtgggcagtcgtcgcagccttcaccaagtag

SEQ ID NO: 189704 - DNA, 846 bp, Artificial Sequence
  Description of Artificial Sequence: Synthetic coding sequence
atgaccagcctgacccagcggagcagcggcctggtgcagcggcggacggaagcttctcgcaatgccgctgatagccgccgggatgagcaagacgatgatgacaagggagactcgaaggagacccgtcttacactcatggaggaggtcctgctgttaggcttaaaagatcgggaggggtataccagtttctggaatgactgcattagttctggcttgaggggctgtatgcttattgaacttgctctgcgaggtcgactgcagctggaagcttgtgggatgcggcgcaagagtctgttaacgaggaaggtgatatgcaagtccgacgctccaaccggagatgtgttactcgacgaagcccttaagcacgtcaaagaaacacagccaccagagaccgttcaaaattggattgagcttctctccggtgaaacctggaatcctctcaaattacattatcaattgcgcaacgtaagggagaggctcgcaaagaatctggtggaaaagggcgttcttacgacagaaaaacagaattttttattgtttgatatgactacccatccacttacaaacaataatattaaacaacgtttgataaagaaggtgcaggaggcagtcctggacaagtgggtgaatgaccctcatagaatggatcgacgacttcttgctctgatttatctggcccacgcctccgacgtgctggaaaacgcgtttgcgccactgctggacgagcaatacgacctggccacaaaacgcgtacgccagctgctggatctggaccctgaagtcgaatgcctaaaggcaaacactaacgaagtgctgtgggccgtggtggctgctttcactaaatag

SEQ ID NO: 189705 - DNA, 858 bp, Artificial Sequence
  Description of Artificial Sequence: Synthetic coding sequence
atgaccaccctgacccaccgggcccggcggaccgagatcagcaagaattccgaaaagaaaatggagtctgaagaggacagtaactgggagaagtccccagataacgaggactcgggagactctaaggacatccgactcacacttatggaggaagtgctcctactcggcctgaaggataaagaaggttacaccagcttttggaatgattgcatcagttcgggactgcgggggggcatcctcattgagctggccatgcgcggtcggatttacttagagccccccactatgcgtaaaaagcgcctgctcgatcgaaaagttctgctgaaaagcgattctcccactggtgacgttctcctagacgaaactttgaagcacattaaagcgacagaaccaactgaaacagtccaaacatggattgaactgttgacgggtgaaacgtggaacccatttaaattacagtaccagctaagaaatgtccgggagcggatcgccaaaaatctggtggagaaaggtatccttacgactgagaagcagaatttcctcctctttgacatgacaacgcacccggttacaaataccacagaaaaacaaagactcgtgaaaaagcttcaggattctgtgctggagcgatgggtcaacgatccccagcggatggataaacggaccttggctttgctcgtactggctcatagcagcgacgtgttagaaaatgtgttttctagtcttaccgacgacaagtacgacgtggcaatgaatcgggcaaaggacctcgttgagcttgatccagaggtggagggcacaaagccctccgcaacggagatgatttgggccgtgttggccgctttcaacaaatcctag

SEQ ID NO: 189706 - DNA, 924 bp, Artificial Sequence
  Description of Artificial Sequence: Synthetic coding sequence
atgaccaccctgacccaccgggcccggcggaccgagatcagcaagaactcggaaaaaaagatggaaagcgaggaagactctaattgggagaaatcacccgataacgaagattctggcgattctaaggacatccgactcacactgatggaagaagtcctattgctagggctgaaggacaaggaggccaacattaatagttggatcacgaggtggctgacccccgtcatacccgcgttgtggggtgctgaaggttatacgagtttctggaatgattgcatctcaagcgggctccgcggtggaattcttatcgagctcgccatgaggggccgcatttacctggaaccacctactatgcggaagaaacggctcttagaccgaaaggtcttgctcaagtcggatagcccaacaggtgatgtgctgctggatgagaccctaaagcatataaaggccaccgagcctactgaaactgtacagacatggatcgagctactgaccggggagacatggaacccatttaagcttcaataccagctgcgtaatgttcgggagaggatcgccaagaatctcgtcgagaaggggatccttacaactgaaaagcaaaactttttattgttcgacatgacaacccatccggttaccaatactaccgagaaacagaggctcgtgaagaaactccaggattcagtcctcgagagatgggtcaacgacccccaaagaatggataaacggactttggcactgcttgtgctcgctcattcctccgacgtgctcgagaatgtgttcagctcattaacggatgacaaatacgacgtggctatgaaccgggccaaggacctggtcgagctggatcctgaagtagagggtactaagccctcagccacagaaatgatctgggctgtgttagccgcatttaataagtcctag

SEQ ID NO: 189707 - DNA, 810 bp, Artificial Sequence
  Description of Artificial Sequence: Synthetic coding sequence
atgaccaccctgacccaccgggcccggcggaccgagatcagcaagaattcagaaaaaaagatggagagtgaggaggatagtaattgggaaaagtcacccgacaacgaagactccggagacagtaaggatatccggctgactcttatggaggaggtgctcctgctgggattgaaggataaggaagccaatatcaattcctggattacaagatggctgactcctgttatcccagccttgtggggagcagagggctacacttccttttggaatgattgcattagctctggcctgcgcggcggaatccttattgagctggccatgagaggccggatttacttagaaccgcctaccatgcgcaagaagaggctattagatcggaaagttcttctcaagtcagactctcccacgggagacgtgttgctggacgagacactcaaacatatcaaagccaccgaacctacagagactgtccagacatggattgaactcctgactggcgaaacatggaatccgtttaagctccagtaccagctgcgcaacgtgagggaaagaatcgctaagaatctggttgaaaagggcatcctgacgacggaaaaacagaatttcctgctgttcgacatgacaactcatcctgttaccaatacaactgagaagcaacggcttgtaaagaaactgcaggactccgtgctggaacgatgggtcaatgaccctcagcgcatggacaaaagaacacttgctctgctggttctggcccactctagcgacgtgctcgaaaacgtgttctcgtcgttaacagatgacaaatattag

SEQ ID NO: 189708 - DNA, 726 bp, Artificial Sequence
  Description of Artificial Sequence: Synthetic coding sequence
atgaccaccctgacccaccgggcccggcggaccgagatcagcaagaacagcgagaagaaaatggagtctgaggaggatagcaattgggagaagtcaccagataatgaggatagtggcgattccaaagacattcggctcacactgatggaggaggtgctgttactgggcctcaaggataaggaggtgctgctgaagtccgattcccccactggcgacgtactgcttgatgagacactgaaacatatcaaagcaaccgaaccaacagagacagttcagacctggatcgagctattaaccggagagacctggaaccctttcaagcttcaatatcagctgcgcaatgtcagagagaggatcgcaaagaacctagtcgagaaaggtattttgaccacagaaaaacaaaatttccttctgtttgatatgaccacacaccctgtgaccaacacaactgaaaagcagcgacttgtgaaaaagctgcaagactccgtcctggaacgctgggtaaacgatccgcagcgtatggacaagcgaacactcgcccttctggttctcgcgcattcatccgatgtgttggaaaatgtgttttccagtctaactgatgacaaatacgacgtggccatgaatcgagccaaggatctagtggagctcgatcccgaggtggaaggcacgaagccatccgccacagagatgatctgggcggttcttgccgccttcaataaatcatag

SEQ ID NO: 189709 - DNA, 1323 bp, Artificial Sequence
  Description of Artificial Sequence: Synthetic coding sequence
atgggcctgggcgtgagcgccgagcagcccgccggcggcgccgagggcttccacctgcatggtgttcaggaaaactctcccgctcaacaggcaggcctcgagccttacttcgactttatcataacaatcggccattccaggctcaataaagaaaacgacactctcaaggccctattgaaagccaatgtagagaaacccgttaaattagaagtttttaacatgaagaccatgagggtgcgcgaagttgaagttgtgccatccaatatgtgggggggtcaggggctgctgggggcttcagtgaggttttgttcgtttaggcgggcctcagagcaggtttggcacgtgctcgacgtcgagccgtccagtccagccgccttagcagggctccgaccgtataccgactatgttgtgggctcggatcagatccttcaggagagtgaggatttctttaccttgattgagtcccatgaaggcaagccattaaagctaatggtctacaactccaaaagtgactcgtgtcgcgaggtcacagtcacaccaaacgccgcctggggcggggaaggcagcctgggctgtgggattggttatgggtatctgcatagaatccctacccagcctccatcgtaccacaagaaacctccgggcactcctccgcccagtgccctgcctctgggggcaccccccccggacgccctgcccccagggccgaccccggaggacagcccttctctggaaacaggcagtcggcagtccgactacatggaggcactgcttcaggctcccggcagttctatggaagatcctctccctggtcccggctcgccatctcattcagcacccgatcccgacggtctgcctcactttatggaaacccccctccaacctccccctccagtacagagggtaatggaccctggcttcttagatgtgtcagggatttcattactcgataattccaacgcttctgtttggccaagcctgccaagctcaacggagctgaccacaacagctgtgagcacatccggcccggaagatatctgctcctcttccagcagccacgaacgaggcggagaggcaacttggagtggaagtgagtttgaggtgtcttttcttgattcgccaggagcgcaagcccaggcagatcacttacctcaattaaccctgcccgactctctgaccagcgccgcaagcccggaagacggcttatccgctgagctcttggaagcgcaggctgaagaggagccagctagcaccgaaggactcgataccggcaccgaagctgaggggctggactcacaagcccagattagcactacagagtag

SEQ ID NO: 189710 - DNA, 4143 bp, Artificial Sequence
  Description of Artificial Sequence: Synthetic coding sequence
atggccagcggccgggacgagcggcccccctggcggctgggccggctgttgttgttaatgtgccttcttctgctcggtagcagcgcacgcgccgcccacatcaaaaaggcagaagccacaaccacgacaaccagtgccggagcagaagctgcagagggtcagttcgaccggtattaccacgaggaggagctcgagtcagctttgcgagaggccgctgccgctggactgccaggactggcccgcctcttcagcattgggaggtctgtagagggtaggccattgtgggtcctgaggctgacagctggactcggcagtttgatccctgaaggggacgcaggccccgacgctgccggccctgatgctgccggcccattgctgccgggccgcccccaggtgaagcttgtgggcaatatgcacggagacgagaccgtaagccgccaggtattgatttacttagctagggagctcgccgcaggataccgcaggggcgacccacgattagtgaggttgttgaacaccaccgacgtctatcttctgcctagcctcaatcccgatgggttcgaacgggccagagagggggattgcggatttggtgatggcggtccctccggggccagcgggcgagataactctaggggtagagatctgaaccggtctttccccgatcagttcagcactggagagccgcccgctcttgacgaagtgccagaggtgcgcgccctcattgagtggatcagacgaaataagttcgttcttagcggaaacctgcacggcggcagtgttgttgccagctaccccttcgatgactctcctgaacacaaggctaccgggatttactccaagacatctgacgacgaagtgtttaagtatctggcgaaggcctacgcatcaaaccacccgatcatgaagactggagagccccactgtcctggcgatgaggatgagaccttcaaggacgggatcaccaatggcgcacactggtacgatgtggagggcggcatgcaggactataattacgtatgggccaactgtttcgagattactcttgaactgtcgtgctgcaagtaccctccagcctctcaacttagacaagagtgggaaaacaatagggaatctctgatcaccctgatcgagaaggtccacatcggggtgaagggattcgtgaaggattccatcacagggtccggcctcgaaaatgcaacaatcagtgttgccggcattaaccacaatattacaacaggcaggttcggggatttttataggcttctcgtacccggcacatacaaccttactgtcgtcctaacgggctatatgccactgaccgttaccaacgtcgtggtaaaggagggccctgcaacggaggtcgacttttctttgcgaccaacagtaaccagcgtgatacccgataccactgaagccgtgagcactgctagtactgtggccatacctaatatactgtctggcacatccagcagttatcaaccgatccaaccgaaggacttccatcatcaccacttccccgatatggaaatattcttacgccgattcgccaacgagtatccaaatataacacggctttattccctggggaaaagcgttgagtctagagagctgtacgtgatggaaatctccgataatccgggggtccacgaaccaggcgagccagaattcaagtatataggcaatatgcatggaaacgaggtggtcggtcgagagcttctgctgaaccttattgagtacctttgtaaaaacttcggaactgatccggaagtgacggatctcgtgcataataccagaattcatctaatgccgagcatgaaccccgatggatacgaaaaatcccaggagggggactccatctcagtgattggtagaaataacagcaacaactttgacctgaaccgaaacttccccgatcaattcgttcagatcacagatccaacccagcccgaaaccattgctgtaatgtcctggatgaaatcttatccgttcgtcctgtcagcaaacttacacgggggcagtctggtggtcaactaccccttcgacgatgatgagcagggccttgcaacttacagcaagtccccagatgatgcagtctttcagcagatagcactgtcctactcaaaggaaaatagccagatgtttcaggggaggccatgcaagaatatgtatcctaatgaatactttcctcatggcattaccaacggggccagctggtataatgtgcccggcgggatgcaggattggaattatctgcagaccaattgcttcgaggttactattgagctggggtgtgtcaaataccccctcgaaaaggagctgcccaacttttgggagcagaatcggcgcagtctcatccagttcatgaagcaggttcaccagggcgtaaggggtttcgttctggatgccacagatgggagggggattctgaacgctaccatatcagttgccgaaattaatcatcctgtcactacctataaaacaggagactattggagactcctagtgcccggcacttataaaataactgcaagcgccagaggatataaccccgtgaccaaaaacgtgactgtgaaaagcgaaggtgcgatccaggtaaattttactctcgtccggagctcaaccgactccaataacgaatccaaaaagggcaagggcgcgagctcctccacaaatgacgcttctgaccctactacgaaggagtttgagaccctgattaaagatctgtctgcggaaaatgggttagaaagcctcatgcttaggagcagcagcaatctcgctctggcactgtacaggtaccatagctacaaggatctgtctgagttccttaggggtctggtcatgaactatccgcatatcaccaatctgacaaatctggggcagtcaaccgaatacaggcacatatggtccctggagatttcaaataagcccaatgttagcgaacccgaagaaccaaagatacgcttcgtggccggaatacacgggaatgctcccgtagggacagagctcttgctggccctggcagagtttctgtgtctgaactacaagaaaaatcccgccgtgacccagctagttgatagaactcgcatcgtgatcgtgccgtctctgaatccagatggtagagaaagggcgcaggagaaggactgtacctccaaaatcggtcagacgaatgctcggggaaaagaccttgacacagactttactaataacgcaagccagccagaaactaaggcaatcatagagaacctgattcaaaaacaggacttttccttaagcgtcgccctggacggcgggtctatgctggtcacgtacccttatgacaagcccgtccagaccgtggaaaacaaagagacgcttaaacatttggctagtctgtacgccaataatcaccccagcatgcacatggggcagccgtcgtgccccaataagtcagacgagaacattcccgggggagtcatgagaggcgcagagtggcactctcaccttggcagtatgaaagactatagtgtgacatacgggcactgtcccgagatcacggtatacacttcctgctgctactttcccagcgctgcccgcctgccttcattatgggcagacaacaaacgctcactcctgtcaatgctggtcgaggtgcacaagggtgtccacgggtttgttaaggataaaactggaaagcccatctccaaggcagtcattgtcctgaacgagggcattaaggtgcagaccaaggaaggagggtactttcacgtgcttctagccccgggggtccacaacatcattgccattgccgacggataccaacagcagcactcacaagtctttgtccaccatgacgcagcctcctccgtcgttatagttttcgatacagataacaggatttttgggctgccaagagagctggttgttacggtttcaggggccacgatgagcgcactgatactaaccgcgtgcataatttggtgtatttgcagcatcaaaagcaaccgtcacaaagacggattccaccgtctcaggcagcatcacgacgaatacgaggatgagattcgcatgatgtccacgggaagcaaaaaaagtcttctatcccacgagtttcaagacgagacagatactgaagaagaaacactttacagctcaaagcattag

SEQ ID NO: 189711 - DNA, 558 bp, Artificial Sequence
  Description of Artificial Sequence: Synthetic coding sequence
atgttcgagaccatggccatcgagatcgagcagctgctggcccggcttaccggggtcaacgacaagatggccgagtacacaaatagtgccggcgtgcctagcttaaacgcggcactgatgcacacactgcaacggcaccgagacatcctgcaagactacacccacgagttccataagactaaagccaacttcatggctattcgggagagggaaaacctaatgggatctgttcggaaggatatcgagtcgtacaaatctgggagcggagtgaacaacaggaggaccgagctgttcctgaaggagcacgaccatttgcgcaactctgaccggttgatcgaagaaactatatcgatcgctatggctactaaggaaaatatgacgagtcagcgggggatgttaaaatcaatacacagtaagatgaacaccctggccaatcgatttccagctgtaaactctttaatccaacgaatcaatcttcgcaagagaagagattccctgatcctggggggcgtgatagggatctgtacgattctcctcttattatacgcctttcactag

SEQ ID NO: 189712 - DNA, 525 bp, Artificial Sequence
  Description of Artificial Sequence: Synthetic coding sequence
atggccgccggcaccagcagctactgggaggacctgcggaagcaggcccggcagctcgagaacgagctggatctgaagctggttagctttagcaaactctgtacatcctatagtcacagcagcaccagggatggccggcgagattcaagcgatactaccccattattgaacgggtcttcccaggacaggatgttcgaaaccatggcaatcgaaattgaacagctgctggcaaggttgacgggtgtaaacgataaaatggccgagtacaccaactctgctggcgtgcctagtctgaacgccgctttgatgcataccctgcagcgccaccgggacatcttacaggattacacccatgagtttcataaaactaaagcgaatttcatggcaatccgggaacgagaaaatcttatgggcagcgtccgcaaggatatcgagagctataaaagtgggtctggtgtaaataacaggcgcacagagctgttccttaaggagcatgaccacctccggaagggttttcagtggtag

SEQ ID NO: 189713 - DNA, 747 bp, Artificial Sequence
  Description of Artificial Sequence: Synthetic coding sequence
atggccgccggcaccagcagctactgggaggacctgcggaagcaggctcgacagttggagaatgagctcgatctgaaactcgtgtcctttagcaaactctgcacctcctacagccactcaagcactcgggacgggagacgggattctagcgacacaacacccctcctgaacgggagctcccaggaccggatgtttgagacaatggctattgaaatcgagcagcttctagcccgacttaccggggtcaatgataagatggcggagtacactaattctgccggcgtcccgagtctgaatgccgccctgatgcatacgctccagcgccatagagacatcctccaggactatacccatgaatttcataagacaaaagctaactttatggccatcagagaacgcgagaatctcatgggctccgtgaggaaagacatcgagagttataaaagtggctcaggcgtgaataacagacgcactgaactgttcttgaaagaacacgaccaccttcggaacagcgaccggctgattgaggagacaatttcaatcgcgatggccactaaggagaatatgacatcacagcgtggtatgctgaaatctattcactccaaaatgaatacactggccaaccgattcccagctgtgaacagcctgatccagaggatcaatctgcgtaagaggagagacagtctgatcttaggaggtgtaataggaatatgtactattctgctgctgctgtatgcctttcattag

SEQ ID NO: 189714 - DNA, 528 bp, Artificial Sequence
  Description of Artificial Sequence: Synthetic coding sequence
atggccgccggcaccagcagctactgggaggacctgcggaagcaggcccggcagctggagaatgagctggatctgaaactggtttcattctcaaagttgtgtacgagctatagtcattcttcgacgcgagatggcagacgcgatcgatattccagtgatactacgccactgctaaacggctcatctcaggaccggatgttcgagaccatggcgatcgaaattgaacagttgctagcacgtttaacaggcgttaatgataagatggccgaatacacaaatagcgccggggtccccagcctgaatgccgccctgatgcatactctgcagcgacatagagatatactgcaggtgatttactgggcccgggacgttttcattatcacaggagtctgggttttctttttcaatccgtgcatcgggtatgtgcacatctacttgaaggggcagagggagaagtccgaaaagataaacgctatgctgaaggggctggtgctcctctttttcggggtaactataatcaaattctag

SEQ ID NO: 189715 - DNA, 558 bp, Artificial Sequence
  Description of Artificial Sequence: Synthetic coding sequence
atgttcgagaccatggccatcgagatcgagcagctgctggcccggctaacaggtgtgaatgacaagatggccgagtacacaaacagtgctggagtgcctagcctgaatgccgccctgatgcataccctgcagcggcacagggacatcctgcaagattatacccacgagtttcacaagacgaaagcaaatttcatggccatcagagagcgggaaaacttgatgggaagcgtacgaaaagatattgaatcatacaagtccggaagcggagtgaataataggcgcaccgaactcttcttgaaagagcacgaccacctgcggaattccgacaggttaattgaagaaacaatctcaattgcgatggctaccaaggagaacatgacaagtcagcgtgggatgcttaaaagcatccactccaaaatgaatacccttgcgaatcgattccctgcagtcaacagtctgatccagaggattaatctgaggaagcggcgagatagtctgattctgggaggggtgatcggcatctgcactattctgcttctgttatacgcatttcactag

SEQ ID NO: 189716 - DNA, 1350 bp, Artificial Sequence
  Description of Artificial Sequence: Synthetic coding sequence
atgaccagcttctacagcaccagcagctgccccctgggctgcaccatggcaccaggcgcccggaatgtgtttgtgagcccgatcgacgtcggatgtcagcctgtagccgaggccaacgccgcctccatgtgcctcctcgcaaacgtagctcacgccaacagggttagggtggggagcacgccactcggacgtcccagcctgtgcctccctcctactagtcacaccgcgtgtccactgcctggcacatgtcatattccgggtaacatcggaatatgcggagcctatggaaaaaatacccttaacgggcacgaaaaagaaaccatgaagttcctgaatgaccgactagccaattacctggaaaaggtccgccagcttgaacaggaaaatgctgaactggaaactactctattggagcgaagcaagtgccatgagtccacagtatgcccagattaccaatcatactttagaaccatcgaggagctgcaacagaagatactctgttctaaggcggaaaacgctcgtctgattgtgcagattgataacgcaaaattagctgctgatgacttcaggattaaactggaatctgaacgatccctgcaccagctcgtggaggctgataagtgcggcacccagaaactgcttgatgatgccacactggccaaggcagatttggaggctcagcaggaatcactgaaagaggaacagctctctctgaagagcaaccacgagcaagaagtgaaaatcttgaggtcacaattgggtgagaagtttcgaatcgaactagacatcgaacctacaatagatctgaatcgtgtgttaggggagatgcgcgcgcagtacgaggctatggtggagactaatcatcaggatgtcgagcagtggtttcaggctcagagcgaaggaatatcccttcaggcaatgagttgtagcgaggagctccagtgttgccagagcgagattctcgaactgcggtgtacggtgaatgccctggaagtggaaagacaagcccagcatacccttaaagattgcctgcagaatagtctttgcgaagccgaggatagatacggcactgagcttgcgcagatgcaaagtctcatcagtaatctggaggagcagttgtcagagataagggcagatcttgaacggcagaatcaggaatatcaagttctgctggacgtgaaagcacgacttgagaacgaaatcgccacatacaggaacttgctggaaagtgaagactgcaagctgccatgcaacccttgcagcactcccgcctcctgtacttcatgtccttcatgcggacctgtgaccggcggaagcccaagtggacacggtgcctcaatgggccgctag

SEQ ID NO: 189717 - DNA, 639 bp, Artificial Sequence
  Description of Artificial Sequence: Synthetic coding sequence
atggaccccctgttccagcagacccacaagcaggtgcacgagatccagtcatgcatggggagattggagaccgcggacaagcaaagcgtccacatcgtcgagaacgagatacaggcttcaatagaccaaatattctccagactggaacgactggagatcctgagtagcaaggaacctcccaataaacggcaaaacgctaggctaagagttgatcagctgaaatatgatgtccagcatctgcagacagctctgagaaatttccaacatagacgtcatgcacgtgagcagcaggagagacaaagggaagagctgctttcacgtaccttcacaaccaatgattccgacaccaccatccccatggatgaaagcctgcagtttaattctagtcttcagaaggtgcacaatggaatggatgacctgatcctggacggacataacattctcgacgggcttagaacacagaggctcaccctgaagggaacacaaaagaaaattctggacatagctaatatgctggggttaagtaataccgtgatgcgtttgatcgagaaacgggcattccaggacaaatattttatgattggcggtatgttactaacatgcgtagtcatgtttctggtggtgcagtatttaacttag

SEQ ID NO: 189718 - DNA, 588 bp, Artificial Sequence
  Description of Artificial Sequence: Synthetic coding sequence
atggaccccctgttccagcagacccacaagcaggtgcacgagatccagagttgcatggggcgcttggagaccgcggataaacagagtgtgcacatcgttgaaaacgagattcaagcttctattgatcagatcttttctcgcctcgagcgtctcgagatcctgtcctctaaagaaccccccaacaaacgccagaacgcccgcctcagggtggaccagctaaaatacgatgtgcaacatctccaaactgcgttgcggaacttccagcatcgcaggcacgccagagagcagcaggaaaggcagcgggaggagttgctttcacgcaccttcaccaccaatgactccgataccacaattccaatggatgaaagtctgcagttcaattcgagcctacagaaggtgcacaatggtatggatgacctgattctggacggacataatattctcgacggtttacgtacccaaagactgactctgaaagtgggatccttactcggcgatcgagagaaggcttcttgtttcagtttgattcagcagttctccaattgtgtgtacatactgatcacctgccctcaaatcgtgattttctag

SEQ ID NO: 189719 - DNA, 699 bp, Artificial Sequence
  Description of Artificial Sequence: Synthetic coding sequence
atggaccccctgttccagcagacccacaagcaggtgcacgagatccagtcttgcatgggccgcctggagactgcggacaagcagagtgtccatatcgttgagaacgaaattcaggcttcaatagatcaaatcttctcaagactcgagcgattagagattttgtcaagcaaagagcctccaaataagcggcaaaacgccaggctgcgcgtcgatcaactgaagtatgacgtgcaacatctgcagactgcattacggaacttccaacaccgtcgacatgcacgggaacaacaggaacggcaacgggaagagttgcttagcagaactttcactacaaatgacagtgatacaaccattcccatggacgagtcactgcaatttaactcaagtctgcagaaggtgcacaatggaatggacgaccttatcctggacgggcataacattctggatggactgagaactcagagactgacattgaaaggtacacagaagaaaatcctggatatcgctaatatgctagggctgtccaacacagtcatgcgactgattgagaaaagagcgttccaggataagtatttcatgatcgagaccagaagtcatcacgtggcacaaaacggcccggagcttctgtcttccagggatccccctgcgtccgcttccaggagtgccggaatcattgaattcagcgagaagatcacttag

SEQ ID NO: 189720 - DNA, 984 bp, Artificial Sequence
  Description of Artificial Sequence: Synthetic coding sequence
atggccgccgccgccgccatggccgagcaggagagcgcccggaacggtggaagaaacagaggtggggtccagagggtcgagggcaagcttagagcttctgtggagaagggagattactacgaggcacaccaaatgtatcgcactctgttctttcgatacatgagccagtccaagcacaccgaagctagggagttgatgtattccggggcgctgcttttcttctcccacgggcagcaaaactctgccgctgatctgagcatgctggtgctagaaagtctggagaaggcagaagtagaagtggctgatgagctccttgagaacttagccaaggtattttcactgatggaccccaacagtcccgaacgcgttacctttgtgtctagggctctgaaatggagttccggaggttccggaaaactgggccatccccggctgcaccagttacttgccctgactctgtggaaggagcagaactattgcgagtcccgttaccacttcttgcatagcgccgatggggaagggtgcgcaaatatgttggtggagtacagtacatctagaggtttccgctctgaggtggatatgttcgtggcccaagcggtgctgcagtttctgtgcctgaagaataaatcaagtgcctccgtggtgttcacgacctatacgcagaagcatccaagcatcgaagatggaccgccctttgtggagccactcttaaacttcatttggttcctgcttctggctgtcgacgggggaaaactcacggtcttcacggtgctttgcgagcagtaccagccctccctgcgccgcgatccgatgtacaatgagtaccttgatcggattgggcaattgttttttggagtgccccccaagcagacgtcctcatacggcggcctgctaggtaacctgctgactagtttaatgggcagtagcgaacaagaagatggtgaggagtccccaagcgacggatctcctatcgagctagactag

SEQ ID NO: 189721 - DNA, 1779 bp, Artificial Sequence
  Description of Artificial Sequence: Synthetic coding sequence
atggccctgcccgaggaggccaagatcaaggacgcctaccacatgcttaaaagacaaggtatcgtgcagtccgatccccctatccccgtggacagaacattgatcccgtccccacctccacgaccgaagaacccggtgtttgatgacgaagagaaaagtaaacttcttgctaagcttctgaaatccaaaaaccccgacgacctgcaggaggctaataaactaatcaagagtatggtgaaggaagacgaggcacggatacagaaagttacaaaacgtcttcacacccttgaggaagtgaataacaatgtgcggcttctgagcgagatgctgctacattactcacaggaagatagctcagacggcgaccgggaactaatgaaggaactctttgatcaatgcgagaataaacggcgcacgttgttcaaactagccagcgaaactgaggataatgacaattccctcggggatatcttacaggcgtctgacaatctttcccgagtcatcaatagctataagactattatcgaaggacaggttatcaatggggaagtggctaccctgactttacccgactccgagggcaactctcagtgttcaaaccagggcaccttgattgatctcgccgaactggacaccactaactccctgtccagcgtgctggccccggcacccactccccccagttctggaattcctatcctgcctccacctcctcaagcgtccggcccccctcggagcagatcaagtagccaggctgaggcaaccttagggccgagctcaacctcgaacgctctatcttggttggatgaagagctgttgtgcctgggcctcgccgatccagctcctaacgtgccacccaaggagagcgccggcaatagccagtggcatctgctgcagcgcgaacagtccgaccttgacttcttcagcccccgacccggcaccgcggcttgcggggcctccgatgcccctctgttacaaccaagcgcaccttctagctcttcctctcaggccccattgcctcctccttttcctgccccggtcgtccctgccagcgtccctgcaccctcagccggcagtagcttgtttagcactggtgttgcgccagcgcttgccccaaaagtggaaccagctgttcccggtcaccacgggttggccctggggaactccgctttacatcacctcgatgcactggaccagcttctggaagaagcaaaagtgacttcaggacttgtcaagcctacaacctctcctctgatcccaacaaccaccccagccagacccctcctacctttctctacaggaccaggatcaccattgttccagccgctatccttccagagtcaggggtcccctccaaagggacctgagttgtccttagccagcattcacgtaccactggaatctatcaagcccagtagtgcccttccggtcaccgcttacgacaagaatgggttccgcatcctgttccacttcgcaaaggaatgcccaccagggcgccccgacgtcttggtggtggtggtgtccatgctgaacaccgctccgcttccagtcaagagcatcgtgctgcaggccgccgtgccaaaaagcatgaaagtcaaactgcaaccgcccagtggcacggaacttagcccgttcagtccaatacagccacccgcagcaataacacaagtaatgttgttggccaatccccttaagaagcaggtgctgtccttcctgggcaaagcatgtctgcagccatgggggcaggctattttgctgaccacatcttgcctcgcatag

SEQ ID NO: 189722 - DNA, 1956 bp, Artificial Sequence
  Description of Artificial Sequence: Synthetic coding sequence
atgaagaactgcggccggcggttccacaacgaggtgggcaagttccggttcctgaacgaattaattaaggtggtgtccccgaaatatctgggcgaccgcgtgtcagaaaaagtgaagactaaagtgatcgaactgttgtactcatggaccatggcactcccggaagaggccaagattaaagatgcataccacatgctgaaaagacaggggatcgtgcaaagcgaccctcccataccagttgacagaactttaatccctagcccacctcccagacccaagaaccccgtctttgacgacgaggagaagtccaagctgctggcaaagctcctaaagagtaagaacccagatgatttgcaagaggctaataagcttatcaagagcatggtgaaggaagacgaggcgaggatacagaaggttacgaagcggcttcatactctagaagaagtcaacaacaacgtgcggttactctccgagatgctgctgcactactcccaggaagattcctcagacggggatcgagagctcatgaaagagttgttcgaccagtgcgaaaacaagcggcgcaccctcttcaagctcgcatccgagactgaggacaacgacaattccctcggcgacattctgcaggcctccgacaacctcagtcgagtgatcaattcctataagacaatcatcgagggccaagtgatcaacggcgaagtggccactctaaccctacctgactctgaaggtaactcacaatgctctaatcaagggactctgatcgatctagccgagctggatactacgaacagcttatcctccgtgctggcgcccgcaccaacccccccttcatcaggaatcccaatccttccccctcccccccaggcctccggacccccgaggagcaggtccagcagtcaggccgaggccacactgggcccatcatccacctccaacgccttaagctggctagatgaggaactcctgtgcctcggcctggccgaccctgcccccaatgtgcctcctaaggagagtgccggcaactctcagtggcatctgctccaacgggagcagtccgatcttgattttttctcgcctaggcctggaacggccgcctgcggcgcatctgacgcgccactgctgcagccgagcgcacctagcagcagcagctcacaggccccactgcctccgcccttcccagctcccgtcgtgcccgcctccgtacccgcccctagcgccggaagttcactgttcagcacaggggtggcgccagccctggctccaaaggtggaacctgcggtgccaggccaccatggactcgccctggggaacagtgcgttgcatcatctggacgctctggaccagctcctcgaagaagccaaagtgactagcggtctggtaaagcccaccacctcaccgctgatccctaccacaactccagcccgccctttactcccattttctactggaccaggctcgcccctctttcagcccctgtcctttcaatctcagggctctccccccaaagggccggaattatcgctggcaagcatacatgtgcccctagagagcattaagccttcttctgcactgcccgtcacagcctacgataaaaatggatttcgcattcttttccactttgccaaagagtgccctcccggcagaccggacgtgctggttgtggtagtgtctatgctgaacaccgcaccactcccagtgaagtcaattgtgctccaggccgcagtgccaaaaagcatgaaggtgaaattgcagcctccctccggcacggagttgtcgcctttttctcctatccaacccccagccgcgattactcaagtaatgctgctggccaatccgctgaaggaaaaagtgcggctgaggtacaaactgacttttgccctcggagaacaactgtctacagaagtgggggaggtcgatcaatttccccccgttgaacagtggggtaacctttag

SEQ ID NO: 189723 - DNA, 1365 bp, Artificial Sequence
  Description of Artificial Sequence: Synthetic coding sequence
atgagcgccggcggcccctgccccgccgccgccggcggcggccccgggggcgcgtcgtgttcggtgggagctcctggaggggtgagtatgttcagatggttagaagtactggagaaagaattcgacaaagctttcgtggacgtcgacttgcttctcggtgaaatagatccggaccaggccgatatcacatacgaagggcgccagaagatgacgtcgttatctagttgcttcgcacagctttgtcacaaagctcagtcagtctctcaaatcaaccacaagcttgaagcccagctggttgacctcaaatcagagctgacagaaactcaagctgaaaaggttgtcttggagaaggaagtccatgaccagcttcttcaactacactctatacagctgcaactgcacgccaagactggacaaagtgctgactccggcactatcaaagcaaagcttgagcgcgagctggaggctaataaaaaggagaagatgaaagaggcccagttggaagctgaagttaagttgttacggaaagagaacgaggccctgcgaaggcacattgccgtgctccaggcggaggtgtacggcgcccgactggctgcaaaatatttggataaagagcttgctggaagagtgcaacagattcaactccttggtcgcgacatgaagggtccagcccatgacaagttgtggaatcagctggaagctgaaatacacctgcaccgtcacaaaacagtaattagggcctgtaggggacggaatgacttaaagagacccatgcaggcccctcctggacatgatcaggacagcctgaagaagtctcaaggcgtgggccccatacgaaaagtcctacttctaaaggaggaccacgagggtctgggcatttctatcacaggcggaaaagagcatggggtgcccatcctgatttcggaaattcacccgggccaacccgcagaccggtgtggtggccttcacgtaggcgatgccatcttggccgtaaatggagtcaacctaagggatactaagcacaaggaggctgtgaccatattgtcccaacagcgtggtgagatagagtttgaagtggtttatgtagcacccgaggtcgacagtgatgacgaaaatgtggagtacgaggatgagtccggacaccgctacagactgtatctggatgaactggaaggaggtggaaaccctggtgctagctgtaaagatactagtggggagatcaaagtgctgcagggatttaacaaaaaagctgtgacagatactcatgaaaacggagacctcggcactgcgagcgagacacctcttgatgacggggcctcaaaactcgacgacctgcacacactgtaccacaaaaaaagctattag

SEQ ID NO: 189724 - DNA, 1389 bp, Artificial Sequence
  Description of Artificial Sequence: Synthetic coding sequence
atgagcgccggcggcccctgccccgccgccgccggcggcggccccggaggcgcctcatgctcggtgggagcccctggaggcgtgtctatgttccgctggctggaggtgctggagaaggagtttgataaggctttcgtagacgtggacttactccttggagaaattgaccctgaccaagctgacataacgtacgaaggccggcagaagatgacgtccttgagcagttgcttcgcgcagctgtgtcacaaggcccaaagtgtttcccagatcaatcacaagctggaagcgcagctcgtggacctgaagagtgaactaaccgagactcaagccgaaaaggtagtgctcgaaaaagaggtgcatgaccaactgctgcagctccacagcatccagctgcagctacatgccaagactggtcaatcggcagacagtggaacaattaaagccaaactgagcggccctagcgtggaggaattggaaagagaactggaggccaataagaaagagaaaatgaaggaagcccagcttgaggccgaggtgaagctgctgcgcaaggagaatgaagccttacgccgccatatcgccgtcctgcaggccgaggtgtatggcgccagattggctgcgaagtacctggacaaagaattggctggtagagtacagcagatccaacttttgggacgggatatgaagggtccggcgcacgataaactctggaaccaattggaggccgagatccacctgcaccgtcataaaacggttatccgcgcatgccgggggcgtaacgatctgaagcgacccatgcaggctccaccgggtcatgatcaagatagccttaaaaagagccaaggagtaggacccattaggaaggtcctccttcttaaggaggatcacgaaggactggggatcagcattactgggggtaaagagcatggcgtgcccatactcatatccgaaattcatccaggccagccggccgaccggtgcggagggttgcacgtgggcgatgcaatcttggcagttaatggcgtcaatctgcgagataccaagcacaaagaggctgttactattctttcacagcagcgaggagagatcgaatttgaggtggtttacgttgcccctgaagtcgactcagatgacgagaatgtcgaatacgaagacgaaagtggccaccggtatcgcttgtacctggacgagctggaaggaggcgggaaccctggggcttcctgcaaagatacaagcggcgagataaaggtgctgcaaggcttcaacaagaaggcggtgacagacactcacgagaatggtgatttgggaaccgcctcagaaaccccgctggacgacggagccagtaagctcgacgacctgcacacattgtaccataaaaagtcatactag

SEQ ID NO: 189725 - DNA, 1389 bp, Artificial Sequence
  Description of Artificial Sequence: Synthetic coding sequence
atgagcgccggcggcccctgccccgccgccgccggcggcggccccgggggggcgtcatgctctgtcggcgcacccggcggtgtgtctatgttcaggtggttggaggtgttagagaaagagttcgacaaggcctttgttgatgtggacttgctactgggggaaattgatccagatcaggcggatatcacctatgagggacgccaaaaaatgacaagcctctcttcttgctttgcccaactgtgtcacaaggcgcagtcagtgtctcaaatcaaccataagctggaggctcagctagtagacttgaagtccgaactgaccgagacccaggccgaaaaagtggtactggaaaaggaggttcacgatcagttgctccagctccactctatccagctgcagcttcatgccaaaactggacagagcgctgatagcgggacaattaaggccaaactcgtaagcagaagttcctcaaagatggaacgggagttagaggccaataagaaggagaagatgaaagaagcacagctggaagctgaggtcaaactgctaagaaaggagaatgaggccctgaggagacacatcgcggtcttacaggccgaggtgtatggagcccggttggcggccaaatatctggacaaagaactggccggaagggtccagcagatccagcttctaggccgtgacatgaagggtcccgcccatgacaagctttggaaccagcttgaagcagagatccacctgcatcgccacaagactgtcatccgcgcatgcagaggacggaatgacctgaaacgtcccatgcaggcccctcctggccacgaccaagatagtctcaaaaagagtcagggcgtcggcccaattagaaaggtcctcttactgaaagaggaccacgaaggcctgggcatatctatcacaggaggcaaagagcatggcgtgccaatcctgatttccgagattcacccagggcagcccgccgatcgttgtggaggccttcacgtcggagacgcaattctagccgtgaatggagtcaacctgagagatactaaacacaaggaggcagtgactatactatctcaacagcgtggcgagatcgaattcgaagttgtttacgtggcccctgaagttgattctgacgatgaaaacgtggaatacgaggatgagtctgggcaccgctaccgcctctacctggacgagctagagggcgggggcaaccctggggcctcttgcaaagacacgagcggtgagattaaagtcctgcagggattcaataaaaaggccgtcaccgacacacacgagaatggagacttgggcaccgcatccgagacaccactggatgacggagcaagcaaactggacgacctgcatacgctgtaccataagaagagctattag

SEQ ID NO: 189726 - DNA, 1659 bp, Artificial Sequence
  Description of Artificial Sequence: Synthetic coding sequence
atggagcccgccatggagcccgagaccctggaggcccggatcaaccgggcaactaatcctcttaacaaagagctcgattgggcatcaatcaatgggttctgtgaacagctcaatgaagatttcgagggccctccgcttgcaacacggctgctcgcccacaagattcagagcccccaagaatgggaggctatccaagcactcacagtgcttgaaacttgtatgaagagttgcggaaaacgctttcacgatgaggtcgggaaatttagattcttgaacgagcttattaaggtggtgagcccgaaatatctgggaagtcgcacatcggaaaaagtaaagaacaagattcttgagctactatactcttggaccgtgggtctgcccgaagaagttaaaatcgcggaagcataccaaatgctcaaaaagcaggggatagtgaaaagtgatccaaagctcccggatgacacaacattccctctaccacccccaaggccgaaaaatgtgatattcgaggacgaagagaaatctaagatgctggcaagactgctgaagagtagccaccccgaggacctgcgcgcagcgaataagctgataaaggaaatggtccaggaggatcagaaacgaatggagaaaatatcaaagcgggtcaatgcaatcgaagaggttaataataacgtgaagctcttgaccgagatggttatgtctcactcccagggcggcgcagcagccgggtcatccgaggatttgatgaaagaattgtaccagcgctgtgagcggatgagaccaactttgtttcgcttggcatccgatacggaagacaacgacgaggcactcggactgagtgaccctacgccgccaagcggaccgtctctggacggcacaggctggaactcttttcagtcatcagacgccactgaaccgccggcccctgccctcgcccaggcaccatctatggaatccaggcccccggctcagacatctctcccagctagcagcggattggacgacctggacctgcttggcaagacactccttcagcaaagcctcccacccgagtctcagcaggtcagatgggaaaaacaacaacccacacctcgcctcacacttagggacttacagaataagtcttctagctgctcttcccctagcagtagtgccacctccttactgcacacggtgagccctgagccgcccagacctcctcagcagcctgtgccaaccgagctgtccctggcaagtatcaccgtccccctcgagagcattaagccttcaaacatcctgccagtgactgtatacgatcaacacgggtttaggatactattccattttgcacgcgaccctctgccagggcgatctgacgtactggtggttgtcgtgtcaatgttgagtaccgctccacagccaatacggaatatagtgtttcagtcggccgtgccaaaagtaatgaaggtaaagttacagcccccctcaggcacagagttacctgcattcaaccctatagttcacccctctgcaataacccaggtcctgttgctggccaatcctcagaaggaaaaggttaggctcagatataagttgacgtttactatgggcgaccagacctataacgagatgggtgacgtcgaccaattcccccctccagagacatggggatccttatag

SEQ ID NO: 189727 - DNA, 117 bp, Artificial Sequence
  Description of Artificial Sequence: Synthetic coding sequence
atgaagagctgcggcaagcggttccacgacgaggtgggcaagttcagatttcttaatgagctaataaaggtcgtctcccctaaatacctcggcagcagaaccagcgagaaggtgtag

SEQ ID NO: 189728 - DNA, 1821 bp, Artificial Sequence
  Description of Artificial Sequence: Synthetic coding sequence
atggagcccgccatggagcccgagaccctggaggcccggatcaacagagcaaccaaccctctcaacaaagaactagattgggccagcataaatggattctgtgaacagctgaacgaagacttcgaggggccccccctagcaaccaggttgttggcccacaagattcagtcgccgcaggaatgggaggcgattcaggcactgacttacctggggtctagaaccagtgaaaaagtgaagaacaaaattctcgagctgctgtattcatggacggtcgggttacctgaggaggtgaagatcgctgaagcataccagatgcttaaaaaacagggtatcgttaagtctgatcctaaacttccagatgacaccacatttcccctccctccgccgagaccaaagaacgtgatttttgaagacgaggaaaaatctaagatgctcgcgagattgctaaagtccagccatccggaggatcttagggctgcaaataaacttattaaagaaatggtgcaggaagaccagaagcgcatggagaaaatttccaagagggtcaacgcgatcgaagaggtgaataataatgtgaaattgctcacggaaatggtgatgagccacagtcaggggggcgctgccgctggcagctccgaagatctgatgaaagagctctaccaaaggtgcgagaggatgcgcccaacattgttccggctggccagcgacactgaggataatgatgaggcgttggcagagattttgcaagccaatgataacctcacgcaggtgatcaatctgtacaaacagctggtcaggggtgaggaggtgaacggggatgctactgccggttcgattccgggatccacgtccgctcttcttgacttatcggggctggacctgccccccgccggcacaacctatccagctatgcccactcgaccaggcgagcaagccagccctgaacaacctagcgcatctgtgagtctgttggacgatgaacttatgtcactcggactctccgatcccacaccaccttccgggcccagccttgatggaacaggatggaattccttccagtcatccgacgccacggaaccaccagctcctgccttggcccaggccccaagtatggaatcacgtccacccgcgcaaacctcactgcccgcttccagtggcttggatgatctcgacttactcggtaagacccttctacagcagtcgttgccacctgaatcccagcaggttagatgggagaaacaacagccaacaccccgacttactttgagggatcttcagaacaagagcagcagctgcagcagcccaagttctagtgccacgtctttgctccatacagtcagcccggaacccccacgccccccccagcagccagtgcctaccgagttaagtttggcctccataaccgtcccactcgaatcaatcaagccaagtaatattcttccagtaacagtatatgatcagcacggttttcgcatcctcttccatttcgctcgtgacccactgcctggccgtagtgacgtgctggttgtggttgttagcatgctttccactgctccccaacccatccggaacatcgtgtttcagagtgccgtcccaaaggtgatgaaggttaaactgcaaccaccctccgggaccgagttacctgcttttaaccctatcgtgcacccaagcgccattactcaggttttactgctggctaacccacaaaaggagaaagtccggctccgttataaactgacgttcactatgggcgatcagacctataatgagatgggagacgtggaccaattcccaccacccgagacctgggggagtctgtag

SEQ ID NO: 189729 - DNA, 1920 bp, Artificial Sequence
  Description of Artificial Sequence: Synthetic coding sequence
atggagcccgccatggagcccgagaccctggaggcccggatcaacagggctaccaatcctctgaacaaagaactcgactgggctagcatcaacggcttttgtgagcaattgaacgaggattttgaggggccacccctggctactcgactgctggcccataaaatccaaagcccccaagagtgggaggccatacaagccctgaccgtcctggaaacctgtatgaagtcctgcggcaaaagatttcacgacgaagtaggcaagtttagattccttaatgagctgattaaggtagtgtccccaaaatacctggggtcgagaacaagcgaaaaggtgaagaacaaaattctggaactgctttattcctggactgtgggtctgccagaagaggtcaaaatcgccgaagcctaccaaatgttaaaaaagcagggcattgttaaatctgatcctaaactgcctgacgatacaaccttccctctgccccctcctcgccccaagaacgtgatattcgaagatgaagagaaatcgaagatgctggctcggctgcttaagtccagtcaccccgaggacctgcgagcagccaataagctaatcaaggaaatggtgcaggaagaccagaagaggatggagaaaatcagtaagcgcgtgaatgccatagaggaggtaaacaacaatgtgaagctcctgactgagatggtgatgagccactctcagggcggtgccgcggccggaagcagtgaggatcttatgaaggagctctaccagcgctgcgaacgtatgagaccaactctgtttaggctcgcttctgatactgaagataacgacgaagctctggccgagatcctgcaggccaatgacaatttaacacaggtgataaatctgtataagcagctggtcaggggcgaggaagtcaacggtgacgccacagctgggtcgattccaggctctacgtcagcactgctagatctgtctggcctagacctccccccagcagggacgacctacccagctatgcctacgaggccaggggaacaggcgagtccggagcaaccttcagcttctgtctccttgcttgatgacgaactcatgtctctcgggctgtctgatccaactcctccttcgggccccagcttggatggcaccggctggaactctttccagtcatcagacgcaacagaacccccagctccagcacttgcccaggctccgagtatggagagtcgtcctccggcccagacctctttgccggcctcctcaggcttggatgatctcgatctgctgggcaaaaccctgctacagcagtctctgccacccgaatctcagcaggttaggtgggaaaagcagcagcctacgccacgcttgacactccgcgatcttcagaataaatcctcttcctgtagcagtcccagttcgtctgcgaccagtttactccacaccgtttcccctgagccacctagacccccacagcagcctgttcccacagagctaagcctcgcaagcataacagttccattagaaagcatcaagcccagcaatatactgcccgtgactgtatatgaccagcacggctttcgcatcctttttcactttgccagggaccctctgcctggaagaagcgatgtgctggttgtggtggtgagcatgctgtccacagcaccacaaccaatacggaacatagtgttccagtcggccgtgccaaaagtgatgaaggtcaaactgcagcctccctcaggcacggaattgccggcatttaatcctattgtgcacccttccgcgattacgcaggtgctcttgctcgctaacccacagaaggaaaaggttcgacttcgctacaaattgaccttcaccatgggcgaccagacctacaatgagatgggagacgtcgaccagtttccccctcccgagacctgggggagcctttag

SEQ ID NO: 189730 - DNA, 1971 bp, Artificial Sequence
  Description of Artificial Sequence: Synthetic coding sequence
atggagcccgccatggagcccgagaccctggaggcccggatcaacagggctacaaacccactgaataaagaactcgactgggcctccatcaacggattttgcgaacagcttaacgaggattttgagggtcctcctctcgcgacccgtctcttggcccataaaatccagagcccccaggagtgggaggccatccaggccctcactgtccgcaggggcgaggccacaattagaccgccaccatgcgacgataccaaggttctagagacatgcatgaagtcttgtggaaagcgattccacgatgaagtgggtaagttccggttcctcaacgaattgataaaagtggtctctccaaagtatcttggtagtaggacgtctgaaaaagttaaaaataagatcctggagctactatatagctggaccgtggggctccccgaagaagtgaagatcgctgaggcctaccagatgctgaagaagcaagggatcgtcaaatccgatcctaaactaccagacgacactacatttccactcccccctcctaggcccaaaaatgttatttttgaagacgaggagaaatccaaaatgctggcaaggttgctgaagtcttctcaccccgaggaccttcgcgcagctaataagcttattaaggagatggttcaggaagatcagaaaagaatggaaaagatctctaaacgcgtcaacgccatcgaggaagttaacaacaatgtgaaactgctcacagaaatggtgatgtcacatagtcagggaggcgcggcggcaggttcctctgaagatttgatgaaggaactgtaccagcgatgcgaacggatgcggcccaccctgtttagattggcttcggatactgaagacaacgacgaagctctcgcagagatccttcaagccaatgataacctgacccaggtcatcaatctgtacaagcagctggtacgcggagaagaggtcaatggggacgcaacggctgggagcatacctggcagtacaagcgccttgctggatcttagcgggctggatctgcctcccgcaggcactacctatccagctatgcctactcgacccggagaacaggcctccccagagcagccctccgcttctgtcagtttgcttgatgacgaactgatgtcattgggactgtctgaccctacgcctcccagcggaccatcgctggatggcaccggttggaactcgttccagtcatcagatgctacggagccgcctgcccctgccctggcccaggctccgagcatggaaagtcgcccaccagcgcagacctcgcttcctgcgagcagcggacttgacgatcttgatttactggggaaaacgctgcttcagcaatcacttccccctgagagccagcaggtgcggtgggagaagcagcagcccaccccccgcttgaccctccgcgacctgcaaaacaagtcaagttcctgctcctctcccagtagctccgcaacatcgctcttgcacacagtgtcccccgagccaccacgccccccccaacagccagtccccaccgaactgtcccttgccagtatcactgtgccattggagtctataaagccgtccaacattttacccgtaacagtctacgatcagcacggctttagaatccttttccatttcgcgcgcgaccccctgcccggacgtagcgacgtccttgtggtggtggtgtcaatgctcagcaccgcgcctcagccaatccgcaatatcgtgttccaaagcgcagtgccaaaagtaatgaaggtgaaactccagccaccctctggtacagagctgcctgccttcaatcccattgtgcatccatctgccatcactcaggtgctcctgttagcaaatccgcagaaagaaaaggttcgactgcggtacaagctaacctttaccatgggcgatcagacctacaacgagatgggtgacgttgaccagttcccccccccggaaacctgggggtcactttag

SEQ ID NO: 189731 - DNA, 1701 bp, Artificial Sequence
  Description of Artificial Sequence: Synthetic coding sequence
atgaagagctgcggcaagcggttccacgacgaggtgggcaagttcagatttctgaatgagttaataaaggtagtgtctcctaagtacctcggcagccggacttccgaaaaagtaaaaaataagattctcgagctgctgtactcttggacggtaggtctgcccgaggaggttaaaatagccgaggcctaccagatgttgaagaagcagggaattgtaaagtccgacccgaaactcccagatgacacaactttcccacttccaccgccaagaccgaagaatgtgatctttgaggacgaggagaagtctaagatgctggctcgactgctgaagtccagccatccagaggacctacgcgccgctaacaaattgattaaggaaatggtgcaagaggatcagaagagaatggaaaagatctccaagcgagtgaatgcaatagaggaggttaataataatgttaagctgctaacagaaatggtgatgagtcacagtcaaggaggagccgccgctggaagcagcgaggacctcatgaaagagctctatcagcgctgtgagcgcatgcgcccgaccctgttccggctagccagcgacaccgaggataacgacgaagcactggccgaaatcctgcaggccaacgataacctcactcaggttatcaatttatacaaacaactcgtgcgcggagaagaggtgaacggcgacgctacggcaggatccataccaggatccacatcagccttactcgatttgtcgggtttagatctgccaccagccggtacgacatacccggccatgccaactaggcctggggagcaggcgagccctgaacagccttccgctagcgtgtcactgctggacgacgaactcatgagtctcgggctgagcgatcccaccccaccatccggccccagtctggatgggactgggtggaacagtttccaatcatccgacgcaaccgagcctcccgccccagcattagctcaggctccaagtatggaatcccggccaccagcccaaacctcattgccagcctcttcagggcttgacgacctcgatctgctgggaaagacattgcttcagcagagtctcccacctgagtcccagcaggtcagatgggaaaagcagcagcctaccccccgcctgactctgagggacttgcagaataaaagctccagctgttccagccccagttctagcgccacctccctcctccatacagtttctcccgagcccccacgaccaccccagcagcccgttcccaccgaactctcattggcctcaattaccgttcccctggaatccatcaaaccctcaaatatccttcctgtgacagtctacgaccagcatggcttcaggattctctttcatttcgctagggatccgttacctggccgaagcgacgttttggtagtagtggtcagcatgctctccacggctccccaacccatcagaaacatcgtattccaaagtgcagttccgaaggtgatgaaggtgaagttgcagccacctagcggcactgagctccctgcctttaatcccattgttcaccctagcgccatcacccaggtactattactggcgaacccacaaaaggagaaagtgaggctccggtataagctgaccttcaccatgggcgaccagacctacaatgagatgggggacgtcgaccagtttccgccccccgagacgtggggctctctgtag

SEQ ID NO: 189732 - DNA, 123 bp, Artificial Sequence
  Description of Artificial Sequence: Synthetic coding sequence
atgaagagctgcggcaagcggttccacgacgaggtgggcaagttccgctttctgaatgagctgatcaaggttgtgtcacctaagtatctcggtagcaggacatcagagaaggtaaaaaactag

SEQ ID NO: 189733 - DNA, 330 bp, Artificial Sequence
  Description of Artificial Sequence: Synthetic coding sequence
atgaagagctgcggcaagcggttccacgacgaggtgggcaagttcaggtttctcaatgagttaatcaaagttgtatcacccaaatacctcggctcaaggaccagtgaaaaagtgaaaaataaaattctggagctgctctactcctggaccgtcggtctgcctgaggaggttaaaattgccgaggcatatcaaatgctgaagaaacagggcattgtgaaaagcgacccaaagcttccagacgacactactttccccttgccgccccctcggccaaaaaatgttattttcgaggatgaggagaaaagcaaaatgctcgcgcggctattatag

SEQ ID NO: 189734 - DNA, 270 bp, Artificial Sequence
  Description of Artificial Sequence: Synthetic coding sequence
atggagcccgccatggagcccgagaccctggaggcccggatcaaccgtgctacgaatccactcaacaaagagttggactgggcatcaattaacggcttttgcgagcagctcaatgaggacttcgagggcccaccattagccactagactgcttgctcataagatccaaagcccacaggagtgggaggccatccaggctcttaccgtacggcgaggggaggccacaattcgccctcctccctgtgatgacaccaaagggggccaggactag

SEQ ID NO: 189735 - DNA, 330 bp, Artificial Sequence
  Description of Artificial Sequence: Synthetic coding sequence
atgaagagctgcggcaagcggttccacgacgaggtgggcaagttcaggtttttaaatgaacttatcaaggtggtctctccaaaatacctcggctcccgcacaagtgagaaggtcaagaacaagatactagagctcctgtatagctggactgtcgggctacctgaagaggtgaagatcgcagaggcttaccaaatgcttaaaaaacagggaattgttaaaagcgatccaaaacttcctgacgatactacatttcctctgcccccgcctcggcccaagaacgttatttttgaggacgaagagaagtccaagatgctcgcccgccttctctag

SEQ ID NO: 189736 - DNA, 327 bp, Artificial Sequence
  Description of Artificial Sequence: Synthetic coding sequence
atgaagagctgcggcaagcggttccacgacgaggtgggcaagttccggtttctgaacgaactgattaaagtcgtcagtccgaagtatctgggttctcgcacatctgaaaaggtgaagaataagattctggagcttttgtactcatggaccgtgggtctccctgaagaagttaaaattgctgaggcctaccagatgctaaagaagcaggggatcgtgaaatccgaccctaagcttcccgacgatacaacattccctttgccacctcctagacctaaaaacgtaatttttgaggacgaggagaagtcgaaaatgttggctcgcttgtag

SEQ ID NO: 189737 - DNA, 57 bp, Artificial Sequence
  Description of Artificial Sequence: Synthetic coding sequence
atgaagagctgcggcaagcggttccacgacgaggtgggcaagttccgatttctttag

SEQ ID NO: 189738 - DNA, 183 bp, Artificial Sequence
  Description of Artificial Sequence: Synthetic coding sequence
atgaagagctgcggcaagcggttccacgacgaggtgggcaagttcaggtttctgaatgagttgatcaaagtggtctcccccaagtatttgggatctcgaacctccgaaaaagtcaagaacaaaatacttgagctcctctacagttggacagttgggctgcccgaagaagtcaagatcgcctag

SEQ ID NO: 189739 - DNA, 87 bp, Artificial Sequence
  Description of Artificial Sequence: Synthetic coding sequence
atgaagagctgcggcaagcggttccacgacgaggtgggcaagttcagatttttgaatgaactgattaaggtggtgagtccaaagtag

SEQ ID NO: 189740 - DNA, 741 bp, Artificial Sequence
  Description of Artificial Sequence: Synthetic coding sequence
atgacccccggcaccgccaaccgggccaccaaccccctgaacaaggagctcgattgggcatcgatcaacggtttctgtgaacagcttaacgaggatttcgaaggcccaccactggccactcggctgctcgctcacaagatccagtccccacaagagtgggaggccattcaagctttgactgtcctggaaacatgcatgaagtcatgcgggaaacggttccacgatgaggtcggcaagtttcggtttcttaatgagcttattaaggtggtgagtcctaagtatctgggctctcgcacctccgagaaagtgaaaaataagatccttgagttactatattcatggaccgtcgggcttcctgaagaggtcaaaattgcggaggcgtatcagatgctcaagaaacaggggatcgtcaaaagtgaccccaagcttcccgacgacaccacattccccctcccaccaccgaggcccaagaacgtcatttttgaggatgaggagaagtctaaaatgctggcccgtttgctgaaatccagtcaccctgaggacctgcgggctgcaaacaagcttatcaaggagatggtacaagaagaccagaaaagaatggagaagattagcaaacgcgtcaatgccatcgaagaggtaaacaataacgtgaagctcctcacggagatggtcatgagccactctcaaggtggagccgccgctggatcgagcgaggatctgatgaaagaactttatcagtag

SEQ ID NO: 189741 - DNA, 213 bp, Artificial Sequence
  Description of Artificial Sequence: Synthetic coding sequence
atgaagagctgcggcaagcggttccacgacgaggtgggcaagttcagattcttaaatgagctgataaaggtggtgtcccctaagtacttggggagcaggaccagtgaaaaggtcaagaacaagatactggagctcttgtatagctggacagtaggtttgccagaagaagtcaaaattgctgaggcttaccagatgctgaagaaacagggatag

SEQ ID NO: 189742 - DNA, 2172 bp, Artificial Sequence
  Description of Artificial Sequence: Synthetic coding sequence
atggccgaggccgagggcgagagcctggagagctggctgaacaaggccactaacccaagtaatagacaggaggactgggaatatatcattggattctgcgatcagatcaacaaagagctcgaaggcccacaaattgccgtgcgcctactcgcccataaaattcagtccccgcaggagtgggaggccctccaggccctgacggtcctcgaggcctgcatgaagaattgcggcagacgctttcataatgaagtgggcaagttcagatttctcaacgagctgataaaggtcgtgagccccaagtacctgggtgatcgcgtgtctgagaaggtcaagacaaaagttatagagctcctatacagctggacaatggccttaccggaggaggccaagatcaaggatgcttaccacatgctaaagcgacagggcatcgtacaatctgatcctcccattcccgtagaccggactcttattccttctccgccaccacgcccgaaaaaccccgtgtttgatgatgaggagaagagcaaactgctggccaagctcttgaagtctaaaaatcctgacgacctccaagaagcaaataagttgatcaaatccatggtcaaagaggatgaagccagaatccagaaagtgaccaaacgattacatacactggaggaagttaacaacaacgtgcgcctattgagtgagatgcttctccattatagccaggaggattcttcagatggtgaccgagaactgatgaaggagttgtttgatcagtgtgagaataagcgacggactctctttaagctggcaagcgagacagaggataacgataacagtctgggtgatattctccaggccagcgataacctgagtcgggtgattaattcctacaagactatcatcgaaggtcaagtgatcaatggcgaagtggctactctgacactgcccgactctgagggaaattcccagtgctcgaaccaggggacacttattgacttagccgaactagatactaccaactccctgagctccgtgcttgcccctgccccaactccccccagctctgggatccctatcctgccgccaccaccacaagctagcggacccccacgatccagatcaagcagtcaagcagaggctacattgggtccgtcaagcacctccaacgcccttagctggctggacgaagagttactgtgtctcggactggccgatcctgctcctaatgttccccccaaagaatccgcgggcaacagtcaatggcatctattgcagcgcgagcagtctgacttggatttttttagtcctcgccctggaactgccgcttgcggcgccagcgacgcacccctgctgcagccctcggctcctagtagcagctcatcccaagctcctttgccacctcccttcccagcgcctgtagttcctgcgtccgtgccagctccttctgctggctcgtcattattttccaccggggtggcccctgctctggcccctaaagttgagcctgcagtcccgggtcaccatggcctggctcttgggaattcagccctccatcacctggacgctttggatcagctcctcgaggaagccaaagtcacatccggcttggtgaagccaactaccagtcctctgatccccacgacaacccctgctcgaccgcttttgccattcagcaccggccctggctctccgcttttccagcccctgagttttcagtcacaagggtcgccccccaagggccctgagctctccttggcctctatccacgtcccactggaatcgatcaaaccgtccagcgctttacctgtgactgcctatgacaaaaatggctttcgcatactgtttcactttgccaaagagtgtccgcccggacgccctgacgttttagttgtggtcgtgtccatgctcaacaccgctcctctcccggtgaagtctatagtactccaggcagctgtgcccaaatcaatgaaagtcaaactgcagccaccctcaggaacagaactttcacctttttctcctatacagcctccagccgcgattacacaggtcatgttgcttgcaaacccacttaaagaaaaggtgcgcctccggtataagctgaccttcgcactcggtgaacagctgtctacagaggtgggggaagttgatcagtttccgccagttgaacagtggggaaatctctag

SEQ ID NO: 189743 - DNA, 2073 bp, Artificial Sequence
  Description of Artificial Sequence: Synthetic coding sequence
atggccgaggccgagggcgagagcctggagagctggctgaacaaggctacaaacccttcaaatcgccaagaggattgggagtacattattggcttctgtgatcagattaacaaagagctagagggtcctcaaatcgcagtgcggctgctagctcataaaattcagagccctcaagagtgggaggctcttcaagccttgacctacctaggggatagggtgtccgagaaagtcaagacaaaggttatcgagctgttgtactcttggaccatggcactcccagaagaagctaagatcaaggacgcgtatcacatgttgaagcggcaaggaatcgtgcagtctgacccgcccattcctgtggatcgaaccctgatcccctccccgcccccccggccgaaaaaccccgtattcgacgacgaggagaaatccaaactgctggctaaactgttgaagtccaaaaatccagacgatctgcaagaggcaaataagctgattaagtctatggtcaaggaggatgaggcgagaatccagaaggtgacaaagcgacttcataccctggaggaagtcaataataatgttagactcctctcggagatgctcctgcattattctcaagaggactcttcagacggtgaccgcgaactgatgaaagagctgttcgatcaatgcgagaataagcgcagaactctttttaagttggcaagcgagactgaagacaacgataattcgctgggggacattctgcaggctagtgataatctcagtagggtgataaactcatacaaaacaatcattgagggacaggtaatcaacggagaggttgccaccttgacactgcccgacagcgagggaaactctcagtgctccaatcaaggaacattaatcgatctcgcagaattagacaccacaaactccctcagttccgtactggccccggctccaactcctccaagcagcggcatcccaatactgccccctcccccacaggcttcagggccgccgagatctcgctctagctctcaagcagaggccaccctgggcccgtcttccacgtctaatgccctctcctggctggatgaggaactcctttgcctgggacttgcagaccctgcacctaatgtgccacccaaggagagcgcaggcaatagccagtggcatctactacagagggaacagagtgacttggattttttttccccccgccctggcacggctgcctgcggggcatccgatgctcctctgctgcagcccagcgcgccttccagctctagctcacaggccccgcttcctcctcctttccccgcccctgtggtacctgcgtctgtgccggccccaagtgctggtagtagcttgttcagtaccggagtggcacccgccttagctcccaaggtggaacctgcagtgcccggccaccacggtctggcacttggaaacagcgctctacaccacctcgatgctttggatcagctgcttgaagaagcaaaggttaccagcggcctagttaaacccaccactagcccgctcatcccaacaaccaccccagccagacccctgcttcccttctccaccggaccgggttctccactgttccagccactcagtttccagtcccagggaagccctcctaagggtccagagttaagtctcgccagcatccatgtcccgctcgagagcatcaagcctagctcggccctgcccgtcacggcatacgataaaaatggatttcggatactctttcatttcgctaaggagtgcccacccggcagacccgatgtgctggttgttgtggtgagcatgctgaacactgcacctctcccagtaaagagcatcgttctgcaggctgctgtaccgaagagtatgaaggtgaaactgcagcctccatccggcacggagctctccccattttctcctatccagcctcctgcagctatcacacaggttatgttgctggccaaccccctcaaggagaaggttagactgagatacaagctgacctttgccctgggcgagcagctgtccacagaagtcggggaggtcgatcagttcccacctgtcgagcagtggggaaacctctag

SEQ ID NO: 189744 - DNA, 1956 bp, Artificial Sequence
  Description of Artificial Sequence: Synthetic coding sequence
atgaagaactgcggccggcggttccacaacgaggtgggcaagttccggttcttaaacgaactgatcaaggttgtgtctcctaagtacctcggggatagagtatcagagaaggtgaaaacaaaagtgattgagctcctgtatagctggacgatggccctgcctgaagaagctaagataaaggatgcttaccacatgctgaaacggcagggtatagtccagagcgacccacctattccggtcgaccgcacccttatcccctccccgccaccccggccgaaaaacccagtgttcgatgacgaggaaaagagtaagcttctagccaagctgttaaagtcgaaaaacccagatgacctgcaggaggcaaataagctcatcaaaagtatggtgaaagaggacgaggctagaattcagaaggtgacaaagcggctgcatactctggaagaagtgaacaataacgtcaggctactgtccgagatgctgctgcattatagccaggaggacagctcggacggagaccgtgagttgatgaaagagttgtttgatcagtgtgaaaataagcgtagaacgctgtttaagctggccagtgagaccgaagacaacgacaacagtctcggcgatatcctacaggctagcgacaatttgtcccgggtgattaactcttacaaaacgatcattgagggacaggtcatcaacggggaagtggccacactaacactgccagattcagaggggaattcacagtgctccaatcagggtactttaatcgacctcgctgagctggacactacgaactctctttccagtgtccttgcaccagcacctactccaccctccagcggaataccaattctgccaccaccccctcaggcgtcaggtcccccccgctctcgatcttctagccaggccgaagccacactaggcccaagtagcacaagcaacgctctttcatggctcgatgaagaactgctgtgtctcggactcgcagatcccgcacctaatgtgcctcctaaggagagcgcgggcaattcccagtggcatctgttgcagcgggaacaatcggatcttgatttcttcagcccccggccaggcacagctgcctgtggtgcttccgacgcacccctgcttcagccaagtgcacctagcagcagctctagccaggcccccctgccacctccatttccagctcccgtggtgcctgcctcggttccggctcccagcgccgggtcgtccttattctctacaggggtggccccggctctggctccaaaggtggagccagccgtgccaggtcaccacggcctcgctctgggcaattccgcgctgcatcacctggacgcattggatcagttgttagaggaagccaaggtgacctccggactcgtcaaacctacaacttccccacttatcccgacgactaccccggctcggcccctcctgcccttctccacggggcctggatcaccactttttcaaccactttccttccagtcacaaggaagcccacccaaggggcctgaactctcccttgcgagcatccatgttccgttagagtccattaagccttccagcgccctgcccgtgactgcgtacgataaaaacggatttcggatccttttccattttgctaaggagtgtcctcccgggaggccagatgtcttggtggttgtagtatcaatgctgaatactgcccctcttcctgtgaagtccatcgtactgcaggccgcggttccgaagtccatgaaggtcaaactgcagccaccttctgggacagagctgagtcctttctccccaattcaaccacctgcggccattacccaggtgatgcttttggcaaaccccctcaaagaaaaggttcgcttgcgctataagcttacctttgctcttggtgagcagctgtccactgaggttggagaggttgaccagttcccgcccgttgagcagtggggcaacctctag

SEQ ID NO: 189745 - DNA, 462 bp, Artificial Sequence
  Description of Artificial Sequence: Synthetic coding sequence
atggccgaggccgagggcgagagcctggagagctggctgaacaaggccactaatcctagtaaccgccaggaggattgggaatacatcatcggattttgtgaccagattaacaaagagctggaaggcccacagatcgctgtccgcctgctggcacataagattcagtccccgcaggagtgggaagcccttcaagccctcacagtgctcgaagcctgtatgaagaactgcggaagaaggtttcacaacgaggtcgggaaatttaggttcctcaatgaactgatcaaagttgtgtcccccaagtaccttggggacagagtgagcgaaaaagtgaagactaaagtaatcgagctgttgtattcttggaccatggccctgcccgaggaggcgaaaattaaggatgcctaccatatgttgaagaggcaggctttcagtcaggccgccgaaaaacagaaaccacggtag

SEQ ID NO: 189746 - DNA, 1806 bp, Artificial Sequence
  Description of Artificial Sequence: Synthetic coding sequence
atggccctgcccgaggaggccaagatcaaggacgcctaccacatgctgaagcgccagggaatagtgcagtccgaccctcccatacctgtagaccgaactctgatacccagtcctcctccccggcccaagaatcccgttttcgacgatgaggaaaaaagcaagctgctcgcaaagctgcttaagagtaaaaatccggatgacctgcaggaggcaaacaagctcatcaagtccatggtaaaggaggacgaggcacggattcagaaggtgacaaaacggttgcacacgctggaagaggtcaataataatgtcaggctcctcagtgaaatgctgcttcactactcacaggaagattcatctgacggcgacagggaactgatgaaagagctattcgaccagtgcgagaacaagcgcagaacgctgttcaaactggccagtgaaactgaggacaatgacaactctctgggagatatcctccaggccagcgacaatcttagcagggtgattaactcttataaaactatcatagagggccaggtgatcaatggggaggtcgccacactaaccttacccgactctgaaggaaactcacaatgcagcaaccagggaacattaattgacctcgccgagctggacacaacgaactccctctccagcgttctggcccctgcacctaccccacccagttcagggatccccatccttcctccgccacctcaggcgtctggtcctcctcgaagtagaagttccagtcaggcagaggcaacattaggtccatcaagcacatcaaacgcactctcctggctggatgaagagttactctgccttggcctggccgaccctgcacccaacgtgccgcctaaggaatccgcgggcaacagccagtggcatctacttcaaagggagcaaagcgacctggacttctttagtcctcgtcctggcactgctgcgtgcggcgcaagcgatgctcccctgttacaacccagtgctccatcatcctccagctcacaggctccactacccccccctttcccggccccagtggtacctgcaagtgtgcccgccccatccgccgggtcttcacttttcagtacaggggtcgcccctgccttggccccaaaggtagagcccgcagtccctgggcaccatggcctggctttaggaaattcagcacttcaccacttagatgccttagatcagctgctggaggaagcaaaagtgaccagcggactcgtcaaacctaccacaagcccactgatccctactacaacccctgctaggcctcttttgcccttctcaacagggccggggtctccactgttccagcctctgtcctttcagtcccaagggagtccaccaaaaggacctgaactgagcctagcctcaattcatgtcccacttgagagtataaaacccagcagcgcattgccagtgaccgcttacgataaaaatggatttcgtatcttgttccatttcgccaaggaatgtccccctggcaggccggatgtgctagtggtggtggttagtatgctcaataccgctccacttcctgttaagtctattgtgttgcaggccgctgtgcccaagtcaatgaaagtgaagctacagcctccttctgggaccgaactgtcaccattctctccaatccagccccctgccgccatcactcaggtcatgctcctcgccaatccactgaaggaaaaggtccgactgagatacaagctgaccttcgctctcggcgagcagctgtcgacagaggtgggagaggttgaccaatttccccctgtggagcagtggggaaacctctag

SEQ ID NO: 189747 - DNA, 918 bp, Artificial Sequence
  Description of Artificial Sequence: Synthetic coding sequence
atggccgccggcctggcccggctgctgctgctgctgggcctgagcgccggtggtcctgcccccgcgggggccgcaaaaatgaaagtagtggaggaaccgaatgctttcggcgtcaacaacccgttccttcctcaggcatctcgcctgcaggccaaacgggatcctagccccgtaagcggtcctgtgcatctatttcggctgtctggaaagtgctttagcctggttgagagtacatataagtacgaattctgtcccttccataatgtgacacaacacgaacagaccttcagatggaatgcttacagcggaatacttgggatatggcacgaatgggaaattgctaataatacattcactggaatgtggatgagggacggcgatgcctgcagaagccggtctagacagagcaaggtggaacttgcttgcgggaaaagcaaccgactcgcacatgtttcagaacccagcacctgcgtctatgccctcactttcgaaactcccttagtgtgccacccacatgcactcctcgtctatcccaccctgcccgaagcactgcagaggcagtgggaccaggtggagcaggatctggcagacgaacttataaccccccagggccacgagaaactgttgaggaccctcttcgaagatgctggataccttaaaacacctgaggagaacgagcctacacagctggagggcgggcctgattcacttggcttcgagaccctagaaaattgccgcaaggcccacaaggagttgtctaaggaaatcaaacgcctgaagggcctgctgacgcagcatgggatcccatatacccgcccgacagaaacgagtaatttagagcatctaggtcatgagacccctagggccaagtcacccgaacaactacgcggtgaccctggtcttcgtggctctttgtag

SEQ ID NO: 189748 - DNA, 4497 bp, Artificial Sequence
  Description of Artificial Sequence: Synthetic coding sequence
atggacggcgccagcgccgagcaggacggcctgcaggaggaccggtctcactcgggcccaagcagcctcccggaggcgcctctaaaacccccaggtcccctggttcctccagaccagcaggacaaggtgcaatgtgctgaggtcaacagggcttcaacagagggagagtcgcccgacggtccagggcagggcggtctctgccaaaatgggcccaccccgccctttcccgatccgccatctagtctggaccctacgactagtcccgtcgggccagatgcatcccctggtgtggccggcttccacgacaacctgcgcaagtcacagggtacctctgccgaagggagcgtgcggaaggaagcactccagtcactgcggctctcccttcccatgcaggaaacccagttgtgctccacagatagccctttacccctggagaaagaggagcaggtccgacttcaggcccggaaatggctcgaggaacagctgaagcagtacagagtgaagcgccaacaggaacggtcatcccagccagctacaaagacccgactgttttcaacactggatccagaattgatgctgaatcccgaaaacttgcccagagcctccactcttgccatgactaaagagtacagttttctgcgaacatctgtgcctcggggtcccaaggtggggtctctgggccttcctgctcacccccgggaaaaaaaaaccagcaagagctcaaaaatccggtcactagcggattatcgaactgaggactctaacgccggcaatagtggtggcaatgttcccgcaccagattcaactaagggttctctcaaacagaacaggagctctgctgcttctgttgttagcgagatcagcttatccccagatactgatgacaggctcgagaacacatcgctcgctggagactccgtttccgaggtggacggtaatgattcagatagctcttcatactcatcagcttccacaaggggcacttatggtatcctgtcgaaaactgtgggcacccaggataccccctacatggtgaacgggcaggagattccagccgacacacttggccagttccccagcatcaaagatgtattgcaggccgccgctgccgagcaccaagatcagggccaggaggtgaacggcgaagtcaggagtcgccgggattcgatttgttcctctgtgagtttagagtcatccgcagctgagacccaggaggaaatgctgcaggtgttgaaagagaagatgcggttggagggtcagctcgaagcgctcagcctcgaggctagccaagccctgaaagagaaagcagaactacaggcacagcttgcagccctgagcaccaaactccaggcccaggtggaatgctcacacagctcccagcagcgtcaggacagcctctctagtgaggtggacacattaaagcaatcatgctgggatctggagcgggctatgacagatctgcagaatatgctcgaggcgaagaatgcttctctggcgagtagtaataacgatttacaggtggccgaggaacagtaccagagactcatggctaaggtggaggacatgcaacgctccatgttatcaaaagacaatacagtgcacgatctgagacagcagatgacggcactgcaaagtcagcttcaacaggtccagttagagagaacaacattgaccagcaaactcaaggccagccaggctgagatctccagtttgcagtctgtcaggcagtggtaccagcagcagcttgcactagctcaggaggcccgagtacgactgcagggagaaatggctcacattcaagtgggccagatgacccaagctgggttgttagagcacctgaagttggagaacgtatcgctttctcagcagctcaccgaaacacagcatcggagcatgaaggaaaaaggacgaatcgccgcccagttgcagggtatcgaggccgacatgctggatcaggaggctgcgtttatgcagatccaggaagctaagaccatggtggaggaagatcttcagcgccgcttggaagagttcgagggggaaagagagaggcttcagcggatggctgactccgcagcttcccttgagcagcaactggagcaggtcaagttgaccctgttgcagagagatcagcaacttgaggcccttcagcaggaacacctggatttaatgaaacaactcactttgacccaagaggctttacagagccgcgagcagagcctcgacgcattgcagacacactacgacgaactgcaggctcggcttggagaattgcagggcgaagccgcctctcgcgaagatacaatctgcctgttacaaaatgagaagatcattctggaagcggccttacaggccgccaagtctggcaaggaggagctggaccgcggagcccggaggctggaggagggaactgaggagacctccgagacactcgagaagctaagagaagagctcgccataaagtctggacaagtggaacatctccagcaggagaccgccgctttgaaaaaacaaatgcagaaaatcaaagagcagtttctccagcagaaagtaatggtggaggcctatcgtcgggatgcgacgagtaaagatcagcttatttccgaactcaaggcaacccggaaaaggttagactctgagctgaaggaactcaggcaggagctcatgcaagtacacggcgaaaagcgcacagctgaggcggagcttagccggttgcatagggaagtcgctcaggtgagacagcatatggccgacttagagggtcacctgcagtcagcccaaaaggaaagggatgagatggaaacccatctgcaaagcctacaattcgacaaagagcagatggtcgcagtaacagaagccaacgaagccctgaagaagcaaatcgaggagctgcagcaggaagctcggaaggctattactgagcagaagcagaaaatgcgtagactggggtccgacctgacttccgcccagaaggagatgaagacaaaacataaagcttatgaaaacgctgtgggcatcctttcacggcgattacaggaggccctggccgcaaaggaagcggcagacgcggaactgggccagttaagagctcagggagggtccagtgactcttcacttgcactccacgagcgtattcaggctctggaagcagagctgcaggctgtctcacactcaaagactctcctcgagaaggaactgcaagaagtgatcgccctgactagccaggaactggaagaaagtagggagaaggtcttagagctagaggatgagctccaggagtcccgcggctttagaaaaaaaattaaaagattagaagagagcaacaaaaaactagctcttgaattggagcatgaaaaaggcaagctcacgggcctcgggcaaagcaacgccgcactcagggagcacaactcgatcctggagacagccctagcgaagcgagaggctgatcttgttcagctgaatttgcaggtccaagctgtcttgcagcgcaaagaggaagaagaccggcagatgaagcatttggtacaggctttgcaagccagcctcgagaaagaaaaagagaaggtaaacagtctgaaggagcaggtggcggctgcaaaagtggaagcgggtcataatagaagacactttaaagccgccagcctggaactatctgaagtgaagaaggaacttcaggcaaaggagcacttggtccagaaactgcaagcagaggccgacgatctgcaaatcagagagggcaaacactcacaggagattgcccaattccaggcagagctggccgaggccagagctcaactacaactcctgcagaagcaattggatgagcagctcagcaaacagccagtcggaaaccaggagatggagaatctgaaatgggaggtggatcagaaagaacgagaaatacagtcgctaaagcaacagcttgacttgaccgaacaacagggccggaaggaattggagggcctgcagcagctgctacagaatgtcaagagcgagctcgagatggcccaagaagacctgtccatgacacaaaaagataaattcatgttgcaagcaaaagtctccgaactgaagaacaacatgaagacccttctgcagcagaatcagcagctgaaactggatctgcggcggggtgcagccaaaactagaaaggaacccaaaggagaggcaagtagtagtaatcctgcaacacctattaaaattcctgactgccctgtgcccgcctccttactcgaagagctcctcaggccgccacccgccgtgtccaaagagcccctgaagaatctgaactcctgcctgcagcagctgaaacaagaaatggactctcttcaacggcagatggaggagcacgcgctgacagtacacgagtccctgtcttcctggacccccctcgagccagccacagcatcacccgtaccccctgggggtcatgctggccctcgtggcgatccgcagcggcattcccaaagccgggccagcaaagaagggccaggtgaatag

SEQ ID NO: 189749 - DNA, 4173 bp, Artificial Sequence
  Description of Artificial Sequence: Synthetic coding sequence
atggacggcgccagcgccgagcaggacggcctgcaggaggaccggtcccacagcggcccttcctctctacccgaggcacccttaaagcctccaggtccattagttccgccagaccagcaggacaaggtgcaatgcgctgaggttaatcgggcaagtaccgaaggcgagagcccagatggtcccggccagggtggcctttgtcaaaacgggcccaccccaccattcccagaccctccaagctcgttggaccctacaacctcacctgttggcccggacgctagtcccggcgtcgccggcttccacgacaatctgcgcaagagccagggaacctcggcagagggatcagtccggaaggaagccctgcaatccctgagattaagcctccccatgcaggagacccaactgtgtagcaccgattcgcctctccccctggagaaagaagaacaggtgaggctccaagctcggaaatggctggaggaacagctaaaacagtatagagtaaaacgccaacaggaaaggtccagtcagcccgcgaccaagaccagactgttttcgacgctggatcctgagctgatgctgaaccccgagaaccttcctcgtgcctcaacacttgctatgaccaaagagtatagcttcctacgcacgagcgtgcccagaggacccaaagttggaagcttgggcttacctgcgcatcccagagagaagaaaacatctaagagcagtaagatcagaagtctggccgattacagaacagaggacagtaatgcaggtaacagcggcggcaacgtgcccgcaccagatagcacgaaaggatctttgaagcagaataggtccagtgcagcatcagtggtctctgagatttctctgtcccccgacactgacgaccgcctggagaatacaagtctggccggggacagcgtgtcagaagtcgacggtaacgatagtgatagctcctcctacagcagcgccagcactcgaggcacatacgggatcctcagcaaaacagttggaacccaagacacgccctatatggtaaatggtcaagaaattcccgctgacaccctcgggcagttcccatctatcaaagacgttctacaggctgccgcggccgaacaccaagatcagggtcaggaggtgaacggggaagtcaggagcagacgggactcgatatgctcctctgttagtttagaaagctcagctgcggagacacaggaagagatgctgcaagtgttgaaggaaaaaatgcgcctggagggtcagctcgaagccctgtccctggaagccagccaagcgctgaaagaaaaagcagagcttcaagcacagcttgcagcactttcgactaagctgcaggctcaggttgagtgcagtcacagcagccagcaaagacaggattcattgtcttctgaggtcgatacactgaaacagagttgttgggacctggaacgggccatgacagatctgcagaatatgcttgaagcaaaaaacgcttctcttgcaagttcgaacaacgatttacaagtggctgaggagcagtaccagaggcttatggccaaagttgaggatatgcagagatcaatgctttctaaagacaataccgtccacgatttgcgtcagcagatgacagccttacagtctcaacttcagcaggttcagcttgaacggacaactctgacctcaaaactgaaagctagccaggccgagattagcagtcttcaaagcgtgaggcagtggtaccagcaacaactggccctcgctcaggaggcaagggtacggcttcagggtgagatggcacacatccaggttggccagatgacccaggcgggcctgttggagcatttaaaactagagaatgtgtcactatcccagcagctcacagaaactcaacatcgctccatgaaggagaaaggacggatcgccgcccagttacagggcatagaagccgatatgctggaccaggaggcggcattcatgcagattcaggaggcaaaaactatggtggaggaggacctgcagcgacgactcgaggagttcgagggcgaaagggaacggctccagcggatggctgatagcgccgccagcctggagcagcaattggaacaggtgaaattgaccctcttgcagcgcgatcaacagctggaggcgctgcaacaggagcacctggacctgatgaaacaacttaccctgactcaggaagccctgcagtcacgggaacagtccctcgatgccctgcagacgcactacgatgagctgcaagcccgtctcggggagctgcaaggggaggcagctagccgagaggatactatttgcctgttgcagaatgaaaagatcatcctcgaggctgccctccaggccgccaagtctggcaaagaggagctggataggggggcgcgaaggcttgaagagggcacagaagagacgtccgaaactcttgagaagctgcgcgaggagttagccattaagtcaggccaggtcgagcacttgcagcaggagacagcagcactgaagaagcagatgcaaaaaatcaaagagcagttcttacaacaaaaagtgatggtggaagcataccgacgcgacgctaccagcaaggaccagttaatctccgaacttaaggctactagaaaaagacttgatagcgagctcaaggagttacgccaggagctgatgcaggtgcacggcgaaaaaaggactgctgaagccgagctgtcacgcctccaccgagaagtagctcaagtccgccagcatatggccgatctggaagggcacctccagtcagctcagaaggaaagagatgaaatggagactcaccttcagtccctgcaattcgataaagaacaaatggtggcagttaccgaggccaacgaagcactgaagaagcagattgaggagcttcagcaggaggccagaaaagctattactgaacagaaacagaagatgcggcgcctgggtagtgatctgaccagcgcacaaaaagaaatgaaaaccaagcacaaggcttatgagaacgcagttggcatcttatcacggcggctgcaggaggctcttgccgcgaaggaggcagcagacgccgaactggggcaactgagagctcagggcggatcctctgattcttccctcgctctgcacgagaggatacaagcgctagaggcggaattgcaggcggtgtcgcacagcaaaaccctgctcgagaaggaactgcaggaggtcatagcattaactagtcaggagttagaggagagcagagagaaggttttagagcttgaagacgagttacaggagtcacgaggtttccgcaagaaaatcaaaagattggaagaatccaataaaaaactggcactggaactcgaacacgagaaagggaaactgacgggcctcggacagagtaacgccgctctgcgcgagcacaactctatcttggagaccgcactggctaagagggaagctgacctggtgcagttgaacctccaggtccaggcagtgctccaacggaaggaggaggaagatcgccagatgaagcatcttgtgcaagcgctccaagcaagtcttgagaaagagaaagagaaagtaaacagtctaaaggagcaggtggcggcagcaaaggtcgaggcgggccacaataggaggcattttaaggcagcttccctggaattgtcagaagttaagaaagagctccaggccaaggaacatctggtgcaaaagcttcaggcggaagctgacgacttgcagattagagaggggaaacatagtcaggaaatcgctcaatttcaggcggaattggccgaagcgcgtgctcagttgcagctcctgcagaagcagctagacgaacaactgtccaaacaacccgtaggcaaccaagagatggagaatctgaagtgggaagtcgatcaaaaagaacgggagatacaaagcttgaaacagcaactggacctcactgagcagcaggggagaaaagaactcgagggcctgcagcagctgctacagaatgttaagtctgagcttgagatggcccaggaggacctctccatgacacagaaagacaagtttatgttacaggcaaaagtgtcagagctcaaaaataacatgaagaccctgttgcaacaaaaccaacagttgaaattagacctgaggcgcggcgcggctaaaactgtgctgcgccctgcttccctcccagggtag

SEQ ID NO: 189750 - DNA, 3405 bp, Artificial Sequence
  Description of Artificial Sequence: Synthetic coding sequence
atggacggcgccagcgccgagcaggacggcctgcaggaggaccggagccactctgggccttccagcctcccggaggcacccctcaaaccccctgggccactggtcccaccagatcagcaggataaagtgcaatgcgccgaagtcaaccgcgccagtaccgagggagagtcccccgatggacctggccagggaggactctgtcaaaacgggcccactccaccttttccggatcctcccagctctcttgacccaactacgtctccagtgggtccggacgcatctccaggtgttgcaggattccatgacaacctgcggaaatcacagggtacgtccgctgaggggtccgtgcgtaaagaggctctccaaagcctgagactgagtctgccaatgcaggagacacagctgtgtagtacagactcacccctcccactcgagaaagaagagcaagtacggcttcaggcgcggaaatggctcgaagaacagctgaagcagtatagggttaagcgccagcaggaacgctcatcccagcccgccaccaagacaagacttttttccaccctagatccagagctcatgctgaacccggagaacctcccccgggccagtaccctcgctatgaccaaagaatatagcttcctcagaaccagtgttcctcgcgggcctaaagttgggtctctaggcctccctgcacacccaagggagaagaagacatccaaatcatcaaagattagatctctcgcagattatcgcaccgaggactcgaatgcaggtaactctgggggcaatgtgcctgctcccgattcaacgaaggggtctttaaagcagaataggagttccgccgctagcgtggttagtgaaatctccctgagccccgacacagacgaccgactggagaacaccagcctggcgggcgactcagtgtcagaagtcgacgggaatgactcagattcaagtagctattcctccgcgtctactagagggacatacggcatcctctctaaaacagtaggcactcaggacaccccctacatggtgaatggacaggaaatccctgctgataccttggggcagttcccttccattaaagacgtccttcaagccgccgccgccgagcatcaagaccagggccaggaggtaaacggtgaggtacgtagtagacgggattcaatttgctcaagcgtatccctggagtcatctgccgccgagactcaggaagaaatgctccaggttctaaaagagaagatgaggctagaaggacagcttgaggccctatccctggaggcaagccaggcccttaaagaaaaagccgagttgcaggcacagcttgccgccctgtcaacaaagcttcaggcccaggtggagtgttctcactcaagccagcagcggcaagattctctttcatcggaggtggatacccttaagcagtcttgctgggacctggagagagcaatgactgacctgcagaatatgctggaggccaaaaacgcaagcctggccagcagcaacaacgatctgcaagtggcagaggagcaataccagcgactgatggcgaaggtggaggatatgcagagaagtatgctgtccaaagacaataccgtacatgatttgcggcaacagatgacggcactgcagtcccagcttcaacaagtgcagctggagagaactaccttaacgagcaaactgaaggcttctcaggcggagatatccagcctccagtccgtgcggcagtggtaccaacagcagctggctctagctcaggaggccagagtccggctgcagggtgagatggcccacattcaggttggtcagatgactcaggcgggcttattagagcatcttaagctagagaacgtgtcactttcacaacagctgaccgagacacaacatcgctccatgaaagagaagggcaggatagcagcccagcttcaaggcattgaagccgacatgctggatcaggaggccgccttcatgcagattcaggaggcgaaaaccatggtcgaggaggatttgcagagaagattagaggaattcgaaggtgagagggagcgcctccaacgcatggctgacagcgcagcatctttggaacagcagttagagcaggtgaaactgacattgctgcagcgcgatcaacagctcgaagccctccagcaagaacaccttgacctgatgaagcagctcactcttacacaggaagcccttcaatccagagagcagagcttggacgccctccaaacccactacgatgagttgcaagcacgcctaggggaactgcagggagaagcagcctccagggaagatacaatatgtctgctccagaacgaaaaaataattctggaagccgcattgcaagcagctaaatcaggaaaagaagagctggacagaggggcacgccgtctggaggagggtactgaagagacaagcgaaaccctcgagaaactcagggaagagctggcgattaagtcagggcaggtcgagcacctacagcaggaaaccgcggctttaaagaagcaaatgcagaaaatcaaagagcaatttctccagcagaaggtgatggtcgaagcttatagaagggatgctacatccaaagaccagctgatatcagagctgaaggcgaccaggaagaggctggattctgagttaaaagagctgcgccaggagctgatgcaggttcacggagagaagaggacggcagaggcagaattgtctcgactgcacagagaagtggctcaagtcagacagcacatggccgacctggaaggacatctgcaaagcgcgcagaaggagagagatgaaatggagacacatttgcagagcctgcaatttgataaggaacagatggtggctgtgaccgaggcaaatgaggctctgaagaagcagattgaagaacttcagcaggaagcaaggaaggccataaccgagcaaaaacagaagatgaggcggcttggcagcgacctcacatcggcccaaaaggaaatgaaaacaaagcacaaagcatacgaaaatgcggtcggcattctgagtaggcgcttgcaggaggctctcgccgcgaaggaagcagccgatgccgaactggggcagttacgcgcacagggtgggagttctgacagctccctcgctttacacgagagaatccaggccctcgaggcggaactacaggccgtaagtcactctaagaccctgcttgagaaagaactgcaggaagtcatcgcgctcacctctcaggagctggaagagtcccgcgagaaagtgttggagcttgaagacgaggtgaggcctggacatctgctctggcgtcagagaggagccggtcacgtgtccccaggtcacgcagccacgcgcgaaacaaggcgcaccaaactccacagagtgccttcagtagccacattcggggttgccacattttag

SEQ ID NO: 189751 - DNA, 6693 bp, Artificial Sequence
  Description of Artificial Sequence: Synthetic coding sequence
atgttcaagaagctgaagcagaagatcagcgaggagcagcagcagctgcagcaggccctcgcacccgcccaagcttcatccaatagcagcacccccacaaggatgcgctctaggacatccagctttacagaacagctcgacgagggcacccctaatcgagagagtggagatactcagagcttcgctcagaaactgcagctgcgggtgcccagtgtggagagcctgtttcggagcccgattaaggagagcttgttcagatcctcgagtaaagagtctctggttcggaccagcagcagggaatccttgaacaggttggatctcgatagctcaactgcctcttttgatccccccagcgacatggactccgaagccgaagatctggtagggaattctgattccctgaacaaggaacagcttattcaacgacttcgacggatggaacggagcttatcgagttacagaggaaaatactcagagctggtgacggcctaccagatgctgcagagagaaaagaaaaagttacaggggattctgtcccaaagccaggacaaaagcttgcggcggattgcagagctccgcgaggagctgcagatggatcagcaggccaaaaaacatctccaggaagagttcgatgccagtcttgaagagaaggatcagtacatctccgtgctccagactcaggtatcattactgaagcagcggttacgcaacggacctatgaatgttgacgtgctgaaacctctgccgcagctcgaaccccaggccgaggtgttcaccaaggaagagaacccagagtcagatggggagccagtggtggaggacggaacctcagtgaaaaccctggagaccctccagcagcgagtcaaacgacaagagaacctgcttaaacgctgcaaagagacaatccaaagccacaaggagcagtgtaccctcctcacatcagagaaggaagccctgcaagaacaactcgacgaacgacttcaggagctggagaagattaaagacctacacatggcggagaagactaaactcattacacagttgagggatgcaaaaaatctcatagaacagctggaacaggataagggaatggtgatcgccgagacgaagcgccagatgcacgagactcttgaaatgaaggaagaagagattgcgcagcttcgatccagaataaaacagatgaccacccaaggcgaggaacttagagaacagaaagagaagagcgaaagagctgcattcgaggaactcgagaaggccctctccaccgcgcagaaaacggaggaagcgcgaaggaagcttaaagcagagatggacgagcagattaaaaccatcgaaaagacaagtgaagaagaacgaatttcgctgcagcaggaattgtctcgcgtgaaacaggaggtggtcgacgtgatgaagaagagctctgaagagcagatcgcgaaactccagaagctgcatgagaaagagttggcgagaaaagagcaggagctaactaaaaagctccagaccagagaacgggagttccaggagcagatgaaggtggcattagagaagtcccaatctgaatatctgaaaatttcccaggagaaagagcagcaagagagtctggctctggaagagctggagctccagaagaaggccatcctaaccgaatcagagaataaactgcgagatctgcagcaagaagccgagacttatagaactagaattctagaactcgagagctcgcttgagaaatccctgcaagagaataagaatcaatcaaaagatttagctgtgcacctggaagccgagaagaacaagcataataaggaaattacagtaatggtcgagaagcataagactgagctcgagtcccttaagcatcagcaggatgccctgtggactgagaaacttcaagtgctcaagcagcagtaccaaacagagatggaaaagcttcgggagaaatgcgaacaagaaaaagagaccctgctgaaagacaaagagatcattttccaagcacatatcgaggaaatgaacgaaaagaccctcgagaagctggacgtcaagcaaaccgagcttgaaagcctcagctccgagctctccgaagtgctgaaagcccgtcataagctagaggaggagctgtcagtccttaaagaccaaacggataagatgaaacaggagcttgaggccaaaatggatgaacagaaaaaccaccatcagcaacaggtcgacagcatcatcaaggaacatgaggtctccatccagcgcacggaaaaagcccttaaggaccagattaatcagctggaattgctcctgaaagaaagggataagcacctaaaagaacatcaagcccacgtggagaatctggaggccgatattaaacggtctgagggggagctgcagcaggcctcagcaaagcttgacgtgttccagagctaccagagcgcgacccacgaacaaacaaaggcctacgaggagcagctagcccagttgcagcagaaactattggacctagaaactgaaagaatcctactcacaaaacaggtggccgaagtggaagcccagaagaaagacgtctgtaccgagctcgacgcccataagatccaagttcaggatctgatgcagcagcttgagaaacagaactcagaaatggagcagaaagtaaaaagccttacgcaggtgtacgagtcaaagctggaagatgggaataaggagcaggagcagacaaaacagatcctggtcgagaaagagaatatgattctgcagatgcgcgaaggtcaaaagaaggagatcgagatcctgactcagaaactgagcgctaaagaggactcaatccatatcctgaacgaggaatacgagaccaagtttaaaaatcaggaaaagaagatggagaaggtgaagcagaaggccaaggaaatgcaagagacactcaaaaaaaaactgctcgatcaggaggccaagctaaaaaaagagttggaaaatacggcgttggagctctctcagaaggagaaacagttcaatgcaaagatgctggaaatggctcaagctaacagcgcaggtatatctgatgccgtgtcaaggcttgagactaaccaaaaggagcaaatcgagagtctcactgaagttcatcgtcgcgagctaaatgacgtcatcagtatatgggagaaaaaactcaatcagcaggctgaggagttgcaagaaattcacgagatccagcttcaggagaaggaacaggaagtggcagagctcaagcagaaaatcctgctctttggctgcgagaaagaagaaatgaacaaggagattacgtggctgaaagaggagggtgtcaagcaagataccaccctgaatgagctgcaagagcaattgaagcagaaatctgctcacgtgaattccctggcacaggatgagaccaagttgaaggcccaccttgaaaaactggaggtggacttgaataaaagcctaaaggagaacacatttctgcaagagcaactcgttgagctgaagatgctggcagaagaggacaagagaaaggtgagcgagctcacaagcaagctcaagactactgacgaagagtttcagagcctgaagtccagtcacgagaaaagtaacaaatcactggaagacaagtcccttgagttcaagaagttgtccgaggaactggccattcaattggatatctgttgcaagaaaactgaggctctcctggaagcgaaaactaacgagcttattaacatctcttcaagtaagactaacgccatcctgtcaagaatttcccactgccaacaccgtacaaccaaggtgaaggaggcacttttaataaagacctgtaccgttagtgaactggaggctcaattgcgtcaactgactgaggagcaaaacaccctgaatatcagtttccagcaggctacacaccagctggaggagaaagagaatcagatcaaatcaatgaaggcagacatagagtctctagtgaccgaaaaagaagcgctgcagaaggagggggggaatcagcagcaggccgccagcgagaaagaatcatgcatcacacagctgaagaaggaactctctgaaaacattaacgccgtcacactcatgaaagaggagctcaaagagaaaaaagtggaaatatcgagcctttccaaacagctgacagacctcaacgtgcagctgcagaactcgatcagcctgtccgagaaagaggctgccatctcctctctgcggaagcaatacgatgaagagaagtgtgaacttctggaccaagtccaagacttgagctttaaggtggacactctgagtaaagaaaaaattagtgctcttgagcaggttgatgactggtctaataagtttagcgaatggaagaaaaaggcgcagtccagattcacccaacatcagaacactgtcaaggaattgcagatccagcttgaactgaagtcgaaagaagcttatgagaaagacgagcagattaacctgttaaaagaggaattggatcagcagaataagaggttcgactgcttgaaaggagagatggaggacgataagtctaagatggaaaaaaaggagtccaatctggagaccgaacttaagtctcagacagctcgaattatggagttagaggatcacatcacacaaaaaaccatagagatcgagtcactcaatgaagtattgaagaattataaccagcaaaaagacatcgagcataaggagctggtacagaaattacagcatttccaggaactcggagaagagaaggataacagggtaaaggaagccgaagaaaagattttgaccctggagaaccaagtgtactctatgaaagctgaactggagaccaaaaaaaaggaactggagcatgtcaacctgagcgttaagagcaaggaggaggagttaaaggcgctggaggatcgcctagagtctgaatcagcagcaaagctagctgagttaaaaaggaaagcagaacagaagattgccgccatcaagaaacagctgctgagccagatggaggagaaagaagaacaatacaaaaaaggaaccgaatctcacctgtcagagctcaatacgaaactacaggaaagagaacgcgaggtacatattctcgaggaaaagctgaaatccgtggagagctcacagtctgagaccctaatagttccacgatctgccaaaaacgtggcagcttatacagagcaagaagaagccgactctcagggatgtgtgcaaaaaacttatgaggagaaaatcagcgtcctccaacgcaacttgacggaaaaggagaagcttctacagcgggtgggccaggaaaaagaggaaactgtgagttcccacttcgaaatgcgctgtcagtaccaagagcggttaattaagcttgagcatgcagaggcgaagcagcacgaggatcagagtatgattggccatttgcaagaggagcttgaagaaaagaacaagaaatattccttaatcgtggctcagcacgtggagaaggaaggtggtaagaataatatccaggcaaagcagaacctcgaaaacgtcttcgacgacgttcaaaaaacactccaggaaaaagagttgacatgtcagatactggagcagaagatcaaggaattggactcctgtctagtccggcagaaagaagtgcaccgcgtcgaaatggaagagttgaccagcaagtacgaaaaattgcaggcgttgcagcagatggacgggagaaataagcccacagaactgctcgaggaaaatactgaggagaaatccaagagtcatctggttcagcccaagcttctgtccaacatggaagcccagcacaatgaccttgagttcaagctggcaggagcagagcgggagaagcagaagctgggtaaggaaattgtcagactccagaaggatctcagaatgctacgcaaggaacaccagcaggaactggagatcctgaaaaaagaatatgaccaagagcgggaagaaaaaattaagcaagagcaggaggatctagagctaaaacataactccacgctgaaacagctgatgagagagtttaatacgcagttggcccagaaggagcaggaactagagatgaccattaaggaaacaattaataaggcccaggaagtcgaagctgaactgctcgaatcacaccaggaggaaaccaaccagctgctgaaaaagatcgctgagaaagacgatgacttgaaaaggaccgccaaaaggtatgaggagatcctcgatgcacgagaggaggagatgacagcaaaggtgcgagacctgcagactcagctggaggagctgcagaaaaagtatcagcaaaagctggaacaagaagagaatccgggcaacgacaatgtgaccattatggaactgcagacccagctggctcaaaaaaccacactcatcagtgattccaagttaaaagagcaggagttcagggagcagatacacaatctggaggacagactgaaaaaatatgagaagaatgtctacgcgaccaccgtgggtacgccatacaagggaggcaatttataccacactgatgtgtcacttttcggggagcccaccgagttcgaatacttaaggaaagtcctgtttgaatacatgatggggagggagactaagaccatggccaaggttatcacaactgttcttaagtttcccgatgatcagacacagaagatccttgagcgggaggacgcccgactcatgttcaccagcccgcgctccgggatcttttag

SEQ ID NO: 189752 - DNA, 6732 bp, Artificial Sequence
  Description of Artificial Sequence: Synthetic coding sequence
atgttcaagaagctgaagcagaagatcagcgaggagcagcagcagctccagcaggccctcgcaccagcccaggcctcttccaactcctcaaccccaacccgaatgcgctctcgaaccagctctttcacagagcaactggacgaaggtaccccaaatcgggaaaatgctagcacccacgctagcaaaagccccgatagcgtgaatggttctgagccatccattcctcaaagcggtgacacacagagctttgcacagaaattacagctgagagtgccttccgttgagtcactgtttcggagcccgatcaaggaatccctgtttagatctagtagtaaggaatccctggtgcgcacctcctcccgggaatctttgaaccgcctcgatctagattcgagcaccgcatcttttgatccaccatctgacatggactctgaagctgaagacttagttggcaacagcgatagcctaaataaagagcagctgattcagcgcctgcggcgcatggagcgatcgttgtcctcatatagaggaaagtacagcgagctggtgacagcttaccagatgctgcagcgggaaaaaaaaaagttacaaggcatcctttcgcagagtcaggataaaagtctgaggcggattgccgagctcagggaggagctacagatggatcagcaggctaaaaagcaccttcaggaggagtttgacgccagcctggaggagaaagaccagtatatttctgtgctgcaaacgcaagtatccttactgaagcagaggttgcggaacggaccaatgaacgtcgatgtgttaaagccccttccccagcttgaacctcaggcagaagtcttcacaaaagaggaaaaccccgagagcgatggcgagcccgttgtcgaggatggcacttccgtcaaaaccctggagacactgcaacagcgtgttaagaggcaggaaaatttgctcaaacgctgtaaggagactattcagtcacataaggagcagtgcactttgctgactagtgagaaggaagccttacaggagcagctcgatgaacgcctacaagagctcgagaaaataaaagacctgcacatggcagagaaaactaaattgatcacgcagttgagagatgccaagaacctcatcgagcaacttgagcaggataaagggatggtgatcgccgagaccaagagacaaatgcatgagacactagaaatgaaagaagaggaaattgctcagctgagaagtagaataaagcagatgacaactcagggcgaggaactgagggagcaaaaggagaagagtgaacgcgccgcattcgaggagctggaaaaagctctgtccaccgcacaaaagacagaggaggccaggagaaagttgaaagctgaaatggacgaacaaatcaaaactattgaaaagacaagcgaagaggagcgaatcagcctgcagcaggagctgtcccgcgttaaacaggaggttgttgacgtgatgaaaaaaagcagcgaagaacagatagctaaactgcagaagctgcacgaaaaggagctggctcgcaaggaacaagagctgacaaagaaacttcaaaccagagagcgtgaattccaggagcagatgaaggtggcgcttgagaaatcccagtctgaatatctgaaaattagccaggagaaggaacagcaagagagtctagctcttgaggagctggaactgcagaaaaaagcaatcctgaccgaaagtgaaaacaagctgcgtgacctgcagcaagaagctgaaacttataggaccaggatcctggagctcgagtccagtctggagaagtctctccaggaaaataaaaaccagtcgaaagatctagctgtccacctggaggccgaaaaaaacaaacacaacaaagaaattacggtgatggtagagaagcataaaacggagctagagagtctgaagcatcaacaggatgcattatggaccgagaagcttcaagtattgaaacaacagtaccagaccgaaatggaaaagcttcgtgaaaaatgcgagcaggaaaaagagaccctcttgaaagacaaggagattattttccaggcacatattgaggaaatgaatgagaaaacactggaaaaactagatgtaaaacaaaccgaattagagagtctgagtagtgagctgtccgaggtgctgaaagctaggcataaactggaagaggagctgagcgtgctgaaagatcagactgacaagatgaagcaggagttagaagcgaagatggacgagcagaagaaccatcatcagcagcaggtagacagtataatcaaagagcatgaggtgtccatccaaaggaccgaaaaggcactgaaggaccagattaatcagctagagctcctccttaaggagcgagataaacacctgaaggaacaccaggcacacgtggagaacctggaggccgacataaaaaggtccgaaggcgaattgcaacaggcttccgctaaactggacgtctttcagagttatcagtcagcaactcatgagcagaccaaggcatacgaagagcagcttgcgcagctgcagcaaaagctgctcgacttagagaccgaacgcatcctgcttacaaagcaggtcgcggaggtagaggcccagaaaaaggacgtgtgtaccgagctcgatgctcacaagattcaggtgcaggacctcatgcagcaactggaaaaacagaactctgaaatggaacagaaagtgaaatctctaacacaagtgtacgagtcgaagctggaggacggcaacaaagaacaagagcagaccaaacagatacttgtggaaaaagagaacatgatcttgcagatgcgggagggccaaaagaaggaaattgagatactgactcagaagttaagtgccaaagaagacagcatccacatcctaaacgaggagtacgaaacaaaattcaagaaccaagaaaagaagatggaaaaggttaaacagaaagctaaggagatgcaagaaactctgaagaagaaactgctggatcaggaggctaagctcaagaaggagctcgagaacactgctctggaactgtcccagaaggaaaaacaatttaatgccaagatgttagagatggctcaggcaaacagtgccgggatcagcgatgctgtttcccggctcgagacaaaccagaaggagcaaattgagtctctcacagaagttcacaggagggaactcaacgacgtgatcagcatctgggagaagaaactgaatcaacaagctgaagagctacaggaaatccacgaaatccagctgcaggaaaaagagcaagaagtggccgagctgaaacagaagatactgctcttcgggtgcgaaaaggaagaaatgaataaggagattacctggcttaaggaagagggcgtaaaacaagacacaaccttaaatgagttgcaggaacagctcaaacagaaatccgctcatgttaattctctggcccaagacgagaccaagctgaaggctcacctagagaaactcgaggttgatctcaataagtccctgaaggagaatacgttcctccaggaacaactggtagagctgaagatgctggccgaggaggacaagcggaaagtatcagagcttacctccaagctgaaaaccaccgatgaggaatttcagtcactcaaatcttcacacgagaagtctaataaatccttggaggataagagcttggaatttaaaaagctcagtgaagaacttgcaattcagttggatatctgctgcaaaaagactgaagctttgctcgaagccaagacaaacgaacttatcaacatatcctcatccaagaccaatgctatcctcagccgcatctcacactgtcaacaccgcactactaaggtcaaggaggcactgctgattaagacatgtactgtgagtgaattggaagcacaactgaggcaattgaccgaagaacaaaataccctcaacataagtttccagcaggcaacccaccagctcgaagagaaggaaaatcagattaaatctatgaaggccgacatcgagagtcttgtcaccgaaaaggaggcactgcagaaggagggcggaaaccagcagcaggctgcttcagaaaaagaatcctgcattactcagctcaaaaaagaactgtcagagaatatcaacgcagtgacacttatgaaagaagaactgaaggagaaaaaggtggaaattagcagcttgtctaagcagctgacagacttaaatgtacagctgcaaaactctattagcctgtcggaaaaggaagctgcaatctcttccctccggaaacagtacgacgaagagaaatgcgagttgctcgaccaagtgcaggacttatcctttaaggtggacactttgtctaaggagaaaatatctgccctggaacaggtggacgactggtctaataaattctcggaatggaaaaagaaggcccagagcagattcacgcagcaccagaacaccgtcaaagagctgcaaatacagttagaactcaagtcgaaggaggcatatgagaaagacgagcagatcaacctccttaaggaggagctcgatcagcaaaacaagagatttgattgcttaaaaggcgaaatggaggacgacaagtccaaaatggagaaaaaggaatccaacctggaaaccgagctgaagagtcaaacggcacgcatcatggaacttgaagatcacatcacccaaaagactattgaaatcgagtccctgaacgaagtgctgaagaattacaatcagcagaaggacattgagcataaggaactggtgcagaaactgcagcacttccaagagctgggagaggaaaaggataatcgggtcaaggaggcagaggagaaaatactcactcttgagaaccaggtctattcgatgaaagccgagctagagaccaagaagaaggaattagagcacgtgaacctcagtgtcaagtccaaggaggaggagctcaaggccctggaggacaggctggaaagcgagtccgccgccaaacttgctgaactgaagcgaaaagccgaacaaaaaattgcagcaattaaaaaacagctgctgtcccagatggaggaaaaggaagagcagtataaaaagggcaccgagtcacacctctctgagctgaataccaagctgcaggagcgggagcgcgaggtgcacatccttgaggagaagctgaagtctgtcgagagcagtcaatctgagaccctcattgtgccccgctccgccaaaaacgtcgcagcatataccgaacaggaggaggccgactcgcagggttgtgtgcaaaaaacctatgaggagaaaattagcgtgctgcagcggaatttgaccgaaaaagaaaaactgctgcagcgggttggccaggaaaaggaggagactgtgtcaagtcatttcgagatgagatgccaatatcaggaacgactcattaaattggagcacgccgaagctaaacagcacgaagaccagagtatgattgggcacctgcaggaggagctggaagagaagaataaaaagtattccttaatcgttgcccagcatgtcgagaaagaaggggggaagaataacatacaggcaaagcaaaatttagagaacgtgttcgacgacgtgcaaaagaccttacaggaaaaggaacttacatgccagattctggaacagaaaatcaaagagttggattcttgtctcgttcggcagaaggaggttcaccgtgtggaaatggaagaattaacctcgaagtatgagaagctgcaggctttgcaacagatggatggaaggaataagcctactgaattgctggaggagaatacagaagaaaaaagtaagtctcatcttgtgcaaccaaagctcttgagtaatatggaggcccagcacaatgatctggaatttaaacttgccggagccgagcgcgagaagcagaaactgggaaaggagatcgtgaggctgcagaaggacctgagaatgctccggaaagagcaccaacaggaactcgagatcctcaaaaaggaatacgatcaagaacgggaggagaagattaagcaggaacaggaggacttggaactcaagcacaacagcactttaaagcagctcatgagggaattcaatacgcagctggctcagaaagagcaggagctcgagatgaccattaaggagacaataaataaagcccaggaagtcgaggctgagctgctggaaagccaccaggaggagacgaaccagctgctcaagaagatcgccgaaaaggatgacgatctgaaaaggactgccaaacgctacgaggagattctcgacgccagggaggaagaaatgaccgcaaaggtccgggacctgcagactcaacttgaggagctgcagaagaagtaccagcagaagttggagcaggaggaaaaccccggaaatgataacacacagcttgctcagaaaacaaccctgataagtgactcgaaactcaaggaacaggagtttcgcgagcagatccataatcttgaagaccggctaaagaaatacgagaaaaacgtatacgcgacgacggtgggcacaccttacaaaggcgggaacctgtatcatactgacgtatccctgtttggcgagcctactgagttcgaatatctccgcaaggttctgttcgagtatatgatgggacgcgaaacaaagacaatggcaaaagtaatcaccactgtgctcaaattcccagacgatcagacccaaaagatcctggaacgggaggacgcccggttgatgagttggttaagatcaagctcctag

SEQ ID NO: 189753 - DNA, 2196 bp, Artificial Sequence
  Description of Artificial Sequence: Synthetic coding sequence
atgagctggttcgtggacctggccggcaaggccgaggacctgctgaaccgagtggaccagggcgctgccactgcactgtcacgtaaggataacgcctccaacatatattcaaagaacacagactataccgaactgcaccagcagaacactgacctgatatatcagacaggtcccaagtctacttatatctcaagtgcagctgacaatatcaggaatcagaaagccactatcctcgccgggacagctaatgtcaaggttggcagtcggaccccggtagaagcgagtcatccagtggaaaacgccagcgtgcctcgcccttcttctcacttcgtccgacgcaagaagagtgagccagatgatgagctcttattcgacttcttgaatagtagtcagaaagagccaaccggacgggtagagatccggaaagaaaagggtaaaacacccgttttccagtcctctcagacaagcagtgtgagctcagttaatcctagtgtgacgacaataaagactatcgaagaaaactccttcgggtcacagacccacgaagcagccagcaactcagactcatctcatgaagggcaggaagagagttctaaggagaacgtgagtagtaatgcggcgtgccccgaccatacccccaccccgaacgatgacgggaagtcccatgagctgtcaaatctgaggctggagaaccagctcctaaggaatgaagtccagagcctgaatcaggaaatggcgtctctgttgcagcggtccaaggagacccaggaggaactcaacaaagcccgcgcgagggtagagaaatggaatgccgatcacagcaaaagcgaccgaatgacaagaggacttagagctcaagttgacgatctgactgaagcggtagctgcgaaggattcccagctggctgtattgaaggtgaggctccaggaggctgaccagctccttagcacccgcactgaggcattagaagccctgcaatccgaaaagagccgcatcatgcaagaccagtccgagggtaattctctgcagaatcaggccctccagaccttccaggaaaggctccacgaagccgacgcaacccttaaacgcgagcaagagtcttataagcagatgcagtctgaattcgcagcgcgcctgaacaaagtggaaatggaacgccagaacctggctgaagcgatcacactggccgaaaggaagtattctgacgagaagaagagggtggacgagcttcagcagcaagtaaagctgtacaagctgaatctggagagcagcaaacaggagctgatagattacaagcagaaagcaacacgcattcttcaaagtaaagagaaattgattaacagccttaaggaggggagtggctttgaaggactcgacagcagcaccgcaagctccatggagcttgaggaactgcggcatgaaaaggagatgcagcgggaggaaattcagaagctgatgggacagattcaccaactcagatctgagttgcaagacatggaggctcaacaagttaatgaggccgagtccgccagggaacagttacaggatctgcacgatcagatcgccggacagaaggcctctaaacaggagctggagacggaactcgaaagacttaagcaagagtttcactacatcgaggaggatctataccgaactaaaaatacacttcagtcccgaatcaaagatagggatgaagaaattcagaagctgcggaaccagttgaccaataagaccctgagcaactcctctcagtccgaactcgaaaaccgccttcatcagctcactgagactcttattcaaaaacagacgatgcttgaatcattgtcgactgagaaaaattctctggtgtttcaactggagcgcctggagcagcagatgaattcagccagcggatcctcctccaatggcagttccatcaacatgagtggaatcgacaacggagaagggactcggctgcggaacgtccccgttctgttcaacgacacagaaaccaacctggccgggatgtatggcaaagttcgaaaggctgcttccagtatagaccagttctctatcagattgggtatttttctaagacgctaccccatcgccagagtgttcgttatcatctacatggcgctcttgcacctgtgggtaatgatcgtcctgctgacatatactcccgagatgcaccacgatcagccttacggcaaatag

SEQ ID NO: 189754 - DNA, 2076 bp, Artificial Sequence
  Description of Artificial Sequence: Synthetic coding sequence
atgagctggttcgtggacctggccggcaaggccgaggacctgctgaacagagttgaccagggagccgcaacagcgctgagccgcaaggataacgcttccaacatttattccaagaacaccgactatactgaactgcaccagcagaataccgacctgatttatcaaactgggccaaaaagtacctacatcagctctgccgccgacaacatcagaaatcagaaagcaacgattctagccggcaccgcaaatgtcaaagtggggagccgaacccccgtcgaagcaagtcatcctgtggaaaatgcctccgtgccacgccccagcagccacttcgtccggcggaaaaagagcgagccagacgatgaacttctatttgacttcctaaattccagtcaaaaagaaccaacgggcagggttgaaattcggaaggagaaaggcaagacacctgtgtttcagtcatcccagacctcttccgtatctagcgtgaacccaagcgtaaccaccatcaagaccatagaggaaaacagttttgggagccagacacatgaagcggcctccaactcagatagctctcatgaggggcaggaggagtcgtccaaagagaacgtgagctcgaatgctgcctgtccggatcatacaccaacacctaacgacgatgggaagtcacacgagctgtcaaatctccgcctggagaatcaactgctcagaaatgaagtccagagcctcaatcaggagatggcatctctgctgcagcggtcaaaagagacgcaggaagagctgaacaaggccagggccagggtggagaagtggaacgctgaccactcaaagtcagaccgtatgaccagaggacttcgagcacaagtcgatgatttgactgaggccgtcgctgccaaagactcgcagctggcagttctgaaggtgcgtctgcaagaggcagaccaactcctcagcacacggaccgaagcactggaagccctgcaaagcgagaagtccaggattatgcaagatcagtcagagggaaattcactccagaatcaggccctgcagacgttccaggagcggctccacgaagccgatgccaccctgaaacgggagcaggaatcttataaacagatgcagagtgagtttgccgcccgcctcaacaaggtcgaaatggaaagacaaaacctggctgaggctataaccctggcagagagaaagtactcggatgaaaaaaagcgcgtggacgaactgcagcagcaggtcaagctctataagctgaaccttgagtcatccaagcaggaactgatcgattacaagcagaaggctacccgcattcttcaaagcaaagagaagctgatcaacagcctgaaagaaggatccggcttcgaggggctggactcatcaacggccagcagcatggagctcgaggaactgagacatgaaaaggagatgcagagagaggagatccagaagctgatgggtcagattcatcagctccgatcggagctacaggatatggaagcccaacaggtgaatgaggctgaatccgcccgcgaacagttgcaagacttgcacgaccagatcgccggccagaaagccagcaagcaggagttagagactgagctcgagaggttgaaacaagaatttcattatatcgaagaagatctatatagaacgaagaacacgctccagagccgaatcaaagatcgagacgaagaaatccagaagctccgcaaccaacttaccaataagaccttaagtaactcgtcgcagagcgagttagaaaatagactccatcagttgacggagactctcattcagaaacaaaccatgctcgagtccctgtctacagagaagaactcccttgtttttcaactggagcggttggagcagcagatgaactctgcatctggaagcagtagcaacggcagtagcatcaatatgtcaggcatcgacaatggcgaggggacacggctgcgcaatgtgcctgtgcttttcaacgacaccgagactaatcttgcgggcatgtatgggaaggtaaggaaagccgcgagctcaatcgatcagtttagactgtgtttcacctccggctcttag

SEQ ID NO: 189755 - DNA, 1923 bp, Artificial Sequence
  Description of Artificial Sequence: Synthetic coding sequence
atgagctggttcgtggacctggccggcaaggccgaggacctgctgaaccgtgtggaccagggtgccgctacagccctgagccgaaaagataacgcttccaatatctactcaaagaataccgattatacggaactccaccaacaaaatacagatctcatttatcagaccggcccaaaaagcacctatatatcctcagccgccgataatatccgcaaccagaaggcaaccataaagactattgaggaaaactcattcggatctcaaacgcacgaagctgcttctaatagcgactctagccacgaagggcaggaggagagttccaaagagaatgtgagcagcaacgccgcctgtcccgaccatactcccactccaaatgacgatggcaagtcccacgaactctcaaatctgagactcgagaaccagttgctgcgtaatgaagtacagagtttgaatcaggaaatggctagtctgctgcagcgttctaaagagactcaggaagaactcaacaaggcccgtgcacgcgtggagaagtggaacgctgaccattctaagagtgacaggatgacacgggggctgcgggcccaagtggatgacctgaccgaggccgtggcagctaaagatagtcagctcgccgtgctcaaagtcaggcttcaggaagcggaccaattactctccactcgcactgaggctctggaagccctgcagagcgaaaagagccgcatcatgcaggaccagtccgaagggaatagcctccagaatcaggcgctccagaccttccaggagcgattgcacgaagcagacgccaccttaaagcgagagcaggaatcctacaagcaaatgcagtcagagtttgctgcgagactgaataaggttgaaatggaaagacagaatctggctgaggccatcacgctcgctgagcgtaaatattctgatgagaagaagcgagtggacgagctccagcagcaagtgaaactctataaactgaacctggaaagcagcaaacaggagctcattgattataagcaaaaggcgactaggatcctgcaaagcaaggagaaactgattaattccctgaaggaagggtcaggatttgaaggcctggactcttctactgccagttctatggagctcgaagagctccggcatgagaaggagatgcagcgggaagagatacagaagctgatgggccagatacaccagctgcggagtgagttacaggatatggaagcgcagcaggtcaatgaggctgagtcagctcgggaacaactgcaggacctgcatgatcagatcgcaggccagaaggcttccaagcaggagctggaaaccgagctagaacgccttaaacaggaattccactacatcgaggaggacctctaccggaccaagaacaccttacagtcccggataaaggaccgtgatgaagaaattcagaagctgagaaatcaattgaccaataaaaccctatccaattcttcccaaagtgaactggagaatcgactgcatcagctcaccgaaaccctaatccagaaacagacaatgcttgagtctctctccacagaaaaaaattctttagtgttccagctggagcgcctcgagcaacagatgaattccgcctccggcagcagctcaaatggctctagtatcaacatgtctggaattgataacggcgaggggacgaggctgcgcaatgttccagtactatttaatgacacggagaccaacttagcgggtatgtatggcaaggtgcggaaagctgcctcatcgatcgaccagttttctatcaggctcggcatttttctgagaaggtaccctatagccagggttttcgtgataatttatatggccctgcttcatctgtgggtgatgatcgtcctgctgacatatactccagagatgcatcatgaccagccctacggtaagtag

SEQ ID NO: 189756 - DNA, 504 bp, Artificial Sequence
  Description of Artificial Sequence: Synthetic coding sequence
atggccaccgaggtgcacaacctgcaggagctgcggcggagcgcctccctcgccactaaagtgttcatccagagagactactctgacggcacaatctgccagtttcagacgaagtttccacccgaactggactcgcgcatcgaaaggcaactgtttgaggaaaccgtcaagacgcttaatgggttctacgccgaggccgaaaagatcggggggagctcctatcttgagggctgtcttgcctgtgccacagcatacttcatctttttatgcatggaaacacactacgagaaagtgctgaagaaaataagccgctacatccaggaacagaatgagaagattttcgctccaagggggcttctgctgacagatcctgtcgagcgtggtatgcgcgtcatcgagatctcgatctacgaggatcggtgcagctccgggagttcctcctcaggttctagctccgggagtggctcttcatccggtggaggggggggagctggagcccggtag

SEQ ID NO: 189757 - DNA, 1812 bp, Artificial Sequence
  Description of Artificial Sequence: Synthetic coding sequence
atggccgaggagaccggccagagcaagctggccgccgccaagaagaaatttaaagagtattggcagagaaatcgccctggagtaccagctgcggcgaaacggaatacaaaggcaaacggcagctctcctgaaacggccgcatctggagggtgccattccagcgaagcatcctcttccgccagctcatctctgcacgcccgccagtcgccctgccaggaacaggcagccgttttgaactctcggagcatcaaaatctctagactgaatgacaccatcaagagcctcaaacagcagaaaaaacaagtggaacatcagctggaagaagaaaagaaagccaacaatgagaaacagaaggctgaaagggaactggaaggtcagattcagcgacttaatactgagaaaaagaagctgaatacagatctgtaccacatgaagcactccctacggtattttgaagaggaatctaaggatctggcagggcgcctgcagaggtctagccagcggatcggcgaacttgaatggagcctatgtgcagtggcggccactcagaaaaagaaacccgacggtttttcatccagatccaaagcactcctgaaacgtcagctcgaacaaagcattagggagcagatcctgttaaagggccacgtcacgcagctgaaggagtctctgaaagaagttcagctggagcgggaccaatacgccgaacagattaagggcgaaagggctcagtggcagcagaggatgcggaagatgagccaggaagtctgtacccttaaggaagagaagaagcacgacactcatcgcgtggaagagctcgagagaagcctgtctagactgaagaaccaaatggcagagcccctcccaccagacgctcctgccgtgagcagtgaggtggaactgcaggatctcaggaaagagctggagcgggtcgcaggcgagctgcaggcgcaggttgaaaacaaccagtgcatatcgctgctgaaccgcgggcagaaggagcgcttgcgcgagcaggaggaacgcctacaagaacagcaagagcggcttcgggagcgcgaaaaaaggctgcagcagctggctgaacctcaaagcgatttggaagaactcaagcatgaaaataaatctgccctgcagttggagcaacaagtgaaagaactccaagagaagctgggccaggtgatggagaccttgacaagcgcggagaaagaacctgaggccgccgtgcctgctagcggcaccggcggggagagcagtggccttatggacctgttggaggagaaggccgacctcagggagcatgtagagaagttagagctaggctttatccagtaccggcgcgagcggtgccatcagaaagttcataggctgctcaccgagcccggtgactccgccaaagatgccagccccggaggggggcatcatcaagccggcccaggtcaggggggagaagagggagaagccgctggcgccgcaggggacggtgttgccgcttgtgggagctacagcgagggacatggaaagttcctggccgcggctcggaatcccgccgcggagcctagccccggtgcacccgctccccaggagctaggggctgcagacaaacacggcgacttatgcgaggcaagtcttacaaattccgtggagcctgcacagggagaagcccgagagggttcctctcaggataaccctacagcccaacccgttctgcagctgctgggcgagatgcaggatcatcaggagcaccctggcttaggcagcaactgttgtgtgccgtgcttctgttgggcttggttaccccggaggagacggtag

SEQ ID NO: 189758 - DNA, 1485 bp, Artificial Sequence
  Description of Artificial Sequence: Synthetic coding sequence
gagaagaaggccaacaacgagaagcagaaggccgagcgggagctggaaggccaaattcagagattaaatacagagaaaaagaagctcaacaccgatctgtaccacatgaagcactctctgcgctattttgaggaagaatcaaaagatctggccgggagacttcagcgcagctcacagagaattggagagcttgagtggtccctgtgcgctgttgcagcaactcagaagaaaaagccagatggattctcttcacgcagtaaagccctgctgaaacgccagttagagcaatcaattagggagcagatcttgctcaagggccacgtgacccagttgaaggaaagccttaaggaggttcagctggagcgagaccagtatgccgagcaaattaaaggtgagagggcccagtggcagcagaggatgcggaagatgtcccaggaggtctgcaccctgaaagaagaaaaaaagcacgacactcaccgtgtggaagagcttgagcgtagtcttagtaggctcaagaatcagatggccgagccgttgcccccggacgctccagctgtgagttccgaggtggagttacaggatttgcgaaaagaattagaacgcgttgccggtgaattacaggcacaagtcgagaacaatcaatgtatttccttgctgaatcgcgggcagaaggagagactgcgcgagcaggaagagcggttacaggagcagcaggaaaggctgcgcgagcgagaaaagcggctgcagcaattggccgagccacagagtgaccttgaagaactgcacgagaataagtcggcccttcagcttgaacaacaagtgaaggaactccaggagaaactcggtcaggttatggagacacttacatcagcagaaaaagagcccgaggctgcggtgcccgccagcggcactggcggtgaaagcagcggcttaatggacctcttggaagaaaaggccgacctgagggagcatgtggaaaaactggaacttgggtttatccaatatcgcagggagaggtgccaccaaaaggtacacagactgctgactgagcctggggatagcgccaaagacgcgagcccgggaggggggcatcaccaggccggacccggccagggaggagaagaaggggaagccgcaggggccgcaggggacggcgtggctgcatgcggctcttatagtgagggacacggaaaatttctggccgctgcccgcaatcctgccgcagaacccagtcctggagcacctgcgccacaggaactgggtgccgcagataagcatggagacctctgtgaggcatcgttaactaactctgtggagccggctcagggcgaggccagagagggaagcagccaggacaatccgaccgcacagcctgtgctccagcttctaggcgagatgcaggatcatcaggaacacccagggctgggatcgaactgctgtgttccttgtttttgctgggcatggctccccagaagaaggcgatag

SEQ ID NO: 189759 - DNA, 1812 bp, Artificial Sequence
  Description of Artificial Sequence: Synthetic coding sequence
atggccgaggagaccggccagagcaagctggccgccgccaagaagaagttcaaggagtactggcagcgaaaccggcccggcgttcccgcagcagccaagcgcaacacaaaggcaaacgggagctctcctgaaactgctgcctctgggggctgtcatagtagcgaggcttcaagcagcgccagcagcagtttgcatgctcgacagtcaccgtgccaggagcaggcagccgttcttaattcacggtccattaaaatctctcggctgaatgacacaattaaaagtctgaaacagcaaaaaaaacaagtcgaacatcagctggaagaggaaaagaaggcaaataatgagaagcagaaggccgagagggaactggagggccagatccagagattaaatactgagaagaaaaagcttaacacagatctttaccacatgaagcacagcctgagatactttgaggaagaatcaaaggaccttgcaggtagactccagcgaagcagtcagcgcatcggcgaactcgaatggagcctgtgcgctgtcgctgcgacccagaaaaaaaaaccagatgggttttcctctcgctcaaaggcgctgctcaaaagacagctggaacagtctattcgcgagcagattctcctcaaggggcacgtcacccagctcaaagagagcctcaaggaagtccaactcgaacgagaccagtacgctgagcaaatcaaaggcgaacgagcgcagtggcagcagagaatgcgtaaaatgtctcaggaggtctgcactttgaaagaagagaaaaaacacgacacacaccgagttgaagagctcgagcgctctctgtctcgattgaagaaccagatggctgagcccctgccgccagacgcccccgctgtgtctagtgaagtcgaattacaggacctgaggaaagaattggagcgtgtggctggtgaattgcaggctcaggtggagaataatcagtgtatcagcctccttaacaggggtcagaaagagagactgagagagcaggaagaacggctgcaggaacaacaagaaagactgagagaaagggaaaagcgcctgcagcagcttgcagaaccacaatcagatctggaagagctgaaacatgaaaataaatctgcactgcagttagagcagcaggtcaaagaattacaggaaaagctaggacaggtgatggagactctcacaagcgccgagaaggaacccgaggctgctgtacccgcctccggtaccgggggcgagagttctggtctcatggacctgttggaagaaaaagccgatctgagagagcacgttgaaaagctagagctgggtttcatccagtatcggcgcgagagatgccatcagaaggtccatcggctcctgaccgaaccaggcgattcagccaaggacgctagtcccggcggcgggcaccatcaggccggccctggccagggcggggaggagggtgaggcggcaggcgccgctggtgatggggtggccgcctgcggttcttattctgaggggcatggaaagttcctcgccgcggctcgtaaccccgccgccgagccctcccctggtgcaccagctcctcaggagcttggagccgcagataaacacggcgacctttgtgaagctagcctcaccaactcagtggaaccagcccagggcgaggcgcgggaaggttcttctcaggacaacccaacggcacagcctgtcctccagctgctcggtgaaatgcaggaccaccaggagcatcctggtctggggagcaattgctgcgtgccttgcttctgttgggcctggctgcctcgccgacgtcggtag

SEQ ID NO: 189760 - DNA, 1902 bp, Artificial Sequence
  Description of Artificial Sequence: Synthetic coding sequence
atgctgcccgtggacggcgaggagcggaagagcgagggcagcgacaccgaaggcgacagaaccagtccttgcgctggaccaacctcatcagccaccctcaaggacctggaagtgggagggtcaggatggagatgtagcgatccggcaggccagcccagcaatctactaccacagagaggccttggcgcacccttgcccgccgaaacggcacacactcagccttcccccaatgaccgaagcctttacctgtcaccgaagtcatcatcagcttcaagctctttgcacgctaggcagtctccatgtcaagaacaggccgcagtgttgaattcgcgatcgataaagatttctcggctgaacgatacaatcaagtcactgaagcagcaaaaaaagcaggtcgagcatcagctggaggaggaaaaaaaggcgaacaatgaaaaacaaaaggcagagagagaactggagggccaaattcagaggctcaacactgaaaagaagaaattaaacactgatttgtatcacatgaagcactctctgcggtacttcgaggaggagagcaaggacctggctggacgcctgcagcgttccagtcagcgcattggtgaactcgagtggagtctgtgtgctgtggctgcgacgcagaaaaagaagcctgacggcttctcaagtcggagtaaagctctcctgaagcggcaactggaacagagtattagagaacaaatcctgctaaagggacacgtgactcaactgaaggaaagcctcaaggaggttcagctagaaagagaccagtacgcagagcaaatcaaaggtgagagggcccagtggcaacagagaatgaggaaaatgtcacaggaagtctgtactctgaaggaggaaaaaaagcatgacacgcatagggtggaagagctggaacgatcactatctagacttaaaaaccagatggccgaacctttacccccggacgcgcctgcagtgtcatctgaagtcgaactccaggatctgagaaaggagctcgagagggtcgccggggaattgcaggcacaggtggaaaacaatcaatgtatcagtctactgaataggggtcaaaaggagcgtttacgggaacaggaggagaggcttcaggaacagcaggagaggctcagggagagggaaaaaaggctccaacaactcgcggagcctcagtctgacctagaggagcttaagcatgagaacaagtctgccttgcagctagaacagcaggtgaaggaattgcaagagaaactcggtcaggtgatggagaccctgacttccgcagagaaagagcccgaggccgcggtacctgcctcaggcactggcggggagtcctctggattaatggatctgctggaagagaaagcagacctaagagagcatgtggagaagctcgagctcggctttatccaatacagaagagaaagatgccaccagaaggtacaccgcctcctgactgaaccaggtgactccgccaaagacgcctcaccaggcgggggacaccatcaggccggccctggacaaggaggcgaggaaggtgaagccgcgggcgccgctggcgacggggttgctgcgtgcgggtcttattcagaggggcacggtaagttcctggctgctgccagaaaccctgctgccgaaccatctccaggagcgcccgcaccccaggaactgggcgctgcagataagcacggggacctttgtgaggcttctcttactaacagtgtggaacccgcccagggtgaggcccgtgaggggtccagccaggataatcctacagcacagccagtccttcagctcctgggagagatgcaggatcaccaggagcatccgggactaggaagtaactgctgtgtgccctgcttctgttgggcgtggctccccaggaggaggagatag

SEQ ID NO: 189761 - DNA, 9780 bp, Artificial Sequence
  Description of Artificial Sequence: Synthetic coding sequence
atgctgagccggctgagcggcctggccaacgtggtgctgcacgagctgagtggcgacgacgatacagatcagaatatgcgggcgcctcttgaccccgaactgcaccaggagtcagacatggagttcaataacacaacgcaggaggatgtccaagagaggctggcctacgcagaacagttggtcgttgagcttaaggatatcatccgccaaaaggatgtgcagctccagcagaaggacgaagcgctgcaggaggagagaaaggcagctgataacaagattaagaagctgaaattgcatgcgaaggccaaactgactagcctgaacaagtacatcgaggagatgaaagcacaggggggaaccgtcctccctacagaacctcagtcagaagaacagctaagtaaacacgacaaatcatcaaccgaggaggagatggagatcgagaagattaaacacaagctccaggagaaagaagaactgatttcaacgctgcaagcacagttaacacaggcccaggcagagcagcccgcacagtcttccactgagatggaagagttcgtcatgatgaaacagcaactgcaggaaaaagaagagtttatttcgactctccaagcacagctctcacagacccaggctgagcaggctgcccagcaagttgtacgtgagaaagatgcaagattcgaaacccaggtccgacttcacgaagatgaattactccagctcgtgacccaagccgacgttgagacagaaatgcagcagaaactgcgcgtgctgcagcgcaaactggaagagcacgaagagtctcttgtgggacgtgcacaggtggtggaccttttgcagcaggagctcaccgccgccgagcagaggaaccagatcctgtcccagcagctgcagcagatggaagccgagcacaacacactgcgcaataccgtagaaacagaacgcgaggagtcaaagatccttctggagaagatggagctggaggttgccgaacgcaaactttcattccataacctgcaggaggagatgcaccatctgcttgagcaattcgagcaagccgggcaggcccaggccgagcttgagagtagatacagcgcactggagcagaaacataaggcagagatggaagagaaaacctctcacattttgagtttgcagaaaaccgggcaggaactgcaatccgcatgtgacgccctgaaagaccagaattctaaactgctccaggacaaaaatgaacaggccgtccagagcgcacaaacaatccaacagctggaggatcagcttcaacagaagtccaaggagatctctcagtttcttaatcggctacccctgcagcagcacgagacagccagccagacaagtttccctgacgtctataacgagggaacccaggcagtaacagaggaaaatatcgccagtctgcaaaaacgggtggtagagttggagaatgaaaagggcgccctcctgctttccagcatcgagctggaggaactcaaggctgagaacgaaaagttaagttcccagattaccctcctagaagctcagaaccggacaggcgaggcagatcgagaagtctccgaaatttcaatcgttgacatcgccaataagagatcctctagcgccgaagagagtggccaagatgtgctggaaaatacattcagccaaaagcacaaagaactgtccgtcctgctgttggagatgaaagaggctcaggaagagatcgcgtttttgaaactgcagctgcagggcaagagggccgaggaagccgaccacgaagtgctagaccagaaggagatgaagcagatggaaggtgagggcattgctcctataaagatgaaggtgtttctggaggacactggtcaggatttccccctcatgcctaatgaagaatcttccctccccgccgtggaaaaagagcaggcctcaaccgagcaccagtcacggacctcagaggaaatatcccttaatgacgccggggtggagttgaaatccactaagcaggacggcgacaagtcgctctctgcagtgccagacataggtcagtgccaccaggatgagcttgagcggctcaagtcgcagatcctggagttggagctcaatttccataaggcccaagaaatatatgagaagaatctggatgaaaaagccaaggaaattagcaatctgaaccagctgatcgaggagtttaagaaaaacgctgacaacaactcttccgcgtttaccgccctgtcagaagagagagatcagctactgtctcaggtcaaagagctgtctatggtgacggaattgcgggcacaggttaaacaattggaaatgaaccttgccgaggctgaacggcagcgccgtctcgattacgagagtcagacagcccatgataatctacttacagagcaaattcatagcttgtccattgaggccaagtcgaaggatgtgaagatcgaagttctgcagaatgagcttgatgatgttcagctgcaatttagcgaacagagtacgctcattagatctctgcaatctcaactacagaataaggaaagtgaggtgctcgagggtgccgagcgtgttaggcacatctccagcaaggtggaggaacttagccaggcactttcccagaaggaattggagatcacaaagatggatcaactcttattggaaaagaagagggacgtggagacgctgcagcagacaatcgaagaaaaggaccagcaggttactgaaatttccttctccatgactgaaaagatggtgcaactcaacgaggaaaagttttcactgggcgtcgaaataaagactctcaaggagcagttaaatctcctctctagggcggaagaggccaagaaagagcaggttgaagaggataacgaggtctcttccggtttaaagcagaattacgacgaaatgagtcccgccggccaaatttcgaaagaggagctgcagcacgagtttgacctgctgaagaaagaaaatgagcagcgaaagcgcaaacttcaggctgctctgattaacagaaaagagctcctacaaagggtctcacgcctggaagaagagctcgcaaatttgaaagatgaatcaaagaaagagatccccctgagcgaaactgaacgcggagaagtagaagaggacaaggagaacaaagaatactcggagaagtgtgtgacaagcaagtgtcaagagatcgagatatacttaaaacagaccatctccgagaaggaagtggagttgcagcatataagaaaggacctagaggagaagctagcagcagaggaacaatttcaggccctggttaaacagatgaatcaaaccctccaggataaaaccaatcaaattgacctgctgcaggctgagattagtgaaaatcaggctatcatccagaagctgattacgtctaacaccgatgcctccgatggcgattcagtggcgctggtgaaggaaacagtggtgatttctcccccatgcaccgggagcagcgaacactggaagcctgagctcgaggagaaaattttggcccttgaaaaagagaaagaacaacttcagaagaagctgcaggaagcactgaccagcaggaaggcgattttgaagaaagcacaggagaaggagcgacatctaagagaggaactgaagcagcagaaggatgactacaacaggctgcaagaacaatttgacgagcagtctaaggagaatgaaaatatcggtgaccagctccggcagctgcaaattcaggtgcgggaaagcatcgatggcaaattgccttccacggaccagcaagaatcttgttcatccacccccgggctggaggagccattatttaaagccactgagcagcaccacacccagccagtgctggaaagtaacctgtgccccgattggccgagtcactctgaggatgccagtgcgctgcaggggggcacttcagtggcccagatcaaagcgcagctgaaagagatcgaggcagaaaaagtggaactggagttgaaggtgtcctccaccaccagcgagctcactaagaaatccgaggaggtgtttcagctccaggagcagatcaacaaacaagggctcgaaatcgagtctctcaaaactgtctcgcacgaggccgaagtgcatgccgagagtttgcaacagaaactcgaatcttctcagctgcagattgccgggctggagcaccttcgcgaacttcagcccaaacttgacgagctgcaaaaactcatctcgaaaaaggaggaggacgtcagctacctctccggacaactgagtgagaaagaggcggccttgacaaaaatccagacggagattattgagcaggaggatctgattaaagccctccatacccagctagagatgcaagccaaggagcacgacgaacggatcaaacaactccaggtggagctgtgcgaaatgaagcagaagcctgaggagatcggagaagagagccgcgcaaagcaacagatccagcgcaaactccaggcagcccttatctcccgaaaagaagctctgaaagagaataagagcctgcaggaggagctctcactggcgagggggactatagaacggctgactaaaagcctggcagacgtcgaatcccaagtcagcgcgcagaataaagaaaaggataccgtactcggacgtcttgctttgctacaggaggaacgagacaaacttatcacagaaatggaccgctctctcctggagaaccaatctctaagtagtagttgtgaaagtctcaaactggctctcgagggactgactgaggataaggagaaactggtcaaggagatcgaaagtctgaagtcatccaagatagccgaatcaactgagtggcaggagaagcataaggagttacagaaggaatatgagattcttcttcagtcatacgagaacgtctctaatgaggccgaacggattcaacatgtcgtcgaagctgtgcggcaggaaaaacaagaactctatggcaagctgagatccacggaggcaaataagaaggagacagagaagcagttgcaggaggcggagcaggagatggaggagatgaaggagaaaatgaggaagttcgcgaaatcgaaacaacaaaagattctggagcttgaggaagagaacgatcgtctaagagcggaagtgcaccccgctggagacacagctaaggagtgtatggagaccctgcttagtagcaacgcttcaatgaaggaggagcttgaacgggtgaagatggagtatgagactctgtccaaaaagtttcaatctctgatgtctgaaaaggacagccttagcgaggaggttcaggatctcaaacaccagattgagggaaatgtctccaaacaagcaaatctcgaggcaactgagaaacatgacaatcagactaatgttaccgaggaaggcacacagagcatacccggcgagaccgaagaacaggacagcctcagtatgtctacaaggcccacatgcagtgagtccgtgccttctgctaaaagcgccaatcctgccgtcagtaaggacttttctagccatgacgagatcaacaattacctgcaacagatcgaccagctgaaagagagaatcgcgggactcgaagaagagaaacagaaaaacaaagagtttagtcagacactcgaaaacgaaaaaaacaccctgctgagccagatttcgaccaaagatggagagcttaaaatgctgcaggaagaagtgaccaagatgaacttactgaaccaacagatccaagaggagctgagccgggtgaccaaactgaaagagacggccgaggaggaaaaagatgatctggaggaacgcttgatgaaccagctggccgaattgaatgggtccatcgggaactattgtcaagacgttactgatgcccagattaagaacgagctcctggaatctgagatgaagaatttaaagaagtgtgtgtctgagctggaggaggaaaagcagcaactggttaaagagaagaccaaggtcgagagcgagatccggaaggagtatctcgaaaagatccagggtgctcagaaagagcccggtaacaagtcccacgccaaagaactgcaggagcttcttaaggagaaacagcaggaagttaaacagctgcagaaagattgtatcaggtatcaagagaagattagcgccctggagagaacggtcaaggctttagaatttgttcagacagaatcacagaaggacctagagattaccaaagagaatctagcacaggccgtcgagcacaggaaaaaagcacaagctgagctcgcatcctttaaagtcctacttgatgacactcaatccgaagccgcacgggtattagctgataatctgaagctcaagaaggaattgcagagcaataaggagtctgtcaaatctcagatgaagcagaaggatgaggacttagaacgccgtctggagcaggcagaagaaaaacatttgaaagaaaagaagaatatgcaggagaagctggatgccctgaggagagagaaggtccacctggaagaaacaataggtgagattcaagtcacactgaacaaaaaggataaggaggtacagcagttacaggaaaacctggacagcacagtcacccagttggctgccttcacaaagagcatgtcctcgctgcaggatgaccgcgatagggtgattgacgaggcaaaaaaatgggagaggaagttctccgatgccattcagtcgaaagaagaggaaattaggctgaaggaggataactgctccgtgcttaaggatcagttaaggcaaatgtctattcacatggaggagctcaagatcaacatctctaggcttgagcacgataaacaaatctgggagagcaaggctcaaactgaggtgcaattgcaacagaaggtttgcgacacccttcagggtgagaacaaagagttgctgtcccagttggaggagacgagacacctctaccactcctcacaaaatgaactagccaagctcgagtcagagttgaaaagtcttaaagatcagctgaccgacctctccaattctctggagaagtgcaaggaacagaaaggtaatctcgagggcatcatcaggcaacaggaagccgacattcaaaactccaagttttcctatgaacagctggagactgacctgcaagcctctagagaacttacatctcgactgcatgaagagattaatatgaaggagcagaaaatcatctcgttactgtctggaaaagaggaagcaattcaggttgcaatcgccgaactgaggcaacaacacgacaaggagatcaaagagctggaaaatcttctctctcaggaggaagaagaaaatattgtacttgaagaagagaataagaaggccgtggataaaaccaaccaactgatggagaccctcaaaactataaagaaagaaaatattcaacagaaggctcagttggacagtttcgtcaaaagcatgagtagcctccagaatgatcgagacaggatcgtaggcgattaccagcagctggaggagagacatctttctataattttagaaaaggaccagctgatccaggaggcagccgctgagaacaacaagctgaaagaggagattcgaggtctgagatcccacatggacgacttaaatagcgaaaatgccaagcttgatgccgagttaattcaatatagggaggacctcaaccaagtaatcactatcaaggactctcagcagaaacaattgctggaagtgcagttacaacagaacaaggagctggaaaataaatatgccaagcttgaggagaagctgaaggaatccgaagaagcaaatgaggacctgcggagatcctttaacgccttgcaggaagaaaaacaggatctttcaaaagagatcgagtccctgaaagtttctatctcccagctaacccgccaggtcacagctctccaggaggaaggcacactgggactataccatgctcagcttaaagtaaaggaggaagaggtgcaccgccttagtgctttgttctccagtagccaaaaaagaatcgccgaattggaagaggagctagtgtgtgttcagaaagaggccgcaaagaaggttggagagatcgaggacaaactcaaaaaggagctgaagcacctgcatcatgacgctggcatcatgaggaatgagacagagaccgcggaggaacgagtggcggagctagcccgggacctggtagagatggaacagaagctactgatggtgacaaaagaaaacaaaggcctcactgctcaaatacagagctttggcaggtctatgtcaagcctgcagaatagtcgagaccatgccaatgaagagttagatgagctgaaaagaaagtatgatgcctccctcaaagagctggctcagctgaaggagcagggcttactgaatcgcgaaagggatgctttactgtccgaaaccgccttttcgatgaactctacagaggagaattcattatctcatctggagaagctgaatcagcagcttttgtcaaaagacgaacaactgttgcatctttcctctcagcttgaggatagttataaccaggtccagagtttctccaaggccatggctagcttacagaatgagcgggaccacctctggaatgagctggaaaagttcaggaaaagcgaggagggaaagcaacgatcggccgctcagcccagcaccagtcctgctgaggtgcagtcactcaaaaaggcaatgtcatcactgcagaatgaccgcgaccggctgctgaaagagcttaagaacctacagcagcagtacctgcagatcaaccaggaaatcacagaactgcatcccctaaaagctcagctacaggagtaccaggacaaaaccaaggcgtttcagattatgcaggaagagttgcgccaagagaacttgtcctggcaacacgagctacaccagctcaggatggagaagtcctcttgggaaatacacgagcggcgtatgaaagagcagtatctcatggctattagtgataaggatcaacaactctcgcacctgcagaacctcattcgggaactaaggtcctctagctctcagacccagcccttgaaagtgcagtatcagcgccaagccagcccagaaacaagcgcttccccggatggcagccagaacctggtctatgaaacagagctgctgcggacccagctgaacgattcgctaaaggagattcatcagaaagaactgcgcattcaacagttaaatagcaatttttcccagctgctcgaagaaaagaatacattgtccattcaactgtgtgataccagccaatcgctgcgggagaaccaacagcactatggtgatctgctgaaccactgtgcagtgctggaaaagcaggtgcaggaactgcaggcaggtccactcaacatagatgtagcccctggagctcctcaggagaaaaacggcgtccatcgcaagtcagatcctgaggagttacgcgagcctcagcagagtttctcagaggcccaacagcaactatgcaatacccgccaggaggtgaacgaactaaggaagttactggaggaagagcgagaccagagagtcgctgccgagaacgcactgagcgtagcagaggaacaaatcaggcgcttggaacattccgagtgggactcctctcgcaccccaatcatcggttcctgcggaacacaggaacaggcattacttatagatctcaccagcaactcctgtcggcgtacacgctccggagttggctggaaaagggtacttcgcagcctgtgccacagtcggaccagagttcccctcctggcagctatatatttcctgatgattcatgttctcctgattctgtgtttcacgggtcatctctag

SEQ ID NO: 189762 - DNA, 2919 bp, Artificial Sequence
  Description of Artificial Sequence: Synthetic coding sequence
atgaaggcccagggcggcaccgtgctgcccaccgagccccagagcgaggagcagctgtcaaagcatgataagagcagtactgaggaggagatggaaatcgagaaaattaaacacaagctgcaagaaaaggaagaactgatatctacccttcaagcgcagctgacccaggcccaggctgaacagcctgcacagaagctgcgggttctgcagcgaaagctggaagagcatgaggagtccctggtgggacgcgcacaggtggtggacctccttcagcaagaactgaccgcagcagagcagcggaatcagatcctcagccagcagctccagcaaatggaagcagagcacaatactctgaggaatacagtagagacagaacgtgaggaatccaagatcctgctcgaaaaaatggagctggaggtggcggaacggaaacttagtttccacaatctgcaggaggagatgcatcatctgcttgagcaattcgaacaggcgggccaggcacaggccgaactggagagccgttatagcgccctcgaacagaagcacaaagccgagatggaagaaaaaacgagccatatcctgtcattgcagaagactggccaggaacttcagtccgcttgcgacgctcttaaagatcagaactccaaattgctgcaggacaagaatgagcaggctgtccaatccgcacagactatacagcaactcgaggaccagctgcagcaaaagtccaaagaaatttcacagtttcttaatcgcctccctcttcaacagcacgaaaccgcctcacaaaccagctttccagatgtgtacaatgagggtacgcaggctgtgaccgaggagaacattgctagcctgcagaagcgagtggtcgagttggaaaatgagaaaggagccctactcctttcatcaatcgaactggaagagctcaaggcggagaacgaaaaacttagcagccaaatcaccctcctcgaagcacaaaatagaactggtgaagccgaccgggaggtttcggagatctccattgtggatatcgccaacaagcgttcaagctctgcagaggagagtgggcaagatgtccttgaaaatactttttcccaaaaacataaggagctctcagtgcttttgcttgagatgaaagaggcccaggaagaaattgcatttctgaagttgcagttacagggcaaaagagctgaagaggccgaccatgaagtgttggaccaaaaggaaatgaaacagatggagggggaaggcatagcccccatcaaaatgaaggtgttcctagaggacactgggcaggacttcccattgatgcccaacgaagagtcctcattaccagcagtggaaaaggaacaggcctcaacggaacaccagagtaggacatccgaagagatctctctgaacgacgccggagtcgagctgaagagtacaaagcaagacggtgacaaatccctctccgctgtgcccgatatcggacagtgccatcaggacgaactggaaagactgaagtcccagattcttgagcttgagctgaattttcacaaggcacaagaaatttacgagaagaatctcgacgagaaagctaaagagatatcaaacctaaatcaactgatcgaagaatttaaaaaaaatgccgacaataatagcagtgcttttaccgctctttcagaggagagagatcagctcctgtcacaggtgaaagagctcagcatggtgaccgagctcagagcacaggtgaagcagctcgagatgaacctggctgaagccgagcgtcagagacgcctagactatgagtctcaaacggcccacgataatctcctgactgaacaaattcattccctcagcatcgaagccaaatctaaagatgtcaaaatcgaagttctgcaaaacgaacttgatgacgtgcaattgcaatttagtgagcagtcaaccctgattaggtcgctccagtcacaactccagaataaggagagcgaagtgcttgagggagctgagcgggtgcggcatattagctctaaggtcgaagaactatcacaggcactttcacagaaggagctcgagatcacgaagatggaccagcttttgttggagaaaaagagggacgtagagaccctgcagcagacaattgaggagaaagatcagcaggtaactgagatctctttttccatgacggaaaagatggtgcagctcaatgaagagaaattctccctgggcgtggaaatcaagaccctaaaagagcagcttaatctgctcagcagggccgaggaggccaaaaaggagcaggtcgaggaggataacgaggtgtcatccgggctaaaacagaattacgatgagatgagtcccgcgggtcagatatctaaagaagaacttcagcacgaattcgaccttcttaagaaggagaatgagcagaggaagcgaaaactccaagccgccctgatcaatagaaaggaactgctccagcgggtaagcaggctggaagaagagttagcaaaccttaaagacgagagtaagaaagaaattccattgtcagagaccgaacgaggcgaagtcgaggaggataaagagaataaagagtatagcgagaaatgtgtaaccagcaagtgtcaggaaatcgagatttacctaaagcagaccatctcagaaaaggaagtggaactgcagcacatcagaaaggatctggaagaaaaattggccgctgaggagcaatttcaggctctcgtcaagcagatgaaccagacgctgcaggacaagactaaccaaattgacctgctacaggctgagatatccgagaatcaggctataatccagaagctgatcacgagcaatactgatgccagcgacggcgattctgtggcactggtcaaggagaccgtggtaatttctccaccatgtaccgggagctcggaacactggaagccttag

SEQ ID NO: 189763 - DNA, 126 bp, Artificial Sequence
  Description of Artificial Sequence: Synthetic coding sequence
atgctgagccggctgagcggcctggccaacgtggtgctgcacgagttgtctggcgatgatgacacagatcagaatatgagagctcctctggatcctgagctacaccaagagtctgatatggagtag

SEQ ID NO: 189764 - DNA, 4923 bp, Artificial Sequence
  Description of Artificial Sequence: Synthetic coding sequence
atgctgagccggctgagcggcctggccaacgtggtgctgcacgagctctcgggagacgacgacacggaccagaatatgagagccccactggaccccgaactgcaccaggagtcagacatggaatttaataacacaacccaagaagacgtgcaggaacgattagcttacgctgagcagctggtcgtagaactcaaggatatcatacgtcagaaggatgtgcaactgcagcagaaagacgaagccctgcaagaggaacgcaaagcagctgacaacaaaattaaaaagctgaaattacacgcaaaagccaaacttacgtctctgaataagtacatagaggagatgaaggcacaaggtggaacagtgctgccaaccgagccacagtcggaagaacagctaagcaagcacgacaaatcctcgaccgaagaagaaatggagatagagaaaattaaacataagttgcaggagaaagaagagttgatcagcacattacaggctcagctgacccaggcccaggctgaacaaccagctcagtccagtactgaaatggaagaattcgtgatgatgaaacaacagctgcaagagaaagaagagtttatatccaccctgcaggctcaactgtctcagactcaggctgaacaggcagctcaaaaactgcgggtactgcagcgtaagctggaagagcacgaagagtccctagttgggagggcccaggtggtcgatctgctgcaacaagaacttaccgccgccgagcaaagaaaccagattctgtctcagcagctgcaacagatggaagccgaacataatacactaagaaacaccgtcgagactgagagggaagagtctaaaatcctcctggagaagatggaattggaggtggctgagcgtaaactgtcctttcataatttgcaagaggagatgcatcacctcctcgagcaattcgagcaggcgggacaggcacaggcagagcttgaaagcaggtactcagctctggagcaaaagcacaaagccgaaatggaagagaagaccagccatatcctgtctctgcagaagacgggccaggaactacagtccgcttgcgatgctctgaaagaccaaaattccaaactgctccaggacaagaacgaacaggccgtgcagtccgcccaaaccatccaacaattggaggaccagctgcagcagaaaagtaaagagatcagccagtttctgaaccgtctaccgctgcagcagcacgagacggcctcacagacatcattcccggatgtttacaacgaagggacacaggctgtaaccgaggagaacattgcatcattgcagaagagagtggttgaactggagaacgagaagggtgctttgctgctcagcagcattgagcttgaggagctgaaagcagaaaatgagaagctgtcatctcagatcacactcttggaggctcagaaccgcaccggcgaggctgatagagaggttagcgagatttccattgtggacatcgccaataagcgctcaagctctgccgaggagagcgggcaggacgtgctggaaaataccttttcacagaagcacaaggaattaagcgtgctgttgctcgaaatgaaggaggctcaggaagagatcgcatttctgaagcttcagctgcagggaaaacgggccgaagaggctgaccacgaagtcctcgatcaaaaggaaatgaagcagatggagggcgaagggatcgcaccaatcaagatgaaagtgtttcttgaggatacaggacaggacttcccactgatgcctaatgaggagagttcactacctgccgtggagaaggagcaggcatctactgaacatcagtctaggacctcggaggaaattagccttaatgacgctggcgtagagctgaagagtacaaagcaggatggggacaaaagtctttccgcggtcccagatatcggacagtgccatcaagacgaactcgagaggctgaaatctcaaatcctggaactggagctaaactttcacaaggctcaggaaatctacgagaaaaacttggacgagaaggccaaagagatctccaaccttaaccagctaattgaagaatttaaaaaaaatgccgataacaacagtagcgcattcaccgcactttctgaggagcgggatcaactactgagtcaagtcaaagagctgtctatggtgaccgagctgcgcgcccaagtcaagcagctcgagatgaacttagccgaagcagagcggcagagacggctagactacgagtcgcagaccgctcacgacaacctcctcacagaacagatccacagcttgagcatcgaggcaaagagcaaggacgtaaagatcgaggtgctccaaaatgagctggatgacgtacagctgcagttcagtgagcagtccacactcatcagaagtctgcagtcccaactccagaataaagaatctgaagttttagaaggcgccgaaagggtaaggcacatatcttctaaggtggaggagctgtcccaggccctcagccagaaagagctcgaaatcacgaagatggaccagcttctgctggaaaaaaagagagacgttgagacactccagcagactatcgaggaaaaagatcagcaggttacagagatcagtttttctatgactgagaaaatggtgcagctcaatgaggaaaagttcagcctgggagttgagattaagacccttaaggaacagttaaatctgctgtctcgtgctgaggaagccaaaaaggagcaggtggaagaagacaatgaggtgagttcaggcctgaagcagaactacgatgagatgtcccccgccgggcaaatttccaaagaggagctgcaacatgaatttgacttgcttaagaaggagaatgaacagcggaagaggaaattgcaagccgccttaatcaatcgaaaggaactccttcagcgagtgtcccggcttgaggaggaactcgcaaatttgaaggatgagagcaaaaaggagatcccgctgtccgagactgaacgaggtgaggtggaggaagacaaagagaacaaggagtactcggagaagtgcgtaaccagcaagtgccaggaaatcgagatttatttaaaacagaccatttccgagaaagaggtagagctgcagcatatacgcaaggacctggaggagaagctggccgcagaggagcagttccaggccttggtcaagcagatgaatcagacgttgcaggacaaaactaaccagattgatttgcttcaggctgaaatttctgagaatcaagctatcattcaaaagctcattacctctaataccgatgcttctgatggtgacagcgtcgcattagtcaaagaaactgtagtgatctcacccccctgcaccgggagctctgagcactggaagccggagctggaggaaaagatcctggctctcgagaaagagaaagaacagttgcagaagaagctgcaagaagccttgacttctcggaaggctatactgaagaaggcacaggagaaggagcgacatctgcgtgaagagctgaaacagcagaaggatgactacaaccggttacaggagcagttcgacgagcagagtaaagaaaatgaaaacataggggaccagctgcgtcagttacaaattcaggtcagagaaagtatcgatggaaagctcccgagtactgatcagcaggagtcatgcagttctaccccagggctggaagagcccttgtttaaagcgaccgagcagcatcacacgcagccagttctggagagcaatctgtgcccggattggccctcccattccgaggacgcctccgccctacagggcgggacgtccgtggcccaaattaaagcccaactgaaagagattgaggccgagaaagtggaactggaactgaaggtatccagcactactagcgaactcaccaagaagagtgaggaagtgttccagctgcaagaacagatcaacaagcaaggactggaaatcgaaagtctcaagaccgtctctcatgaggccgaggtgcacgctgaatctctgcagcagaaactagaatcaagtcagctgcagattgctggtttagagcatctgagagagctgcagcccaagctcgatgagctccagaaattgatcagcaaaaaggaagaagatgttagctatctgagtggccagcttagcgaaaaagaggcagctttaacgaagattcagaccgaaatcatcgaacaagaggatctcatcaaggccctccacacccagctggagatgcaagcaaaagagcatgatgaaagaatcaagcagttacaagtggaattgtgtgagatgaaacagaagcccgaagagatcggagaagagagtagggctaaacaacaaattcaacgaaaactgcaggcagctctgatatctaggaaggaggccctaaaggaaaataagtctctgcaggaagagctaagcctggctcgcggaaccattgaacgtctaacgaagtcacttgcggacgtggaaagccaggtgagcgcccagaacaaggagaaagacactgtgctaggaagattggcgttactgcaggaggagagggataaactcataaccgagatggaccggtctcttctcgaaaatcagagcctgagttctagttgcgagtcactgaaactagctttggaggggctaactgaagataaagagaaacttgtgaaggaaattgaatcactgaaatcctctaagatagccgagtcaacagaatggcaggagaaacacaaggagttgcaaaaggaatatgaaatccttctacagtcttatgagaacgttagtaatgaggccgagcggatccagcatgtggttgaggccgtaagacaggaaaaacaagagctttatggcaagcttagaagtaccgaggcaaacaagaaggagaccgaaaaacaactgcaagaagcggagcaggagatggaagaaatgaaggagtag
